United States Patent 7,494,798 (BACILLUS LICHENIFORMIS CHROMOSOME) - sequence listing, part 2

SEQ ID NO: 1 - DNA, 4222334 bp, Bacillus licheniformis (residues 2,111,168-4,222,334 of 4,222,334)
ggcaggccctgagccgactatcgcgattttcttgccgctccgttttttcggaattcgcggctgaatccatccgttttcaaatcctttgtcaataatcgtccgttcgatccctttgatggatacggccggatcggaaatcgccaccgtacaagagccctcacaaggcgccggacagacccgcccagtgaattcagggaaattgtttgtctttagaaggcggtcaagcgcttctttccaccttcccttgtaaacgaggtcgttccattcagggattaaattgtgaatcggacatcctgacgtataaccgcctatatccatgccgatttggcaaaagggggtgccgcagtccatgcagcgcgctccctgtctttttgatgcttcctcagaaaatggagacgaatattcgttccagtcgtttatccgtgtgagaggatcgcgttcagcaggcttttcccgcttgaattccataaatcctgttgctttgcccattttcccctcccctttcttactgtgccaccgcttcttttgatgaagcagccgcagatggttcaatcttttgtttcgtaccggcttcaaacgcgtacatcaacgcttcttcatcagacaagccggcttctttctgctctttaatccgctctatcatttgcttgaagtctttcggaatcactttcacaaaccgaccgacggcctcttcccaatgatccagtatcgaagctgcttttgagctttcggtatatttgtaatggttttcgatcatcgttttcagttcagcgatttcctcaggtgcttcaagtgtttcaaactcgatcatttcaggattgcatttccgtttaaaggcttttttgtcttcggcgtatacgtaggcgattccgcctgacatgcctgcggcaaagtttttgccgacgtctccgagaatggcgacgcgcccgccggtcatgtattcgcatccatggtcgccgatgccttcaacgacaacgctgactccgctgtttctgacggcaaaccgttcgcccgcgagtccgttaatataagcttctccgcttgtagcgccgtaaaacgcgacgtttccgacaataacattttcacggaatgcagggttgaattcgtcaggcgctttgacggcgatttttccgcctgaaagacctttgccgatgtaatcattggcatctcctgtcaaatacatcgtcattccttttggtacgaacgctccaaagctttgccccgctgaacctgtgaatcggagcgtaatcgtatcttcagggagaccttcttcgccgtagcgcttagaaatttcgcttccggttatggctcctgttacacggttgatgttgcggatttcaaaagacgcttctacaggcgtaccgttttcaacagctgactgcacggccggtaagatttgcgtaacatcgagcgattcatcgattttatggttttgcggcgtacggaatgtacgtgtgccttccggctggtaaagcaggcttgataaatcgagctgacccgctttccaatgcgctttggcccgttcgctgacacgcaggacatccgtgcggcccaccatttcatcaaccgttctgaaaccgagctgggccatcaattcgcgaacttcttctgcgacaaagagcatgtaattcacgatgtgatctggatcgcccatgaactttttgcgaagctcagggttttgcgtcgctaccccgacagggcacgtatccaaatggcaggctctcatcatgacgcagccgagaacaacgagcggtgccgttgcaaaaccgaattcttcggctcctaaaagcgcagccatgacaacgtctctgcccgtcattaattttccgtctgtttccaatacgacgcgttcgcgcaaaccgttcatcatcagtgtttgatgagcttctgcgagtccaagctcccatgggaggccggtatgcttaatacttgttttcggtgatgctccagtgcccccgtcatagccgctgatgacgatgacatcggccgtcgctttggcgactccggctgcaatcgtgcctactccggctttagcgacaagctttacgctgatccgtgcatcgcggttggcgtttttcaaatcatgaatcagctgcgccaaatcttcaatcgagtagatatcgtggtgcggcggcggtgaaatcaagccgaccccaggcgtagatccgcgtacattggcaacccatggatacactttgttgccagggagctgtccgccttcccccggttttgcaccctgcgccatcttaatttgcagctcgtcggcattgacgagatagtggcttttcacaccgaaacggcctgaagcgatttgcttgatcgcgctgcggcggttatcaccattggcgtcaggcgtaaagcgcgccggatcttctccgccttccccgctgttgctttttcctccgagacggttcattgcaatcgccagcgcttcatgggcttccttgcttaaagagccgaatgacatcgcccctgttttaaagcggcgtacaattgattcagcggattcgacttcttcaagcggcagcggcttccggttttcatcaaacgagaagaggttgcggagaaaaccgattctttcttcatcagccgctttcgaatattgtttaaacaggctgtaatcacctttgcggcaggcccattgcagcgtgtgaatcgttttcggattaaaagcgtggtgttccccgccttttctccattgaaaatcgctaccagaatcaagcgtttcactgaatgtatcttcataagcttccctgtggcggcgcttcgcttcttcggcaatcgtgtccaaaccgattccgccgagctgtgaagccgttcctgtgaaatagctgtctatgacgtccttgctgattccgaccgcttcaaaaatctgtgcgcccctgtagctttggactgtggaaatacccatttttgacatcacttttacgacgccttctgtcacgcttttgctgtattttgttacagcttcttcataactgatggagagcgctccgtcttcaatcgcctgcttgtatgtcgcatatgtgaggtacggatgaatggcatccgctccgtagccgatcaaggcggcaaaatgatgaacttcgcgcgcttcacccgattgggcgataatgctgacttttgtgcgctttcctgcacggaccaaatattgatgcaaggcactgacggctagcagcgcaggaatcggcgctttttgaccgtccattttgcggtcggataagataaggagtgtcacgccttcggcgatcgctctgtccgcttctttaaacatatcttcgagtccgctcttcaagtcgtctgtaaagagcgtgtgaatcgtcttgcttttgaaatctttgtgtacaagcccctttaaagaattgaactgcgcgttcgtcaagaccggtgtatacaatttaatccggcggcagctgctttcgttcggatggagaatatcgccttccgctccgagccatgtcaatgtcgatgtgacgatctgctcgcggattgcatcaatcggcggattggtaacctgtgcaaacagctgtttaaaatagttgaacagcgattgcggacggtctgacaacaccgccagcgggacatcgtgacccattgaaccgagcgggtctttgccttctgtaatgacaggaattaaatacttgtgaatatcttcgtacgtaaaaccgaatgctttctggcgggtcagcagatcaggcacagatttttcttcggtttcctcaatgtcgtttgagacatgaaccagttctttactgagccattcctggtacggaaactctccggcgatttcggatttgacttcttcatcggagataatacgtccttcttcaagatcaacaagcagcatttttccgggatccagccggtctttatataaaatgttttcctgttcgacatcaattacgccgacttcggaagaaaaaataaggtagtcgtctttagtgacataatagcgagcgggtctgagtccgttccggtctaaaatggctccgatctgttttccgtttgtaaaagaaatcgcagtcgggccgtcccaaggctccattaaagagctgtgatattcgtaaaatgccttcttttcttttgacatgtacgggttctcgttccacggctccggaatcagcatcattgcagcatgggccggctttcttccagccagtacaaagaattcaaaagcgttatccagtatcgaggagtcgcttccattttcatcgagaatcggcaaaaccttcggcaagtcttcaccgaacgcttcagaaacaaactgctgctccctcgctttcatccagttcatattgccgcgcagcgtattgatttccccgttgtggatcaaataacggttcgggtgcgccctttcccagctcggaaacgtgtttgtgctgaaacgggagtgaaccaaagaaaaagccgagacgaagtcctcgtcttgcaaatcttcatagaaggcatcaacctgctcgggcgttaaaagacctttatatacgatggtattgctcgagaggctgacgaaatagaacgttttctcgtgttcttttgcccaattttcggcctgtttgcgaatgatgtacaacttgcgttcaaatgccaaattgtctttcagcgcttcatttgctccgataaatacctggcggacgactggcgcgctttcttgtgcgactgttccgatttttccgacatttacaggtgcagttcgccagccgagtaccgtctgcccttcctgttcgatcagctcgttaatgcgcgcttcggatttttcgcgcccgctgtcgtctttcgaaaagaagatcatcccgacgccgtagcgtcctttttcaggcaagttgaaatcggcgcagacttttttaaaaaaagcatccggaatctgcatcatgatgcctgccccgtctccggtatgcgggtcactgccctgaccgccccggtggtccaattggcaaagcatttgcaatcctttttggacaatatcatgagtaggaaggcccttcaaatgagcataaagacagattccgcaagcatcatgatcaaattcaggacggtagagaccttgtgcatgtggaaggtgataataagtcaagattcctctcccccgttcagatatcccgttggtccccggtcataaaatctgacaaactataatcgtgtggtaggttttcaaatctatacaaacaatatataatttagattaaaactatctcatttggagattagcaggtgaaacaacgatggaattacgccaattgcattactttatggaagttgcggaaagagagcatgtatcggaagcggccatgcaccttcatgtcgctcagtcggcgatcagcaggcagatcgccaatctagaggaagagctcggcgttgatttgtttgagcgcgaaggccggaatgtgaagctgactccgattgggaggcagtttttagaccatattaaaacggcgatgaaagcgatcgattttgcgaaggaacaaatcgacgagtatttggacccgaatcgcgggaccgttaaaatcggtttcccgacaagccttgcgggccagttcctcccgaccgtcatttccgcttttaaagaggagcatcctaatgtcgcttttcttttaagacagggatcttataaatttttaatcgaagcggtgaaaaacagggatatcgatttggcttttctcggtcccgtcccgtcaaacattgccgagattaaaggagacattttgttttcggagagccttctggcgctcgtgccggtcaatcatccgttgtcaggccagaaaagtcttcatctcggcgatctcagaaatgatcagtatgtgctgtttcctgacgggtacattctccgaaaaatggctgttgacgcatgcaagcaagtcggatatacgcctaaaatttcctcggagggcgaagatttggatgcgatcaaagggcttgtttctgctgatatgggggtgacgcttttgccggaaagcgcctttaatgaaacggcaccccgttttacaaagaagattccgattgattatccgcaggtaaagcgcacggtcgggatcatcacccctaaaaacagggagctttccccttctgcaaaagtcttttatcagttcgtaaagaagtttttttctcgccttcagcaatatcaataacagtcttgcaacgaaatcagccgggcgcaaaagcttggctgattttattttatcataaataaagataaatgtctgaattttctgccctttattgtttgcggccgtgtctcttctattataatgagcgcgtcttacagatgtatgttcatccctgttttatcaaatggtttgcccttctttacattgcgcttaacgcagctcatgaaggtctcctctcttggaacggacatgccgcaccggccgcagccgttgccggccttgggcttgtcaaaacagctgaagcaaaaggcgggttgcatccgcgctgctccgttacaaggacagaaaaggcgatcatcttccgggtttaagcgccgccgcggtgacgaggttttaaaaaagccgccagtcaggcggcttttcttttcattttatttcttgcttttcaggcatatcggcatggattaaataatggatcaacgctttttgctcctgtttggaaaagccgcttttggcgtcgatccaaaattcatgccctttgccggttactctgactgcttttaagtcgggcgattccgaattgcttttgatgaccttctgtcttaagtctctgtcgatcatcgccaataaactgttataagggttcgccggcttacctttgataatcgtctttggtatgcctgtttctttcaatgagctcccaactgcaacccctccgtcgtgcaaataaggagcgcgccagtaaacgccaatcagactcggcactttatacccgcctttggaatcaccctgcgcccacgaaagcttgatctgttcggggtcaaatccggctgtcgggactttcagaacctccggcttgcgcggcagaggcaccggtgtgtcaggcgaatggacaaggcttttcccgaatatgctttctgctttcttaaaagactgcgcccttgtcggctcggtcccgatcgtttcagccgagatgaccttgttgttcgtcaaataccggccggcatgacaggatatgcagcctgcttgttcaaaaacgcgcctgccgcgcctgatggtttggccgtcggttttttgccgcggttcaggcggtctaagtgtattttgccaggcagacacagcgttgttttcttcatttacatttcgtccgggcgagctcacatgcacgccgtcgggcgccgccagagtgattttaggaaagctcggcggcttgaccatttggttgacgcccggtactccgggagtggggtctgcttttttgaaaaacgcggtcggactttccccttttttcggctgatacctgtatgttgaggcgggagccctttgcaggatcgtcccgatataaacatcttcgctcattccgaaaagcgcccggcttgccggagattgtgagaggctgtccgaattttgcgcatgaacattattgctgaacacagtcaagcctttaaacggcccggccattgccacaccgctccagctgtacggatggtcgcccaatgtataggcatctggaatctgcgtgggattgcttttcatatcgatcgttgaatcgaaaaaacctctcggccacttcaggaaaatacgatcgactgcatcttcgaggcggtccggatcggggaggcgttcttttttgccgtttcttgcggtgatcacagggcttttatcattcataaattgtttaatattatgaatttcggcatgtgtaaaatatgcagctgagttcgtcgccagcgccagcatcagccctgtatttaaatctgagtttgtcacgccttccatcaccttcatcgttttcgaatcaactgtggcgtggcaggccgcacagctgatgccggctttgatttttccgtcagcgtatttaaaaggcatgccaaggggcgcgtatgccccttttgcaacatcaatgccggtgtcgatcttctcgccttttttaaaggttttcccgccgaccttaaccgtttccgccaattcgatgcgcaagtttgtcgtccctttccctttcaatccagcaatggctttcgtcatgttggcagctgtaatgggaccgtcaagcagtccgacgatatccgtcaaaaacacctcgtttccgaatgtttccttataaaatgtctcacgtcccaagtcaagaaggcggtcatcaacctttacagctccctcccctgcggacgcgggcttatccggtgtaaatgccccccataaatcgtatccgtgcaatcgtttttcttttgagatgactttttctttaggaggcatataggcatattccggttcaaggtgtctgaccgtgaaatagccaataacggctaaaattgcgatgatagcaattgcggctaaccacttatgtttattcatcattttccctcctttctaattgaataggcttcccaagagctggcgtaattcatttagaacctattaccagctataacttccggcgccccatgccagaatatgcatacaatgggattaaaggaatgaggccattttgaaaaagctaagcattgtacttgtcattttcatatgtgcgctggtttcattcatcatatggctgaatgccggggatgaaaaattggggctctcagatgaagaagcagaggccgtcaaaccctctaaaaaaccggtcattgtcctgatcatcgactctttgatggatcagcctttgaaaaaagcgattcaagaaggccgcgctccggcattaaaattctttcttgaaaacggtcattatgaacctgaagtggcgagcgcgtatccgaccatgtcggtcgcgattgacagcacgctgctcaccggaacttatccgaatatccaccgcgttcccgggcttgtctggtataatcaggctggacagagaattgtgaattacgggagcgataaaaaagaaatcgccgcgctcggcctcaaacaaacgatcgaagacgggatatattctctcaatcaccgccatttaaaccgaaaggtgacaacggtacatgaagatttgcaaaagcaaggaaaacagtcggcatccatcaacgggctcatatacaggggacctgaccgccgcgaattaaacataccgcccccgctcaagaagcttagactgatgcctgaacatatgacggtaaacgggccggctcttttttcgtacggccgctttgcccagcttgatcccgacaactcctaccaccatatttggcagggttatggcgttaacgacaagttcacggcgcaggaaatggcttatttgattaaaaagaggaagcttcctgcgctgactgtcgcctacttgcccgatttcgaccacgatgcacacaaaaaaggcccgaaggatatggaaggcctcgaaaaaatggaccgtcagctgcagcgtatattgaatgcatatgattcttggcgcgatgcggccgaaaaagcggtgtgggtcgtcatgggagacggcggacagacatcgatcggacgcgataaagataaggcagccatccggctccattcgctttttaaaggatatcggatcgctaaaataaacgaaggcccagatcgaaaagaccagcttctttttgcggtaaacgacagaatggcatacatttatgtaacggatcaaaacacgccgctgcaagatgccgtcaatgaattgaaaaaagacggacggatcgctttcacagcgtggaaaaaagacggctggatatacgtcgattcgaagcgttccttaaaaccgctgcggtttcgtccgcaaggcggttatcaagatccttacgggcagtcatggacgatcagcggagatttttccttattggacattaaaacggacggtgcatcgatcatgtatggcgattacccggatgctcttgcccgcctgtacagcgccatgcattcgcatcgcggacggtttgtaattgccgatgcgaaacccggattccaatttgccggagaaaagtctcccctccattttggcggaggcggccatggctcactttataaaacggatagcttggctccgatgatcatcgtcggttccgaagaagttccggctcaccttcgccaccttgaactgaaggattttttaatgaagctcgtacaatgacccggtcatgtcatcaatgatcgggttttttctttttttctaggtttcttctttgacattcttttgttgttctatgtatgataataccgtgttttagtttatttacttaattaattaaaatggagaagcaggtgcttttatgaaacaagataaagtcggccgcgagaccgttgagcagttgatcgaagctttcaacaggctgcgttatgcggaaatgaaacagtcatttccttcagttgaatggaaaaagactgaggcgaaagcgctgatgtttttaaatgaagcaaacggtgaaggaaaaatggcatccgaaatcagccgcgctttgcatgtcacctcccccttcgtcacgcagctgttgaacagaatggaaaaaaaaggactcgttttacggcgcatagatgaggatgacaggcggatcgtccggatttttctaaccgatgaaggaaaaaaagcggctgacgatgcgcttaaaggcctgaaccgatggttcttgcagctctcgcggtttctgggcgaggctgaaagcaggcacttcgccgatctgattcataagctgtccgagtttatcgaacaaggagaaaaaacaagtgaaaagaaggttgaaaaatgatctcactcttaaaatatttaaagccctataagctgcaagtgattctcgtcgctgtttttactttgctgagcagtgtgcttgagctttatttgccgacgttgatggctgatgtcgttgatgtcggaatcgtaaacagtgatatgccatttattttgaaaaccggcggctggatgatcgcctgctcccttctggccatcatgatgactgtcggaaaagcgtttttcgcttcgaaaacagccctcggctttggaagagatatcaggcgcaaactgtttgtcaaagttgaacaccattcaatggatgaattcggaaaaatcagttctgcttctctcattacccgtaccaccaatgatgtcaagcaggtccaagatgtgctcaacatgatgctttcattgatgacgagagcgccgttaatgctggtcggcggtattgtgcttgcggtttccagagatgccaagctgtcgattatatttctggccgctctcccgatacttgcagggctgatttttctcattacaagaaaagctgtccccttattcggcgtcctgcaaaaaaagacggatcgtctcaaccttgttctcagggaaggtttgacgggcgttcgtgtcattcgcgcgtttaaccgcgttgatcaagaaaaagtccggtttcaaaaagcgaacgaagaatttcgcgatacaggcatcgccgtcaacagaatcatggcttttctattccctgtcatgatgattatgatgaatttcacgaacatcgcgattatctggttcggaggcatccgcatcgatcaaggcagcatgcaggtcgggaacttaatggctttccttcaatatgcatcgatgattctaattgcgctgatcatgcttgcgatgacattcgtgatgatcccaagggctcaggcatctgccggccgcattaatgaagtgctgttaacagagccttcgattaccgatccgaaagagccgcagaaagacagcggcttgcgcggttatgttgagtttcagaatgtgacttttcgttatgccggggccgaaaagcccgttctcgaagatatctcgttcaaggcaaagccgggtgagacgactgcgatcatcggcagcacaggagcgggaaaaacgacgattcttcaattgatcccgagatttttcgatattgaaaaaggaactgtgctagtcaacggaacagatgtcagaaagatggcgcaaaaggagcttcgcgcgaaaatcggctatgtcccgcaaaaagcttcaatattcagcgggacgattaaagacaatatccgctttggcaaagaagatgcaacagatgaagaaattctggaagcacttgaaacggcacaggctgccgagtttgtagaaggcaaggaaaacggaattgaatctgaaatcgagcaggccggagccaatctttcaggcggccagaaacagcggctttccatcgccagggcattagtcagaaaaccggaaatttatttatttgacgacagcttttcggcgcttgattacaaaacggatcaaaagctgagaaaagcgctgaagaaaacaaccgctgatgccgccgtcatcatcgttgcccaaagggtaagcacgattacggatgcggatcaaatcatcgttttaaatgaaggaaaaatagccggcatcggcactcatcaacaattgcttgctgaaaacggcatttaccaggaaatcgtcgcatcacagcaggctgaggaggaaagcgcatgagccaacaaccaaagcatcacggctctatacccaaaggaatgcacaagacaaaaccgaaagaatttaaaaagacccttttgagattggcccgctatttaaaaccgcggaccttccagctggtgctcgttgtcttcgctgcaatattggcgacattatttaatgtcatcagtccaaaacttctcggggacgcgacctcttcccttttcgcaagctttaaagaaggcaccggtgttcaattcggctttctcggccggatcacgctgatcctggcaggattgtatctgctttctgctttgtttacgttcttgcagcattacctgatggccggggtagcccagaaaacgatatacgaaatgcgccaggaagtgaatgaaaagctgacgcggctccctttaaagtactatgacaagcattcgcacggcgacacgctcagccgcgccgtcaatgatatcgacaatatcaatacgtcattgcagcaggcgctgacgcaaatgattacgtctgtcattacaatagtcggaatcatcgtcatgatgcttttgatcagccctgtgctgacgctcgtcgtcttcatcacggtcccgctcagcatgctggccgtccgattcattgcctcattttcgcagaaacacttcgccgcgcagcaaaaagaactcggcgacatcaacggacacgttgaagaaatgtttacggggcatcaggaagtaaaggcattcgggcatgaagaaaaagcgattcagcaattcgatgaagtaaatgagcgtctttaccagtcaggctggaaagcgcagtttatttccggtctgatgatgccgatgatgacattcatcggcaacctcggctatgtgtttgtcagcataaccggcggtattttcgttcttaacggcacccttttgatcggaggcgtgcaggcttttatccaatatacgcagcaattttcccagccgctcgttcaagctgccggaatcgcgaatacaatccaatcggcaatcgcatccgccgaaagggtgttcagtcttttggacgaagaagaagaaaccggggagacgccggcttccatcgataccggcaaattaaaaggcgatgtatcgtttgaacatgtcgccttcggttatgataaaaacgttccggtcatccgcgacttaagccttcacgccaaagaaggccagacgattgcgatcgtcggaccgaccggcgctggaaaaacgacgatcatcaatttgctgatgcgtttttatgaactaaacaaaggcagcatcaaggtcggcggcacagatatcagcgagctgtcgcgcgaacaggcgagaagcatgtttgcgatggtgttacaggacacatggctgttcaacggcaccatccgggaaaacatcgcttacgggcgtgaaggcgcgaccgaagaagacatcatcagagcggcaaaaggcgcctatgccgacgattttatccgcaccttgccggacggctatgatacggtacttggcgaagatgcccaaaacatctcgcaagggcaacggcagctcttaacgatcgcgagagccattttagctgatccgaagattttaatattagatgaagcgacaagcagtgtcgacacccggacggaaatgaatattcaaaaagcgatgaacaaactgatggccaaccgtacgagctttgttatcgcccaccgtctttctaccattaaagatgccgacatgattcttgtgatgaaaaacggagatattattgaaaaaggcagccacgaagagctgctccgcaagaacggattttatgccgatttgtataacagccagttctcccgggaagaagccgtcagctaacattgaggccgcacctgatcaggtgcggcctcttttttcatccatctctttagctgatattcccgcttttttaagcatacctcgccttttttccttttttagatccgatactttcggccaattgacaattttttcattgtatgtccgttgaaaccgttataaaaatagtgataacgttaagattgaaccggctcataaagtataaacgtttcatttaaaggagagagttgactgtggcaaattcaaattcacttcaatcaagcaagcattatgccaattggattccgatgaaagaaatcagctcgagtaatgaccggctgtttccgtttccgatttataaccggatcagaaagacgtctcctgtgcgttacgatgatgagcgaaaatgctttgatatcttttcttatgaagacgttcaattcgtgttaaaaaacccgaagctcttctcttcaaaacgcggcggtaatatggaaggaaaaagtatattaacaatggacccgccgagacacacaaaaatgagagccatcgttaataaagcttttacgccgaaagcggtgaaagagcttgaaccgcatatcgaagaagtgacggcttttttatttaacgaagcgaaacagaaagaattgtttgatgtggtggacgacttggctgctcctcttcccgtcattatcatcgctgaacttttaggcgttccggctgaagaccgcctcatgtttaaacattattcagacatccttgtcgcaggtgcggaagaccgctcggctgaagccgccgaacggatgtacaaacgacgtgaagaaggcaatcggtttttggcggattattttaaaaacattatcaagcagcgcaaaaaagagccaaaagacgacctgatttcgcttttactgcgggcggaagttgacggcaaatcgctgacagaagaagaactgcttcatttttgcatcattcttttggtcgcaggcaatgagacgacaaccaacttgatcgcaaacagcgtccgctatctcacagaagataaaatcacacaggaagccgtaagacaagatccgtccctcgtccctgtctttgttgaagaaatgctgcgttattatccgcccgtgcaagcgatcggccgcacggcggcagaagacgttgatatcggaggcgtgaggattgcaaagggttctacagtgatcagctgggtcgcttcagcgaatcgtgacgaacttaagtttgacgatcctgacagcttcaagcttgatcgcaaatcaaaccctcatatgagcttcggcttcggcatccatttttgcctcggcgctcccctcgcccggcttgaagcgaaagtcgcgctcgattacttgctgcggcgcgcatacatggaaagggacagctctaaggagcttgaagcgattcaaagtccgtttgttttcggcgtccgccatctccccgtacaactttcacaaaaatagcgcgaaaaaaaaggacaggctgttacaaacctgtcctttccctgctgtttaaggatttgtagaccacatgccggctgatttaatgaaaatgcgcggatgcagtttgagctgggcaaccatgtattccgccagatcttcaggctgcatgacgcgttccggattgccgtctgtcaattttgagtcgattgccaaatccgtcgcaaccgtgcttggtgtaagggcgctcacgcggatattgtgctttctgacttcctgcatcagcgattcggtcagcccgagcacagcgaacttagacgcactgtaggcgcttgtgccggctgctcccctttggccggctgtagaagaaatattaatgatatcgccggcttttctttcaatcatttcaggcagaacggcgcgtgttacattgtaaacccccatcagattaacctggataatattttcccattcttcgggagattgctcaagaaatcctgcaaacccgccgatcccggcattgttaatgagaatatcgatttgtccaagctcttctttgacggattggactgcacgttctacagctgttaaatcctttacgtcagctgcggctacagatacttttacaccgaacgccttcaattcctctgccgctttttcaagattcgcagctgtacggccgataaggccgatatgtacgccttcttttgcgagggcaatcgctgtggcgcggccgattcctcttccccctcctgtaatcagagcggttttgttttgtaaggattgcatatgaaaaacttcctttctattatgtatagcacgttttaaattataggaaaataaaatacgcttttgcaaatattacgacttgcgaagaatgaatggccggtgcagctggcactaatccgcaggacgcatgaattcaattgcccctaagttatgtcgaatagcaaacttttccggccgacatcgaggttttttctgctcgcacgaggaaaagaaaaaagaacctggtaataacatccaggttcttttggtattgcacaaaaacagacgcgatgatataatcaaatcacgcatgttttcaattaaacgacataaatatcccatcttacattttaagtctaccatattaaaaagctcttgtcaaatttttttcggaggagagatgcagaatgagtcatttggttctcggttttcacgaaatggaaaaaacacagcttccactcgttgggggaaaaggattgcatttaggggaattatcaaaaatcaagggatacaagtgccagacggattttgtgtcacaacagcaggatttcaaaaagccatcaaacaaaacaaatcgttccaagccttgttggatcaactgacaatgcttaaagttgaggatcgagatcaaatcggtgaaatcagcaggaagattcgacataccattatggaaatcgaaattccttccaatgttgtgaaagaagtggctcgctatctctccctgcttggcgatgaacatgcttatgctgtgcgttccagcgcgacagctgaagatttgccgcacgcctcttttgccggtcaacaagacacttatttaaatatcatcggaaaagatgcgatcttgcagcatatcagcaaatgttgggcttctctatttacggatcgagcggtcatctaccgcatgcaaaatggatttgaccatcgtcaagtttattcatccgttatcattcaaagaatggttttcccgcaggcttcagggatattatttaccgctgatcccattacttcaaaccgaaaactgctatccatcgatgccggttttggtcttggggaagcactggtctccggcttggtctctgccgattgttataaagtgcaaaacgggcaaatcgtcgataagagaatagcagccaagaaattggcgatttatgggcgaaaacaaggcggaacagagacaaagcggattacgcctgatcagcaaaagacgcaagcccttactgacgggcaaattttacaactggcacacatcggaagacagatcgaagcacatttcggccagccgcaagatatcgaatggtgtttggaccgcgatacattttatattgtccagagccggccgatcactactttatacccgatccctgaagcgaatgatcaagaaaatcacgtctatctatctgtcggtcatcagcaaatgatgacggatcccataaaaccactgggattgtctttttacctgttcattactccagcacctatgcgcaaggccggcgggaggttgtttgttgatgttgcgcctaggcttactacacgtatcggccgggaaactttattaaataccgtaggatccgatccgctcataaaaggcgcactcatgaccgtaatagagcgagattatataaaattgtcaccaaatgatcaaacagcaccgattcctgacagagggaatacggatatgctggcgcaattcgagaacgatccgacaatcgtttctgatttgattaagcgcagtgaaacatcgatagaagagttaaaacaaaatatccaagcgaaatcgggatcggatttgtttgattttattctggaagatatccggcaattaaagaagatattatttgacccgcaaagtacggcagtgtttatggctgctataaatgctacatcatggatcaatgaaaacatgaacgagtggttaggcgaaaaaaacgcagcagatactctttctctatctgtaccgggtaatattacttcggaaatgggtctggcgctaatggatgtcgcggatgtgattcgcccttatccagaagtgattgattatttgcagcatgcaaaagatgataactttttggatgagctggtgaaggttgatggcggacaggaagctaggggcgccatctatgcttatcttgacaaatacggaatgcgctgtgccggagaaatcgatattacaagagctcgttggagtgaaaaaccaatgacacttgttcccatgattctgaataacatgaagaactttgagcctaatgccggcaatcgaaagtttgagcaagggcggcgtgttgctttggaaaaagaacaagagttaatagagcgattgaagccattacgggatggtgaacaaaaagccaaagaaacaaaacgaatgatcgacctcatccggaatttcatcggctaccgggaatatccaaaatacggaatggtcagccgcttcttcatttataagcaggctttactgaaagaagccgatcaactcgtacaagcgggcgttattcatgaaaaggaagatatatactacctcacttttgaagaatttcacgaagccgttcgcacaaaaaaaatagatgacaagatcatcagcatacgaaaagacgagtacaaattatatgaaaaactaaccccgccacgtgtgatcacgtctgatggtgaaatcattacaggtgattacaaacgagaaagtttgccggcgaatgcgattgtaggtctacctgtttcttccggagtgatagaaggaagagcgcgtgtcattttaaacatggaaaatgccgatctggaagacggagatatattagtcacctcctttaccgatcctggctggacaccattatttgtatccataaaaagcctggtcactgaagttggcggactgatgacccatggagcagttatcgcacgcgaatatggcctgccggcagtggtcggagtggagaatgctacccaactgataaaagatgggcagcgaattcgcgtgcacggcacagaagggtatatcgaattattgtaatgctggctgctgcccaaaaaacgggagtcggcaatgcatgaaaagaactcttcagatttggagagttcttacctttttatccatcaggggaaggattcgggcatgattcttttcagtcagaacatccgccggcgaaacaggtgaaatatacctgtaataacggaatggctcgccgaaaggatcaccaacccctccctccccccccttttcttcatggcgcttccctgccatttcataatcatccatacgttaacttcaaaagatgaacctgacaattttattgtaaatatgggtgaaaccgagtatactcatatagttgccaatcatgaagaaaaacgatgaacggcggtggagacacgttattatataagatgaaaaacgaaaaaagcaaattaggaccccggagattcggagtcctacatatcatttgttgtcatgtttttgggtaaattgtattacaggaggtttgatatggagaaaaatttaaattccaaagcaatattagtcaccttcatgattggtgcattttttgcaatattaaacgaaacgctgttgaacatagcattaacagagctgatggaagtctttcacgttgatgccccgaccgttcaatggctggcaaccggatttatgcttgtaatgggtgtgttaatgcctatttccgctttactgattcaatggttcacgacaagacagatgtttatcggcgttatgtcgatttttttagcaggaaccgtcattgccgcttgtgcagtgaatttcccgatgctcttgacggggcgcatgattcaggcagtcggtacgggactcttgatccccattattatgaacgccctcttgctgatttaccggcctgaagtccgcgggaaaatcatggggacgttcggactggtcatcatgtttgctccggcgatcggacccactttttcgggcgttattgttgacatcctcggctggcgctggctgtttatcatcgttattccttttgcagtattttcaattctgtttgcggtaaagtatttgcaaaatgtcggagaaccgacgcgcccgcgggctgattttttatcgatcatactctcaaccatcgggatcggcggaatcgtatacggattcagcagtgccggagaggctcaggaagggtttcagtcccctctgatcatcggtgtgatcatcatcagcctgatcagcatcgtgttgttcgtgcttcggcagttgaaacttgaacaaccgttgcttgatgtgcgtgtgttcgcctataaaaattacacgcgcggggtctgcctttttgtgattgtcattatggcgatgttcgcttccgaaattgtgatgccgatgtatttgcaagggccgctcggtttttcagcaaaagcagcaggtcttttgcttttgcccggagccttgctaaacggtctcatgtcgccggctatgggcgctttgttcgataagttcggcccgagaaaactcatcattccaggtacgatcgttctcgtcggcgtgatgtttttcttcagcaggatcaatccttcggtgccgatttgggcgttcattattgtatacatcatcttgatgctgtccatctcggccatcatgatgcccgcacagacgaatgcattaaacgaattgccgaagcatttatatcctcatggaacggcaatttccaatactcttcagcctgttgcaggcgcactcggtgtttcggtgttcgtcagcatcatgagccagggacagaaaagctatcttgccggccaagaagcagccagcaaacaaatcgtgcatgaagcgatgactcatggtgttcaccatgcctactggtttgcgctcgctttaagctgtatcgctttctttaccgctttatttattaaaaaagcggtcgcgcctgattttgataaagaataaccaaaaacttaaaggatgtccttcctcggggcatccttttttatcattttttctgccgggattcttccgctcttattttcagaattgacgacattttgtgatataatgctagaatcatattcattttatcggaaaggaacggattccatggagtcatatgttgatcaaaaagacgggattttcaaatccgtatgttcgctcgactgcccggatcaatgcgggctgctcgttcataaaaaagacggaaaaatcgttaaaatacagggcgacccggaccatccggtcacacagggcaatatttgcaataaagtccgcaatatgacggagcgtatttatgaccccaaacggctgaaaaccccgctgaaacggacgggtccaaaaggagccgggatgtttgaaccgatcagctgggatgaagcgattgaaacgattcgcacccgctggcagtcgctcattgaacaggaaggccccgaaagcattctgccctacagcttttacggaaatatgggaaacttgacggctgaaggaatggacaggcgctttttccaccgcctcggttccagccagcttgaccgggcgatttgcacccctgccggttctgtcggctataaatacacgatgggcggaagcatcggcaccgatcctgaagatacaacggagacaaaactgtttattttttggggaatcaacgcggtctcaaccaacatgcatcaaatcaccattgctcaaaaagcccggaaaaacggcgcaaaaatcgtcgtaatcgatgttcataaaaatcagaccggccggatggccgactggtttattccgattcgccccggcacagacagcgcgcttgcgcttggcatcatgcatgttttattcaaggaacatttggctgatgaatcatttttgaaagaatttacagtcggccacgaagagctgcgccgccacgtgcggcaatacgaccccgccgcagtagaggcggtcaccggcgtatcccggaatgatattatcgagcttgcccgcctgtacggccgcacctccccttcattgattcggatcggcaacggtcttcagcatcatgataatggaggaatgatcgttcgcaccatctcgtgcctgcccgcgatcacgggccaatggacgaaaaaaggaggcggagcgatcaaaggcaacacggcatttttggcctataatacaaaagcattgcagcgccccgatttattaaaaggcagaacgccgagagtcatcaacatgaatcagctcggcaaagctctcttagaaaccgaaccaccgatccgttcgctgtttgtgtacagcagcaatccggccgttgtcgcgcctgaggcgaacaaagtcagaaaaggacttgagcgcgaagatttattcacggttgttcacgatctatttctgacggaaacggcacggtacgccgatatcgtcctgccggcttcttccgctttcgaaaatacggatttctatacatcatattggcaccattatgcgcagattcagaagcctgtgattgagaaatacggcgagagcaagtcaaatacagaagtattcaggcttttggctgaggcgatgggctttgatgatgagccgctgaaagattccgacgaagagatgatcagacaggcgcttgactaccctgataatccgtggctcgatggcattgactatgacagcctgactgaaaagcattttgtcaaagcaaatcgaaaaacggtttttcctgataaactgccgacgcctagcggaaaaattgaattgtattcaaaaatgatggagcagcacggctatccgggcctgccgactcataccccgctcattgaaacggacaagtatccatttttatttgtgcccggcccgaatcacaattttttaaattcgaccttttcaaacaatgaaaaacatatcaaattagaaaaggagccgaaacttcacttaaatataaaagatgccgaagaaaagggcatcgaaaatggagatttggtgaaagtttggaatgaccgcggctcatgcatcctgcccgctgccgtcggagaaaacgtccttccgggcgtggccgtcagccagggattgtgggcggatgcagaagggaagcattatctcgtcaatgcgctgacgcccgaccgtttagctgatatgggcggtggtgcaactttcttttcaggaagagttcaaattgaaaaaatatgaacatcaaaaaagaccggttgcagcaaaaccggtcttttatcacttcgtcttttttaaggttttggcataatcggcggcaaacgccgtgctgtttttcaaaaacttgataatggtttgcagttcttcctctgaatatcggcttagaaattcggcagactcttgcgccaagtcatgaaatatatgtgatatcgtctccagattttccgggatcagttcgactaaaagacgccttctgtcggacgaatccctgatgcgtctgacatagcccgctttctcaagacggtcgatcactcctgtgatcgctcccgttgtcagtccgctttttgcggcgagctcccccgctgttacttgaccttcccgcgagatgatctcaaggcatttatgatccgttccgttcagtccgattttctcgccgatcgcctggtgcagaaaaacggttgctgtgctgtgaaacctcaactgctgtatcagctcgttgaccagcccttttccttcaatatgatttgttcttgacatctgtaacacccttctataaaatcattatgtcttagcagctaagatatttatttcctgatataaatcatcataacaggatgaagcgtcgatgccaaacgctgctttagaacgaatttatttaaaggagaatagattgatttgtcacaaactcaaaatcaaaaattaggatttgttgtagcaggacttttgcttgccattctgatggcttcgatggacaataccatcgttgttacggcaatgggaacaattgtcggcgatcttggcggactcgacagctttgtctgggttgtatctgcctttatggtcgctgaaatggccggtatgccgatattcggcaagctgtcggatatgtatggcagaaaacgttttttttctttttggcagcatcgttttcatggcgggatcagcattgtgcggaacggctacaaccattgagcagctcagcatataccgcgcgatccagggaattggcggaggcgcgctcattccgattgcttttacgattatctttgacatttttccgctggaaaagcgcggtaagatcactggacttttcggtgctgtttttggcctttcaagcattttcggaccgctcatcggcgcctatgtcactgactacatcagctggcactggattttttatatgaatctgccgctcggtatggtttcttttattttcattcttctattttacaaagagacgaaacagcatgaaaagcatcgtattgattggctcggagcgattacgctcgtaggggcggtcgtatgcctcatgtttgcgttggagctcggcggcgggaaatacgcctgggattcgaatgtcatccttacccttttcggaagtgcagccgtcttgttggtttgcttcctcatgatcgagcgcaaagccagtgaaccgatcatttcgtttcatatgtttaaaaaccggctgtttgccggcagtacgcttgtcgccttattttatggagggacatttatttcagcgaccatccagattccaatctttgttcagggtgtttacggagattcggcgacaaactcgggacttgtgcttttgccgatgatgctcggctctgtcgtatcagcacagcttggcggattcttaacaacaaaaatgagctatcggaacattatgctcatctctggattggttctcgtcagcggattttctttattaagcacgcttaacattgacactccgcgtttattattaaccatgtatatgatcgtcgtcggcttgggagtcggtttttctttctctgtattaagcatggcagcgatccatcatttcggcccggagcagcgcggctcagcgacatctacgagcaactttatgcgctctctcggcatgacgatcggcgccagtatgttcgggatgattcaaaaaaaccaattttcagaacagctggaagatatgtttaaaagcagcggcgcttcaaatttcgcctcaacgaatgacgccgaccagattttatcaagtgcacgggcatcactgccgccggatgttttacataacatcaccgaagcgctatcaaattcgattgttcacacgttcatttgggcgatttccccagcagcggccgcctttttactggtgttcttcatgccgaatgacagggtgaaagtgaacgcaaaaaaggaagtgaacaaagccggctgaacctctagctttgcactgccttcttttttctcattttcgaaaccaataaaagcggaatcggcacaatgccgaataaaacggccgcaatatagccgatcatgtcgccgagagaaaatacatcatcaatgttttttggcgtcatcgcgagcaaatacatcaccgggagcagaccgaacatgatcggtctgctctttttcttgaaaatttgcgagagccccagggatgcagcgtaatatgagacggaaaaagtcgcaaacagctgcataatccagatgacaaggagcagcgattcaaaacgttcaaatattaagccgggcatttcaaaactgcggatgaggtcaagcgccggccatgtcatcgctgtcaccccgtcaactgacagccctccgatcacaaatacgatcgttgttagataaaagagcattgcgatgccgattcccatgacaacgactttgataccatctttcggctttttcataaacgccaaaaggaataccatcacttctgcgctgataaacgaaagcgttgttgcttttgtcccctttaatgccggcatgatgcctttccctaagacaggccgcaggttatccagttcaaatatgccaaagctcataaataccacggttaaaaagaaaagaattgtaatcggaaagatgatttcaaacaaacgggcaagcgaccccattccgtcttttattgaatagaatccgatccacatcatcgacatgacgatcgcccaaatcggcgtttgctgcagcaaaaaaaaggtgatcacctccgccagaattcttgcttcaaaagcagcaatcgctacaaaatgctcaatgaaaagcaggctgatcacaatactgagccactttccgacaatgtctcccccgtattgaaaaaatgtttgcccgggataatgctggcttaactttgtcataaccactccggctgccgttgtgacaagtccgcctaataggacggaaatccatacatccggcgtaccggcttcttctacagcggttcttggcagggtgagaatcccggccgccataatataactgaccaagacaacgattgcctgagaagtcgtgattttatcttcggaacggatcattgcgcgtttctccgcctttcgtgattagaagttcttctgttactgatccccaacagttccgtattctttaatcgcgatttgaacatgaaatgtaatcggtatatcggtaaaggtctcatcccaatttttctttagtttttcccaaagcctcggatgcttgatcctcagctcgttaccgaatccggcaagatctgctttgtattcggttttcattttttttgtaatgtcctccatcgattttttcaccgttttcgcggttgttttttcgactttttctaaaaatttgtcatcaaaagctttttctttcgtgttccagttttccgcaagatacccctctgactttacgttcacttcaaaagacaggcggtttcctttgacgatgggtttgatgttgcttttaatcgattcaacgccaaatgcggtcaccttcttttctgtcggatcatagcttttaaccatgcccccaatcccctttccgatgatccacatcacgccttctaaatcgtgttcatccaaatagccgatcagcttattggttttcccgttaattgcggctgctcccgcatattttatttctccatcggtaccgatgacattttgaagcagatagcttgttcctgatctcattttgcctgtcaatttggcaagcgttacaggagggagaatttttttcgctttatactcattttcaacgattttaagcagacgaaacgccggcatttcgccggtttccttcagctcaagcgtgtctctcgcacgccctcttgtgaccagcaccatactgctcggcctgatttcattatcgcggagaggctgatctagcagttccgacagcgaataggtgcggaggaggtcagcggcgatgacaatcacttttaaatgaggactgaatacaggcctgtcttgtcttaatgctacttcagcgttaatttgctgaagcgagtctccagtttcataaacgttgatatacgttttttgatcagtgcttcctccaatcgattttgaaccggctgcttgttcgttcacgtattgatagatcatcgtgatccggtcttttttcggataatcgcccccaactttgtcaaactttttttcaagttcggtttcctcgcctttgtcaatccccattgcaaatgttaagccgagctcttcaatttcgtggctgctccagcatccggttaatagaaacaatagtaaaacactcgttaaataacggatggtgttagtttttttcaaactttttcctcctcactttcgatatgaccagaagcattagcgggatgagaccgaccaaatagatggcgctgttgccgattagatctcccatttgaaaaagctgattgatatttttaggcgccatcgcaatgagataaatgaccggaagcaagctgaataatatcggttccatccttttcttcaagagttgcgacaaacctaaagcagcagcaaaatagctgatcgtaaaactggagaacatttgcatgatccagatgactagcagcaaggactcaaaacgttcaaaaatcagcccaggtatttcaaaacttcgcatcaaatcaatcgtcggccatgtccgtgatgtcactccctcgattgccaatgcaccgatgaccataatgacggtgatcatataaaagacaatcgggaaagaaatccccatcaaagtagcttttaaggcttgctcgggctttctcataaaaggaacgatgatcagtatgatttctatgcctgtataagcaaaagacgttgttttgactccttccagcaccggcttgatccctttcccgagaaccgggcgcaaattgtcgatgtcgaatatgcttgcgctcataaaaatgacgatcagaaaaatgagaacagtaattggaaagatgatttcataaagtcgggcgagcgggttaataccgccggttaataaatagattccgctccataaaaaaaccatcgctgtcgcccaaatcggcgtttcttccagtaagtaaaatcccataacctctgtgacagatcggacttggaaacctgatgttgcgagaaaataacaaatcaaaagcagggtgaaaagtcctcccggccacttgccaatgagatcccggctatattgatatagcgttttgtcggggtactccatgcttaatttcaccatgatgaaaccggctaatatggcaaccagccctccgaatgcaacagaaagccagacatccggcgctttaaccgcttccccagatgtccgcggcagcgtcaagatgccggttcccagcagaaaattcgtgatgacgatgctcgtttgtgaaacggtaattttgtcctgctgacctaccatcatggagaaatcacccctttctttttcaagcgtcagctgattccctgttttctccttcttatttttgaaatcaccagcagcacgagcggggtcaaaccgcctaaataaacgccgctgtttccaataaagtcaccaaatgcaaacatggcgttgatgtttttcgggatcattgcaatcagataaatgaccggaagcaaaacaaacatcatcggccgaatatttgttttaaagagctgggccaggcctaatgccgaaccataaaaagcaatcgcaaaggtacagaacagctgcatgatccagatgaccagcagcaaagactcaaaccgttcaaatatcagacctggtatttcaaagcttctcattaagtcaatcgtcggccatgtccgtgaaaccactccgtctatagacagagcgccgatcaccataacaactgtgatcatatagaaaagcaaagggatggcgatcccgatcatgatcgtatgaatggccttgcgaggctgattcatgaaaggcatcaggatcaaaatgatttcaatacctgaaaacgacagtgcggtcacctttattccttttaagacaggacctattccctctcccagtacaggacgcaagttgtccacatcaaaaattccgatactcatgaacacgaccagcagaaaaagaatgaatgtaatgggtaacacgatttgaaacaagcgggcgatcgaacttaagccgccgacgatcaaatataagccaacccacaaaaaaaccatcgcaactgcccagcggggggttccttccagtagaaaaaagcggatgatttcaagcattgagcggacctgaaaaccggaatgggccaagaggtaacatgcgaaaaacaggctgatcaagctgcccccccatttgccaatgatgtcctgactgtattcataaaaggttttatcaggatattgatggttgagctttaccatgatgactgcggccgtcagagcgaccaagccgcctaatacaagcgtgatccagacatcaggcgtccccacctcgtcaacagacgttcgcgggagcgtcagaatccctgtcccaagcaggaaattggtgatgagaactgctgtttgcgaagtggtgatgcgctcttcgtgcctgaccatcataagcgtttccctcctttctatgctactggcgtgtcgaatcgtctgtttttaacagcttcggccgttttttcatcatctgtatcggcatgcgaacgatgaagtctttccaatcgcgcaaacgataaggaacggcagggctcgcataaggaacgccaaagcttttcagcttcaccgcgtggctggcaagcatgaggaaaaacataatcaccccgtacaaaccgaacgtggctgcacaaaacatcgctacaaatctcagcatgcgcagcgaaatgccggcgctgtattgaggaatcgcaaatgaagaaatcgcggtgacggcaacgacgatgaccataatcgggctgacgatgcctgcctgcacggcagcctccccgatgatgataccgccgacgattcccatcgcgggaccgattggttttggaagccgcaggccggcctcgcgcaaaatttcaattgccacttccataatgagcgcttcaatcagcgatggaaaaggcacacctaccctcgttccggtaatggaaatcgcaagttcactcggaatcagcccgggatgaaacgaaataaaggaaatatatagagccggcccaagcagcgagatcatggctgcgccgattcgcatgatgcggatcagggaactcggcagccagcgttcataataatcctcgggcgattggaggagcatgctgaatgtaaccggaacgattaaaacaaaaggcgttccgtccaataaaatggccactcttccctccattaacgcactcattaccctgtcaagacgttcagtgctttgcacctgcggaaatggactgagataattgtcttcgatcagctgttcgacaaaacctgattcaaggacatcatctatatcaatcttttcgattctttttttgacttcttccaccagccctggttccgcaatgtctttgatataagcgacgacaagatttttgacggctcgcttcccaacttgaaattgaaccatagacaagttttgatttttgccgtgctgcctcaaaagggctgtattggtgccgatcgtttctgtaaagccgacgcgcgcgcctcttaccaaagattctgatacgggctcttcaatgttccttgtatttcttttaacagttcccagcagtaaaacttccgctgaaccgtcgatcagcagcatggccgcaccggataacacttcgggcaccacttcgttgacatggtttacctctgatacgccgctaattgataaaatttgctttttaattaagtcggtcacattgctgcttaatgaagaaagttcaactttatattctttggaaaaatcatccataagggatttcataatatgcttgtcaatcaggtcttgatccgcaagcatttcgacaaatacaatcgccgcgcggatgccggtgcgccctaagttgaattcgcggaaatgaacgtctgagttattctccatagccgttttggccagtttcaagtcgtgatcaaaatcgccggtaaaatacccagttgactccacagacggcacttcatttttaggtttatccggcttgttggacgactgtatcattcttcgcgtttttgctttccaccatctcatgccactcactcatcccctgccgtgcgaagccacaaaaatacttttgatatggcaaacgggacaaaaaagacaaaaaaagcctgcatcaggaccagccagtccggaaaataggaaacaatggttttccacatgttgatcaccctttttcattgctgtagtaagtccatcatttttatcctattattaccttgggtgccagctataattggtggtaatttaaaccacgtcaaacaaaaaagaaccatctgcgttaaaaacacaaatggttctgttcatttattctttttctaaaaacgcccgtttccgtttggccagctctgaaaactcctgatccaattcatgatatttcggatcttgaggcgtaagtccggccaactctccaagaacggcggtcatccgattttcgatgcgcagccgctcctcttcatcgctttttgcatggggctgtttctgtctgttccgataatcttttaatccggtttcgacgcgggtgatacgaccgttttcaaatacaaggagcttctcacacaatttgtctgtgaagtacaggtcatgcgacacaatgatgatcgttccctgaaactcaagcaatgtctgctcaagctgctccctgcttggcaaatcgaggtggttggtcggttcatccagaatcagcagatcataatcttttaaaatcatgcctgccagtttgattcgggtccgctccccgagactgaacgtcccgatttcatcatgaaagcggttttctttgatccccatattggccaaaatcgtccgcgcatttgcgatttcggctctgtcagacaaattcagcacttcagcaactgtttggtcaacccttagatcactgacatcctggcttaaatatgcggcctttacagaccggcttttccatagcgttccggctgttggaggttcggcatccaacatcattttgacaagggtcgttttgccgcacccgttgtctccgataagcgctattctctcgccgtgtttgacgtaaaaatggctgtctttgaataaagtacgtccgtcaaacgcttttgtcagatcttttgcttcgataatccgcttgccccttttttctcctgatgaaaactgaaaattgacagatgctgcttcctttggcttttcagctttgtttttttcaagctcctgttcaaggcgtttcagttttgatttgacttggttgtcaagctttttggcttttacccggtggtattctttaaaaccaagctgccttctttctgactgtgatccctgttttgttgagtcgcggtgggctttctgcgaccaattttgaagagtggcaatctgtgactcgattctttctttttgcttctgctggacttcgtattggtgcaggcgtgcttcgtataaccgttttttctcccgccggtatgcactgtagtttccttgataggtgtgcaaattcccatcttccagctcaagtattttggagacggattgatccagaaaataacggtcgtgagaaataatcaatacagccccttgatattgttgcagttcttcaaggagccagctgatcccttttaaatccaagtgattggtcggttcatctaagatgagaagatcaggcatcgtcttccagacgtgtgccagtgcaagcttcagtttttctcccccgctcaaatggctgagccgttcggaattccagctttgaacctttgataagccaagactgctcgtcaactgatataatttcccgccctcgtcgcctgttaatatgctgttgaaatcatgaacagagtactcaatcgactggagcagatagccgattttgagcgtccggtctgtttgaacagtgcctttgtcggcttctgcatgaccgctcaatatatttgcaagcgttgttttccccgctccattgcatccgaccaaaccaatccgctcatgattggaaatgtcaaaatcaatgttttttaaaatcgtttgctctccaaagcttttttccaagcctcttattttcattaaaatcgtcataccgttcacctctgtttatttttggctgacaacaaaaaacctctcgcggaaacccggagaggatatcatgccaaaatatgcatcgtgaaagcggtataaaccgatcccattccattgcacgacaaaaaacatgcaaagtcagaaaatgatgcaaggtataaaagggcatactcatcctattctccaagtttccgttttttcatattaaaaaaacgatggaaaataagattactgcttcatgtcccctatacctattcctttcactgtatttaccgataagtatataaacggagggaaactttgtcaacagttctccagcccattttccgtcaatacagatactttcgcctttgttgaggattttgttttgaagccaaaatttttaaatttaatgcaaaagtgtgaaaattgtccgatattattctcgtaacctagaaaaaggagttttggctaatgaaaaaaatattggaatggttcaagcatccatctctttcaaaaagattagcggtctcatttttattgattttaacgctccctgttttaatcctttcaggtgtttcctattatacggcaggcgggtcgattgaagatgaaatcatgagaagcgcaagaaacagcgtggatcaattaaacgaaatgatcgatcaaaacattgagaaaaaagcggatgctgttacatatttcagtgaagagatcaaagaaaaaacatacaaggaaaaaggccagacttcgttaagacaaaagtttgaacaatacgccaggcaaaacaaagatgtagaagccgttttcacaggctctgaagacggtgtatacgtgcagcacccttatacgaaaatgcctgacggctataatccggcggaaaggccctggtttaaagaagcggttgagaaaaaaggcgaaattatcgttaccgatccatacacatctgccgctaccggcaacacggtcattaccatcgccaaacaaaataaagacgggtcgggcgtcgctgcgctcagcttgaatatcgacgagctgattaaagcgacaaacgatatcaaagtcggaaaagacggctttgcttttatctcaagtgcgtccaaaaaatatatcgcccacccgacgattaaagccggaactgaaggtgaaggcggctgggttgatcaagtttacggcaaaggaaaaggcgaattcaagtatacttttgaaggaaaagccaagcaaatggcttttacgacaaacaaactgacaggctggaaaatcgccgggacgatgttttccgatgagataacaaacgcaacaaagcccgtcctttatatggctctcatcgtcttttcaggggctttggtgcttggcggagttctcattttctttattgtccgcgcgattagcaaaccattgaatcagctcgttctatctgcaaagaacatcagcagcggcgatttgacacagcaaatcgaagtgcgttcaaatgacgaattcgggcagctcggcaaaagcttcaatgacatggcggaatcgctccgcacactgatcggcaccattcaggaatcggttgagaatgtcgcctcctcttctgagcagctgacagcaagcgcagaacagacgagccaagcgacagaacatattacatctgcgatcgaacagttctctaacggggctgaaagccagaatgaaaaagtcgaaacgagctcgcagcagctcagccagatgaatgatcatctgagcgaaatgaccgaagtgtcggaatcaatcaccgaagcatcgatcaaatcgacagaaatcgccgaaaccggaggagaactcgttcagaaaacggtcggccagatgagttcaatcgaccaatctgtcaaacaagctgagagcgtcgtcaaaggcctcgaaggcaaatcgaaggatatcacatcaattctcagggtcattaacggaattgccgatcaaacgaatctattggcattgaacgccgcgattgaagcagcccgcgccggcgagtcaggcagaggattttccgtcgtcgccgaagaagttcgaaagcttgccgcgcagtcagcggactcggcaaaagaaatcgaagcgttgattcaggaaatcgtcaaagaaatcgaacattctctcagcatgtttcaatcggtcaaccatgaagtgcagtccggacttaaaattaccgagaaaacagagtcgagctttcacgaaatcagcggcatgacgaatgagatcgcaggcaagctgcaaacgctcaatgcggcggtcgaacagttgtcgaatggctcgcaggaagtctccggtgccgttcaggaaatcgccgatgtatcaagggaaagtacagctggaatccaggacattgctgcatcagcggaagaacagctggcttcaatggaagaaatcagtacatcctctgccacgcttgagcagatggcggaagatctgcgagaattgacgaaaaaattcaaggtgaaataaaaaagagaggcttccttcatttagagggagcctctcttttatgtatcagctgatcttcgttccattgggcgcttcttgatcaggggccagcaatataacatcgcctttttccggtacgcctccaagaacgagaacttccgatttaaacccggcaatccgccgcggcggaaaattgacgactgccgtcacctgccggcctacaagcttttcaggcgtataacgctttgtgatttgagcgctcgaacacttgacgccaatctctccgccaaaatcgatttcaagcttaatggccggtaccttcgcttccggaaactcttctgcttttaaaactgttccaacccgaatatcaagctttaaaaaatcttcgattgttgccatgaactcagctcctttggccgctttctaaagggtgatattgacatgactagaatatcatgtattttgattcgtttaaaccctggacttccgctgcattttatagaatcgagtagtaaacaggccttttttgccgccgttttaggacagccaactttacgggaaccgcctctcattcatagattaagaggaagaataaactataagagatgaggtggagctagaatgttcggttcctacatggttcaaatggtaaggtccaacgcccataagctggaccggccgctgagagaaagcgtgctgaaactctataaaccttttaaatggacgccttgctttttacacggttttttcgaaaaaatattaatgaaaaacaaaaaaataccagtcattattgaatttgaaaaagactgtcagcataaaggctatcaattagtcaatgaaatgatcggcagcaaaagaagaaacaaaatcaagcatcgcttctccaacgttagctgctgcagcgctgaagtcaccccttcttctttgcaatcgcttctatctgagtgcggcgacattcgcaaaatttatttaaatcgcaaagtaaaagcgctcctcgacgtagcggttgaatcaagccatgccaaagaagtggtcagaaacaatcagacgctgacaggcaaaggagtgacagtcgctgtcattgatacgggcgtataccctcacgaagatcttgaaggcaggatcagggcttttcaagactttatcaaccagagaacagaaccctatgatgacaatgggcacggcacacactgcgccggtgatgcttgcggaaacggagcggcctcatcgggtcagtaccgcggacctgctcctgaagcagaacttgtcggtgtaaaagtattggacaaaatgggatccggatcgctcgaaaccgtcattcaaggcgtagattggtgcattcaattcaataaggaaaatcctgatgatccgatcgacattatttcaatgtcattgggtgcagaagccttgcgctacgagaatgaagaagaagatccagtcgttaaagctgttcatgcagcatgggacgcaggcattgttgtatgtgcggcagccggcaactccggtcctgatgcgcaaacgattgccagcccgggtgtcagcagcaagattattacagtcggagccttggatgacagggatacagtcagccgggaggatgacgatgtcgcctcttattcaagcagagggccgacaatctatggtcaagtcaaaccggacttgctggtaccgggcacaaatattacgtcgcttcgttcacccggatcttttctcgataagctgcaaaaaacaaacagagtcggcacaaaatatatgacattgtccggaacctcgatggctacgccgatctgcgcaggaattgccgcacttatccttcagcaagccccgggcacagaacctgatgaagtcaaacagctgctaatggacggtaccgatttatggaaagatcgcgatccaaatgtttacggtgcagggtacatcaacgcagaacaatcggtgccgcaagactaaagaccgttcgcccgtttttgcaataagcgggcgaatcttacataaaaatatttaaactgcagaccttcttttttcaaggatgagcggtatcgtcaaatacatggcatacgcgaagaccatccaaaccgcaaacccaatcatctggccatctgaaagcgccgggaagatcagcgaatgattccataaagaaaaagcgtcgagaaacaaaccgacagccgaccccacaatgccaagcttaaccgccgcaaacctcgttttgtcaacccgccgataaacgagcatcacggcatataaaagggcaaaagttccggcttcaagaagcaaaaagcggagcataaaaccatcttggccgggttctgtaagaaccgcactgccgaacagcataaaaaatacggtggcgccaagccagacaacgattgaaaaaacaagagccaaacccagcttttcagtcaacttacccatccctttttactcccctccatgctgtttaacagcggtttccgtcagcatctgcagcacagcttctaattccctgtagattttttcaggggaaaatcccggagacataagcgactgaagtgcaagaccgtcgattagtgcgtttaaaagaatgccccacgtgctgaaagaaaccccgtcaacaggagaacgcttccacaggtcggaaagctgttctgccaacaccgcattttcctcttcgagaagttcgccgagctgttcttttatcttttcatttcgaaaccctaaaacggccaattctaaaaaaagctgatgataatacgcatccttcagtgttcttgatttcgcggaagacaatccgtcttttatcctttcggcagcgggcttttcatttgctttcaatcgctcccacgacgcgcggcataggtcgcggaccacttcaaaaacaagctgctcttttgtccgaaaatgatagtaaacagttccctgtgtgacctttgcttcttcagcgaccgcctttagcgtcagtttgtccaggccatgttcggcaatgcggcgcttagccgcctcaatcaacgtttcttttgatgtcacatttggccttgccattcggttcacctcttagttattcaaataactaacttgatggtttaactataatatggaaagtatttcttgtcaatcgattttcttctctcagccatagatttttaagtttacataataatattattgttagattgaattaatgcttcttatccgtttctgtcataaacgtcagcccttgaaggaatttcaaaatcgctccctgttctgctgttgaaaacgaatcgagaaatctgctaaactgatccgctttttgctgatggagcttttcatgaagctcaaacacttgttttccgctgggcgtcagcctgaagtatatctcttttttgttgtccgtcaattgaaaccgtttgatgaggccttcttttaacagctttgaactgatttttgtaatatttgcttttgataaattcattttttttgcgatgccggtgttgttgatcggttcatcatgaccgatacagctgatgacatggatggtagtcatattccccgggagccgtttaacatcagattctgccgcctgctttaaaaatgccttgagatctgtatccgctttttgttcgttcaggtgcaggagtttaacatacatatcatagatcagctgttttgtcagttcagacatagtcaatggacagtcccttctttttattttccggttaacaaaatattttaatagtttatttcaggatttgtcaatattatgataaggtgaaatcagataacaaatgtgttttgtttatcatgaaacaacaccaaaaaggagaatcgctgatgaatattgaaggaatagagatggaagttcgctgcacaggcgatgtatgttcagatgcccttgaatttttgagacgccataaccacgaaaaaacagccgaacattcgataagggtgaaacaagcggcagaaagattggcaaatcgttttcatgttcctgcacaaaaagctggtatagccggtatgatgcacgacatcaggggtgtcatccctaatgaaaaaagaattgcggctgctgaagcgctcggtattgatattctgcccgaagaacggatattcccgatgatcatccatcaaaagctgtcgaaagtgatggcgcgggacctgtttcaggtggcggatgaagatattttaaatgcaatagaatgccatacgacgcttaaaaaaatccttcccagctcgaccttgtcctgttttcagcggacaaaatagaatgggatcagacggggactccgccttacatccaggagcttcatgaagcgcttgaaatttctctggagcacggggcgtttgtttatattcagcatttgtggaaacaaaaagataaactgaaagttgtccatccctggctgaaagatgcctattaccacctaaaagcaaaaatcgaagcttgacctcaggcaagattacggcttgaagaggtgaccgccttaagccgcaatcttacttgtaactccgttaattcacgccttttgaagcatcccagattttcagctgctttctcatatggacgatttgccccaaatgataaacattatgaagaatgaggcaggacaaaatctccgcccaggtagaatgcggatcgtgctgagccggttgtttcagcatctcctcttcgcattccgaaagcgcatcgatccattcggcatagatcgtattcagttcctgccggctttctttccagccaagtccgcttttgtttacaaacgtatcatcgatcgtataatcaaaagccggaacgggaattcctttaaaccgctttaaatagcgctcgttgtaaaaaatcaaatggttggcaatttctaaaatcgaattttccgaaccttcccctttttgccttgcctggctttccgtgagatcagcggcagccgtttgaaaacaaacaaaccaagtcgtttcgttatagcatgctttaaactgttcaagcaaaacgttttttagcataaagaccctccagttcgattcgatttttgcctagctttcatttgctattttcgcccttttcacggcagaatcctttttttcaatatgatattgaatgtcgagaaaccgtatgccgaacagccacatgcggtgatgggcgcagagcctctttcgtccctgctctttaatgataaagcgttcggcgagcggcagtttaaacgttcctgttccggtcgaaaggaagatgccttcatccccacggtcagatcgtttatcactgctcgtcaaaatcaggcagccgtcctctgctttcggctttaaaatgcctgtcatattggaaaacggcaatggcagcgcgatattcatatatgtgatgtgatcgtgggtatgagcagaataaagcgccacaaacacagtctcgcctacctcgttcgttctgatccaggcgcgcacattcttccttccgtctctggctgaatcaacaccgataatctctccgtccatcgtttgccgtccggtcttagtccccaaatgaatttgtcctgtctttcttgaaatcagctggtacatgtgcgcgagcggtttaaaccatggacgccaggagatctccgctgttaacgaataatcggcagtatgctcatagaaatcgagaataagaggagaaaccttctcaggctgaaatcctttgctctgaaatgcgctcatatcatcggcaagaccttggtaagacgaatcggtttgtaatcggtgtctgtgtaaaaaatcggctccgatcttccaagtgccgtaaatgttgctcatcgtttcgccttgcctcctttcacagcccggcccaggggattcaaggcgccagccggtcagcgctggaatgatgacgccaaaggcgttgacaagcccgtgaatccaaatcatttcctggattgtaaaagtcgtccggccgcgaaaaacgccgtaagagtaaatgagtgaaaaagcaatggtgatcattaatgtaaaagacgaaaagataacaaagcggcgagccgcgctgtttttgaaggccgtaatcgaggcgagaaagccgcttccgtatagggccgacaaatacagcgcaacagcgatgacatcaatggttttcgaaaacgatatgccgatggcaatgaacagcggagacagcatgatgagccatgtcaccgccgcataaaggaggcctttctttttcagcttccttccgagcattccattaaaaatcggaatgagaaatgcagaataatgaaaatgtaccgctgtcagcagcacaatcagcgggctgaaatccatgacctggagattcagcgtataagcaaaaagccacccccctccaaaaggaaggtaaagcaggccgctgtcaatcgatgcctcttcaaggctccttccttctctctcccagaggcgaagtgccccgtataaggcgatcatccccgtatagcatagccaaaccaatgaaaaaagcggggaatggaacagcagtgatagcgatgccgaacaagccgcataaggaaaacagacgctgatcagccgaaacatcccattttcatgctgaatgagatcgagcgcagccggaacaaaaaacagcattgataataaaagaagcgcctctgccgccgggatatccggcgctttgccgatgaaaaaaaccgcgtagcaaagaacgcttacaaaaaaacggcgggctttcatgccgtctcctcctccctgttaaacgttcctctgtaggcaaacagcgttccgaacagcgggtttttcacatgaacgtcaattgtaaaacagcctttttcttcgtcatacgattcattcacgctggaaataccgtataagcactttggaaggggcagcttttttctgaataaaggcagccattgtctgacagaagtaatcgataatgagccgtcggcctccgccttaaaccgcaggcttgagattaagattggcggatgcccgaaatagtcgatgatttcaacacggcttttatcatagatcatgacagcatcgaaatgcctttgtttatcctgaaaaaagaaagtcctgttccaaacggctgccggtgtatcatttttcgtcagccgaatgtgattttcaatcgtgaacggaacgttcctccccctttcgggaaaaaaacagcggaagaccgttcccgctttgaacaacagtctgacccagtatgaaccgccggaaatttccgtcatcactccttttcctttgaacacgttttcttgagtgagctgataccgctccttgagttttgggtggagaaggtgaaaatcctcgatcacccgttcatacatcgaaatcaaatcaacgcctctttctgatcgtatttcccgcgtttggaatgccgcaagcgctcacatagccgataacggacaagatgataagtgcggcattgagcacgaccgggttaaaaggttcggcaaaagatgcgatatcagccattcccgcggaggcagaaagcagcacaagcaggacgatatgcagaagaaaccacttccttttccgaacaggataaagccataacacgccgaccatcacctcggctaaaccgataagcctcaggagcgtttcgggatggaaacggccgcccgtaaaagccgaaagcatgctgatttccccagggtgagccatgatgagctttggaacaagcccttggtaaatccagacgaaagaaaacagcagacaaacgagccaatagaccaatgttttttgaaaaagcagccttggatggagccctttttcaagccaaatcttcagtgcatcaaaactccaggccgtcgcccagccgaggagcggcctgaatgccatatctgcaagccggcccagcctaccgtaacgggtgtcataatcgtattgtgtcataaacgtgattccggtttcgctctcgctgtatttccaatatcctcttccttcgcgaatgacagaaagcgggtggtttgtagcgaacttgagtgacgagactctgtctccagtatcttgaaatacgtttccggcagactccccggtgccggagatttttaagccgaagccgattctcgtttcgtataagaacctctgaggttcacccggtctgcgctttaaataggtaatgtccgtaaatcgcaagtcccattgccgatggagggttgggtcttgggtatagcgccatagccgctccatttctgcctggatggatatttctacataaattggagtttttttcattgtgcacacccttttgtgaatatattcacaatgatagcataacatggaacacacgatgtgtgaaccaatttttgcatatcaagtctctctttgccgacataaaaaaatcctcggctgttaggccaaggcaattagtggctggttaagccttctcatacctatgactcaaaaaatggaagagccatacgacaatcatactaaattttcgaaaaaatgtaaacaattaagaaaaatcctcttgtttattcggtctgatagacagcaatgccttttaagaagacgcggattgtcagatcaagactttcttctacatcataaggaagaccgaacgcatcgtgttgcctgagtgcggcaaatccatgcaggatgcttctcaagcctctgaccgcatgaatcgcggcttcatcatctaaatgatagtctttcagaacggaaagcaccaaggcgaggactctgtctccagcctcgtcaagccgtccatcttcatcgggcattgcaataaaagttgcttcataaagccccggtctgtttttggcaaaagcgagataggcatgagccatttggctgacagcctgatcctcttcggctctctggatagccgaagccatgttttcataaagaatcgtcaagccgtaaagtgcgagttccttccgtaagtcgttcaatccttttatatgattgtacagagacggagatttgacattcagccttttggaaagtgaagcaagcgtcacttcatgaatgccttcctcatcagccagagctgcagcagcttccaatactgcgtctttattcaaaccgattcgcggagacaagattccttcatcctttcctgtttaatttgatgtatgcttcgtttaccgcttttttcatcgcttgagccggatcatggacaagatcgccgtggccggcggcaagcgcctttggttttaaatctaacagcttttgtgcgctttctaaagcgatttctttgtcccatgtggccaaagccggaaaaggaaatgaaagctttaaatgccccgataccgtcatgccgcttcgcgtatggtacgcatcaccgactatgagaaggccgcttctttcatcaaaaaacgaaatgctgccaggcgtatgcccgggtgatgaaacagtcagcaatgaaccgattctgtctccttcctttaaaaagatatcaggatttgtcttgatgtttttcggaacgcctcctttgattattccgcgctccccttccagcatctttgtatcgccttttaacagacgtgcatcccgttcagatattgacaccttcacacccggaaggctgtggtacagcgcgtcaagcgaaccgacatggtcgctgtgggcatgggtcagcaaaatccgcttaatcggcttgcggaggtgatccgcagcctttaaaatcccggttttgctgatcggaatccctgtatcaattaatgttagaccgtcttcttcatcggctaaataacagttgacaggaaatatgtgcggaaaaaaagtcagctggtaaacagattcaaatcgggtcatcctcataacttccacctcttccatcaaaataaaaaactaataccgttagtttccattttaaaactaacagcattagttttaaaagctttatttttttcgatcgacagcaatataaatggcaacttgagcattttcgggattcactgcttgttcaccataaacttcataatctccggtatatgtacggagatttttctcagcccatgtccaaatctcctgccaagtctcaaacacgacctcttcgatcctcccccgccttgaaacaaaaacggcatattcggatgcagggagcgaaatcacattggccgctttttcatgctgatcagcgaacgtaccgattgaaaatgtatacgccccatattcttccgactcataatctgaataaagcgcaatcgtatctctcttcatgtcctggcgttccttatgcggaaatctttcacggtataaactccacatggaaggaattttacctttttcggttgcttcattttggttgcttgttacggtggataccccgctgaataactttgccttctgtttttcgaaatgagaaaagctcatcttccctgcccgccttccgtttgcgccgccgcccatcgttttaaataagggagtgtccgcgacaaaagcgctctcgcttcggcctcggtttttccctcttcttttatataaggcacacagatttcgatcatatctttcaatgtcgcatctggatgagtataagctccgttttcatagcagtaaatgcagtagtcacgactgttccccccgtctttttctgtgccgaaaagttcgcttgtcatcggcatgccgcagctttggcaaaaataatgttccatgtttcattcctcctttttcttcatcatacaaaaagaaacctgacagcatcgtgtcaggtttcgtataaatgtacaatttgttttgccaagtcttttattttttgacggatgcgaggaggatcgagaacttcgatatgggttccaaattggagcagaaatccgtacagccattgatcttccggataagaaatggttgccacgcattgtccgttttcataagtgagagcttctgagccgaaccattctcttgccaaagactctcccgacggcttaatgagaagggtcacctcggtcatattgtccggtttgtaccacgatgtctcccaaggaagtgaagacagatcgacttcctttctttcaaacttttcttcaagcatccgcacgtctttcatccgcaacagtttaaagaagcgaaacgcctgtctcttcaggcagaaagcatacaaataccagtgccttccctttaggacgagggtatgcggctccgctttcctttttccggtctgcccctctctgtccacataattaaaggagaccgcccgcgtgctgtctgacgcttcatccagcaagcggatcttttctttgatgacaggactttctccccaggaagagatgtcaacaaaccatttttccgttttcttgcggaattccggcatttcttcttccgaaacgagaaaccggattttttcaagtgcagacccgtgatggagcacttcgtacgtcgaggaaacgctttccaaagccgtcgtaatggccgccagttcgtctgctgacagcagcttattttcgagccgaaaccgctccatgatgctgatcccgcctcctgctccctgtgaggtgacaatcggaatgcccgcctggttgatcgcctcaatatcccgataaatcgttctgacagagacttcgaacatgccggcaagctcctttgcctgcacttggcgtttattaatcaataaaatcacaatggccaaaagccggtcaattttcactgcagatccctcacattcatcttgtgcagcctctttttttctgctattttcattccatagcgcacaccattctgggatatcatgacaaaaaagaggatctcatcacccatttatctagaaaaccacttttcaggttacgatttgtacagtttggacatatactccttaaaaaaggaggttttaaaaacatcatattttattttttgcagtttttcatcattgtgtccatcgtctatatcaagttcaaacggtcggtcggttatcagcctttaaagccggcacgcatgttgttccggatcatccttttttcgggaattttcgtttttctgctgacgatgagcgcacttcaccctttatcatacttttatgatctgattgggatcgcgctcggactcatcttgaccgtctatgcgctgaagcatgtgtcgatcgaaaatcggggcggagtcctttatttcagaacgcatttatgggttgaattgatcgtactctttttatttttataccggtttctgtaccggatcgccgagatcggccagctgcagactgcggtttcagacgggggttcggcagcttacggcgccctttttgcgcaggacccggcgacgatgatcggtttttttgtactggccgtttattatgtcggtttctctttttttgttttaaaaaaaggcagaaccgaagaaaagcgctcagcttaaaaaggcaaactcgggaaattgagtttgccttttaaactttagtcatgttgtgtatgatcgatcatctgctgaagtacatcgaggacatgctggtcttccggagaataaaaaatggaagtccctgcccttcttgatttgacgagacgaaggttttttaaaaacctgagctggtgagaaacggttgactgcaggagactcagcttctctgctatttcattaaccgaatgctcgccttgtgagagcaggtgaagaattttgattctcgttgggtcagagagcgctttaaacgtctgtgaaacgagaaataaagtttcttcatctaactcggcccgcacctgtttttctgttgtttcttgattgtgctcactcatgcttttcaccttttccgcgcgacttttacctccatatcatataccaaaacataccggttgaaaagttttaacggatcaagtcgaaaacagcgttccttgaagcgcttctacatatcttgcagcagacctctgcacacattctccggcgtttttttcaactgagcggcgaaaagcgttgtacagcctgttgaatggaacatcctttatttgatcagccatttgctgcactttgccggcgggaagaggaatcaaattcggatagctgtacataaaactcacccacctgcgatcttgaacaacttggataatgtctcctgaaaggaggattcccttgcctgcgttcccgtttgcccaatggcagaccgctccccctttaaaatggccgccaagcctgtgcaaggtcaacccgcttgatagcttgagagtttcgccggaccaaaaaacaatccggctgctcggccgctgcacccattgtttgtcatcttcatgaatatagatcggagcatcaaacatttcagcccattccgcctgtgcagaataataatgcggatgtgataaagcaatcgcctggattccgcccatctgctcgatgttctcagtcgtacgctgatccaggtatgtaatacaatcccacagcaagttaaagccgggctcctgaatcaggtacgccgattgaccgatgccgaattcgggtgttgtcgtcaaactgtataggcgctcctctacaaaggtgatctcgttttgaaacctcccgctttgcttcatttcttccagtgttgtccaggtttgccctgataaactgacatactgtctttcttcattgcaaataatgcattctgccggctctttcgaagcagcgttatattgaacgccgcacgtcgtgcaaatatggtttttcaaagttgcccctccccttttaaactatattttaccatcctcttcatgtatacaaatatttttatgtgtcggtatgctctaaagattcagaatgacctgtcattcgaagagtccggcaattttctgaaagcgaaaaaaagcgtccgatgatcctggacgccagttgcctatggttgaaacatttgttcaagctgtgaataggaaatgtcgccggccgcgcaatctacagcggcattgactacctgatcaaagctttcggccgaagcgcttttctcttttaactgttgttcatagcgttcgagctcttcctgctgtcttcttaaatcctcttcttttccatcataatcagatgcattcatcgtttccatatttcttttgacggcttcaacatagcctctcaatatatccatatcttcatactccttgccttttttcaaagggtttgcaacatttgttatttttatgcgaaaaaagaggttttcatacgcttgctcaagcacaaaaaaacagataaaatatgtcttaatttctgtattttttacataaggggatttagaagtcattgaaaaacgaaactgcgcttaaacgaagccttacactcggcccgctcgttgtgatcggccttgcttatatggacccgctcgtcgtatttgattcctacggagttgtcgcacagctgacaaagggacacgttccggcggcatacgtattcactgttgccgccctccttttgaccgctttgagctacggcagcatggtcaaagcttaccctaaagcgggatcggtttatacttatgcatatgaaagcattcatccgcatgcgggatttttagccggctggacgatcatgctggactatttgtttttgccgatggtcaactttgcgatcggcagcgcttatttaacggcggcttttccagaagtgccgcatggtttttgggtcgttctgctcgctctatccatcactgtcgtcaatgttttaggcatcagactaacggcaaatattacagggctgttcgtcgcttttcaagtgatcgtcgccctgacttttgccggatttatgatcgccgggctggcaggcggcctcgggacgggcgagctgatttctgccgatccgtttttccattctgatatcgaaccttccctgattgtgtcaggggcgacgattttgtgtttttcgtttctcggttttgatgcgatctctacaatgtctgaagaaacggtcaacccgaagaaaaacattccgttagccatctttctaacagtagcgatcggcggaacgctgttcacggcgatttcttatttgatgcagcaaatctatccgtcctatgataacttccggcatgccgattcggcatcgctggaaatagccctatatacgggaggcgcttttttaaagtccttctttctggcgggaacgatggtcgcagtcatttcatcctcgctctcttcgcatgcgagcgcttcgcggcttttgtatgcaatggggcgtgacagctctcttccgaaacgctttttcggctacgtgcatccgactttaaagacgccggtatttaatattttgttcatcgggctgatttctttgacggccatgatcggggaattagaggtcatctattcattcatcagtttcggcgcgctgatcggattatttttgtccatttgtctgtcatcggccattactacattcggaggcaggaaaaaggctttttaaaaacgcttcgttatttggttatgccctttttaggggcctctttctgcggctggctgctgcttagcatcagcaaaaatgcgctaataattggagccggctggctgattgccggttttatatactttttgttcaggatccgttctcttccggacgtcacattcggctttgatcgcgatccgcgctagaatggtatatcgcttggtcttcttgtagagatatgtcataataaatgagactgtatactgttttgcatcagggcgctacagaggtgaaaccattgaagaaaaagaaatcaggatgtttagccggagctggctgtttgtcattttttgtgtttgttccattgatcattttctttgccatctccggtctggaacaattaaaatggcttcctcttgacactgaatctaatattcttgagagattaaaagattacaagcctcttgttgaagaagaactcgataaacagggtctttcacaatacaccggtcttttattgggcatgatgtatcaagagtcaaaaggcagaggcggtgatccgatgcagtcgtcggaatctctcggcatgaagcgaaatgagattgacgatccaaaagcaagcattaagcagggtgtgcgccattttacagtaatgtatcaaaagggacagaaaaaaggcgtcgatattgaaacgattatccaaagctataatatgggggccggttatatcgactatgtctcaaaacacggcggaaagcactctgagaagctggcaaaggcattttccgaagaacaagtcaaaaagaaccccgacctgtacaattgcggcggggatacaaacaatttccgctatccttattgctacggggattactcttacacggaaaaagtaatggaacgcacaaaaaaagtcgaagaacatatcgaaggattaacacttgaacattgacaaagcggctggctgggtgatttttcgcccggcttgtcctgttttggaggagcgaacgaaagcatcgcctgcagacgcatgccatgcttgtcatcagttcgcatattccccgtgaacgcttcgatccatccgtctaatccaaaaaaccgccttttttcagcatttcttttacttcctcttttgagattaaaaagtcttttgagctcaagttatctgtttctaaaggctggcaatccgcatactttttatgaagctcgggcattttgattgcaggaagcaccaccgcgaggtcatctgtaaatgagacagcatgctgccgttcatgaggtgaaatcagcagttcatgaagcttttcccccggccttgcccccgtttctgcgatggacgttatttcgtttccataagcttcgatcagcacctcagccatgtctaaaattttgcaggccggcgaattcataatgaaaatttccccgccttggccgctttcagccgcttttaataaaagctgaatcgttttttccttcgtaaggaagaaacgggtcattcttttgtctgtgatggcgacttggttcttttccctgatctggtctttaaaaagctgaagaacgcttccgctgcttccaagcacatttcctccccttacacaaataaaacccgtgtctgaatacagatggttcgcgtatacgatcagcttctcgccgatcgctttcgtcattccgtagaagttggcagggtcggccgctttgtcagtcgagacgttgatgacttttttaacgccgttttcgatcgctgcttcaatgacgttttcggtccctgtgacatttgtttttaatgcttcaagcggctgttcttcacaaaccgggacatgcttcagcgctgctaaatggaagacatagtcgacaccttttaatcctgtattgagcgctttccgatctctaatatccccgatgaaaaacgtcagcctcggatcttcaatctgccttctcatttgaacttgtctttcttcatttctggaaaatacaatgatctttttagggcttgaggctagcagctgaagtatgagttcctgaccccatgagcctgttcccccagtaatgaatatcgttttattttcaaacatccgctttttctctccctttgtgccttagtcaatcattctcatcggcgaaaaactaacgaattgttatgccttggaacatttctctccaatacgggtcgtttgattgccaaatttcttgatcaggaagttcaacagcgcatacgttcttcagcggccagtgattttcaacaataccggatacatttgtatgattgatcaaaagaacgctgaaatcgtttgtaaccaaatcagagagcacctcttcaagctctttggcttcctgcatcgtgccgctcgttctgacaaacagcacgcgctttgcagtcgaggtcttttctaaaaatctgttaaatctcctattaaacttctctattacttcatgataagtagccaggttgtcgagtgtatttcgatccgctttaaaatcgtgtgccgagtcaatgcagtaataatcatccgtaaccgagataaaagggtctttagtggcaactcctgtagaatagcccgtcactctcaaatttataggattcataaacccttcaaaccggtttcgtatcaagcggcacagatcaggcagcgacgaggtgccgacccaatcaaaaggtcctgcataaggtcttttattcatttttctcagctgaagagctgtcaggcacaaatgccctaggctgaaaaccgcatcatattcgccttgtatctcttttaaattcatatactcactccttgtgcttactgacggaacattctcgctataagtagagcatctggtctttataacatagtatgtcggtgtaataaaaaggtaaaagacaacaacctaagatcggctcctaaaattcaatccaatattgatagattgaaagacttaataaaaaccttcggagcaccgaaggttgattgagaaataactattctgttttggtttcattttgtgtttgaaagaattttaatgtagtatcatttggaagtgtgtaattttcaggaagtgactctttgatcgcttcaagcactttattattgctttctataattttattgttcatttcttcaaagctggctgttaattcgtctaagacttcatttttgctgtttacattggttgagctttcgttctttaaggcctctccggattcagccggctgttcatttgatacagcttctgagcctgctgctgaattcgtctgagctgccttttctgccagtgcttcaactctttcttttcggaactcgaaaagcaattccaaatatttatcccaccaaccgacatcgatttcctcttttgtcagaagttcaaacaaatgctttttaatttcagacttcatacgacatgtctcctttattttaaagtttgttgataaatgtccaaaaccttgttgacagcttcatccatattccaatactccattgcaaatttgtgtgcattggaccctaaagtttttctaagcgtctcatcttccaacaactgattgatagagttgcaaattgcctgtgcatctcctttaggcgtcaccataccggtcacattatgttcaacgatttcgggaagtccccctgcatcgctgacgataataggaagtccggctaattgcgcttcaataacagacagcggctgattttcgagaagactcggcaaaacatacacatcagcgattgacagaagatatgggacatcatcgcgctttttcataaacacgacatcgttttccaaaccgagctgcccgcataaaattctcagtcccgccattctctccccgtcgccggcaatccagcatacccaatcatcccgaacctcttttaaatgcgaaagtgcggcaagcagatgctgaacacctttgttttcaacgagccttcctgtgaaaaggataattttcttatctgtttgcggtatttccgctgactttgtatcctttcgttttagaaagctgtcaatatcatagccataatggagaacgctgatttgttcctccggtgtatcgaattcctttgtcaacagattcttcaaccaattgttggcaacaattgtagcgtcagccgaaacagcgccgacccgttcaagatggtcaaagtacgcccttgcgatgtcagaattagacttcctgtggatcgttgtaagctgatgtctgatttcatgggctacactcccgtgaagcgtggcaacaagcggcgtgtctttttgcttcactcttttcaggcagccgcttgagatgacatcttgggcatggatcaggtcgtatttttccagccctaaataaatagctgcaagttcgtatacatagcgctggatctcagtaaagtggaccaattgattgtcatataattgcggaaaagactgttgatcgactgattgctcaatcataggcaaaagctgttcttttttcaccttgcgatcttcgtttacaatatgaacaatctcgttctcttctccatatccaagcagatcgacttcatgtcccatagattcaagcgattctttcagctggaccatatatgtccacacaccacctacgtgcggaatactccaataagtggcaagaagaattttcataagcatctcccttttcatttctatccaatgctctaattatttatattggtgattgctatatcttgtgtaggacggatatccaattaagaaagattatttttgaagaagctgctaaaagaaaaaatccgctccccttgtataagggaacggatttttttcttttaataatatggggaaatcatcatatagacgagaacgcctgtcaggctgacatacagccaaagcggcatcgtccagcgggcgattttgcggtggcgttccacctgcatgctcaggcctctgaacagcgtgaacaatgccaagggaacgattaaagcggacaagacaatgtgtgtgatcaaaataaaatagtagatcggtcttataatcccttccccgccaaaatgagtgtcaggcatcaatgaatggtaggtcaaatatgagacgagaaagatgaacgttgtcgtaaaagcggcaaaaataaaccgtttgtgcgctttaatgtttttctgtttaatcatgatcagtgcagccactaagaaaatgaatgtgaagctgttgcagactgcgttcaaaagcggcagaaaagtcaaatccaaatgagcgaatttgtcgcttttcggcataaaaaacaagagggcaatgacgccgtttatgataatcgtcagagcaacaacaattcctgtgtagtttttatttttttttgtatgggtcatatcgggcaatctctcctatttgtgcaagctatcaaaatcgtattcaaattcaggaggaatgtcaacgttttcggcttttcgtcagaatttagtcacagaatatacaaaaattcccctcctcttgaacgaggaagggaacacaggcgggtgccttagaaattcatagcatcttgagccattaatttttcgaattcttcttcagttacgatatcttctttattcggtttatgctcaaactttacgtcaccatcgatatttttgtaagtcgttgatgctgtgatgccgaaagattgaggcgcttttttgctgtcaaccgagaaagagatatccgcattttctgtcagaaggttttctttgtcatcgattgtcgatgtcacatcgaattttttaaatgtgacgtctttcagtccgtctttaatcttgttcagctcgctcttcggaacagcttctccgctcgcttttccggcgatttcgatgaacttgacgaccgcagctttaatttctttgtcactaaagctgaaagcgactttttgagaagcaccctgctctttttctttatccgtcagatcagctttttcaaacttatctgcaggcagattgtccgctgcttctttgatggattccatcaattgtttttgaagttcatccgtgtctttagatgaagatttgtcatcttcaagcgggaattcaaggtatttgcctttgacgctgtcaaaattcatgccggctgttccaaggaagatgccgaagctgtcaagaacgctgtcaattttgatgtagccgacttgtttcttttcatccatataaaccggaatatcgaaatcaagagacatgttttggactttcagcttcgctttaataacggcctcagactgtttcgtttcagcatttgttttaccgctgatcgtcaatgttgcatcattcagcatgtcagcgaattgcttatcttccgcaccaaggttggatgcgtcaactttcaagccgatatcacttgaaaattcgtatgatttcgcagaaatcagctttttataagccgctgcgtaagatccttttggatcagcctgctgacatgcagctaatacaagaacaaaagctgacatcagcatcaatagagaaaaaattcttttcttcaaaatcgtacgctccttttgtcatgatttttctgggattaggaggatccattgtctcgtatcctaggtaaatataccagaagtcatatgaattctatcacaaaaaaatcgtagaatgtgaaatatttgtttaaaattacattaaaatttaattctagcaacccatttgcaaattgccgttctttttactataatcgaaaactgtatgtttaaatggaaaggagcaagttctatgataacggatgaagaactgcaaaaagacagctccggcttgcagaaggaattgaacgacctgcaatttcaactgtttcggatgcgtgaaaatatgaaggatatctccaaagattcgcgagtgctcggtattgatcaatcgaaagacgatgaatggatgattgtccattcgattgatgatggccggacatgcaagatcatgttaagcgattgccagtcgccgtaccgcgggaggtgtgatttttctctcgtcgcttcctacacagaagaaaaacgcgcgatccatatcggggatattaaaggaccggcaggctttggatatggttcaatctgtatgaagtatttaaaggaaaaagcccgcgagcataacatccccgtcatcaccggggacattgctaaaagggattgggaccatgtggaccggctgatccatttttacgaaaagcatcattttgaagtaacgatcgatcctgattcaaaatccggcgaaattcagtggcaggatctttaaggtgaaataaaggcaaataacgcaaaggacaaaacattaaggcagaggatgaacgcacatcccctgccttttttatttggcaagcccccaaggcgaaaataacaggtaaatgcaggccatcaggcaaatcacaagaacagaagcaagtttggcatgcttccatggctgcaaatctaccttggcatttttctcaagcttgaattccgacggccttggcttcaatcttccgatgaaaagcatcaagaggacggaaaacggaaacagaacagccaatatatatagaaaatgaatatggccgaaatagatttttgagatggtatacaatacaatgtgtgcaaatatcgcccatttcactgcaagcgccggcacttttttcgaaaaaaatccaacgacgacggcagccaatacaggaacattgaaaaaaccgaacatttcctgcagataattgtaaaggccagacggcgcaaacaaaataaaaggtgcgatgataatcgataccgcggccaggatcaccacaaagatccttccggttttcacgagctcttcctcttttgcctctggcttgaagagcggtttgtataaatccaatgtaaacaacgtgatcgtactgttcagcgaaccgttaaacgagctgagaatcgctccgaataagatcgcggcaaagacgccaatcagtgcagtcggcagcaaatcaacgatcagcctcggataaacggtgtcagcgttttgaatatggcctccgtaaaggtgataagcaataacgccgggtagaacgagataaaacacaccgatcgttttaaatacaccggccagcaatgcgcctttctgcccttcagccaagtttttggctccgagcgcccgctgaacgatcgactgattaacagcccaataaaataagttgttcacaagcagtcctgtaaaaatcgtcggccacggcacttctgcagagttgtccgctgtaatggcattcagcttttccttatgtacactcgtcagctctgtatagccgctcaagaggctgccgtctcctattgccataattccgagcacaaagatgaacagaccgccaagaattaaaccgacgccataaatggcatcagccgaggccgcggctttgagtcccccgaaaaatatgtagcagcagcttgcggcgccgatcacaagcgagattaaaaaaacagtcactaacgtattgatcccaagcgcggatgaaatgttgaatacttgatcgagaacgagcgccccggagtacaaaacggttggcagaaacgaggtcgcatatcccagaagcagcaggatcgagacgatttgccgcgttctttgatcatagcgcttttcaagaaagtcgggtatcgtcgtgactccggaactgagatacctcggtaaaaagacaaatgccagcataatgagcgcaagcggtgctgtaacctcccacgccatcgcactcatggttcccgaatagctttgcccgtttaatccaaccatttgttccgttgacaaattggttaaaagcagcgaacttccgatatagagggcagtgagactgcgcccgccgagaaaatagccgtctgacgtttttaaatcaatatcttttgtcctcaaataagaaaaaataaaaattcctgcattaatcaataaaaatgtcatgataatccacaccaatacttctgcaactcctttttagatcagctgatatgtatttatctattgaactacccatttgccaatctaaaaaaacatcaaaatagaaaaaaagatgcagaaaacagaaaaaagacactgatcatcttcatggtcagtgtccatcaatggtaaacctattattttaaaactttaactttaaccgttttaacgccccagttttttgctgcggatttgcttggaacaaatacgtcgattttgttccccttgatcgcaccgccggtatcggcagcggtcgcttctccgtagccttccacatacaccttggatccaagcgggattacgtttggatccaccgcaataaccttggcgtttttattggccttcagatcgatacccgtggctgtcacgcctgtcataccgccgtcattggcagtgtatgccgttgctgtaaccgtcagttctttggcagtgctttgagatacgtttgaacgggaagccggttctttttcctgcttaggtgcaggggcaggcgcagccttctcgactttcgcttctttttgtacggcaggctttgtttccgcaggttgcgccgcagcagcctggaccgtcgcctgtccgtcaacagttatggatgtattcgggtaaatgatatctgattttatgttgttccaatttttaaggtcattcactgaaacgccgaatttttgggcgattttccagagagtgtctccctttttaatggtatattgtttcttttcttctgtctgtttttcagaaacgttcagcttttgtcccggaataatcaagtcagaggaaagctgattccattcttttaagtcctgcagatttaccccttgtttttgcgagattccccaaagggtgtcacctttttggactgttacttcttttgcagaggcactcgctccgaatgcagttgaagataatgctgcaactgcaacaaaggacataaacgtcttcttcataagtaaatcctcccttgttagctttttattgtccggctaacaggagcaatcgtaacatatgaaaatgtcaaatcaataacaaaacaatttgtttttgattacagttgttttacgaggaggaatttcagccgccctaaaatcggccgaaattcagatgtatcaagggttccaatcgtttttcaactgaaataggagatttactaaaaaaaattttacatatataaattttgggtttttatgcttctttctcagttttataggcttgaagctcctgtagaaatacagctccgtattttactcttttttgttctcccactcctttgactgacaaaagctcttcgtctgtcagagggactttcccgctcatttcccgcagcgtttcgtcagagaatacaacaaaaggaggcacgccttgttcctgagcaagctttctgcgcagcgcccttaaccgttcaaacaattcgtcatctttaacgatttgatttgtttgcattttttctttgcgcatcaccgcttcccggccgagcaaaacgtttcgccccttgttggcgacaaagagaacaggatatgtcccgtcggacattttgatgtactcatctgcgattaaaaactctataaaatcgcttatgtcggcaatagaccgtttctttaaaattccgtaagtcgataattgctggaagccgttttcggtcactttcttatttttcgaacctgccagaacttgcgccaccatggtttttccgaacctttctcccatgcggatgatgcaggacagcaccatctgtgcctccttcgtcacatcggtgatgcttcgggtgtcgagacagctgccgcacctgccgcagtcttcggttggaacttcgccaaaataagaaagaataaaccgttcgagacagccttccgtatggcaaaaatcaaccatttgcctcagttttttcacgtcttgcgcccgaatgtcttcatcttctgtcgactgttcgattaaaaaccgctgaagccgaatgtcctgaggggaaaacagcaggatgcactcgctgtcaaggccgtcgcgtccggctcgtcccgcctcctggtagtagctctccatattttttggaatttgggcatgaatcacatagcggatattggatttatcgatgcccattccaaacgccgaggtcgctgtcattacactgatctcatcatttaaaaagagatcctgctgccggtctctttcttcatcatccatcccgccgtgatagcacccggccgcaattcctttttgagagaggcggcttgatattctttcggcttcctttcttgtcgctgtatagataattcccgcctctgagcggtttttctccacatatgattcgataaaacggtccctgttttcgccttttaaaattttaaacgtcaaattatcccgtgaaaaaccggtaaaaaccgtgttctctttttcgatcccgagctgtgtgcaaatatcctcatgaacctcgggcgttgcggtagccgtcaacgccaatacaaccgggcgggtgccgaggctatttaaaaagccttcaatatgtctgtagctcggcctgaaatcatgtccccactgtgaaatgcaatgagcttcatcaatggctaccagcggaatatgaatgtgggaaatcgcgcgaatgaattcgggagacgtcagccgctcaggtgttacataaaagagcttgtagccgccttccttaaatacggagagccgctcagcgatttcgttatggcctaaagaactgttcacgtacgcagcttgaattccaagctgatttaaagcatccacctggtccttcatcaaggaaattaaaggagagatcacaatggttgtcccttccataaggagcgcgggaatttggtagcagattgatttgcctccgcccgtcggcataatgcatgctgtatctcgcttttcagaaacgacagattgaatggctttcttctgccccgggcgcagtgaaggatagccaaaatagtgctgcaatagtgcttcggctttctctagcatataaatgaaaccctctcttatcattaaacttcttcctgtcccccatgatatcatatttaaaccggcaatcagcctctccccgtaaaatcgtctaatcgataaagaaaattcatttttagatgtaaagcgtcagaaaatcaaatgtattgggactcgccatcattaaatcccggtctgttgttcagctaataatcgcaagcgctccgcttcctcccggcaaagcgttttgtatgccaaggctccggcaatactcgctccgtcagatgcatcgcggcgcagagcggatagctctgacagcacagctgccgcgtcgtcttgtaaaattccgcggtcatgcagcatttgaatcaattcatcgccttcaaggcggatcgcatcttgatcaaatgttgaggctgtttcccgcagaacattgtgaacatctgaccaagcgctttcgatcatgttttcccctcgctgcgctgaccgtacagaagtcagtcccgataaccttttttcccgtacggagacgagctcctgaagccttttgtcaaactccaattcaaaatccttatatttcagtttgatcaattccttcattcgatcggacaaaggctcctttagcagcaaaacgcaaatcatcaaggcagctggccatgccaatgattgaaccatcgcagaaacaaattcaagccaatccataaaatcagcctccgtttcaaaaggaaagttgttttgtgaaagaccaggtggtaatgttgaatcgaaaggaaaattttgcatattaaggggtgtcgttataccatgtggttcatcatcatactgatgatcattttgattggatttgcaggaaacatcgttgccatgttgcgaacgattgtaaagcagaatgatagaatcatcagcctctttgagaatgaaatcaacaaaaaccattagacaaatgcccaggaaatggagaaatcgcagaagatacaaacgaactgaaaacagccactctccctaattcgggacaaataaggaaccgatcattttccgtattgagaggcggattcttttttatgatgcctaagatggcgatggatcggtttacaactatattaaattgaatattcagattagtaaatatgagtaaagtcctcacctctctaaccgatacacatgttaaggaggtggttatgttggatattgctgttttatcaatggccatgagtcaggcggctctttatcaaaacgtgcaaatgtcgctgacaaagacggctttggataccgccgaacaaagcgcacagcagctcgtagacatggtgcaggcgccacatcccgtttcaggacatcatattgacttgaaaggctaaggccgaaacatacattcagcaggctgcgaagtctgccggatgtatgttttcccgaagaaatttgtgaaaaaaaccgctgcaacctctttattttttcaggtttttgtactataatattgttctgtgtcccagtagctcaggtggatagagcaacagcctcctaagctgtgtgtcgggagttcgaatctctcctgggacgtttcaaatgtaaagaggcaagcccttgtatgccaagggtttgcctcttttgttaatggccgtgttgttggtgctttaaaataaagttgatcaaaacggattcttatccaacgaatttaagtttcggttgcataaaaaagtttgaatattttctggttgcttttgcgaaagataatttcacgatttacttggttaaattaaagctttgctcaattaagttataaacttcttctgaatctattcgttctaaaacaattgatatccaattttccttatccatatgataaccaggtaaaatactctttccatttcttaaactgccacttatttctggagggcattttaaattcagaatatctatttcgtcatttccatctaagcctaacttttccggaagaacattcattacaagaccataccatttttcggtagtttcatgtcttaaagcggcatagtttggaaatttttgaaatgggtaatctggcgatgtcccgaatttttctttgacgtgcttaaagatatcttctcttgttaacatactgaatcattcctccaacaactcaaatagattttcggcatttgccgatccagagggaacaatggtgaattttttgcagtcatgatgtgaaggtggacatgttttactaaccgtcaatattaaggcttttattttgatctgttgttatttcctttggaattcaacttcatttttcttttatattaaacaatttggccctttgccgtatatacttcttttacaataagaaacccttttgacatattctatccaaacataggcgaatttttcaccctaatacattgagtgcgaatgtctaaaccggcactcctcatctcattttcaaatgctatctgataggcagaaggatgaaacacataaatcgcggctttatcttccatttcttgagtaattctgaaagacgtctcttaaaaattcatcaaattgatcagctgccatttcatcattcagaatcgtcttcctcaacatgaagaacctctgaatctcccgagaaatctaaaaggagctccactaattcttctcccgaaaatcctgtcattaaaagtgttatttaattcagcaagatgcagctggagcttttcctcatcccagtcgccgcagatcttatttttcctcagcctcatccagatttacaactgaaaccaggagagtctttggtcctttttccatgaggattttaaagcgttggttgccgcctgcaaggttgccaatcctttcattccagactaacggttcaactgttcaaaagcgtttcatagactgtttcagtgtttcatattctgaagcacccggctgcaagtgtggattgtatggagccgggttaatttttctatggaatttcacgaatgttcatgacctccaagaaaaaaagcatccattgagatgctttataaattgatatttatttatgatagatagttaactttttgcatgatcctttttatttgttgtatctcatcgactgtatatttagcaggctttaaaacctcattcttaaaatactcgcacaaacttgcttttgaggtaaatctattcttatcttttgtagaataatctattacacgattttctttgtcctccggataaccaaaatagactataggctcaacatagttgaatttattattataggttatgagaaaattcctgagtttatacattgtgtccatgacttgatttctcgggttatcataataagaaatatttatagaatttttttgctcggaatccttatctatattgctatttttcataaaaatgattgtcttctctgtatcactattcgctttcggaaataattgttcaaagacaaatgaaaaatcatttgcaattgattccgcatttttacgattaatcccatggataactgttccacgccaatacttggtttctataatatagatatctgatggcaaaataactaaatgatcaatttgcctggtttttgtctccccattttcttcatagggtacaaatacgtttcccattataaccatctcgttttcatttattttcccctcagaaataagcttttcttttaattccgttaaaatagtgtgggtaataacttcaccgctatttcttgaatactttttaagattgtttatatattcatccatctttacaatcttgttcttcagaaaatcgttttcatttaagaattcatttttttgattaatattcatgacttcagcttgttgtaaagcagcggaagcctctttatgagcttgcaccaggtgatcttgatatgtttgctctagattttttaattcacgttctaaattgttttgatgaattttttttgcctcttttaatttccagatcatataaccagaaaagccaagaagaacaataatagctaatgtagacaccggtctcctcctagacagaatatgattctacattttattacaaataaacctttttttgaagagtccagagaaaaaaacaaatcgaattcctttttatcccttcaagttattttccgctattaaaaaagcacgtttccagatgatgaaaacgtgcaactgtaaatcaacttctaatctaacttcaccaagtaatcaatatcgtccttaactctctcttcagtattactgctatttgtatcagctaaaaacggatgatataccagttgtaatgtgtctgtactcccttaggagtacacctggggcgggtggtcaatccctcttattcatcccccttttctctcggggttcctgatgatgtttttggtgctctggaggctgagtcgtgcgttccagctcctttgtatcttgtcccattccttttaaaaaggagaaaagcagcgtaactgctttgttgatttccgggtctttgagcgagcggatgatatcaaaataacctgttttctcttcgctgtccttctgttccaccgcgtttgccacccccgcattcactttcaaaatgagaggttcaagctgttttacatccagcatgccaagcgttccgaacagaagaagcagatttttcagtgtattggccgtttcctctgtatctgcctttttcactaagatgtcaagaactttatctccttggccaaaaaggccgcgcagcaatggcaatacaccacgctcgttcatgtggccaatcatatgcagcatttcaagaatggcttccttattttcgactaatgcatcctctatttctttcatatcacgctttctctggtcctcttcggttatctcgattttctgaattcgtttaatcgctctagccattatgcccaatcccccttttcacagcgtcgccagggaaaatataatccttccgcgcccatttcttttgtacctgcacaccgatttgcggctgcggattgccgttgcggtgattgatcttaggcagcggattgcttccgtcgcgcttcaaaatttccatcttggctgatgtttctttgtacgcaggcgtatcggtatccttatcagcatggctgcctgttaacaggttgatcgctgcttctcctgaatcgttcattggcagatatacttccttccctttgacacgatcagtgatcaagcacttcactttgacatttccgaaaggcgatgtgagtctgacaagggttccgtcctgaatccccctttctgccgcgagttcaggagaaatttctaagaacacttccggtgttttctttgaaatgccttttgatttgtaggtcaggttcccttcgtggaaatgctccaagagccgcccattgttgacgtggatatcatattcctctccgaactcttcaggttctgtccaatgcacaggatagagaatggctttgccgtctgggaaagggaagcgctcagtaaaaagtaaaggcgaatcctttccatcagcgcttacaggccattgcagggaattgtagccttcaagccgttcataggtgacacccgcataaatcggagacagcttggctgcttcctccataatgtcagcagggtgctcatagtgccagtcagcgccaagcttattggcaacttccataataatctgccaatccggctttgattcgcccagcggttcaaacacctgataaagccgctgaatccggcgttctgtgtttgtaaaggttccctctttttcaaggctcgggctcgcaggaagaacaacatcggcaaactcggctgtacgtgaaaagaaaatatcctgcaccacaaagaaatcaagcttttcatatgcggcgtgtacatgattgatattggaatcgaccagacccatttcttcaccttttacatacatcgctttcagcttgccagagtggattttttcgatcatttcgtggttggtcatgcccggctccttcggcagcggtacaccccatgcctgctcgtatttttggcggacttgttcgtccgtcactttttcatagcccggcagtctgtcaggcatgcttccgaagtcacttgctccctgcacgttgttatggccgcgcaatgggtaagagcccgctcccggttttccgtagtttcctgtcacaagcagcagattagagattgctgtgctcgtgtcgcttccgccaatatgctgtgtcacccccatggcccacaatgcgcacacactgtcagcctggccaatcatctccgccatttggatgagggtttcttgatcaatcccggttttctcctcggcatattcaagggtatacggcgtgaggcttttcacatattcatcccgtccgttcactctttcctgcaaaaagcgttcatcggccttgccgttttcaattaaatatttggcgatggcattcagccagacgatatctgatccggcacgcggctgaacaaacagatcagatcgctctgccatttcgtgttttctgatatccgctacgatcactttctgccctctcagcttatgagcccgtttaatgcgagtggacaagaccggatgcgactcagacgtgttcgaaccgataatcaacacaaggtccgcttgcgcgatatctgcaatcgaccctgagtcaccgccatagcccactgtccggaacaggccggcagtcgcaggagattggcaatagcgcgagcagttgtcgacattatttgtgccgatgatccctctcgccagcttttgcatgaggtaggattcttcgtttgtacatttagaagatgtaataaaggcaagtgaatccgggccaaactcctcttttaaatccgtgaacttgctggcgatcagcgttaacgcttcctcccattccgcttcacggaaatggtcgccttcgcggatcagcggctttgtcaagcgctcctcgctgttgatgaaatcccagccgaattttccttttacacaagtagaaatgccgttggccggtgcttcctcctgcggctcgactttcagaatatctctgccctttgtccagacatcaaagctgcagccgacaccgcaataggtgcagacgggttttgttttcttaattcgctcgtcacgcatggcggattccatatcagaaatggcgagaatagagccgtaacctgtttctacgccttttgtgatctcgatcatcggaacgcagcgtttcgtcatcgattcctgttaaatatccggcttctccctcattcctttttccatcatcgcattacatggacagacggtagaacaatggccgcatgatacacacgacgactcattgatcggcacatcattatcccaaatgacgcgtgggcgtttccgctcccagtcaatggtcagtgtttcagtcacctgaacgtcctggcacgcttcaacacaacgcccgcacaaaatacattgatccggatcgtaccggtaaaacggatttgattcatccttatggtaaggcttctgatcaaacgggatgctttggtgattgaccttcatttccttcaccgtattatgtatttcgcatcccccgttgttgtaatcgcaaactgtacaataaagctcatgattatataaaatcttgtccatcccaatgacctgcgcttttttcacatcaggtgaaagcgtatcaatgacgtctccatcctttacttcagcggagcacgacctctttagctcgccattgatgctgacgatgcacgtatcacatgtttcaatcggccctaagctaggatgatagcaaatttgcggcacttcaatcgaactgttattcaaaagctgaagcaccgtctgttcctcggacgcttccatttcaacgccgtttattgtgatttttttctgttcagccatctccattcccctttcttgcttgtgtatataccgaattatccatttctcttcccttacaagggagcaataaaacatacaaagcgcactcacatgttttattgcttcatcaccgggaaacgagaggatagatgaaaaaggagggatcagcatgaaaaacaatgcctgttctaaccgcggcaccagcattgacaagctctatttccggctttggagcagcgtccttttcaacatcggcaaaccccgtaactcaagcaacctcgctctctgaaaacacaaaccaatcagccgcataacatccgtatgcaaaagatcagtgtccgcaggctctccgtcttggactcgatattccacgttcgttttcttgtctctatcgtatgacaaagtggaaaagaaaaagtcccctattttatccccctttttgtcggatttttctcgggtttgaatataaaaaaaccttgaaaggccaaaagccaatcaaggtagaaaaggtgaatattgtttatattttcaactcattcttcattaaatattaatcatcatcaccaaataataactcatccaattcttctcggtcttttgcaatgccctcataggtttcgatcaagacatctcaagtgttatttctctatcattttcataaattttaatgctagctcccaatgagagtaactgttctataatgattactagtgatttcaattcttctgtgtcatagtaatcacattcaataactggttttcctgtttcaatcgcctgctttagttcgttaataggtttagatgatgtttttcttaataacgaaatgtacttagtaatatttgaatcattgagtacttccacataaatgaagtccatcaagataactcccctctaaattaaaaatctttaatatccttaatcggctttcccggaaggctatttttgtaatttccctccgtgccatctgtgtaaatgttcacttgttgttgctggatatataacttcacctttgtcacttaaatgagggaatttagaagcgctataactgtgatgtccttgcatagttttcccttcatactttgctctcttattgtttataatatcttgcgcctgctcctttgaaccaatttcttgttggagcttcaccattaagtattcttgtttaaaaagtcttagcacctttatctcgcttagctgcaaatttcttattccaagtatataccttgtattcttctcgagtaatagtcctattatctatttttgatttaagttcgattgatcaatggctttgtgcaacgcctgaacatcaagagttttcatagcattctcctctaatactaaagtgacataccacgaactgttttaccactttacggaaaggaattggttaataaatcctgacaatccgtgaaaatgaatccttgggatcaggtcattaaacctttgttgagggtttgaaatacataaaaaaaagccgctattaaaacggctaaaaggatattccaaaaactcttttaggttaaacaacaaaatcatgactggagggtgcgctgtgatgtttcttgaagctgtgttcatatcatcgttgttcgaaaaatgactgagaaaaccaagtccaattatcataatccctaaaccgatcttcattttagatttcatacaaacattccccattcaatatttgcttttgagcatagaccatctttttaagacagatgagactatcctctgtttctaaagcaaatcgatcagcttctcctcctattctttatatatttgcaaagtattcgacatcatctcaccaacagctttccatttcaatagatgtggcgagaaagaaaaaaaggcagatttcaggtctttctcaacttttgggggatgacacctactgtaagctgcatcatataacaggttaaaattaatattctaatcagatttcagttttcttctttcttccaattgcaattttatgcaataatgtacaagtgcttgttcatcatgttcatccatcttgataaattcaactgtcatgatctgtttgtttgttctccgatctatgtaagtgcgtttgacttgagcataaacgtcaatcacattttcatcatgtccctcatttggcagatgaatgcttaaatttaaatcctcttccgcttcgtgtatttgcgtctcttcaataattaacgcagcgcctccagcactgatatttgctgtatatgttttaaacattgaaccagatccatatgggcggacagtgacaggaatcgttgtatttactctaaaaaattgccgtctttgaatttttgtcatttgatcttcttcgggtaaatacatatttaatacaggtatatcctgatagatctctcgtccctgtattacactggtaaatttatatgggacttgttgctcatttataaagtgaactattgctactgtatttgttggaataataacagttctccctgtttcttcatcaacaggataatgtactcttaaaacattgtcctcaatggatagcactttgcttttcgcgaggacatactcttgaatttcgttttcaaattctattgttaaaatatttcctaaagataacaatggacatcactctttcaattctacttaatcattatatcggtactatgacacataaatttaaaaaagaaaaggagaaagcattgagaaattacgtaaacggaccgcttctcttgtgagactgacgatcttatcatcattcagttcagggataggtgtgtctcccattctatgcccttttttcggattaaatataaaaaaccttgaaaggcaatagccaatcaaggtcattcttcaaagttaatcaattctcaagtcaatttaggcatgaatataatagtctggttcttcttcatccattttcttgaaaactcttcgagtgatgccgcaattatcttgtcaaaatagtatactggacaaataccgttctcttcttcctgatctaaatctagagtcagatatgtcccctcaccgacttcaaaaaacactaacatgggtatagttctctaattcttggatctataaaatcagctacactatgagaatccattactctatctccatgagttttatcaagattacaaataaaaccatatcatactcttaaataaaactctcttagttcattaggaattttttctaatatattttccgcctaaataacattatattccagtcgatatataatatgttttttgcttttgactttagcaatttcgtctgattgatgttttaaatgttccagcgctttgtgcagcgcctgaacatccaatgtcttcatggctttctcttctattttgttttcatcgatgaagccagctgtttgtcggtgtccatcattgcttcgactgctgattccgtttggacgacttgttttgagaaagcagaggcataggaagaagcgatcttattaatcgtctgattcagttcctctatcttctttgtcgcatcaaggtgattctggcccttgatatctgtcggaatcgtcgctttcattgaatggctggaatgctttaatttagagagcgcttgtttgacttctccggtattcacttttatttcttgatccatttttcatttactccttgtctcgtgcttcccgcttcgcgttctcaatctttttctctaaagaacgaacttcctggctgagcgagtgaatatcttcttgtaaagatttgattcgttcatcgattttgcttaaaacatcagaaagctgttttccgcttatgtcattgtaagcagtcttcatcagacctcgaatacggtcaaaggagtcagcaagactgccttgccacgtatgagacgacagttgtggttcggtgatcgtctttttcgaatcagagaactctgttttgtctttttccagctctttgcggcaagctttcagctctgccaaaaattctttcttcatcgataaatcaactttcatgatatctaaagccagcgtttctcccaggattgaaccgatcatttgcaatacctcgcttcccaaaaaatgcatgacaaaagtaatgaccaactaagagtttaccactatacggaagggaattggtgaataaatcctttcaatccaacaaaatgaatctttaagaccagttccaataaacctgttttgaataaaaaaaagccgctaatgaaacggctgcaaaaagataattcaaaactcttttttaagctaaacaataaaatcgtgactgggtgcgcttgtggtgtttcttgaagctgtgttcatatcattgttgttcgaaaatcgaaaatgactgagaaagccgagtccaattatcaaaacacctaaaccgatcttcattttagactccatacatccccccttcaatacagatgaggcttccctcttttcacattataatccatacgagtgccgcctaacaatcgctgctttttactcgaaaaagacgttctgactaccgcacatagcaatctgcggtaaagattaagaactatagattaatgaggtcgattttaggtgagtaaaatgctcttgcagtttataaaggtggttcactatccctttccaaaggaattatgagatccctgggtgttcgcattaaatatttttcaccgaatcaagaaatactgataaaaaaaggtggtgctatatatggatttcccaatcattcatacaaacttttgggatgctgttacggcagtgccgattattttgatcgtcacacagataattaaaatctttcttaaggttcccaaaaagtatgttccatcaattgcacttgcactaggcttaatcatatctgtttgcataagtcatcgacacagcctcatagctggagtatttatgggcggattctatggttgcgcagctattggttcatatgcatcattgaaaacgacaatttcatcatatagaaacaaaaaagcataaacaggcatgaaaagattggttccagagttcaattcgctttttcccgcttcaccggttaaatcagaagcagctatacttgctcctttgcctggttcatttccgcttttctccccagaagaggtatcatgctctccagcgtgttcgcctaacgaataagccccttccgtcagccgcttgtaacagaagaaaattgaagccttaaatcactgaatggggagttctcgccccttctttcacttgttctcttcccttgaataggcttgcagtttgattcactcgaaaaaaagcgaatgaataccttctcaacagacagaataagaagagttggtattccaccatattttgggcgaaaggagtgaaatcgttgtattgatcaaatgagaaatgaatatgagactgaaatgcctttcagatgacctttttacctaaagaacaaaatttcactgatatggagtgattaacgtgcctcaaaaaaatggagcagacagaccggatgattacaaaagattttcttcactagacaaggaatatgattctcagcaatctttagacagcaatgctaagacagaaaacgtaaacactgaaactgataacaaagaaaacacaactgacactaccgatgtggccggaaaatatttcgacccttcggattatgaaggggctactcaattggaaaaaggattagctgaaactcatgaacaggtcagtgatgactattttgaaggaacgatcgatcaaaatttggattagcgattcaaacggaactaactctttaaagttagttccgtttgaaattaacaaaaaatgactgtcctctaatcaattattcggtcaactccaaaagctatagccgaattataaaaatgcgtctgtttgatcagatgacatttgtctttttacagcctatctatatatatataacttatccgcgaaaaaagtttgataaaacacacacttaccgtttatgaccaagcattctcacccattccccgttatcccctcgctgttatttgtgcacctttataaagtcatgattaagctaatgtctactttgtgatccaaattcttcaatcgtgatgttcacatcatattgaatgggggtttctgtgaatacttcatcccaatttttcttcagctttctccaaagaaagggatagtggatcctcacttcatcaccgaagccggcaaggtcggctttatattccttctgcattttttctgtgatctgctctaccagctgtttcactgtttgtgacgcactttcttcctttcttttcaaatattttttgtcaattgccgtttcggttgtattccagttttcagccaggtgtgcctctgaattaatattcactttaaatgagaggcggtttcctttgaagactggcttgatctcactcttaaggtgatcgactgacatggccgtcaatttttttgttttttgatcatagtttttgacagtgccccctaccccttgtcctttgatccacatgatcccgtctaaatctttttcatctaaaaaaccaaggagcttatttgtttttccgttaatggcaacagctcctgcatatttgacttccccgtcggcaccaaacaacgattaagattcagatgatgcacctatcaggaagatttatgagtttaagcattaaagattttgaaggggactggcctgaccgaaccgctcaggatgtcatcacgttgatgcctcgaacctacaggctttattttgaaaattccgaaggcgaatgtaaggatattcgcattaaaggaacatacggggccattccgcaaacttatgattatttctcggccttcaaaaagactccgggaaggacaaccctttttgccaaatagatacgaacaacaaacggatgaggggggacgcatttgaaaaacttttggacatacgaagacgaagatccatacaaattaaaaagcatatcagagagagatattcaaaaagctgaaaaaaagttaggtgtgaaacttccggaggaatacaaagcgcttattcttgaacaaaacggcgggtatatcaattttaacgccttcccttctgaacggcctacctcctgggctaaagatcatgtccagtttgactacttattaggcttagggaaaaaggcagggattctcgagagcaaatacatcattaaagaatgggaactgcccgacaacctgatccttattcacggtgacggccatacatggatagcgcttgactacagagaaacgaaagaaaatccgcccgtgcactatttcgattcagaatttgaagagaattataaattagcggattcatttggagaatttctctctaaactttatacagataatcccatggatgatgacgactgccagcttatcgaaggcgtgcatcctgacattccctatgtctatccggaagatgccattacaaaagaagaagctgaacaaattctgactaaaaattcggcagccgagctgcatcagcttaattactaccctattgaaagtattgatgatttaaaatggcttttgacaaaaatgaaaaaatccgctttaaaagcagaccgtgacactggtttggcacttgccggcgctttggaagccgtcatttcttactataaaaatttaacgtttgaggatgaacaaacaagaaggtcagtccgcgatatcttggtgatattagagaagttgaatgactctactgtagacatatacttatcccaaattgacgacttattttaaaaagagccagcccctttatatcaagggctggtctttttagcatttgagaatctgtttcctaacgttttagtttccagatgatacgcggctgtctatgaggcctttacttcattggtcagatatccgttttttcgcataaccaatctggggtcttatttgcaaaggcgcatcatgaaactgtttttcttaaaaggcgccctcaggggatcggaataaaatatgatctcttgcttccagcgctttttgtctcaccttttcaagatctgcatcaaccagccggccgtttcgtttcaccgcttttcctgcgacatatacggaatctacatttccggtgtgcgtgcattggacgatggcccccgccgcatcagtgaaagggagcaaattgacgctgtccgttttcaccatgataaagtcagcttctttgcctggggaaagcgagccgattttatgatcgagctttagggcgcgcgccccgtcaatggtagccgctttcaggatttgttcggccgatatgctcaattcgggccccggcataattccttctctcagcagttcatcattgtgctttgcgcgttctgcttgaagagcaaatttcatctgtgcgaaaaggtctcccccggtcgatgtgacaacatcaaccccaagcgcagtaagaaccccgttttttagagagagccctgtaacaggatagccgtgccccatcatcatctcaatttctggtgtcacagatatcgagcttccgtgagccgcaagcattttcatttcttcttcactcatcgcattggcatgcaccatgtttaaatcgggaccaagcagcccggcttgattcagcttttcaatcgaacgatctttcgctccccagttgccaaaagcaatatgcatgctgcataaggcatccagttcccgggccgtttcgatttcaaagacagatgtcttccatgaagaaaactccggacctcgaattgcaagccccatcgtcagaagctgatccttcgattgaaaatatgctttttttacccgtttcgcttcgtccatattcgaaagatcgctgtctctgtcccaatattcggcgtcaccagatgttccaaaggcgaatactgcgcgaatgccggcgtctttcagtccggcaatcagctggtccgtatgatcaggcgactcaatcatcgtccagtccagcaaagtcgtgacgcctgcatcgagcgcctcaagcgctcctaaatagttcgcggcccaatcatcctcaggtcttctcatcgacccataattcccataataaatccggtttaaataggtttgcagggaccagtcggctccgattccgcggatcacagattcccatacgtggcggtgcgtatcaacaaatccaggcatgatcagcatattggaggcatccacaatctcagcgtctccggcttcaatcgactcggcaacgtccagaatgacggagccttcaatcagcatgtcccctttttcgagcgtatgaagctgcggatcaagcgtcacaatcgtagcattttgaaaaagcgttttttgcataacggctctcctttcttcccaaccgattagagaaaataacatcctatatgtaccatattaatataaaaaaggtataaatgacattaataagcattccgcgacttcgaacttcgtctgcatttttcattttgccatatactatttttctgctgttcgctataacctatgttaaacgttgatatacatggtagctcccttataaaataggaacagaccataaaagacccctgccgggtatttatatggtctgtgaaagtacaattaagccttaattaatagcaatggccgtaatccgattttttttcatagcttttgcaaggttttccgcaatgatagtgttcatgtgaaacatctttatgatgtgagtaagtgtgcggatagtaatgaacatgttcatacttgtggtggtctattttttttgtatgctgtggatgaatatgaggaacgacagattttgagtaatgatgatcctcacaatatttcgtagggtaaacatgcggctcatgatgtttgcaatacattcgtacattctcctttccctttgttttatagattcactagtacattatgctgaaaagctaaagcccgactgcataagcacctatgctttgtccctaatttcgcccgttcattttctaaatatcgtttttggaaaatctgttttatgactatgaagcatctgcggttgaatcccattgcttccagagttaaaaaaaagacactaaacgaatattttaaatgttcgcttaaagtccttcacctccaatgaacattgacgggctctgtatgaatatgcagctctttttttgtatcaaaatgaacaacaaagcctctgattaatccatagaacttgtttttttctgtaattttcattacggtcgcttcgtctctaaatcctggcggatggcatcgctcaccgacgatatattgctttgaatgaacggtgattgattggattgacttcattaaattccattccccctcagaaacgtcatgctcccctctgcttctgtgccaaacggagatacaccccgataaaaatacttgcacttcgggtatttttcacgcttcagggtgcagaagcagtctcggtgattatcatcataacatgattatccaaaatattcctctctgctttttgaacattatgtggcagctcctcaatataaaatcaaccgataaattgcgttaaaatccgattgaacattttgcgttcctcccagaatggaccgtgtccgctgtattgaaacggaacaagatatgaatttctgattttgcggctgagctcctttgcttgtgcaaacggaatcaccttgtcttgaataccgtgaatgattaaggctggagcagcgactttttccggatcatcatacagtttctcatctctcagcatttcgatgaccgcttttgtcgaccagcctgccgcctgcaatcccaattgaaaaaaacagtctgagaacggttgtgtaatatattgaaagaaaaacgtgtcggtcacttcgcgcatcatcttgggacgatcgttagacgcttgctgaagcaatttggctgccgtttcttcagtaaatcccacaggcgccgccgcatcgatcaaaaccagctttgagaccccagcgcccctatatcgggacatatagcggagtgctatggcgccgccggttgaatgaccggcaagcgtgaagttgtttaattgaagcgcctcaacgacagcgcggatatcatcagccaaacggttgtaattatagcccgtcgccggcttatccgaacgcccgaatccacgccagtcaatgccgatacagcggtatccctttcgcgaaagatcgtcaaattgatattcaaactggagatggcttaatggccagccgtgcaaaaatacaatggctttgccgctttgaggattgatgtcttcaacgtacagattaacgcttggttctgcctcgataaaatatcccatgccgtcgcccccgatcatgtctttaccataagatactcccaagatgtaaataggtgaatgtctccgagggctgaacatgaagaatttgaaaaggcgtgactggttaaactatttcaagaaacggagggttgttcaatgatggcacttctgagaagtctggcgatatcgtttgtcctcattctgcctgcggcagcggcctacgcacaagtaccttatccatgcagcgtcgttcttgatccagtccgagatattcccaatgcccgcggaacggctttaattgcgaaagtgaagaaaccgtataccgaagcccccgggagtcctgtcagggaaaggcagagtgtcggcatctacgctgattggcttccggaccctgcttcatttggagattatgatcaatttgaaggaattgcccggatacctgaccagatcagctggcgtttcaccatgcatcaagtccaagaagacgcgccgagctggtttggcggaagtccttgggcgggcaaatttgacgaaatatcatcagagctgactgtgaatacccaagtcgaagtgcgccctttcaattcgaagacgaaaaaggccggcgaagctgttttgcgtgggaatttgcaaggatgcaggagctaaccaaaaaggccgtaaaagctccatggggacgcttctacggccttttttcatgtgaagaattttttcttccggaaaggttagtatttttcgtagcgatcgcaaggtttaccgcagtaagagtggtcatgataaaccggcttatagcttgaataagagtgcggataatagtgaacatgttcgtatttatgatgatccacttttttaatatgctgcggatggatgtgaggaacgatcgttttagagaatctgtgatcctcacagtatctagtaggatgcacaactggcggcagaacgcgcggtttgcagtaagacataagcacttctcccttccttaggtttcattcttcactatcagattatgttgattagcacaaacttgtactaatacaagaaactaaaaatccgtccattttccccgcctttttgctaaaaagtgtttctcagatgctataataataaaaatactattgaaaatggagctggacagatggacgcgatatcgatcgtttcttttttgggtgcggccgtactgctaacacttatgccgggccctgacaacctgttcgttttggcacagagcatatcaaagggaaaatcggccggtatagcaaccgcatccggactatgcacagggctaatcgtccacatcacggcggctgcagcaggcatttctgctgcgatctatcaatcagctgtcgccttctcgattgtaaaatatgcaggtgcagcctatctgctgtttttagcttaccagtcttttcggcaaaaaagcgccggtttcaacgttgaaaccaaagattcattgaaccgcagggctttatatcaaaaaggcgtggtgatgaacctattaaacccgaaggtctcattgttcttccttgcctttcttccgcaatttatccaccccggcaccttcaatgtgacaacgcaaatgcttgtttacggcatgttatttttgattcaagcgttcgctatctttgtgatgatcagcctgtttgcggaaaaagtcggagaccggctgcgcagaaatccgcaagccgccaaaaaagttcatttgctggaagggtctttgttcgctttgatcgggcttaaaatagcggtcagccaaaggtagaaccgctgaaaaaaggtatgcagcctgcacaccttttcccggttttattgcttataaatgtgacgcgtttaccatttccgccgtcgtcttcgttagtaaacggtctcaatgacacggcggcatctcatccttaaaacatcgaggttcagtgaaaatgaacagccctgcattccgttttcgttttcaagtttgatcgtttgggcgggaaatggtgttgcggaaacgaattgatttgttcttcagctggagtagatcacaaggctgtcaaattctacagcgctttcttactatgtttgattccttcttcgtttcattgcatagtggagtgccagacaatgagacaaaaatttaaataccgtttttctctatactcccccctttctttgatgccagtatacaaatttacagccgctgcgtaatgatgcaaatcggttattttccgctcaatctaaatgatcagatcgaataaagcggactcattgatctagggacggcagatcagtcaatcgataggtctgggtcttttttgatagaaaatgccgtttgcctgaggtaaaacgggatcgttgattggcatatctgctataaagtcttcgctttttatcagcaaaaaagactcgaacagcgagtcttttcaatttatttacaaatgatattttaaatgttataataaattgtttacaaaaataaaatctatttttatttatataaatcgataaatgtaaaaggaggtaaaaaagatggccaagacttcaatgattgtcaagcaaaaacgggaacaaaagttcaaagtcagagagtacacccgctgtgaacgctgcggcagaccgcattccgtgattcggaagtttaaattgtgccgcatctgcttccgcgagcttgcttacaaagggcatatacccggcgttaaaaaagcaagctggtaaaacgatttcgccagcccaagaggctggcttttttatttagctctgttaaattttaatattaatacttttgttcaacatcccttcagctcaataagaacgatttaatcagttgctcattatacacactaattgagtgtaaattctcttttaataagctatcagtgatttgctttattacattcggttctcgtaagccttcgttttcaaatgttacaaggtcatttactgttatccacttgctgtctgaaatttcatcttcttcgagatttaaagaacctccagtaacttcgccgataaaatgaaataaaataacttgattgttcgtactactgataaaattatatacacctgtagtggcaatcagatttacgtcgaatccagtttcctctttaacttcccttcgggctgaatagagaatgtcctctccatattcgatacgtccgcccagaaaattccacttattaacagaagtaggtttattctcttttatcatcaagactttatcatcactaaagatagatacactggctactaaaacaattccattttgcgacatccatttctcctcaatttctttggaaatgatattatctctataatatctgattcgcttcttctaacaataaccgccttgtttttgctcgccttgacaacgatatcgaacgcacgttcccattctggttatatcaaggattcgtataggtatcaaatatcaattttcctatataaagcctttatttaaaataactcaggagccgttgccgtccaatatttgaacaaacccgtttgttccgtcgactcggatgtaagcgccgtcttctatgatttctgtcgctttgtcgatcccgacgacagcaggaatgccgtattcccttgccactactgaaccatgggtcatcatgccgcctacttccgtaatcagtccgaccgctgaagtaaagagcggagtccagcccggatcagtatacggcgccactaatatgtccccttgattcagcttcgcgtcttcaggactctttgcaactctggcggtcccttcgatgattcccgcggaaacaggggtacctgtgagagcgccttcaggacttttttcatttcgcagctttcctgtgatgatctcccctttactcgtcatcacgcgtggagatgtgagcttttgattggacgtatgctgccgttttctgtctgttaacaattccggaatatccccgatgccgcgattctccaatagggcgataagctcctcaagcgtaaagtaaaagacatcttcttcacaattcaaaatcccttttccaacgagggtgcgggcttctttaagaatcgcttttttgtataaaaacatcagttttacaagtgtaaatttatgatgctcccgcattcccatcaagcttcggtacatatgaacgagccgggagactctctttttttctggaaaacgaaattgagagatgatctccttttttgcctcttccgcttcggtttcaccttgtttaaatttccttctgtgttccccggcggcaatcgtccgaatatggctgagtatggacggaacgagctgaaccggggcctcggcccatctcggccttgtcaaatcgatttctcccacgcaccgcatcccgtactttttgagaaaatcgtctaaactgcgtttcatttcggcgccgccggggattttgagcagttcttccataaaattttcgctgtttgcacgcttgaaatagtcaatgacagcaggatactttctcgcctgatcggaaagatctcctaactctagacccatttccgttgtgacattatggggcagggatttatacaatttccccagcaaaatagcgcttttctcgtcccccagcttctttttcagctttttttcgagcaatccggctgcaatcattccgctcaagacatacacagcgacttttgaaagcacgtcttgcaacatgtttcccattcctttttggatgacgcggatcgtctcagcaccggaagtccggctaagctgctcttcggtgtccgtcacgatcgcttcaatgatcaattccgcttttttctcggctttatccggatttctcatgagcaggattccggcaacttttaatgctgccggaatcaaaatcggcgccaaattcccggcaatatgaaaaatgccttttgtggatgtggaatatagctgatgttctttgcgcttgactacctccgatacagctgatgccatcaactgatccatgccgctcaatactttaagcagccggcttcggacgaatttgagggagagagcacccgtaatatcggcaaagactcttcctcccgcttcgcgaagaatcggctgtgccgaaggatctttttttaaaaatcggaggacttggctgataaccgatacacccaatggtttcagcggatcggtcatcatttggatgtagccaaaattaatcaatacgtgcggcctatcatcaaaaaagcgtacgaccgggtaaagggatgtgatcggccggctttgaagaatgtaaaacctgccgccggcaaaagcccactcgatatcctgttccttgccatagtgagcctcgattttgcgccccagttctgctaattcaatgattcttggatccggcaaagcctgtgtttgttgtttttccggagagagggttttctggacggttcctccctctggtacggagtaaatggccgattctttcttagagagttgttttttaacgatttcaccagaccgaatctgatacagatcagcgctgacgacgccggacaccaacgcttcacccaagccgaagctggcatcgatggataccgttttgcggtgccccgtgatcggatccgccgtgaacataattccggaaacctcgggaaaaaccatctcttgaacgacaaccgcaagaaagacagagcggtggtcgaaaccgtttttcgctcggtaggaaatcgccctgtctgtaaacagcgaggaccagcattgtttcaccgcttcaagaagctgatctttcccgcagacgttcaaaaaggtgtcctgctgtcccgcgaatgaagcatctggcaggtcttcagccgttgcgctggagcggacggcataggctttatctttgccggtcgtatctatgccctccaatatcgccgatttgatctcgtcaggcatggagatctgagcaagatgctcacgaatttgtttccccacagtccgaatctgttcaagatcatcatgtttgagctgttcaagctgatcgaacagactgtcgatgatgccgcttgtttgtatgaacgcacggtaggcttcagttgatatgcaaaatccctgaggaacgggaaagcccgcttttgtcatttccccaaggttcgcccctttcccgccgacagagggcaagtcaaattgatcgatttcattgaaatacagcacgtatttctccattctatcctctccttaaaatccgctttttgcagcaactttacaccgcattttccagcgtgacatgcatcaatattcagctcaaaccatgaacagatgcctaacgcggcataccttctttatacgaataaaataaacactatgttgattaatattcatcatgtttattataattgcgcaaaaggagaacgcaatgaacaatcaatcggcaaatgttaagttctcaacacaaagatggaaattgttgattttcatgaaccgtcaggaggatttgaatgactgagcagaaaaaagaccgcagggtaaaacgcacgaaaaaaatgattagagacgcactctctgaactgatgaaaaataaagcgtttgaagagatatccgttacggacattacgaagaaagccgatattaaccgcggcacgttttacttgcactacgaagataaatacgatttgctggaccaaagcgaggaggaaatcatccaagagatcaataaaattgctaaacgctcgattcactcaatggatgtattaaatcaggatgtgattgaccatccgctgacattcgtcgtcgacatttttcaatatataaaagaaaacgaagtttttatgaaggcagttttaggccctaaaggcccgggttctttccgtttaaaattcaaatcggttttgatcagcaatttaaaacggctgaaaacagcgatcagaacggatccgattgtaccggaagactacttgatttcctacataaccggcgctcatatcagcgttatgcagcaatggcttgagaacgggatgaaagagacgccgcatgatatggcgctgattttatcaaaaataaccggaatgggccctgcatatgcggcagggctgagaaaaaaatgaccggctttcaggaagagggataaccctcttttttgcttttttcgtgttatgtataagaaatcaataacaatccaaaatatagtgaaaaaggtggtgagaccatgcagaagaaaggtattcaaaacagcagccttgagcagctgaaaaacgatcacgaaacagaaagcgcattccagcaggatgacaaaaacaataaacagcaacaaaacaggaatgctttaaaataagctgaaaggtgaggaaacgaaatgaagcatgtaagagcattgtgtttaaaattcattgtgagccttgtccttttatatgtggtcctaactctgttttttggcgttccattcggtgaaatgtttgttttgacattgtttctgggtgtgatatcctatctggtcggagatcttctgctgctgccgagaacaaacaatacaaccgcgacaatgggagattttggcctttcactcgtattgatttgggtgattctcgccatgcaaaataatcccccgtatggtacgcttgctgcagcttcaatcgtgtcagcgatcggcgtcacagtgttcgaatattttttccaccgctatatggaagccaacgtcttgaacgaaacagaaaacggaaaacgggaaaacagagaaaagcctggttcattgcagtatcaaagcgaatcatcagaggagctttatccggttacccactctaaaaaacaggacgaagaataagcatgaaagcctgccgacccggcaggtttttttacgtttatgaccagaggcatttttcattgattaaaggaatatccgtctttttcacgaattgatataaaaaagtgaggaggacaaaaaatgacacatagcgcattaaagcatttagattatcacaattgggcgaatcaaagggtgctcacccacctgaaaagcctgcctgaagagctgttcacccgggaaatcaaaagcgtttttcaaactgtatctgaggttgttacccatatgtgcgtggctgacgccttatggctgaagatcatatccggagccgcttacgaggaagcaaaggaaacaggcatgcgtctgaaagaaggattaaagaggaaaaagatcgatgacttcatttccatctttcatgacacggcgcttcaatatgaagcgttttttgaaaatcttgaagaccccgatggtgaaatcacgattgcccatccaatattaggcgaaatcaaaacgcctattagcgaaatccttcatcacgtagtcaaccacggcacttatcacagaggcaatatttcagcgatgctgagacaaatgggtgaagcgggtgtgccaacggactatatttattatttattaagcctgaagcaaacgacataaataaaaaaacccttgttccgtctttggaacaagggtttcacaattaaaatgatgctgcaagctttttagcttctgctaagccgttttcaataattttttgagcgtcgtcaggaacagcgttgtgtccttcgatgacaacggtatgcaagtcttgaacaccgaagaagcccatgacggttttcatgtagttcaacgacatttccattgcagccatcggtccttcagaatagaagcctcctcttgcatttaacagagcaaccttcttatctcccatcaggcctttaggtccttcaggagtgtatgtaaacgtcactcctgcgcgggacaagtagtccacataagtgtgaagtacagctggaacggcgaagttccacaatgggaaagcaaaaacaaccttatcggctttgacgaattcgtctaagtaacgatccgctacagcggcggcagctttttcatcctcgttcaattccatgccttttcctgctttaaatgtcccgttaatggcatttctgcctaggtacggcgggttttctctgtaaaggtcaagctctacaatttcatcgtttggatgattttctttatagctgttaagaaacgcttcataaagttttacagatacagcttcttcagctgtacggtcattagctttaacaaacaatactttagacattctattttcctcccgttgctaacgttttaatatttacttacaaatagtatgttactttcatttaaatagaaagtcaactcatttatttttctaaccaaaaaaagcacccattgggcgctttatttggagtcctgttcctggtcaagccgttcatagacgtatgaatgtttttggtccatcgtttctttattcgtcaaatccttcatttgccgtgtaaattgccgatcattctctgtgcggtcttcttgtcttgcttccgcttgagcttcggcggttcttcgcgcatatggaatcgcttcaaggcgttcataggggatttcttttcccgttgtttcacacgtgccgtatgtgccgtctttcatcctatttaaagcgtcttcgatctctttcagcaaagcatcgtccgattgccggaaagcctggtccctcattcgttcggtatacacgccggcatggtcggcaagatgattgtcaataccgtttgacaattcgcctgtttcttcattcatcggctgcacctcagactttgtacctgtgatttcgttttttaagctgattaatttatcgtaaaggtgctgtttttgttcctctgtcaatggcatgttgatcatcctcctttctttttcattacccgattgccaaaagggaaaacgtgcatttctccgcaaaaaaagaccgttcattcgcaaaggagcgtttgaacagcctgttgagattatgcacataagtattttgataacagcgcttgaatttcaagcatgtcggtatccttcgtaaattccagatcaaagattttgctgctggtcatcagagaaagagaactgtctggattgaacatgctgacttctctaatcgcaaagccttcaatcgatctgtaaggcaggaagacgcggactttctttttagaaacagtttattatcaaaaaaaataatccgcttgttcgtaaaacatatttgatccattcttagtctgcaaaccgattcaatttttctccttctataagcagcggttcaaatttttgccgtctgctgttttgcttgctgaaaaaacgcccaatcaaaacccctctttctatgtgtccaatttatgtttatgcacaaggcaaagtatgctgtcagttaataataaggatacgataaccctgatttataaacaattacgagcagattacatttctttaactctatatgtttgtttttactatcaattaatacgcccggcggacgcgtgaggtttcaacttttcatcagttttttcagcttatttttcgtttgctatgaatcaaaaggtgcatagcggatacagcaaaaaaccgcagcaagatgttctgcttctgcggttctcctctgacgttattatgccttttatgtacgtcggcacttggtcacacttccgattcagccagccgattttttatgaaagtgttcggttttgttgaaactttatgcgaatgaattcaggcttttacttcttcaaagtattctttgtaatagccgccgactttgtttgtattatcgatgataaacaaaaattctcccgtttcgtttttgacctcgtatatgttaccgacggtcagcgctctgttgacgatatactttttggcatcggtatgtatgcactttacttttttaatggttttattgttctgccatttttcatgaatcatgtggatgtctcctttttcatacgtgtatagtttccattgtagcgttttttcgccgaaatgcaatgcgctctgtcggcgaatgtggtttttgccaaacatgaatattgatttggtttcattccctgttatagaatggtggtgtatagttccaaaatcagaaatatatccctctttcatccgcgtaatgaccgaactaaaagacaaaccagcaccaagacaactcacctgaagacagaccaaaattttaaaggaggtttgtttgacaaacatgagttcattaacgatgcaggtcagtaagaagctggagtcatttttgcagggaacaaagaagctctatattaacggggaatttgtagccagcgcctcaaacaaaacgtttgagaccccaaacccggcgactggtgaaacgctcgccacgttatatgaagcaggtcccgaggatgtggacaaagctgtaaaagctgcgcgggaagcctttgaccgcggtgagtggcggacgatgaaccctgccgaaagaagccggctgatgtacaaactcgccgatctgatggaggaacataaaacggaactggctcagcttgaaacgctggataacggaaagccgatcagcgaaacgaccgcaggcgatattccgctgtcaattgaacatatgcgctattatgcgggctgggcgacgaaaataaccggacagacaattcctgttaacggaccttattttaactatacacggcatgagcctgtcggagttgtcgggcaaattatcccttggaacttcccgcttctgatggctatgtggaaaatgggagccgcccttgcagccggatgtacggttgtcttaaaaccggctgaacaaacgccgctttccgctctgtatttagctgagctgatcgatgaggcaggcttcccgaaaggcgtcatcaacatcatccctggctttggggagacggccggagaagctctgaccgaccatgcccttgtcgacaaactggcattcacagggtcaactgaaatcggcaaaaagataatggagaaagcggccaaatcggtcaaacgtgttacccttgagctcggcggaaagtcgccgaatatcatcctccctgacgccgacctgaagaaagcgattccaggcgcactaaccggcgttatgttcaaccagggccaagtttgctgtgcgggatcgcgcgttttcatccataaagaccaatatgacaaagtcgttgatgaaatggccgcttattcaaaatcgctccgccaaggtgcgggccttcatgaagacacgcaaatgggaccgcttgtcagcaaagaacagcatgaacgcgtcctctcgtatattgaaaaaggacgccaggagggtgcgaaaatcgcggccggcggaacatgcccttatgaacagggatactttgtttctccgactgtattcacaaatgtcgaggatgagatgacaatagcaaaagaagaaatcttcggtcctgttttggcggcgattccttatgaaacggttgatgaagtcatcgaacgggccaatcgcagcgaatacggcctcgctgcgggcgtatggacggaaaatttgaaaaacgcccactatatcgccgaccgtctgcaagccggtaccgtttgggtcaactgctataatgcttttgacgccgcatccccattcggcggctacaaacagtctggactcggacgtgaaatgggctcatacgctctggataactatacagaggttaagagcgtctggattcatacaggcgaataactcgacatgagcttctgcagccgccctgtcgatcagggcggttttcttttttatagaaataaacatttatagatacatatggtaaaatagatgacaattcaagtcgactggaatgatagaatcgtgtattcttcctctcttggcataaccgtctggaaacaaaaaaactttagatacatatgggcgtcgcaaacagcgcaggctgtcggatcaatcttgatgacgatcattgtcatggtcgatgtatttaaggaaacgaactctgtattcggatccggtctggttttggctttatcctcgttcggcagtgtattaggcggagcgatcgctgcttttgctattcagcgtctcgatctgctgcaaacagcggcctggtcaacatggttcagagcggtctgtgcattatgcatcggcttatgccaatcgcttggcttaccctcttatatcatttatctgctgctatttttgcaaagctttgtcggctcctggtatactcccgcacagttaggtttactgtaccaagccattaaaaagcgcgattacgtggctgcatcgggaagcatcgtagcggtcaaccagtttgtccaggcggcaggctggggtctcggcggctttttaaccgttttggcccagacttatacgttgacagtgtttacagcagcactctttttcatatcagggcttttaatcagattgccggatttcaaaaaagcgattatccctcgtcaaaaagcccgcgcacaatcggtctggcgcactgtttacaggaagaaaaccgttttgctgcttacgatgatggacatgtcggaaggtttagcaaatgcagtctggacttccgccgttttgctggcttttactaaagaggcgctgaataaaggagaggcttggtggggattcatcaatgccggttattttttgggagcgattttgggcggcattctcgctgtgctcttttccaaccagctcaaaaaaaggcttggcctcatgattttctttggctccgtttcaatgggcatcacaacgcttttattcgcctattcgtccaaccccctcctttcggttatcctctgtatcatgatggggccgctttatcaagtaagagacgtcagccagacggttatccttcaagatacattgactgatgaagagcgtgcaccggttaccgccgccaaaaataccattttggctgcatggtctatcataacaatcgccatcatgggggctttggcagacttgatcggggtacgaagcgtatttatcgctgccgctgtattatatgccggaacagccgctgccacatttttcgtccgggatttaagaacgtacagccaatctgcaaggcagcagacgaaagggaaaatagaaggatgaagctgctgcggttttttctcattaacgggatatttggagtgatcgtttttgaaataaaagaagcacagcggcgctgatcgccggcggtctgtcttcggcggcgtttgcagctgttcagcaaagattgaataataagaacaaacaaagcggcgatcaaaaaatcaaatgctcccgcgtcctccgattcagcgggacatcagctcttcgtattcccgcttcaatatccccataatgatttcatccgagtactgctcattcatataaagagcctccctgatccttccttccattttaaatcccgctttttcatatgctttcagcgcgcggatattgtgtgaaaagacttcgagctggagggggttaagatcgagcctttcgaaagcaagctgcatggccagccgcaccgcttcaatcccatagcctttgttcaaataagcggggctgtgcaaagcaattctaaaccccgcttttcgattcctccggtcaatgtccataatggacagatcgcctatcaaacgatcgtcctcctttaagcagacggcaaaatcatagcgcgtctcatcactcgtgattctctcatagtgctcataaaggtcttccatcgtatattcgcgcgtcgtgcccgtcatatacctgatgtcttcattttgaacggctttgtaaaagctctccatatcgcctttttcaacaggtctgagataaaccttgcggctcttgaacatcgaacgcccctcccctgctacttttgatacgcggcaaaccaatggtatggctgtatttcctttaaagttttataaaccaggcgcccatccggtacagttacagctgctttaagatcaggaccccaataaaaaagtctttcctggcataccccgcacggcgttaataccttgcattcggaatgttcgtcgtctcttgcaacacaaacagagtgcgttattttcgcctgatacttatgggcttcgagaatggcgcccgtttcaatgcataattctgttgaagcgttgattacttccggggctacgctcgttaagattcttccgtcctcggtatacatggcggctgccccgccccatccggtcggatacctctttttgatcaattcgactgcggtgtcatacagcatctgttcaatattcattcatcaacatctcccaaccattgtttaatctaaagtctctctttatacaatacctgatgttggaacgggggtaaatgaagttattaaagacaaatcactacactcacgattccctgataatgcccaccgcctaataaaagcgcggcgtgcccatgctgacttgacgactgtatcctcatcacttatttaaaatctatgttcttctgttttcacccgattggcatgacacatttcccaaatgaatacagtaagatgaaggagatgagaagattgcgatctatactagaagacgtgaaagctttcaggcaaaagacgctcgcagagcttcaaaacagacaaagatctgatggttcgtggcggttttgttttgaagggcccgtgatgacggacagttttttcattctgatgctgacatcactcggcgatcaggactcttctctcatcgcaagtcttgctgaacgaatccgttcaaggcagagcgaagacggcgcgtttcgcaatcacccggatgaaagagcaggcaatctgaccgcgacagtccagggctataccggaatgctggcttcggggctctatgaccggaaagctccgcatatgcagaaagccgaagcttttattaaggacgcaggcggattgaagggcgtccactttatgacgaagtggatgctcgccgccaacggtctgtatccatggccgagagcctatattccgctctcgtttttgctgatcccgtcctatttcccgctgcatttttaccatttcagcacatacgcaagaattcattttgtccccatggccattacgtttaatcggcgattctctttaaaaaacaaccaaatcggctcgcttcggcacctggatgaagccatgtcaaaaaaccctctcgaatggctgaacatccgcgcctttgacgaaagaaccttctattctttcaatctgcaatggaaacagctctttcaatggccggcttacgtccatcagctcggatttgaggccggcaaaaaatatatgctggacagaatcgaagaagacggaacgctatacagctatgcgagcgcgaccatgttcatgatttacagcctgcttgcgatgggaatatctaaaaacgcccccgttgtcaaaaaagcagtcagcggaatcaaaagtcttatttcatcatgcggaaaggaaggggcccatttggaaaactcaacttccaccgtctgggatacggccctcatcagctatgccatgcaggaatccggagtgcctgaacaacattcttccacctcatcggcagccgactaccttctcaaaagacagcatgtgaaaaaagcggactgggctgtctcaaatcctcaagcggtccctggcgggtggggtttttcacacatcaatacaaacaatcccgatttggacgataccgctgcggcattaaaagctattccgtttcaacggcgtccggatgcatggaaccgggggctcgcctggcttttatccatgcaaaacaaggacggagggtttgcggcatttgaaaaagatgttgaccatccgcttattcgaaatctgccgctcgaatctgccgctgaggcagcagtcgatccgtcaacggcagacttgaccggacgcgttcttcatctgctcgggcttaaagggcggttcacagataaccatcctgcggtccggcgcgccctcaggtggcttgatcatcatcagaaagcggacggctcttggtatggcagatggggcgtctgctttatttacggtacatgggccgcactcaccggtatgaaagctgtcggggtttccgccaaccagacgtctgtcaaaaaagcgatctcctggctaaaatcgatccagcgtgaagacggaagctggggagaatcttgcaaaagctgtgaagcgaagcgttttgtccctcttcactttggaacagttgttcaatcttcatgggcgctggaggcgcttttgcaatatgagcgtccggatgacccacagatcataaaagggatccgttttctcatcgatgaacacgaaagctcgcgtgagcgactcgaatacccgacgggaatcgggctgccgaaccaattctacatccgctatcacagttatccttttgtgttttcattgctcgcttcaagcgcatttattaaaaaagcggaaatgagggagacatattgaacagagatgcttacaaagaaaaaatatcgtcatgggccaaagacctgaaagaccagatgaaagatgatccttctttagaaagccatttagaaaaactttttcaatcattggatgatcctcgtgcgaccgaacaggaatggtatgagcaggcagaagccgtgtatcaagccatctcccgcagtgatgcgtctcaagcaggccggcagccattcagaacagtgccgatcggaggccatcgcctgccaagcctgccctactcgtattcagcccttgagccctatatttcaaaagaaattatgtttcttcatcatacaaaacatcaccaaagctatgtcgacggtttgaacagagctgaaaaagaactgcagaaagcgaggcaaaccaaacagtttgacctcgttaaccattgggaaagagagctcgccttccacggagccgggcactatttgcatacgatattttggtacgcgatgcacccaaaaggaaaaagacggccgacaggcgaattgctggagatgatcaaccgttcattcggcagctattcggcctttaaagaacacttttccgaagcggcgaaaaaagtggaaggcgtcggctgggcgatcctcgtctgggcgccgcgttcgcaccgcttggaaattctgatcgcagaaaaacatcagctgatgagccaatgggatgtgatccccctgctcccgctcgatgtatgggagcacgcatattaccttcaatataaaaatgaaaaggcaaaatacgtcgataattggtggaatgtcgttgactggagagagcctgaaaggcgatttgcgtcagcaaagcgcgttttatgggagccgttctgattcaaattcgctggcgggacttcaatagttgaagtcctgtttgcgtttcggcagatcatgcccatttgctgcgccggacattggcctgatgtcgccgaaatttctcctccggattccccgtcatcagagatgaataagccgtgccttaaaatcctctcgcgcttttccttacatgaatgcttctaaaacgcctggcagccgtcgacataggtcgtgcgcatctatgctttctcttcaaccctctattgtatataagaagataaccaataaatgtttatatatcccagtttatcttgaggattttcaaatagtcggcagagaaatcccttgccattcgccctctcggacatgctgtttgaaaagggccgcaaataaaataccgactgcaaattctatcaatatatcccaaaatcgagccttaagtatgaaatgtgaacattttttgatttatttggaaaatagtctattttcctcattcttctaattccaaaaatcgttaagctattctatgagaagggaggtaatagatgaaacaaactgtcgatgtttgtctgattcagctggtcagttttttgaaaaatggcaatttatattaggagggttaatcatgaaaaaaatgtttgctttctttacagctttaatgctcggtttgacttgtctgccatacttatcggaagcgaaagaatcaaaacatacggacagttctgttacaagcttgccttctatgtctatacctacatctctcaatcagtcattgaacgaggaaaaacagcagtttaaaacttccgctattgatctcagcatcagcctcgacctcttaggaatcggaaactcgattagagacgctatcgttcaaagcaataaccgcagcggtttcgtcaaaaactgcatggaaaccgctttttattctgcagggcaaagatacaatgtcatggtgttcaacttaagccaaggctatcacaatggtttaagaggagttaaattttatggatctgccaactatcatggcgtgatttacggcatttgggtatttgaaagcggacaatttacaaaccaaggagacggcggctggattaactgggcctttaaaggctggtttgatcgaaacggccaaacagtaacattccgtaagccttaatcaaagtccatgtatcccctcttctgcttgccggtaaaccggcaagcttttttaaatttctgaccagaaaaacaaccgctttttcccttcctctcccccctttcatcacacacttccttgccggttataccgccgagaaatgaaagtgcggctgacctaagcgacacgcaactgtctgcatgaaaaaaggccggatggtccggccttttaaaaacaatttattcttaaaataccccgatagcatccaaaaagacgacaataatgacgattggagctgcgtagcggatcagcagaagccaggctgcaaaccattttctgctgattttagagccttctttcaattcggcaaaaagctcgtctttcggaattttgagcggcacgaaaacggcaattagcaaagcgccgagcggcattaatatattgctgacaagataatccgccgcatcaaaaatggatagattaaaaatcgacacatcctgaagcacgccgtatgacaatgctgaaggaataccgaataggaaaatcgcaattcctcccgcccaagcgaaagcctgtcttttcttaggatccccttttgacaaggaagaaacaaggatttcaagcattgaaaatgcagacgtcagtgtagcaaataaaaataagagcagaaacgccaataaaaagatgattcctaaaggcatcttatgaaagactgacggcagcacattaaataacagcatcgggccggcatcaggagataatccgaatgaaaaaacggccggaaaaatcgcaaacccggcaagaatcgctacagatacattgagcaatgtcactgatacggctgactgtacaaggttttcttttttcgataaataagagctgtacgttaccatcacggaaacaccgacgcttagcgagaaaaaggattgtccaagcgcaaacagcaccgtttcggctttgatatgtgaaagatcaggttttaagaaaaactccaagccctccattgaaccgggaagtgtgagcgaacgaacgatcaaaagcagaaaaataatgaacagagcaggcatcataaacttgctcgccttttctattccgcttctgactccttttgcaacaacaaggatcgttatgatgataaatgcaaactggctccctagaacgagatacggatttgcaatcgtctccccgaaaagaccggcataatccgtacttcttgacagttcaccggtcagccctttgacaatataaatgatgatccagccgccgacaacactatagaaagacagcagaatgaaacacgtgataatgccgaggcgcccaacccagtgccagagcgagccgggagcaagctccttataggattcaaccgcatctttttgagtctttctgccgataatgaactccgccattaataaaggaagcccaatcaataaagtaaaaagaataaacataagtaaaaatgctccgccgccgcttgttccggcaacataaggaaacttccatatcgcgccgagcccgattgccgaaccggccgaagctaagataaatccaagctttgatgaccatatattttgtttattttccacttaagcacctcttcttctcggtctaattgcacatggctacaaactatcattttaaaaagcataaacgaattcgtcaaggttttcaaacatttctttcagtttacataataatattatgttaaataattctttattttactagtattgaattattcagaatattaattataataagagaatgttacatttctacagatgtgaggagctggacttatgagttatttgatcaaaatcagtcaatttgcaggaaaaacgttcgccatttgggtgattctatttgcgattctcggctttgcctttccgtcgcagttcacttggatcgtcccttatattacgattctgcttggcgtgattatgtttggcatgggattgacattgtcagcggacgattttaaagagctgctgagacgtcccctgcatgtgctgatcggtgtgctgattcaatatacggtgatgccgttgctcgcttttggactggcctatggactcgctctcccccccgaaatagcagtgggggttatattagtgggatgctgccccgggggaacagcatcaaacgtcatgacatttctggcaaaggggaatatcgccctgtctgtggcgatcacaacgctttccacactgcttgccccttttttaacgccgtttctcattttatttttcgcgaaggaatggcttccggtatctccgggctctctgttcgtgtcgattttacaggcggtgctgctcccgattatcgccgggctgatcgttcaatttttctttaaaaaacaagtgaaaaaagctgtacaggtgctcccgcttgtctccgttctcggcatcgtcgccatcgtctccgcagtcgtcggaggcaatcgggaaaacattattcaatcagggctgctgatttttgcggtagttgttcttcataatggcctcggacttttcctcggctttgttttggcaaagtgctttaaaatggattatgcgtcgcaaaaagccgtgtccattgaggtcggcatgcagaattcgggtctcggcgcggcattggcgacggcgcacttctccccgctttcagctgttccgagcgctgtgttcagcgtctggcataatctttcaggttcatggcttgcgacatactgggccaaaaaaacaaataaacagaagaatgacaatcattctcctgccccgcaaatgataaataaaaagctttgaccgtacttacggccaaagcttttttatgattaaccttccaacagaagctgttcaggatcttcaagcagatttttaatcgtaaccaggaagccgaccgcttcttttccgtcgacgatccggtggtcatacgataatgcaatgtacatcatcgggcggttttcaaagcgctcttcatcaattgctacaggacgcagctggattttgtgcatgcccaaaataccaacttgcgggctgttcaaaatcggagtcgataacaatgaaccgaacgttcctccgtttgtgatcgtaaaggacccgccttgaagctcgttgagcgacaatttgttgtttctcgctttcttcgcaagctctccgatatccctttcaatatcggcaaaggttttgcggtccgcatcgcgcacgaccggtacgacgaggccatccggcgcagcaacagcgattccgatgtcatagaattttttgatcacaagctcgtcgccttgaatttccgcgttgaggagcggatattttttcagcgcggcgacaacagcttttgtaaagaatgacatgaatccgagcttcacgtcatgctgctccaggaattgatcttttcggcgcttccttaagttcatgaccgccgtcatgtccacttcgttgaatgtcgtcagcatagcggcggtgtgctgaacttcaacgaggcgtttggcgatcgtctgtctccggcgggacattctttgacgctctacaggtttaccagcatcttcggtttgtttagcggccggcgcctgtgttgcgcgttttggttcaggctgagcttttggcggctgctcgttcttttgataagattcaacatcctgttttctgacccttccgagcggatcaccggtagggatttccgataaatcgatgcctttttcccgggcgagctttcgggcagccggagaagcgatagttcttgttttggctgtatccgcctcatcgctcgcaccttcgcgaggttcggctgtcttttcagacgaggctgctttctcttccgaagcgccggcgctttcttgagcgtcagcttgcggagccgttgatttgcctccttctccttcgccttctgaaatcgttccgattatttcgccgacctgaaccgtgtcaccggaatctttcagcacttcctgaagaacgccggactgctctgccgtcaattccacgttgactttatcagtctccagctcaagcaggaattccccttgctctacataatctcccggttgtttcagccattgggctatcgttccttctgaaattgattccgctaattcaggtactttaatttccgccattttatagttcccccttaatttttgcgagtcaagctatcagatacaatgcgttcctgttcctttttatgaaccgtcggatccccttctgccggacttgaacgtcttcttctgccaatatagcggaccttcacgtcctttggagctacctctcttaaataaggctcgatatagttccatgcgcccatattttgcggttcttcctgtacccagacgatctcctccaaattcggaagtttgctgaagatcgctttaatatgctttgcagggaaaggatacagctcttcaacccgtgcaatgtgcagccaatccttttcaccttccattttattgaaatggtcgctgatgtcaatcgaaactttgccgcttgaaaggacgaggcgcgtcactttgtcatattgatgggaaagtcctgacatttcatagaccggcttaaagctgctgttactgagctcctgcacttctgacacggtattcggatttctcagcaggcttttcggcgtcatgatgatcagcgggcggatctcctcgcgaaggagcatcttcgcctgccttcttaaaatatgaaagtattgggcagcgctcgtcaggttggcgacagtccagttgttttccgccgccaattgaaggaatcgctctgttcttccgcttgaatgctcaggcccctgcccttcatagccgtgcggcaagagaacaaccagccctgatttttgaccccacttcgctcttcctgcagaaatgaactggtcaaagtaaacttgcgccgcatttgcaaaatctccaaactgcgcttcccagatcaccatcgtttccggcgaagacacgttatagccgtattcgaagccgaggacggacccttcagaaagcgggctgttgtgaaccgcaaatgacgctttcgtatcggcaaggtgatgcagcgcgatgaattcgtcccctgtcttgctgtcgtgaaggacaaggttgcggtgtgcgaatgtgccgcgttctgaatcctgcccggtcagccttagcggcgtaccgtctttcaaaatcgacgcaaacgccatcgcctctgcaagcgaccagtcgacttttcggtcatcttcgaaagctttggcgcgcctttcaaggattcgttttagcttatcgaaaacgttgaagttttccggccatgaaacaagctcctgattgattttgcgcaaagtttcaaaatcaaccgatgtgtcaacatcaggaaaaccgttggagaccggctctggaagtacgatttcatgcgtcatgtcttcctttttggccggcactttgcgataggcttcttctaaacgcttctggacagcgtccttgattttgccgacggtttctttatcgacgatccctttatgaatcagcttttcagcaaagatgtttttgacggtcggatgctttctgaccgcatcatacagcatcggctgcgttgcggacggctcatccatttcattgtggccaaaacggcggtagccgatcagatcgatcaaaaagtctttgttgaaagtcatgcggtattcaacagcgagctgaaccgctgaaagacatgcttcgggatcatcagcattgacgtggacgatcggaatttcaaaacctttcgcaaggtcgcttgcatatttcgtcgatcttgactcattgctttccgtcgtaaagccgatcatgttattggcgataatgtgaatcgctccgcccacttgataccctttaagctggcttaaattcagcgtttccgcgacaatgccttcccctgggaatgccgcatcgccgtgaatcagaatcgccatcgattttttgacgtcttgaaccggatagccgctctccgttctcgtttcctgggcggctcttgtcgatccctcaacgatcggatcgatgaactcaaggtggctcggattgttcgcgagcgcaatgcgcgccgttttcgtatgctcatcctgaatctggcggttggcgccgaggtggtattttacgtcgcccgtccagccgtaattgatcccggtcgaaccttccgacggaacgagatctttgttcggcgcatgctggaattcagaaaaaatgatttcataaggttttccgagcacatgcgcaagaacattcaggcggcccctgtgcgccattccgatattgacgtttgtcgtacctgccgaaacggacttggcgataatatcatccagcatgggcacaagcgcatcaagtccttctattgaaaagcgtttttgcccgacaaaggttttgtggagaaactgttcaaggctttccacttctgtaagccttcttaaaacttctaccagtttttctttcgatttcggggtgaataattccccggattcgatctttttcatcagccagttgcgctcttcaaaaatgtgcacatggtcaaattcaaaagaaatcgattttttgtatgtgtttcttaagtactggatggcttctaaaccgttcgttacttctttaggggcatctttgcatatgacagacgccgggatttttttcacatcctgctcagttaacccgtactcagcaagaggaaaaagctcctgtttctcttgtgtttttctcagtggattgacggaagcgtttaaatggccataggttctaatatcttctgcaagttttaccgctgatgcgattttttgaatagatccagccgtgaaatctgcctcttcgtttttttgagaggcggccctaatatcgcccgggggagctccaagttcgtcaaacatctcttttaaatcagcatccaagctttctggatccttgacgtactgatcgtaaagctccagcacatagccgaggttcggaccgtgaaattcttcccaagtcattctttgtttcatactattttgaaacatttgaacattacccccaacctaataatcaagtgaatgattcactatcttaatatatcttctgaaccttgcgcccagaaatatgtaataaaaacgcttccacgtacattttaccactgtttctcatttgtttctacacagattgttcaaataaaattaaaaaatcgtcttgaaaaataaaaaaatttataatttcgaactttcagatccctttctttcaggacctgatctttatttattcacatatttcccctggccgtctattttttaacatccggatgtgctccttaaaaaattaagttgataaaaataataaaaatttcgttatttcactgtgttttcacgataaaaaacagatggccgcgagtattgctgccatctgtcatatctatcctatacttttgttcaacagcttttttaaaagcgggtacagaacatcgggaagctgatcgacgtctgggacaaaaaggctgtactttccgtacatgtcctgtatcgtcttcatttgcgattcttcaatttcgctgtttgataaaaatacattgatgacttcgatatttcgtttccgcgcttccatcaccgcttcatgtgtatcgacgatcccgttttgctcataatcgaatgcggccggctctccatctgaaaagacgatcaggaacttctgagcttcgcttctttgaacaagcatcttcgtcatctgtctgatcgcatatccgtcccggttgtcttcctccggttcaagctgcataatgtgcggtccggctcctgcttttaaggaatccgcaaaagaaacgaccgtatgaaagtagttgggctggctcgtctctgtcgcatcgtttgtatcttcccaaaaaccgacgatttgatgagggacagcaactgatttaagcgcttcatgaaacagcacaatgccccgtttcgtctccgccattttgtcatgcatgcttgccgaacagtcgacgagcaatgtgaaaacggcgtcgatttctgttgacggctcctgctttttatagaacaggcgcggattgcgctctgtaaagtaacggagcagtttattgttcaatctgcctgcatgcaaatcggttctcgggagtgtttttttatgctcaagcgttttttgaatcatctgtttgagccgtttttgatatgattcgattgttttggcttgagcctggtagtctaatatatcttcattcgaaggtttttccggcggcttcatcaccgaaaaggcatagcggttttctttaccggcttgggctgttccggcgttcggttcatcttgaacagattcaagcgattcaagttttgagtagtctttccttttcgtctgcttcgccgttccttgaacagacccgagcgcttggtcgccgtcttctccttctcttaaagcgccgccggaaatatcggattttgcgccgtgctccaaatcaaactggagaaagcttttggccggagcttccgtttctctgtgccaagtcggcatttcttcttcatgaacttcctcgtcacccgcacttttctcttccagcgtcagatcctcgctcagcttcggttttgcttttaaatcttgaaagagcgcttcttcgtcaacttgttcgtagtcaagttccggaaaaaagaagtacgtattcagcatatctttttcgagcacttcttcaaaaccttccattaacccgtttacaaacgaaacgatgtcagcagttgaacgcgcttcgaatacgcgggcgagctcggcttctataaaccccttcatcggatcgaccgattcatggatagccggtatctcttcaagcggcgactccgcggtcagcttaagatatacagcgcaaaacaaagcatctgtaaaaatgctccgctccagattcagcgtcagctgtgtcgcaaagtgtttgcggtacatcgatttccggtttgaaaatacctgctttgtaccggggcgctccctcttgatggactcttcaattctgatatcctcaaaaagcataaacaactgttttgccaaactcttaaactgatatttccgagccgagtccagcatgcgggaaaagtctttcatcgagctgtagcgggagccgattgaccgcaagtatacatcgctcttcaagccgtctaccatatcgcggtggttcctgtctttccaaaagtggctcatgtagatctttttctcaaaaggattgtaataagactgaaccccgtactccacttcaacctgatcgcttttcgcgagcgttttcgccagatctgtcagctccataaatagcaaagagtcaatcttgctgtcattgaatttaataaacttcataaaaaaccctcattcgaacaaagtttgggcaatatttcggaccgccgctttttcgcgttcatcatcaagcttttcaacgatgccccgttcgatcgctcgcagcggcggaatatacgtcgacagatcgcaagtatcgagaagcgctctgatggaagcagcctcttcagatacctgtccgttgtgggcttgcgtcattaaatccgatgacagggtgacaaaccggtccagcagcttctgattttttagttcggattgtgtttcaagcacccgtttcagcaggtcgcctttaatgtatggcacgtcgatgatcacaaaccggtttttcagcgcttcgttcaatgggactgttccgacatacccttcgtttattgctgcaattacgccgaatccctctttcgctttgacgacttcccctgtaaacggattggtcatcattttccggtaatccagcaccccgtttaagatcggcagcgtttccggtttcgccatgttgatttcgtcaatatataggaaatggccgttgttcattgcttttgtcacgggaccttcgacaaattcaatagaggcgttcccgccggtgttttcaatcgttttgtaaccgacaagcgcctctgcatcaaggtccacagaacagttgacactgtgcataggtttttgaaaataagcggagagcgtttcggcaagttttgtttttccggaacctgtcggaccttttaacaaaacgttttttccgagtgacaacgcgatcatcgcgtcatagagaatggcgctgtcttccgcttcatagccgggcgtcccaatcaatgattggtattccgcgtcaacaggtttagcggcagactgaatcagccgctcttttatcttttcaggcagctctagttcgtgcagatcatatttcatgtgttgtaaaattcctttctaaaagcgtcttctatatttaagtatactagaaaagacgcgctgccctcaatataaacggcttccaggcgccgattcacttttttccgctgttcgtcagcgctccgcaaaccatccgggctccggagttacctgatggatttgtcaaatcgtcatcctgatgctcgtgaataataaaagcacttccgtcatgatccagcagactgaacctgcttttctgatcgagggtgactgccggcgcattgacgatgacgtcgactttgccgtctgctccgacttcaatattcggcaaatcaccggcatgcggcccttttggattgttaaagccgtgctccttttgatcaggattgaaatgagcacccgcactttcaaaatcaggctttttgcaaacgcccgtttcatgaatatgaaaagcaagcatgcccggcggcagatcatgggcgctcactctaatatcaaggccttctgcagcagattcatacacttctataaaaccggtctccgtcccgtcgcgtttgatcagcggtacttttaatggctgtgtcatcgtttcaaaagtttctttatgttcctgttcggcatttttttgctcgatttctttttgctgtgtgcatgcagctgccaaacaaacggacatacatgcgagcaatatgtaatgtaatgttctcaaacagcttcccccttcgcttttcttttcagtttagacaatgaagaggggcattaaacctgtccttcccatcctgaaaccacgcaaaaaaaagccatataaaatggcttttttaaaatgaataccgttttgcgccgagatagcgctgcttccagtaggaattgttcatgtcgctcacggtgacgccggaatcgttggcattgataaacttgttgtttcctaaataaatgccgacgtgtgaagggcccgctttatatgttgagaagaaaacaaaatcacctcttgaaggctggctgactggcgacatgatgttccagtatcctgctgcgctcagccttgagacagatgtaactttgttcaacgtgtaatagatgaatccgctgcagtcaaaaccggaaggattgttgcctccccatctgtaaggcacgccgatatgcttttctgcctctgcaatcatccgctcgacttttgcgcttgtcgaagtgccggttgaaactgaagagttcggcgagctggaagatgggctgccagatgaccctgaagacgatgcaccagaaattttaagcttctggccgacttgcaatacatctgtttttaattgattagcctctctgatgctctgtaccgttaccttcatcgaattcgcgattttccacagagaatcgcccggtttaaccgtgtaagtggtcgtttttgaactgctgcctgtgttcgttttacttgatgaagagcttgaagacgaaccagaagatggtttgcttccgctggaaactgttcctttcactttaaggacctggttcgggtagatcgtgtccgacttcaagttgttcagcgttttaatttcggcgactgtcatattcaaactattggcaattttccataaagagtcgcccaatttgactttgtatgtgctgcttgaactgcttgcactttgtgagccggatgatgagccggatgatttggagcttgatccagagctggaaccggcgctttttgcgcttcctttaataaccagcttttgtcccggataaatcatatcgctgctcagcccgtttaagtttttaatctcttgtacggtcgttttgtagtctctggcaatcagccacaaggaatctcccaatttcaccgtgtaagtggacttggcagcgcttgaacttgagctggaacttgcggattttgtctgtgagctgcttttcgacttgccgtccggaacttttaaagtttgtccgacataaataaccgtcgatgaaagattgttggctgattgaagtgccgaaacactcgtattgtactcagctgaaagcttccacagtgagtctccgcttttcaccttgatggtttgggcttcgaccggtgacgccgccaatgaagttccaactaccgcagaggccgccaaacctgctgctatcttcttcttcataacctcttaacctcccgtttcattttcgttctctctatgtatgccattacatttgccattgcttaagactttatccagccgatcaggcgggtgatctgatcaccatatgtatgcctttggccgaaatcccccttttatactcttaagcaaaaaatgcaattcacgatttgtatcggtctattttatatttttttaatagcttttttgtttttttacaaatttctcattaaaaatacagactgatagacatattgacaaaaatcaacacttttttctgtgtactcgaggtgccggatgcttttttgcaaaggttttgagtttcaagttttcggaaatacgatgatcagttgttttaaaatcagaggttcatggtgaaaacagcgagaagggagttgaccagatatgctgcatgtgccgaaacagccagaatagacgccataacatgcggatttccgtgccgttttactgccgatttctctttctctcggatcaaacggaaacaggtaggcaagccagcgttcatgttgagggtgtgaaaactgcgtgttcatattctttatttttccggaaatcgccgatctatcctcatctattgcctaatcgaaaagcaaagatcaggatcatttatacaattctacatttcagcacaaattcctccacgaaaccataaattgactatatcatacattttttttgccaacatccggaattgggagtatcttttttttagatcgaacggcgttttactatttcacctatagattcttatttcctatcttaatataacgatatacagaaacataaaacttaatgctcactcatttatatatattaatagatctaatatactatcaaaacatgtaaaaaagggttctgttttatcaccgcagctttcatgcatgtttcctccttttatggcgcattttaagatatggaggtgaatcttcttggccattcaaaaaatatgtcaatatttatgtacgtgtttagggatcctttctctttcctttatttatgtgcaaatgtttaaaaaaacaaaacagacgaaaaaagattgaacagacatttattgcattttatacataacgtgttataatttctctcgttatccaaaagaaacggggaactgatatgagggaaacaaaggatttgcgggagaaagcaagacagtttttaacgattttaattccgattttgattacgcaagcgggactgtcgctcattacggttctcgacacggtgatgtcaggcaaagtcagcgccgccgacctcgccggcgtcgcaatcggctcgagtttatggacccccgtttatactgggcttgccggcattttgacggctgtaacacctatggtcgcccagctgatgggtgccaagcggcaaaaggatgtcccttatactgttattcaatcgatctatgtggccggaatcatcagccttgccgtcatcgtttccggatattttctgattgatccggtgctggagaatctcgatcttgaacggaaggtagctgtcatcgcaaagcaatatttaatctgcatcgggctaggcatattgccgctgtttgtttacaatgtgatgcgctgctttattgattcactcgggaaaacgcgggtgacgatgctgattacgctttgttctttgcccattaattttgtcttgaactatttgtttattttcgggaacttcgggtttccaaagcttggaggagcaggagccggtttggcttccgctatcacatattggtgcatttgtctgatctctttatacatcgttcataaaaagacgccgtttcaccagtttaggatttttggaacattctattcattttcttttgctgaaagtatgaaacttctgaagatcggcatcccgatcggtttcgccatcttctttgagacgagtatattcgcagctgtcaccttgctgatgagccactttgacacggtcacgatcgcttcccatcaggcggcaatgaattttgcttcgcttctttacatgcttccattgagcgtatcgatgacgctgacgattgtcgtcggctttgaagccggggccaaacggtttaaagactcgagggcctacagctatctcggcatttcaatagcggtcggtttttcattattcaccgcactcatcatactactgttcagagagcagatcgccggtttgtacgcggctgaccgggatgtcctgcttctgaccaaggacttcttgctgtatgcgttgttttttcagctgtcagatgccattgccgcgccgattcaaggagcgctcagaggatataaagatgtcaactacacgcttgtcacagctctcgtctcatattggattatcgggcttccggtcggttttgtaatcggaacgtatacttcattcggagctttcggatactggatcgggctgatcacggggctagcggccggtgcagtcgggctgttcttcaggctcaaacgcattcaaaaccgctatattcacactcaaagcatgtaaaaaaggtgccgggctcaaatgcccgacaccttttttgatcatgttaatcattccattgataggtccaaaatgcttctttttcaaaccatgtctcaacaaccggctcgccattggcgagttttttctctatttctttcaaaaggccgcctgtttgggatttatgcgcttttaaagcgttcattttaatatccgcgacttctttgatatcaagaacgacgtcaggcttgccaagaacctcttccctgtggtgagtgatagccatgcataagacgcgcggccggtcctctttctttttccgcgataatgccctgatgaccgcggcaccgcatgcatcatggtcaggatgaacgccgtgtccggggtaaaacgtcacaacaaggctcgggtttacatcatcgatgacagcctcaatttgatcggccagtttttcttcatcctcgaattcgagcgttttgtcgcggtatccgagcatgcgcaaatcctgtacatccatttccctgcaggcgtcgatcagctcttgctttctgagcagcggaagggtttccctgttggcaaaaagcgggtctcccatatttcttcccatctcgcccagcgtcaggcaagcgtatgttacaggaatgtcttcttttcggtttaaggcgatcaagccggcgactccgaaagattcatcatcaggatggggcaggatcacgagtaaatgttttttcatcttataacaccttctttttagactgcaaatggctttttgctgatttgaagcgaaatggcgagtttgccgcccggcaaatagccggcaagaagcaaccttccttcatcgtcaaccgtataatccgtcaggccttcggcgtagatccagccgtcttcggttttcaaaccggcgcgaaatggtccctcgcccgtgattttggcccgggagcaggctaccttcgcgtttctgatatatgccaccacggtcatgttctgctcatctttatgcgcggaatacgatccggttgtcgtttccaaatgaatgtaaacaggctgatttaaaaatgtttccaaagaagcctgcacatcttctttttttattgctttcatgttactccctgctttcttcgtttgttaataactccaatcgttccgtatgacattcaatcagcttgagcttcatttctgattccaattgtgaattcacgatgcgccggattgattgatagtatttttcgtgcttcgtctttctgagccttggatgggtgccgaggtcgttcagctcatcatcaaccgcctgatgaagcgcctccctgccttccccctccatcgtccggtttttccaaagggttttatatgcctggaaaagctccagttcatctgccatgacggaacaacctccgaattgcttcaataatgtttaattatacataatcggtgtttcttgaaaagaaagagggcttacggatgaaaggatttttttctttttaaaaataccttctccggtctcttccattgaaattgcgaaagtgtaaacaatatcagcgccgcccatatgcaggaaaacgtaaagaccttgctgctgttgaacggttcatggtagacgaaaacgcctaaacataatgtaatggtcggagcgatatattgcaaaatgccgacttgatagagcggcagtttctttgcaccttccgcaaataaaagcagcggaatcgcggtcagcacccccgccagaaacagcagcaccatcatgccgatgctccctgaggctgcctgagccttctccggatggctgaagaacagcaggtagatcgctgcaaccggagcgatcatcatcgtttccaaagtaagtcctatggcacttgagagcgatgtgcgctttttcgccagtccgtagagcccgaagctgaatgcgagcatcagggcgatgtacggcacggacccgtactgaaaagctgaaataagcacgccgagggcagcgagaagaactgccgctccctgcatccgcgttagcttttcctttaaaaagacaattccgagaacgatcgatacgagcggattgatgtagtagcccaggctcgcttcaagaatatagccgttgctgacggcccatatgtagacataccaattgatcgaaatcagaacggacgacaaaatgagcggaacaaattcctttcggtttcccgaaagcgagcgaaatgctttgactccgtttttccactgccgcaaaacgagaagcaccccgcacataaaaacaaatgaccagataatccggtgcgccagaatatcgagcgcggccgtctgatcgagcactttccaatataaaggaaggagcccccacagcaaataagaaagcgctgtgtaaatgattcctttcgtttgagatgaatgattcatgtctgtttctttcctttcttcttcatcactttccgcacttttttgcatatactgtaccgtctatgtgaaaggaagtgtgatcgtgtttgattggcaacgcttttttccatttcagcagttttccaaggacggattaaaaaacgctgacccgaaagatgtggagcaatatatccaccacatgatgaaaagcgttttcggaccggggtatgcagttcaatttccttttcgtgaccctctctcaaaagaaacatcggcggcagatgaatctgatccgattgatatttttgaaacgacaagccatgtatttgttaaaataccgctcaccaaagaacagcttaaccttctgaaaattaaacatacttcacaaaccctgatcatagaaaactaccctgaaaaagggcggcaggaaaaagtcgttctcccctctctagtgcgcagaaagggtacgaaagcaatatttaaagacggcattttggaagtgatgttcttaaaaaatgaggactttaacctgtctgaaatcgacatcacgttttgaaaacggccagcttgaaaaagcaggctgttttttttcttcctgtatcatcttaacactactcctcaaggatgatcatctcatttgcctgacattcggccgcgcctttaaattttgacagtgttagtcattattccttaaaaagtctctgtaactatttcctctttcggctgttgtcgatttgtccttataatgataatggttctcaatttataaaacaggaggatgtatatgaaaaagaaaatcagcatattgatcacagcaatgtttttgacaatcctttgtttttcgcctcaagcttccgctgcgtacaactcactgcatacgggctatgccacttatacggggtcgggctactccggcggcgcattgcttttggaccctattccgtccaatatgaagatcaccgctttaaatccgacagatatgaattaccgcggtgtgaaagctgctcttgccggcgcctatctgcgggttgaagggccgaaaggaaaaacgaccgtctatgttaccgatctgtatcctgaaggagcgccgggagcccttgacctttcaccgaacgcttttcgcgagatcggcgatatgaaagacggcaaaatcgacattaaatggcgtatagtcaaagcgccgattaccggcaatttcacttaccggatcaaagaaggcagcagccaatggtgggcggcgatccaagtcagaaaccacaaatatcccgtcatgaaaatggaatattacaaagacggaaagtggatcaacatggagaaaacggattacaaccatttcgtcagcaccaatctcgggacaagtccgcttaaagtcaggatcacagatatccgaggaaaagtcgtcaaagacacgataaaaaagcttccggaaaacgggacgtcaagcgcatataccgtaccgggaaaagtacagttccctgactgatcgatccggaaagaatgagacggcggccaaaggcgaaaagattcgcaggctttggccgccgcttcatattgacatccggcatttagacgccagcaacaattggcttattgatcaatagcccggtcctgctcctctgtatggagctgcgcccggaacacctccgtacggaaaagccccaggagctgccccgtagccgtaataaggcgcgccgccgtaaggtcccgggtatggcggcgggtaagcgtaaggtcttgggtagttaaaaatcgcgcttccgagaaatccgcccagcaatccgccgacaagcggcgctccaaaaccccagaataacgggaatctggccgggtatccggcaggacctgatctcgaataaagcatatgagggttcattggcttttatcctcctttatgtctgcctatagtaaaggtattcataaagtcgggaaacgtttgggctattcttcataaatcattttttttgtcattccgccgtccaccgttatgtttgtaccggtgacgaagcgattgtccggatcggtcaaataaaagcatgctttgacgatatcctgtgggcggccgaccctgtttgacaaatgctgcgcgtggtcaataggccgcagggcagtataatcaccggtttcaatccagcccggggaaatgctgttgaccacgattgaatctttgcttaaagacgcggccaatgcgtgagtcaaagctattaagcccccttttgacgcggcataggcttctgagtccggttcggacataaatgcccttgtcgaagcgatattgacgatggcaccgcctgttttcgcctctttcattcttttggccgcttctcttgcgcaaagaaacgcgcctttcaaattcgtattcaggacgccgtcccattcttcagccgtcaagtcgtaaggggacttccaaactgatcggcccgcattattgatgagcgccgatatcgaacggccgtttcgggaagcttcctgcatcagccgtttcacgtcttcttcagaagctacatcacaaggtgcaaattggacccgcgcaccggaagcggtcagctctttttcaagctgttcaccctcttccttcaatacgtcggcgaatacgacgataaaacctttttgagcataggcggccacgaggtctcttccaatgccttttgccccgcctgtaatgacgacagtttctttactgttcaatccggtcagctcccttccggatcacaatggctttcggcccaggtttgtatctccttgaggacaggctccagcgccgttcccttgtctgtcaattgatagatcacttttaccggcgtttccgggagcacttgacgctcgactattttgcagtgttcgagctcttttaaacgttcagccagcattttctggctgatcatcggtatcatttcagtcaagtctttaaatcgtttaggtccatccaataatacatggatgatcagtccattccatcgtttgccgagtaaagaaaaggcggcttccattctaggacacattgtaaaccccaattctctcacccctccatatccagttgacaaatataatgtgtgccattaaaatactcattaaagttacaaaaagtaagtttctaactttttatctaactctatcataacacgtttagcccaaaggaggaagtcacatgtcttcacaagaaaacaccgctctcaacattctggaagagcgtacttcgattaaagaatatgacacaagcgtttcgatttccaaagaggagctgacaaagctgctgagcatcaccacaaaggctccgtcagcctggaatctgcagcactggcattttacagtctttcacagccaggaatcaaaagataggctccttccgatcgcgttcaaccaaaagcaagtcagtcaggcctctgcggtcgtagcggtgctcggggacttacaagcgaatctgaacggtgaagccgtatacggccctctggcagaagcaggctatatgactgaagaaatcaaaaacacgctgctcggacaaatcaacggcgcttatcaaaacagcggatttgcaagagacgccgcgtttacaaacgcatctctagcagccatgcagctgatgatcgcagccaaagcaatgggctatgacacatgcgcaatgggcggctttgacaaggaagcatttgtgaaagaattcaacatcgatgaacgctatgtaccggttatgctgatttcggtcggaaagccggtcaaacctgcgcacaaaagcaatcgtttcgatgtgtctgacgtatctacatggctgtaaacatgttaaaaaccttagtcccaaaaaaggactaaggtttatttttatgcttttatatgcttttcataccagattttcgccttttcaatttcgccgtgtgtcagctgatggcctccgccttcccagtgaaggagcactttggcgccggcgtttgtgaaatagccggcaagctcgcttgattcctgcggcggacagagcggatctgttttgccggccccgataaacacgggcagacctgtcatatcagggagcttgcgatttctaaacggaaccatcggatgatgcaaaatcgcccctttcagtacatgttcatgacggaacagcagacttcccgcgatattggcgccgtttgaatagccgattgcgaccacccggcttctgtcaaagtgaagttccttggctgcttcatctagaaacgtttttaattcatccgtccgttcgatcaaatctttttcgtcaaacaccccttctctcagccgcctgaaaaaacggggcattccgttttccagcacatttcccctgaccccgagcaaatttgcatcgggatcaatcatcttgccgatcggcagaagatcgtgttcgtttccccctgttccatgcaataacaacagggtgagatcagagtcccctttttcatatatataattcatttcctttcactccttttccattttggaagtatgccttcaattggcctgcaatcatttcggaaagcttcaattcaccgaaagagactctccaactgttcatcaatcaaagagccctgttcactgtctctttcccatacattactttggagcctcctgcaatatggtgcaccccttctgtttccatcatcatctttttatcttgaattcaagatattaattattgtaaagttatgttttcgaatatgcaagacagaactattgtttaaataatttaaaaaatcacttttttctaataattatcttgtgattaaatctgacaactgctatgattatgaacatcaaaatggcttaaggaggaaaaaaggtgaatcaacagcttttcaaatgggttctgttcatcatcccttttatcggacagcttgccttgctgccgtttgtaaaccggatcgatccgatcgttttcggacttccgttttttcatttttggctggtgctgtggattgtgctgacaccgctgatcacatttgcgatttacagatttgagaaaagaaacggaggttatgagtgatgcagggaaatctaacagcgctcctcattaccgccggcatcattttggccgtagtttgtatcggatttatcgccggcagcaataaacagtcgcggaaatcggttgaagaatggtcggtcggcggaaggcggttcggcgggctgctcgtctggtttctcgtcggcgccgacttgtatacagcctacacgtttttaggattgacaagcaccgcttttacaagcggaagcgttgcttttttcgcgatcccttattcggttttggcctattttatcgcgtacttttttctgccgaagatttggaaggtggcgaaagtacatcagctgacgacgctggccgattacgcaagggaacgtttcagcagcaagctgctgtcttcgcttgttgccattgtcggcgtcttgatgctgatcccgtatatctgcctgcagctcagcggaatccaggatacgcttcaagtcgcgggtacagggtttattaacgtcaatgccgtcgtgatcatatcattcatccttgtcgcgctctatacgtttttcagcggcatcaaaggtcctacatataccgccattattaaagatattttagtttgggtgatgatgctgtttatggtcgtttcgttgccgctcatccattttaacggctggacgccgatgattgacaagcttgcaaatgaagcgccgcatatgctgacgatcccttctgacggaccgcgcgggatcgcctggttcatcacggcatcgatcgtttccgcgtttgccctgttcatgtgggcccatgcggcgacaggcgtcttcacggcgaacagcgcggatgcgctcagaaaaaacagcatgtttctgccgctgtacaatatcgtattgatcttagtcattttcttaggctttatcgcatttctcgtacttcccgatgacattaatccgagatttgccttgctgtatttaatccaaagttcctacggcggcgtcacgcaaggattcgcctattcaacaattgccctggcaagtctgatcccgtgttcgatcatggcgatcggggcgtctaatctattcgccaacaatttataccgcgatttgatcaatccccgcgtttcggggcaaaaactgacgatcattacgcgctcaatggtatttgtcgtcatcggcctggcccttttatttggaatgctgttccccgcagcgcttgtcacgcttcagcttctcggcgtttcaggcatggtgcagatattcccggccatcgtcatcagcctgttctggaaaaaccagacgaaggaagcgacgatcatcggtcttctcatcggccttgccgttacatttaccgtttatttgacaggggccactttcggcatttacgaaggattctggggccttgcagccaaccttttgactgttgtcttgttgaatccgttttttgtgaaaaatgtaaaacacaattctgtgatcaactatttgtttcatactaagaagaatgtgcaaaaaagcgcctgatcaccaaaaaacccttgtgctccgtgtggagagacccaaataaatgagacaaggaaaaaacaccccctgaatcgtattaatacaatatgattcttaggagggtgtttttctatgggcacaagagtacattacgcagaagaagtaaaatgggaagtaattaaaatgaaacaagctggaatgacaaacaaagaaataatggaacaactggggataaaaaataagactcaaattaaaacatggatgcgatggtacaaaacaggccaaacctatcgattttcgcaacaagttggaaaacaatattcctacggtaaagaatcggaggaaatgagtgagctagaagaattaaaactaaagaataaacagctagaggctcaattggcaattataaaaaagtaccaggagatcgaaaggagttggagccacgagtcattgtccaagttgtagaagaactctcagccacttttaaaataattgatattcttggagtattaggcatacctaagtcaacatattaccgttggaaaaagaagtataaaaaagttgagctaacttcattagaagagctagtaatcaagctgtgtaagaaaaacttctatcactatggtcatcgtaaaattaaatccatcttaaacagaaagtatgggataaatgtaaaccgcaaaactgtacaaaaaattatgcaaaagtttgagattcagtgtcaagttaagaagaagcgacaaaagtacatttgtggtgagagtaatattattgtgccgaacactctcaatcgtaattttaaagcaagccgattaaatgaaaaatgggtaaccgacattacctacttaccttatggctcgactatgttatatttatcaacgattatggacttatataacaacgaaatagtggcttacaaaataggtacgagccaagatattaacctagtattagacacattgagggaagctgtagaattacgtaaaccagtagggttacttcttcatagcgaccagggatctgtctatacttcacatgcatatcagaatttggccaaagaaaaaggcattaccacaagcatgtctcgaaaaggaaactgccatgataatgccgtcattgaatcctttcactcctcgctaaagtcggaaggatttaacgctcaaagtagagcatctatatccaattctaaagtagtacaaattgtaaatcaatacatgtatcgatataatcatgtacgaattcaggcaaaattaaactacctgtccccactggaatacaggggacaggcagcataggtgttttttctaagtctcattttaacgggtcagttcagtgtgagcgcaagggtttcttttatttctctttttttaagatctcaatcgctttatccaactgcgtatcattgtcggaaagcttatcctgcagcttgcttgtcaggctgattgtcgtctcgcccgttaggatgcctgtcgttttcagcttttggtctttttgaaaagccttaacggcagcttccgtctgtgcgtcgaaagctccagtcgcattcagcttatagccgagcgcttgaagcatttgctgggcggctttcacttcgtctccggtgctgcctgccttatactcttttttggaatccaggtacggcagtttggcatagcttgggagctccgctttatattgaggtttgattcctttttcgtgaatccagtccccattcggcgtcagccacttggcaatcgtcagcttgacggtcgatccgtcggagaagctctccgcattttgaaccgtccctttcccaaacgtattttcaccgacgatcgggatgcctgaagactggtgaagtgctgcggccatgatctcagcggcgcttgccgttcctccgttgacgagaacaacggtcggcttgttcacttttcgctccttctcagctttgtacacttctttttttccgtttttggattcaacctgcatgatggttttgcctttatcgacaaacatgttgctcatcataatcgcttggtccatcagcccgcctggatttcctctgagatccagcacgaatcgttccgcacctttttcagacaagtcatcaatggcttttgtcagttcttttgcggtattttcagagaaagacgtaatttggatttcaccgatattgccgtcgatcattttggaataaaccgtttcgatcggaatcgtatcgcgcttaatcgtaacatcgatttggccgacgccttccctgttgagaacaagtttgacattcgtgccttttttgccgcggatcatcgctgtcgcttcgttgacggtcttgccttttacgcttttgccgtccactttctgaatttcatcatgcggctttaagccggctttttctgcgggagatcctttaataggcgcgacgattagaatttgtccatttttttcttctacttgggcgccgattccttcaaaagaagatgtaatgctttcttcaaagcttttagcttctttcttatccatgtatgtagaatatggatcatccaaagctccaagcatccctttaatcgcgccgtcagtcagcttttcatcgtctgcattttgataatagtcgctcttgattttgtcgtacgccgccatcagcttttcgaatttctcggaatctgaagcggaatatactgaaccgccgctgcctttgcccaccagataaagcgtcagtgcggaggcggcgacggccgtaatcaatacagccaaaaagagtttcaactgctgtttcaaacgaacaccaccttttcttcttaccatattatcatggacgaatctttattcgtcaactcgaatcacttaaataccgatttttccgggatgctggcattcgatcgttttcaaccattattccgcttttgcatatgcatacaaaaaaggagggatctcaatttgagcgattatttagacatgctcgccagcttcggcgtctcatccgctcatcccggcgggatgtccctgtcaaaggcagtgctcgccaaagccggcatcgaccctgagcagccgattcttgatgcaggctgcggaaccggccagaccgccgcttatttgggtcagcttctgtttcctgtcactgcccttgatgccgacccggtcatgatcgataaagcccgacagcgttttaaaaaagaacagctttccattccggctgtccgctctccacttgaggaaatgccgtttcagtctgaaagctttgcctgtgtattaactgaatctgtgctgagcttcacaaatatccggtctgctttacaggaaatccggcggattttaaaacccggagggatgctggtcgcgatcgaagtctgccttaaggaaggaaacgcactgacagacgaagcaaaaaaagaaatcacggaattttacggattcaccgcattatatgacgaggatgagtgggtcaatgtccttcgagaagaaggattttcaaagattgacatcattcctgtcgtattggaagatgcaggagacccggatgacgccgttgaaatggatctgtcgcctgcaatttccgacaaagactatgaaacgatggaaaaacacctgcattacctggaaaaataccgggactctctcgatcatattatttttatatcacatctataaatcatcatttgtcctccttctttcgtccaaccttttctattaaatccgtcataagctgactaggaatagattagatgatggaaggagcattcaagtggaccgatattataggttttgccaccaaaatattggcagagttgcgagaatcaccgacaaaggaggccgcgtccatgtcggaagaatcgtccgtgtttcaccaagcaaagtatatattgccccgatgatcagacggggaggccgcgggttcgcctacggatattacggcggctggtggggttggggccctgtatacggacttggcctcggtctaattgccggtgtggctcttgcaggcttgtttttttggtaatatgaaaaggccgattgatatcggccctttcatttttatatctttttcacctgtttaaaatactcttcaagcgtcaagtcgtgttcttggatggctttagccgctttttttcctacatagcgcaggtgccaaggttcatacttatatttcgtgatgtcttctttatttttcggatagcggatgatatagccgtatttgtaggcgttcttctcgacccattgtccgtctttcgtattgccgaattcctctgataaggcgaagccgttgcttttgctggaaatatccatcgcaagtcctgtctgatgctcgctttggcccggatatgccacagcttctttcgccttttcttctcccttttggctgacttcgttgttatagatcgctttttgtctgtcataggatctgtagccggacactgcaacgagttcatagccttctttcttagcggcgctgaacatctcttcaagcgctttggcggcttcttttctgatataacgcttgtcgatatcctcggtaaaagaaaacgcgacatcaggcactgtcaggtcgctcggtgcatagttgccgggaagcgcgtattctttatttacaagcgccattatgttttccggattttgaatcgtcggcagcccgtctacatcttttatttgattaaagtacttgctctcgagtatgaagtcctgatcttccaggctgctgtctgacttttggtcttttgcatccttgcttgcatttgcagtattctgtgttttagccgtgtcattttgcttctgttcggtcatggtacatcctgtgccaagcaggaccgctgcactcagcaatgaagcaatcgtcacgtatttgtactttccgttcattcgaatccatcctttttcagtgcatgtatgcttttacaaagcagtatccagagccagcagaatcatatcattaaaggtcgtctgtctttcttctgccgttgtttcctcgccggtaatgacgtgatcgctgaccgttaaaatggagagggcttttcggccgaatttcgcagccaatgtataaagcgccgtcgtttccatctcgaccgcaagcactccgtgtttggcaagcttctcaatttggctgtcgtcgttatagaattgatccgccgtaaacacattccctgccgtaaccgggatgttccgctcacttgcagcgtcataagcagcttttagcaggccgaagtccgcgcagggcgcaaagtcgatcgagccgaatgccactctgttgatttgtgaatcagttgatgaagtcatcgcaagaatgacatctcttacattgacgtcttttctgatcgcaccgcacgatccgacgcggatcaggtttttcacatcatagcttctgatcagttcattgacataaattgaaatagacggcacacccatgcccgtcccctgaacggaaacgcgctttcctttataagtgccggtaaacccgtacattccccgtacttcgttataacattcaacgttttccaaatatgtatcagcgatatattttgcgcgcagcgggtctcctggaagcagcaccgtttctgcaatttgtcctttttctgcgccaatatgtacgctcatgattattcctcctgcctttttaaagctgattggtgatgatgattgcaacatccactcgcatatgtattataaaccaacatcgcggaaaaagaaaataaagccctgctccgattcggcatcattctttttcttgtcatgtttaaaaaaggacaggcatacctttaaaaaagaatcattacgattagctatttcaggatggaggaaaagcgatgtttcgttcacttaacagttatttaatcgactttaccgggcttgttgtcatcagtgttctgatatgccttgtgtcagccggcgggtcgctcgcctcaggcctccccttccagattccggcttccgttctgcagctgaatacgattttcatcagcattttaatcgaagcccttccctttgtgttaatcggagtattaatcgccggtttcatccagatctttgtgactgaagagcatattcgctccctttttccgaaaaacaggttttcaggagtgattgtcagctgtttactcggcgcttgttttccggcttgcgaatgcgggattgtcccgatcgtgagaagactcgtgtcaaaaggcgttcccatctatgcaggcgtcggctttctgttgacaggtccgctgatcaatccgattgtcgtcttatccacttatatggcttttggcaatgacttgcgaatggccgttttaagggttgccgtcggttttgccgcagcggtcatcatcgcttttgcgatcagcatgatgttccgctcgagccagctgaaaacggaaagccggcagacagctgcacactgcgcccattccggcagacgatcccctttttcggaaaagctctttgatatgctgaaacatgctgttgacgaattctttgatatggggaggtttctgattatcggcgctttagttgcagcgcttgtgcaaacatacctcccgttaaaatcgctgtttgtgttcggagggggcatgcttgactcggcattggtcatgatggggctggcttactttttatcgctgtgctctgaagcggatgcatttatcggcgcttccttcaccaatttgtttccttcctcatccatccttgcttttctcgtttacgggccgatgctcgacttaaaaaatacggtcatgatgctgcatgcgtttaagccgaagttcgtcatttgtttgtctgtcctgatcaccgttgttgtctttgtttgtatcaaagttgtcagtttgctgtagaaaggaggttttaccaatggtttttcagcttcggcaatttttgcgcgcacttgtgctggctgccttttccgtctttattttcaagctccattacacaggggaaattgataagctgattaatcctaaatacgattacaccagcctcatcgccgcaggtgtgttcgcgtttctgttcatcattcagctgaccaggatctggacggtgaaggatgaccgcgctggggattgcggctgcgggcatgatcatggcgagtcaaagccctttttcatcaggctgatgcattatgccgtcatcgctcttcccctcatcaccggattcaccctttccccggctgtactgaattcgtctgtcgccgccaataaagggacgatgctcaccaaaacggagatcgcccctcaaactgaaggcgaaaaggaacatgtcatgacaccggagattcagcaaggactcgccgattcagcgatgacgaagtcggcgtatgacaggaagatggatcagtttaaacaggaaaagcggattgtcatgaatgacgacatgtttgcagactattatgatgaagtgacaagcaatcttgatcactatattggaaaggagatcacggtcaaaggcttcgtccataaggaagcggggctgagcgcacgccagctcgtgctgtcccgatttatgatcacgcactgcatcgcagacgccagcctgatcggatttctcgccgaatggaacggtgctgagcaattgcagcctgacacatggattgaattggaaggaacgcttggcaaagcgtcttataacggctctgtcatcccgatcatccgcacgaagcgatggaaggagatcagcgagccggagcagccgtatgtctatccggccgcgattagtatgacagattaaagacagctttctcctggataaataacggggcgtttagtcatcctattttttaggaaggaggtcataaatgatgggcaaaaaacagcgaaacagagtcaccggattgaaaaaaaacaaccacatcccgacaaaggacgtcatcgcggcagaggatgcgcatgaaaaggaatacagcgccagaaaaagaaaaaatacaacataaaaaaactgcggacagcgcttccgcagtttttcacttcttacgaagactgcagcaaaatgcggttgattttgctccaccccgtagacagcagtttataataggtttttccctttcttccttcatcgattaaaacgatgtcgccagttgcaagaaatctcgccttataatcattcggcaccgtgtcataaacattgaaagtggaaaacgtccgttccagcacatcttcatgggttctgccgtttatttccgttctgtaaaccatctcgtatcccttatcttcaccaaagcaaggcgtttgaaaaatcgtcacatcataaggtatcagcttttttttaaacagttgaaacattaacggcaatacagatccctcctttttttataaaattggcgcttcggggctcaatccctttgactacttttgtcgaacaagcgggtacttttcgccaatttttttgaagatgaaaaacagcgcgagaccgagcgaaaaacctgagataacatcagtcatgtaatgaacgccgagatacatgcggctgattccgatgagtccgacgagaaggcccgtccacacgtaaaccgcgcgactgtgtttttgaaaaaaaggaatgcagagcaaaaggagaaatgcgataaacggatacatgctcgccgcattcatcgaatggccgctcggaaagctgtatgacggttcgtgcacgagcgggtttatcgcgggccgctctctggcaatccagccttttaaggcttcattggccgttctttcaacaaaaaacagcaaataaagatacagtgatgccgctgcttttttatagacggcgagaaccagggttaaagcaagcatcagcggcagcatgaagccgcttgaccccagctctgtcagcgctttaaaaaccgctgtgagaaccggatgtctgacagactcgagagcctgtatcacgctcacatcaaatgattgaaccgccgggatgcggataagaatggccatgatgacaaagacagctgctgaaaatagtgctttatacattagaaaagtcagtgcctccttgacattgtttttaaacattttacacccggctcccctgccgggcaaataatataggaaaaaccggagcaggtccgccccggtctccattttcaatcctctatatgctcatctatcatacattttgcaatcagataatcaaaggtgatatcggcaatttcgaacagttcgtcctcgttcggtatgtagcctcttcttgtcagctctagataaaaaaaatcagcgatttcttctgtatctatcatcagttcaatttctttcattgtgatcgcctccttattctgatgtatgagctggcattcggttttataaccggtttgtcataatgtttgtcctctttcatatacatgtcgtaacaagacaaaagccggaaggggaaaagaaaatgatccaaaaaacgcttgaagcacttgacggagaagggtttgacctggtattggggaaggtcttgaaagccatgttcgctcttattgtgttcggctgttttccttatttcttatatttgttgtttatcatttgaaatattctttcaggctgcttaacacaaactccatcatatctttatattccgcatcctgaaacatttcatacaatactttatagtcattgtagatatcaagcagttcatccacgacagtaactgccatattgcgctcatgatcctgctcctcggaatcaccagaaaatggcaaaaacactttttcagatatcggttcatcaagctcttgtccggcttcgccgacataatgaacaaacagaagctgatggacgaactggtccatttcgtaggttctaagcacgagcgttaaatcttcttcttcagtttcaagccattctccgtctttcaaacgggtcagctcgtaaatgatatcttcccagccatcctccacatatctccaaatttccgttctgtgcccggtgattttaaacaattctttgccgtaatcttttacatagacgacatctccgattaaaaattcatattcgatgtcaagcttttccgtatcgacaatgaccccgtcataatctttgtaaagttgaagagaagtctcgaaataaagcacttcattatgattgacttcatacaaaaaatgcttatcgattttatgaacttttgtaatcgttccgaccgtcccgtacatcacgacgacgaccacatccccgactttgaatttaggcgcgtttgacttcatttggattcccccttgccttgaagcttccgtgttacgcttatcgtatgctgagtgctgtcaattcgcatgggctaaggctacaaggcccgatgagttttccgaaaagcccagtcggctcgaacgaacgcaaaaaaaccgcagttctgaacaactgcggtttttttatcgctttgtttccgaaatatatcgttcccaagcctcatcaaatgtcgtcattgacgataaataatccccattaagctcaaggtaagagctgatttcatcgtaatgagttgatgccttgggaaatccgtgatcaaggtaagcatggttcgcgaattcgctgatcgcgtccttcggtttcggatggcggtatttcattaaataatggtaaaaagacttcacggtctcccctcctgtcctcttttgatgttctattatacaggccgtctgaaaaaatacaaacaaaaaacccgttgaaacacgcaaaaaaaccggcaaaagccggcttcatgaggaaaagtcaaagtaattccgcttcagtatgcgctctgttttcatcagcgcatcatatgaaacggacgatggcagtttttttgtatcaatcaagagcagctgattttcaatttcccaggtgacactgtcctcctgatagaccatcccgcacccttcgcattccaccgcaggtgtgtcggtgatttcaatcgctttcgtcccgtcgggaagctcccaatataccgccgtgcgggctgccgcggctttttcttcattgcaccattcacacttcttcattgcgcatgcccctcagcttcgccttctttcttttgctgggcaaggaatttcttttctttcaattcatcgcgctttgcccggcggcttttcaatgtttcatgatcaggcctcttggaatagctttctcttctctcgagccgttttaagccgtccggtgtgtatgaaagagcttgatccgcatagattgccgatatgccgatctcctctttttccttcatcacatcagggaagatttcggcaaaatagtcgtccgctctccccggaacatagttttcaggctcaggatacgacgtaatgacgccttcaaaattgcggagcacgactttatcggggctttgcgaaatcaagtaattcggctggatggcgattttcccgcctccgcccggcgcgtcaacgacaaaggtcggcactgcatagccgctcgtgtggccgcgcaagccttcaatgatttcaagcccctttgatacaggcgctcggaaatggccgattccttcagacaagtcgcattgataaatataatacggacggactctgattttcaccaaatcatgcatcagctttttcataatggaaacgctgtcattaatgcctgccaaaataacggcttgattgccgaccggcaccccggcattgaccagcttctcacaggcttccttcgcttccttcgtgatttcaatgctcgtgttgaaatgcgtattcagccagacgggatgatactttttcaaaatgctgcatagcttgtcggtaatccgctgcgggaagacgactggggcccttgtgccgatccgaatgatttccacgtgcggaatggcgcggaggtttttcaaaatatattcaaggatctggtcgttaatgaggaggccgtccccgcctgatatcagcacatccctgacatcaggcgtatcccgaatatagccgatcgcctgatcgagctgctttttcggcacgcccatgccgatttgcccggaaaaacgccgccttgtacagtatctgcaatacatcgagcattgattagtgacgagaaacaaaacccggtccggatagcggtgggttaagccggggacaggcgaatcttcatcctcatgaaggggatcttcaaggtcgtattttgttttgtgcatttcttctgcgagcggcaccgactgcattctgatcggacagcgcggatcatccggattcatcagtgaggcgtaatacggcgtgatatttaaagggatcgtctttgtggagattcgcaccccttcttcttcctctttcgtaagattgacgacttttttcaaatcttcaagcgttctgacggtgttggtcagctgccatatccagtcgttccatttttcctcgggaacatctttccaaagctcaatatccttccagtgccttttcggcttaaacagaccgttttccatcttccatccccctatcagcattttccctatacttttcaggttatgtgaccggcatgaaaagtgtctcttcaaatgtaaaacccgcggaagaccactttttaagaccggcttaaatttttgcaccagatgttcatattctcaatgcttctataaatgaggcagttgttcaaaagccggcccctgtatgagtatgataaatgataaagactggcgttcattccgaaagaagccgctcttgcgattgaaaaaacgcaaaagatgcccgattgcttcaagtcggtttcaagctcggcaatcaaccgcctcgtcaatgaaaagcccctgtattccggcaggacggcgcagtcggttatttccgcattccccaaagcgggattaacgtctgcgcctgctgatgcaatgactttttcgccgtcaaaagcgaggtagtaaacagccccctttcccatcgcttccttgagatatgccgaatctgaaacaggtgcgggatatacaggaaagacgctgttgtagaggtcggcgagaacaggcgcatcaacagagacggcccgcctgattttaaaggaagcgttttggatctcggcgatgcggggtgtgctgaacagctctgccagcatttgatcctgcataagccagtcagcggtttttcgcctgtcttcttttacatattttacgaacacgtcagcatcatgcccgttaaagtatccgtcgattttcccttccggttcaaacgtccgctcaagcaatgcgtctctgtcagtcgttttggtgaaaatgataattttccctatatcatgtttttttgcttctttcagtatgtcgggaaaaaatgaacacacattgccttcataattgacaattctgatccttttgctgaacaagtcgacatccgcttcaagcgtgcagctgtcattgctccattttttcaccatgatttaacctccgaaacggctgatcttttcacctttcataatcacaccaattcataataaacaggctgatgatcttggctgactggatcagggcgtctttttcaatgtattcgtttgcctggtgggccattttcgtttctcccggcccgaagacgatgacaggggtgcctccggcgtgcgacaatattccgccgtctgtcgcccacggggaagcttcgatgagcggagcctctgccgtgatggtttgataggcggatttcagcactttcgtcagttcatggtcttcagccaaatcgttaggaagccacatggcgccgaaccattctatatcaacaggatagtgcttaaaccattcatcatggtactgaagatcgttgagccagttttcaagctcggactggacggcttcaggggattcgttcggagcgattccgcaccttccttccagtgtcaccgtgtcggcaaccgacgaaggccaggcgcctccgttgatcgtgccgatgttgatcgggaccggaatcgggatattgtcatacaaagaatctgttattctcttattcctgacctgttcaagctggcggagcgattgaatgacaagcatgcttttttcgatggcgctgacgccttcatatcttgtgccgccgtgcgcagaaagccctttgaccgtgattctgaaccacattgagccctgctgtttaataaacattttcatatttgtcggctcgggaatcaaagcgccgtccgctttgtagcccctcattacggccgcaagcgtcccggctccgccacactcctcgtctacgacactttgaaaaataaggtctccttttagttgaaccccgcattgctccagcgcttccatcgcgattaaaagagcggtattgccgcctttcatgtcagttgtgcctcggccgtatatccgcccctgcttcacaaccggctgaaaaggctccgtctcccagtcttttctgtttccttcaggcacgacatcgatgtgtccgtttaagatcagcgatttcccgccgccctttccttttttaacagccgcaatattcgggctttctttaaagcttgttctgtctgatttaaacagcggatgctgttccaactgctttatgcttggctcccagacatcgatttcagcttcgaattgcctcaatttctccaggacgacggcctgggcgttaaattctcggcccatcgtgcttttttctccgacgagttttttcaaaaggcgaatcgctttttgctcatgcgaatcgatccaatcgcacacttttctctctatgttctccatccaattcctcctcttacgaaagcggcccgtcgatccggatctttccctccgtcagccgcagcacatcatcaagatcctcttcattcatcagctcttgtaatacaaaaccgccgctgtcaatggtgatcacggctttttctgtaattaccatgtcgacgcagccttttgctgtcagcggcagagtacagtcagcgacaagtttgggtgcaccgtttttatcggtatggctcatcacgacaatgacttttttcgccttttgggcaagctccatcgcccctcccattccaggaacctttttgcctgggacgatccagttggccagatctcctgactggctgacctgcagagaaccaagaatggtgacatcaatcgcaccctttctgatcatgccgaacgacagagctgaatcaaaataagaagcgccttttactacggtgacaggccagcctgccgcattgcaaagattctcatcttcctttcctttttcaggcgatccgccgatgccgagaagcccgttttcagattggatcattacggaagtgcccgggtctaaaaagttgggaactaaagacggaatgccaatgcccagattgacaatcattccgcttttgatttcgcgggccgcccgtttcgcgattctctcccgctctatgactcccaaacccatttccagttcaccccttccgtttcagctacaccttcgacaaaaacaccgggtgttacaatttcttcttcatcgagctctccaatgggaacgatccgctcgacctcggcaaatgtccgatcagcagccatcgccataagcgggttcatgttgcgagccgttttgtcgtagatgatattgccgaattcatcggcggtttttccataaatgaaagcgtattccgcactcaaggcttcctcggcaaggtatgcgcgtccgtttaatgaaacgatattctttccttggcgcaccatgtcattatcgatcccgatatcggtcaaaatgccgccaagacctgtgccgcccgcacgaattcgttcggccagcgtaccttgcggagaaaattcaacggcgagaaaaccgtcggtcatttgttttcccgcaacgggatttgaaccgatatgagaagcgatcagccgccttacgcggttattgacgattaatgggccgatcccgatgccgggaaatcctgcatcattgcatatgaccgttaaattttttacgccttttttcaaaatcgcccggatgaaagaaggcggtgaaccgactcccccaaatccgccaaacatgacggtcgcttcgtctttcaaatcggcaatggcatcttcaacagcaatacgtttgttcggcatcgtcatctttcgcgcatcaccttttccgcttgtttttcaatctcatatacggcatgtttaaatatttcaatgagctcttccatttctttgtccgatatcgtaagaggcggcgcaatgatgaccgcatctcccccgccgccgtcaatacccgcctgggacggataaagaagcagtcctctttttttcgcttcggaaatgacgagagccgacaccggcattgaagaaggaaatgtctttttgcttttttgatcggcgacaaattcaatcccgagaagaagtcccttgcccctaacgtcgccaataatgctcgactgtttcataacttctttcagcattcttttcagcttttccccttttatctcggcttgtttgacaagatcgtgcttcaggatgtagcggagaacggcgagcgcagcacgggctgaaaaggggtttgcgctgtacgtatgcccgctcatgatggcccctgagccgtttttgaccgtttccatcatgccgtcggacatgaccgctgcggcaatcggtgaatagcctgcgctcagccccttgccgagtacggcaatatccggagtcacaccccaatgttcaatcgccagcatccggccggttcggccgatcccgctcatgacttcatccgcgataaagagaatttcattatcttcgcatatttcttttacttttttataatagccagcaggtgccgtaatagctgctccagcagccccaataacgggttcggcaacgaagcccgcgatgaattgctttccgatccttttaacggcgagctcgatttctttcacgcacgcttcctggcattcaggatgagaaagccggcatctgtagcagtttggcgctgaagcggcgggatacttgtgcagcatgtgcgtaaacctgtagcggcgctcataaaatcccgacagcgacagggctccatttgtaattccgtgatagctgttccatcttgaaaggaaaatcgttttgtcgttttgtcctttttcctgccagtattgaacggcgattttcatggcggtttcaactgcttccgatccgctgttgacaaagaaagaccaattcagatcacccggcagccattcagccaggagttcggcaagctgttcggccggctcacttgtaaactgcgaacggtagacgaatgaaacagcatcaagctgctctttgagaggctcaatcacttcttggacaccgtgcccgagattgcaggtaacagcccccgaacaaccgtcaaggtaacgctttccggaatggtcgacaatccagcttccttttgcatactgaacgaccggatagcttgcgtgcagatccggcttaatcaaaaacgacatgaaaacatccccccttccccaatgagaggtttttctttacattatatgagtcgggaaaaggcggcattctcttttcacgcggaaatggttgatttcggagcaaacgccgttttcgcaaacaaaaaaaggaaggacatgtccttcctttttttcagggcgcgctggtttatattgacgtttcatcctgcaaagcgaccgtttccttcgtctgtttttcccataaataaaatgatctcatcattgaaaacgcagcgaacggcgcgggcagtgcgacgatgaggaataaatattccggactgacggcctccgacaacatccctgcggcagcatagccgagcggcataaaagagctgttgaccgcaaagaaagcgcccagcgatctgcctctattttcaccttccgttaccctttgcaagtaaccttcaatatagatgttgacgacgccgctgatcattccgatgacgatcaaattcacagcgcccagcacgacatgatcaatccagccgagaggagacaaaagcaggccgaaaatcagcattaaagcaggcacagctgcttttgcgtgctccggttttgcgataaaggacaagaaaagcgccgcacacagcgtcccgcacgcccaaaatgattggaaagcgccgcccagccaggcctgatcttttaaaagcagcgaagtccaaatgacgatatatatcggaaaaccgctgaatacaagctgctgtatgctcgtcccatacaacaaatacttgagcggcttattttgatacaagcttgtaaaaccgctgaacaattgtttattggtaaaaggaatacgcttttggctgcccctttcatctttgattctccactccaaaaagatcgacaagaaggaaaggcttccgcacagcacccataaccagccaaaatgcaaaaaggaaaacagaacccctgtgacaagcggaacaatcacttggatgagctgtgtgagcacttcttgaaatgcgattcctttttcaatttgttcttttctcaatgtatctggcaagagcgatcttgcagcgggttcgattgcggtcaaacatgccgatacgatcacccttgaagcggccagcaaaaaaaccgaattcatgcctgacagcgccaaaaatccgatcattaaaaatacagctgaaatgatcatatccgaagccgcaatgagctttcccctgtgaaacctgtcggacagccagcctgtaaacggcgataccaaaatcgagacagtcagcccgatgccgatcacgacgcttcccgaaagggcgctcccggtttcagataaggaccaccataccaatgaataatagaaaagaaccgaactaaagagcgataaaaaagttccagaccacagtctgaaaaagtccccttttatgacccaagcatatttcaaagtttctcccccgtttgtccgatattttcacctcatgaccatattacatacgaatgcaaaattttacaacaaaaacaaaaaaaaccttccggatggaaggctttgtgagcatgtcaagcgccgggcgtcgggcttttagctagcaaatgaaagccgcaccgacaatgatgagcaaaataaagaggacaacgatgagtcaaatgtgttcttccgtgaaacccgtagccgtatcctccagtaggacagcaataatgggagtaatgcacaggcttatcatcctttcgtataaagtctacaccccagcctatgcaggccaagtcccaattggtatgtgcacctgcctactttatacgaacaaatatttaaatattgtcgtgagcttttccttctgctgaaagcccagcttttcataaaacgttttcacctgatcgcttcccgaagttacaagatagcacgattccatgcccgattgtttggcggcggtgagcatctgcttgataaggcccgatccatagcctttccgctggtatggctccaaaatggcgacttcttcgattttagcaacgttttcgtcgtgatcgagataaagctcagcacatccaatcggttcgccttcttccgagtagcagacacacagctgaatgatgccttcctcataaaaaggatacttgcgcagcagcttttccttcgcaaacgcttcattgatagacaatgtatcataagcctgcatcatgcggcagccgtcaatgagcgatttctccgtcccccactctgcccgtacaccaggggaatctcctttccaatctgcaagcctgatggaataaaacaattcttcatcaagaatatagccaagatcaaagagcgactttttcatcgtaaaaggcagatcccgcttataagagcttttcacatgaacataatttcgttttaaaatttcgggtgtccgaacgagcagggagtacagctctgtcagcggaaaatcgtcctgcagctgcagaaaatgagaggaaaacatctgcgggatctcctcatctgtgtatatatgataatgggattcaatttttttgctgcatgtcagcattaaataacggtcttctgtgtttgaaatggatgtcacaacggctgcctcttttctcaagatgatctattgtaatgttttttcgctttcagagcagaaaatcctctaaaaaaagatgaccctttgaaaaaaggatcatcttgcatgctgctctcctcagctttcctctccggatttcttgcgttcaaacagtttgacatattcgccgtatccttctttctcaaggtcgtccttcggcacaaaccggagggcggctgaattgatgcaatagcgcaggccgtccggtccgggtccgtccggaaacacgtgtccaagatgggaatcggcagacttgcttctcacctcagtccgaatcatgccgtgtgaagtgtccagcttttcttcgatttctccggcatcgaccggttttgtgaagcttggccagccgcagtgtgcgtcaaatttgtcaagcgatgaaaacagcggcttccctgaaacgatatcgacatagatcccgtcttcatgcaggtcccagtactcgttttggaatggaggctccgtcccgtttttctgcgttacttcatattgcatccgggtcagctgtttcagccgttcttctttattgttcgtcatgctttcgcccccaatgctgttgtaaaaatccttcccttccgcttccgatccgatactgtgtgtagcgttcagggtgctttttatgatagtcctggtgatactcctcagccggataaaatggcccggcctccaaaatgtcggtcgcgattggatctttaaagatgccgctttctccgagctttttcttcgattcttcagcgagtttccgctgcttgtcattatggtaaaaaatcgctgtccggtaagactctccgcggtctgtgaattgtcttccgctgtcagtgggatcgatttgctgccagtagagttccagcagtttttcgtatgaaagacatcggggatcaaatgtgatttgcaccgcttccctatgtcccgttgtattgctgcacacttcttcataggtcggattttccgtatggccgccggtatagccggattcgacttttagaatgcccggctgttcgtcaaaaggcttgaccatacaccaaaagcagcctccggcaaatgtggcgagttcgcgtttttcagccatctgttctgcctccttctcttcaacacttgttgggaaccattatatcacagcatgctcatttttaagcccgctcccgctcacaggaaacaacttttaacacattcatcagccgctggctaaaaagaaaattatgacaataatatgtcattgccatcggcatattctaagaaacagctgtattcatatataattgccatagaccgttgttcaattgatggtcaaatgaactaaaaatcttctgaaacatacacttgaaaagcaaaaattatggtatcatagtgatatcatgttcatgaaaaatgataatcatgctgattcggtcattcctttttaaacaaagctgaaatttgctaattatatggaggggcgaaattttgaaagttagagaacaaatgatgtatgatatggaagcactgcttcgcacagtatttaaacagatacgtgatgagataaatgagctgctcgaaaaagagatgtcccgcaatgaattcatgattctccgcctgctgagcgagcaaggtccaaagaaagtcacggagtttgcaacgattttaggcgtttcagcaagccatatcacagctgtaaccgatgcattggttgaaaaaggctggatcacgagagtccggtcaaaagaagacagacggatcatcaaaatccatctgacagacgcaggaaaagaaattatcagatatttcgaagaaaagaaaacggaatattatttcaagcggttcagcagctacagtgatgaagagctgaaaacgctgattgaactgttcagcaaattggacaaaaaacgggaacagcgctaacccggactttacataaattggcctgaatccgtgcaccttaaaataaaaaagaggtgtactgacctatgactgctccttacctttgtccaaactgcaaaacaaaccgaacacggttcaacttaatcgaacagtccccgacatccgttaagattgatccggcaacaggggaaatagtggaaacgtattcagatgacgagctttcgccttttcacctgccgtacagcgccctgccataaaagtgcagtgcggcgcgtgcggattaattgaggatgagaagacttttatcaaacttgctgaattcgataaacgaacataaaaaagacaggatagatgaacctcgtttcatctatcctttttcattcagctgaatgcgagttcaaacggaggtgcacactctgtttctcccaaggtgtttagccctgtacaaacattgatcggctttttcaatcagctctcccgtactgtgaatcacctccggaaatgccgcaactccaatcgaaaccgtaatatgaatcttttttgaatgagaaatgaaaaaagtgtgtgtctccacttccttgcgcaccctctcagcaatctctgcagcctgcgaatgggaacagttcggcaatatgaccgaaaactcttctccgccgtttcttgatacgatatcttccgatcgggcagacttttttaaaatcgttcctaattcttttaaaatcgcatctccatttgaatgtccgtacgtatcattaatcgttttgaaataatcgatatcgatcaaaagcaaagacagtttctcgttcttctcttttgcgtttgaaatatgagcattccatatcgcatcaaattgccggacattattcaatcccgttaaataatcaatcgacgattcctcttcatacttttttaacagaaaatgagattttcttaaatatgagacgatgtatactgacgtaaagccgccgatagtagataaaatccagaaccacgtcaataacattttcattaagaagaaatcatgaaggatcatcaagatcacaattgaaatcgccacattggcaaaaataactaatgcaaatgtctttcgataagtgccggcgtctttatccatgatccgaagaatgagataatatcctgcgaatatcacgatcatacctataagcgctgcaatcgaggatgtattcgtcccgtaaacaaaccttcctcctataatcagcagagaacagataaaggccggaaaggcgcccgtaaataaaaacaaaatcatgacggggacataacgcaagtcgacgatcgtctcatcggttgcctggatcgaaaagaacataagcacatttccgagcaccccgccaagaatgccgtcaatccaatcaagttgtttgtttgtagcttttcgggaaaaaatattccactttagctgagtgtaaataaagagcgaagtaattaaaatgcacaaattcaaaaataaatcgattaaaaacatgacaagcccccagcgccaaactcattttatattgtatatatcgtcaattattaagacgttaaaagcatttttgttcctttcttcagacgcccggcgggatctggtttccgaggcttgccggaggagcttgctttcatttttcaaatagaacgaggtgcttccacttcccgtagcggtaatataaaaaggcggtcaggctgctcagcataaagctcattccgatgcccagcgctatgccgttctcgccaagccactttgaaaatagatatgtaaacggatagcgcaaagcccaaaaagaaatcacgttcagcaccaaaatttgaaacatcgctccggctgcccttacaacaccgttcaacacaaagttaattccgataaacggatagaaaaaagcaatcgtttttaaatactcttccccgaatgcggctgaatcggcttccgatataaacagcctgaccgcgtgatagcctgtcagaaatatcgcggtgctgacggcagccataaacagcaggacataaatgacgccgtagttggcgatttttttcgtacgctccatgtcgccgcttccgaaggtttggccagccatactgttgacagccgtgccgatggccatcgctgggagaatcagcaggctgtcaagccgctgtaccgcgccaaaccctgacacgacgctttctccaaatgaattgacaacgctcataatcgccatcgagccgcctgaaatcaccatcatttgcaagccggcaggcactccgagcttcaaaatgacggacgtctctgccagcgatggaagcgccggctttgaaaatggaacaagctgctttctcaccgtatagaccactccgtaaataaaagcaatcccttgggacacgacggttgcataggccgctccggcaattccgaggttgaataccgagataaacagcggatccatgaacaggttcaggatgacggccaacaggacgaaacgcaaaggtgtttgactgtcgccgaccgctcttaatactgtactgatgaaattatagccgaataaaaatataatcccgataaaatgaatcctcaaatagcttacggccaaatccatcatattgccaggcgtttgaagtagcgagagcaaaggctctgtgaaaaaatagccgataaccccgagcaatacgctcatcgccgtcatcagaacgacaaacgcgtttacatatgatgccagtccctttttatccccttttcctttttgctgcgcaagaatcgtcagcgccgcattgttgacgcccaatacgaacgacagcaccgtaaagaaaaccgttcctgagacggccgcagcaccaagagcttttgctccgagcagatttccgacccacaagctgtcgacgaattggaatgaaatctgcaaaagattggctaaaatgatcggtccggaaaaatagaccagctgtttaaatacatttccgtatgtaaagtccgttttcattgttttctccttttcatctgtcgtcttgatcacatgtgaccgatggcttcgcagcctcatatgatgtcagaaagcatgcaaaggggcgtgacaagatgttctctgcagttcataatgcccgttatatggcggaaggcttccaggggagccgctatgatgttctgcctgccgaggcgcccttttattttcgaaacagcggaaaagcagtgatgatcagactgctccacgcggctcctcataccgacaatctcgacgttttcgtaaacgggatatccgtttttcgaaacgtctcctatacagatttatcttcttatgtccggtttcctgccggccgtattcaaatcgacgtttttcgaagaggctgggcgaacggtcccctgcttacggtacagtatcacctgatccacggccggtactgcacggttgctgtcacaggcacagccgcaaagctcgttcccgtcggaatgtatgaccagcctgcggctgatccggaaagccgcagcattcgatgcgtccatctctcgccggactctcccgctcttgactttgcagtgcaaaacggacctgtcctgttttccggcgtcccctttcaatctgttacccggtacatcccggtgcgttcacagaaaatggacgtcgagctgaggggggccggttcaacagcagtcctgctgaaggccccgaggatcacgcttcatgccggcgaatccacaacgttgtatggcctcggtttcgtcaacggctctccttctctcgaaataaaagcggcgccgtttcccgtcaaagctccgccttcatagcgaaaaaaaagagacccgatgtctcttttacagtctgctgaatgcagggacaacaaaatcctaaaacgatctcatgttttaggattttgccggcaattattgattgtgatggtcagtttttttgtgtttttttgcatcaagagtaaaaatcataatgcttaaaaacaacgcacaatacctgatgttcaaatacatcttgtccatgttttcatcaacgaaactgaaggcggcgagaccgccgaagtacagtgaaaacaacatagacaacaagctgaaatatgtgtagatacgttccatatgttcacccctgtaaaccccgctgcacgatttatgaatctgtttgtgcaggcttgtaataaacaaattcgatttgatctttttctaaatcaatgtcttttgctttcacatacattccgtttttaagcggcatctctgacagacgaacttgaatttctttagcgtctgaacgaacgtgtacaaaatcaggaaggtcataaaattgatccatgtagttgagcaccatcgatatcggaacattcaacttgccgatcgaaaatctcgtcacgtcaaggaccacgtctccgtttttttccaccgtcggccgaaaggacaccctcgcatcgactgtcgaggaaaaggcgcggatcgcaccgacgatatggaattcatcatcgatttcgatttgatagtcaagatcaggcgaagactccttttccaagtacgtgttgatgaatgcggccaatgaatctttcgtgctcgtcacgttcaattgatattcgctcggagtcggacgcggcggctccttttgtccgccgggcagggaaatgagaatgaaaatcccggcaagtatcatgacgttgactgctgctaaaattaaaaataagctcttccatttcttcatttttttcaccttattctgctgggaggtcttcgtttttaatttgttcgtaaacgcgtttcgctattaaagaatacccgtattgattaggatgaaactcgtcttctgcaatcttcttttcatcgctgtattcctcaaaaatatcagcgatatccgccattttcgtgttggagaccttcttcagccttttttccgcgccttcattccattcgtctacgacttggtcaacttcccgcagttcagacagcgtaaacttaaacggattatacatgctgacataaatcaattcagcgctggcgttttgctctctgatttccgctaaaatattcgaaaaccgcttttcaaacagtttttgttcagcacggaaaggtgtgagcgttaagtgcgcgaagttttggcggacgactttcatcaggtcgttgcccccgattgtaaacaaaatgtagtctgcatctttcaggccctcttgtacttctttgtcttttaatctttcaagcagctgatcagtccgggagcctttaacggcataatttttgaccgttacggacttcacatcgctccggctttcaagctcatcggccaccatgccgacatagcctttcttttcttgatcgcctaccccctctgtcagagaatcgcccaccgctgcaatcacgatatcgcgcttaggggagaccgatgttttttcaacacccgcattccactccgtacaggctgaaagcagacagacgagggccatcatgactgtaataaaacgtatgttcaataatgatgccccttccttcttgataacctaaaaaaaagtgtaccatgttttgattcttttgaaaatcatttggccgatgtaaaaaaaagcctgttttccggtgttcaggaaacaggctttagcggcaggtcgcccgtttttatcaacggttttccagcgtcttaatatcggcgatgatttcatcgtacggcgtatttcttgcaccgtcataatccttgacgactttgccgttttgatcgactagataaaatgacgattggtgaatcacctgatcctcatcttcaggttttttcacgattgatttaaagcttttcagcgcaaacttttcgatttcttcctgcgagtatccggttaaaaagtcccaattttgaaaactgagcgggtagttggccgcaaatttcttcaatttttcaggcgtatcattttcgggatcaacgctgaatgagacgatgcgggcctgcaggttttcctcttccatttgtttttgcagttcagccatatgtgaagtcatcggcggacagatcgtttcacagttcgtaaatataaagtcagccacccacacctggccttttaaactttcaagagtcaccgctttcccgtcttgattttgaaaagaaaaagactgtacatcatagttcaaaggattatcaatcttgctagttccgcaggacgaaagaaacactgtgagaatacctgcaaggaaaatgccaaaaacgtttttcaatccttccatcccctttttcaatcggtgtaaaaggtaaaaccgatcgctccttttccggtatgaaccgagataatcggtgtggtgtagtcaatatcaatatcgattcccgggatatgttcaagcaaggagtctttcagccgatgggcgagatcgagcgcatcggcatgggcgattccgatcgcctgtaccgtccttcccttaaccgctgaaacaaattgaccagttaaataacggataagctgactgctgctccggacatttttttcaggcgtatagattccgtcctcaagcctcgcgatcggcttaaccttgagcaatgagccgagcagcgcttttcccctcccgatgcggccgcctttgatcaagttgtcaaaatgatcaattgtcacatagagggaagtccggtcgcgcaagttctccaagtcttttacaatcgcttcggccgtcatgccctcttcggccagcaaggcggcccgcacgacctgaaaaccgaggccttttgaaatatacatggaatcaatcaccgtaatgttcccgccgaccatatttgaagcgcttacagcagtctggtatgtcccgctcaattcgcttgagagatggatgctgatcacttcgcttccgtcagcggtcagctcttcatacagttcgataaaagcgcctagaggcggctgtgaacttttcgggagttctgcggcgctctccattttctcaataaattcgtccggctgaatatcgaatctgtctctgtatacagtgccgtcgatcgatatcgagagcggaagaacggaaatatgatattttctgagcagttcttcgctcaagtcagcggtcgagtccgttacaattttaatgcttgtcaattcccttcacatcctgtcggttcaaatggtgtattttctagtgaggccaaatccgcatgaaaaattctttgccggcggatgccgtcttccgctcttttaaagcggattaggctctcttcatgggccggcaaagaatgccataaatatttatgcattatgcttcaattcatcatgttgataaatggccaggtaatcctgccatttcaatgctctctttaagtagtccctaaaggagtagacgttttttttccgctttgagcaatagagcgtctttaaaaagatttcaagcctcagattggccataaaaaaatgcgggtcgtcctccttcagcagaggtatttccgtcaccttcaccttctgtccatccgaacgtttgaactccaggcttttaagtaacaagctatcatcctcatttatgagatattttctttattatacataatctctgaagccgttgtctgtgattaaggttgttttcaaaaaaatttcttaaatcagcaaatgaaagagcccttcatctttattgacttcgacatagcggaagcctttcctgtccattcttgcgatcagcggctcgtaatcttcgcgctgcttcaattcgatgccgacgagcgcagggccgctgcttttattatttttcttcgtatattcaaaccgggtgatatcgtcggtcggcccgagcacttcatctaaaaattcgcgcaaagctcccgccctttgcgggaagttcacgatgaaataatgctggagtccttcatacatcatcgatctgtctttgatttcctgcattctgccgatatcgttgtttcctccgctcacaatgcatacgacatttttccctttaatttcatccctgtaaagatctaaagcggcgatcggcagcgctcccgcaggttcggcgacaatcgcgcattggttgtacagctcaagaatcgcggtgcacacctttccttcaggaacgagcaaaatatcatcgacaacggtttcaagcgttttaaatgtctcttcgccgattttctgcacagcggctccatcgacaaatttatcgattttctcaaggatgacgacttcgccttttttgtttgattcaaaaagagccggcgcgcctttaggctcaaccgcgatcagctttgtatccggggacacgtttttcatataggttcccactcctgaaagcagaccccctccgcctacgcttgcgaataaataatggggttccgtttcgatatcgtttaagatttcgaccgcgaccgtaccctggccagccatgacggcaggatcgtcaaacgggtggataaatgcgcgcttttcttcctcgcagcaggcgactgcgctttgataagcatcatcaaacgtgtcgcctgtcaggatgatctcgacgtattccttgccgaacaattcgacttgggaaattttttgcctcggggtcgtcgacggcataaaaatctttccgtgaataccgagatgtttgcaggaaaaagcgactccctgcgcatggtttcctgcactggcgcagaccaccccgtttttcgtcgtttcttttgaaagctgcttcattttataataggcgcctctcagtttaaaagagcggacaacctgcaggtcttctctttttaaatatacgttgcaatcgtacctctcggacagcctctcatttttttggagaggggtatgaataacaacatcttttacattttggtgggcttttaaaatgtctttgacttggatgagagagttttctttaagcaacggtttcatgtataagatcctttctgtataaagctttatttaatacgccattatatcatgaatattcaaaatttaaagggcaattctttgttatttacagaatattatacactttctcaatatatacggggttcttttcgattcttaatgtgcaggccacatgcactttttttcaaaaaactctttatttgttctaattgggtgttataatagaaccaattagaaccaaaaggagagccgccatgattaaacacacatatccgtccgtaggtttctccgagctgatcggggaatgcgattcctttttgcaaacgaaaaacagagcgatacaatttgcagcatcttcccatccgattctgattcatggggaaacaggcacaggcaaagagctgttcgccaaagccattcattccggatcatctttcaaggatgatcccttcacacatgtaagctgcagcacgctggatgaagatgaaacggctgaagatttttttctttcagagctgaatgagcccggaaccttgtttctcgacgaagtgtggggtctatccttgcatctccagggcaggcttttggcagccattgaaaaagggatgcaaaaaagattgatcacctcttcaagcatgcctctcattgaacggattgatagcagcgaattccgcaaggacctgtactacaggctcaatgtgctcgaccttccgcttccctctcttagtgaacggcgaagcgacatcccccttctcgtgcatcattttttaaaaagcggggatcatgacatatatgtcgaaccggtcgtttggaaagctttagagcagcatgagtttgaggggaacgtcagagaactcaaaaacatgacggattatatgataaccgtctcagacggaaaaacgattcagctttacgacacaccgccctcgttaagagaacaaatcaaaaaaaagaagcctaaggacaaaaaaacggcttcggcatcacttaccttaatggaaaaagaggagtttgcgtttttgctcgatgcaatcaagcaattaaatgaaaaaggagagcctgccagccgcagggttctgtccgagctgagcaaaagcggcaagtcggagcttacaccccagcaagtgagaagcagattggattatttggaaaaaagagagtttattacaaagggccgcggaagagccgggacaaaaatcacgcttgaaggcctccgctttttaagctctttaaagcatcacattattcaagattagaaagggtgtcttggtatgtacacgattaaagaagaaattgctaatgcaataacccatggactcggcgtcctcctgtcaatacctgccatcgtatttttggtgatatttgcgatccgctacggaagtccggttgatgttgtcagcttttcaattttcggcgcttccatgctgttcctgtatttaagttcgacccttctgcacagcattcagcaccaaaaaacaaaagatattctggagatcatcgatcactcagccatctacgtactgattgcagggacatacacaccgctgctcctcggacctttgaaaggcgcgctaggctatacgatgcttgctgtcgtttgggggcttgcgattggcggggttgtgtttaaaatcttttttgtgaaacggtttatcgttgtcagcacactggtatatcttgtgatgggctggatggcgatcattgcgatcaagccgctttatacggccttgaccggagaagggttcgccctgctgcttttagggggaatcttgtattctgtcggaaccatcttttatttatggagaaagattccatatcatcatgcgatatggcacactttcgtgctcggcggcagcgcctcaatgtttttctgcgtgcttttctacgtggcaaaagtgccgtttgtatcgtaaacggcgaaaaccaggcttccattatgggagcctggtttttttatgcccgaagctgtttgttttcagtcatgacgtatgccgggtggatcgtcaaatcgatatcaacaggtctcagcctcttgaacaacgtgccttttttcatgtcttccgtaccggctgtttcgactgcaacgatcggaatgccgagccttttggataaagatttgtaatcgagtccgtcatcttcagacataataaagctttggcctttccggagaatctcttccacttcttctagcgatgcttccttgtcggcgctttttctgaccgcggccattttattgagccagccgctgatcagcggataacgaaaggcgcgcggatcagcaaaaaacgaagcggttttgtcaaggtgtccaagcagcacggcaagctctgacaggccgagctttgggtgcacataaagcacggggccagccggcgatcttccgttctgatggatggaaacggttgaaccggttaagccgatgcaccctcgcaaaaaagctttcggcttatcaaagacagcttccatctgattggcatacgaaaggcgcggatcaagtgtctgcagcgcctgcagaagcttgatatgcttgatgagcatataggccgaataaatccataaaaaacaatagcgcaacatgaaaatcctctcctctatccttttctttgataaacgaggaattcgtagtcataaggatttttgtcatctttcaggcctttccgcctcgaaacgatttcccactcagcttcgctgaattcaggaaagtaccggtccccttcaaaggtttcatcaatttttgtcacatacagcttgtccgcaaaaggcagaatctccgtgtatagtgttgaaccgccgatgacaaaacattcttcgtttctgtttttcgcaaaccgcaccgcttcctctgccgagtgcatcacctgacaattcgggatatccagttctttattggatgtgacgatgatgttctcgcggtggggcaaaggtctgccgatggactcgaacgtctttctccccatgattacggcgtgccctttcgtcacctctttaaaatacttcaaatcttgcggcagatgccatggcaaatcattgtctttgccgatcaggcggtttctgtccattgcagcaatcaatgagatcattgtttaatgcctccttatgatgtttgtagcgaaataatgccggatgatgctcatctttttgtgtgatcatctgtgaacatgatgcatgaagatggaggttaaagctgtgatgagaggaactttcttcgaggttttcattctgatcaggccgcccgaatgcatttgtctcattccccgttttgttcaattccggttttcttacatatgacggcacatatccgcatgatgtttcatttttttcatccttttgtagtgtatcttgtttaacctttcgaaaacaagacatttttcgagaaaaggcgtaaaatatgccgcataaaaaaacccgcctgatggcggggacgggcgagtctttcagcggcttttcgcaacgctctgtccgtctgttctctcttcctgcacttcatcctcaagatcctgatgcgaatgggcaattcggcttgccgccgctgccgccaaagctgcgacgatatcatcaaggaacgtatgaacctcatcgtccggacagtcgtccagttctttaatgatgccgaatttttctttatccagatagccgaagttcgtcaagccgatcgaaccgtagacgtttacgatagatagagggataatctcgtcgatcccgtaaaggggttcgtccgtttcgaccaaatattgaagcggttcaggcaacagctttttctcggccagctggtcaagcgctatccccgttaaaacggcatgaacgatttccctcttatttaagaccttttcgacattttcaatgcatacatcaagcgggagatcaggatggtatttttcctgcagcttttgtacgatcagcgcgatatcctcaatcgcaaccccgcgctcattcagcatatttttcgttaagtgcaccatttcattcatcgtatacttcttcatctgcatcaatctcctttagtgactcatccagttaggcggtgtattgcggtcccagtaaatgcttccgagatcgtgatgtttttgaaagccgtcttcggcagtatggtaatgaaagttaaaccagtaccctttatgcggcggcttgtccctgcgcacatggaaccttagcacatcttcccccgttttcagattgtaacacgtggaagattctctccgacttccccgccgtagttcatcttgtaaatgacaagatcctgttatgtgtctctggcctgcctcgttttgcgatggatgtctatgatctcctcgatccatggaagcacttcttccctgtactcgtcttcaatgaccggcgatatcctgctgccgaattttacgaatgatagatcttcagcttcattgagcagttcatccctgtaggtgtcaaatgaagatttggattcgccgtcttcatcaagctcgggctcttcttgcttttgataaacagccgtatatccggattctttcacgctctgatgctcctgcggcttgtccgccatcaatgccgcaggaggagatacaaggccgaacgttgcaattgtaaataatgcgacaagcgcttttctcatccacatcttcatgactgattagttcccttctgatcgctttttcgttttctcttattctatcataggttgaattttcagtcattcataaagtggagatgctgatctacaaaacgccttttcttttagcgataaaacgtttacaatcaaagatgaaaattccaaatttgggagtgatcgttcatggttgaaggtctttttatagccgcttcattaattaccctcgcttattttatcgtcatggaaatcgcagattaaaaaaacccaaggtatataccttgggttttcatttttcgaggacaccgtaatgaaacagggccgttttgcgtttttttacggaaaatccgtatttttcaaagcgcggactcttccagtggtctttcagaaccactctttttctggcgacccgaagggcttcatgtaaagcgccgtcaagcgtaaactcggaatgcgcccactttcttaaaggggcgatgccgtctgattctttgattccatcatcaaacatcgggtcgaagtagacgatatctgctgaagcatcatcaagttccagcaggtaatcaatgctgtcgcctgaatgaacccgaatccttttcatcgcctgatccaaaacgtcaaggccggtctcccacgattgaagccccgcctcgacaagaaaagcgagaagcgggcttttttcaattccgcgcacttcgccttgttcgcctgcggcaaggctcgcaatgatcgcgtctgatccaagaccgagcgtgcaatcgagcaccttgtcccccggttcaacttgtgcagcttcgacaaaagggtccggttcgcctcttaacatacgcttggcccggaacatcgcagagttcggatggaaaaagaacttttcaccttctgaatgatacagctcaaagcgctcttttccaaccacgagaacatcatcctgctctgtttgccgaatttggcgaatcggccgttttctccgctcggaaaagcggcgccgaggtccggcttgattttttctgctgttaaaatcgtgctttcagtcggtctgtagcttgttgtgacaatcatgtttttctccgtaaaaaatgcccttcaaagggcattttagcaatgtttttcaaaagcgtccgtaatgtttttcataatctccgtcatttcacggccttcaatctgttcacgcggaatgaaatgaacgacttctttgcctttcagcagtgccattgaaggtgaagacggttcatatccttcgaagtattccctcatttttgccgttgcttcacgatcctgtccggcaaaaactgtaacggtctcgtcaggccctttttcgcttccggagacggcctgaacggctgccggtcgcgccagccctgcggcacatccgcagactgagttgacgacgacgaaagtcgtgccttctgcgtcttccatgaatgtctccacttcttccgcggtcgttaactctttaaagccggcctgcaccaattcctgacgcatcggaagaacaagctggcgcatgtattcttcataagctgttgacatattaaaaagccccctctataaaccttgactactgatgttttcaaggatactacagagggggctgaatttcaaacgccgggcgaaaaaaccgctagattttcataatgccgccggtattggcagatgtcacaagctttgaatacctggcgagatagcccgttttcactttcggttcaaagccgggccagtttgcttttcttttttcccattcctcatcggagatttcgatgtttaaaatccgcttttcgatatcgacaacgatatggtcgccgttttctacgaaagcaagcgggccgccttcggctgcttccggtgaaacgtggccgatcgaaagaccgcgggaggctcctgaaaagcggccgtcggtaatcaaggcgactttcgggccgaggcccattccgacgatctgtgaagtcggcgcaagcatttcaggcattcccggtccgcctttagggccttcatagcggatgatgacgacatctcccgcttttactttacggttgatgatgccgtcaagcgcttcttcctgtgaatcaaagacaaccgcaggtccttcatggcgggtaatcccgtcttggacgccgcccgttttaatgatcgcaccgtcaggagccaggttgccgaacaggacggcgagtccgccttgctctgaaaacggctgatcgatcggatgaatgacctcgtaatctttcacttcgcgtccggcaatattttcgccaagcgttttccccgttacagtcagcgtatccaagtgaagcgcgccttcttttttcgacagctcgtttaagactgccgatacgcctcctgcttcatgcaaatcttcaataaacacatcggaagccggtgcaagcttcgataaatgcggaacccttgccgctacctcattgatccgttcaagcgaatagtctacacccgcttcattggcgatcgcaagcgtatgaaggatcgtattcgttgatccgccgagcgccatgtctaaagcgaacgcgttgtcgatcgctttttcggtcacgatgtcgcgcggtttgatatccgacttgatcagctccatcagctggcgggccgactgtttggcaaattccctgcggtcgggcgatgtcgccaaaatggtgccgttgcccggcatggcgatgccaagagcttcagaaagacagttcatcgagttcgccgtaaacatgcccgagcatgatccgcaagtcggacagccgaactgttcaagctcctcgagtcctttctcatcgattttgcctgattgataagcgccaacgccttcaaatacagaggaaagcgagatttttcgtccgtcgctcgttcttcccgcttccatcggccccccgctgacaaacacggtcggaatgttgatccgcattgccgccatgatcatgcccggtgtgattttatcacagtttggaatacataccattccgtcaaaccagtgcgccgatacaaccgtttccactgaatctgcgatgatttcgcggctcgggagagaatacctcattccgatgtgccccatcgcaattccgtcgtcgaccccgattgtattaaattcaaacggaacaccgccggcctctctgatcgcctctttgacgatttttccaaactcctgcaaatggacatgacccggtacgatatcgatgtatgagttgcaaacggcaataaacggtttgccgaagtcctcttcttttaccccagccgcgcgcagcaaactgcggtgcggcgctctgtcgatcccttttgtaatcatgtcactgcgtaaacctgtcatcgtgatcctcctaaacatcttcgtatttacattctatatattctgaatattcagttttaaaaattgtctgttaaccgcttgccggactgatccgcaagatgacggctgttttgatcttcatctgtaaatcattccccatgaatcagaacctccacattccatatgattgctaactactatatatattttcagcttgtttttcaacaatattcgaaatatttttatagaaaaagtgatattttattacaagacgcgtgacttttttcagaattcccggatcgatcgccgctttgaagcataaaaaaagacgctgtttccagcgtctttgtcagctgtcttttttgcggctttccgtcatttgcttcatacggagccttttgcttcttcaccgtattcgatcgttcgatcgccattttgatctgaaggctgacttcaaattccggatcgttttcagcttcttttaaagcgggaagcgcgctttcatcgccgacttcgtacagaaacatggcggctctccagcgcacaagcttgctcggatccttcagcgctttgatcatcgccggaatcgcttccgggttgccgatgtctgacagacaatcgccggccgttcttctgaccgtgatggttttgtcttcgagcgctttatataaaaggggaagcaccgcaggcgtttcgatcatgcccaaataaacgacagcaagccttctgatcgatgttttcgggtcattgagcgctttttcgagtactggaatatcctcttcagtaggatccatttgttcaagatgcgcatagcgtttttgccaatcttcctcatccatcatttcaagcgttacccggtaagactttcgctgcacagccgtacgtttagcctcagcatcgcttgatgcagctgattccgtcagcttccgcaggcgctcttcatcgtaagccgcctccagctcttccgttacttcgcggccgatttctgaaaaatcgccgaatctgacgccttgctctttccaagaccgttcgagcacgacgttggaagacgcggttttaagcttcaagatcgcttcctggaaacgttctggaaggccgaagcgctcctcgcgctcgccgtcggtcaatttcacctgcatcggtattccgctgaacatttgcacgaaaactttaacctcgccgaacgattctttttcttcggaacggccctccgcctcttcggcttcatccattccgaatgcagcgcgcaccttaggaaggatgtctttccaatcaaatctcgcattgcgctcgacagcgataaaatcggccacatgatagacgccttttactccgtctatgtttaaaacttcctggatgacgggaggtgcgccttccgcatgatcctttttataattattgctttttccacccggcagttcctcggtcaaaatcaccttcattgtattcggactcggtgtcggttctatcgatttaattttcatcattgtccccctctgtttaaagatccggtcttattctaccataacccccagccctgatctatcaaggcggctttctctagagaaggcgcattcattttccagttcgccgaggaattcgagcatcagcttatgccttttttctgcgagcatccgtcccgtctttgtattcatcaaatcttttaaaaggagaagcttctcgtaaaagtggccgactgcagtaggtgcattgccgcccccatagaggagatggccctttgcacccgcatacatcaaagccctggcgatcccgacggcgccgatcgcatcaagccgatcggcatcctggacagccattccttcttttgaaagaagttcgtctttatatttctctctgtctctgaatgaaattcttgtgatgatagcaaaaatcccgtcaaccgtttccggatcgaccttccattcttcggacaggcgccttttcagctcctgcagcggaacccggtgctcatcggacagcttttcatcaatcacatcatggagaagtgcgcaagcttcggtcataaacaggtctgcaccctcttcttttgcgatctgaaggcttacgttcctcaccctttcggtatgcagccagtcatgacctgtgccttcggcagaaagcttctcttttacccattcggacatcaagcggatctgttctgtttgttcctgattcagcccagccatttctgaatggtctcctccatctcctttggattggtttgcggtgaaaagcgcacaacgttttctccggtttgatcgacgagaaattttgtgaaattccatttgaccgcttttgttccaagcatgcccttcgccttgttcgtcaagtggcggaacagcgggtggatttgatccccttttacattcaccttcgaaaacatcggaaacgtgacaccgtaattgacgctgcaaaattcttcaatgcttttttcatcgcccggctcctgattcatgaattggttgctgggaaagccgagaatctcaagcccccggtctttatatgtttcatacaagtcttgaagctgctgatattgaggtgtaaatccgcacttcgaggcggtgttgacgatgagcagcactttgcctttatacggccgcagtgtcgtgtcctcgcctttaatcgtcttgacgctgatatcgtaaatggacatgacggtccctcctttttagaataaacctttggctctgccgctttcgtcgacatccatcttaagcgcggcagggtgtttcggcagccccggcattgttaaaatactgcctgtcaaagcgacgataaatcccgcgcccctcgatggttttaattcgcggacggtgatgctaaaatcttgcggcctgccgattttacccgggtcatctgataaagaatactgagttttcgccacgcagacaggcagtccgtccaacccgttctttttcaattcaagcagctgttttttcgccttttcggtaaactctaccccttcggcgccataaacggtgcgggagatcttggctaatttgtcttcgatcgagtcggttaattcgtataaataggaaaacctgttgtctttttgctccatgacatgaatgacttcccttgcgagatcagtcccgccttttccgccctcttcccaaacattgcaaagtgcagccggatgtccgttgtctctgcaccagccaagaacggcctcaagctcgtcctccgtgtcctgtacgaatctgttgacagccacaacgtatggaagaccgaaggcatctatcgtttcgatatgcttcgcaaggttggcaattcccctttttaatgcttccaggtctttttgcttcaaatcggcgagaggcgttccgccatgcattttcagcgctctgacggtggcgacgatcacgaccgcccccggtgtgaacccgccggctctcgttttgatgtgcatgaatttttccgcccccaaatcagcgccaaatcccgcttcagtcacgacatagtcagccagcttcgcagccgtttttgtcgcgatcagactgtttgccccgtgggcgatgtttgcaaacggtcctccgtggacgagcgccggtgttccttcaacagtctgaacaaggtttggtttgatagcatcttttaacaggagggcaagcgctccctgcacaccgagcatgccggccgttaccggctgtccgtcgactgtgtaggcgacgatcatcgaagccaggcgcttttttaaatcggccaagtctctggccaggcataaaacggccatgatttccgaagcgacagtaatgtcaaagccgtcttccctgggaaatccgttcgcttttccgcccaggccgacaacggtttcacgcagcgccctgtcattgagatcaagcgcccttttccagacgatttttctgatatcgatgtttaattcgtttccctgatgaatatgattgtctatgaaagccgccaaagcgttgtttgcagctgtgatcgcatgcatatctcccgtaaagtgaaggttgatgtcctccatcggaagaacctgggaataccctcctccggcagccccgcctttcaagcccattgtcggaccgagtgaaggctccctcatcgccacgatcgattttttgccaatctgccagagcgcctggctcaatccgacggtgacagtcgacttcccttcgccggccggtgtcgggttgatggaggttaccaaaatcacctggccatcgggtttttctttcaaacgctcaaaaattttcaaagaaattttcgcttttgtgcaaccaaaacactctatttcttcgtcatttatattgagtttccgtgcaatttcggtaatcggttttaattccgttctttgtgcgatttctatgtctgataaatgggatttcatttgcaagaggagcctccttttggttcatcacacgatgattttccatatttttcacacacttcttttattgtaacacaattcacacattgaaatatcgccaaaaagttcctataatgaagaaaaatcagcggagaaaaccggaggtggcgtgttgcctatcaacatacctatcaatttgccagcaaagcagattcttgaaagtgaaaatatttttgtcatggatgaaaaacgggcttttcatcaggacatcagacctttaaatattgtgattcttaatctgatgccgcagaaaatcaagaccgagacacagctgctcaggatgctcgggaattctcctttacaggtatatttcacttttttaataccgtctacacacacgccaaaacatacaccaaggcagcatttggaacagttttatacaactttttcttcaatcagggaccgaaaattcgacggcatgattattaccggtgcgccgatcgagcatttggagtacgaagaggtatcctattgggaagaactccgggagattttagactggagcaaaacgcatgtcacgtcaacgcttcacatctgctggggagcgcaggcgggactgtatcatcactacggcattcgcaaagtcaaactgccgaaaaagacatttggcgtttttgaacacagaataatggagaaaaatgaaagactggtcagaggctttgaagagttctactatgtcccgcactccaggcatacagatatcaatatggatgaccttaaagccgtttcccatttaaaagtgctcagcatatccgatgaagcgggcgtctgtttaattgcttcaaaggatgaaaaacaagtttttttaactggacatcctgagtatgatacagatactcttaaagaagagtatgaaagggatttagccaggaacatggagattgatccgccggtgaattattttaaagaagggccggatggcgcggtacctgtaaaccgctggaaagcccatgcgactcttttgttcatgaattggctgaactactacgtttaccaggaaacgccgtatgagtggaaatgaaattctcatgccctggtctgatgcaagacattcaaaatgtgttaaaatacagttgggttagtcttccacaatggggattcggctttgccgcgaaagcgggaataataaggaacccagcgctttcctgccgatccatactttaaaaataccttaatttttgttcttcatttataattaaaataatatttatggtatggtatgagtggactttgactcctgtttttttaccattttagctcttgctgtttgaattaattgaggtgaatatgcttgaataccaataaaaatatattaattttgactgcaaattacggaaatggccatgttcaagtagccaaaacgctctaccaagagtgcgaaaggctcggttttaagaatgtaactgtttcgaatttgtatcaagaatcaaatccgattgtgtcagagattacgcagtatctctacttgaaaagcttctcaatcggcaaacagttttatcgccttttctactatggagtcgataaaatttacaataaaaggaagtttaatatttatttcaaaatgggaaataaacggctggaccaactggttaaaaaacatcagccagacattatcatcaatacgtttccaatgattgtcgtgcccgaatacagacggagaatgggaaaagtcattccgacttttaacgtcatgacggatttctgtcttcataaaatttgggtccacgaacatattgataaatattacgtagcaactgattacgtgaaggaaaagctgctcgagatcggcactcaccctagcaacgtcaagatcacgggcattccgatccgcaggcagtttgaagaagaaatggacaaagataaaatctacgagaagtatcagctgtctcccgacaagaagatattgctgatcatggcaggcgcccacggggttcttaaaaacgtaaaagaactgtgtgaatctctggtgacgaaagaggatgttcaagtcgttgtcgtgtgcggaaaaaatacgatgctgaaatcttcattggaagacattgaagccctttatccaaacaagctgagaacgctcggttacatcgaaagaattgacgagctgttcagggtggcagactgcatgatcacaaagccgggcggaatcaccctgacggaggccacggcaatcggcgttcccgtcatcctttacaagcctgttcccggacaggaaaaggaaaatgccctgttcttcgaagacagaggggctgccatcgtcgtcaacaggcatgaggagattcttgagtcagtctcttcccttttggctgatgagaaaaaattaaacgaaatgaagaaaaacattaaaagcctgcatttatccaattcatcagaagtcatcctgacggacattatcgagcagtctgaaatcatcatgaacaaaaaacagactgtccgggcgctgtcctaaaaaacgcccgattcaaaaaaacacttgctctgcaagtgtttttttgatgctaagattccgagtaataaacttcttcaaatggctgtacaacgacaaacccattccctgaaaacttcatttggatggattccccgcttcccctgccgatgaacgtcttaaaagaaacatctgtcacaaattcaggctgaaggcttccagaccaggcaaccgttgcgtttggatcggtatagacggggctttccggggttacgatcaaagtgagcggctcgtagtggcttgtaatggcagccattccagttccctcaagcttaatgttaaacagtccgccggccagcatgccggaaattcttttcatcagtttaatgtcccaatggatcgacgggtcaaatgcgagcagatcatgtccatttacaaatatggagtcatctttcaagtttaagatggatatcttctttccctgatccgctagatacacctttccgtttccttccgctttcatcagggcagccccttcgccgctgaacacttttttcaccatccgtccaattccgtgttcaaataccccttctcgcttaaatttgactcttcctctataggaaaccattgaaccggcctttgcccacacttttccgtcgagattgacttccaagagacggggcgtttccatttcaaacagcccctcccctttgtcttcctgctgggttttggatacaaactcatcaactgaataacggttcatctctaaacactcctgttcgcattcctgatattggttttattatatacggaccgacgcttaaaatgtttcacccgcttgatgatgaataaccataaattgaaaacgatttcaaagaaattcctaaaaaaagcattaaagttcatttttttctcttgacagcttgacgaagcatccatggatagtgtatagtgaaaccatcatttagcagaacaccgttagatgatgaaaattttttttagcacattgtgctacagtactaggaggattaagcaatatgcaaaacggtaaagtaaaatggtttaacaatgaaaaaggcttcggcttcatcgaagttgaaggcggagacgatgtattcgttcatttcactgcaatcgaaggtgaaggatacaaatctctagaagaaggacaagaagtttctttcgaaattgttgaaggtaatcgtggacctcaagcatctaacgttgtgaagctttaacaaaatcaagacaaaatgagacttcaaataagaggagaggcaatttctgcctctcctatttaattttcagctgaatttcgatcgccagtatattttgcttcagcctttgctcgatttcctcaatgttcttctcgagagatggacgcccctttttagcgatatcaacgagctgttcaagatctttatatacctccacaaatgtcttgtgaagaacggtttgcagttcattgctttccactgttcctcagactcctttttttatgattacctaaattagtaataaagacttatattttttaggttcaatagttatatcggattaattttactttattttttctattttacacataaaaatgcctttttagaaaaaatacttgtcggaggtgtatgatcatgaaatcagaccatcgcgatgatctcgaaaccggatttaatcagcgcaagcagcttgaaattgccgtagaaactgctcaaaaaacgacgggaatggcaacgaggcaaaagagctccactttgctgaaatcggcgtatcaatccattgaagatgccagacagctgtcacaggctgaggaattagccgcactggatgaagattttttaaacgaacagctcaacatactaaatgattgccagcatcagcttgatgaatcacagcattaaaaaaaacctgaacgcggttttttagcgtggcccgaaaaccccagattgcatggattatggcctataggggaattttcggggatcaatttttgtttgtcagcacgtctccataggtgcggagcttttctccgaccgtacattttgaaatgcaaaatgcgtgggcatacgtttttccgtattcttttctgaagtgttttttgatgaagcacccttcacagtaggtgtcctgcaaatgtgtcagttccttaaagatctctttcttatccaaaacgttcatctccgttattcatctagtttgattgtgctttccacaatggtatgctcaagcattttttttgcgagctggtccgcttccttattgtctttacggctgatttgaatataggtgggcgtgagctttaatttttgaagctggctttcgattctgtccagccatttcgaatgaacgggatcatagcatggccagctgccttcaagctgattcagaacgacgagcgaatcccctttaatgacgacggagttcctgcttgccccgaggtctctaagctctttaacggcttcgtagagagccgcatattccgcttcgttattcgttgtcagccgaaagctcttattctttctcaatcgatacctttccccgccgagggagtaataaatcacaatgcctaaaccggcgagctgactttctttatcatagctgccgtcaaaatacacggtgatctcatccggttcagccgcaagttcttctttcagcttttccagttctttcagggtccaaaagctgcccttctcatcttcgaattcaagttcagtgacatacgggctttgagaaagctgacgccccgccgccactgcctctttcacttcgatccattcatcggctgtaaattgaatgggtgaagaccctttaatcttgattttcattcctgctctcagtttcacaaaatcacctttattcaaattatggcttgttatgctataatcaaaacagtttattcagaaaggaagtacccgttcttgtttaacgaaatattatggattagttttgcgatcattaattttatcattgttctcttcttttttaaacgatttggcaagaccggtttatttgtctggatcggttttgcgacagccgccgccaatatcgaggtagtcaaaacggtcgagctgttcggtttgactgcgacgctcggcaacatcctgtacggaagcgtgttttttgcgaccgacgtcatcaatgaaagatacggaaaggaagaagcgaaaaaagccgtttcaatcggttttttcattctgattaccttgacgctcgtcatgcagggagcgctcctattcaagccgcatcccgaagacatcgcacagcctgcgctggagacgatattcggcttcttgccccgcgtggccctcggcagcctgctcgcctatatcatcagccaaacgcttgatgtttatgtatattcgggaatcagaaggttatttccttccgaccgggcactgtggcttcgcaacagcggcagtacagccttaagccagctgcttgatacgttgatttttacgagcgtcgcgtttatgggcgcttatccgctggatgtatggattcagatttttatcacgacatacgtcttgaaattcgttgtagccgtattcgcagcgccgtacgcttatgccgctaaaaggatcacccctttggatgaaaggagcgaaaacaatgccggttgaggtgtatattgacggagcaagcgccggggatcccggaccgtccggacttggcatttttatcaaagacggccagaagaccgagtccttctcccttcccgccggctcactgagcaaccatgaagcagaattcatggcgctgatcgaaggaatgaagctgtgcgccgaacgaaactaccggatcgtttcgtttcggaccgattcgcagatcgtcgagcgcacggcggattcggagtttgtcaaaaatcaggctttcaagccttatctggatgctatcatccgcttaaaaaaggattttgatttattttttatcaagtggattccttcgaagtcaaatcaagcggctgacaagcttgcgaaaaaagcgatattgctgaaccaacccgagtaaattccattcccgctgcacatcataacgagtgaggtggttcatgtggaaaaacagcattcagcaggaagaggccgtctgacaggcggtgtcacgccccagggtgatattgtattgaaccgggataaccgtcatacagacccaaaaaccgagcttgaaaaccgggcgaaaaaaagcaatacaaaacattagagagatcggtttatccgatctctcttttttcgaatttcatcagcagcggctcgattccccgtatttgatgaagtctcagcatctcctttgccctgtcatgcatcaaggtgaagtccgcatcgtccaatgagcaggaaagcggtacatcgcatttaatttctgcaagaattctggacatcttcagatcttctagacattcggttattttcgtctgctggcccttcgtcagctgaccgatgttttccagcagccggtcaacagtcgaatattccttgatcagcttgtaggccgttttttcgccgatgccttttacacccggataattatcgcttgtatcgcccatcagcgctttaatgtcaatcaaagctttcggttcgatacctgtctcttcactgaatgattcttctgtgtataccttataattgccgattcctttttgaagcagggcaactttaacattgactgttaaaagctgaagtaaatctttatcaccggtgacgatcgtgatgtccgcttcttcgctgaacatcgctgtcagggtgccgatgcagtcatcggcttcatagcccgcaaggccgatatttaaaatcccgagctcttccgccgcttccttcgccatgtcaaattgcggaatcaattctagaggcggctcgctccggttcgctttatagtccttaaataaatcgtttcggtacgttttgcttcccatgtcccagcagcagatgacatggctcggttcaaacgcagacgcagcggttaacagatgctttaaaaaaccgtgaaccccgtttgtcggcacgcctttgtcattcagcataaaattgcggtgcaccgcagtcgcaaaaaaagaccggaataataaagccatcccgtctacaagcagcagcttcttgttcattatggaaactttctttcatcatacaatgcacttattgtaccacaggagcaaaaatgatgaaaacagcgtctagcgacgctgtttctatttttggtgctgttttttgcttgagattaattttgcggcttccatttgcgaataggattcagtcgcaaattcagtgttaaagccgttcttctttttagcgttgttgtttcgctgtgcattcgcgttgccaagctttgttcttcccattacacttcacctccagcgggcgggtcatggtttatgttttgcaaaaacacatgacgccacacgcggaaggatccaccagctaggcctgcggatattttcggctgacgtattcggcaaccatttccttcgagacgagccgtcttgtgggaacgatgccttttttggccaattcgttcatctgcactgtaatttggttgatgaggtcggttgaaaatgcttcgttacgccggcacttatcgaccacatcatcgattgctttttccctctcctgttcgagacgcacgaactgcttgatgtgctggtgctgtttttttgaatgtgctgtaatcgcttcatgaacgtttgtcatcgtctaattcccttctttttttattcagtctatcatgcctgccagccagatatccataccaatatcaatctgattcaacatgagcggagccattcgcctgccaaggcatgcgctttttcaatgttttcgcgctctgcgctctccagcgcctcatgaaaatatgcttctttttgttcttcgagttgagcttttgcggatagaacagccgctttctgtaattgaccggcgctcgttttgcagcggtttaaaaatgtctgcttttcacgttgaatccaattgtccgtgatcgccgaaagctttgcagtaaacgcctcgacaagccgggctttgccattttgctgaaaaaacgttttaggtgttttgaacattttcagttcatctgtaaactccccttcatccgctgacgcttcagtcgtttcccagctttcggtctcaggccggtcagcctggatatgaaccgaaaaataaggattgccggcaagccgctcttttacggcatttgcccattgttcgcccgcaaatttcagcatcaaattttccattctgatatcaagcgcttttagttcctgcaaaaattcgaattcatactcctttaagcagcttttcaaagcggtttgcagattggcgcgccaatctccgttctgaagcccggggtgtatcgcagctttaaataaatcgtgtgcaaaaaaggccagacgctgcttcatgtggtaaaattgctcttccacatccttttccgtcatttgaaggattgatgaccccttctctgcttcttcaatcgcagccaaagcctcttgataagcttttgcgacgcgcttttgctccgcttccttttcttcagcggaacggtgcagtgaaccgcggagctgaaagacggtttcacacagttttttgccttcatcaagcagctcttcgacagctgttctggccaaaccgttttcgataaaatcgtcgagctcccgctttagcctgctgaagtcgttgtacggcgaagtttttttgttgagctcctgcttgctcgatacatggtacaggtgcggattttggatgccttctttcaagagctctccccttacatagtcttcaaccgtctgtaattcgaccgggcttttcgcgaggtcagccgcatttaaaataaaaaacattttatccatgctgaaagcgtctttaatgagccccagcctgcgcaaaaacgaccggtccgctttggaaaatgaatgctggtagtatgttaagtaaagcagggcatcagcatctttcatgtattgaaacgcaagttcagtatgccgtttattcatgctgctggctcccggtgtatcgacgattgttattcctttctccgtgaccggtgtgctcaaataaacggtgacttcgcggacggcacaggccgtttgttcttcagcgacatacggatgcagatcgtcagcggaaatcgtcaggatttcctgatcattgatatatgaaccataacgcttataagccttgaggaagttcttgatcagcagccgttcatcatcgtgcagttcctcttttttcaagaggtttttaagtttttcgccaaaagcggagccttttgctgaagccatttttccatctaaaagctgatccagttcagctgtgatttccccttccgttttaaaagcgacttcggctgtcccgtcccttttggttcccgacggttttgttattttattaatcgttgccgttgtcggcgtcggagatgacggcagcactttccgcccgcaaagcgcatttgcaaaagacgatttgccggaactgaatgcgccgaagagcgccagggtaaactgccttgtatgaaggcgctccgttttgtgcaggaatgcttttctctgcttttctaaagccgggatatccgccaaaatccgggcaagttcgaaaaagtgctcaatggactcagaaacgccctttttcggatgaagagcctcgtctttacggctgctgttttccccttgtgcacggaccggttccgctcgcttcgcatcaagcgttttttcaaggggctttctttcggcggcataccaattcgccggcagatcgctctgattgccgtgttcccattgatcccagagacggtttgctttttcatatgacttctgctgctcaatcaaccgtctttcgcgctcggcgagcttcgcttgttccgcatcatattcagcttttatcgcttccgcctgcaggacgcttctttctttaataaaggttttgagctggtcgatgagcggctgcgcttgtctcttcgcctttcttctgatgttttcagccagttctttcgtgtagttcagcacgtattccggtgtaagctcagccccttttttccgggaacgaagcaggtcgttttcatctatcacggtccgaaattgaagaacttcccgaagcatttcatcattctggacgttaaagcatttcatgaatgccttgattgcttcaatgacatgccaatcgatttcggcttgaacccttttttggacgtcggcaagaaaagcttcttttcgtttttgtttttcttcaagcgttttggccttactgaaaagaattccttttttaaagcccttttcgattgattccaaatacgatttggccagctctctcatctcaaacggcgttatatttgcgttttgggcaatcgtttggatgtcttttttgatttgttcctccgcccgtttttcctgttctgtcaaatcggcaagctgtgattttaaagtctcgacggtttctcttaaggaagcggtttcttcagacagagccgtatcttcgtcactgatcagcattttgatatgttcatgaatcaagctgctgattttttgctccgtatatgcctgcagctgctgttcggattgatgctgcagtctttccagctcagcacggagccggttgaattcgttgagcggatgatcggctgcggtgaccgatgtaaaaaagaggtgttcttcactgatcccttctttcagcagcatatctagaacttgctttttataggcgtggaagtctgtttcagcttcgtcatggcggtcaatctggttcacgatgaaaaaaatattgggtatcttatcttttattgatcgaagaaatttcacattttcttcggaatggacatgattgtagtgcacgacataaaacaaggcatccgcctggtgaagaatcgaagacgccgatagaaaatgagcatcgtctgtagaatcaattccaggcgtgtcgattaagacggcctgaggcgctattcctgaaaaaggccccccgatttccaccatttcaatctggctgccgtccctgcagtacgcctgcactttttctttatcataagagccgtccatctgagcgtatcttccatcgaccgtatggagtgttgttttcatttctccccggcggaccagcacgagattggcgctcgtcggaatcggacttgtcggcaggacttcttcctgaagcagcgcgttcaaaagcgatgatttccctgctgaatagtgtccggttaacgcgatgtacacttcttttctcagccattttcggatgatgcccgcaagctgcgccgaccgcttgtcatccccgttttttgtgagctccccgaaaaccgctccggctcttttcatcagatcgtctttcgtgtttatttgtgccatgtttcctaccccttttatgcgttgttgtttgccatcttagccctttctcccattttacacaaccttgctgtatttttcttcacaatcggaaagaaaaacgagaaaaagctgccggtttcggcagcttcagcacgtgtatctatttatttttgcggattcgctcctgcgattccttttaagacatatccaatcaataaactgtatgtactgacggccgccagtagaaaaaacatcgtcatacgcgactcaccatcctataatgagaatgtttatcatcattataaatgaaatgataatcattttcaatggtgtaatttttctaatgcctgttcttccgtacgaatgcggatgtacatgacagcagcgttgagcaccgtaaataaaagtgcggtggcgtatgcctgaaaaagcaggggcaaaagcagaaattcaagagcgaccgccaaatagttcggatgtttaatccattgatagggcccctttcggacaagattcgttccagggatgacaaggattttcgtgttccagcatttccccagtgaaaagagcgcccaataccggagaacctgcgtgaagatgaggcctgtcaatacgacaagcgccatcggaagggttccgcgttgaaaagcggtcgtttcccaaatcaaagatacgaaaaacgaaacatgcatcgcgacgatgtaagggtaatgacgtttcccgtattcgaccgctccctctttcagagcgtttttttcgttgaacttcgcgactgccagctcaagcaggcgctgggcggcaaaaatgcttaaaatcgtccaaaacatgtgtcagtcactctctttttgtccatctcaagagcagcagctccgatgaaaagcccggtccgagcgcccctaagagaccgtattttcccggcacggggccgccatgcaagcaatattcctttaaaacatgcatcacagtggccgatgacatattgccgtgcctggccaaaatttttcgtgaacagtcgatgtgcgcttcggaaaatccaaggatttccatataagcgtcgagaactttttttccgccagggtgggccagaaatacttgaatgttctccaaagcgataatgttctttattcagaaatgcttcgatatcgttctttaagtgtgttttgatcaatgtcggaatgtccctggaaaaaacgacgcgaaaaccgttgtcattgatttcccatcccatgacctcttccgaatcttccaaggtgctggattgtgagcccaatacttccggaagaacctcaaatctggcttctgagaaatccgcttccttgccgcacattaaaagcgcggcgattccatcgccaaataaagatgtgccgataagattgcttttcgattgatcatccttttgaaacgttaaactgcacagctccgccgcaatcacaaggacatgggcttttggaaacgctttgcagtattcgaatgcccgcgctatacctgaagcccctcctgcacagcctagcccccagatcgggatccgcttcgcccgttttgaaaaaggcagaatgttcataagcttcgcttcaatgctgggagtcgagatgcctgtagaggaaataaaaaaaatcgcgtcaatttttccgcaagggatttcttttttcaaaaaacggtcgtccgacagacaattcgaaacggcttcagcactgtgtctgacagccatatcaatgtacgtttgatttttctccttgaagctcttggcctctttgtaccaatccaaaggcatgacaaattgccgtgaagcgatttcgccattttgaaaagctgacagcagacgatcaatgtctttaaatgaatctttgaacatctccctcgcaaaaacggctgcttccttctggtcgacatggcagcgcggaatgcttgtccccgccgaaatgacataggccataacaccacctctgtttacagcttctcccgaatttggcggccttatgtggacccgttgaaaaaataggccatcagcacttcatcttcatatttcccgtccgacaaaacctgttccttttgaaccccttcaacgataaagccgcttttcttatagagcgacagcgctgcttcattttcggaaaaaacggtcaagcagagcttatgcaggcgatgcagcctgcaccatttcagggtgtaggacatgatttccctgccgatcccaagcccctgcgccttgctgtggagccaagttctgaacagacccgtgtgccgcttcattttgagttcgccgcgtatgacccgggcaattccgtacaccgtaccatcgatttcaaccgccgcatacatgttgtcttttttcatcatatcgctgataaatgcacgctcttcctcaagtgtgcgcggccgttctttttggatgtaaacgcccgtttgaatcacatctttcaccgcctcgatgatgtcaggggcatccgccattttgacgggacggatgacagcttcaccgccgtctttcgtcctgattcgttcgacaagctcattcacagtttccattcgttacgcctcctcttcataccggtagtatggcttatccgcaatgagaaaacacaacaaaaaaacctcacaatccgtgaggttttaaacggcagatttctcagcagaaactgcttcaggctgttcagcatgacgagaaaacggatgaatgtgaaagatcgcattcaagagaatggcggtaaagcttcccgcaacaattccgttctctgtcaaaagcttgacggcgtcaggaaggttttgaaacatttgcggtacaaccgtcacgccgaggccgattccgattgaacacgctacgatcaacaagttctcctgcttgccgaaatcaaccctgctcagcattttgatcccgtaggcgatcaccatgccgaacatcgctaccatagcgccgccgagcacaggtttaggaatgatcgtcgttaaagcagcggctttcggaaacagccccaacaaaatgagaaaagctccggcaagcgcgatcacgctgtttttcttaactcctgtcagctgaacgagaccgacgttttgcgaatacgccgtataaggaaaggcgttgaaaaccccgcccaacagcacggcaatcccttcggcgcgatatccttttcctaaatccttttctgtcaggcggcggtccgtcaaatcgcccaatgcaaagtagacgcctgtggactcgacaaggctgacgatcagcacgagggacatcgtcaagatcggggtaacttcaaaaacaggggcgccgaagtaaaacggatgaatcatctgcacccagccagcgtttgcgacttctgtaaaatcaacttttcccattagagcggcgccggctgttcctgcgatcaagccgattaaaatggaaattgacttgataaatcctgatgtaaaacgatataaaaggacgatgactagtaaaacggaaaaagctaaagcaagattggacagctcgccgaaatcgctgctgccttcaccgccggccatgttgttcatcgcaacgggaatcaaggtgataccgatcaccgtgacgacagatcctgtgaccacgggagggaaaaacttaacaagctttccgaagaaaaaagaaatgatgacgacaatcacaccacctgctatgatgcttccatagatcgctggaataccatatgtcgaggcgatcgaaatcatcggagaaacggctgtgaacgtacaccccaatacaacaggcaaaccgataccgaaaaagcggtttttccaaacttgcagcagcgtcgccacaccgcacatcaaaatgtcggcagatacaaggtatgtcagctgagccggcgtcagaccgagagcgccgccgacgatcagcggtacgacaacggctcctgcatacatggcaaggacgtgctgaatgcttaatgaaacagttttaccggctgtaagtttcatgacccaacctcctgtaaaaaggtaacttttccaccggcaagagaggcaatacgcgcaagggattcgactctgattccaagattttcaagttcctccctgcccgtctggaatgatttctcgatgacgattccgattccgcacaccttagcgccggcctgttcaatgatggaaacgagccctttagctgcttgtccgtttgccaaaaaatcgtcgatgatcagaactttgtcatcctttgaaaggtggctggctgatacggcaaccgtactttccgttttctttgtaaatgaatagacagaagccgtcaacagattttccgtcaaggtaagcgattgacgctttcttgcaaatactaccggcacgcccagcttcaagccggccatcacggcaggtgcgatgcctgaggattcaatcgtcacaatctttgtgacgccttcctcccggaaaagcgaagcaaactcttcacccacagcaagcattaattccggatcgatttgatgatttaaaaatgaatcaactttcagcacttcgtcagacaacaccgtgccctgctctgcaatttttcgttttagcttttccattaaacccctccgttcatcaattgcccttcataaaaaaaagcattgtccgctcggatttgaaatgcgagcgggcaatgcttaaaaagacgaattccgtcagtttgactaaaagacgttcgttttcttatcgcccactcatagtcggacatttacggtgcccggtagaaacttgcgtgccatatccacgcgattatatgagtgatataatgtatcaaattatatcaactttcgttccgaatgaaaagggataaaacaaaaaaagacgaacctgcacacattttttcatttgaacgttcgtatttaacagaaaattctgacccgaaaacccctcccatacagacgggaggggttttcttttacaaatagagtgttgtatatttttcttccagatagcggattaaatgacggacgtttaattcttcgcctgtcgcagatttaatgatttccagcggtttttttcttttgccgtggatgtgtacatgctctgtcagccactttctgatcggttgaaaatcgccgttttcaatcagacggtcaaactccggaagatctttcagcatgcttgacttcagttgagccgcatacatatatccaagcgcatatgaaggaaaataaccgaaatctccgccggaccaatggacatcctgcaggattcctttagcatcgtcgggaggcgtaatgcccaggtatgcttcatatttgtcattccatagttttggaaggtctccgaccgatacttcgccgctgaaaatcgctttttcaatttcatagcggatcataatatgcagcggatatgtcagttcatcagcctcgatccgaatcagcgacggctttgattcattaacggctctgtagaacccttcggcagtaacgcctgcaaactggtcagggcttgcttcctttattttatcaaaataccgcgtccaaaagctttgatgcctgccgataaagttctcatagaaaagggattgagattcatgaatgcccattgatgcgccgtctgataaattggttccgcccagcgcttcatcaatgttctgttcataaatggcatggccgcattcatgaattgttccgaaaacagccgaccgaaaatcgttttcattgtatgctgtggtcacccgggcatccccttggctgatcgtcacctggaaaggatgaaccgtctcatccaggcgccccgcctcaaaatcatagcccagctcctgtaagaagaagtggcaaacatcgcgctgccgctctttcgggaaatgatcgtgaacaaagcccgtatcaggctttttatcactggcggcaatcttttgcacaagcggaacgatagcctcccgcaattcagaaaaaagggcgtcgagcttttcgactgtaacgcctggttcgtattggtccagaagcgtgttataaggatggccttcatatccccagtatgagataaaccgttttttaaagtcgatgattttttctaaatacggagcaaagagagaaaaatcggacgcctttttcgctttttcccagacggattccgctttggaagtcagtgtcgtatattctttgaactcctcttccggaatcttgctgtttaaatcgtactcttttttcgcttcttcaaccgctttctgtgtatcaaaaggcagatcttgtttttgcccggctaaggtatccaaaagctctttcatccgcggggacgttctcatctgaaagacgtctgccgacaattggccgatagcttcagcgcggctttcctccccttttctcggcgcgcccgttctcatatcccagtacatgacattaatcgcctgctcataccggctgattttctttaatgtttctaaaaactctttttcatatgtattgatcgacatcattcatcctcctcttcccgtatatgatgcgaattgtaatcagactaatggaaatatttacgaaagtcaacttttatgcagccaaaaaaagaaaagcgggatgtccgcttttcttatacatagactggctgaacaggaagaacagattcgacttcttttatcacattccattctttttcatcgcccgcaaaaatgctgatcgtgccgctgtcgctgtttgatctgatcagacgtccgatcccttggcgaagtcttagcagcatgtaaggaaggtctacttcgcgaaaggcgttttccacgccgctccgcttcgcttcaaacacgggatcatgcggcggaaatgggagcgaccagatgatgacattttgaagcgggtctccgggaatatcgagcccttcccatagatggacagagcacaagacggattcttctaccgtttgaaacttttcaacgattgtactgatttcttcatccccttcaaagtaaacgggaaacgaaaatgattcctgtgcagtccggcgcttgaaggacagaagctcttcaaaagacggaaacaggatcagcgtcttccctccagattctttgattgcacggattgccgcttcttctttcgcttctttttcctcgatttgatggatgtacactttcatctgctcttcataatcgtacggcgaatcgacggtaaatgataagtaatcgcggatcccgaggctggtcgccaaataatcgaacgatccgttttccgataatgtcgccgatgagaaaataaacggaatctgcttggagaacaccttttctccgagaacttcagagacggttctcggcatgacgacgaatgtcgactcaagctctttttgttcaagccagctgatcgcatttttcctgtagagcgaaagggagtaagccatctgttctaaatactcttcgacaacagttaaagcgtactggtcgatcgtgtacagctcgccctcaaaaacgagcgcctctccgattttttcaagcaaatcatacagctcggcggccgcttttttcacatcggtatcgtctttgatgcgcatgcgctcagagccttctgctttttcggcattttccgtaagcaaaccgaaaaattcgtcgttggcgcgaagcgcttcttcgacaagctctgcaaattcttctctgatgtcattgccgagcaggcgctcaaggaacatttcgagcgtggattgtttcaccctgtatgtcagcgctttttgggccgcaaactcgagcagatgcccttcatcaaaaaccactgcgctgtgctccggcaaaagcggaagctggccttcccgctttctcgcctcttccgtccaaacgtgctccatatagaaatcatgggaacagatgatgaaatcggttgattttcgataatggtctcttgacagtgtgagcccgcagcggtgcctcatatcacatgtaagacagtcctgaaaagagtcgtaaccgatttcagaccactcatcgtttgataaagacgaattctcttttcggtcgccgtacggataaaaagcctgcatgccctgcgattcgtgaacgaaagacggcagactttcgtaaaggtcaagccatttttcatcatcagagcgctgcatcgttttctccagttttttcaaacataaatattgatcatgcgacttgctgagccttgcgtcgatcgtcaggcctaaatgctcggaaattttataaatgtcgccttcttttttgacgagctgttcgatcagcgtctcatccgcgcaggcgatgaccgccggcttgcccgtatacctggcatagctcaaggcaaacagaagatagacgagcgtttttccggtgccgacgccggcttccgcaaacatgaccttcttttccttaaatgcccgctctaattgaaaagccatgaatatttgctcatcgcgcaaatcaaagcctttttcaggaagaatatcgtaaaatacatcaccgatccaattgttcagttcttcataaaagttttttgtttttgttaatgaaaaaggcagacgagatgctgtcaccctgctccaacccccaactatcgagttttcagaacttctatcctatcactatgattcaagaaattcaacaagaaagatttgaaaaaaggagcaggaagcctctctcaactatttccggtaaatcgaatgcgtcaaaaacggatgatctgtcgattccatatggctgatcgcgtttttcaattcttcctttgcatatgtaaggcgctcttcgccaatgtcctcgagctggctttctgacgtctccagcgctttttgaatcatttgaatatgatcgctgttcaacatgaaatcacctcttttcaaatcgaataatcccgagtatatgcaggatgaatcgtttttatacaggctgattttatgttttttctttctatactcttagggcggaccgttttcgcagcggtcaaacacccttttttcagtcaaacaaaaagcttaacaccagataacaaggactgtgttagacaatgtgctctttatccatcataaaaacccagtctattccatttttctatcatatcctgtagggacttaaaatttatagactaaaggtggagagtacatgtattattatgaaccggcaaagaaagattattgggattatgattatgatccttacaagaaggatcacgactattgcaaaaaggacttttactatcatgagccttgcaagaagaattactactatcacgagccttgcaaaaaagacttctattaccatgaaccttgcaagaaggattacgattattgcaaaaaggattatgactaccatgaggattacaaaaaagactacgattaccacaagccttgcaaaaaggattacgattactgcaaaaaggacttctactaccatgagccttgtaaaaaagactatgattaccacaagccttgcaaaaaagactgctattatgagccgcgcaaaaaatgctatgattcgtcttataaaaagaaaaatgattcatggatttattagtgagtcgatgttttgccatgcgcttttaaggggctaactccgagcgggcgcgaattcaatacgccgttcagcggttccggctatggaaagaaaaaaggctgccgttttacatggcagcctttaaacttcacttttctttgttcggttttggcggccttttcccccaatactggtaatagtccgtcttaataaaaccgttaaagagcttccgttttttcgttgcttttttcccgtagcactcttcaaaacgctcgtttgatgtcagcatgtagacagaccatgtatcaagctcggcaaatgctttgcccatatccttatacatggcttcgactgctttcttttcaccgaggcgttccccgtacggcggatttccgacaattacgccgtattcctctttcgtccgaaaatcctttacctgcatttgcttaaattcgatgaaatcggcgagtccagcttcctcggcgtttgccttggcgatttcgatcatgcgatgatccaggtcataccccgagattgaaagcggctgatcataattcgctttttcttcgacttccagcctcgcttgatcccacacttctttaccgatccattcccatctttcagatgcaaaatccctgttgaaacccggggcgatattttggccgatcaaagcggcttcgatcggtatcgtacccgaaccgcaaaacggatcgacgaaaggcctgtcaggcgtccaatttgtcaatagaatcaaagctgcagcaagggtttctttcagcggcgcttccccttggccggttcgatatccccgtttatgaagcccggctccggatgaatcaagcgttatgaccgctttgtcttttaaaagagagacttcaattttgtattccggccctgtttcctcaagccactcgccctgtgtctgatattctgatttcagcttctcggcgatcgcttttttgacgatgcgctggcagtccggcacgcttgcgagcactgatttaacagactttcccgtcacggggaatgacgcgtgttcaggaagataggcgctccagtcgatcgcttttgtcttctcaaatagctcgtcaaaggtcttggctataaattcggcagcctgcactttcaccctgtcagcggttctcagccacagattggctctgcagatggcgagggcatcgccttcaaacacgactttaccgttgtcaactgtacaatcatatccaaggtcgcgcacctctttggcgacgatcgcttcaattcccatcggcgctgttgcgattaatgtataggttttcattatatcacctgtttttatgtatgttttttacatgataaaagctctcctacctgcggagagcttatacattgtcatcatcataatagtgtgtaacgttctgtaagccatgttttgttccgtcgtactgccgtcggctgctaagcctcgtactcgggtggtaatcatctatctacagagtcaactctgtccttccttccgttcatttccgtccagaaggttcccctaccaaaatttgggtttctcgctcgaggggtttaccgcgttccactctcaccatttctagtgagacttcgtcactgtggcactttcaaggatactcagccatatccataaaggacgtaggcttttttcctgccgtcagccttctgcaaggctgccctagcttatgacttcgctaggcacgaacactacgggcatctcagcaccgtgcgagcatggactttcctctacagatgtaaaatctgcagcgattacccgaacgttaagacatccactattatagcttagtttgttctaaagggcaagcggttttcatcaatcgtataatttgcttccaaatacatgtttttccaaattggaaagtcgttttagaatatcaaaattggtcgtatttgattgagccggctgtcgcttgttggcttcttcaagctgttttttcaactgcaggttttcctgctgcaattcttcgatttcctgatggaaggcttcatagtccttaataaccatgtccaagaatttgtcaacgtcttcctgcttgtagcctctgactcctgttttgaattctttttccaaaatttctttagcagaaagcttcactttatcagcaagcatctttttcacctcatatcgtgaatcatcatcttatattttttcagaaaacgtgtgcaatgtcaaattttctcttgcactttttactcttcgtaaaagctgcattcttcaacagtgactctcaagtcatccatcgtaatcgtgtagatcggaaaatcgcgtttttcctgagccttttttgcttcattcagcatatacacaggcgagccttcgatttcttcatcgtacagaatcaataagccatccgccttttcgatgaagaaccggtttttttgtttgaattgcaccgggctttcgtacggcctgtgtgtcaagctttcagtgaaatcgctggctgcgagcacggcttcatactgctcttgatttttctcgctccacttcttttcctgttccaaaaacggagtgatgaccgccactttcaagtcgggaaattcttcctgcagcgaaaacgcgacttccgccgcccatagttcagtcccgagctggcccgagataaggacccattccaggccttcctcaaggagagcgatcatccggttttcaagcgctttttttatgtagaacagggccttgtcatcgtgtttgaaaatcccgagttcaaacggcttgtaccctgtaacggccaatactttcattatgatcacctgctaaaaaatggggccgtattccgccccatttttttaaaaatattctgttagtcacgttcaatccggcgctcgttcatcctgacaaaacttccgaaaaacctttttagtaaggccccatgcccattccaggtcccggcatccctccaggcccaggcatcattcctgctccagggctcacgaagtgctgatgtgacgccttgttgacagctgattgagtttgcgggtagtaatgaacatgctgaaaatgctgatggttgacattcgttgtgtgctgcgggtgaatgtgcggtacgacggttttgctgtgcgtatggttgtagcagcattgagtaggatgaacaatcggcgccattacatgcggtttacagtgcatgaaaattcccctttctttaagcttctatatacactattaaactatgaagcagggggtaaacatgtactaatataaaaacctattttaaaagtaagccataaagctttccttgaaattcgtcatgatcaatacgataaacaatacgacgacaaaaaacagataaaacagccccttatacatatcgacgctcccttcaaacgattctaacgctattttacaagaagcgatcggtttctacaattcataacgtgcttgaaatgtttggctttcgaagatcgtcgttttctgcgcttgcccggggaatatttcgtccgtatttcctttccagccgctcgcgccttctcaagaggccggccatttctttttcggtcagctcaaacttttgtgaaccgtgctgctccagcaggttttccgctacctcaagagcggcccgaatatcccgctttcgatgttcaaagtatttggcaagttcgatgcctgcgcgccaggcggtttttccgtcttctccattttggagcttcagccaaagggctgcggcttcttttagcatgccttgttttttatactgcatggataaatcgaatgatgcgcgttcagaatgttcaaaaggttttttttcaagctcttgcaattgcgctgtcgcaagctctgtctcccggttggcgaggagccattttgccatcgcgtacttttcgtttgcttccgctgtctgctccggagtgaggattttcttcgataaatggatgtaaagagtgattaaagaaagcacgtcaagctcattatggcgcaaaacgccttcaatgatttccggccgttcctcctttaaaaaatgaaaatacatcatcggcgccagatagcccggcgtatcttcagttcttacaacgcccagctcttccttttccaccgtccctaaggaaacgcggtcaaatttatgcttccaaaggcggcgggatccgtgcagcaggtcaaagtggccgaaatccggaagctttgggaccctgtcgcggatcagcgtgtgcctcgttttcacctggggccagtcgaacgctttgccgttataggtgacaagagactgaatatcgacttcactcagaaagctgtgatagagggcggcttcgtaccccggctttggcagcagatgctgtttgacgactacgcggtcgtcatacacccttgcatggccgagcaaaaagatcgcattgccggccccgcctccgagaccggtcgtttccgtatcaaagaagaagagctggctcggtgtgtaccctttgcttgaaagcgaatgggaaacggcgctgttgttccatcgcctaaccgtctcatgcagctcagaaaacgcgtaatgaccatgaacatgagtcaacgggtaaacgacttccctgatcaggcaatagcattcctcaaacacatatggtttaacaccgagttcggcccattctttttcaaaactgacggacaaggaagtcagcttatctgcgggaggttccgttttttcttctttcgcttgatttcccaggtgatgcttatagcgattaagttttcgttttaaagacattccgctcaacctttccagccttttaaaaggcgcagagcattgttttttgtctgatcgccgccgctcactcctatgcaggaagggcatcctgactcacacggacatcttgaaatcagccgatgcgcttcactgatgatctcgggcatttgttcatacactttttgtgaaagacccactccgccgggatagcgatcatacaaaaagatcgtcggcttttcgttatgaacggctttgatttgcggaaaaacatgcagatcagatggatcgcacatcacttttaaggcggctacatgcccaagaacgtttgcagtcccaagcaaagcctcttccaatttgatgtcattccaattttgccgctcactatcgttcacctgcacccaagccgcattggtatgcagctcctcttcaggcagatgaatcggtcctgaaccgatattttcatgcgtctcaaattttattttcttaaaaatcgtcgcttttgcctgaacggtcacatccccaaaaccgaacgctgcggtttccgtctttttctccttgtcaacctcgagaactctcagcaagacggcaagattggcatcggtatagtaatcaacttgaacctcgcggacaaacgcctttttctcctcccagtcaagcttttccacctggtattggatgccttgatgcaaataaatggcttcatcgtgaagaagcgtcatggcgctgaacctgtccatttccccgattactttcgccttctcgcgtcttgactgatcaataatcacaacattttcctgagaagccgatcttaagctgatgccgtgcgcgggaaaagcgtcattcatccagtggtacgtattcccggttaagtggaggaccctttcttctgccaagtagtcaagaatatcctcaatttcgataccgccgaatgtgtccgttcttttgaatggcagttcaaaggccgcgcatttgatatgatcgacgagaatgaccaggttgtccgggttaatgacggcagtctcgggattttgtttaaagaaatagtccggattctgtacgatgtactgatcgagcggggcggaacttgccaccatgacaatcagcgcttcgttgtgccttcttccggcgcggccggcctgctgccaggcgcttgagatcgttccaggataaccggtcatgatgcatgtctgcagctgtccgatgtcaacgcccagttcgagtgcattcgtgctgacaacgcctttgatgtccccgctgcgaaggcctttttcaatgacgcgccgctcgttcggcagatagccgcccctgtacccctgaatcgaatgcgggccgacaatcggcttcatcacttcctgcaagtatgtcaatataatttccacccgaactctgcttcttgcaaacacaatcgtctgaatgccgttttttagaaattcggatgcgagctttctcacttcaagggtcgcgctttttctgatgttaagggaacggttgaccatcggcgggttgtaaaataagaagtgctttcttcccgacggggcgccgttgtttgaaatcaggtgcatcggctgccccgtgagcgtctcagcgagctccaatggattggcgatcgtcgcggatgtacagataaactgcggcttgcttccataaaattcagcaatccgcatcagccgtctgatgacattggctacatggctgccaaagactcccctgtatacgtgaagctcatcgatgacgatgtatttcagattttcaaacaatgacacccattttgtatggtgaggcaagatcgccgaatgcagcatatctggatttgtaatcacgatatggcccgcttttctgactttctgcctgatcgaaggcgacgtatctccgtcatatgtataacagttgatcgacgcaccgatttcatcgattaattcattcagttcgcttttttggtcctgcgacaatgctttagtaggaaaaaggtataagctgcgcgcatcttggtcttctgtgatcctctgaatgacgggcagattgtagcaaagcgtcttcccagatgccgtcggcgtcacaagcgtcacgtttttgccggcggcgctgtgcagaaatgcgtcggcctgatgggaatacagcttttctatccctctttgctgtaaagcatgcacgattctcttatctaaaccttcaggaaaatcgcggtaatccgcttcttttccctcgattgtatgccaatgaacaatttgcctgctgaaagcttggtcttctttcagaagctgaatcatatctgtcaaatttcgtttttgaaacaacgctgtcacctctcccttctattttagcgaatgtccgttcgttctgaaagaggtgatttcctgacaaaatgaaaaagcagagaagcgctctctgcttttttcttttactttactttactttaagctccatgagctttgtctcgctttttttcgctgctgcctcttcatgttttgtgacgcgttccaacacatcgccgttcataatgacgatcggcgtaattgtgctgctcgctttttccttgatcagttccaaatcgcatgttattaaaggatcgccgacttttactttgtctccttctttgacatgggctgtgaaaccttcgccttccattgctacggtttccagaccgatgtgaatcaagagctccacgccggacaatgaacgaatgcctatggcgtgttttgtgtggaacagctggatcacttccccgtcgacaggcgatacgatctcgcccgcggaaggctcgacagccattccgtcacccatcatcttttgagagaaaacggggtcaggaacttttgaaagttccaaaacttgtccgtcaaccggtgaaaaaacggtttcttctttcacttcatcttgtttttgaccaataccgaataattttttcagcaatacagtgggctcctttcaaaacgcctctttatgatggctattaaaagaggaacaggttaaataccaaatcgttggattccccactatttaaccacactttcaaattcccatcaatgaataaccatatgaagagcccctgcataagctgaaaataaaaaatcgagggtgatgaagaatggattttaaggaaaacgacaatcactcgctcagcaaaaaggacgaaattcaagaagctgttgaacagttgttttacaactcgcctttccacgatattttaaattcattccaaaaactcatatcagaccagcttcagaattccacgatttccatgaatatcagagaggatgatggggcgctttacgtcgatatcgccgttcctgaatcgtttcaaaatggagatattatgattgaagcgaaatcacggtatcttcatatcgccttgaaggagaaacaagaaagcggcggttcttcatcatttacaagcctgtccagaaccgttctgctcccataccctgtccgtgaagaaacaatgaagacgtcgtggaaccgaaatgtcctcacggtctcattttcggagcaaaaaaagcatgaatgaccttcatccatgctttttttatttgaagaatcccataaaccctttggcaagcgctccgacctgattgaccgtgctcaccatctggcctgcggtgtccatcattttgctgaaatcaatctgcccgttcttttttttgaattgcgacagaaagctttgaaactgtgacggctgatggagattaggccgcggcgaagggtatggatgctgataaggaaatccctgaaacggcggaagcggctgcatttgctgctgaacaggctgatgatagactgaaaacgggtccaaattctgctcaatcggctgctgatatggctgcggccgctgtgcaggatgggcgtacggaacggtttcctggctgaagtacagctgaacgggatgataggcctgatggttttgctgataggcttgaatatgcgcaccagggccggaataaggatatacggcggatctcctctcttccatctttcctctcctcctatagcccttttttataagtgtatgatatagaggcatttctcgttccaaaggttctgtcacaagtttgtcaaaaagtgtcgaaaattttaatatttgaaaaacagaaaaaagtcgaattgttatggtactatattattaatataaaaggagaggggatgcaccatatgaacgtatcatacttaagaaattgttttgccgagatgaaacagtatgagacagactgcatgaacaaactgatggatttcgctaagtttttgtatatccagggacatctgacattaaacgaatttcgcacaagtatgaaagttcttgaagcgaatggcgcacagcaccctgcttatgatatgaatacggacgccagctaaataacagccctcataaaaagagaagaccgggattaggcccggtcttcttttaatatatcgtcttctacgtttttgagcgtgtagaggacggattccgtcagatctttaaagcgttttttatgaattttgcagaaataggactgcatgaaaatttcattcgcattttcctcaaccgagttgagctgttcttcgtaaatgtattttggccgattggccttgatataagacaggctttccgccagccagcttttcactgtttgttcgaacctctcgacagaaggtttgacaacctcgaaaaaatcgtattccgtcccttcctcttttccctttctatatcgttcttccgcttcttttacaaggcggattaaatcctgtgtctgtataagaagagattgtgtatccaattttttcacctcgggtttatcgtaccaaaggaagacggccgttacaacgaatccggcttaagccgtctctaccccgggctccactcccattaacgtgctgtttaaacatgagctgagttctgccagctctttttcaatcagatcgagccgttcgttccaggcagactgcttttcctgctccgtccggcgtacggcttctgtcaaagccttctccgcagacgacatgtctgattccgtttccaaaagcatttgaaggaccgagtctttgcttgcaaatccgttcatttgcttccctcctttttgatggccttctatgcattctcccttatgcgcactctctcctccacagctgacaaaactagaagcaaaccgccaaagaaactcattttccagccaaacgcgccgctttcgacaagtgatcttgcgaaaaatggtatgatcagcgcttttttgcaaaatctaaaaaggtaaggaggtgcccgctgtggaaaacaataaaaagaaatcacctgcgaaaacaaaaccagatgctaaacaaacagacacactggataagaaattaggcggacctaaccgcccgtctacttaaaaagcaaggagaacccttgcttttttctgttttcacctcttattcagccaatgctccagcgaaaacaatgcctgcagctgccttcttttttgaaaataccaatcggtgatttcgatcgttttcggcagtttttcatctttgaacatcgcctccctctttcctccgcgaaaccaatcgcattttaatccgtctaatgaatgggcaacaacgggataacacgttctcaaaaacggcgaggttctgattttaacccctgcccagcgctccatatcaaagcgcgacccggtatgcggaacacatgatgtaaaatgaaaaaaaccggggaaaagctcaggcgaaaacagcagctcgcttaattgcttgccgagcttgatcctttcctttaaactggtgaagcgtttgacagacacaccgtaaaaaacgccttcaaccgtcgggaaaatgaccgtgttgaagtgaaaccattcacacagctgaaaaggaatcgtctgaaaaacattctttttaaacaaaggattttgtataataggagtttggatagtgttttgttcatttataatgagagcgtacatgagccgcttttgatcgcgctcatgccagaaccgctcccactccgttttcataaatgaagacacgccaaatgaggagagcaaatgaaacagcggctggccaagctgcttggaccaatggtatagcaggagctgcggataggcgtctgaaaagatcagccagttcgctctctcatacgctaaaaacagccatttctgctgaaaagccgtaagtccgagctcgaataagcgcccttttaaatcggtcatcgaccagccggcattccgggaaacaaatgaagccaaaagcgaccacttgatttcaggatggcggtcaaagtagcgtttgtaggcatttgtccgtgagatattgtccttgttcagttttgcggtcagctcttgaatgcggctcgtcagctccgccgcggaaaaagtgttgtgcaagatcagccacttccgttagtatccagattttttgtaaaaggaggatgaagaaagtgattcgttacccgaacggcaaatcctatcagccgaaaacagctgcctcatccttgcaaaagaagccgtcgtattccaatcgcggcatgaccctcgaagatgacctgaatgaaacgaatatgtattatcaatctcattcgattgcggtcatccataaaaaaccgacacctgtacagattgtccaggtcgattatccgaagcgaagcgctgcggttatcaaagaagcatatttcaagcagtcgtcaactactgattataatggggtttataaaggccgctacatcgattttgaagcgaaagaaacaaagagccgaacctcgttcccgcttcagaatttccacgatcatcagatcgagcatatgaagcaggttgtggcgcaagacggcatttgttttgttatcatatccgcttttgaagaaatttattttttggaagcagaaaaattattttatttctgggagcggaaaaagcaaaacggcagaaaatcgatccgaaaagacgagcttcaggaagccgctcaccccatttcacttggatactcgccaagaattgattatattaagattattgatcagttgtatttttcgccatcataaattatgattttaaagtcatgtgagcggaaaggtttaactacgaaaggttgagatgttatgtcagatcaatttaacagccgccaggaacggcgaaaagcccagcagggcaaaagcaggtctaatactcattctaaacccaagaaaaagaaaaaagcaggattgtttaagaaaattcttttatccattttaatcatcggtgttatcggcttgattgccgggggcgtcacttttgcggtgatggtagcggactcgccgtcccttgatgaagcaaaactgaagacaccgtactcttctaccatctatgacaaaaacggaaaagaaatcgccgaaatcggttcggaaaaacggacgtacgtgtcgattaaagacatcccggattccgtcaaaaacgcatttcttgcaacggaagacgcccgtttctatgaccaccacggcgtcgacccgatccggatcggaggagcgcttctggcaaacttcgaaggcggatttggttctgaaggcggaagtacgatcacacagcaggtcgtcaaaaactcccttctgtcacatgaaaaaacgctgaaacggaaagtccaggaagtctggctgtctttccagctggaaagaaaatactcaaaagacgaaattcttgaaatgtatttaaatcggatttacttctcgccgcaggcctacggtgtcggaaaagcggctgagcagttctacggggttacagatctaaacgacttaacggtcgagcaggccgcaacgcttgccggcatgccgcaaagcccgaataactacaacccgatcaaacatccggaaaaagccgagaaacggcgcaatgtcgtgctgagcctgatgaataaacacggctttatctctgacgcagagtacaacaaagcgaaaaaagtagccgtcacaaaaggccttgtatctccgaaagagtacgcaaaaacaacgtccaacaaatacagcgcgtttatcgagcaggccgtcgccgaagtgaaagaaaaagcgaacgtcactccgggaacggacggactgaagatttacacgacgattgatacagacgcacaggattatgtggatgagctgatggacggcgattctattcagtataccgaaaaaatgcaggccggcctcaccctgctcgatacgaaaaccggagagatccgcgcgctcggcggcggacgcgaccggaaagcaggcgactttaactatgcagtagatactaaacgtcaacccggttcaacgattaagccaatccttgactacggccctgtcattgagaacaagaaatggtcgacgtatgaacagattaaagatgaagcatacacgtattcaactggagatccgattaacaactatgacagaagctacagaggctggatatcgatgagagaggcgctggtcgattctcgaaacatcccggctttaaaagcgttccaggcagccggcaaagacaatattgtaaaatttgcaggcaaccttggccttaacataaattcagatgacttagtggaagcttatgcaatcggcggcttcggaaatggtgtgtcgcctctgcaaatggccggagcgtacagcgccttcggcaacaacggctactacaatgagccgcatactgttaccgcggtggaattcaatgacggcactaagcttgatttgacgcctgaatcaaaggctgccatgagcgattataccgcatttatgataacggatatgctgaaaagcgctgttcagcgaggaacaggaacagcggctcaagtccccggcgtcactgtagcaggtaaaacgggtacgacgaactttaccgaggacgacattagaaaacacggcataaatcgaaacggagcgagagattcatggttcgtcggctatacgccgcaatataccgcagcggtctggaccggtaaagaaggctttaattcgctgagccagagcgaacagcaagtcgccaagctcctattcaaaaaactgattgccaaggtggacaacggcagcggctcatttgaaaagcctgacagcgtcgttgaagcgaccgttctaaaaggctcgaacccgccggtgctcgccagcagcaacacgcctagcgataaaaaagtcactgagtactttgtaaaaggcacacagccgacgaccgtttcgaaaaaatatgaagaaaaagaaaatgccgacaagccgtcaggtttgagcgcagagtatgatgaagcatcaaagagcattaagctttcatggtcatattccggagacggtgatgtatcctttaaagtcaaacagtctgttgacggaggcggatacagcgaaattcaaaacagcagtgcgaaagaagccgtcataccgaatgcaaaagaaggatccgtttacagattccaagtcactgccgttaccgaagatggtgaaagcgaccctgcttctgtaacgcttaaagtcaacgcggctgatgaggatgagtcaaaaacggacgatgaaaagaaagacgatgacgagaagaagcaggatgctgatgatgatcaggacaaagacaaacaaaataacggcaattcaaatcagccgaatgatcaaaatccaggaaattccgatcaaaacaatcaaaatccgggaaattcagaccaaaacaacggcagaaaagatgatgacgccgatgatcaagacaacgatcaaaataaagataaagataaagacaaaaacaaaaacccggatcaaggcgccaacacaggtgatcaacaaacaaattccaacggtcaatcaaccggcaccaattgatcaaaaaagccactcacaatttagtgagtggcttttttatgattcatggcaacatatttataaaattgctttttcatttccgtaaacaattcgtcaagctggataaaacaatggtactgcgtcggtttcagcaggatgaactcgagccgttccgtccagttcatcggctttgctccaaaatccttccgggtgatgatctcccagttgagacttttgacaggctcccccatcgtccagtgaaggcttgcgatcaagcagcacaccccgttgagcatgtcatcctggctgcaccttgattttctcgttttaaagacgggcagaagcttttcttttgtgcgttcccattctgcaaacagaagcgggacccattcttccgcatgctcccaaggcttgtcctctcctgcgtcttgaaaaaaatcatagcagagcggattttcagaaagtaccgcaagcctttcgccggattccggccttttcttccgcagcgttttttcgtattcgtccaacagtgaaacgcttgtcacagcagcttcaccagcccttttttatatcgtttttgcccttccctgcacagagaaaacaacgggcattcttcgcatttcggtctttgcgccttacagtgatagcggccgaaaaaaatcaagcggtgatgagtgacggaccactctgattcaggcacttttttcatcagcgtcttttcaacttccatgaccgaatccttccatctacaaatgccgagcctttttgaaactctttccacatgggtgtcgacggcaatggcaggaacgccgaatgccacggaaacgacgacattagcggtctttcttccgacacccggaagtttcaccagctcatcgcggtctctcggcacttcacctccgtagtcttccagcagcattttgcacagcttttgaatatttttagctttgttgcggtataagccgatcgatttgatgtcctgctgcagctcttcaagcggaactgcaagataatcttcaggttttttgtatttttggaaaagcgttttcgtcactttattgacaagcgcgtctgtgcactgggccgataaagcgacagcgatgacaagttcaaacggattgtcatggactaattcgcactctgcatccggaaacatttcaccgattgtgtctaaacaaaactcgatctgtttttttgttagcatgtcttcacctttcactttattgttcaagccaattgtaaaaaggaacctgtcttgtatactccttttgctcattttgccgcggagcagtcttccgcctgaatctttggctgtagtttacggcttgttcgactgttgaaacgccgtttttcttccactcaaacagaatccggtcaatgtagcggaaatttaattttcctgatatgacggcttctttgagagcttgtttgatcagctgtgcatcgtgatgatcctggtcaagccagatgctgagcgtctcgcattccagcggagaaagcggtcgtgcaaactcttcttcaaagattgtataaaggctcttctgttcgccttcattctgttcggcgagttttttctgctcggccatttctaaaagctcaaacagcttgccccagagaggttcgagcgaatatttttcaaatttaatgccgttctggtcttcgcattcttctatatagatgaagcctttttgaatgaacattctcagcatattcatgcattcttcggtttcaatcgacatcgtcttgcttaattcctccggcgtcggaaaaaaagaacctctttcaacatgcattttaatgtttaagagcagcatgaattctgtctcgtttaagccaagctcccgatagttcataaagagcagattcggaatggtgacagctcccatatcctgcatcttaataaagtgctgttttttcattcgatacacctcttaccttccagtatatcatggatgactgtgaaaaagtctcctgcaatcaggagacttttttcttaaggatataagcgatttaacagtcttgggaacggaatcgtttcgcggacgtgcggagagccgcagatccaggcaaccgtccgttcaagtccgagtccgaaccctgaatgcggaactgagccgtattttctcagctctgcataccattgataagcgtccgattctaaaccgtgctctttcaggcgcgcttcgagaagctcgagatcatgaatccgttcagatccgccgataatctcgccgtagccttcaggcgcaatcaagtcagcgcacaatacgacatcttccctgtcaggtgcaggctgcatataaaacggctttaatgatgtcggatagtgtgtaataaataccggcttgtcatagctttcagcaatcgccgtttcgtgaggagcgccgaagtcatcgccccattcaatatcgtcaaagcctttctcttttaagaactgaattgcttcatcatacgtgattcttgggaaaggcgctttgataagctccagcttggaagtgtctctgccgagcgtattcagttctattttgcagttttcaagcacgctttggacgataaaagagacatagttctcttgaacttcaaggttttcgttgaattcgacaaaagccatttccggctcgatcatccagaattcgatcagatggcgcttcgtttttgatttctcagctctgaaagtcggtccgaatgaaaagacttttcctaaagccattgcagcagcttccatgtaaagctggccgctttgcgaaaggtaggcatcttcgtcaaaatactttgtcgcaaaaagctctgtcgttccttcgggtgcgcttcccgtcaaaatcggaggatcgactttaacaaagccttccttattgaaaaattcgtatgtagcgcgaataatctcgttgcggattttcatcgttgcatgctgccgttttgaacggagccacaaatgtctgtgatccatcaaaaattctgttccgtgttctttaggtgtaatcggataatctgtcgcttcatggatgacttcaagcgacgtcacagcaagctcgtagccgagaggcgaacgctcgtcttctttgacgacgccttttacatataatgatgtttcctgtgttacagacttagcggtttgaaatgtttcttcgtccacttccgctttgacgacgactccttggataaagcctgtcccgtctctaagctgcaaaaacgcaattttgccgcttgaacgtttgttggcgatccaagcgccgattgttacttcttcaccaacatgcttgtacacttggtttattgttgttttcactatcgtttccctccaaaacacgaaagaattcggtcaagccatcattctttctgacgtccataacgtatattataccttttttaaatcgatcaggtcaatgcaggttgtgtgcatgaaaaaagcgtccgcctgcggacgctttttaatttctagcggctgcgattcacgacaaagcggcggatgcgttcaaccgcttcttccaaaagtgacagggatgtcgcatacgacagacggatgttgtccggtgcgccgaaccctgaaccaggaacgatcgcaaccttttcttcttccaaaagcgcttcggcgaattcatcaacgcttgaaaagccgcacgattctgccgctttttttgcattcgggaacaagtagaaggctccttcaggcttcaggcatgttaatcccggaatgtcaacaagcagttcatacaccttgttcagccgttcttcaaaagcttttctcatctcctcaacaggctcgtttggcccattgtaagcggcaatggctccatattgagcgacagatgtcggatttgacgtgctgtggctggctaggttcgtcatcgctttaatgatcggttcgctgcctgctgcataaccgattctccagccggtcatgctgtgtgacttggaaaccccgttgatgatcacggtttggtttttaagttctggagaaagctgtgcaatggatacatgtttttttccgccgtaaatcagcttttcatatatttcatcagatacgattaaaacgttgcgtcgaaggcatacttcaccgagagctttgagctcttcttccgtatacatcatccctgtcggattgcttggggaattgatgatcacagccttcgttttttctgtgacggctttttcgagctgctccggagaaatcttgaagctgttttcctcaaggccttccacaaacacaggtttgccgcctgcaagcttgacttgttcaggatagctgacccagtacggagtcggaataatcacttcgtccccttcgtcgaggagcacttgaaatagggtgtaaagagcatgctttgcacctgtgcacacaataacttccgattggctgtattcaattccctgatcgcgcttgaatttatcgcggatgctgtctttcagcgccgcaagaccgccggaaggcgtgtatttggtatgtccttcgttcatcgaacggacagccgcttcaatgatgtgctcaggcgtattaaaatccggctcacctgccccaagaccgatgacgtcgtgccctgccgcttttaattcttttgcttttgcagtgattgccaatgttgcagatggtgttaacgctgatactcttttagctagattcaactcgatttccccctgtttcgtctaaggcgtaatatttttgtgaatttttccgtttataaagtccacatagcttaaactgtactgcccatctttatttaagtatgtaacttcccacaatagaacattgccttcccttgcaaggtgcacctctttaagctcagacatcaggccctcatcctgaacagcttttgcagcctggcggccggtaatgccggctgatgcttttttgtaaagcgttttctgctttttgtcagcaggcacccaaacatacattttgtcgccttttttgtctgcccctgtaacaatgtactgcttttctttaccgacaaacgtctccacgctgtcaacttgttttaagccggcttcctgcctggctgtttcggcagcctgctcgtggccgttttctttctgatccattgccgtacggtagacattcgctcccgcaagaagtgctgttaaaaagataataccaaatatcagtatgaaaattaatgtttttttgcccattttctgctcctaagtacgataaatcgtaaaaatggcctgtttttggtcttcttcatcgagagcgaggccgaacatgagatcatcgcgtttgagcgtacggttcaaaagatcaacgattttatacaggtcttctgagtgctcgacgcttacagtagatagaatttcgattttgttttccatttttcaaatacctccgaacgaaacaataattgtaattcatactctttgtagcaaaagccatactagttgttacaacgggatatccgtttaaataaacagcctaaaaaataaaaccttaatccacaccatttaagagccgctttatgcggcttttagccgtttttcccggctatgtaggcttcaagctcaaggaaagtaggctccatgacttttgcagggggcagagccttcataaacaccgtgccgtaggaagaggttcggatgcggcggtcaagaataacgaccgttccgctgtctttctctgagcggagcagcctgccgattccctgcctgaaggccaggacagcttccggcagagataccgcttgaaacggactttctccccttctctttgcccggtcgcactttgctgattcaaccggatggtcaggcggtctgaacggaagccttgcgatgatcagcgtcgtcagctcatcacccggaaagtcaacgccctcccaaaaatggttcgttccgagaagaaccgcatgaggatacgatttaaacaacttcatgaccttaacgggacttccgccggaaatcccctgtgcaaggagctgacaaggaaagtcttcctcatttttcaatgtatggtagacgtctcgcagcatatcatgagacgtaaacaggacgagcactttggcatctttctgttttgcaagcgccttgacgtaacgcgagacatcctgaatatagtctcccggatcgttttgaatcgggctgacatccgtcggaatcatgatattcatatgtttatcataagaaaaaggcgactcgatttgcaaggtcctcggatagaaatcgcttaaaccaagctttttgatcatatagtcaaaagagttctcgacgacaagcgtccccgatgtgaggacaacgctttttttctcggtgaaaaaccggtcggccagaatttcgcttgtatcaagcggctgagcgtaaatagcagcggcgttttttgcgcccttcgcgtcaatttcaatccagacgacctcatcttcaacagggtcaaacatcaagcggccgagcgtctttcgatattcttcaaggtcgttcatgcacgaatcgtattcctctaacaaaaacgcctgacggcttgtgaaagaagcctgtttttcagcgaggcttttcttttgatccataaacagccgatgcatgtcatacagcatggaacacagtcttcgtgcgccttcttcaagcctgctccatgctctgctttcaccggtttcgccgatcttatataagagacggtttagatcgtttcttggtttcctcctcttgacaaaagaatgaacagccgtaaagaatagatcgctttcttcaagaagctgagcgagccattcgtccatttggaaaaaggattctgatgaaatgcctgccgaccggtagagccgttcggcttttttcaaaatacccctctgcttgagggtgccgagcctcatcaatcttttgtggagaaagacatagtctgctctagctccatactgctcgcccgccgcgcgctcaaaatgatgggcttcatcaataatgaacatatcggcatctccggtatggattcgctgattggtttcgtcagtcaacagaagcgcatgattggtaatgatcatatcagccttctgggccctcgctttggctctttcataaaaacacaatttcctcatgttgctgctttctgcatatgaatgcgaatcatatgccagtctgtcccataaaagctttccgcctgacgggagattaatttcggataaatcgcccgtttccgtgtctgtcagccagacgagaatctgcgcttttgctaggacgctatcataattgtcatcatcttcctgtaaaatatgcttgaacttgcgaatggataagtaatgggagcggccctttaaaaccgcggcttttaccggaaatggaaaaatcttttccaaaagcgggatatcgcggtttatcatttgctgctgaagcaatgtcgtatatgtgctgatcacgaccggtttgcctgtttgcttggcgtgaattgcagccggcacgagatatccgagcgattttccgattccagtagcggcttctattaacgcatgctcatgattttgaaaagcggtccagacctcccgcatcatttttgtctgaccttctctcttgtcaaaccggtcgtccaatgaagaaagcccgccgtctctttcccaaatgagcggctctgtctgcggaacccggctcttatggccggcctcttcatcctcgacttcaggagtcctgatcacaaaagaaccgaccttcgtaaagccggcctcaagttcagcatcggcgcctttttcagcaatcaagccgtcaaaaagctcctgcgcgtcgctgatcaaatgccaggatagacgtctgatagatttcaaaacgggaatcggcagccttttcagtctgtccatcatatgtaaaaagatcaaagcggtcacttccgcatcgctgtcagccctgtgcgggttttcatggcgaatctgaagctcttcgctcagctctgtcaatttatagccgtcaaaacccggaaagacgattctcgaaagctccaccgtatcgagaacgctgcattcaatctcaccaaagccggccagctgcagctcatgcttgacaaaagcaagatcaaaatgaatgttatgagcgataaaacagctgtcatgaagcagctcaaaaatatcttcggcaatcgccgaaaatggttcttcattttcaaccatttcattcgaaatgcccgtcagctgctcaataaaagcgggaatcggctgattgggattcacatatttggagaaacgttcggttatctgtccattttcaatcacaaccgctgcaatttgaatgattctgtcgccttttttcggagaattccctgtcgtttccacatcaatgaccacatatcgttgattgttcattcaatggacacctcaatttcgataccttcgacaaaagtgtaacacgttttaaaaaggcgcgggggaaaagcttcaaaaccggcttcttctctttcgctctttccaaacgatatgaaagccccctaaaggcaagggggctacagaatggtacgggctggctcctgacccagcatttcctcgatttcgtttctctcgttcaaaacggcaaccttcggcttatgggtctttgcttcctcttcagacatcatcgcataagacacgatgatgacgacatctccaacctggacaaggcgggcggcagctccgtttaaacaaacgacgccgctgcccctttcaccgggaataatgtacgtttccagccgggccccgttattattattcacaatttgcactttttcatttgccatcattccgacagcatccagcaaatcttcatcaattgtcacgctgccgacgtagttcaaattggcttccgtcactctcgctctgtgaagttttgcgctcattaacgtacggtacatcacaaatcctccttttgatctgccgggatatcgacgatgatattgtcaattaagcgggctttggaaaactgaacggcaaccgctatgatgacttttccagtcaatggatccctgatctccagatcgggatatgaataaatatcggcataatcaataacaccactcgttttttccagaatgctccgaatctcccgcttaacggcctccgggtctctctctccattgcggatcagctcggcgccgcgctgaagagctcggtaaagagcggttgcttcctgccgttcttcagctcgcagattgacatttcttgagcttttggcaagcccgtcttcttcccgttttgtttcgacagggatcagctcgatatccatgaaaaagtcgttgatcagcccgtcgacgacggcaacctgctgggcatccttcatgccgaaataaacccttgtcggagacgtgagattgaacagctttgtgagcactgttgcgacaccgtcgaaatgcccttctcttgaacggccgcaaaggacatccgtccgctttttcacgcttgcggtaaccgtcggctcctggccgtacatttcttcaggctcaggagtgaacaagacgtccactcctgagccggccgcaagctgacggtctctttcaatatctctcggatacgcttcatagtcttctcccggaccgaactgcataggattgacaaaaatgctcatcacgacaatatcgttgtcttttcgcgctttttctactagcgacatatgaccttcatgaaggaagcccattgtcggcacaaaaccgatggttttgccttccttgcggtaatttttcgttaagttttgtatatcttttgctgtatagatctgaatcatgcctatttccctccgtataatccttcaagaacttgctgatctatacggaacgaatgagcatcttcaggaaacacgcggcttctgacatcctcaacatatccccgaagcgcttgttcaagcggctggtcgatttgtgcatactgcttgacaaatttaggcgtccggcttactccgtgtccgacaacatcgtggtaaacgagaacctgtccgtccgtgccagcacctgctccaatgccgatgacaggaattgtgagctcctttgaaatccgttcagcgagcgctgccgggacgcattccagaacgagcgccatcgcgcctgcttcttcacagcgcctgctgtcttcaatcagcttgccggcgctttcttcatctttcccttgaactttatagcctcccaaaacaccgacggattgaggagtcaagcctaaatggctgacaacaggtattccgccgcgtgttaaagccgtgatcgtctcaaacacaccgtcgccgccttcaagcttcaaagcatctgccccgctttcttgaacgatcgccgcggcatttttcagagcgctttccaaagagcagtgatatgacataaaaggcatatccgtcacaacaaacgtatcttttgccccgcgtttgacagcttttgtatggtggatcatatcagcaaccgtaacagatacggtcgagtcaaggccgagtacaaccatgccgagtgaatcgccgacaaggatcatatcgacgccggcctgttcggcaagctttgccgccggataatcgtaggcagtcagcatgacgatcggctctccctcttgtttcatttttagaaagtcagtttttgtcttcatgttttctcctcctctttttcagaggagatgagctgccgtgcttgcatctgcatcttttcggacagcaaaaaaaccttccggcaaggagaaggatttcgtatcgtccgtgttcggcaagaatcatccctctgtcccagtcctttttggatcaaggcagactgtttttttataagttgcatgctttccaggtgcagttcccagaggatactgcccatccgaagtataccaaaaacgcatggatcgttccaactatgacggattaatatcgatatcagcggagtatatttttttgatgccgtcactcgtttccaggatcaatacgccttcttcgtcgattccgagcgctttgccgtgaaacgttccgttcagcgtccgggccgtcaattcgcggttcagggtcaaagcatagctttcccacaaaagcttgatcggttcaaaaccgtaggcgagatagtcttcataccttttttcaaacgtcgacattattgtttggaccaaagccgctctgtcgattttttcaccgcttgcgagacgaaggcttgtcgctgtttcttgtaattcctccggaaagtcggctgcaagctgattgacgttgatccccgttccgacaataacggaatggacctgatcagcttccgcctgcagttccgttaagatcccgaccacttttttgccgttgatcaaaatatcgttcggccatttaatttcggctgcgatgccggtttgctcttcgattgcctgaacgatcgctacagcggctaaaagcgtcagctgcggcgttttttgcacgggaatttcaggccttaaaatgatgctcatccaaatgccgtttccttccggggaatgccatgctctcgccattcttcctcttccttcagtctgcttgtcggcaacgatgatcgttccttcgggcgcaccgttgtttgcaagttcgtgggcgattttttgagttgatgaaacgacatcctgaaaatggatcgtctgtcccatttttttcgtttttaacccgagcctgatttcatcttcagtgatcttgtcgggtttttttatcattttatagccgagctttcggaccgcttcaagttcatatcccgattttctcagatcttcgatatgcttccaaacggcggttcttgagcatccgagctcttcgctgattttctggccagaaatgaattcgccgtctgcctcggtaaacaattgaatgagtttctttcttaaatttgactgcatgaatccagccactcctctatggcttttttttgattggcaagctccccgtttaacacggcccgctcaatccgtttcaaatcatcggacacccattttccggccggcttctttctgaaattcagcagatcgcttccagataccgccaggtctttcaggcttttaatcggaagcgcctggtacgactgtctgatttcagccagctgctcttcatcgattgcctgcttgtccctcaagctgcgaatggcagatgcggccagcagcgtctcttcccccgcctcatacatcgagacggcatcccatttttgatcgatccgttcagccgtatggagcgcctgtctgatgactttccccggaagcttccacccttttaaaaaccggtgcgcttcagcgggattgatcgatatcatgtgaatgaaagccgcccatatatcggcacttttttgaagttgataaaaaggaaaagctcgggcagccagaacgcgctcctttttgccgtccagccccggaagctccttgtaaagccctgtttcagccgctgcttccagagcccggcctgctgcttttccttttaaaagtttttcgaattcaaccgttttccgctctgtagaaatatgggccaggagcggacggttttcgcaaatcgctttttttgtatttggagaaagctcaaactcgagctgactcataaaacggagcgcccgcagcatgcgaagcgcatcttcgtgaaaacgctccgccgggtcgccgaccgtttgaatcaatctttcccgtatgtcgcggagcccgccgaaatagtcgatcagtctgccttcttcatccatcgccatcgcattaatcgtcagatcccgcctcttcaggtcttccttcagcgatttgataaactgaacgccgctcggccttctgtaatcctcatattcaagctctgcgcgaaaggtcgtcacctcgtaggattctccctcaaagaggacgatgatggttccgtgttcctttccgacatcaacggttttcggaaaaatggcttcgatttcttccggggatgcatctgtagcgatatcaatatcgccgacatctctgttcatttgggcatccctgacggctccgcctacaaagtaggcctgccagccgtgttttttcagctcacgaaggagaggaagagccttcaaaaagagatcctccattgtcacactcccagtctgttaattgttgataaatttcttcatattgcgcgatgattttgttggaagaaaagcgttccttgatgctttgcagcgccgcttccgcaaactggcgctgcaggctttcatcagtcagtaaatgaagcgccttactagctgcaccttcaatatctccgacatcgaccaagtaaccggatactccgtttttgatcacctcgggaatccccccgatatttgtgccgatgcacggaacgccgcaggccatcgcttcaagcagcactaaaccgaagctttccttctcggacaaaagcagctttaaatcgctgatggcgtaaagctcttctacgctgtcttgtttgccaaggaaaagaacgtcgtcttttaatccgagctgtctgacaagctggcagatcacggtcatttccggcccgtcgccgacgagaatcagcttcgatttcatttgtttgacaatgcggctgaatacatggatgacatcctgtacgcgcttcacctgtctgaaattggatacgtggatgatcactttttcatcaggtgcaatgccgtactgctctttcagcgaatgatgctcctgtttttttaaatacacgcgctcatccacaaaattatagatcgtttcaatttttttgttcggtttgatcaaatcatacgtttgcgcggcaagagccgaagaaaccgcggtaacgcggtcagacgattcgatcgcaaacttgatcaggtcttttaaagacggatcatagccgagcacggttatatctgtgccgtgcagcgttgtgaccgttttaatgtttccgttcagcatttgcttcgctaaaaaagcggaaatcgcgtgaggcaccgcgtagtgggcatgcagaacatcaagctgttcccgctttgccacctccgccattttgctggccaaagccaaatcatacggcgggtacttaaaaacggcatattgattgacttcgacttcgtgaaaatagatgttggaatacactttattgagcctgtacggaacacttgatgtaataaaatgaatttcatgtcctttttccgcaagcagcttgccgagctcggtggcgataattcctgatccgccgacactcggataacatgtgattccgatttttaactgtttcatcatccgcccccaaataaatcgttgtttaacagaagagtccgctttgaaaaaaacccttccgcgtatgcgacgccgacctcttttcccaaaagcttttccctggcttcgaccgtttcaatatatccgtttgtcagcggtgtttcaaccgactgccgggaacgggtgaactggctctgataagcagcaaggccatcctttttttgattgatcgtttcagaaatgtcgatgacaaactcaggtttgtgaaaaccgttgatcatatagtagtacacgttttggactttatgggccggctgtttttctgcatcttcgtatttatgtataccagcggaaaagaccgcttcttcgacgatttccgctgcgtgcccgtgatcgggatgccggtcctttggataagggacaaagacaagcttcggtttatgtttccgaatgacggcaacaacgtccctgatcgccgcctggctgggaaacagccccctgtccggcagcgtgagggaaatccgcggactggcgccgagaatttcggccgccagcgccgcttcgctttttctcgtttcgactgttccgtttgaagacagttcagcctgggttaaatcgcagattccaatttgaaagccttttttagtatatttggcaatggttcctcccatgccgatttctacatcatcgctgtgtgcaccgaaagcaagtatatcaagcatcgcgatccctgccgtggacaatgtttctgaactcaaacgcgccttcctcgacagaacggatcaagatttccgcagttcccatgttggtggcgagcggaatggcataaacgtcagacaagcggataagcgctgacacgtcaggttcgtgcggctgggccgtcagcgggtctctcagaaaaatcacaagatcgatgtcatttttcgcgatcaaagcgccgatctgctggtcaccgccaagcggccccgattgaaagcgcacgacgggcagccctgtcgcttcagtgatttttaaaccggtcgttcctgtcgcaaacagctcatgcttttttaaaatgtctttataagcggtcgtcagctgaatcatatcctgtttttttcggtcatgggcaattaaggcgattttcaaagcgatttcccccttcttgttactctatgatattttcaaggccgtagacaagctgatcgattttcatcacttgttcaacagccagtttcacaccagacataaaagatgcgcgattgtatgaatcgtgacggattttcagggtttggccgtctccgccgaacatcacttcctgatgggcaatcaatcccggcagacgaacgctgtggagacggattccgttttgatcggcgcctcttgctcccggcagaatttccttttcatccgggtgcccctgcgttttcgcttcgcgaacagccgaaatcatttccgccgttttcaaggccgttccgcttggcgcgtcaagtttttgatcatggtgctgttcaatgatttcaacatcggtaaaatagttggcagccatttgcgaaaacttcatcatcagcacggctccgagcgcgaagtttggcgcgatgatagctccgattcccttctcatcggtcagttccataagctcgttcaagtcgctctcagaaaatcctgtcgttcccacaacaggacggacgccgtgctccaacgcgatttttgtatgtagcttgccgatttccggcgttgtcaaatcaatcagaacatccggagacgtttctgaaaagcattccgtgatatcggtgtaaatgacagcatctgaacttgacgtcatcacatctgacagcttttcacggttatatgtacggtcgattgcaccgacaagttcaaaatgtgcggtatcttcaacaagtttgaccgcttcgcttcccattcttccgcgcggtcctgctattgcgattttaatggtatccttttgcatcttgattctcctctactttccttcttcttttcttgtccagcgatctttatcacgggtgttgaacttctccatgaccatatcatgcgcttcatccaatgatatatgaagcgaattcgcaagacaaactaaaacgaacaatacgtcgccgatttcttcttcgatctttttttccgattcggtttttttctttggtttttctccgtaatgatggttgatttccctcgccagttcgccaagctcttccgtcagtctggccatcatggcaagcggactgaaatagccttctttaaactggccgatatattcgtcgacttcacgctgtatatctttcatcgttttttctttcgtcatgctggcaaaacctcctgtcatctcttacatgttagcgaattcaaacaagtttgacaaatgtttaagacgagtttgctgttttaaaacggatacactataatattaacgccagcttatggaaggaaaggagtttttttatgttcggagacatcagaatgaagaacgtcctgtttattttagcaggcgccgctgttttttcctttggactcgttcattttaatatgcagaacaacttgtcggaaggcggttttaccgcattaccctgctgctttatttcctgtttaatatcgatccttccatatccaatctggtgctgaacatcccggtcttcttcatcggctggaaactcctcggcagaacggtcttctcatacaccattctcggcacagtcagcctgtcggtgtttttatggatttttcagcgcttccagattcatatgccgcttcaaaacgatcttgcgctcgcggcactttttgcaggcgtgtttatcggcaccggattgggcattattttcagatacggcggaacaacgggcggcgttgatattatcgtgcggctgatcaacaaatattttcaagtgccgatgggcaaagccatgtttgtgtttgacgcctgcgtcattacattatcccttattttttacctttcctataaggaagcaatgtacacgcttgttgccgtatttgtcgcctcaaaggtcatcgactttatgcaggaaggcggttatgccgcaaaaggcgccaccatcatctctgaaaagaacgaccagattcagcgcaaaatcattgaagaaatggaaagaggcgtcacagttttaaaaggtcaagggtcttatacgaagacggagcgggacattttatactgcgtcgttccgaaaaatgaggttttccagctgaaaaatgtgattacttcggtcgacccgcacgcttttgtagccgtaagcgacgtacacgacgtgctgggagagggttttacgcttgatgagaacaaaaatcccatcacccgctgattgaaggtcagcaaaaaagaagctcgcgatcagcggagcttcttatttcggccaatctttttctctttttctgcgcctgtcctcttcggctttatactttctgaaaccgacgtatgtcagcgtcgagaggataatgcttcccgtcgtcaggatgacccatagcagggaagggtctgcatcatcttcttctacttgatcaaacacatcttccaaatctttttccaaaagcgtcagcctttccagcttgctgctttccgtcatttgctggaagcctccgttttccacgactgcaatatggttggagacgctttttaactgctttggcgaaacatcgatcgttaagcttggataaatcgtatcatacaaggataaaaaatgattccacttttccctgaatgtcaagttgtcttctttctgaatcccggctttcaaagcgctgaaagaatccatgatcggctttttcaaactgctccacagcggatcatgatctgattcaatggcgtccatcagcattctaaactgggcggcggctttaaatttctcctggtgtgcgacctcttcgctttccagacttttcagcgtatcatgataggccagactgacctggcggatttccgagcctgtcatcatatcctctgtcccgtctttctccgcagctttcagccttttttcaaagtattgaagaatttgtaccgcttcctcatattgagactgccttgttagctggaataccgtatccgacagttccgtcaattcctgcaaagccgatgattctttcgctttcaaaccggccgcaggaaaaacaagcgcaagcatcatgcaaaggatcacctttcgtatcattacggtccctcccactccttctattaaagcgtatgaagagagggacaaggttagaccaagattgtgaagcagtgttacagcttaaaagcttttcgggacaagacaaggtagtaggccaaaccgatcgaagcgatgctgagccaaaatgtaaaatagccgatctgcggcatatattgatcgagcatagaataattcggcatcattccaaacaagtaatcaatggcatcgttatgcatcgtccaaacagccgcaagcgccaaatgccaccctttgaaccggaaatgcggggcgtacagcacgccttgcacagccattgcgaagtgcgacgcgatcagcatataccccgtccaatgaaggcttccggtcaccacaagcacgagaacattcattacaaccgcccacagcccgtatttgacaagcgtaacaagcgcaagcgcctcaaaaagcggagcattccttcccaataaaagtccgatgagaacgaataaaaagaacaaggtcgccgtcgggctgtcgggaacgaagatcagaaacttcgctggcgtattcgtcagctgcggaaggtaccaataatacccgtaaaccgtaccgaagaaattaatgatcaaaagcagcagaagcatcggcttttgagcgagcatgtaggaaatcagtttcaaagcaatcaactcacagtctctttaaataaaaaaagccgccgccgggtcagcttcacagattgaccgcagaacacctgtcgagaagcggcggcctttccagcttccgtgccggttcactgtcagcagcggtcaaaattgaaaaggccatcgacattgtcgacagcccgagaggctgacttgccgtcagcttcagctctatcaagagtatagcctgccttcatcaacttgacaaccgttttatttcgccgttgtttcggagatgaatttagacagttctttaagctctttgtcagatcctttaaaaacgccggcaggcatttcgccttttccttccttggcgattttcgcaatctcttcaggagacaagccgttgtcaacgagagacgggcctgccgctcctccttgcatgttgtctccgtggcacgagatacagccctgctcctgataaatcttatagccttccgcactcgtatcaatatcggcctcttccttgattttaccctgctcttcagcagcggcccagtcgtgagtgacaacggactgccacgttaagaaaaccgtcgctgaaatcgccaaaagcatcaaccctacggcaaccgggcgtttaaacggccttctttcagggcctctgtcaagaaacggcgccaataaaagcgctccgaacgcaattgtcgggataataatcgcgccgacaaccgtatacgtccggcagcatattcgtatttcagcaattggtaaagaaatagaaaataccagtctggcaaaggtatgtagccggtatcggtcggatctgccatccgcgagcggaggctcatgcacgatggtcagcacgagaaaaccgacaaggaaaaccgctccgaccatccattctttcagcaggaaattcggccagaacgcttccgttttccctggaaattcggaataatcttttggaatattcggttttctttccgccgggatccgtgaatcaccgacaaacttcatcccttttccccttttcatgccatcccctccttctcaattgagtcgctcgtttacagcggcccagaaattccttgtttgcgaatcatgataaagtgtgcagccatcagtccgaacagagcggctggcaggaaaaagacgtgtatggcaaaaaagcgcgtcaacgtctgagcgccgacaatatccggatgaccggcaagcaatgttttaatttccgagccgatcagcggcgtcgcctcagcaatctgcaaacctacttttgtcgcaaacagagctttcatatcccaaggcaaaaggtagcctgtaaaacctaaaccaagcatgacaaagaagattaaaacgccgacaatccagttcagctctctcggcttcttataagccccctggaagaaaaccctgagcgtatgaagaaacatcatcacgatgaccaagcttgcaccccagtggtgcattccccttacaatctgtccgaacgccacttcattttgcaaataataaacagattcccaggcatttttaatatccggaacgtagtacatcgtcaaaaacatgccggacagcacctgaatcaccgtcacgaaaaacgtcaatcccccgaagcagtacacgaaagctgaaaaatggtgagccgggtttacgtgttcaggaacttcatggtcggcgatgtcccgccagagcggcgtaatatcaagtctttcatccacccagtcataaattttgtttagcatgatcacccatccttcctcggcttggctttccctaagtaaaggtagccgtctttaacctcttgctcatagcggtccaaaggagcaagcggcggagttccgggcacgttggtaccatccttttcataaagtccgtaatggcacggacaaaagaacttattcggatttttaggatcgctgttccagttgaccgtacaccccaaatgtttacaaaccggtgataaagctacaatttcgtccccacttttgaaaacccacgccgatctcgattcttccgattcgtaccaggcatccacttgtttgattttaaaatcgaagcgctgcggttcatttgtcaattcatcaacgctgacaacctgaaccatgtcctgatcttcagtcggccttaaaaccggatcgagcgcgaagcgaaccataggcatgagcatccccgccgccataaagccgccgactccggtcagcgtatagtttaaaaactgacgtctggatacccgatgtcttttttcgctcatcttcatatcccccctcaagtccccagctacaatataactgaaatagaaaaaaattcatgaaactaggacaccctcataatatatcaatattttaggaaggtcaacattcccaaaatcattatacaaaggaaatgtaagtgtttttatcaagagttccaatattgtaacaaaatgttcaatatttgctcaatttgatcttccagcagcttctgctttaacgaatccttcatatgttcgagaggaatcgccggaacccacagcagcttttgctcgctgtcgagcatctgcttccagcgttcatccgtcgttaaaaaaacgatgtggcgaaaatgtttttcggccatttcttttaaatcggcgatatgctgcgccgatttttcatccgcttctaaatatgtacagggcggaaaacaggtagattctgcccttcagctgcctttcgagttcttctgcaagtatagacgtaaattccccttttgatacggccgattaaactgatctccaagatcaaccgatattaaagggatgacagctgtatcgatgtattctttcgcgttcaagtaaacatccgcatcgtgcgtattccatttcacggctttcgtcctccccgttttgacagcgctttctcagagctgaacaagccttgctttcggcaaggcttgattggcagcggattatcgcagctggctcagttgtttagctagtttttcgaagctttctttatcctggcggtcaagcgcttcgtcgatttcccgcagcagcttttgtctctgaaaagtggcaatggaatgctccaaaatctgttcagcgacaattttatctttttcattttcatataggtctttcggaatatgcggattggcttcgagtacagccgcatattccggagaattataggctgagcggaagttcagctggataaagagatcctgctgcttattcagcctgatatcatgaaatgatttttctgcatcggtcgtcatgacattttctttataaaaacgaaaaggcacttcctcaacgcagtgggtagacatgataatgcccctcggacaaaattcggcctgctcgacaaaatgcactttttccatcagcgagtcatggctcattaaataattcagaatccatacacactctcttcgtttcagctgataatggttgagaaaccagcggataaaatcttttttttcattgacagaaacaggggtctgcatgttattccctcctctatcgcatcttgtgtattactttataaattccacacaaaccgatcatatcctgcttattcaaaggaattttcatcttcgattctgaaaatcgtctcctggacttcctcgtttgccgggtcgagctctgccagttttttcagcagaggcagcgcttctttccgccgtccttcttcaagcagaaacatggaatattcgtaaaggaaatcggcgtcatcccgatagtgcaaaaatgcgttctcatattcctcgcgggctttgtcgtacgcttcggtccgggcgaacgccgatgccagatgccagctgaacttcggatcatcctctccgtatttgcgcacttcccgaacgagttcaatgatgctctcatcgtcttcttcttcaagaaacagggcaagcagtgtatgaacggcttccagatatccgggatccagcgccagcgcttcacgaagcagctccttcgcttccgaatgccttttcgtttttaaggctgcttttgcagcagaaagataaagctctttgttgaattcatcgacacggattccttcttttgccgtttcgaatgcttcctcataaagcccttctgtttcaaagctgttggccagaggcttgtaaagcgaagaataagcgggatccatttccttcagctctgtcagctgtttaatcgcagttttaggataccccgctttcagtgccgtaaaaccaaagccgaacagtgtgttgggctcggggttctccttgacggctttttcataccattcaagcgcttcttcaaacgctccggatgaacttaatgattccgccagcctttggtacacattgacgccgccgatgacggcttcttcttcggccgcttttttgaattgacggaccgctttgccgtaagctccctgagtaaaatacagctctcccaaagcaaaatcgataaccggctcatccggcaaaatggcttgcgcctttaacagcttttgctcgctgacttcaaacagaccctgcatctgatagagatcagccattaaaagcaggcactgcgggtacgcctcgtctgtttccggaatcgtttcgagcacgctgagcgctttttcttcctgatcggtttcgatgaggagttcggcataaaagcatgtcagttctgtttcatccggatacagttcatggaggtcagtcacgatggcgatagccttatcgacaattccccattcgtaatacagctgggctactatggctttgtcttcatcatgaaggtcagactcgatatcagcaagttttttcaatccgctttccgggtggcctgcttcaactaattttatggcttcttgaatagaagtattcaaatctaaacgtccctttctttcgtcaattcatcaccggccgtatcagccggcatatcgcggtgagttacttactatcataattcacgcggcggtttccggcaaatatgttgcccgcacagctgtatggaagcagattgattctgttaagacaagctatgccgaaaacattcgttttatgagcaaatgcccggctttcatgattttccgggcagaaaaagcctgagcacaatgcttcaggctttttctgcaagcttttcgatatgttcaaaaaatgaaggatatgagacgctcacagcttcgggctgtaatatgtcgatcggctgctcgcagatgcaggcggcgatccccagcatcattccgatccggtggtccccatggcttgagaccttcgcgccgcctgtaagaggcgtcttgccgtgaatcttcatcccgtcttccgtcggttcgatgttcgcaccgatttttttcagctctgaggcgacggtatcgatccggttcgtttcttttactttgagttcagccgcatctttaatgaccgtcgtcccttcagcctgtgttgctagaagcgcgatgatcggtatttcatcgatgaggcgcgggatcaaatcgcccgaaatttcggctgccttcaaagaggacgttttgattctcagatcgccgtacggctcggtatttcctgtgtccttttcttcgatttcaagatcggctcccatttctttcaagacatcgatgattcccgtcctggtcggattgagtccgacattgcgaagcacgacttcactgccaggaacaagcgatgctgctgccaggaaaaacgcagctgatgaaatatcacccggcacaaagacttctgctgctttcagctgctgcccgccctcaatggacacgctcgtttcatcttcccgaaggctgacgccgaacatagacagcatccgttccgtatggtctcttgatttatgaggctccgtcaccgttgtggtgccttcggcctgcagacccgcaagcagaacggccgatttgatctgcgcacttgcaacaggcgactgaaaatcgatcgccttcagatgtccgccgcggacagaaagcggtgtgtattcccctccggcgcggccgtcgattttcgcccccatttttcgaagcggttctgtaacacgcttcatcggccttttggcgatgctctcatcgccggcaaccgtactgtgaaacggacgccccgccaaaatgccgagcatcagcctgatcgtcgttccggaattccccacatcgaggagctcggcaggctcagcgagctgatcgagccctttgccgcggacggtgacatcactgccattctgttcgatttcgacacccattttccgaaagcaggcgatcgtgctcaagcagtcggctcctggcaaaaagtttttgatgaccgttttcccttctgccatggctccgaacataacagaacgatgggagatggatttatctcccggaatatgaagctctccctttagtgaactgatttttcctcttttcatgtgttccacctcaatcagcataaaatgtttcgtattttgcgcgggtttggatgcatttttcggcgcgttttcgatcttcatcggattgaaagctgattctgagaacaccgtttatgtcttcccttgtttcgataatccggatgttcgtaatgctgatttgctcgtcggcgaggatcgccgtaatttccgaaataacccccggatggtccgggacatcgacataaagatcgtaaaaggaaggaatcgcgcctttttgccgcaaaggcagaccgtcgcggtattccttggcttgccgaaaaaattcaaacagcccgtctgcatcttcattttcgacaaaagactggattctgtccagctcttgtttccattcgtcaaaccgctccaatattttatctttattgtgcaagagaatatcgcgccacatcgccgggctgcttgaggcaatcctcgtgatatcgcggaagcctcctgcggcaaaacgcttgacgagcgggtactgatcttcgaatttgacggtctggtggacgagactcgccgccacgatatgcggaaaatggctgatcacgcttgtaacagcgtcatgttcagcaggagacatttccacaaactttgcatttgttcctttgagcagatcttttaaagaagcaaccgcttctttgccggcggagccggatggcgtcaaaatataaaacgcgttctcgaaaaggaagtctttggcggcagcgacgcccgatttatgcgagcctgccatcggatggcctccgataaacctgtagtcatccggcagcactttttcggcatggctgacgaccttttgtttcgtgctgccgacatctgtaatgagcagctttttcttgatgcctgaagcggcaagctcatcaagcatgtgaagcgtctgttcgaccggcgccgctaagaaaacagtcgacgcttctttcaccccttctaaaaaagaagcggccggagcatcaattacgccaagcttttgtgcagcccttgcctgctcttctgacacgtcaaacccgataatccgtttgcccgggtgttcctttttgatggccagggcgatcgaaccgccgattaagcccaaaccggccaacaaaatcgtttcattcggttgagtcattttttatcacctagttcatcaatagactaaagaggtgactgaatcatcacctcttacaacatgccggctaacgttttcaaaaagccttcgttctgttccttcgtaccgaccgatattctaaggaacgtcggaaagccgagcgcattcccggatctgacgatatagccttttttcagcagctctgagaaaagttcgtctgcatcccgtttaaaatcaatcagcacaaagttcgtttgtgaaggatagtaatttagcccgtgctcatcacagaaatcgtagtactgtttgagcccttcattgttttttctcacacagtcgtggataaatgcctgatcgccgagggcggcaagcgcggccgcctggccgagccggtttgtattaaacggctgtctcgccggctcaatcgcctgaatcagctgttcagaagcaatcccgtagcccacccttaaagacgccaaaccgtaggcttttgagaacgtcctgagaatcatcaggttcggaaagcgctccagaagcgggatggtctcggggtagtcttcagccgttacgtattcgtaataagcttcatcaacgacagcaaggacatgttccggcactttttcaaggaaacggatcaagttgcggccggattcatacgttccggtcggattgttcgggctgcaaacccagacaaccttcgtctgttcatcgatcgccttcagcattgcatcaaggtcgtggcagccgttttcgagcaggccgacttctctgacttccgctccttcgatgacagcgttgtgcttgtattgtgaaaatgtcggattcgccattacagtgtttgaggcagggtccaacaaagaacgggaaataatttgaatgacttcgtccgttccgtttcccaggatgatgttcgtttcatttacgccgagatgggaggcaagctttgttctcaatgccgcactatagccgtcaggatagagagccatttgctgcacctcaatctggagggcttcctttgccgcttctgaacagccgtaaggattctcatttgaagcgagcttgacgacccggtcgaggttgaactcttttttgacctcttcaatcggtttgcccggctggtaaggcgttaattgttttaactgttctttaatttgcaacattctgtcacctcattttaccatgtacgatccgctaaatgtcttagcgtatgcctcaaacgcctttaaggcttgttcccttgtctcaggggcgacgagttcgtctttcagctcctcgatctttctgacaagggcgcttcccacgacaacgccgtccgccagttcattcatcatctccacttgtttggagctggaaatcccaaacccgacggcaaccgggacggagctcattcctttaacagacctgataaatgaagaaacagaatcttcgaattcattgcgcacacctgtgacaccgagcgaagaaacgcaatacacaaaaccttccgcctgctgcgttattttttgaatgcgcgattcgcttgtcggcgcgaccagcgaaatataggtaatcccgtgttttttacactgctgctgcaaatatacgctttcctcaaaaggaaggtccggtacaaggagtccgtctagctgattttgtcgcagtaaagcgaaaaagtgatctgtatctaattgtaacacaggattataatacgtaaagagaataatcggaatatggacgccgttttttttcatttcaccgccaagcctgatcgcttttacgatgttcatatcgttgtcaagcgccctttttgatgcgcgctgaatcaccgggccgtcagcgagcggatcagaatacggaaccccgagttcaagggcggacgctcccgcctcttgaagagattttgccagctcgatcgagatttctggcagcgggtctcccgctgtaataaacggaacaaatagcttatcggacggctgttttttcagattgaacatcttgattcacctcttcttccaacaccttcatcaaggtatggacgtctttgtctcccctgcctgaaaggcagacgagaacgcttttctctctcggcagttctttagcgatttcaaatgcttttgccaatgcatgggcggattcaatagccggcaaaatgccctcagtctctgtcagcagccttaatgccgagaccgcttcatcatctgtgacagattcatacgtgacgcgccctgtttgatgaagatgggcgtgctcggggccgactcccggataatcaagtccggctgagatggaataaggctcgatgatctgtccgtactcgtcttgaatcaagtaggtcaaagaaccgtggatgacgccttttgtaccctttgtgatcgtggccgcatgaagaggtgtgtcaacaccttttcccgcagcttcgactccgatcagttcaacagtttcttcaatgaacgcgctgaacatcccgatcgcattgcttccgcctccgacacaggcgacaactttatcggggaggctttgctccaattgataaaactgcgctttcgcctcttcgccgatcatccgttgaaattcgcggacgatataaggatacggatgcggcccgacgacggaaccgatcatgtaaaaatggtcctggcaatgctgaacccagtagcggatcgcttcgtttgtagcatcttttaatgtcccgtttccgcttgacaccgggacgacctccgctcccaagagcttcatccggaacacgttcagcgattgtctggcaacatcttcctcccccatgaagacgatgcatgataagccgaacttcgcggcgacagtcgccgccgccacaccgtgctggcctgcaccggtttcagcaatgagctttgtttttcccattttcttggccaggagcgcctggccgagggcattgttgattttgtgggcgcctgtatggtttaaatcttctctttttaagtaaatcttcgctccgcccagctgcttagtgagctggtctgcgaacgtcaaagccgtcggcctgcctgagtagtcatttaaaagcttttgataatccttttgaaatgaagggtcgtctttcagttcaagaaacgctttttcgatttcttccaaaggctgcatgagtgtttccgggacgaatttcccgccaaaatcaccaaacctgccttgttcattcggatatgaatacatgttcgaacatcctttcttctaaaaggctgatcagcttttcgctttttctgcctctttcttcgattccgcttgccaagtcgattcccggcggacgccgctttaaagatctgcgattgtgtccgggttcacgcctccggcgataaacaggcgcttgccttctctttgggctgcatctatatacagcgggacgctgtcccacgaaaacgaaactcccgttccccctctcatccctttgacagacgagtcgatgacatacccgtcgatgtaaggtgcgaaagaagccatgctctgtacggtatcattcccgtgagggagcgccttccatatctcgcagtctgtcatgcttttaagccgcttgatgtctgccgccgtttcatctccgtgaagctggatcacgtccaagcctgcatcttttacgatttcagccattcggctcatgttttcattaacaaaaacgccgacaagctttttacctggcgtatccgtttcgccgcaccaccgtttcacatccgccgggtctaccgaccgtttgctttcggcgaaaataaatccgagataatcggctttcgagcgggctgtcacctttaaatcttccaatgaatgaatcccgcaatattttagactcggtttcttcatcagccgtcctctccgaataacgcatagacagccttcagctgtgacgtctctctcatcagcgattcgccgacaagcacggcttgggctccgcacgtttttacaaaagtcaggtcttccgattttccgatgccgctttcgctgatgagaacggtccccggcggaacgagtttcgccattcgctccgtttgtccgacggtcgtttcaaagttttttagatttcgattgtttacgccgatgatttcgggtgtaaagacatttaaaatgccctcaagcgtctcttcgccatgtacttcgacgagcacatccatgcctttttcaacggcttgctgatagagttcaaacagcttttgcggttcaagcgcttcaccgatcagcaggatcgcatccgctccgatgcggtccgcttcttcaacctgaatggaatcaatgataaaatccttgcgcagcacaggcagggaaaccgagcgtttcacatctgacaaataactgttcttcccttgaaaaaaaggtgtatctgtcagaacagacaaacaatcggctttagcctgttcgtattgttttgcgatcttgacgggctcaaaaccctcctgaatcacgccttttgacggagaagcttttttcacctccgcaattaaagcgacaaaccggttcggagaaaggagcgcttttttaaatgaccgctttggcagttttaaatcttccgacagcttgatctttaggatgtcttctcgttttctatcaataatttgattaagcatacaactcttcctctttctgttttaatcgctccagctgattgagcgcttcaccgccagcaacagcttctaaagcgagcgcaacgccctcttttaaatccgctgcctgttctgcgacgtataaagcggctccggcattaaacgctgcgatatgaacagccgagtccggaccgcggtttttcaaaatatcgacgatcagacggccgctttcttcaggcgtcgccacctgaatgtctctcagccttccgagaggcagtccaacatcgcccggctcgacggtgtattcgtatgttttgccgcctttcagttcaattacatctgtcggcgatgtgatcgacagttcatcaagaccgtcccggctcgaaacaaacaatacgtgctccggttcaaacgcttcaagagcgcgggccataagctttgctttttcgatcgagtagacgccgatcacctggcgtttggccttcatcgggttgctgagcgggccgagcagattgaatacggttctaaaagccagatccttcctcgcgcctgccacgtgcttcatggaagagtgatagcttggcgcatacaggaatcccatatttcggcgttcaatgctcttaatcgtttcttcaggcgacgtctgaatagaaacgccgagatattcgagaacgtcagcgctcccgctttttgaagaaacggatcgattaccgtgttttgcgatttttgccccggctgatgaagcgatgatcgcagccgctgtggaaatgttgaaggtggagcttccgtctcctccggttccgcacgtatcaacaacatgttccggtccgtctattgtatgcgcctgctcccgcatggctctgacaaatcccgtaatctcttcagccgtttctcccctgtaggcgagaacggacaggaggcctccgatttccgcagcgctcagcgagccggtcatcatgtcgcgcatgatgctgtgtgcctcgatttcattcagtgtccgtccgttaacgcatgatttcagcagttcgttcattgccgtcctcccccttttcgagaaacgtttcttctgcgatttgaatcgtttttaacagagcccctgctttattgcaggtctcttcccattctttttcaggcacggagtcggctacgatgcccgccccggcctgaatggacgccactccgtttttcacgctcatcgtccggatcgtgatgcacgaatcgatatttccgtcaaatccgatgtaagcaatgcatcctccgtatgtttccctcggttcgggctcaagctcatttaaaagctgaatcgcgcggattttcggagcgccggtcaaagttccggccggaaatgcgctcattaaagcgtcaaccgggtggacacccgcttttaaagtgccggttacgatcgaaatgatgtgcatgacgtgcgaaaaggaaacgattttcgtaaactcgggcacttggacagacccgtactcagctactctgccgatatcatttctcgccaaatcgacaagcatgtaatgctccgctttttctttctcatcagccaatagttctttttcaagccgcttatcctcagcctgatcaccgccccttttccttgtgccggcgatcggatggatttcaagatggccgttttgaacatggatcagacgttcgggcgagcttccgacgagatcgcggtcaggaagcctcatgtagtacatgtacggggacgggttgatcattctcagcactctgtataactcaaaagaaccgaccttcaccggaatgtcgaacctttgcgaaaggacgccttgaaaaatgtctcccgctttaatgtattctttcaagcgatcgacatcggccaaaaaccgggatttctcatatgttgattgaatcccttcaaagctgggggccgtgtgccgtccttgcggaagaaacagctctttcggcgttttccggtctgacagcctgtgtgtaagctgcttgagctcttctttcccctttttgaaaatgcggcgcttttcctccctattttcactgccttcaagccttgtatagtggatgaaatgcagctttttcagttcgtgatcataagcgatcatcgtccggcagacaaacaggaggcattttgccatttccgtttctttgctgtgccctttgatggacggttcaatgagcggcattaaatcgtagcttaaatagccgaccgctcctcctgtaaacgggatgtcgagctcaggcgctttgatcgaatacgtctccgacatccattcgagaacgtcttttaactgtgaagccgaataaagcttcttctgcttttgatcgcaggcgtgaaaccggccgcgttcttctttgatcgtcaaaaaggggtcaaggccgatgaaagaatatcttgaccatgcagaggtttcatcctggctttccagcaaatagacgatgtcttcctgcagcttctcgaccaattgaacgggcgtcagcgtatcgacggaaaaactctcaataatcggtatcgttttaaagtgtgaagaatcctctgaaaaagaggcaaaatcggtttgcagactcaactatctctcactccctttcaggcggagagaatgagaagaaggcctttagaggacaaatgattgaattgacgaggggaaaacgaaacaaacccaaaagaacagcgtcttttgggtagaatgaataaacgttttgtctcaactcagctcatctcaactcattctcaatctaccctagtctcatactcagcttttctaaactaaaacccatacacactcctgtgtatttcaaggtttctacaatcgtattacaattcagtattttttgtcaatgataaatcaggtctgagcgttactgcattttccaaataaacatggcggacttcatcctgccgcatatccgtctgtaccgtcatcatcactctgatgcattttttaaggccgtgttcaacatccatttcctgcatgcacatgacgggcacatgctgccagccgtcaaacgttctgacgaccttcgcgggaaaagcagcgtgtatatcggaagtagcagaaattaagatctgtacgacttgttcaggtttgagtcgattttcatcgatcatttttccgatcagctgcttcgtccgctccgtaatgtctttttctgtatcccggtcaatggtcgtcgctccccgaataccgcgcatcatcatttgtctccctccaatctccacatattcagccatcgttcgatttcttcggctttaaaggagtgcagccgcacactgccgatcttatccagaaggacaaactgaatgatgcctccgcgtgtttttttatcgttcatcattcgatagataagggcttctgttgaaacttcgcgtttcacgctttccggatagccgagatttttcagccaggcggcgattttcgtacggtcaacaggacaattcagcaccttctcgctgacaaacaaagcaaattgcatgcctaaagcgacggcatcgccatgggtgatctctccgtagccgtattcggcttcaacggcgtggccaagcgtatgcccgaagttcaaataggccctgattccctgttcgcgttcgtcttgtgagacaacttccgctttaatcgaaatgcctttgtaaaccatttcactgagctggccggtcgtaatcgcttctattgaatcaagtttaagcaattcgttcaagaaagattcatcacggataaatgcgtgcttaatgacttccgcaagacctgaacgcatttctttttccggaagcgtgctcaggcattcggtgtcatataccaccgccttcggctgatgaaaagcgccgattaagtttttcccgagcgggtgattaatggccactttccctccgactgcgctgtcatgagacagcagagtcgttgggaattgcacataatcgatgcccctcataaaagttgaagcgacgaatcctgcaagatcgccgacaacaccgccgcccagcgccacaatgcatgacgagcggtcaaggtgaaattgaatggcttccgtctggagcttcataaacatatcgatggatttggcctgctcgccgcttggcaccgcaacctttttgacgggccatttgctgcggagaagactgaacagctcttctccatagcgtttatcaacttcttcgtcggtgatcaaaagcagtttcgtcatcggaaggttcaaggatgacaaaagctctgccgcgttttttctaatgcctcccccgatgaataccgggtaggacaaagaagcggtttcgatttgaagtgatttcattaaaactccctcgcaagctttctcattttctcaacattttcagcgatccggtccatttggtcaacgccaaactgctcgacgatcgcatttgcgatttcccatgcaacaaccgcttcagccaccacgcttgcggcagggacagcgcaggagtcggaacgctcgatgctcgctgtaaacggctcttttgtctcgatatcaacgcttttaagcggtttgtataacgttggaatcggcttcatcacacctctgacgacaatcggcattcccgttgtcattccgccttcaagaccgccgagacggtttgttgcccgcgtatagcctttttcttcgtcccagatgatttcgtcatggacttcactgccgtttttgcgtgcggcttcaaagccgatgccgaattcaacccctttaaaagcattgatgctcagtacggcggctgcaagcttgctgtcgagttttcggtcgtaatggacatagctgccgactcctaccggcaccccttcaactatcacctcgacgattccgccgatcgaatccccatttgcttttgcttcatcgatcgcgtccatcattttcctgcccgcttcttcgtcatagcatctgacaggggactcttcggttacttttttcaagttttcgatagattcgtaatttgttttttcagcttttactccgccgatctccagcacgtggccggccacttgaatgccgagctgggaaaggatctttttggcgacggctcctgccgctacacggacggtcgtttctctggcagatgaacgttcaagcacgttgcgcatgtctctgtgcccgtatttgatcgcgccgttcaaatcggcgtgccccggtctcggccttgaaatctgtcgtttcatttcgctttcttcttcagccgtgatcggctctgaacccatgattttcgtccagtgtttccagtcattgttttcgacgacgagagcgatcggcgatccaagagaacgcccgtgtcttacaccgcttgtgatccgcgcctggtctttttcgatttgcatccggcgtccgcggccgtggcctttttgacgtctttgaagctcgtaatcgatgtcttcttttgtgatataaagccccgctgggactccttcgataattgtcgtaagctgcggaccgtgagattcaccggctgttaaatacctcatgctttcgttctcccttcatcacattaacgcttttaagtaaaactataacataaccctttataaaaagtcagctaacttttttgatagaaaaacgtatctgtcgattgaaaaccgtatttttccggattgaagatctgttccgtgcttccgacaaacaaaatccccttattcttcaggctgccgctgaacttatgatagatcttctcttttgcttcctccgtaaaataaatgagcacattgcggcatacgatgatatcaaaatctttctcatacggatcagccagtaaattgtgcttttgaaagcggatgtttttcctgatctcgtctttgactttaaagcggtttccgtcttgcgtaaaataaagttctttcatctctttcggcacttcctgcagggacctttcctgatatacgccttctttcgctttctgaaggactttgtcatcgatatctgttgcgataatctgatagtctgtgaggcctttctgtctgcttaaaatcattgataatgtataaggctcttccccggttgaacaagccgcgctccaaactttcagcgttttcgcaggctttaaaagcggcaggatcgttttttcgagaacctcccacctcttatagtttctgtaaaattctgaaacattgattgtcattctgtccaatgtttcctgcagaagagcttcattcttttctaaagcgagcgcaaactcgcggaaatcgccgtatccttttttctcatatagagacgtcagtcttcttttcatttgcgcctctttgtacaatgccaaatccacaccagtcatttttttccatttatcaacaaagaaactgtaattgtccatgttttctctcctaatcgtcgtgctgatatgagtacaattatagcttgttttcttttaaatttgtatctttaaaagaaaaaagcccgcccgccggcagccattctattccatataaaaaaatcagcttttcagctgatttttagtaaatccattgattcattaatttctcgtcttcaacaagttcgtcctctttaaaaaacaagttgatttcgcgtgctgcactttcaggagaatctgaaccgtgaatgatattttttccgacaaacatgccgaagtctccgcggattgtacctggaagcgcttccttagggttcgtcttcccgatcagctgtctggcgaccgcgattgcgtcctcgccttcccataccatggcgaataccgggcctgaagtaataaagtcgacaagttcgccgaaaaacggtttcccgttatgttctttataatgctcgcctgccgtctcttctgagaccttcatcagcttggctccgattaattgtaagcccttacgttcgaatcttaacaaaatttcgccgatcagctgacgctgaacgccgtcaggttttaccatcacaaaggttttttccatagtcgattctccaccccgctaatatgtataggctttcaacactacaacagaaatatagcatttttcaaacaattaatcaataaagggtggagaatattcatactttcgactcatttgacgttttttagaactttcgcttgccgatgtatttcgcaatttggcccagtgccgtccgcgcccggtttttcgggagcgtttcaagcagttcgaaagccttgtttaaatacatttcactgaccctgaacgattgttcaatggcatccgttttcttcagctcttcgatcactggcttgatctgttctggagtggtttcactgttgaccagcatcaggcgcgcttttagctcaggcgatttccgtgcatataatacgggaagcgtgacattcccctgaagcagatcgctgcccacaggcttgccaagctctttttcgcttgaggtgaaatcgaggatgtcatcaataatttgataggacatgccgacataatagccaaaccagtacaacgttttatgaatgttttcacccgcaccagcagcaatggctccaagctggcagctcgacgcgattagaagtgctgtcttgcgcctgattcttctcaaataggttctgagattttgctccatattatatttatctttaatttgttcaatttctccaagacagacttcgacaatcgccttggacaagatttcatgggctttcggttcgtttatttttgtcatcgcttcaagtgagcgagcgaacaaataatcacctgtatacattgcaatccggttatcccacttcgctttgattgtcggctgtcctcttctcagctccgcatcatcgatgacatcgtcgtgtacgagcgaagccatatgtatcaattccaacgaaacggcaacatttttaattttgctgatgtcgtattcgccgaacatgccggaaagcaggacaaacacgggacgaatcctcttgcctccggcctgcagcaaatgcaggctcgcttcactgagcaatggatagtcggagtgcacggtcttttcaagctctttttctattaattcaatatcgtcattcaaaaaagaataaaacgttgtcaatttcatatcgattcacccgagtatttctgtagtcatcatcgcttccagccgacatgtgttgccgctacgccgcctgtgaacggatgatattgaacattttttaatccagcctcttcaaacaacgcggcaagctctttcataccaggaaattccctggccgattcctgaagccatgaatactccttgaagcttttggcaaagagctttccaaacataggcataatgaagcggaagtacaggaagtatagctgtttgaacccgaacatttcaggctgggacgtctcaaggcatacaacctggccgccgggttttaccacgcgcgccatctcttttaatacggttaaatagtcgggaacattgcgaagcccgaagccgatggtgacatagtcgaatgtattatccgggaagggcagttccatcgcattgccgtggatcaattcgatctggctgtagctttccgttttttgttcggcgatgctcagcatgtttttgctgaaatcaaggcccttgatttcccctgtctctcctgccgcatcagcgagcgcgatcgtccagtctcccgtcccgcagcagacgtcaagcgctgtggctccttttggaacgttcatgagctgcatcgttttgtcgcgccattttttatgctgtttaaagctgatgacggagttcatctggtcataatttttataaatcttttcaaacacgccatgtacgcgctgttcttttgactgcaccatgattacccttcttccactttctgatgataagttcgtttttcaggccgaatttcctgcaggcgtttcagaagccatttttggacggcgggctttttggcaagcgactggttgatcgcaagcttggcttctttataagccgcagcagccagctgtccgcatgaagcctgtccttccggaaactctttctgtatgatcgtctccagcagccgggaatctgaagctttttcttcggccgcaaaccttttaaagacaagaaagtcattggcggctgttttccagtgaggcaggtaaaagtggtcggcgagatggtgaaaaagtgcagcttccactatgctgacgctttttttcaggctgtctgcatcttttgcggaatggtcgtaaagcctgattttgtgttcgtttatttctttgatggccgcagcgagcgtccgaatcatataaatatccttcatacccgataacagcgagtagtacatgccgctgaagtaatcaccggccaatacggtcagctggcggtttttataatcgtcctgtttaattgaagctgcggtcgtgacttcatcatgggtatcaagggctgtttgaacaagcatcgccgttaagatgtaactttccttgtcagcttcttttaaatccgtttcctcaaacagagcgtagaaaagaaacagcttatcctcatcaactttcggcgcagtcagatgcttcgccaaatatggatgtgaaagcttttgattcagcttgattttcaaataagataattgtccgtagatgtcttgcaaagatatcacccttgtcccaaaattcgcagtttttcttttgattgattatgtatcttttttgagcggagaaagtttaattataccataatatgttgaaagatattgtcttatgccacgcggacgggcataaaaagccagcctgctattttttcgattcgctcttcatctcgccgtttgccgtctgaataagggcctcgccccggaccttgatcgcggaggtatgctcggtaaactggcagatcatcacttctcctttatcaagcttttctgaatgatgaaatctcgtgtccgtcccccttgtcagtccgatcacattgacgccgtcttcaacggctttgataacgacaaaatcattcgattgattattggtcatgttcatcgcacaccttctcatttttaatcatgatgttttgataagctccaacacctcagagcgagcagccacatcctgtctaaacgttccccttacagctgaagtgacagtttttgaacccggctttttcacgccgcgcatcgtcatgcacatatgctcggcttcaacaaccaccattacaccgtgcggagtcagcgtttcaacaatgctgtcggcaattgttgacgtaatccgctcctgaagctgcggacgttttgccaccgcttcaacggctctcgccaacttgctgagtcctgtcacttttccgcctttagggatataggctacatgggctttcccgtagaaaggaactaaatggtgctcacacattgaataaaaaggaatatctttaacaagaacaagctcttcgtgatcctcgccgaaaatcgttttgaaatgctctttcggatcttcgtttaaacccgcaaatacttcagcgtacatctttgcgactcttttcggtgtatcaagaaggccctcgcggttcggatcttctccgatcgcctccaatatttgccggacggcttgttcaatttggtctttgttgatttctctcattgttttatatcctccagaaacgcatacatttaattcagattctagcacacttcagcttataaaagcaaaatgaaaggttttttgccggcaaaatgttatccgtctaaaaaaggcctttaaattatgaaaagcccctttgaaaaggggctttcctgtgaagaaacaacatggtatgtattacgcgcgaaaacggcatatacatacaattattttcctgctacagcgtctttaagcgctttacctggtttgaaagcaggtactttgcttgcagggatttcgatttcttcacctgtttgaggattgcgtcctttacgagctgagcgctcacgaacctcaaagttaccaaaaccgatcaattgaattttttcaccgtttttaagtgcatctaaaattgtatcaaaaacagaatcaactgctttagtagcgtcttttttagatagttcgcttgcttctgcaaccgcattgattagttctgtcttgttcatgcctttcacctcctcccaaaaggtatcaatcaatagattatcatcatttcttcacagttcaacctgtttctatacctgtttgaacagaaatttcaaataaatatagaaaaggcatttcacggcttccagcgaaaatttcactttgagaggaacgtttgtccagtaaagtgaagattttctgtttgtagattaacacatctgaatagccatatcaagcattttaaagcgatgatcccttattcgtcaaggtttaagcagaataaaacgaacaaatattcctgttttttcttttttaatcataatctttcctatatttccagccgcaagcccttgccgtccaaccccctttcaccgcgcccgttcagcctgttttcaggcataaaaaaagacctcccgtatgataagaggccttcccttttataagatgatcgcaatcaagccgcctgagccttcattgataatgcgctccagcgtctccttcagcttatatctcgcattttcaggcatgagtgacagcttcgcctgaatcccttctctgacgatcgagctcaagcttcttccgaatatgtcggaattccagattgacagcggatcgtcctcaaagtcctgcattaaatagcggacaagctcttcgctctgcttctctgttccgatgatcggcgcaaactcgctttccacatcgactttgatcatatgaatcgacggcgccaccgccttcagccggactccgaatcttgaaccctgcctgatgatttccggttcatccaggctcatatcggttaatgcgggagctgcgattccatagccggtttgtttcaccattttcaatgcatctgagacttgatcatattcggtcttggcatgggcaaaatcctgcatgagctgaaggaggtgatcttttcctctgatttcaacgccgacgacttccctcaaaatttcatcgtacaggtaatccggcgcgtataaatcgatttccgcgatcccctggcccatttcaattccggcgaggcttgcgcgctcgatgaaatcaaattcgctgaagtgtccgacgacgcggtcgacatctctcagtcttttaatatctttgacggtttctttaacggaatcttgatagttttccctgagccaatgattctcttttaataccatcacccagcttggaagattgacgttgacttcgagcacagggaattcgtaaagcgcttctctgagaacgctcagaacgtccgcttccctcatgctttcaacgctcatcgccagcaccggaatgtcgtacttttccatcaattcttgcctgagcgcttctgtttccggatgatacggccttacggaattgatgaccatgataaacggttttccaacctctttcaactcgtcgatcacccgttcttcagcctcgacataatcctgtctggcgatttctccaatcgtgccgtcagtcgtaatcacaacaccgattgtggagtgctcttggatgacttttctcgtgccgatttcggcagcttcgtgaaacggaatcggctcttcataccaaggagtattgatcattctcggcccgttttcatcctcgtatccctttgccccgggtacagtatagccgacgcagtcgacaagccttatattcacatcgagtccgtcactgacatgaactgacattgcctgattcggaacaaacttcggttcagttgtcataatggttttgccagcggcactttgggggagctcatcttgtgcgcgcgcccggtctgcttcattgttgatattcgggagcaccactagctccataaattttttgataaacgtagattttcctgtacgtacagctcctacgacacctaagtatatatcgcctcctgttcgttcagcgatatccttgaaaatatcgaccttttccaagtgatcccctcccggacttccaatccttttcaattttttacttcttcatcaatcaaaaacaggacactatagtgtatgacgttgtcctatttcaatatgacagcttagggaaattttttcggcatacatgaaaaaacctttctcctcattgtatgccgaggagaaaggttcatgactgatacttgcattttgaccgatattctattcgagaaaaacaggttcctgtttgtcattcactgtgtactttaccgaaaacgccggaacgaaaggcgtctcttcccacatcaaatcttggacttcctcgcccggctttaccgtttttttcgacttcttcatcagcttggccaaatccatccggtaatccactttaatgtcgcctttttcatcgacgagaagcggcagcgaggtgcccgaaagcggactcgtgacagaaggcgcctctttcagtccgagcttttcatggtcaagcatgaataagttcttggatacgacttttttatacggcggatacttgtgctgatctttatacatttcgacccgaagctttaactccctgatcatttccgacatttttacatcaatgagcttgaccgtcggctttttttccacatcgacaagaacgtacaagtactctccgccgttttcataggatgtgcccggcggctcagccatataccggggggacagcctgttaaaatcgatagggtatttttgatagattggcacgcccatatcccttgtcttaatcggcagaagccctcccgtcgcctccctgaattcatcaacggccgcctgcacttctttgagctggtgctgatgcggtgcgctgtttttcgcctttctttcttcagggtacaaacaaccgcttaacatgattgcggtcaataaaatagcgagcagaacgtttacgattttcatatgaatcttccttttttatgcattattcgttgacggggccgctgaagacgacaaaaaagacgatcacgccggagatgagcatacatgtgtaggcgacaaacgacgtgataatttttaaaaaacggtttttaaatttatatctgcttatgtatatggcaatcaccgctaagaacatcaggcccattgatcccaaggcaaaccacatttttaacagaccgacattcacattgaagccctccttctaccttttcttgtgatgtaagcgttatatttcattttatataagaaaaaccagaagttcaacagcttttccaatatttcgaaacggaaaaagccgcaaaaaaaagcctgaagcaaagaggggggctttgcttcaggcataatgattgtgactatataacccaatttgtaagatacagctcttccagacttcgattctattttatgcaagtcttcggacaaatgtatcctctcttgcctaagtctccaaaatgttttggtttttttaaaacgaacttagaggagagtataaaagcagttgatgatggggcggtcatttcatttgattttcgaatgtgttcacaagatcttccatctcgtgtgttttgactcttgccatcaatgattcgactgccgtctcaactttttcgccgtcaaacaatactttgtgcagtgcttcggtgatcggcatttttacatcaaatttctttgaaagctgataagcggcttttgtcgtgcggaccccctcgacgaccatccccatttcttccagaacttcatccagcttgaagcctttacccagcatattaccggctcgccaatttcgtgaatggacgcttgtgcaggtgacgatcaagtccccgattccagtaagacccgagaatgtcagcggatttccgcccatttttgtgccgagccgggcgatttctgccaagccccttgtaatcagcgcggctttcgcattatctccgtatcccaaaccgtctgtaatgcccgcggcaagcgcaatgacgtttttcagcgcgccgccgatctctacgccgatcatatccggattcgtatacacgcggaaattctggttcataaacatatcctggatcgcctgggccgattcaatgctgctgtcggcagataccgttactgtcgtcggatgccttaaaccgacttcttccgcatggctcggtccggacagaacgacgatgtcctcccttaattcagccggaatttcttctttcatcatttcagaaattcgaagcagtgtgtcaggctcaattccttttgaaacatgtacaaaaatcgccttttggttgatgaaggaaacagcctgtgccaaaacttcgcggatcgcttttgtcggaacggcgacaatgatcgtcttgacatcagccactgcagcttcaagatctgttgtggcacgcacgttttcagaaagtttgacacccggcagataatctttgttttcatgatgttcattgatttgctgaatcagttcttcacgatggccccatatgcacacatcgtactggttgtccgccaaaacgagcgccaaggctgttccccagcttccggctcccaaaatcgatacttttgtcatttttactacacctctttattttcttgctcttgcgaaaatcctgattggtgttccttcaaatccgaaggcgtcgcgtatccggttttccaaaaagcgttcgtaagaaaaatgcatcagctcagggtcattgacaaatacgacaaatgtcggcggcttcacagccacttgtgtcgcataataaatttttaaccggtttccattatgcgtcggcgtcgggttcatagccaccgcatccataatgatatcattaagaatattggtctgcaccctcatcgaatggttttcgctcgccgtcatgaccgcaggcatcagcgtatggatgcgctttttagtcaaagcggacataaacaaaacaggcgcgtagtccaaaaattgaaagtggtctctaaccttttcttcaaattctttcatcgtccgctcgtctttttcgactgcatcccatttgtttacgacgatgacaacagcttttcctgcttcatgcgcatagccggcaatccgcttgtcctgctcaataatgccttcttcgccgtccaagacgacgcagacgacttctgaacggtcgatcgcctttaaagctcggaggacgctgtatttttcagttgcctcatacactttccccttttttctcatcccggctgtatccacgatgacaaagtctctttgattgtatgtaaacctcgtgtcaatggcgtcgcgcgtcgttcccgcaatattgctgacgataacgcgctcttctccaatcatggcgtttacaagggaggattttccgacgttcggccggccgatgaggcaaaattgaacgacttcatcctcatacttcgtctcgggtatgtttttaaaatgttcgctgaccgcgtcaagcagatcgccgagaccaaggccatgcgtccatgaaatcgggaacggctcgccaaagccgagggcataaaaatcgtaaatgtttgctctcatttcaggattatccactttattaaccgccagaacgacgggtttttttgtacggtataaaatttttgccacttcttcatcagcggctgtgacgccttcgcggccgttcgtcatgaaaataatcacatctgcttcttccatggcgatctcggcctgatggcgaatctgcgccaaaaacggctcatcgccgacttcgattccgcctgtatcaatcaggttgaagtcgtgattcagccactcggcagagctgtatatccgatcccgcgtcacgccaggtgtatcttccacaatcgaaattctttcgcccgcgatcctgttaaagatcgtggacttccccacattgggtcttccaactatggctacgacaggttttcccatagtacccttcctttcaattcagtaaagcttttccatctttaaatgaatgatcatttgtttctcttttcaaaaaatcagtttgaagaaagaaacccttcttattccatacagaagggcttaactcatatattatatcaatttctaaagagatcacaactgtaattaaaaatgtttcacaatcaaataaaggtcatctcctattccgtgggcgattccgtcgagaatggcttcaaggtttttggcgtacgtgttcatttcctcgggggtgtcgcagaaaaatgcagccgtcccgccgatcactctgtctcgcctcgttgtgacgacggcgagaatgaatttttcgattgattcgctcattttatcaccttgctgtgcttttctttaatgaattccatcggtacgcggatggcgttttccagcgtcggaacatcgccgatgaccctgatcgccgtctctttgtccttgatgaccggaaggacaaaaaccgcgacccgcccgtcattcaaatcccttttcgcaagcggcgaaagagagggttctccagaatctcgatacacgccgagcacatttgaaacgtcaaataaaatcgcttgtctttgcccgagattggcaatcgttactgcggaattaaaatttttcggcttcaaaataaaccccatgccgtgttccaaaatcagcttccgcttttcgggaagcccgatattcataatgtaaatattgtcgacataaagtccggccccttcaaaatgaggctttttatactctatatcggcgatatccttaataaagcttccggacattaagattctgcccgcgataaaacagatcaaagcagcagcaaggcctgcccataccgatgaaaacagaatgtatgcgagggtcgtcaggagcgatgtaaaaatgacaatgtaattcctgctttcaaaggcgatcgcgattccttcgatatacgtgctgcctcttgaaacgagttcatagccgtcaagctgcgtcaatgtttcccgttccatgttccggacatccctgaattgggttgcagccagcgttaaaaacgtaatcgctgtataatccgatttcaagattgacggaataatgatcgcgccaatgctggcagcgatcaaagccagcgcaatatgtatcgttttcccatgaagataagtggggtactggcggtagtcggttcggagcatatatactctgacaacaatacctgcgacaattcccaagatgatcggataagtatattggctcatgacatttttgctgctcctttattcaatcgcttcaatttatgatagacttgatgcatcagctgttcatactgggatattccgtaaacgagaacgatccccgcagcgcacattgacagccatgaataaccgcccgctgcaatgtctccatagagctttctgatgacgaatgtatacaagagctccccctggcacatcccgagcacaaacaccccgagacggacggcgaagcttctttcaaaagctgctgtcatgatgacaaacaagatgatgatcagccattcaggctttaggataaaccaaacagggtcatataatgcaaacagaaacaaaaaaccgtaggcggacaccatcgagagatgaagcagcagccgcttgacacttttatgaagcctcaaaaaaccgcacagcatgaaggctccgatataaaacgacaaataggcggcattaaaatacataaagagcctgacctgatacatacttaaaatgatgttgagcaaaataaatgctgacgcataaaagcgaaacctgtttttctcgaggataaaagtcgtcagcacccataaaaaccacattgaccaataataatagaattcttccatatgttttcgtcctccattttcagtatggagcgacttaagattttttaaacgtgcgataaggagggaacagcgttgggaaaagacagacaggaaaagaagctgaaacagcagaagcgaaccgaatcggaccgtgaccagtcgatcagctacaatggcgccgcctctctcgaaagtgcggaggacgcgcgcaagcgaaacccgtaaaaaaaccggctcaagagaagccggtttttttaacgcatgctgtaaacaaaggggtcaacacccctcgctttcagccaatgatatgtatcgcccttgatgacgagcggcgcttttttcaactgttcaatcgtcctgcaacccaagacggtcataattcttttgaaatcttctatcaggctctcgatttcggcggctaacgcctcttctcccgaagctgtcagcaccttgagaaaatagcctgccatcccagccgcagacgcgcccagcgctatcgatttggccaaatcaagggcatcttgtatgccgccggatgcgataatcggccgatcgccggatatcgaactgacttcggccaggctggctgctgtcgatatgccccattgatcgaaaaactcaactgctttatccctgcgcaaattttcgattttcgaaaaattcgttcccccgaaaccgccgacatcgatcgcctgaacgccgacgttaaaaagccgggccgcggtatccctgctcatcccaaagccaacctcttttacggcgactggtacgctgacactccggcagatgtcttcaatccggcgcaggcgtcctgtaaaattgcggtcgccttcaggcatgacgatttcctgaatcacattgaggtgaatttgaagcatatcggcttcaatcatgtcgaccgcccgcttggcctgttccactgtcgcttcgctccccaaattggcgaatacaagccccttcatattttcttttctgacgatctcgtatgaaggtcgctcatcgggatctttcaaagcggacatttgcgagccgacagcgaccggtatgcctgtttgtgcagccgccctcgccaaagccctgttgatctcaaacgtcgccttcccgcctccgcctgtcatcgcattgataaaaataggcgaacttaaaaacagttcgcctattttggttgaagtatcaacttgtgacaattccgtttccggaaggctgacgtgaacaaatgtgatatcatcaagcccggtctgacgtttctgtccggtggacagggcatgatcaatgtgttctttttttctttttgctcgcgtcaccatcatcaccaaattttactttaatttattcagtttgtctccgatcatttcaccgagctggaaccctgaagactcttccttcgcctggtactgacggtaatcttcctgctctgctttatcggtgttttcttcaagctctttcatgcttaaagaaatgcgctcttcctcttcattgacatcaagcactttcacttttacgtcctggccttcctcaagcacttcatgaggcgttccgatgtgtttgttggagatttgcgaaatgtggacgaggccttcaactccaggaagcacttcgacaaatgcaccgaagctcaccaagcgctgaacttttccgtccaatacgtctccaggcttcaccttttcaccgatgttggaccaaggtccaggaagcgtttctttgatcgatagcgaaattcgttcattgtcgcggtcgacggacagcactttgactttgacatcctggccttcttcgacgacgtccgacggtttttcaacgtgtgaatgcgagagctgggagatgtgaacaagaccgtcaatgccgccgatgtcaacgaaagcaccgaagtctgtcaggcgctgtacttttccttcaagcacctgtccggcttccagcgtttgaagaaattcttgttttctttctgactgctctttttctacaaccgcacggtgtgataaaatcacgcggtttttatctctgtcaagttcaacgacgattaaagtaagcgtctttcctttataatctgtaaaatcttcgacaaaatgcgcctctacaagcgatgcgggaatgaatccgcgcacgccgatatcgacgaccagaccgcctttaacgacgtcttttacttcggcttcaaacacttcttttgactcaaactttttctctaggtcttcccaagcgcggtctgcatcaacagcacgttttgataaaatcaatgcatcgtcttccacttttgtcacttttaattcaagctcatcgtcaacattgacgacatctgatgctttttcaacatgaagacttgataattcactgattgggataattccggtttgcttgcagttggggatgtcaacatcgacatgcttgtcctcaactttcgttacaatacctttcaccacatctccaacctctggtacttgaacatcaatttgattcatttcctctgtcatttcaataacctccttggtccaaacctacacagcttttgtaaaaacggttattccggacgaaatgatatccgctccggacagccgatatgtattaaagaaccattcaaaaatggatatttgaatgttctaaaacatgatttattattactaacttctaataaaagcctgtgtttgtcaagtcaaaacatgcagacaataagtaatttgcccggattttttatttttgagcctttttgtctacaatctgcagaattttttcggccacttcatcgatcgtcaatgaagtcgtgtcgatttcaagcgcatcgtccgcttttttcaacggggaaatctcgcgctctgaatcgagtttgtcacggcgcctgatttcttctgcaagcgtttcataatttacattgtacccttttttgacgttttcttcaaagcggcgttttgcccgctcctcgacggacgccaagagaaatattttcacttccgcattcgggagaacgtgggttccgatgtcgcggccgtccatgacgactccgcctttttcagccagctgctgctgccttttcgtcatttcttcgcggatcccggcgtatttggcgacgatggagacttggttgctcacgctatccgtgcggatcgcctctgttacatcttcgcctgcgatataaaccttctgctctccttcaggcgaaaccgtgagatcgatggcagattcttttaacaaggccgtcagcgccgcttcgtcgtttaaatcaacgcccttttccagcgctagatacgtaatcgccctgtacatggcacccgtatcaatataaatatacgacttttttctggccacgattttcgccacggtgctttttccggctgccgcagggccgtctattgcaatgcataatttcttttccataattcctctccttgctatctggtactccttataggattgtatcatgtattaggcgaaaaaggggagattttagcgtgaattacggcttaaatgtctcgatccattcgccgattttcatgttgttcacgccttcatactgcacgacctttgacagataaggctcagccttggagaaatgaaaaagaagctgcacgctgattaaaatgaccgtctgtacgacgagtatcttaaataataaccgttcgattgttttcatattattcctccgctgcccggaaaatttatggccccgggcattttcaatttaccggcggacgttccgcccatatgttcagtatggaaatgtttagggcgaattattccgaatgctaaaaaggaaaaggcatgttatcgccttttccctttgatctatcgtttttacaagtcgttgtatatcggttctgcgcttttcattttctgaaccttctcttccgtgccgtcattggcattgatgaacatgcggaatgtatcgttttcaatcgtgccgagaatttcgtagcagagcacttcttgcgaaagctcgttcgtgactaaagcaaggcgcgtctcctgaacttttacgttgggattcaggcttgctttcgctttttcaggcgttagtttgggcttcggcaagtctctttttttatgggagattaagaaatcctttgcattaaacccggtaatctcgccgtcgtcaagcgcgaccttgatgcggatgctgtccggatagagccagacatcgtcctggaccggaacaaatgaaaacaccccgacgccgtcgtattgcgagctttcatccatcttcaggtcttccgttttatagccgttttttttcaaaaattgaagggctttgtttgacgcatcgtttaagctgattttttcatctttaatttttttgttttgaatcagataaaccggatatccgcctttttcggtaatgtccatataaatatccgctttttgatcagggtcctgcatactgatgctgtatacatccctgttcgttttcttgccgcttttcgatactttgatattgtaatttttgtcctgggcgaatttttgggcaatcttgcgcgcttctttttcggttattcttttgccttgtaaatggtcgtacccttgctgctcttttttcgtgttcgtcatctctgtcgcgcctaaatccgtatccgaaaatgcacttgcgcttttttcaacggttttaaagccattaataatcttattgtcgctttgtttttggccggacgcgagcgcaagttctacatccatccatctcaaatttttgtcaataatcaaatgctggacattacgcagttcattttgtatatcctttgaattttcatatagctgatttaaagaagcgtactcttttttattgagcggctctttgtcaagatcgcgcacggctgctttgtagctgaaatctccgacctttgccaaaaactcttcggtcttgttaaacggcattaaggtcagcggcagctggctgacattgttatgcgcttcagaagtcgttttccagacttccgccaaagcgggagacagcgtttttttgctgttcatcgcaagcgtgctcccgattttatcatgcagctgatccacctgataagttaagtcgtgaaatgccctttgatagttgttttcggcatgaagcaaaacggcgtctttctcctgatgttctttatagccccaatagcttgttccgacgatggcgacacctaaaagggcgattaaaattcctctgatcatttatagcacctcgcttttattcacagaaaatgtgtttaccgatccttttaatttgaggtctgccccaaatccatgagctagtggccgtgtcagggttaaaatagtaagtggcattttctgatggatcccagccgttgatggcgtcaagaacggcttttttcgccgtttcatccggcgtcatataaatctgtccgtccgcgacagctgtaaatgcaagcggttcaaagataacgcccgccaccgtattcgggaacgtagggctatcgagcctgtttaatataacagctgcaacggcaacctggccgtcatacggttctccgcgcgcttcaccgtaaaccgcttgggccaacagattaatgtcgttgttcgagaatccgcccggcatattggctgcaacggcatcctgttttttaggcgcggcttgtttaggtgcagcctttggctgtgcttgttttttcggctgtgcaggagcggcctgctgcttttgctgcggctgtttttgggcggtaccctgctgttgtgcgccctgccgctgtcttgcttccgccttttttctcgcctgctgctgcacttcttttgaaggcttcgtctgatacttcagcggcagcccgccgtaatgtgtaaattggtttccttttcgaagctgtctgtgcacgtagtcgctgtaatatttagtatgattgattaataatcgttttgttttcggcccgaccaggccgtctgtatcccttaagccgaactgattttggaaattgcggacggcccagtatgtcgcccacccgtatactccgtcaattctgccattgtaatagccattgtattgaagtcttgcctgcagttcaatcacatcatcccctgtcgccccccgctgtattacctgttcagaaaaggcagcgcttttttgactgaatggaagtgaaagactggttgccataatggtacataaaatgacattcaaacaaaaagaacctttcgacttcatgttttaagcctcctccagcatttttgtaaccatatcttttgtagcgaggcagattttatacacgctttcctttctgtttcatctttaggcaaatatgcctgacaagaaaaataaaaaaaccgcccttttacaaggcggctattgctgaagaggctgcccgccggttttgacggaacgggctttttttgctttgcgcaagccgaaccaccaaagaaacgccataaagggcagcataaaatagatccagttttttaaggcgagcagaatataatcgtatagaccgtgaagcaaagccggaataaaaagcgagcatagcagccatttcatctttgttttgctatccgaaaaacgggctttgcggaagtaaaagcccatggatcactccgaataaagcatggctggaaaccggaagcaaagcgcgcataaaggcgtactccaccccgtttccgatgaggtacaatatattttcaagcgtcgcaaaccccaatgaaaggcttgtcccgtatacgattccgtcatagtgttcatcaaagtcgatatgctgaaaggtgctgaccatcagcaaaaaccattttaaaaattcttccaaaaagccggaagttaaaaacgaaacgacaaaactgccctcagaaatgtgttctttttccaatacatactggatgaacatcgtcggaaaaacgagcaaaacccccagtataaagaggcggatgaccatatgaatgggctcggattcatatttttcctttaagtaaaaatacattaacagtgcgattccgggagctaggcctgctgagataattccgaacatgaggaaacctctttccttttcatctcattctatcctaccatgattcggattgttttgaaattgaaaaagaacaggccgcctaatagcagaatttgtcttttatgccttctttatagcttgcaagaaggacggcgagtttcattctcgcttttttgctgtcataatccttgcctaaaatgaccccttttttcgcgaggtcatagctgctgcctgcatagtcataggtcgtataaacttcgccttcctctgcgctcgtcgtgatgacgatataaacgccctgatttaaagcttgttcgatatcagccatcatattcggcggcacctgcccccttccgactccctcaaggacgatcccttcgacaccctcgcggacggcggctctgataaacttgccgtctccatcaagatagcatttgacgatgtccactgcaggaagcggcctttgcagctggtgaacatcccgctttaacggcttttgataaacgtatactttgtcgttatcaatgatccctaagtagccgaaaccgaatacgtcaaaaccctgcagattcgaagcgtgcacttttttaacgtagcgcgcgttaaagatcctttcgttaaaaacaacaaccgtgccggctccttttatatccggactgcaagctgtatatacggcatgcctgatatttgtatatgcatctgtgccttgctgttccggtgctcgctgtgaacctgtgacaacgaccggcctctcatcctctattgttaaatccaaaaaataggcggtttcttcaagcgtgtccgtaccatgcgttacaaccgcgccgtcatagccgccgtcctgaaacacgcgttcgatggtttgcttgagctctaataaatgctgaaatgttatatgcatacttggaagctgaaacgccgggtagacatcgatctgtacatcttccggcaggctgcacatttcggctaattcagggccgctgatcgcccctgccgcaagccggccgctttcggttttccggctggcgatcgttcctcccgttgtaatgagagctacttttttattcatgtcaagatgccccttttcgcgttgatctgtgtgccgataaaaaagagagcacatctatatatagaatatgctctcttttgcctgatacaaatcataaaacatccggtttttatatccgtttagcaatttcagctgcgattaagccgccgtgaaaacggccgttttcaataaagatttcatttgcgttgttcccggccgcaataacgccggcgataaagatgccttcttcgttcgtctccatcgtttcttcattaaagaaaggacggcccgactctgcgtcgattttgactcccattttttgaagaaagctatgatctggatgatagccggtcatggcaaatacaaaatcatttttgatcctggtttcttttccgtcgacagaaaaaatcagctcgtcttccgtaatttctttgacgaccgcccggaattccattctgatttttccgtgcttgacaagcgaaaggaattccggaaggatccacggtttgatgctggaggaatattcgttccctctgtacaatacggtcactcttgcgcccgccttaacgagctccattgccgcgtcgacgcttgagtttttgcccccgataactgcaacatctttatcaaagtacggatgagcctctttaaaataatgaaatacttttggaaggtcttctcccggtacattcatatagttcggattgtcataatatcccgttgcgacaatgcaaaaagaagacaaatacgtgtcctttgatgtttccacgataaattggttattctctgtttttgttacggattgaactttctcaaacgcgttgatccgtagattttttcgtttggcgacttccctgtaataagaaagcgcctgatttctgaccggcttgtgattttcagtaataaaagccacatcgccaatctccagtttttcgcttgagctgaaaaaggtttggtgagtaggatattgataaatgctgttgacgatgtttcctttctcaatgacgagtgcatctattccgatctcttgcatgtgaatagctgctgaaagcccgcaggggccgccgccgataatgatcactttttcttctttcatgttccgttcatctcctgtcatatccggcaaatcaaaaaatctcctattttatgataggagattttttgggttgttgcaaatgtttgagcctatatccagcctctgaagcgggatgcttccgccatcttgcggacgcccaccatataggctgcaagcctcatgtcaattctgcggttgtgcgccatttcataaatgttgttgaacgatttgaccatcattttttccaaacgttcttcaacttcttcttcagtccagtagaatccctggttgttttgcacccactcaaaataggataccgttacaccgccggcgcttgccagcacgtccggtacaagaagaatgtcgcggtcggaaagaattttcgtcgcttcgagcgtcgtcgggccgttggcagcttcgacaacgattttcgccttgatgttatgggcgttttccgcggtaatttgattttctatggcagccggcacaagaatgtcgcactccagctccagcagttctttgtttgtaatggtgtcattaaacagctttgtgaccgttccgaagctgtctcggcggtcaagcaggtaatcgatgtcaagcccttcaggatcgtacaggccgccgtatgcatcagaaatgccgacaacctttgcacctgcgtcatacatgaatttcgcaaggtagcttcccgcatttccgaacccctgcacgacgacagaagctccctcaatgtcgatgtttttctttttcgccgcctctttaatgcagattgtaaccccttttgctgtcgcagattctctgccgtgagaaccacctaaaacgagcggtttgccggtaatgaagcccggcgagttgaattcgtcgattcttgaatattcgtccatcatccatgccatgatttgagaattggtaaatacatcgggagccggtacgtcttttgtcggtccgacaatttggctgatcgcccgaacgtaccctctgcttaaacgttccagttcaggaaaggacatatcccgcggatcacagatgatcccgccctttccgcctccatatggaaggtcgatgatgccgcatttcagactcatccaaatagaaagcgctttaacttctttttctgtaactcccggatgaaaacggatgccgccttttgtcggccctactgcatcattgtgctgggctcggtagcccgtgaaaatcttaacagatccatcgtccatgcgaaccggaattttcaccgttaaaaaacgaatcggttcttttagtaattcatacacctcttcaggatatcccaatttttcaagcgccttatgtatcaccgtttgcgttgatttcaaaacgtcatgtgtgttttcttcagtatgaccggtgttttgatcggctaccattataagttaacctcctaaagtctttctggcatgttgtcctttcagagaatagtatacacccttgcactaatcatgcaaagaacaatcaaccatttttcgtgaaaatattcaagaaaaatcatttttgttatattcttattttcggcagaaaaaaactgctgtttaacacagcagaatatcttttttgaatgcgggctatttaaagtatgtctgaatggtctgaacggcattgttctccatgattttctttccgtattcctgaagcctgtaaatcgttaaagtcgtcggattcccatattcggctaaaatcgaaatcacgccgtcaacctcaagggagtcaaaatcgtcgagacttaagaaatacctgccctcatagtggtagactgtcccgccttgaataccgatgcggtccagatttttggaaagttcaatcagatgctcaaacgtttgaaattcatatataatgtcaacactttcgccaagtttgacttgcatttcaatatagtcctcatcatactcattatcgtcttcatctgtttcctgattttttgtgacaatgatgaccattccttgtgcttgaagagaatacacttcaacagcgattgggccattcgcttcgaacccgagctctgtattcgcttcgttcatcatgtccttaaacagctgctgaactttaaatgagtctttccaaaggtcttctttcgtcagcccccggtctgtcagatcgtcaagtgtcagaaagattttgatcttattataatttagacgctcaagccgcataacgttccctcctgcctcttcttgcacacatcatatatcttattatatggagatgatgagtcataggttcttaattttgataccagtttacactgtgtttgagaggaagacaagcacaatgccgccttttcgttttttttcagtgaaaaagcatcagtttccttccatacgggggcccggaaccagattgatcagatgggtttccggcctcgctccgagccgcagaggaagcttcgacgttccatagccgttgctgatcaagtacggagccttgaaaacagtgccggttcctccgatttcacagagcccgaatctgccgaagcgaatctgtcctccgtgggtatgaccgctcaatatcaggtcaataccgtccgcctcctgtatttgatgatgaatctccggattatgtgacacaaggacagtcggaaaacccggctgcacgccgccgagagctgccgggtaatcatccaattcgagtctgatgtcatccactccgcaaatattgacagtttgtccttgatggtcatgcaataccgaagcattgcgcaaaggcgttacaccgtatgtcttgaatatttccagcagcctttcctgatcaacttcataatcgttatttccccatacaaaatacgtttttcccaaacttgaaagccttttgatattttcttcaattctcgtataagggacgccgccctctgctaagtcgccgccgatgatgacgagctgaaccccgcgttctttcacttcacaaataatgtcttcgctgactgtccgcctatgaatatctgaaataaaaaagacattcaattcctttttcaggcgcccgagtgaaaattcagccttcaacacccggttttcgcgcgcgatggctgacattttccacactaaagcagcaaggccgatgaaagcggccgaagccagactgagccaatagatcatgtgcattctccaatctgttttgtttatgataagacggcttgatgcaaaaagacgtttcttttaacaagaaaacgtcttttatttgctttcgaaataaagattaatgtcatactgctgtttcatgatcttaaaaaccgtttcccttgatttccactcttcaggctggggccatagatccgtgcttttctgaataatctcgcatctcagcttatgatattccccttctgctttttcttccttctttttaaaatagtaagcggtgctgtatgcaaaagcggccgacaagatccacagcagatagacggagtcattcagcaagccggaaaggaagccgttttgcccaatcccctttgacgctgcaaacacacaaaacgaaaccgcgcatatcgccgccaccgcctgccacctgaatgtctgtctggcatagttttcgtactttttcttccttttaattaaggcgcggagcatttgtttcgtcggttcgtccgtaaaacggtccagctcttcaagctcgcttcccacagtcctcacaccttgtcctatttgttagtacaatgtatatgtattcgcgggcaaaatcatgccactgttaataaatcgggatatccaggacctggccggcgtagacattgttgcctgataattgattgtagttgcggattttttcctctcctgaccggttcttataatatttcatcgaaatccggaaaagcgtctctttttcgccaaccgtgtgcttcagcacctttttgggctgcggtgcttgctgaactggcggcgtttgaggcgcgtttgccgttttcttctcttgttccgcaggctgcttcgatgcggcgggcttctttgcagcgacaggctgctcatctgctttttttgcctctttaggccgctctttttgcttttgctcgtcttttttggacggttcatcctctttattttccggctgtttgctctctttcagcttttcttcttgaagggcggcggctgtatgctgcgaagccgccttttgatccgcttcttgttcaccgttttgattttcattcgtcattcccgtttcacctttgttttcataaaacacattatcatattgatcagggtcggtatcgcctccttgattcagcatgtacatgaacaccacgaagacgatgatcggaatgaaaacaaacatgactgcaagagacgtgaatagtggatttctgtctttattcttttttttgctggacttcttttttttatgataagtccgtctggaaggaatctcctcatcaagtgtctccagttcaacagccgcggccgcctcccggttcatttcagcgctggccttctcctgttccctcttcttcctctctattcttgacatctccgtcatgtgaactcctccttacgtgttgaaaacgaatctggcacgcaaatacaacatcgatcaaaaaatgtgccgtgacaggaacaaataaattccctgtccgttcaaagctcaatccgagcaaaaagctgatggacaccaccattacaaacagcagccatttttttaaataacgaaaatgcaatatcgcgaaaataatgctcgccgcccagagaccgaaatgcgtctggataacgcccctgaacaatatttcctctgcaaatgcaatgaaaagggtaagaatcacgatatgcggatacgagcgttcacgaaagagcttttcatttatcccttcatcgtcatacatatgcttgggagcccatttcatcaccatcaggtcggcgatgatcacgagagccgcgagcggcgccccgtacttcaggatgctcaagtccgatggattccaaagcgatagaaaagcgtctgcatcatcaaataaaaagatgcccatcaataatgcggtaaaaagcatcagcgtctgggaaaaatagagctgtttcagcatttccccgtctgacaggcgacgtatgatttccgactgttttttcagcatacacgatcacagctggcggcaaatatggtatccaattcttcttcccacgctgtcaatttgttcatagacggacggtctcctttgacttcgtatgcttcaagacttaaaccgcaggatgtgcagcacgctgtttcatccgttttcggcggctttttttgttcattaaaataagcgagcaagctttccctgaaacacccttctgtttcggtgacggcggcgaatcccgccgcttttttcaatttgagctgcctgcggctgtccatctccctctgaatgaccgcccggccatcgccgcccagatgatgcaccttctcataaagatggagaaaatggcgggcttgcgtttccgataaaccggccagctgcagagcttcccgccggcagcgttcatctttcactcctgcaagcttttcgtataaaaagccgatatcgctttgggagagggcttccatttgaatcagctgctcctggatttcctcgtctcccggagccttcagcaaaatgctgacgctccgctttccatccctgccggcacgtccgatttcctgcagatacgcctcaatcgtctgcgggaggctaaagtggatcacatatctgatatccggcttgtccactcccataccgaaggcgtttgtacagcagaccacatcaagctgattgcggataaactgctgctggatcagcatcctgtcgcttgctccatcccgccatgataaaatcccgttctcaagtttgcttctttacggagcttgtcagccagttcttcagcccattttctcgtcgggcaataaacaaggccaggaccttgcagcttttgaaccagccctgtcagccgctccgtcttctcagcagtatccctcagcttttcaatatgaagcgcaatgttcggacggtcgaccgaatgaatcaaataattggcggctttaagccccaggatttccgaaatgtcctttaatgtcgcttcggttgccgttgctgtaagcgccagagtgacgggatgaccgaggagcgccttgatgtctccaagcttcgaataatcaggcctgaaatcatgcccccattgtgagatgcagtgggcttcatcaacgacaaaaaggctgacattgagcaattgaagctttttcagcatttggccggactgaagcgcttctggtgaaatgtacagatatttgaggcggtgaagccggtttaatacgtcatttttttcttggtgtgtcaaagcgctgttcaaggcggcagctctcttctctccgcgcatcttcaattgctgcacctggtcttccattaaagacaaaagcggcgagacgatcaggacggtgccgtctaacaaaagccctgggagctgatagcacagcgatttcccgcctcctgtcggaagcatcgccaccgtgtcccgtccctccagcacgcttttgatgatcgtttcctggccttttttaaaagcatgataaccaaaatacctgcggagcgcctgatgaagtttatccattcctgatcaccgttttcgacagggccaggcggattttaaaataactgtatcggccgccgagtccctctttaatttgtctgattttattggtttggttcgctatcgcataatcggcaataattttctgttcctctttcgacacgtactgatcgatggaaaaagacggatcatgaatggcgatttccacaatgtgatcctcgatcgtcgccaatttcagctttctaatttttgcgatccggtctattgtatacccttcttttataagaaagagcgtttttctcgtcgattgtgtcagaccatcattcaaaggaatgtcatgaatgagcgtttgaaaaagcggactttcaccattttgggcggattgaataaaatggtgcagaacatcccaaaacagtgcatatatgtaccactcatcaaggttcattttttcggaaagctgtctgaatgtatagcccgcttttgttctggatgtcagggagtgaacaaaaatagcggcctgttcatcatgatttaaaacagacagcttctctttcagctcttggtgaaactgggccgctgtttcagcagcattccggtttcttaaatactgtttaacccagttctgaatctgataatcttttacgatcggcaaatacacgcgttcgcggtaaagcttgttggagagcacttggatcaaaagcgacatccttgcccacatcactttggctgccgcctgataatagccgccgtgaaaatggcggggccacggataaagggcaaaaaagccggcaagttccgcttctcctttttcggtgacggtgtaagcgccgctttccgctttttctctgaccaaagactcctgcttcaatcgttgaacgctggctgccacctgctctctcgacagagccgaacaaaagccgaagtattttgaaacggcaaataaaccggcgtcctgtatcgtctgtgacgacctttttccttttaataaatgatagaccgcgcttggagaacgctcacccttcatggatgacagaatgtcaagcacaatcgcgtcaaaaaaatgaaccggcatatcatcacctgcaatcttccggcaacattcgatcatttcttccttttattttaacagattttgcggagaaatcgacgtttaaactcatataaaaggggtatgttagcagtagaacccttgtgtgataagcattctcaatatttttgagttgaaatgtaagattaacaccattacaataaggaatgggaataggtttcatatcggatagatagagggttaaaccatttgttccaacgaagaacaatctgggaggttttttattcatgccaaaatatacaattgtagacaaagatacgtgcatcgcatgcggagcttgtggtgctgcggctcctgatatttatgattacgacgatgagggaatcgcatttgtcacccttgacgacaatcagggtgtcgtcgaagtccctgacgtcttagaagaagacatgatggacgcgtttgaaggctgtcctacagattcgatcaaagttgcggatgagccgttcgaaggcgacccgcttaaacacgaataaagccaaaaaacatccggtgcacaaagtgccggatgtttttttatgagataagcacggctttaccaacaagcaaaaagaagccggctaaagacatccggcttcttctgcagctgacaatatccgggaacatgcacccgatattgtcatgtttatttatttggccatgcggacgttttccttcagccgcggtttcagcgaaaggaaaatcggcgtggacacgagggccacagcgatgcctttaatgaaattaaaaggcaggattccggccagaactgttgtcttgagcgcctctccagtcagcgctggagcatttaaaaaccaagtgtaggcaggcagaaacagcagataatttaaaatgctcatcgaaacggccatcacaagcgtccctgcgaaaagagctgtgacaaaccctttggcagaacttgattttttcagcagtacagctgccggcaggataaacaatgttccggcaatgaagttagccgcctgatcaatcggaacgcccgaggcgcttcctgcaataaagtaattcagcacgtttttgatcgcttcaacggcaatcccggctcccggaccgtacaaaataacagcgagcaatgccgggatatcactgaaatcgatttttaaatacgggaatgcccccaggatcggaaagctcagcatcattaaaataaatgcgatgctgctcagcatgctgatagagacgagacgtctcaccttgttgtgtttcattttgtcactctctccttttcgatcacatctcacgaaaagaggaatggttctttcccctgtcctaaacaaaaaacccgctttattgaaaaagcggggctgttttacagacaggtcaaataaacgtttgaaaatgttcatttcaaaacgcgcggaacctccatcttctcccatccagactatactgtcggcttcggaatcgcaccgaatcctgcccataaaaaggctcgcgggcttagagcgcttgctcatcaccgccggtagggaatttcaccctgccccgaagattgatcttatttatttttaatactgatattattataaattaattgtgaaaaaatgtacaggtgcaaagcttattgcgctgttttgggacatcctgcacgatatttcggtaaactcactttttccgcatactaaaaaccgcacattcacagttatttcatttttaattttcgtctttccgcgtgaaactcattgacactctttatggaatatggtaaattatcagatatttatgacgcttatttaggaggaaatcttacatgtttcgagtattggtctcagataaaatgtccagcgacggcctcaaaccattaatggaagcagattttattgaaattgtagaaaagaatgttgcggaagcggaagacgagcttcatacgtttgacgcgctcttggtgcggagcgccacgaaggtaaccgaagagctgtttaaaaagatgacttcgctgaaaatcgtcgccagagcaggtgtcggcgtcgacaatatcgatattgacgaggcgacaaaacacggtgttatcgtcgtaaacgcgccaaacgggaatacaatttcaaccgctgaacatacctttgcaatgttttcagcgttaatgagacatattccgcaggcaaacatctccgtgaaatcaagggagtggaatcgttcggcttacgtcggttcagagctttacggaaaaacgctcggcatcatcggaatgggccgcatcggaagcgaaatcgcgagccgcgcaaaagcattcggtatgaccgttcatgtatttgacccgttcctgacccaagaaagggcaagcaagctcggcgttaacgcgaacagctttgaagaagttctggcatgcgccgacatcattacggttcataccccgctcacgaaagaaacgaagggacttttgaacaaagaaaccatcgcaaaaacgaaaaaaggcgttcgtctcgttaactgtgcaagaggcggcatcatcgatgaagcagcgcttttggaagctctggaaagcggacatgtcgctggcgctgccttggatgtattcgaagtcgagcctccggtcgattcaaaactgatcgatcatccgcttgtagtcgcgactcctcacttgggcgcctcaacaaaagaagcccagctgaatgtcgctgcacaagtgtccgaagaagtccttcagtatgcgcaaggaaaccctgtgatgtccgcgatcaaccttccggccatgacaaaggattcattcgaaaaaatccagccttatcatcagtttgccaatacgatcggaaaccttgtgtctcagtgcatgaatgagcctgttcaagatgtagccatccaatatgaaggctccatcgccaaacttgaaacgtcatttattacgaaaagccttttggccggatttctgaagccgagggtcgcggctaccgttaacgaagtgaatgccggcaccgttgcgaaagagcgcggcatcagcttcagcgaaaaaatttcttccaatgagtcaggctatgaaaactgcatctctgtgactgtcacgggagatgtaacaacattctctttaagagcgacgtacattccgcacttcggcggacgcatcgttgccttaaacggctttgatattgatttttatccggctggacaccttgtctacattcaccaccaggataaaccaggggctatcggccatgtcggacgaattttaggagaccatgacatcaatatcgccactatgcaggtaggccgaaaagaaaaaggcggagaagcgatcatgatgctttcctttgaccgccaccttgaggacgatattttagctgagctgaaaaacatcccggatatcgtgtctgttaaagccatcgaccttccttaaacagaagctgcggaacctgaaaagaattcctttcaggttccgtttttttttaggaattctccctgatctcaagcatctggcggggataaatccgctctcctttcaaatcgttccattctttgaggcgctgtacagttacgcccattttttcggcgatatgatgaagcgtatcccctttccgcactacatatgtaccggtcttcgattcatcgtcatgaaggcggagtgtttggccggccttgagatttgaatgtttcaacccgtttattctcatgatctcctcgatggatataccgctatccttgctgattctccagagcgtgtcccctttttgaacggtcaccgcaccgctcattgtcccggcgttttgatgaacgtggatagaattttgccggaacgcctcctcacgaagcaccgtcagcggattgattgcatatcttttatcttcagtccatgaaccgtgatgcatttcaaaatgcaggtgggttccggtcgatattcccgtaatgccgatgattccgatttgctcgccttttttcacccgctccttttcctttttcaggcgtttgcttaagtgggcataaacggtttcatatccgttgtcatgtttaataaatatcacttggccgtaggagtcggattgatacgatttgcttatcgttccgtctgcggctgccgctactgcttccccttcgggagcagcgatgtcaagccccttatgctttccgcctctcgtaccgaattgatctgtgatctctcctttaatcggttcaatccactctgaggcttccgaccccggggcattgacgaaaagcgccaatcccgaaagccatgcgatcgcgaacaggaagttttgatgtctgagtttcttcaaggttttccatatcctcctattacatgcatcttcggtaaaattgccccctattcggagacagcttagtatacttccaaatcaatacaatttatacattaaaaaaagactccgcacagggagtcttttagttttctatcgtcatcggattcggtgcgtacggaacctgtacagatttcgacaggtcataggcgccgaccttggttatggatgcgtttttaaatttcacttttgtgaagccgaaatctttcgcggtcaatagaaggccttccaccatcaagacatcttcgggtttattttcaatattcgcggaggaagaaaattgaatgatcagttcttttccattcttttgaatatcttcaatcggcgtatcatcggataaaatgggttttaaatgagtgccgctttcttcgtttttcatcatcttaatcgcttcctgcaccgattcgtaagattcgcttgaaggtgcaaggaaccggcgcccgtctgagctttcatataaatagtagcatttttgcgtctggtgcataatcgccatatcggcgagcattccgaatgtttcaaattcaacacccgatttatcattggaaataaacagaacagaatcatacgatccccatttaaaggtttcgttgatcacatttttcagccgttcgaaatcttcgactgatagctccggtattttctcatcaacttgaatcttcagttttttattgtttttctgctctttgaacttcaccttatcaaggtaagctgtgtcaaatgatgtaaactggtccactccaagccggctgtaagcgtgaagcgcatcttcaagatttgtcatgccagtgcttttctcgaggcttaccgggacaacgacagacttggactcgtcaaggaaagcgaaggtgatatagtcgtctttttgattctgtgagacgacaaacgtatttgcaggttcagacttggcagcatcagcctccgtctgcaccaattttccgtcagaagaaatgttggcgtcggcgctgttttgagatctgatctgttcgattaactggggagtgatcagcatcagaagaaagagaaccaaaactgtagcagcaaatgcgccgacccgttttttcggtgatttacgctttggtgcgagaatcagcttttgatagatctgatttgccgaacgattatccttaaccgttggaagttggcttagtaacgccttcagccgttcttcgttccattctgacttcttcattctttggatcctccttcaaaagctccatctgtttacgaagcactttcagaccgcggtgctgagtggtttttaccttgctttcggaaaaattcaaggcttttgctgtttcactgatcgaatatccttgaataaaacgcaagacgataactgatctttggtcaagcgtacacttgtctagggcctcgaaaatttcctttaggttttcattttgcatcacgatgtcctcaggcagaggcttgcggtcttttacatcttgtttctcccagtcaaacgtccccaaaatccgctggcggatcgtctgctgctttctgaaccagtcgatcgcaacgtgccgcgcaatcgaaagaagccaggttttttcgctgctcctgccttcaaatgtttcgtaagaatgcaggacgcggatgtatacttcctgaactaagtcttccgcctgatttttgtcttttaccatataaaataaaaactgaaataaatcctgatgatactgatcatatattttctgaaaggtttcttccacctgaaacccctccgttcaatttattgtcgtttgtcaatcttaaaaggttacattacaactattacaactatattacgaacatatgaaaatggaaagggggttttgcgaaagttaagcttaattttaacttaacaagcacaaaagcacccgttctaaatgaacaggtgccaaggttataggagcccacattttcactaagctgtgcccttacaaggctttcgttctcctgaccggagcgttgcggatccgctgaaatgaactgatttcaatccgtttatgactttaagtccaattgttggcgaagctttttggaaatctccattctcttttcgtcagtcactaggtgataccataagctgtcaacttttttgtcttcaccttcaatttctacctgcttaatatctttagcagcttctttataagaactttgaatatcgatcatcttgtccagtgttaagtttgttttgatgtttttttctaatgctgccaaaatctcctgatagtttgttaatgattttaattgtgcaccttcatgaataatttcgttgataatctcacgctgacgctcttgacgcccaaaatcaccgcggggatcgtcttttctcatccgggcatatgtcaatgctgttttgccgtcaagatgctgcttcccttttgacagatgcacgccttcaagggtgaaatcaatccgattatccaccgttacgccgccaatcgcatctactatatctttaaacccatccatattgattttgatataataattgattggaatgttcaaaaattgttctacagtttcaacggttccttcaattccgccatacgtataagccgaattcattttcgaaaatttattttttgatttgataaacacccttgtatcacgcggaatactggtcattgtcgttttctttgtcttcgggttaacagtcattacaatcatagaatccgggcgtcctttatcaccggggcgctcatctatccccaataaaagaatggatataggatcgtgcggagcagtatccttctgctcggcatcccgatgaagaggttcgtacattccatttattgatttggcgactgtacggtaaatcccgtatgacaccacactgccgatcgttatcactagcgcgaggacaaacaatatcacatttttcatctttagttttccttttctcatttttaccatagtatcccttccttgttgatgcatctcatattttttaattccatctgaaatgaaccggttttatcgaatcatgaatgggcttcatttcatatccgttttcttggaagtatttcaatagtttctctaaatgggccgcagttgtcggtttttcatgcatcaatacaactagcggctcaacaccggaaaggttattgacttgctgaatcacattattcacgaattgaccgtttgtatttgcagatttccagtcctctgaatcaacagtccagtcccaaaggttaaaatggtcgcgcttaattacttcttgaaatggaccggtgatatagggctttgatccgtaaggcgatctgatcaaatgtgtgtcaacgttggtcgtttctttgatggctttaagcgtatcattcatttctgccgcgaagctttcaggagatttatagattttcgatacttgatgcgtcactccgtgagagccgacagaatggccgttttcaaccattttcttcacaatatcgggattttgttcaatattcggttttaacatgaaaaatgtagctttcgcatgatacttatcgagcaaacttaagattttatctgaagccgcaggattcggaccgtcatcaaatgacaaatagacgacctttccgatttccggcgctgtttgcttactttcttttttctctgctttatgtttgcctcccggcaccgatgctgaagccgcggaattttcttttatcggttcctgctttgggccggcaagcgcattccaagaaatgcataacaaagtcacaccgaatacaatcaacatacctagcactaattttcctagtgcgctcaatttatgatcttcttttggtgaatttgacactttttccaactccttagactttaattaacaatcactaggtttcttttaaactcgtcactcacaagtgacaattttttaagctgctatttttgaagacaaagttctataagaaggatgctctttaaatataagaggaagatatcgcagaagttcgaccaacttgtaaacaaaatgtcacaaaaagaagaaaaacatcattttttgaggaatgataatcaggctaattaccctgcaaaaaaagtgaaagaagtctttacaaaagaaaaaccttatttcggttaaatgccgaaataaggtttttttgcctgatattaaagtggagaacgaacaattatttaaatgtgatgatataagcttgctcttctaaaaatcgcacggatgcactctccatggcagggtactggtattgagcgttaacaagcaggctgttgccgtccggactccaaaatatttccgaagggatggtgccgtggtatatcggttcttcatagaggatatttttcccctgaagcttacctgcatagatattgtcttcatcctttaaagagtaagcgattttcttaaagtcgtttgagaatttaaaaacagttactttatcgagcagagcagaaagctctccgtttctgcgatcatattcgcacagggtttccccggtgtccaggaatacaaattgatcattgtttaaccaaacaggcccgccgcggctgtccagacgcttgtcctcgattttaatgcggctgccgtcaatggttcccattctgatcccgtactcgtcggaacgctgcaacacggtaaacagcaaatctcgtccattatcggagatgttaactccggtaagcgaatccttctccgcaaaatcattcaatgaatacgttttaagcgttccggaagccgtatcataaacacgaaggccggtctcatccccctgcccgacatctaaaacaagatagcaaacgtatctgctattatttgaccatgaaacatcttggacatagacctcactgctggcggaggtgctggcgatttctgtttttttcccgctcgccggcgaaaacagctgcattgatgccttacttaatgacaaagtgactccggcgatacgctttccgtctggagacatttttaggttggacgtgttgctttcaatgccttttacgatttcagctttttcatagggggaggaaaggcgctgaagactgtgcgctgtacgttcggatgtcccttctcccttgaaaaaaccgacaacggaatccggtgaagaccacccgagcagctgcccgacttttggaagacgatagatcgtattgacttgaaaagggcgggtcttctggtcatagatatgattttcttccccgcttgggataataatcgtttccgatctttttccgacattataactggacacgataatgatcagaaacagcagcactcctgcccatataataaacggtttgtttttcatcatttctcaacctttgcgtaagctaattcaacttgaatcactgtgtggttttctttgtagaacatctcgattgttcctccgtgttcgtcaacaattgttttcacaatgcttaatcccaaacctacacttccttcttccttaatcttctgattgactgaataaaaaggttggaacattttggtgtgttggtcattttccaatggatcgcttggattcttgaatgtaaaaagaatgttttctccaacgatttcggccttaatgatgatttccgaatgagataagctgtatttgatggcgttgtccagcagattgataaaaagctggcgcagcctgctcacctcaccaagaacgtacaggccatcttcaatgtcacaggtgatccttttcttataccgttctgcccgaaatttcatcgactcgcaaacatcttttaaaatttcgcctgcgtcgatcctgtcaaattgagcactcttggacgtttcccgggatacttcaagaagcttgatcaccaaattatgcaggcgccggctttcttcgacaatgtggttcattcctttatcaaaaaatttccggtccgcttcccctttatcttttatgatctcagcatatccttggatggaagtcagaggtgttttcagctcatgcgtcatattatcaaaaaaccgtttttcttgttcgttaagttcttttagacggtcgcgatccctttcgatggttaaaatttgttcccgaatcctgctgatcatatcgttaaagttgacggcaagctggccaatctcatcttttctattaaagtggatatccatatccagcttacccttcttgacttgtgaggtggcatctgtcagcttgacgagcggaatcgtgatatgtctggacaggatataggagaaaaggaacgccgccacaaatattgcaagcgcgatataaaaaacaatatccagaatctctccgctctgcttatacagcaggtcgaaatttttcgaaaagcgtaatatgcctacttttgtgccttcaatgacaaccggatatgagaaaaacacttttgctttattccggttataggtgatatgataggcagtctttcctttgatcgcctgttgaagatcttcatcactccctctggaaaacaccttctgatcagaagaagacaacaatgcgccatctactgtataaacaccgacattgcttcctgtggagtgatttaaattatctaccatttcatcggccatatcaccgaaataaagttcattgtttttatagtgattgattaaaaatgcttggtttacatagacggtactgttttttttcagttcgactaaatccgatgttacaattttttcgttactcgaccaaatgacgttcttaaccgtgtgattgagcacaaggaaagagagagaaaaaatcagaaaaaagccaacaataaacttgcccttgatggtccgtaacactctctactcctcctgcttctcgaatttatatccgatgccgaacactgttttaatcaagtcgcttgcatcaagctttttgcggagtctttgaatatgggtatcgactgtacgggtgtcaccgaaaaaatcgtatccccagatgaattccaaaagctctgaacgggtaaaaacttttccccgatggtcaaccaaagtcattagcagatcatattctttaggagttaattcgacggctgccccgtcttttttcaccagtctttcgcccggaacgatcacaatatttttaaaccggatctcatccactttttccgtttcccgttcgttcacatgatgggcttgttccagacgccgaaggatcgtgcgtattctcgcgacaacttcgcgcagatcaaacggctttgtaatatagtcatcggccccgaattccaaccccagtattttatccgtgatatctgattttgcggtaatcatcagtattggaatattacagctttcggtcacttttttgcaaatatccaatccgctgcagtccggcagcatccaatcgaggagcagaaggtcaggtttgaactgatctagtttcctcattcctgaagaaccgttattgaccgtgcacgtttcaaagccttcggacgtcagcccgtatgaaagcaaatcagcaattgcttcatcatcttcaataatcagtatttttgttttttccatcagtcatcactcattccctgtttcatgcttattttatctaaaaaatctcttttgtttctcgcatccttctatagagattatacataaatccaaaccaaagtcttcatttgacagcccttcagtcatcccactcttattgggaatggctggcggactttagtgtgtgcagtaaaaagcgaaccgccttgtatagattaccagaacgggagcggccatttccatatgcggttttcactatgataaagtttgcggttgtcctaaattcttctttcatctcctcttagacgctcatctgtcttcctgaaattctcactcttttatcggctacaaaggcataaacgtttcaggatatacagaaattttacaaattggatacattttgccctcaaataactgagcacctgttctgtatgaacaggtgctctttgtttcgtatggaacaagattcttcgtcaaatttggccatcatcctgcttatttcttggaatgtagaacgtgaaggaagtaccttcgttcagcatgctgtggacggtgatcgatccgttgtgtgcatcgacgatgtttttgacgatcgcaagcccgaggccagtcccgccttttcctctcgtccttgctttatcggccttataaaaacgttcaaaaataaacggcagatcctcttcgggaatcccgctgccggagtctttcacggcaatcttcagcccgctttcagcagactgcacatcgacatgaacggtgcccccggcatttgtatggcggatcgcgttgtcaatcaggttggttaaaacctgctccattttgtccggatcaaacacaaattttgcttcatgcagatcaagattgtgagaaagcgtaatatttttgtccccggccactccgtaaaactttctgaacactctctcaaaaaactcgcggagctccaccggttcaacgtttaaggaaatatgccccgcctccattctggcaaggtccagcaaatcattcacaagccttcccattcttaaagactcgtcatagatgacctgggcgatttcctttttttcttcctcagagcttgcgatgtcgtcaacgatcgcttcactgtacccttgaagcatcgaaatcggtgttctcagctcatggctgacattggcgataaaatcttttctcagcttatcaagccgtctttcctccgtcatatccctcaacacggcaaccgctccgcgtacatgggactgattgtacagcggactcatgagcagcacccatgttctgccttgcagggtcatttcaatcatctgctctttctccgtgctgacggtgttttgaaaaagctctcgcgcttcgggaggcagttcatggccttcttttacattcatgttctgctcataataccaagcctgtaaaaagcgttcagccggagggtttgtcacaaggattgtcccgtcgatattaatggtgatcacgccgtcggccatactgcttaagatattcgacaaatgctccttttcctgattgagtgccgtaatgtgaaacttcagctggcgccccatttggttaaaggcaatcgccagctcgccgatttcatcctgggtcagaatcggaatcttcgtatcaaacttccctttcgccaagtcctgggcaccctgccgcatttttctgagcgggtaggtaatccggcttgagaggaagaaagcgaaaatcgtcgttaacacaatcgcaatcgcagcggcaaagaggatatacctcgtcgtatgctgtgtcgtatccttgacggcaagaagcgattgagaaagaaacaccatgccttcatcttcgcctttcccgtagggtacgccgacaatcagctgatcgttcttttgattggagataaccgtcctcttctgcactttttgatgcttgcgaagcgcttcgttcagatctggatcgtttttaatatcttttaatgtgatggaagccactttttgatgttcccgcggtgaataccaatattcattctcatttttgatgacggcgatgctcgtcagttcatcggcaagctcccatgtaatcgatctggctgtctcctggtctttatggttttccatgatgacggccaccttgctggcgagctttgtcaaatcagcttccgcttcatctacatggtagttttcaataaactcgagcagaaagaacgtaaggataaataagacaaatgaaaccaaaagcagtatggtaaaccacagtttaccgactacgctcttccaaaacttcattcgtttccgacctcaaatttatacccgacgccccatactgttacgatttttttcgcagctttcggcgagactttgttcaatttttcacgtaaacgtttaacatgggtatcgaccgttctcaagtcgccgaaaaactcgtattgccatacttccttcagcagcttttcacgatcgtatactttatcaggagttttggccagaaagtaaagcagttcgtattctttcggcgtcaggctgacttccgttccgtccgccatgactctgtgagcatcgtgatcaatggataagtgagaaaaaacaagcacattttttgccgttgtatccgtattcaggtaagaggtttgcgatgatcttcttaggagcgccttgactctcagcaccacttccctcggactgaaaggtttcacaatgtagtcatcggttccgacttcaaagccctgcacccggttcgcttcttcgcctttcgccgtcagcatgatgatcggagtggcttttttatcgcgtacttggcggcatacttcaatgccgtcggttcccggcatcatcaaatcgagcaggattaaatcgtaatcgttgccgagggctttgtcgatggcttcatcgccattctcggcttcttcgatcttgtagttttccctttcaaggtacatttttaaaagtcgtctgattcttgcctcatcatctactactaatatttttgtctctttcgtctgttccatcgtaaacctcctgatttgaatcttcttacattcattttattagaaaagcgattgtaagccaagccaagaatgcctttcctcaatttaaaacaaaaagctgcggaaggcccggtgaaaagcccggaccttcctgcaccgcacggatcatgcataagagtgaagcccggcgatcacaaggtttacaaaaataagattaaacataataatggcaaaaccgatgacggcgagccacgccgatttttcgccgtgccagcctctcgaaagcctgagatgcagataagctgcataaaacaaaaatgtaatcagcgcccagacttctttcggatcccagccccagaatctgctccacgccagctgtgcccatatcatcgcgaaaataagcgcgccaagcgtaaaaaccggaaagccgatcgaaacggagcgatagccgatttcatcgacaaggtcaaggttcacatttttcacgagcggctgaagaagctgactgatgcgttttctgatgatcagcctgatgacaccgtaaagcaaggcgccggttccaaacgaccagagaacggtattcagcttccggcctgaaaaaatgggcggcacattgacaagcggctccattctctcctccgttaaaagttctcctttattcgggccgataagagcgggaagctcgtaaatcatgacgtcttcctggttgtctttatcaatccacttaaactgcgcctcatagcccccaatgcggaatgaggtcgtcacaaggataaacgcgagcgttgtcacaagcataaacatgacacattcgagccagaacgtttttttgcccggctttgaatgatccacatgcttgagcagaaagatcacgccggcgacaaagctgatggcgagaatcgcctgcccgagggctgcagtcgtgacatgaatatacagccagttgctttgaagcgacggaatcagcggtgtgatatcggtcggaaacatgctggcatatgcgatcaaaagcaggacaacgggaagcgtaaacagtcccaatgcggacagcttgtaaataaagtagatgatgatgaacgccaggacgagcatcatgctgaaagcagttgtaaattcaaagagattgctgaccggcgcgtgtccggaaacgatccatctcgcaataaaatatccaaactggcatacaaatccgatgatcgtgatcaacactgcgatcgatgcccagcggttcttcttcttccggtctgaagccttgctcctgatggagccgccaaaaaagaagaccgctgagagatacaagagaaatgccgcgtacaataaattgccgcttaactctgccatgaaaacccctccctatgctggccgtttattttttttcctttgacagttctttttgatcggccggttcggatatccccgtatccgcgagcgcggccttcaagtcctgcttcagcccgtaccagtttttgttcgtatgtccggcgacgagcacatgcccgtccagcgttctgagccagatccttctatggtgccagtacatcccctgaatgacgccgatcataaagatggcaccgccgaccatgagcacccacaaagtcaaatcttttctaattgtgaggcctgagagattcttcgtttcgacatggtcaaacttcattttgtatttattgtcgtcagaaccttcgattgtttcctgaatcgccacgaaacttttttctcctttaggcttatccggtgcggtgatctggaatacaaatgccggattgttcggattcctcgttttcgtgctcggttccccgtctttgttaaaataaaagtccggcaggtagcttgctatatgaactttgtaaccgttaccaagatcatattccggtttcggctccaagaggtcgattgccactttgccgaaggatttcccgctgtctttttcaatcagctgaaacaccattttgtcgagctcgccttccttgtatgtcagctgatagagtgcatatgaaccgaatttcaacgggtcattgaccttgatcttgccgtttttcactttcttcaattcaggcgcttcgcccggcaggctgtcattttttctttcatacagttcaacatcggtttgatatgtttttgcgacagtcccgtcaccagctttggtgatcgcctctgaaaatacttctttttctttttcactgtcgtacatttcttttataaaccggttgtttttcaaatagtaatggccgtcagttcccggaattggcaccgtttccccttccctgatccaaagggtttcgtcgacatacatgcccgggacaaatctgagcatgaccccgatgaggaatataatcagtccgatatggttaacatatgggccccaccttgaaaaacggcctttttcggcaaataggttgccgttttcttccttgacgcggtatcgttttttcttcagcttaccgatgatttgcgattttgtgtcctcagacatgtccgcttccgtccggctgaataggcgctgcctctccataaagttcggatttcgcgtgacgccctggtttttcagggccctgtacaaaggaacgacccggtcaaggctgcagatgacaagcgaaatgccgattgaggcaaccagaataataaaccaccatgaaccgtagagattgtgaaaaccgagagcataatagatttgtccgagaagcccgtattgttcgctgtagtatgtatcagcctgcgcacccggcggcaggaacatttcctgcggaaatatcgttccaaaagcggatgctgtcagcgtaatgacgatcagccagacgccgacctttacagacgaaaagaaattccatattttatctacgatcgttttattataggtttgagagcgtctcgcacttccgtcataccgcatgtcaaggagtttggcatcctgtttgaccagcggctttccgcacgattcacacaaaacggtacccgccggattcacatggccgcattcgcatttgatttctttcatcatgacgatccctctggtttgatcatattcatataatcgtggatcatccgttctgtcatctcgcccgtcacgaccttgacaatctctccgtcagggttgatcaaaaacgtggtcggcagcggtgtgacatcatatgcgttaaggacctgcctgtctttatcaagcacaaccggaaaattgacgccgtggtctttcataaagtttctgacggcgaggttcgattcgccgacattgacggcgacgatttccacccctttatccttaaacaccttgtattgattcgccatataaggaaattctcttttgcatggttcgcaccatgttccccaaaagtttaaaaatacccctttgccttttagttcgtccagtttgagacggttgccgtcaacatcctccagcgaaaaaatgggagctttttcccccaccgccacactctccgtgttttgaaacacggcgctgtacagcgtgtagccaagcgctgcaagcagcacaaggaggatgcctgtccgaatgtaaaaacgcttttttttcataatccgccccctcatgtagacattcagtatcattatatcatctcaagactgactgccatttgccttttttgaaggttgtgtgaaaatttagaaagccgctttaccgtgttctgccaatgccctgagccttttgacttcatgaggcgtaagctctcttttttcccctgttttcaagcccgccaggttcaaaaaagcatactcttcccttttcagcttgagcacctcgtgtccgatggcttcaaacattctcctgacctggcggtttcgcccctcatggatcgtgatttggacgatgcttgtctgctttttcttatcaagcgacaaaagcttcacttttgcaggagctgtctttccatcctcaaggcgcacgccccgctcaagtttttttaaattctcctttaaaggaatgcctttcagctttgctacatacgttttattaatttcgtatttcgggtgcatcaatttattggcgaagtccccgtcattcgttagcaataagaggccgctcgtatcataatcaagccttccgatcggataaatccgctcctccacctcggtgaaaaagtcggtcacaactttccggcctttgtcgtctttaactgctgatataacccctctcggtttatacaggagaaaataaacgggttcttcgctttcaagctggacgccgtttacctcaatccgatcggagcttgatactttaacgccaagctctctgacggttttgccgttgaccgtgactctcccttcttttataagctcctccgccttccgcctcgatgcgataccggcgtgggcgattactttttgaagtcgttccatatctttcacctcatgtattatcttacttttttccagaccaacaaacaagtttgcgaggcgccttcttccttaggaaagtagctctccgcccttaaatgtatcctttctcacctcaaaagtaaaacagttttggctaaaaagcaaaaagcgcctgttgatcaggcgcttccaaacagcaatgttacaataattacagacgcgataacccccgctaaatcagcaagcagtcccacctttaaagcatcccccattttcttgattccgaccgctccgaaatagacggtcaaaacgtacagagtcgtgtctgtcgatccctgcatgacagaggccagccggccgatgaacgaatcgggcccgtaaacggcgatcaaatcggtcgtcatgccgagcgctgccgttcccgaaatcggccggatcagagccagcggaaccacttccgtcggaattcccacggcggaaaacacgggctttaaaagattcataaaaaaatcgagcgcccctgaagcccggaaaaccgtgatcgctacaagcataccgactaaataagggataatggaaaatgcaatttggattccttccttccccccctcaacaaacgcttcataagtcggaacttttttgaatgtaccgtatagcagaatcgtggcgatgataaacgggataagggccagagaaagccagttgatgaattccaaatgctcaccccttcttttttcttctataataaaagtatcggtcgatgaagatcgcaaagatccccgatattaaagtcgccaaaatggtcggaccgacgatgtctgtcggcgcctttgcatcatatgtcatcctgaccgcgatgacggtcgtcggaatcaaggtaatgcttgacgtattgaccgccagaaaggtgatcattgagcggctcgcttccctgcggttccggttgagcgccttcatctgttccatcgctttaataccgagcggtgtcgctgcattgcccaatccgaaaaagttggccattaaattggataaaatatatcccatcgccggatgatccggagggatctcgggaaacagctttgaaatgaacggccggcacagcctgctgaatttttcgagaagcccggactgttcagcgattttcatcagccccagccaaaaaacaaggacgctcatcagtccgatcacaatcgtgacggcttccttcgatcctttaaatacagcttcattaacttcctgaaccgttccgttgaaaagcgcaaacaccagaccgatcaccgttaagccgacccagattatattgaccatgatgaaccgcccgccgctttttggaatacggattgaaaggtctcgaaaaacgattttttcggttttttgtttcgctcgttttcataatagatcggtacgcttgcaatcgtttttccgtcgaacatgacgttcatttctccgatgatgtccgggatttcttttttgtttttacgccatgattttttcggttcaagaagctcgatatcaaccttcacatcttctttttcctcttcgtttaaaagatatgtgacatcccgtttaataaaagctttatttccgtaaaaagagtcttttaatttcggaatctcgccttttttggcgatgatatatgttttgtagtggccgaatacatagttgaacatgttcatatgatcattccagtcgtcaggggcattgattgtgacggcgatcaaatcggttccgtctttcgatgaagtggagacgagcgtacgctttgcaagctttgtatatcccgtcttcccgcctgtactgtatttgtaaagccctgttaaaagcttgtttttatttctccagatgccttgcatcgtttctgctttatagcgtttcgttccggcgatttttttgtacgtttcatttgtcatcgcatattttgttaaaagcgccatatcataggccgaggaatagtgatcagggtggtcatcaagtccgtgcggattgcggaacagggtgttttccatgccgagctcggccgctttttgattcatcatgtagacaaagccttccaggcttccgcccacatgttcggcaatcgcaacggctgcatcatttcccgatctcagcatcaaaccgtaaacaaggtccttcagcttcaccttttgcccgcttgttaaatagatcgatgatccctctgtcctgaccgctctgtcgctgaccgtgaccgtctcatccaatttgcccgattccacggccaaaatggctgtcataatcttcgtaatgcttgcaatgcgccgtttttcatgctcatcctttgcaaacaaaacccgtccggattgcccgtccatgacaatcgcgctttttgcgctgatatgaagggagggctgtgcttgagcggtttcgtatgaagagcataaaagagagcatatcatgatggctgctgccgcttgttttagaaaaaagcgcattttttctcacgtccttgtggttgtttgtacaagtttatgcgcttgtctttttgttatgaacaccaattggatgatttcccgagaaaaatctaaagcaagataaaaacccccctttcatgaaagggggagttccggctcacggttcatttaagctatgatctcggctgaaccatcttcattcgatagtcagtcgcatagtattccaattcttctctcatcgattgatatcctgtttcaagcgaagccatcaaattttttaatgaggccggcgctggttcgtgaaagcaaatggcgttttttcccgtgtaggccgctctgctgtcttcgtaccaagtatcttttttcggtgtaaaaaattcttctatgcatcgatgatagacctgatagagcgtcctttcggctgcagcctcctgaaaaggatcctgctgcagcctgattcggcaggccgcaagcccttcttcacagtaaaccgccagttttctcaagttgctgaggacatcgcgataataatctcttctcccgggctcttcggcttcaagggatgaaagcgtcgtttcgtttaaataatcgcacagcgtctgaacggtctgtgctaaaaattcgcctgcctgctcggtttgggctcttgccatagattttcccattggtgtcggcaccctctcctcatcgctttgttacaatcgtattctttcatgaatgaaattaaacataaaaaatacgataatatatattatcatacttcgatccttaaggtgaatctattttaaatcttcgaacgtctggttaaagttttcgaagaacagatcggcttcttcctgaaccccgtcttcttctacattttcgggcagcggcggaagctcttcaagcgtttttaagccgaattgttccagaaatgtttctgttgtaccgtacaagatcgccctgcccggtccatccgcccgtccgacttcgcataacagcgcttttgcgaccaggctctgaagaatccgttcagatttgacccctctgatctcctcaacttccgctctcgtgatcggctgcttataagagacgatggccaaaacctcgagcgcagcctgagaaagcccttttgaaggggcttcgatcagctttttcaaatagacggcgaattcttttttggtcgaaagcatgtacgtatccgcatactcgacaagctcgatgcccctgtcttctttttcataggtttctttgacatcaagcataatatccagcagctcggcttcatcgacctccaaaacggataatagctgtttttttgtcaggccctcgtcgccggcggcatacaaaagcgcttcgacaatggctttccaattcacgatatcaagcgtcatgaatcgcttcactccctgttatgtaaatatctgaaaagttgtgttcctgttcaatgatgatcagctggtttttcatcagctccaaaatcgccaaaaacgtcacaacgagatgctctttctgttcatacgggaacagttccataaaatgcatccttttgcgggacgatttcaaacagtcgacgatttgcgtcattcgctcttctatcggtatttcctgtcttgaaattcttgtttcagacggccggttgatttttttgcggttcagcactttttgaaacgccccgagcatgtcgtaaacggtgacggacagcttttgctcgctgagtttgatttccttggcgtagtcgcttaaatcgctcggcggctttgcgaatgctttttgccgctcttcctcgcgctcctttaaattttgcgcggcacttttgtattttctgtactctattaatttttcaatcaattcttctctcggatcctcttcctcctcgagaaactcttcgtcaaacagctcttcttcctgctttggaagaagcattcggcttttgatgctgagaagggtcgcagccatcaccaaatactcgctggccacgtcgagctcaagttcgcgcatcgtgtgcacatataataaatactgctcggttatcttcgcaacaggtatgtcataaatgtctatttcaaggcggttgattaagtgcagcagcagatccaggggcccttcaaacgcctcgattttcacctgatattccatgttcatttctcaccattttcaaaatcgcttctaagccggctaaaactggctaccctttagtataaattacgcgtctgcatgaagtccaatataatttaagaagctttggcatccgcctatacggtttgagtgtattctgcatagaataccgtgtaaaatcttaaatctgaggagggaacaacatgggaggtaaaggcttcggctacggcggaggatttgctttgattgtcgttctgtttattttgttgattattgttggagcggcatggatctattaacataaaagatgagaagcgtccgttaccgggcgcttttttcacagcctggatatatcagccgtttttcctccgttccgttcttatgatacactttaacggaaacttaaaggaggatgtcagatgtatccccaagcttatatcgattacctcgccgaattccacggggcaagggattattttgagtgccacgaaattctagaagaccattggaaaaaggaccctcccggcgagcggaaattacactgggtcgggttgattcagctggctgtcgcgctctatcatcagcggagaaacaattttgccggcgcggagagattaatggcgaacagcattcgcatcctggcgtccgaaaaagacgcagttgaatcgctcggattggattacagccgcttcatcgaactgttaaggcggactcaccaaaaaatcgaagcccattccccttatgaaagcatcatgctcccgatcgcagatgaagcattgatcaaagcatgccggaaacaatgtgagaaaaagtcatatgagtggggagcaaacgctgcaccagacgcctttatcattgataaacaccggctgagggaccggactgaagtaattgccgagagggataaacaaatcaagcggcgaaaaaagagcagaggctagaagcctctgctcattggttatatgtgatgtcttcattttcatgatcctgacagcgctcaaagaatcctttagttaattcattcggaaccagcggtttaggtgcaaatattggcgaaatagccgacaccatttttttgccgattccctgatgacggtgagacggatttacactgatatgcttgatctcgacttcttcttctcttttctctactcctacacagccgacaatatcctcgccttctttccataggaacagttgcctttcagtgtccgtttcatagtctttaattgtctgctgaagctgcttgacgtccttctcattcggcataaacgaaaggagccccatcgcaatcttttcgaatgactttttataacgaattaacataaatacccctcaatatatcaaaatgtggatctaacgaaggctagtcgcttcacatcacattataaacatttttataacctttttaaactctttttcggcaattattgaagcgaccgggtcaggttcgccatttcaatcgctgccgcggcagcttctgcacctttatttccggcttttgttccggcgcgttcgaccgcctgctcgatcgtgtctgtcgtcaatacgccgaagatcaccggaacgcctgttgacatgctgctcgctgcaatccccttagccgcttcattgcagacatagtcatagtggcttgtcgctcctctgataaccgtgcccagcgtaatcactgcgtcgtattttttcgtttcagccatttttttggcgatgagcggaatttcgaaagcgccgggaacccaggcgacatcaatatcatcagctttgaccccatgtctcaacagcgtgtcttctgcgccgcttagaagtttgcttgtaataaaatcgttgaaccttgacacaacgatcccaattttcaaatctgttccaattacatgaccttctattttattcatatgaatcccgtccttttttgtgattgattttagtttaaaaatgaagcatatgccccaattttgattttttcgtttttagatacttttcattatctttttttgtctccatctgcagcggcaccctgtctgcgatcgtcaggccgtaaccttcgagacctgcaatttttcgcgggttgttcgttaacagcttcatttgcttcacgccgaggtcccttaagatttgggcgccgatcccgtagttgcgaaggtctggaagaaaaccgagcttttcgttagcctgtacggtgtcgtatccttcttcctgcagcttataagctttcagtttattgattaagccgattccccttccttcctgtctcaaatacaggagtacgccccggcccgcttgttcgatttgcgcgagcgcagcggcaagctgcgggccgcagtcgcagcggtaagagccgaaaacatcgcccgtcaggcattctgagtgtacccggacaagcacaggctcgtcaccgaaaggtatgtcgcctttgacgagtgctatatgttctttgtcatcgatttcgtttgtatagccgtaaaccttgaaggtaccgaattcggaaggcagcgtaattttcacttcccggttgatcagcgttcccttgctgtagcggtattcgatcaaatctttaatcgtgatcattttcaagccgtgctgatcggctatttttttgagttcaggcacccttgccatcgtgccgtcttcattcatgatttcgcagatgacgccggccggcgcggacccgcacgcttctgcaaggtcaacggccgcctccgtatgtccggctctttttaaaacgccgccttttttcgcgatcagggggaaaatgtgccccggccttttaaaatcacccggatgcgcgtgatcagcgatcagcgacatgacggtcagcgaccgctcctgagcgctaatccccgtctttgtatcgcggtgatcgacactgaccgtaaatgctgtgtggtgagaatcggtattttcgtccaccatcggttggagctcaagccgggaagcgatctcttcattgagcggcgcgcagatcaacccccttccgtgcgaagccataaagttgattacatcgggtgttgcgtattccgccagcgcaacgaaatcgccttcgttttccctgttctcgtcatcgactacgatgatgacttttccctgcttcaaatcgcgaatcgcttcttcaattgtgtgaaacatagacgcacagcctcctttcatttaaaacccgttttctttaaagaatgcttcagtcaatgcctgtgcctgtttttcttgttttgtttggtggagaaagcggtaaatgtatttgccgatcatatcgcactcgatgttgacgatgcttccgaccttttttgcaggaaaaatcgtttcatccaatgtgtgcgggataagcgagactgttacctgatcctccgtcagtccgaatatggtgaggctgacgccgtctacggcgatcgaaccttttaacacaagcattttggccagtgaagggtcaagttttaaatcatagtatacggtgtttgccgctttttctatgcgaacgatcgatgcagtgccgtcgacatgccccgacaccatatgcccgccgaagcggccgtttgccgccatcgcccgttcaagattgacgcggcttccttttttcaatgtgccgagtgatgttgctttcagcgtttcaagcatgacatccgccgtgaaactgctggaaccgaactcatttacggtcaggcagactccgttgacagcaatgctgtcgccgagcttcacatcttcgatcactttgttggattgaatgactaaagacatggcgcttcccgcctttttcatgtccaaaatcgttccgacttcttcaatgatgcctgtaaacatatgtcaccgccttattcttttatcggtcttgctgccagctttatatcctggccgatcttggtaatggttgtgaattgcagtaaggggacatctttcatcgattgaaagccttcaccggagaggatgctgggagattgcagccctccgattaatttaggggcaagatagaagattatttgctgatagagtccttctttgacgaagcttgcgtgaaccgttgcgcctccttcgacaaagactgaagcgatgccgcggtctgcaaggtgcagaagcacgtcgcgcacctgaagttcatccgcatcgagcacggttacctgcacaccttctttttccacgttccgaaccttttcgggatctgccttggacgtcgtgtaaatccaagtaggcgcttctttatcctgaatcacttttgactggagcgggattgacagcgtcgtatcgagaacgacgcgcaccggctgattcaccgcaccggggagacggcatgtcaaacttgggtcgtctgcttttattgtgcccgatccgactaaaatacactggtggttttttcggtattggtgagcatccatccgcgcttcttcagaagtaatccatttgctgtcgcctgttgcggtggcggttttgccgtcaaggcttgcagcggcttttaatgtcacatacggaaggcctgtccgcataaaatgcatgaacttttcattcagctcttccgcctgttctttgagaacgcctgtttccacctcgatcccggcgcttctcagcatctcgattcctcttccggaaacgagcggattcggatcttccgcagccacgaccacccgcttcaaaccggaacgaataatcagttccgcgcaaggaggcgttttgccgtaatggctgcacggttcaagcgtcacatagatgacggctccttccgcatggcggcctgccatttgaatggcgtgcacttctgcatgtgcttcgccgtattttaaatgggctcccattccgaccacttcgccgtctttgacgacaaccgctccgacaagcggattggccccggtctggccttcgccctgcctcgccagctccaatgcaagattcatataatgcgcatccgtcatgaatttccctcccttctttcaaaaaaataaccccggatgttgatccgggggttgtttttgtgcatgagaaataaaactatgcttattcattattttttacatagtctcttcatccttctcccatccagactttcactgtcggcttcagcttttcactgaatccaccgctttgcacgaagcacagcgggtcacgggctctaaagctgtctctcgctttattaccgccggtcgggattttcacccagccccgaaggatacaatcgatatttacttgtccttatgcgtaattatagcggccgcatattaaaattgcaatgaaaactgcttgcacagaaaaaccctctgaaaaacagagggtttttattctgccaccttgacgacttttattaatccgtcgattctgttggcattagagaagtaggcctttactttgtctccttctttaatgtcggacagatcctggttaagatttttcgcattgaaaatgatcttcgttccgttatctgataccccgtggtattcagtgccgtcaattttggtgatcttatattgataaatggtatagttcttttcctcagatgagacggtttggctgagcgccgttgagacatcctgaacgcttccgttttttaaataataaaagcctccggccagtacggcagccaaaacgagcagaaccgtgagcttgaattttattttccccatgatcaaaacctccagaacacgttctgaactatcctatgtttatttcctatgaatgatgaaataaaacatgttcgattcagacggaaaatatgtggtttttaagtataacgcaaaatgaagggaaatcgtttcatattcagacgaaatactacttataacctacgaatgtacattctgatttaggggtgtttgcgaaaacaagcttaaaaatcgagtctaaatcactacatttcaaaaaaccgtttgttctgtcttcttcgcttcaggtttcgttgtaaaagtcgtttcggatggcgataacagactgatttttaaaatactcgctgtcttttgtttttgcccaggcgagaaacttcacatgctcggaatggaacagtgcctcgtgttggggcgagcgagcagcagccgcgccgagtctgtgtttgattccgcggatgaacttccaatattgatagaaaggcagttttaattttgtcataaatcctgccgagtcttcaatcacatatccttcctcttcaatcgacgggtcatttgacacagacaggtaccatttataaaaatcggtccactgatgaaaagtaatgactttttgcttacattctacgcggaatgtctccgcaaaacgaaggacgtcttcatacagcagcttttcatatttcatctgcctcttgacaatgtcgagaaggacaagcttgtccgattcgtactcgataatgtgcggatctttttctggcagcacgacttcaaacactaacgaaacattgcgttttttcacatattctttcatagcctctgtttgagatgcgtcaaacgttttgtaaaacagctcttccacccatttcgcatggccgtctttttgtccgcttgatgtataggattttgaggtgaagacaagctcatcggtttcagaattgtagccgaccgttcccaaaaatccattcgccttatcatagacggtgaccggaaagcgcagcgtgttaacgagaacatgcattttcgtcgtcagacgctcctcgatgttgaaaaatttgttgtagcttctgctgacgatttcattcgtgtttctattaataaacagccctcttgccttcatgctgacgctgtcccattttctctcctgaaaagcctttctcgtaaagttaaaagaggaaatgccgccggctagtttttgctcagacacataatcatgttcgtccaaatgctttagaaaatgttcgaccgtcagctcctcgtgcgcgtgatgagaagtaagcggaggagcggaagttttaaacacatcattttttatttcgtgtgtttgaattcccgaccgatcaatggtgacaactcttaaatgcccgccgtgctccacctgcccttccaggttatatgattttgcagctgcatgcactggaagtcggaacatgtttctgtgcccgtggatttgaatgatgttccgcccttccatatttttcgtaaagacatggtcgatatctgtctcatatccgccgacaccgttgatcagctggctggtagccgtaaacagaaggttgtcagggagcgcggaaatgccgccgtgcgtgatgatgtaagtgtcttgtccatacgtgaagtaggcaatttggtggaagcgcctggccagttccctgatatctctcttgtcaaaacctgcttcgtctaattctggttttgtcttcttgttgaatacgctgcttcttgttacttcgtcatgcccgtattgctttaaatatttatcatgatttccttcgagcaaaatcacatttttgcggtctttgatacggagaaggaattggacgacttttgcgttttctattcctctatcaaccatatcgcctgtaaaaatatataactcgtcatcttcgagtctgcctttcaaataggaatcaagcaccgtaaaacagccgtgcacatccccgatgacatgtatttttttgtagctgtcaagccgcctcggcttatactgcatagcatcggcaaattcttccggcttgatcactgttgtccaggaaggcgccggttcggataaaatccgctcgtgcatggcgtgaaccacgctgtctggcacccgcttatgctcagccctctcgcggtttctcaacagggcggtctcaagcggaacattgggaaaatcaaccacatacgctctgtagcgatactttaaaacgagagctttatagccggaaatcatgctttgttttgcatgtgtggcatcaacgatcgtgaattctcccctctccatcctttcttcaagcaggctgaacaaaagcttccataccttgccgtcatttttttgggaaatgtcgtatttcccttccaaatttaacactggtgactgatggatcagcctcagctgatcggcagacagcgtatattgattcaattgatgatccctgatccaggttgattttccggtgccagggcagcctctaagcagtactaaagtcctcattgttgatctccttattcagttctgatgagttaattttagcattccttccaagaatatacgtaattttttgctatttgtttcaaaaacaaataaaaaagatccccataaaggggaccttttgtgtccttaatgaaattccacatctatcctctttttttcgtcgggcttgtctttcggcattctcacttcaagcacgccgttcctataagaagctcttattccttcacggctgacgggagcaggaagcgcgactgccctgtgaaaacggcctgtaaatcgttctttccggtgcatgttttcctcttttacttcgcttgacctgttgatggttccgctgatatgaagcatattgttttcaacctcaatatgaacatcttctttgctttcaaggcccgggatatcgcaggaggcgacgatttcattcccggcttcatgcacatcaaccctgatatcgccaaagccgtgctctcctccaaagtttgccggaaaatcggcaaacacccgatcaaactctcttctgatcgtattcaaatgtttaaatggttcgtaaggtactaacggcattttctttcctccttcatgttttcataaccttatgatttcttgtacgctttgatttatgcatgccaatatgaggtcaagctcagggaagaagaggctttttagcggacataaaaagagcagtgctgatatagaccaagcactgctcttttactgaaatattatgttacgtttcgttctccgatatgaatcggtgacgttttgacagatgttacgtttctctcagcaacttgcaccggtgcggatgttacgtttctctctgcgattgcactggcgcggacgttacatttctctcagcgacttgcaccggtgctgatgttacatttctctctgcgatttgcattggcgcggatgtgacgtttctctcggcgaccttcacaccatctgtttgcgtcatcagcgcagcacttgccaaagaaagtcctgctactgaagcagcggcggttaacaacagtttagatttcatacgaccagtccccttttttcatttgttttcgagcactgaataccgtttgatagaaataaacagagtcgctcaagcgcccaatttcattatagtattcagctgcttccaatgccaagtcctcaatatcgggatacatcttttttgacccgagcagctgaaatgtctccagcattggagccctgccgtcatcatcaacatacaaagcttttaaaaaatgaaattttgaaaggtagatcgcatcgtctgatcggcgggcgatgtcaattcctttgtttaacgcgtcatccgccttttccagctgcttcaacttgaaatatgcaagtgcaagactgaaaaacgcttttggaagaatatctgatgactcttcttgataaatcgcagcagccctgttgaagtactcggctgcctgatcgaaatcccccatcttataatagcagtttcccaaattgtaataggtgtgtccttccaatatgagctggccttcttgctgtgaaagcttcagcgccttttcaagatgtgacagcgctttttcattcgactctaaatcgtcatagttccctgcgatgacgaactcgcattggattctccgaaccgtgtaggtttcatgcgcctgataggtttcaatcgcttgaagcgcatagttcatcgacacatggctctgtttcatatgataaaacacttcagccattttaaaatgaaactcggctctctctatttcgtcctcgacgtgcagcagctttttttcggcgcgcctgtaaaaagagatcgctttaatataatcatggtttttatattcatacatccctctaaaaaagttaaaataatattcgagcaggcctgtcagctttccttgttcatcttcgatatcttttaatatttcagaaaagtcaggcggggtttcgccttcttccaaaggttttacgtaatcaagcatgattctgtgtctgaattccattaaggcgtaatacaataataagtcttgatcctcttccatttgagaaatttcgcgctcaatttctgccttcagcatttcggcgtccgtgacgttgaatttacgtatcgcgttataccagtcattaatttttacgccgactgccgtcgatgggatttttacgctcaccccttacgccccttccttttttacagattgcgttctctatctagctcttcacttgaatatattttacataaagggtcattttttcacaattattttatttattagcatcgttatttcctatcaggatgtggacgaagaatcggcctcaagtcctgttgcacctggaaaataaacaccgttacagacaaaaaaacagcccggctaagcgggctgttttttgcgctctctgattatgcatcaaatacttcgactttttccatgccttgtccctgctccattgaagtgacggcatcaaggcctgatgtgacctttccgaaaacggtgtgaacgccgttcaagtgcggctgaggctcatggacgataaagaattggctgcctccggtatcttttcctgcgtgagccattgagagagaaccggcttcgtgtttgtgcggattcccttctgtctcgcatttaatcgtatatccaggtccgcctgttccggtgccgtgcgggcagcctccctggctgacgaagcccgggatgacgcggtggaacttcagcccgtcatagaacccttcgtttgcaagtttttcaaagttggcgacagttcccggcgccgcatccggatatagttcaaactcgatttttttgccgtttgtcagttgtatgtatccttttttagccatcttgattctctcctttcatttcacaagggtcattatatcatattgaagaagcagagagccaatcgaccgaaataaacgccgctcttgtatcgtttttgtaaaaaattttaaaaaaaggttgaatcgcctgtgaaaatcatgaatgataaaagagcggcgagatacgatgccgggagggcatttgacttgaagagaaaattctctctttttttctttgaaacctcactcatctttcatccgtctatatttcggaacgcattatttccgttccggcaggcttctttaaaagtacagcaattctgcctgaagcctgcatttttaaggagggcattgagcttgaaaaaatcgatactaggaatctttacagcattgtgtctgctcattttcccgcaggtcagcttcgctgacgccgcagtgggtgatgtcatcgtcacgctggggaaagacttgtcaagccaggacagacaaaaagtattaaaagaaatgaatgcgcctgaaaatgcgaccatcatcgaggtgacaaatgatgaggagcataaatatttaggggattatataccgaaagcacaaatcggaacaagagcgatttcttcttcttcaattaccgtagcgaaaaaaggcaccggtttggaagttcagacacacaatatcagcagaattacagatgagatgtatttgaacgcgctgatgacggccggtgtaaaagacgccaaagtctatgtcaccgctccgtttgaagtgtcaggcacagccgctttaaccggattgatgaaagcgtatgaaacgacttcgggcgaaaaaatttccgaagatgtgaaaaaggtcgcgaatgaagagcttgtcaccacttcagagcttggcgagaaaatcggcagtgaaaacgcgtcagcgctgatggccaaagtcaaggaagaaatctcgaaaaacggagttcccgagtcaaaagaggaattggagaaaacgattgattcggctgcttccgaacttggcgtgacactcacagaagatcagaaaaactctcttatatctttatttaataacatgaaaaatattaatatcgactggaaccaggttggagaccagcttgacaaagcaaaggataaaatcacgaaattcttggattctgaagaaggacaaaactttcttcaaaaactgatcgacttctttgtgtctctgtggaacgccatcgtttccgtattcaccggcggcggcacctcagagtccaacggttaacacaaccgccgaaacacctcctttttcacttggagagacccaaataaatgagacaaggaaaaaacaccccctgaatcgtattaatacaatatgattcttaggagggtgtttttctatgggcacaagagtacattacgcagaagaagtaaaatgggaagtaattaaaatgaaacaagctggaatgacaaacaaagaaataatggaacaactggggataaaaaataagactcaaattaaaacatggatgcgatggtacaaaacaggccaaacctatcgattttcgcaacaagttggaaaacaatattcctacggtaaagaatcggaggaaatgagtgagctagaagaattaaaactaaagaataaacagctagaggctcaattggcaattataaaaaagtaccaggagatcgaaaggagttggagccacgagtcattgtccaagttgtagaagaactctcagccacttttaaaataattgatattcttggagtattaggcatacctaagtcaacatattaccgttggaaaaagaagtataaaaaagttgagctaacttcattagaagagctagtaatcaagctgtgtaagaaaaacttctatcactatggtcatcgtaaaattaaatccatcttaaacagaaagtatgggataaatgtaaaccgcaaaactgtacaaaaaattatgcaaaagtttgagattcagtgtcaagttaagaagaagcgacaaaagtacatttgtggtgagagtaatattattgtgccgaacactctcaatcgtaattttaaagcaagccgattaaatgaaaaatgggtaaccgacattacctacttaccttatggctcgactatgttatatttatcaacgattatggacttatataacaacgaaatagtggcttacaaaataggtacgagccaagatattaacctagtattagacacattgagggaagctgtagaattacgtaaaccagtagggttacttcttcatagcgaccagggatctgtctatacttcacatgcatatcagaatttggccaaagaaaaaggcattaccacaagcatgtctcgaaaaggaaactgccatgataatgccgtcattgaatcctttcactcctcgctaaagtcggaaggatttaacgctcaaagtagagcatctatatccaattctaaagtagtacaaattgtaaatcaatacatgtatcgatataatcatgtacgaattcaggcaaaattaaactacctgtccccactggaatacaggggacaggcagcataggtgttttttctaagtctcattttaacgggtcagttcacacttgaagggggtgttttatttttgcagaggggaaatcccctccgtcttcttcatagttttcatgaataaaatctgtcagcagctttgtaaatcggtaaaacgtttcgttttgcgtcgccgccctgtcttttagtgtaaaccggtcgaataaagatttgcggaaacccgtgctcatttcaagctgaatgctcagcccggaaagcgacttgttggcgatgttattcggatgggttccggcatacttgtcatctgtccccagcatttcagcggcaaaccccgagcggttcagctcatcaaccaatattctgattttagcgcggtctgtgccgcctactttaatatcgcggtcttcactgtaatagccgtggagcgacatgacatactggtggcttgcagtaattgcgagcgccgctggctcgtcaaaacgcgtgcttgtaatgtgaaggtccgtattgcctgatgatttcagcccttcaaacaagtacagggaatagtttttggacacttcattggcgatttcgctcgttccgggttcgatgccgcctccatggatggccatgatgagcatcggcactcttgcgttcttctccgtaattcggtaagaagctggatcttcattccgctccaattcttcaaagcttgaatattgatcgccggactgtgttgcgccatgggccgcagcagaatatgggaatgagatcacagccgaaatcaataaaatattcacaaaaatgtttattgctgtaaaacgatttactgtgttacaatcaacacattgcttcaggcactggagcaatcggtggagtagggatactttggccggtttcatctactccgcctctaaatccaacaaatcagcaaatctcatccttttcaccctggtcattgcctttatcatctcctttgtaaattttttgttaaattcacaatattatatacaattagcccggtcgctgttctatgcatgtcatgatctttttaacaaaaaacacctcccgatcaccgggaagtgtttttcgtgcttgaattaaaaatggagacccccctcttagggaatctccatttttttattgtttgactttcgatttcagcggcagatccagcttgacgatatcctcatacgtctctctctgaatgacgagctgcgcttccccgtcctcgacaaagacgacggccgggcgcggaatgcggttgtagttgttggccatgctgtagccgtacgcaccggtgcagaaaacggcgagcacatctccgtcgcgaacttcggggatttccaaatcccaaatcagcatatctccgctttcgcagcattttcctgcgattgatgcggtatcatgacaagcatcgttcatcctgttggcgacggctgcttcatattttgcctcataaagcgccggcctgatattatcgctcatgccgccgtcgatggctacatatttgcgaatgcccggcacctctttttgagaaccgatcgtgtacagcgtagtccccgcatcaccgacgagagaccggcctggttcgatccaaatctcagggatgtcaaagccgaaatgctcggcatttgctttgaccgcctcgatgattttttcaacataaacatcagctgcaagcggctcgtcgtcttttgtatagcggatgccgaagcccccgccaagattgagcacttccggaatgaaagagtaagtctcccgccattccgcaagcttctcgaaaatcttgtctgctgcaaggacaaatcctgccgtatcaaaaatttgcgaaccgatgtggcagtgcacgccgaggagcttaaacgcagacgagcggaggacttgttcgatggcttgttcgacctgtccattatgcagatcaaaaccgaatttggaatcttcctgccccgtcgtaatataatcgtgcgtgtgcgcttcaactcccggagtgattctgagcaaaacgtctacagtttgtcctgatcgcttgcaaagatcttctgtaatggcgatctcgtgaaagttatcgagcacgatgcagccgatttgatgctccagcgccatggctagttcttcagggctcttattgtttccgtgaaaatgaatccgctcagctgggaaccctgctttgatcgcagtgaaaagctctcctcccgataccacatccagagacagcccctcttgttcggcaagctgaatcatggcaaccgatgaaaacgccttgcttgcatacgctacctgcgcttttaaaccggcttccttgaatgccttctggaattttcgggcgcgctctctaatcagcgcgacatcgtatacataaagaggtgttccgtatctttctgccaatgatagaacatcgacaccgccgatttcgaggtgccctctttcattttgtctgctagtaccgtgtaaaaacaattgtcattccctctttctctatcgacaaaggtgcaaggggcgctccggttgctgcccgatgcatcttccggcttcatgatagtgcgattcttatgttgtattataacatttcgttttaaaaactaaaccaccatttgtccaaattttcttgatttataaaggaaatgattccctaaacaactaatccattctattgattatagaataacagaaaacagcgcttgatagaaataggcatacacaacgtccattcaataaaaaaagagccgaaaagctgagattttcgcccatacaaataggcatttacctgaatataatcttaaagatgaaaaccaaaaaacgaagtgggaaagaggttatcatatgtatccaaatcgttatccctacacccccgctcccggctatgcacctgaagatgtatacgccccttatcagccggctgcgcattatgaacagagaatttatgagccttatgaagggcagattattacagctccggcgaatacgagattttggcggagaggaactgaggttttccttcattcgtcaacgattgacccgtacggccgcgaaatgctgtatgtcgtctatccgatcagaagacagaacaacatctgcagcctccgggcagtcgcgatctctgccaatgaatacagaggcatcggtactcaaagaccggaattcgattattgaaaaagaggcttttccccggggaaaagcctcttcgaatgccggcttcacggctgtctggagcggtttctcggatgaacgatgctcggcctgacttttccccctggaacggacgtgcgcacgagaacatgccaaaacgcttttccattgaacgggaggagaggccataagtaaggcgttcgcaatgacctgatcgaagtcatcactatagttaagatcgttaatccgatgacaaatccctccactttaaaaagcgccaccaatatcagcataaacagcttcaccattttattcgccaggctcagctcgtagcttggtgtcgtgtaggctccgattgccgagagggaaacgtataaaatgacttcgggagaaaacaagccgacattgatcgcgatatcgccgatcaatacagcggcgatcaggcccattgcagtcgaaagcgccgtcggcgtatgaatggcggccattcttaaaaattcgacgccgagatccgccaggaaaatctgcatgataatcggaatatgggtgtctttattcaacccgataaacgataaattatcaggcaagagcgacggatgaatgacaaacagcagccaaagcggcagcaaaaaggtggaggccaaaataccgaaaaaccgcacccaccttaaaaacgtcccaacagccggcgtctgtctgtattcctcagcatgctgaacatggtgaaacaaagtggtcggtgtgatgatgacgcttggcgacgtatcgacgatcacgatgacatgcccctctaaaatatggcttgcggctacgtctgccctttccgtaaacctgacaagcggaaacggattgtagccttggccgaccaggaattcctctaccgatttatccgacatcggcagcccgtcgatcttcacatcttcaatttctttttttaatacttcaacaagatcgggatctgcaacgtcttccaaatagcagaggcagatgtctgttttagagcgttcaccgatatgaagcattttgtagcgcaagcgctcatctctgatccggcgtctaatcagggctgtgttgacgatgatgttctcgacgagtccgtcccttgcaccgcgtacgactttttctgtatcaggttcttccggcgttctgcccgggtagcttctgacatcgatgataaaagcaaagcccgcatcttcgacgatgatggcaaccagtcctgacaacacttggtcgacagcttcatcaagcgtttccgcttttgaaacctgctggttcaaaagcctgttttcgacgatgtcttcgacctcgcccgattctttttctttatcattcagatgcaccagttctcttaacaggtgaatgatgtattgtgtgtcgcacaatccgttgacataataaagctgaacttcatgtccgagaataaagaccttccgtacgccaaggtcaaagctttctcccatgccgacccgcttcttgaaatacgcttcattcttagaaggatcaaggaatacgttcgtcttctcttgcttttgagcactcatgatacccgctcctttctaaaatgagctcgaccgctttcattgtaatcggcgaacctttttccacatcgtcttttctgttcatcttaccgatatcaccgattccgacaatgatcggaacatccagctggtcaaggcaatagactgtatcaccattcattcgtttgacatcgaactctttgaccccgtgtttatcgacgccgtactctgtcagttcgccttctgcatcgattgatacatcgactctcgtccactctgcataatgagtttttgaagcgacggcgatgactccgagcacctcgatatcgggatgcatcgctacatatttcatagctgtctctcccgggccttcaccttgaagtccggaatcatcaaacatgacgaatacaggatcatgaggggtttgcaggatcatggttacaagctccggtcctgttttaacgctcggattccccgccgattgggaaatgcagcggccacccgtttttcttgctgcatattcgattgcttttgcagcgtatatatcgccgtctgtgaccaaaatgaccttgcgttttgctggcattttcctttatcctttcggtttaaaaatcacggcaacaagaaaagcgaacaagatagcggcagatataccggcagatgtcagttcaaatatccccatgccgattccgataaagccatgtttctcagcctggtgcatcgcgccgtgcaaaagagagtggccgaagctgacaatcgggactgtagccccggcaccggcaaattcgataaaacggtcgtaaatgccgaatccgtcaaggatcgctccagatacgacaaaagttgacatgacatgagccggcgtcattttgaagatatcaagcaagagctgtccgatgacgcaaatcagcccgcctgcaataaaagcaatgacatactccatcttaagcgttccccctttcggcccgttcaaatacgacgccatgggcaatgcatggtatcgattctttttgctggatgatcgtcgggcttaaaagggcgcctgtcgcgacaacaagcactctgttcagccttcccgcttcaatttctttgaaaatatgggcaaaggtgacgaccgcggaacaagcgcatccgcttccacctgcaaaaacttgctggtcaggcgtatagatcatcagcccgcagtcattatgttttgtcccgacattgattccttcctcttttaacagatccttcaaaatcgggctgccgacgcctgaaaggtcgccggttaagatcagatcgtaatcatcaggggtgcgtcccagatcctccaaatgctgcttgatcgtatccgcagcagcgggtgccatcgccgaccccatatcttgcgaatcggtaatccccaagtcgataacccttccgacagttgcgcttgtaattttaattccgccgggctgctggctgaggacgaccgctccgcttccggtcactgtcgaagtcgcggttcccggtttttgccccccgtattccgtcgggtagcggaactgcctttctgccgtagcattatggctgctggttgccgctagggcgcgctttgcgaaacccccgtcaatcaacgccgaactgatcgcgatcgattccattgatgtcgagcatgctccaaataagcagagaaaaggaattttcaaatgccgcgccacatagttggctgtcacgttttggttgagcagatcgccagccaaaaagatatcgatgtcttcctttttaagattttgttttgataacgcggactgaaccgcatcctccatcagcttgcgctctgccatttcccagtttttctggttgcagtgcatttcatcatagcttttgtcaaataagtgtccaagaggaccttctttttctttgggaccgaccgctgttccgcttgagttaacaaacagcgggttctcgaattcccatgtttgttttcctgttaatttcatgatgttttcctcctaaaacagcttgtcaaaggcaaagcggatcatccccacaatataagcggccacaacaccgaacacgatgacgtttcccgcaagcttgaacatgtttgtccctacgccgaggacgtagctttcgcttttatgctccagcgctgcgctcgtcatactgttggcaaaccctgtaaccggaacggcagaaccagcgccggcaaactgtccgattctgtcgtagacgccaaggcctgttaacagagcggagatcaggatcagcgtggcaaccgtcgggttcccggccgttttttcatcaaaatggaacacagccatataaaaattctggaaagcctggccgatcgtacaaatcagaccaccgacgagaaatgccttgatacagttcaggacataaggcggtgaaggctgatacgctttaactttcgattgataattatctttcaaacttgacatcataatcctccttttatgacaaatgaacaaaaatgagccattggaacatcgatccgagaatcttgccgaaaacaatggccattaaaagtatcaaaatccggtctcccatcccgatgcgtttcgccagtatcggcagcacgttcaagacttctgttagcgccgctgcaagcattccaatgaaaacgcccgcaaaaaggccgatcggaacaagcagccatttggataaaaaaaagcgggacatgttcagcgattcccatcctccgaaaaccgcgcctaaaatgacagcccattcatacgcctggataaatccttttgttttcgtcagctgagtcagcctcgggataatgccaagcacggtaagaaaagcgacaaagccggatccaacagcaacccctcctgcgagtccgagaaagatgataaatatcacgctaatgatcatgaatatcctttgtcgtttctttgttttcgtgcatggccacataatggtccaaatcaagctgatatttaaacatctcgacctccagggggctgggctcctcgttaaaccgttttttaaataaatgattaaaaaacaagatcatgccgaggccaagaccgatgctgtacggaacctgcaaaaggtatggatagcggttcaccttgcccgtcaccatttcgtaaagcaggatgtgcacttccctcatgctgacatcttcatgaaagttcatgacggcaaggccggcaccgacgaacaagagcagccagacggcgatgaaaagcacgggcgacagatcccttttcggatattggatctccacgatggtttcagaaccgccgacggtttggacatcaaggtcaggaaacgatttatgtacagcttcaatcaccttcatcacgtccagcaccaccatgctttgatccgctttgctgacctgataaataggcagccgttcaagcttttctttgtatccgcggtcacccgctacctgtgcgatatggccgagcaaaatcaattcatccggatctgcctcaagccggtggcggagtctgataaaaacttgacgttccatctgggtcacttcctatatgatggttatagttgtagtatgaagtacatcccatttatcattcagaaaggcgcaaaagaccataaattaccacacaaaaaaaccggaacgctcccaagagcgtccggtttttcatcggacatccgaggctgcctgcaacatgagcagcctcagctttcaaaatggtccatctggtttttgatttgctttaaaatctttttctcaagcctcgagacttgcacctgggatatgccgaggcggtcggcaacttcagattgcgtcttgtctttgtaataccttaaataaacaatcagcttttcccgttcatccaaatccttgatggcttccttcaaagcgattttatcgaaccacttctcttccgactgatcggcgatttggtccagaagtgtaatcgggtccccgtcgttttcgtaaaccgtttcatgaatggacgagggagagcggaccgcttcctgggccatcacgacctcttctgaactgatttcgagataatcggcgatttcctgaacggtcggaatccggccgtttgacttggaaagctcgtctttcgcccgccggattttgttgccgagttctttcagcgagcggctcactttgacggttccgtcatctctgataaaccgctgaatctcgccgataatcatcggaacggcgtaggtggaaaaccgaacgtcataggaaagatcgaatttgtccaccgacttcaagaggccgatgcagccgatttgaaagaggtcgtcaggctcatagcctctgttcaaaaaacgctgaacgacagaccaaacaagacgcatgtttttttctatgaggaggtcccttgctttttgatcgccgttctggctgtttttaatcagttctttcacttcatggtctttaagctgagtgttctggttttcttttttaacctccacatccataacaaatctcccttaattgcaaagcgctttgctttttgataagtgctttgttaagtgtattgtggttcccatctcaggtgaggagtcgatcgaaatatcatccatgaaattttccatgatcgtaaagcccattcccgaccgctcgagttcaggctttgtcgtgaacaggggctggcgcgcttcttcaagattagggatgccgactccttcgtcgcggatcgttaaatagacaatatggtcctcgagagtgacggaaatatatacgtttccctgccctgagttttcataaccgtgaatgatcgcgtttgtgaccgcttcggatacgaccgttttaatttcggtcagttcatccatcgtcgggtcaagctgagcgataaaagcagcgactgtcacccgtgcaaacgattcattttggctgagcgctgtaaactgaatgttcatttcatttttcatgacgccacccccaacgtttcaagtgcacgctgctctgattgctcaaggcgaatgattttaaacagcccggacatatcaaataaacgtttgacagcaggggaaatggcgcagacgatcatttctccgccgagctgcttaatctccttatatctgccgagcacgacgccaagccctgaactgtccataaacgaaaggtctgcaagattcatgacaatatggcgaatgtcggtttgttccagatggtcactgacttgttttctcaaggtttctgctgtatggtgatcgagttcacctgtcaaccgaatgcataatacggattctttgacgtgaatatcgattccgaggctcatcctcattcctccttggtttaaatcggataatgagtgtttcgcttcagactttataaattccttcaccgtgacaaaactagtgaccgttcggcattattcactccacttcgtccagtgggtcatcgtccgcttgaacatcgtccacatccccgctttgtccatatctttttcagcgacaagaggactttcagcgagcacctttccatcctttttcaaaacgagcgtcccaagctctgtgccttttttgacaggggcctggatatcttctttctgtttgatttcttttttaacagattcgatattttcgccttttttcgtcaaaagggaaatcggttctgatgtgacaaggtttattttttgctcacggcctttattgaccttcaaatcggaaatgatttcgttacgtttatacatcggatgcgtttcatattggctgaacgcaaaatcaagcatttttgtgatttgggcatttcgttctttcggcgtgctggctccaaaaacgacagcgatgacgcgcatgtttccttttttcgctgaagctgtcagacagtactttgcttcatttgtaaagccggtcttgactccatcaactcctggataaaatttgatgaggcggtttgtgttgacgagccagaattttttatcagtgttttctctcagatagtcttcatacgttcccgtaaatttcgtgatgttttcatattttaaaagctctttcgccatgagcgccatgtcataggctgtgctgtaatggccttcttcaggcagacctgtcgtattttgaaaagacgtatccttgaggccgagctcagcagctttttcattcattcttttgacgaattcctcttcagaccccgcaatatgctctgccattgcaacagaggcatcattacccgatccgatggcgatccctttcagcatatcttcaaccgtcatttcttcaccgggctctagaaaaatttgcgaaccccccattgaagcggcatactcgcttgttctgactttgtctttcattttgattttgccttcatcaagggcctccatgatcagcagcatggtcatcacctttgtcatgctggccggaggaagcttttcacggctgttcttgtcatacatcaccttaccggtatcccgctcgattaaaacggcagattttgcgtcatcagcaagctccgacggtttctttgcgctctcttttgcaagcgccgacggcgcagtcatcaggattatcgtaaaaatcagcaatttggataaatgacgtttcatcacccagacctccatttcgtaatcctctctattttttccaatccggttggatttatacggatcggttggaaaaaatttctcaacgaccaaaaagaaagagccaatgcaggctctcatttgaacttgcactggctcatatttcaacttcgctgtagttttagccgattttggcgactgccgctttaacaaaccgcaagaagtcggcttttactttttcggtgacttcgatcacttcatcatgggagagcggctgatcgaggattccggctgccgcgtttgatatacacgaaatgccgagcacgcgaaggcccgcatgttttgccacgatgacttccggaaccgtcgacatgccgacggcatccgatccgatcgttctgaggaaccgcacttcggcaggcgtttcgtatgtaggtcctgtaacggctgtgtaaaccccttcttgtacgctgatgttcaattcttcggctgtttttttcgccaagaggcgcagttccttatcatatgcggacgacatatccgggaatctgacgccgagcgaggaatcgtttggaccgatcagcgggttcgttcccatataattgatatgatcggatatgatcatcaaatcgccgggacggaacgattcattgacgccgcctgcggcattggtcacgattaaagtctcgatccccagctctttcatgacacggacagggaaggttaccttgtccatggaatacccttcgtaaaaatgaaaacgcccttgcatcgcgacgacttgcacattttcaagtctgccgatgacaagctgtccggcatgcccttcaacagtggaaacaggaaagtccgggatgtcttcatatttaatgcggacggcgtcttctatctcatcggcaagcacgccaaggccggatcccaatatcaggccgaccgcaggtttgatttccgttttgcttttaatatagtctgcggcatttgcaatcatctgtttcacgtcgtttcctcctatttcagcagggataaaaagctttttccgtactttggcatattcgttttaaagttgtcggcgatcgttgcgccgatgtccgcgaatgtatctgcgagcggaagcgccccaggcttttcgtgttttttgctgtatacaagaagcggaacgtactcccttgtatgatcagtgccatggtgaaccggatcattgccgtggtcggcggtaatgatgagcagatcatcttcgcgcatcttttcaaatacttcaggaaggcgcgcgtcgaactcttcgagcgcttttccgtatccttccggatcgcggcggtgtccgaacagcgcatcaaagtccacgaggtttacaaagctgatcccagtaaaacctttgtcaagcgtttgcaccagcttgtccatcccgtccatattcgatttcgttctgagcgattccgtaatgccctcgccgtcgtagatatcggagattttgccgatcgcaatcacatcaaagctgtcatctttcaattcattcatcacggttctgtcaaacggcttcagcgcataatcatggcggttcggcgtccgtttaaattcgcccggcttgccgacaaacggcctcgcaataacgcgtccgaccatatatttctcgtcaagcgtcagctcgcgcgcgatctcgcagatcttgtacaattcctcgagaggcacgacttcttcgtgtgcggcaatctgcagaacggagtctgctgaggtgtagacgatcagcgcgccggtttccatatgctccgcaccgagttcatccaaaatcgcagtgcctgatgcaggcttgtttccaatcacttttcttccggatttctgttcaagttcgtggatcaattcgtccggaaaaccttcgggaaacacccggaaaggtttgtctatgtaaagtcccataatctcccaatggccagtcatcgtatcttttccgtttgaggcttctttcattttgccgtaataggcaagcggcttttccgccttttcgacgcctttgatttcacggatgttgctgagcccgagctttgccatgttcggcaggctgatgcctcccatgtgttcggcaatgtggcccaatgtatctgcgcctttgtcattaaatttttcggcatcaggcgcctcgccgattccaacggaatccattactattaaaaatacgcggttataatcaaatgcaggcatttgtcggcctcctttttttctttctgtcagctataggctgtcacgcttggcataaaaaaaccaaaataccgctattagccaagtataaaccgtttacacaacagttgacaatacgaacggaaatagtgagaaacttcccgcaatttgctactccctcaacatgaaaaaccgtgctaccgcctgtcctttcaggctatgcacggggatggtattgcctatacacatctttcagccttgttttcgtcacgtgcgtataaatttgcgtcgtcgaaatgtcggcgtgtccgagcatttcctgaacggcccggagatcggctccgttttcgagcaagtgtgtggcgaatgagtgcctcagcgtgtgcggcgtcagctctttattaattcccgcttccaaagcgattttctttaaatttttccaaaacccctggcggctcatttgtctgccgtggtgattcagaaacagggcgtcttcggtattttttttcaaaagcttgcccctcgcttttgacagatattcgccgaccgcatgtgacgccgcttcgccgagcggaacgatccgctcctttcttcctttcccgaagcagcggataaagcccatcgataaatggacatcggacagctttaatgcgatcatctcgctgacgcggattcctgtcgcatacaataactccagcattgctttatcgcggtagccgaacggccccgtcagcttcggcgtatccaaaagcgtttcgacttcctgtaatgacagcaccttcggaagggtccgttccgttttttgcgattcaatatggacggacgggtcctgggccgtcactttttccctcagcagaaactggtgaaagctgcggatggaagcgagatgcctcgcgaccgtctttccggattttccggcgtcttttaaatgcttcaaaaactggatgatgtgcagccttgtcacctggtcaaaagagctcagctgctcctgctcctctaaataggcggcgtagctgttcaaatcccgttcatagctcacaaccgtgttgtgggaaagcccccgttcaacaacggcgtagtggataaagtctttaatatgaactttcacgctatcctactccccgttcaaataaaaaaagattaaccggttaaaccagctgccctgctcgtcctcttccatcgaggcgaccttgagggctgctccttcaggtttatcataccgatgatagttttcatactctgaatttatccatatcatagcataataaaacaagacggtaaaaccggtaaacagcacaaacaccttgatcatatcggcggccgttttcagcattttcatacggtttcaggtcccttcttttgattcgattactaaaacttatgccaaatgagacaagttttatacgtctgaatcaaaaaagaacccgctcatggctgaaagggttctctccggtttaggctattccgattccttttgctgacagtcatgacagatgccgtggaacgtcagcctgtggtcttttattttaaatttccaatccttttcaatgatttcttccacgtcttcaagcaaatcttcttcaatttcaacaaccgaaccgcattccatacaaaccaggtggtgatggaaatgggcggcaccttctttgcggaggtcatatcttgacacaccgtcgccaaaattgattttatccactacttttaattcagttaacagttcaagagtccgatatactgtcgcaagaccaatctcaggagatttctcttttacgaggaggtatacatcttctgcgcttaaatggtcttcctcattctctagcagcacccttacagtagcctcgcgctgaggggtgagtttatagctggaagaatgcagttgctttttaatccgatcaatacgtgtttccattgactttccctcctacgccgcattacctagcttattataacaaaacaagcgcagagagccaactataatcattataaattgagaaacaaaatgaatattttttaataatcattataaattaatgctgtttcggcaagacgtactctgtcagcttttccatcaacactggcgaaaggtatgcttcaaagaaagaggatataagagacattgcgagaatcaggacgagtacaaaagcgtagcggccaaaccaatggacaggtgcttctgcaaggctgcgtttaacaaaaagctggcggatgagcctcatcgaaaaggcgatggcgcaggtgcccatgatcaagtacgccgggatcagcagaatattttgcgggagcacggagacaaaagacaggaaaaagccgttgattcccatttgattgaccaaaaagccgactgtaaatccgacgacgatcccttttaagaagaccatgataaaaatgacgggcagaccgatgatggatatcccgagaatccacattaagcctaaatatttcatattatgaagaaagctctgcaaaaacatttcctttgagctggctgcttttccttcggaaagctgtccaaaaaattgattcaaatagtagaacaaatcttctttttgaccgatcgtcatgctgttgacgatgaccgcgccgaaaatcacacccattaagaacagcacagaaacaaataaatagatcgacagatggtccttcatatgttgaaagatgagctctttgattgtgggcttccgcatgtatcttcctcccagacgtgcttttgattttaatagattgtatgagagaaaagagagccgcatgactttttttaaaaaaagacgggcgcccgtaaaaggcgccccgtctaaagttatgattccttcctgttttccgcggaatgctccctgtccgtattcacagtcttgttggcagccatcacaaacggcagataaatcatcgttgaaatggcgaggcagagaaagccgacgccgagcgcaagccagtttcctccggtcccgagaaacggaatcaacggccctggcgttgtccacggaacagcgtatgcgatcggcggaatcagctgaaacttgatgaacaaatagccgatgacagtattgactgccggaacgataataaagggaatcatgaagattggattgagcacgaccggaagtccgaaaatgacaggttcattgatattaaatattcccggcccgatcgaaagcttgccgatatctttataatcccgccgctttgaagcgatgaatatcgcgatcaaaagccccagcgtcatgcctgatcccccgtagttcgcaaaggcgtcattcagcgcccatgtttcaggaaacggagcgttccatgcagagcctgttttagcggcaaaaccgaggttttcaaggtttgcttctgcaaaaatcgtttctctgatcgccgcaatcgtattcggaccgtgaatgccgaacagccataaaaagttggcgacgattccaagaaaaacaacggtgaaaatattcgttcccatctctctcaacggcgcctgcagcacagtatacaccaattcatgcagaccgtttttcgacagggacatcagcgcaaagcttaatatcgcaaaaccaatcgtaatgaagatgatcggaaacagcactttaaatgtccgggcgaccgcaggcggcacctgcggaggcatatgaatttgcagtcgcttggcatttgatagcctgctgaacacttcaccgacgatgattccgatgattaaggcgacgaacagtccttgggcgccgagccatttcgtcgttaaaaagctctcgttttcgatcaggcggtacggtgaataaatgataaaataacaggatacagccgttaatccggcaagcagttcatccgctttcattgagatggctaaattgcgggcgacgagaaacacgacaaatatggacataatatcgagcgacccccgcagtacgggcgtaaagaccgactggtaatcagccaagttcggaaatatcttttcaagaaataaaattttggcgataaacccgtccggagataaaatggcaaaattcaataaaatgataatcgatcctgccataataatcggaaatgatagaataaaagcatctctgatcgcacatatatggcgctgtgaattcaattttgcagcaacgggaaccaaaaaccgctccacgttccgctcaaacttctccataaacccgctcatccctatctcccctccttttttatttcatcagctgcagcgctttttgcagcacagcttcgccgttcatggtgccgtagtctcgcatgtcgatcacctggaccggcgtgtctcctgcgctcgcctcaacctgtgacttttggtacctgacttgcggccccaacaatacgacgtccgcgcttgacgcggcagtccccgcttcggatacaggcagagcaatgatgtcgacctcttcgttcagcgcctctgcatgctttttcattctgctgacaagcaggctcgttgacatgccggccgcacaaaccaataaaattttcttcattatcaattgaccccctttggattcatcttttcctccgccgcaaagaaaacgctttcattatgatgcggagaaacatttcaacctggtcttttatcctatgatcgagatagacaactgtttcataaaaatcaatatttttatagctgtttcaaacggctcgtttagtcaacctcaacaaacgccttgaaacatttgtttagtttatctaatgaatttttcaggataatgagttatatttttccttaaaaaatccggagggattacatgaaacctgtccatcaagaaaaaattcaaacagacctcacgctctcaaacagcgacttgcagcctctgaagccggaggaacgcacatggaaagcggttaatttcgcatcgatctggatgggctgcatccataacatcccgacttatgcaacggttggcggactgattgcgatcggactttctccgtggcaagtgcttgggattatcgccgtcgcttcgattgttctctacgcggccctcgcgttgaatggacatgccggcgcaaaatacggcgtgccttttccagtattaattaggtcttctttcgggatctacggggctaatataccggcgctcctcagaggtttcgtagcgattatgtggttcggcattcaagcgtttgcgggaagcacggcgatcaacatcctgatcttaaacgtatggagcggctggaaagacatcggcggcgactggaacttatttggtttgcatttaccgggtcttttgtcatttgttttcttttgggggattcatcttctcgtcctccatcacggaatggagtcgattagaaggtttgaagtctgggccggcccgctcgtttatctcgtctttggcgggatggtgtggtgggcggtcgatattgcaggggggctcggtccgatttattcgcagccgggaaaatttcagacattcagcgaattaatttggccatttcttgccggtgtgacggggattatcggcatttgggcgacgctcattttgaacattcccgattttacgaggtttgcagcctcccaaaaagaacaaatcagaggacagttttacggtttgccgggcacattcgttctgcaagcatcaccgtcacctccggctcacaggctgccttcggggagccgatttgggacgtggtcgatattctcgcccattttgacaatccgtacgtgatcgctctttcggtcattacgctttgcatcgccgccatttcggtaaacgttgcggcaaatattgtctcgcctgcctatgatctggccaattttttgccgaaatacatcgatttcaagcgaggcagctatttgacagcagttttggccctgttcacttttccatggaagctgatggagaatgaagcgagtgtgttttcgtttctcggcacgatcggcggaatattgggcccggtcgcaggcgttatgctcgccgattatttcatcatccggaagcgcaccctctgcctcgaagatctctattccgcaaaaggacagtatatgtattataaaggctataattacagggcttttgctgcggtagctctcggagcgcttatatctctcatcggctcttacatccccgccatgaagccgctttatgacatctcctggttttcgggcgtgctgatcgctgccttcgcctatatctttttaatgcgcatccatccgccggctgccatttcaaatgaaacggctcaatacgaaggcggcggaagaaaaataagcgggtaatatcgaaaaaggatttttcgctagtgaaaaatgccttttcttcttacctctttttttcaaaggcagcttatgatagactcatattatcaaaaattttccactggtcgatggagagcaatgatgcaaacgggcgccgagttcgacggacaggccttttggatcacgtcgcctgcggtggcaacatttcatgaaaaacacctgcgggaggaatactttatgaatccgatactgctcgattttccggacagcttcgaaacagagcgcctgctgatcagagcaccgcgcgccggtgacggcaaggcagtatatgatgctattgcagcttcgttttcagaactaaagccgtggatgccgtttgcaagggagatccccgaggaagagcgtgtagaaatcaacgtcaggcgggcacaggccgattttattttgcgcaacgatttgcggatgcatattttccataaagaaacgggaaaattcgtcggcagcaccggtcttcaccgcatggactggaaagcgaaacggtttgaaatcggctattggcgcagttccgaattttccggacaagggtacatgacagaagcgcttaacggtctcattgatttcgcgagaagacacgtcagagccaagcggcttgagatatgttgtgacagcatgaacacgaaaagcagaaaaatggcggagcgcctcggtttcgagcttgaagccgttttacaaagcgatgacctttcgaacgatttgagcgaatatcgggacacatgcatttattcgcgcatcttctaaaaaaagaacccttatgatcttcatgaagcaaatcataagggttctttcgtttatgtttcatatgcagctttgcaagctcttcccgcctgcttttcgtttttctgacgtgcgtgccgaagtccggcgccttgcctcttgatgcggcggcatctctgcctgtgtttctcaacatgtgctcgcgctttttccttgccttgcttttggccatgttccccactctcctgtcaaatttttacctcactattatagaaaggcggggttctaaacgcaagtcatacggtttcttccgttctgaccatatccacatgcggaatgccgtcctccatatagacgtctgagattgctttaaatccgaaggagccgtaaaaggaacgcaaatgattctgggcgctgatcttgacctttgtctcttcccactcgccttccaaaaagcggatcgctttatcaagaagcgcctgcgcatatccctttcccctgtcttctttgcggacgatcacccggccgattgatgcctcggggtatgctgtgccgctcgggaacagcctgcaatacgcagcgatctctccttcttggctcagaaataaatggtgcgcccgctcatccaagtgatcaagctcgtgatacggacagttttgttcaacgataaagacgtctattctgagcttgatgatgcgatacaactcttccttcgacaattcctcatacgattttagtttccactccatccctgttctctaaagccccctttagctctgcacttttccataggttccgccgcctccggctttcagctctaaatccccgttccttgctttgatcacgagctctgccgtctgcggacgaatggtttcttttagatcgccttcttttacacggtgaagtatattcatttcagtgccgaaagcctctttcagcttctgaatcgttttcgggccgatgccggggatcagctgcagcggaacctggtgaacgtacggcgggcgcttgaccgggctttcatcctgatcataaagctccattagacgcgtgctgacgccttttgtaaactttcggctgccgcacgctttgcacaacgtttcatctgcctcctgcagacggccgcatgtttcacaagcggtttgaaaatatttgcccagctgcggattcatcccgtaattcgcggcaatgctacgcccctcttgtccttttaaagcaagcgaaaactcttgaaagctggcatgtttgatgtgcagcttattatactccctgccgatttttccaagagaatgggcgtccgaattggtcaaaaatgcataaggattcagttcggatacgtgtgaagccatatcggtgtcgctgctcagcccgagttcaaccgcatcaatcatcctcgggtcaaacacttctttcagcgaaaattcgactccttttccgtacaggctcttgtgcggcgtaaaaatgtgcgcgggaatgaacaggccgccgagctctttcaccttccgctgaagaccgatgcccgtctcatagatgcgctgggagctcaggtggatattcgtcaccctttctgagagccagccggaaaactgcttcattgcggagatcgacggcataaaggcaagcacatgaatcgggccgcggcatctgtcatcattgatttccaattcagacccgcataaaagcacggtatctttatacttgattccgccgtcttcaagctctgtataacgccctgaagacacccctttttcaatttcggccagcacctcgggtgaatgacaatctataatgccgatcagttccatccctttatgttcgcttgcttcaatcaaaatttcgtcgagcgttagcgttctggcagccgttatcttaacgggccggcctgattccgtccgcccgatatggatatgcatgtctgcgaatatttctttcatttttttgcttgcagggcctttctcagctccagatactgcacggcataagccgttttcgcatcatagatgtcctgagtttccatcagtttcagcgcgcctgaaagcggcacctccagtacttcaacaaattcgtcttcatcaagttcgcgcttttcttcaagcggcgtcagctcttcagccaggtacagatgcaccagttcgtccgcaaagcccggcgatgtgtaaaaagcggtgattttctcaagcttcgccgccgtgtatcccgtctcttcctcaagctcccgcagcgcggtatattcgggtttctcccctttttcaagcttgcccgccggtatttcaacgatcgtccgttcaagcgcttttctgtactgcttaactaagatgatgttttcttcatcagttaaagcaagcaccgctacagcgcccggatgcttcacgatttcgcgctttcccgttttaccgttcggcagttcgacatcttcaagataaagatcgatcaccttgcctgaaaaaagcttttcctttgatatggttttctcctctaaatgcttcagtttgatcatctcctaagttctgctctggctttagatcccatacattttatcatacaccatgaaagggggacgcgccatgaaggtctaccgcctgaatgaccgcatcgtcatgtctgggaaagcatgggaaatccgcgccaagctgaaggaatacggacgaacgcatcactatgtgaaagattggctttctgaaaaagaaaatcgcctgcaaaagcttaattttattgacatcaagaagggctgcatgaaataatacttgtgagtaatgttactcacaagtattattatttggaggcggatgatgtgggaattgaaaagggccgcaaaggcaaacaaagccggaagcggctgctcgaggtcgctgcaaacgaatttgcaaaccggggattccatgagacaaaagtgagtacgattgtgaaaagagctggactgactcagccttctttctacctatatttcccaagcaaggacgccatctatgacgagctgatcaatggctttcacgcgaacttaaaaaatctgatcgaatcgttccgtttagagaaaggaatcgagaaaaaacacgtatcaaaacgggtaacggccgctgtagaggctgtatttcgatttttggcagaggaccccgatttgactcgcatcggtttttttctcagccctgaagcaggcgaaatgaaaaaagatttaacgctcgccttgaaagaaaacttgaaagcagagcaggagctcggctacttccgatccgacctggaaatggagaccgttgctgaatgtctgacaggcatgattgagcaccttgccgatatctatttgcttgacggatcaaaggacccctcaagtctcgcaaaacaaatcacggatcttttgatccacggaatgctcgtaaatccgcagcatccagaaacggagtgaacacagtggcatttattttcttaaaagcagggctggcggcatttatgctgaccggaggcgtaatcaaggtgctgcacgttccttttcaagtcgaacattggcgccattatgaatatccgctgtggtttctttctgttacaggatgtctcgaaatcgccggagcgcttggcatgatcggcggaatttggaatgtgcatctggctgtcggttcggggctgttattctccctgcttatgacaggagccatccatgcccacctggtccgggcgcggcagccttttttcacggccatccctgccgcggtttgtttgatttgcgccctaagcatgatcatcgtcgagctgtacttctgatcccgatgccgatgggttgaaaacttcgctcctttgtattacggtcaaagtaagaaaaaaaggagtgaggcttatgaaaaaaaggacgctcggacattccgatttacaggtgagtgaagtcggcctaggctgcatgtctctcggaacggacaaaaagcacgcactgtcaattctggatgaagctttggaactcggcatcaattacttggatactgccgacctgtacgattttggacgcaacgaagaaattgtcggtgaagcgatcaaatcaaggcgccaagatgtcatcctcgccacaaaagcgggaaaccgctgggaggaaggaaaaccgggctggttctgggatccccggaaagcatacataaaagaagccgtcaaacgcagcttaaagcggctgcaaaccgactatatcgatctttatcagctgcatggcggaacgatcgaagataacatcgacgaaacgattgaggcctttgaagagttaaaacaggaaggcgtcatccgccattacggcatttcctcgatccggccgaacgtcataaaggaatacgtcaaaaaatcaaacatcgtcacagtcatgatgcaatacagcttgttggacagacggcctgaggaatggctttctctccttgaagaacatggaatcagcgtgattgcaagaggacctctggcaaaagggattctgacagaaaaacccctgtcagatgcaaacgcatcgattaagaaaagcggctatttatcatattcctacgatgaactcatcaaaacaaaggcggacattgaaaaaacagcgcctgatttatccgcaaccgaaaccgcgctgaagtatattctcgcccagccggctgtcggcgcggtcatccccggggcgagcaaactctcccagcttcgggaaaacgttgaatctgtcggcggacgcagcctgacagaacaggaaatcaaagcgctccgcttttatacaaaacgcgacgtgtacactgcgcatcgcgaatgaattcaataagaaagcaccgtctctttggcagacggtgcttctttacttatacttcctccagtcgtcaagtccgctttcgttgaggagttcttcaaagcttttatttttttccctttcctgtctttccttgataagccgttctttctcacgctcttttcttttctcgtcctcctctttcaattcgcttttcatttgctgaagcttatgtttcaaatcgtcggcgagtgcatctttcagcagctgccgggtatttgggtcttgttttttctttcccatttcctgtcctccgttctccctgtttgtgatgatagtttatcaggaatctaaaagttcaggcaagccgtcactctgggagccgcccccctcggcaaatctcaatggttgtgtggtatgataagagagaagcatttaagaaaggaagaatacaacaaatgttgatttggctggctgctatcggagcggttttgctgttcattgctgcgctcggaatctattttacgaatcaaatcatgtacattaaaaaacggaccgaccaatacattattgagcgggaaactgccgacggccattatgacgaaaaagctttcgccgctctcccgaaggaagaaatcaccctcgcttcttcttacggctacaatattaaagggtactacgtgcacccgcacaaaacgaaaaacaccgtgattatctgccacggagtgacgatgaatctgctgaattcaatcaaatatatgaatctgtttctggatctcggctggaacgccgtcatatatgaccacagaaggcacggcgcaagcggcggaaaaacgacgagctacggatattatgaaaaaaacgatttgaaaacggttgtcaattggctgagggaaaaacacggcgaacaagcgctgatcgggattcacggcgaatcgatgggcgctgtcacaacccttctttacgcgggaatggatgacgccgaggctgatttttatgtggccgactgtccgtttgccacatttgaggatcagctcatttaccggctgaaagaagattttcatcttccaggagctttcattttgccgctcgccagcctctttttgagatggcgggacggctaccgcatccgtgatgtctcccctttatccgtcgtcggaaagatcaaaaaaccggtgctgttcattcacagcaagcacgacgactatatcccggctgaatcaagcgaaattctttacgagaaaaaaccggggaagaaacggctttatattgctgaaagaggagcgcacgcaatgagctacacccaaaacagaaacagctacaaaaacacggtgcgggactttcttcaagaaatcacaaaccggcacaaagaaggcgaacgagcataagtctcgtccgccttcttttggtgctacaggatatctgtaatgtcgctcatatgatcgccgatccaggagatggccgtctcaattgtatcaaattcctttgtttcaaaggtcatttcatcctgaagaagccagacatcctttttgacggactctgtccctccgattgaccaatgaaggagtgtatacggatgattttgatgtaaaaaggacgcccatgttttattttgagcggtttgctttaaagattttaccttttgattcaaatcgaacgccaccctatttcactaaaatactcattctgggagaaagcacctgtgccggactcttcagcatcaacgcacccgctttctcataatagtcgatggtcatcgcttcatcaaaaaagactttttgcgatgactgaatataaatcggaagcccgtttgtctcaaggggctcgcaacttcccgataattcgtccgtcagccacaagaccggcacaccgctgaccgcgcatccgcatccctcggaatcatagcggagctggatctttttatcaggataaggctctgttgcccgttgaatggcttgtcttgcctgagcagtgatttcaagctgcatgatatcatccttctttgttatgtttacggacattgtaccacgggtcgggaaaaagcgcatcgtttccggctgtcaggcataaatatgaagggattcggaggtggaatgatgtccaaaaaagtgcagattaaagtgatggacaacggcggtttccgggtcacgggagacgtcgaactgatcgacatggaaggaaatcctttccctgaaaaaccggctttttcgctgtgcagatgcggaaaatcgctgaaaatgccttactgtgacggaagccataaaggaatgttcgactcttgtgtcagagcttgaagcaggaggggggctttatctgtcctcctccgccttttcccattgttcagccaagcgctcagtctcttttatccagccgcttttgccgtcaatatagcctgctatgtcaagcggaaacatctccgccagcttcatcttcagtgcagcatattcttcggcccgctccggatgggagattaaataatcccgaaacgcgagatgccgtctgatatcgggatgcccgctttcatacagatggacatggtgtgtacgcttccgtctccctttttgatagaatcttcttcccggaattccgttttcccccttcggttcatagccgagcattttcatccccttttcgaagccggcggcggagccgagatctttcacttcgatcagtatgtcaatgataggcttggcgctcattcccggaattgacgtgcttccgatgtggtgaatatgcaagacttcattccggaaaagcgcttcaagctgctttttttccttgaaaaattcgcccttccattcttctttataggagacgactttaacctttctcggtgcttgcagcgtaagccttgaaagaacaacccctttttcaggttcatactgttcaatttcagaaaaccccaatttccgatacagcgcttttgccggctcattccccgcacccgtcgtcacttcaaacgattcggcttccttcaccatcaatatataacgaagcagggccattgcaatcccctttcgaaaatggaccggatgaacggccagcctgcagatcgtcagcttttcagctgtatgtatgaaggaagcgattccggctaattcttccccctcaaacgagccgatgaaagtttctcgtgaatccattacatcaaaaaccgtttcattcagctgcggaatgccctgaaattgaatgatctccgcttctctttcataagccggcctttgaacatttacaatgctgcgggctgtatgcggatctttttggtttaacaattgaatcattgcatttcctccccgctggtgccatctgacgggggccggccggaacgctccgaaattctggcgtcttcaacttttgcaatccgtacggcaaagtcagagtaccattctgttcggcctttttccttcgcctgccggtgttcgccgtgaaacttccatttttcaatcgcttcaaggctttcccaataggagaccgttattccctttccgttcatgtcccttgcgctttctgctcctaaaaagccgggctgttctgcggcaagctttagcatgttctcagccgtctctttgtagccgttatccccattcgttctgaccgatgtgaaaatcaccgcgtaatacggcggctccggcgtttttgaaatcatattcatccccctttgattcacagctctttgataaccagaacttactcctgatccgttctgccatcattcgaaaaccttggacacttttttccatcgaaaatccctggtgataaccaatcggcacattgttgacatgcagcggaccgctttgcagccggcacacgctgcacatgagagagaagcttcaaagcccatgttttcatcaagatccacccgctcttttcaacattgtacctgaccatccgccaaagtgttctgcagtattggatatgcttccttattataccgtttcccgatcctaatttaccattttaatacgtacgtcagtagattaataggaaaaattccttagttccaattcaacagcacaaaccgatttgctttctcccagaaaagcttcactctccttaccctataagagaaccggcgcgcagcggtaaaaaaacgtttcatatactgctcttttttcgggtatgaaaaatagataaaattacacttcgttttcatattttcgttttatagaattgtcgttgttgtgaacttattacttttttaggaggaaaaactatgcgtcgtcattcatttttatctattctattgatttgcatgctgtctgttgtgtccgtattttcgttccggccttcagcagcttccgccgcttcccacaatccggtcgtcatggtccacggcatcggcggagccgattataacttcatcggcattaaatcgtatttacaatctcaaggctggacaagcagtgagctttacgccatcaactttatcgataaaacgggaaataatataaacaatgctccgagattatccgaatacatcaagcgtgtgctgaatcaaacaggagcatcaaaagtcgatattgtcgcccacagcatgggcggggccaatacgctctattatattaaaaatctggatggtgcggataaagtcggacatgtcgtcacccttgggggcgctaatcgtctcgttacaaacacggcgcctcagaatgacaaaatctcatacacttcgatttacagcacaagcgactatatcgtcttaaacagcctctccaaacttgatggtgcaaacaatgtgcaaatctcaggcgtaagccatgtcggtcttttgttcagcagcaaagtaaatgccttgattaaagacgggctgaccgccagcgggaaataagattgaaggagccttgaagagcttaacttcttcaaggctcctcattgatcggaattgtcacccctcttgccaaaataaaaaggactctaaataaacgcctattccgaccgttcattcagtgtccgtcaaccccctcgatatgtgattactccactatgatttcaaagactctttgttcgagattgtatttagcgtcttggaatgtaaatttataatcatctgtgtcggcatcaggtgaaagccaagctccgtattttctgatcgtctggacgatgctttcgagttcagcaggagtgaagtcacctatgtctgtgccttcggtttcagcagtatggcgtatttttactgtaatcatcatcactttttggctcctttcacttgctgtttgaacatcttattaacagcatatttttttcctctgtaaatcgttccattaactcccttgattcaaattattcgggctttcttttttacagacctattttatatggaaaagccggacgggatccgaaaaatgtgtcttcgtactttcgtcatataaaggcaaatattcctgtttacaacaatgagaatatcccctatgattatgaggtaaatcgaaatcattactacttggaggtataacttatggcttacatagcaaaacgcatgatcataccgattatttttctcttcattctcgcttcctgctccgccggaggcgctggctcagcgaaaggggaagagaagaaactcacctttcttttcaatattccgagtcaaacccttgacccgaatcttgatgtcaattatacggctatccgcgccggcatcagtgaaacactcgtcaaaatcagtgcggacctttccatcgaaccgtggattgccaaagattggaaaagcaaagacggacaaacttgggtcttcacccttaaagacaatctgacgtttcaaaatggtaaaaaagcggatgccaaagcggtaaaagcgtctttagaacggacgatgcgcgagagtaaagccatgaagaacgccctaaaaatcaaggaaataaaggctgaaggacaaacattgacgattacaacgaaggagccgtttcccgaattcccttcagaattggttcatccaaacacatcgatcattgacgtcagcgcagcaaacatttctcaacagcccgtcggaacgggacctttccaagtttcctcttttgaggccggccataaaatagagttagaacggtatgacgattattgggacggcaaaccgaagctgaagcacgtcacattctcgtttaatgaagacgcaaacgcccgcgtcatggctctccaatcaaaagatgccgatatcatttacagaccgagcgttgaggatattgaccaaattcaaaaagattcgtcgattaccgttgattcggtaccgagcttgcgcgttcaccagattctttacaatacaaagaaggatcatcttgctgaccgccacctgcgccgcgccttcgacgcactactgaaccgcaaagaaatcgctgaaagcattttgaacggacatgctcagccggcagacggccccttcctagccgatttcccattttcctccgatacggttcaaaagccgagcggacttcaggctgcaaaagctgagctgaaaaaagccggctacgagcttgaaaacggtaaagccgtaaaggacggaaaagccttgtcttttacactgctaacctatcagtctcgtccggaattgcctttaatcgcgcaaattcttgaatcaaatgcgaaggaattgggcatttcgattaagattcagcaagtcgaaaatattgatgaatatttggcgaaaaacgatgactgggatttagcgacatacagctcaatgaccgcgccaagaggcgatgccagctatttgctgaacaccgcctatatgccgaacggcgctttaaactacagcggcatcgaaaatcaaaccttgatcaaatggattaaggaattcaaccgcacgatcgacaaagagaagcggaaccgacttgccaaaaaagcagctgaattgatcgagaaggagacattgaactcttttatcgtgactcccgaaaacatcacagcctaccgagacggtgtattaaattgggaaacgagcaaaagtgagtattatatgctgacgaaagatttggatgtgaaaacgaaatgaagcagatcgccaagcggctgtttgaactggtcctgttcttattcctgctttcatttatcagctttgtgtttatgaaagcggctcccggtgatccggtgaaacagatgcttcgcgtagatgatgttgcggtaacggacgagcagatcgaggcattcagagaggagctcggtttggacaaaccggtttatattcaatattggaactggttcaagcgctttttccaatttgatttgggaaaatcctatacaacacacgaacccgtcatcgacgagctcagccggaaattcccggcgacattgcttctaaccggcgcatcgcttctcgttatgctgctgattgccgtgccggtcggaacgctttccgctttataccgggatcggtggatcgatcatctcagccgcttgctcgctttagtgggagccgcgctcccgagcttttggctcggattgatactgatcgatctcttttccgtcaggctgaattggctgccgtcgatgggagccggaacgtttaaacatttgattctcccctctctcacgcttgggatcgcgatgtcgggcgtttatgtccgccttgtacggtcaagcctgatcgaaagccttggtcaggatttcatcagatctgccagggcacgcggcatcagcgaggcgagaattttcttctttcacgcgtttcgccattgtcttgtccctgtcatcacgatattcggggtcagcctcggcagcctgctcggcggcacggtgattattgaagtcctgtttgcatatcccggcgtcggcaagcttgtcgttgatgccatcgttcagcgtgattatccgatcattcaggggtacattcttttcatggggatcgcggttgtcctgatcaatcttttagtcgacctctcttatcggtacctcaatccggaaattcgcttaaaggaggctggtcgccgatgagaaaaaacgtatttcgatctaaaacaggactatggtttgtgctgctgttttccgcggcgctgttcaccgtccccttctttttgccgttcgatccgctccgcacagatatggccaaccgtcttcagccgatcagtatgcagcattggctcggaaccgaccatttgggcagagatatattttcccggatggtcgccggtgcgaaagcgacggtcggcaccgccttgggcgcgattctgatttccgttttcataggtgttcctgtcgggcttgtctccgggtttttcggcagacggctggaccggatgatgatgagaattgttgacgcggttatggcttttccggactatattgtcgcgattgttttaagcggtttgcttggtccggggctgatgaacttaatattggccgtcgtcgctgtcaaatgggtcggctatgcaaggctggtccgcagcacggttttttcggaaaaacaaaaagattacatcgccttggccgagcttaccggtttaagctccggggcgattttaaaaaagcacctgctgccccatgttctcggcaacctttccgtacttgcgacacttgatatcggaaaaacggtgttaatgattgctgccctgtcctatatcggcctgggtgctcagcctccatacccggaatggggcgccatgctgaacgacggaaaacattacttcttgcatgcgcctcagcttatggtgattcccggtcttgcgatcatgttcatcgttctgttgtccaacctgtacggtgatcgtttaagggacaggtttgacgtcaaacacaagaaaggagtttcttagcatgccgatgttatccattgaggacttatcaatcagctcccggcagcacaccattgtcaaaaatgcctccttctcgattcatgaaggggaatggttcgcgctgctcggggaaagcggcagcggaaagagcctgaccgcttcggccatagccgggctgcttccggacggactaacggtgaccggcggagacgtgatatttgaaggccaacagatgcttcaagccggacgcaaagcactccgacgcgtgcgcggaaaggatatcgcctgtatttttcaggactgtcacggagcattcaccccttttatacggatcggcaaacaaattgacgaaatggtcaaaacgcatacaggttggtctaagaataagcgaagagaagcgattctccatgcttttcgggaggtttctctgccggaaaacagagtatatgaaagctacccgtttcaattgagcggagggcagctgcaaagggccgcgattgctcaagcgatggtgctccgccccaagcttctcatcgcagacgaaccgacgacggctttagacagcatcacggccgcggacgtcttgcaacagctcgccgcgatgcgcgccaaaacaaactgcgccatcctttttatcactcatgacctgcggcttgtcaaaagatacgccgatcaaaccgccgtcatgcaaaacggagaaatcgtcgaaagcggcttaaccgctgatttaattagacagccggcacatgaatatacgaggtgtttattcgcggccatcccgccgctgaaaaatcctccgccaaggctgacggcagccccgcctgaaacaaaggaagcggtgctggcgggaacaggaggtgcgtgatgacccattctgcagagaccgttctttttgtcagcaatctgacaaaacattacgcttgcggccacaaagcggttgacaacgtatcattctccattcgaaaaggcgaatgcctcgggctcgccggcgagagcggcagcgggaaaagcaccctcgcacgctgccttttgctgctcgaaaaaatcgatcacggagagattaggcttcatcaacatccgcttaccggcataaacaaaaaagagacccggagactgcgtcgaaaactgcaggctgttttccaaaatccagctgcatcattcaatccaaagctcaatattatcgattcagttatggagccgcttgatgtttccaaacaagacatgccgtcatttttaagggacttccgaggcagccgccgtctgacggctgagcgtctgttctcaatggtcggccttccctcgcgcctccttgaccgctatccgcacgaattaagcggcgggcagcgccagcgggccttgatcgccagagccatcagcactcatccgtctttaatcatctttgatgagcctacagcaagcctggatgtcaccagtcaggcgaagatcctggatcttctcaaagatttgcaggatgctatgggcctttcttatttatttatttcccacgatctggccgctgtccacttcatgagccatcgcatcatggtcatgaaagacgggcagattgccgatcaatttgaaaaagaagagcttttttctgccgaaaggcacccatatgccaaaaagctgcttcaggtgtttgaatcctaaggggggtcttaacagatgaatcacaagcaatatctagcactcgccgttccgctgatcatttcaacgatcaccactcctttattgggtgcggtcgatacggcggtcgccggccagctttcctcccctgcttacatcggcggtgttgcagtcggaacgatgatttttaatacgatgtattggctcctcggttttttgcgggtaagcacatccggattcgccgctcagtcactcggctcccaaaacagatcagagagcgttttggcccttgcccggcccgttttcatcgcgctgtttgccggactgatgttcatcatcttgcaaaaaccgcttgaatacgcagcgctgacgctcatacagcccgaccgccataccgctgaattcgcctcgcagtatttttcgctgaggatttggggagctccatttgctttaatcagctattgcattctcggctggctgatgggaatgtctctaatcaaagtgacattgcttttgcagatttcgatgaacgtcttgaatatcgtgcttgacatcgtttttgtctacgtctttcacatggaagtatacggcatcgctctagccactttgatttcggatgtgacgggctgcctgatcggctgctggcttgtgaaaacgaatgccgccatgccgtttaagctgccgtccgtcaagcttttattcgacccgaaaccgtttaaaaaaatgatggttgtcaaccgagatctattgattcggacattgtgccttttgacggttttcaatttatttacggctaaaggagccggcttcggcgctgaaattttagccgcaaatgcgatcttgattcaaattcattatttgatggcttatgtttttgacgggtttgccaatgcatcgagcatctttgccgggaaagccgttggaagaatggatcgggatctctattcccgtacgctttccctttcgatccagtggtcgctgatctcggccgcgctgctttcagtcggctactttctcttgagaaatgcgatccttccattgtttacaccgcttgaaagcgttctggaagcagcgaaaacttacgatgtttggatcgctctctttcctttggccgcaagtttcggactcgttttttacgggattttcacaggcgccaccgaaataggcccggtcagaaattcaatgtttttggctgttctcgtcttcctggccgccttttttaccgctgtccccgctttcggaaaccatgggctgtggctcgcttttcttttattcagccttgggcgttccgtattcttatgcatggctgttcccgggctgaccacccggcttttcggagagcgcagtgctgcgagagaggcaggccaaagaccgaaatcattaaaacaccccggctaagctttagccggggtgtttacgtttattctttcgttaattgtgcgacgaaatggttcagatgatccagcgtcatcaaattttgattgcatttttcactgtcacagcaaatgtaattgcctctgtccgtataggtttctttcccgcttttcacgcgggccatgaacagtccgatctcttcggtcctgttgcatatcgagcagattccttttttattgctggatttgatggtgccgtggattccggtcagctttccgccgacgtccacaatcatgtatttcctgcctgatcctgcatcgttccatcccaggtaggaatatccgctgaaatccatctgctcaaattcgggcgtctttagttttttcactttagagaacagctttttagcagtctttaccgttacattctgaaatggaatcacatgaagttttaattcagctaaaaagcgcaccgcttcaccgctgtcttccacttctgccagcttctccagcaaagacttttgatcgctgctgagatcaggaaacaggttgaacacttgatccagcgcattgcacttcaaagcgtcaaggacgttttcgtcattgatgttcgcatgtccctggacgaggctgtccgtttgaaacttaataaaattatattggtcatttctgataaaaggtgtcttcatttctgccagctccttatttatagatctatattttaaaataaggtgcaaagccggatgatcagaaatgataccttgctctgtcaggcgatttgtttataaccccgcctcatgcaaagtatcgcctttcaagataacaggctttgcatgagacgctgcagtcggcaaatgaatgtcatttaccattttatccacctccgaatactgattccattataaacgacaatcgtattcaatctcaatgatatcctctatctttaaaatgcaaatttcatccgcccggcttacgatccgcagctcccttttcagagcgtcagcatagtgaatccggccggcgagcgttttcacttccccctgccggtaataagcaaattgcaaaaacctgttttctgccatcgcttcacaaatgatttcattgaattcttcatatttttgttcatccaggatcggttttttgattttttgaaagctttcatgatattccctgagcaattccacgtgctcaggcagcatcatggaaacccatttgatactgcctctgtcgcgaagcataaatgattctcctttctatgcctgatggcctccgaccaattttgaccgcagacgggccgtcccggcgtttgtgtaggaaacggcccgcaaaagcgctgttgagccgtaccgttctctgatgccgtccatcacatacccgagctgccgcttcttttcctgatcggggcgaaaaagatcaagctgcatattggtgtcatcttgaatattggacaaagagacggaaattttccgaaccgttttgccggcataaaaccgctcgaacagtgccagacatgtatggtaaagatcaagcgtgacatttgaagggctttccattgtttttgaacggtaaaatccgccgccaagctcatcgcggctgtattcgatgccgagactgacggtccggcccgcctggcggtgggcgcgcgcccttttggccacttcctcacacatttcaagaatgacatgcttgacttcctccggattcggataatcgcgaagcagaatctggctttttccatagctgacctgcccctccatgagcggcgctccaatcgctgaaagatcgatgccccaagcgtgataatagagctggtttcccatcaccccgaatgttttctcaagccgactgagatcatagtgcgccagctggccgactgtaaaaatccccatccggtttaacgtcttttccagcctggagccgattccccacatgcggcgcagcggagacagcggccacagcttcgttttcacgtcttcgtagccccaaacggccaccccgcctgctgattttttcgcttcaaggtcaaggcacagctttgccatcagcagattcggtccgattccgacagcacagggaaggccaaactccctttccatatcatcttgaattttcatcgcaatcgttcgggcgtctccccacatgctttcaacaccgtccacctgaataaagctttcatccacgctgtacgtatgaatggcatcaggcggcacatagcggcagaacagccgggtgagctctgtagaaacacggacaaacagccccatcttcggattgaccagcttgatgcgcggatcatccggcagctgataaagccttgttcccgtttgaacgccgaactctcttttcagagccggagaagcagcgagaacgatgcttccctgccgctccgtgtttccgacaaccgccaagaagcaagtcatcgggtcaagtccgagcagggttccggcgcagcttgcataaaagctccgcatatcaacgcacaaaaccgaacgcgacggatattgactgtaatccatactctccctccagaagaactgatgttcgcacaattagtgtatgaatactatactccgaatatacgttcgatttccaggcgtaattttatccaaagaaaatcctggcggaaagcaataaaaaacaccttctttggaaagaaggtgacatggttgaccattccagttcggaatttcgccttattcagtttgatgattcaaattgaatgctctcttgagaacatcagtttttcttagtaagataaaagaaaaagcgctcctaaaggagaagacaaatggatgagaaactgattgaaaaaatgctcggacaggcgctgaagcagtacggacgcaatgttgcaaccgatccgctcagccccggcgaaaaagaaatcctgaagctggctttgcaggaaaggcggatcgaggagccgaatgaagggctgcatgcccatatcgaggatgtcatctatgattatgtcacaaatcaaggcttgttctcatcataaaacgatttttctttgcggcttcctttgtacaggaagccttttatcacccagcatttagaaattcctctattcaccgccatctgtttcatgtatgataaacaaataaaaacgtaacggagagtttatcatgaaacaaaaatggcagaacatccacccgctcagctggaccattattgtcggaaccattttcggacgcatgggaacagccatgagcatcccttttttagcaatttatttgacacaagtgaaaggcgcctcttccggctttgcgggagctgtcattgcagcgagctctctgatcggaattgcggcaagcttttatggcgggtacttatcagacaggttcggccggaaaaccatcatgctcgtctcgattttcggctggacgttcgtgttcgccggttttgcactcgccgatcatgtctggacattctttatcatgaatgccttaaacggattatgccgcgctttgtttgaaccgacttcaagagcgctgctttcagacgtatccaaacccgaaacgcgccttttcgtctttaatctccgctataccgcgatcaacctcggcgtcgtcttcggcccgcttttaggcctgtatctcggatcttccaaaacgacgctgccgtttttcattgcggctttcatttattttatttatgcggcggtgctggtcattcaatttaaacaccacaccgtaccggcagctgagcgtaataagcgtataaaagtgcgggacgcgctggaggtgacaaaaacagaccgggtatttacgattacgctaatcggttcgattctttgtttgttcggatattcccacttcacatcgacgcttgcacaatacatggcggccagcccgttcattgaagacgggacgaaagtgttcggcatgatgctgacgctgaatgccttggccgttcttgccgtacagtacccgatcgtacatatcgccaaacggttttcaccgattttatcgctgattgcaggaaatgtgctgattagtggaagcctgttcagcctctcttttttccatgatctatggtccattgtcttgatcattatcgtgtttacgatcggggaggtgcttctcttttcgatgatggatttactggtcgaccggattgcccggcctgagctgaaaggcacttactttggggctatgggcttcacccagcttggaagcgtggtcggcccttgggcggggggaatgctgctggacacctttggagcggaaaaaccgtttttcacttttgcaatcctgtctgctgccaccatttgcggcgttcctttcctggtagcagcctaccggaaactcaaaatggatgaagcaaaagtcaatttaagttcgaaaaaaacgatgcagcattaattgaaaacaggccggctcgaacaaaggccggccttcggctgccgcccgcctcaaggggcagcaagttcaactttgatgcggtccggatcttcggtatacaaggcataatgcccgtttccgccggcaaacggatgtctgtcttcatataaaatgcggcatccccgctctctcagtttcattgtcatttcgtcgacctgctctttggatgccgcgtaaaaagcaagatggtttaagccgacgcggcacctgtgataacccgctttgataaactgctctttcgcctgcacaagcacgagataggcgccgtttgctttccagctgatgccgccttcccattgttgaaaaacctcatagccgagctccccgagaaaccagccccaaaagcgcttcgacgcttccaaatctgaaacgtacagttcaatatgatggatcatgcaagcctcctcttctatacccgtctgaccaaaatctcttccaccttgtggccttcgccttttctcaagattaaatcagaccggaattttgtaggcagaatgttctcatacaaattcggacggttgacggtctcccatattgactttgccatatggtccgcttcttcgtccgcgaggtctttgaatttatggaaataagaactcggatcttgaaaagccgtctccctgagcatgcgaaagcgttcaagataccatttgataatgaggtcttcttcggcatccacataaatcgagaagtcaaaaaaatcggaaacgaaaacccgcggttttgtacggtcgtcttcgatcgtcggtgtctgcagcacattaacgccttcgatgatcacgatatccgcttgttctaccgtttcataaaccccttccaatctgtcatacgttagatgggaataaacgggtgcgtggacaatttcctttcctgattttaaatcgttcaaaaactcaagcagcgctttgacatcatagctttcgggaaaccctttcctcgacatcatctgcttttctgtcagaaccgcattaggataaagaaaaccgtcggttgtgatcagactgactttcagccgttcctgcaaacgggagagcacagtctgaatgatgcgggccgtcgtgctttttccaaccgcgacgcttccggcaatcccgatgataaacggaatcttggccgcgtgaggatgattcaaaaaaccgtttacccgggtgttccgttcatattgagttgcccggtgtaaataaagcagcctcgccagcggaacataaacggtttcgacttcttccaaagacagatagtcatttaaaccttcaagcttctttacttcctcttcggtcatctttaccgacatatgcccgccgagatttgcccaggcatcacgggtatgactcgtatataacgtgtgcaaattcaaatcctgattcgccactattctcacctgccctctgttcaaacgctgtttacttaaaaaagtgcatgaattctgagaccgctttattattatatagaatttttcgaatatttacgaggaacaacgtttcaatcaaaaaaaccgtcttcctccagagacgggtgggtccggtttccttgcatggcggatgcgaatggctctccttcctgtcaaccctgagccaacgggtgtccttcgtttgcaaaagaaaaaagagcgcaggcgcccgcactcttttttcaaacgacatatttgctttgcctgtgcgccatgtaataagtgaccgcagacagcaagccgacggatgcggctaaaatgatgatgaccggaatcatgtccaccttcaccggtgtaaacagtttaaagccgccgctgaaactgaaaaccgcatgcccgagattagacagcaggttttttaaatcgaacctgcccaaagcagggatcagcaggctgtaaacgacataaagcaaagcaggcgtaataaagcttctgaagaggacgcccaaataaaatccgatcgtcgaaaagatgaagctgaccgccagaacgacagcgagctgaagcaggatattgctttttgaaacagcgggtattgtgaactcgccgaccggtatatcccttgaagcaagggaataaaagacgaggcttgacacatatgccgtacatacaacggcgatcacggcggcagccatcaccatgtaaaccgaacactgtttggcaaacagaacggatttccaatcatggctgaccgctttcactttcatcgtcttgaatctgatgtcgtatgaggagatatagatggcatacagcgtgaaagccaagggaaaaatgatgaagcccatcagctcaagcgtcatagtgactgactgtttcggctccaggtgatggagggacaagacgaaattctcatagtcgaaccttaaaatattttcgacgatctctccgtcgccatcctcgcttttcagctcaccttccttcaccttgacgggcgactccagcgcctgcttaatatcgatgccgagttctttatattcattttcagtctttttgaactgctggtagctgtccattgtatttttatagtgaacatatatgtatccggatgaaatgaataatagaggaagcaataaaatgatgagcaatttagaatacgattgaaatgcaagctctttcttgaaaatattataaatattctttatagacatcgcccaattctgctccattcgttttaaaattgtctatgtggatagctgaaccgtctttcaacacgtataattgatcgacgattgaagaataaaactcaaactgatggccggcggcaacaatcgtcatcctgcttgaccagtcattgatgagctcctgaagctccatcatggaccggtagtcaagcccgtttgatatctcatccaaaaacaagaatgacggtttgtttaatgcagcgatcattaaggccagctttttcttttgtccgtatgaataggtcttgaccttttttttcagcagctccctgccgagaaacttttgcgacaattgttcaagctcttctttgccggcaggtttattgatcagtagtttgatattttgatagccgctcagatgatcgtaaaacggggaatcgtcatagatgacgtggactttgctcctgactgcttcaagcggctcgccgtcgtacagtatgccgccttcgaaaggttcaagcttgagcaggcatttcaagagcgtcgtttttccggcgccgttttctcccatcagaaaggtgactttgtttttttcaatattcatgttgagacggttgaataccgatttgcttccataagatttcgtcaggtcatcgattttgatcaatttgaaaaatcctttctcgcatcaggatggtgttgcaacattctccattatacaacgctgccattaatttctaaatagtcttttagcagcgttgtatgaaatggcttatagtaaattaatcgtttccgtattttccttttttattgacccaccttctgtctgtaaaggttgagctggccaattcaacatctcccccacggtgtaacggttccgaagctcagcgtttttttcgctctccatttgtgaagccctgatgacttataataccttttaatcccctttgccctcaccacattcggaaagacgtagccgacatcctgcgatccgctgcttttcgatacttttttgccgttgtagtaccagtcgatataatcttttgaccaggcgaggaagcttcctccttttaattgtcagccctttttcctgcataagccgtcacaccgctttgaacggatgcctgttcaggaagtgattgaacgtattctgtcttggcttcaagcagttccttttgctcgcttgtcagctgcccgtccccagcagccgcagcgaatgaggatggaaccaggagcgccgcagacaaagaaaaccctaaaatcgcttttttcatttcgtttccctccgtgtttttgaaatatttgtatgtacgtcttcagctgccatccataagctactgccacatccaaaacaatttaaggtccgagttctcttattttaatggatgaaaaaatagattcctagcaaaatggaccatttcatcgttacctattggaaactatcccctcctccctctcgtaaaattataacatatttttccttaccttcaatcaaattctcttattttaccatttttcccgagggtgttcttaggcgaacacctattacctctgattaaaatgtaaatttgtgtattatttttgaattttattgaatttctacacaattagacatttttttctccagccgagtgataggatgtacatgcctatgatgtcataggcaaaaaaacaatctttaggaggtcgttagggatgtttcaaaacaaaatcaaaaaagcagtcggagcggttgcatttgcaggtgctttgttagtgtctggattgcccgtaagtgcggatacactgcctgaattaatatgggtgagggacaagtatcccggtgcgcaatacgaatataaggtaataaatggcgagagatatgtcgatgtttacagagtaataaatggtaaaacagatgtcacacgcgaaaaatgtgaaacgatgtaccaagaccgctgctatgtcaaaaaataaacaacgtgcagctggcgtctgaaatatgaacatgcttcgatccgcttttggagaacagagcgtgaacgagcggctgattcttttacagacgcgggctttagagcgcaagcaagcgggaggcgttttgatgcgcctcccgctttccgttctgtgaatgtcgatcttttttaaaagtcaacaaccgctgcaatgaaactgtgttcccctctattcattggaaaaaggcattcctattaaacaaggcatcccaccgatcagaacgccttgttttttcaaataaattccttatattcatccttcggccactatcctttaaagccgttatcgagtacctcgatcatcgaagaagtcgtttttgcatggttttttgtttgctgcacaagcttgatgatgtcttggtatgcctgctgcgctccaagcaccagcaaaggaaccccgatcggatcgattttcagcctcctcgaaaataaaccgccgaatgtcatcgctattggcacagtcggagacgtgtttgaaaaaatgactttctcctgaagtttcccgtttttttcaaacagctcgagaacgcctcgcatggctggaatgacagcttttgacgatcctctgccgatcgtgtacacctggttgccttcttcatcaagtccgtgaaagattaattttcccatttccttcggacttaattgattaaaacagtcggtgcttaaaatttcgtttcttgttggttttctgctgaatgggagctttttcagatgataagcagcggcaagtgcagatgaatgagtgccgccgtaacaattgtatatatagatcaacctgctcaccctcttcatgtctttggttttaatgtggcccaaatatacaatgcttatttatacctcgtttccagaacttctttaacagctgagacatacgcttgaaacgtctcatttttagaacttgcccgcgtccacaggccgaactccgaaaaaaaagcctctcgttgaggcgtgctgatttccaattgaatgctttgacctgttttgcattgattattgatattttcaggatttcctcctgcaagccggtggctcgggctgaccagctccgccgaaaaacctttgttcagcagcgctctgacaatcgctttcgcccctcctgtatccgttccccccacaagcgtatgttcaacgatgtcatgatatccatgaaaagccagcacatagctgtgctctttgaccgctttgagggcctgaggttcatcaaaatgattgcttgtgatgtggagatcccagttttgcgagggtttgattccctcaaataaataagtggaataatcggcgctgaaggcgcggacaagttcactgacacctccttcgattcctccgccgtgcggtgaaagaatcaacagttcggtgcccatgtctgtgtattcgatttggtaatcttctccttctgtttcatgttcggcaagctcggcaaaattggcgtatttgtctgcggatgaagcgacgcttttcagcggaaattgaaagatgaccgttaagcaaatccccgtgactaaccagatgatgcaacgatttttcatcaatgggttccattcttcctgcaccgttaagaaactccttttatcgtgtattttgttgcgagtatcacgtgatatcatgtttcggccgggatgagagaattccaataaatggtaaaatattactccctttcgtcacccagttgccattttatataagaagaacggcaaaacgaaagcgacctttaccttatttttcatcagcggccggcacgtgttcccggaagcacggaatctttcggcgtgccgtatttttatatcaattgcctcaggctggacaggtgccatcagatcaagcagcgcttaaagaaggaagcagaggttcgatgccgggttttgcagagggacaaagtctccctgtttttatatgatattttgagcctctctgcagggggcatcgctaaaaaaatgcaaacaaaaaaggaacggatgattccgttcctttcttcgagaaaccattattttttatagaaagcgcttcgacctgttcgttcaaccagcgaagggaaaagctggtagagtttgctgacgctgttcatccagcctggaagattgatttcgcgcttgttcgtcatcattgccgagacgattttcttagcaacccgatccggatctagcatccatctcccgacgctttttacataatcgccttttttatctgccgtcttgaaaaagtctgtttgaatcggtccaggattgaccgttgtcacgttgacccctgtttctgcaagctccattctcaagctgtttgaatatccgagcaccgcatgctttgttgccgcataaaggcttgacttgggcgtcgctattttgcccgcttgtgaagcgatattgataatatggcctttgtcttgcctgatcatatgcgggagtgccattttcgtgcaggcgatcagaccgaatacgttgacctcaaacatcgctttcatatcttcaagggaagcgtcaagcgcgctttcaaaaatgccgaaccccgcattattgacaagaatatcaaccggaccggcctcttgaaacgccgcttcaacttcatccgtccggctgacgtccaatacgattatacggcactttgcgccggttttatccgcgatgttttgcttcaaagcatcgaggcggtctcttctgcgcgcagccagaatgatctccgctccttcccctgcagcatgatatgcgatccgttcgccaagccctcctgaagctcctgtaatcatcactttgtgcgctttcaacttctgctccatgttcgtcacctactttgcataatagtaatcgattccatcggccgcatcaactccgatcctcccctgggattccagatcgtcaagctgcccaatcgtttctgacagtgttaagaacagctctttttcatagactgcagggaacagttttcgacatatctgataaggtgaatgcggtttttcagagaggatgcggtacacctcttcggctctgtttcgctgcttttccagccttttggcgacaagctcattcacttttgtgatttcctccccatggccgggataaatcatgtgaagcggaagctcctgcagcctgccgagagattccaggtaatccagcagcggagtcgggcgtttccctcctttttgcggcacttccagaagcggatttgaagaagacggctttagcagcaagtctcccccgagcatgcttccaagttcttcattataaaggacaatatgcgaagcggcatgtccgggcgtctcaagaacccgccacccgtcaagcccttcaatttgcccaccttctgaaacggtctctgtcaatgtccgattacatgaataccggtacgacgcttttatggtatggcctggcggcttcatatcgccgggaacgccgaatcgttgaaacaggtatgtaaaaaaggacttttgtttttcaataaaatcgggattttgactgatatacggttcattgaacggatggccaatgatttttacctctgccgggaattcgttcagcagtccggcgtgatcagcgtgatggtgggtcaggacgacctggtcgatatcgcttaatgacagtccctgttcggccagctcgctcttcaaaacggctgccgccctcctttgtgttgggcccggcatccaccagagtgagcgcctcgcctctgagcaaataaatgttgacgtctccgactgcaaacggagtcggcagtgcaataggaatgattcttgcgtctttcatcgttttattctcctcatcctgcgaattgatgttgatcatattttacctttttctcccgcgcatgtcatttttgcctcaaatgcctgttgacatttcagcattcctcatagcataatgaacaacaaatatatgaaggtgaatgaatgaagacgcgatgaagaggaatagtaaacgagcaatggctaaagagagtgaaatccacggctgaaagatttcacagcccgcttgcctgttgaacctgccctcagagcgcttaggcaaacctaaacgtatcccgcgttacggggcaagagctgagcatgtatatgctaatgaaggtggtaccgcgaaaccttttcgtcctttgcgaagacggaaaggtttttttgtttttagaaggaggaatcaaaatgaaacgaataggatttatcggagccggttcgatggctgaagcgatgattaaggggcttgtcaaaagcggtgcaatggaacctgaggcgatattcgttacgaatcagtcgaatacggccaggcttcgtgaattaagcgagacttacggggtatgcggagaagcagatacggcaaaagtcgccgcccggtcggatacactcgttttggcgatgaagccgaaagacgcggcaggaggaatagccgcactccgcccctatttgcgaaaagaacagctgctgatctctgttcttgcaggcattccgattcatacgatccagcactatgccgggcttgagctgcctgttgtgagagccatgccgaatacatcggccgccattcaaaaatcagccacagcctttgcggcaagcccgcttgtcacgaaagagcagatgcaggaagcggctgacctctttgcgacggtcggcagcgttacaatcgttgaggaatctgcccttgatgctgtgacagccgtagccggaagcgggcccgcttttgtttatcggtttgtcgaagccctgcaggcgtcggctgccgagctggggcttcctgaaaaaacggcgaaacagctgattatcgatatgatggcaggagcggctcaaatgcttgaaaccggcagagatccttctgtcatgaggaaagagatcacaagcgccggagggacaacggaagcaggccttaggatgcttgacgaccatcaatttgaacagaccgtcatatcctgcgtcaaagaagcggcgaatcgttctgcggaactcagggatatgtttgccgccaaaatttaaaaaagtcgggaacagcgttttcgctcgttcccgatttttcttcaagcggtcccgtatcttagagaagcttgtgtatcgcgagccggaggatatctggcagctttccaaatgaaaacggcacatggagacgttccgtccatttgtgaggatctttgccggccggcccgatattgatgaccggcacaaacagtgcgttttcgcgtccttttggaagtgaatagccgtgatgaaaaagcggcatattggatgtgaacgcatcgactgactgtttttgcagctgcaggtagcttaaatcggacaggccggggaaatattggacttctgtaaattcaattccgtgcctgtcggccgcatactgcttcacttctctcatcacctttcggatcagaggatcgtcctttgaagaaacagccggataaaacggcggactgtaaaacagaacgatcatcggagcatcttctttgcagagtgaagccaattcagagacgattttcgttgaaaagtcgcggtctccaagctcccccctgttcgcaaatgcaaagttgaggatgcgttccgcctcgggcttcccggctttttcctgtgctttgttccacagctcctcaaacgtcatcacggaaacggccgggttaattggcgtgaaggcttcaaaccgctgatattcggccgttttacgttcgatatttgtttgaatattggcggccgcttccctggctgtgtcgagcagcatgcgatggagctcggcggcggaacgctgcatcatcagcacattaaagagcgacaccgctgtgtgaggagtctgaaccgagtaggcctccttcagatctttttgcatcagattggccgggggaggcgtcacctctccgtccgcttcttcgcaatagtcgacgtttaattcgagcagcctgttgatctcagacaccattagattcgcattcacccctgcaaacggctcgccgacatgcgtctcaacccctttgcagaaaaatccggcaagcgctttgccgatgctgcctgaatagacgtactgcttcggatcacccggatgtttttcaaacatcggctcacagtttaagcacgctgtataatgaaggccaaattctttttctaaagctttcagtacaggtactgcttcaagcatcccctgcgagttgacttcttcgtccggaaccgtaattaatagaaggtttccgtcaaattctccgttcatcgcccgttccagcatagaaaattgaacagcaagacccgctttcatatccatgcttcccctaccgaacagccattcgccgctttccaggtcttttttgacccgttcaggcaaaagttcttttttatcatttaataggtccatgagttccgggactttgcatgccatatgtttgaattctccgtagtctgccgtatcgaccacgtcaaaatggctcaagaggagcaccgtatttgatttcttttcctttttgacgagggcggttaaaaaatagcgcccatcctccatcgggtgaagctttaagtattcaggattcttttgaaagtacgaacggtcctttaagacatcatgcatatatttcgcaagcgccacttctccggccgtgcctgagatgctttcgtattgaacaagagaaatgagcagccgtttcagttcttccactgtctgccacttcacaaagcaagccccctctttcactgttttccgcaaatgtatgtgatatcatatttagtaaaaaatagaatgtgtacaactttattgtactgaacattcttacatatggaaatgacttgagcagtttatatgacgagaatgggcagaattggtataatcgaggcgaaaacttacgggaggcgaaaaaatttgagtaatcgaaaactattcacaccatggagtttaaaaggagttacactaaaaaaccggattgtcatgtcgccgatgtgcatgtattcctcccatgaaaaggatggaaaagtgcagcctttccacatgacccactacatctcccgcgccgtcggacaagtcggactaatcatggtagaagctaccgccgtcactccgcagggaagaatctctgaccaggatctgggcatatgggatgacgcgcatattgacggacttgctgcattgacgtcacaaatcaagacgtacggcagcaaaacggcgattcagttggcgcacgccggaagaaaagccgaggtcgaaggtacaatctacggaccttcagcgattcctttcgacgaaaattcgcgaacgcctgttgaaatgacaaaagaggacataaaagaaaccgttcaggctttcaaaaaaggagctgaacgcgcgaaagccgccggctttgacatcatcgagattcatggagcccacggatacttgatcaacgaatttttatcaccgctttccaacaaacgcgaggatgaatacggaggttcaccggaaaaccgctacaggctgcttcgcgaagtcatcgacgctgtaaaagaagtctgggccggaccattattcgtacgcgtttcagcttcagactacaaaacaaaaggccttgatgtcgccgattatgtcggtttcgccaaatggatgaaggaacagggcgttgatttgatcgatgtcagctccggtgctgttgtgcctgctgatatcaacgtcttcccaggctaccaagtcggcttcgccgatacaattcgcgctcaagccgagattcagacaggagctgtcggattgatcactagtggccttcaagctgaggaaatcctccaaaatggacgcgctgatctcattttcgttgcacgggagctgctgagagatccatactggccgaaaaccgctgccaaacagttgaacacaaaaattgaagggcctgttcagtacgacagagcctggtaaacttaatatcccgccttatggcgggatatttctttttttcaactcgtgagaaacgaacatccttgtttgtgcgtctttcctaatagaacaccatatacaaagagaggatgacctctatgaccataacggaaagaatatatactgttgaagggtgcatgttttatacaaagcagagaaaaggaaaaaagaacgcaacgattatttttgaagcgggctacggtttttcttcaacgacttggcagcccattttatccgatatagacgaagatctcggcttgtttgcatacgaccgtgcaggccttggcaaaagcgggccgagcaccagcaaacgaacagcggatcagatggtgaaagaactaaaagcgctgcttgcagcagcagacgtcaaaccgccctacctgtttgtcgcccattcgttcggcgccgtcattgcaaggctgtttgcaagccggtacagcgatgaagtcatcggcatggtgctgcttgatcccgcttgtgaagatcaggaggaaaaagtgctgccgctacttccggacacattaaaagaagattatgtcaaacagttttcgatcgaagggtcccatgaggactttaaacaaagcctggacatgctgaagcaggaaaagaaacacctcggttcggttcctttgctcgtcctctcggcgggaaaaaggacggaggcggcgaagcaagctcatcaagaatggctgaagcttcacagcagactgctgtctctatcgcatcaaagcggctggattcaggcgaaaaacagctcgcatttgatccatcatgatgagccgcacatcgtccagcttgcgatctatgatgtgtggtatgcggcacagcagcaaacatacgcctatcaagccgccaattaaacaaaaaaccagcagacagtctgctggttttagttattttgtttcacggtgaatcgtgtgccttttcagacgcggagaatattttttcaattccaggcgatccggatttgtgcgtttgttttttgtcgtaatataattgcggtcccctgtttcggtgcacgccaatgtaatttttactctcatgttgtcctccttaataaaacgtaatcattacgctttattatacatcattttagaaccgtgtcaacaaaaaaagcttcccgtcccggattgtcggaacaaagaagctttataactgcccattaagttcttttgatctcatgctcataaaagtcaaaagctgccacggtatcaggaaagatcgcttttgcttcatcgaccagttcaagcacgttttccccctggtatcttgcactgatatgggttaaaatcagtttttttgcacaggcttcccgcgctgtttcagcagcttgttctgaagtgctgtgataatagtctccggcgagctccctgtcgcctttcgcaaatgttgcttcgtggatgagaacatcggctttttcggcaagcctcttcacattctcgcatggcctcgtatccccggaaaaggcgacaatccgccctttttttggcggtccgataaagtctgccccatgaatcgtccggccgtcttccaatgtgaccgtctccccgtttttcagtttttgataaacagggcccggcgagactccgatctctttcagtgcttcagcgtcaagggcgcccggaacatctttttcctgcacgcggtacccaaaagcgggaatgccgtgagatacgcttctggccgtcacgataaactggtcatcctcaaagactgtcccttctccaatctccttaatcacaagcggatatgtgacatgcgtccccgatacgtcaagcgccgtttcaagaaacgttttgattccttgcggtccgtatacggtcagcgggccttcccctccctggaaagatcggctgctgacaagacccggaagcccgtatacatgatcgccgtgaagatgggtaataaaaatcttttcaatttttctaggtttgatcgatgtatgtagaatttgatgctgtgtggcttccccgcagtcaaacagccaaacagaccgcctttcttctaaaagcttcaatgcaacggatgtgacattcctcgtttttgcggggatgcccgctcccgttcctaaaaataataactccaatatcctttcctcctgctaaaaacttcatctatcacaagcatacaggaagtcttggaaaaaagaaacgccggcctcgcgtcgggctatgcaactaaataccctgaccgttttcagtaaagttttcatacgattcgatctcaaatgtttgctttaagggattattagctttaaaatgaagaaaataaacttatgcttcgaataaagtgaggtacgtttaattgaaaaaagatcaaatggaaccaaaagcagttatcgtaatatttggcgcaacaggggatttggcaaaacgaaaactatatccttctatccacaggctctacgaaaacggacaaatcgggaatgaattcgcggttgtcggagtcggcagacgcccttggacaaatgaagactttcgcagtaccgtacagcaatcggtttcgaagtttccgttaaacgaaaaggatgtggacgagtttacatctcacttctactatcatccttttgatgttacaaattccggctcataccgggaattaaacgaacttatagagaagctggaaagtacatatgatattccgaataaccggatgttttacttagcgatggctcctgaatttttcggaacgattgcaaagttcctaaaatcagagggtgtcacttcaacaacaggctggtcaaggctcgttatcgaaaagcctttcgggcatgatctgccgagcgcaaaagccttgaaccaggaaatccgtgaagcttttacagaagatcaaatttatcggattgaccattatctaggaaagcaaatggtgcagaacatcgaagtcatccgctttgccaacgcgatttttgagccgctttggacaaacagatacatctcgaacattcaaattacgtcaagtgaagatttgggtgtggaagacagagcgagatattatgaaaaatcgggtgcgcttagagacatggtgcaaaaccacattcttcaaatggtggcgctgcttgcgatggaaccgccgatcaagctgaacacggaagagatccgcagcgaaaaagtgaaggttctcagagcccttcgtccgattcaaaaagacgatgtcgaccaattttttgtgcgcggccagtatgacgcaggagtcgtcgacgaaaaacatgttccggcttatcgcgatgagcaaaacgtagcaaaagattcgaatacggaaacgttcgttgccggcaaactgctgatcgacaacttcagatgggccggtgtgccgttctacatccggacaggcaaacggatgcagaaaaaatcaacgcagattgtcgtccaatttaaagacattccgatgaatctttattacggaaacggcaacacgatgcaccctaatctgctggtgattcatattcagccggatgaaggcatcacccttcatttaaacgcaaggaagcttggaggcggcacttttgcccagccgatcaagctcgactactgccataactgcggggacggcatcaacacgcctgaagcttatgaaaagctgattttggactgcttgcacggagacgcgacaaactttgcccactgggatgaagttgcgctttcctggagttttgttgatgcgatttctcaaaactgggaggaaaacaaaaccctttcccctaactataaggcgggctccatggggccgaaagcttctgacgacctgctcgcaaaagacggctttcattggtggccgctttaataaaaaaacagccttcacaattgaaggctgtttttttatgctttcaaggcctgcatctcttccggatggcttttgtcccgcttccacatcagctgaaggacgaacagcagaaggaatatgccgaggccgatcatatcggaatagccttctggataaatcagcagaagaccgctggcagccgccagtattctttcaaaccagaacacttttctcatccagaatccgatcatgccagcgccgatggcgatcattccggacaatgcggtaaagaccacccagagaatttcataccaatgcgcatcaatcatgagaagctccggagacaggacgaatatatacgggatgataaaagcggcaatcgcaagctttgctgaattgatccccgttctgatcggctctcctcccgcaacccccgcagctgcaaatgctgccaaagcaacgggcggcgtaatgtcagctacgatgccgaaataaaacacgaacaagtgggccgacagatcaggaacattcagcaaaatcaaggctggcgcggcaatcgtcgacgtaatgacatagtttgccgtcgtcggcgaccccattccgagaacaagagcggcgatcattgtcaaaaagagcgaaggcaataatgcgcctcctgccaaatcgagcaggccgtttgcaagtttgaggccgagacccgtctttgtgacgactccgacgatgatgccggcagctgccgttgccgccgcaacggaaagcgccattctcgctccttccgcaagagccagcacaatccctttaacgcccattcgcgtttctttattgaacaaaccgaccaggatcgccagaacgatcgaatacaaagcggcatgcatgaccgtgatgcccgacattaacaaaacgacgaccgaaatgatcggaagcagcaaataaatctttttgaatacttccttgcggttcggcatttcttctttcgttagtccgcgcaggccgaggcgcttcgcttcaaagtgcgtcatgatccagatgcccgtaaagtataaaacagccgggatcgccgcggctttcgcgatatcccagtacgtaatgcctccgccgatgaactcaaccattaaaaaggcggcggctcccatgatcggaggcatcagctgtccgccggtagatgcggaagcttcgactgcaccggcgaattcttttttatagcccagttttttcatcatcggaatcgtaaacgatccggaagtgacgacattggcgacagagctgccgctgatcgttccctgaagggcgcttgaaaaaatcgcgacttttgccggtccgcccgtgcttcgtccggcgatcgctacggcaaggtcattaaaatactgccccactcctgtcctgacaagaaaagaaccgaacaggatgaacaggaagatgaaagtcgaggacacagcgagcggcgtgcccaggattccttccgtcgtaaaatacatcgtctgaacgagccgttccatcgtcaggccgttgtgagacaaaaagcccggaagatacgagccgtaaaggccatacaaaagaaacaggccggcgatgatcgtaatcggcagtccgacagcccgtctcgtcgcttccaatacgagcaggacggccaacagcccgacataaaagtcagtttccgtgatcaatccgatcccgcccacaatcgtttcataattggcgacccaataagcgccgacgcctgctcctaacacggctaaaattgcgtcataccaggcgactttgaatttgccggtcttccgcaaaccttttgtcgccggaaacagcaaaaaaatcagaccgagcgcaaaccctaaatgaacggacctttgaatttgagccggaaaaacgccaaaaatggctgtgtataattgaaacaaagaaaaagcgagcaggccggcaaatgcaatggcccctgtcaatcctttgagctttctcgttcccgcttcaggatcgtatttctccagcagttcctgctgatctttttccgaaagctgctcagtcattgatcttcactcccctcagttgttgcaagacatttagttttcggacactcatccttgtccatgtgccgggacggatgtaccgctttaactcatgttcagcgcctgaatacttgatcctgtgattcgccctcaccctgccgatccgcatatcgatgaacggaaaggtcctcttcatgttcgaaatggtgtagacgccgtttttgatgtcgagcctttcaccttgttctgcgtttgcgggcattccgacggccggatcatgataggtcagagcggtctgccgaatcatccctttttcccacacatacgattcgatcacttctgtccgatggatggaatgcgtatagaccacatcaaagcttttcttcttttggaggggaagaaaagcgatgatctcgccgctgtcctctttctcgaacacgacggcggtctgataaggaatcaggcatgccgctgcaaaaacggcaatgatcagcgccggcacaagccgttttatgatttttaatttccccattttttccatatcccctgccgaatagaaaaacgatagaccgatgtttcattgcaacggtctatcgattgcccgggcttattcatcgcttatcttccttggttttacgatttttcgatccctttttctttgaagtatttagccgctcccggatgaatgtcgatatcgcccaatccttcaagcgcggtttcaggcttgataaactcgcctttcgcatgattgattttatcggcttcaaacagcgctttcgtcattttatagacggtgtcctcatccatcttgtcggatgcgacgagcatcgctttgacagcgaccgtgttcacatcgctcccgatgccgtaggttccttttttgatcgtatcctccgcatagaacggatacttttcaatcagctttttctgcttgtctttttcaatgtttataattttgattttattttgtgcggaaagcccttcgacagcgcctgtaggcgttccagccgtgatgaatgcggcatcgatagcgcctgactgaatgccgtcggttgattcttcaaaagacaggttttgcggtttgatgtcgtcaaaagacatcccgtgaacctccaaaatctgcttggcattaatgttgacccctgctcccgcagcacccacggaaaccgttttgccttttaaatcctcaaccgaattgattccgcttttttctgttgtcacaatctgtacagtttcaggatacagggcggcaatcgccttgattccctcaattttttctttaaacatctctttgccttctatggcataagtggcaatgtcagtctgggaaaaagcgacttcagcttcccctttttgcagagttgccatgttttcagcagaagcccctgtagtctgcgtcgtaaatttgtctcctgtggcatcctcccaaaggtttgcaaactgaccgccaagcggataatatgtaccgccggttccccctgtcagcagactgtagtttcctgatccttttgacgcagatccgccgtccttatttcctgatgcattgttgcttccgcacgcagccaatcccatgacgagcgtcagcagcaataccatccatgataggcttttccactttttcattcattctccccctttgcttgatggacaaataacaatcctatcgtaccatgaaaaatgtattagttgtcaatatattgttttatttctaattatttagttaattttatgagccgctcgttctgaatatgcgcacggcctctgaaattctcgtccgctacagcgatgttagtccataatcccttcggaggacaagcgtgctggaagattctatgacaaaacaaaaaaacccgcggttatgcaggtttttcatttccgaatatggacgctcgaaaacacaaacttatcatagcgatgccttgcaaaagaatattcaaacggttcccccgtatttaaaaaagcgacctgttcgacttcaagaaccggatcgtcaggggcgcattccaagtactctcggtcgagtgcactcgacttatccgccctgatcttccggtgcgatccggcgattgtcagtttcagcgtctcggtgatgtgccggtaaacggagccgtgaaggacgtcttcatttaattcagagatgacgttcgaaggcatatacgtttcttcaatgacatacggttcgccttcaacctttctgagcctgatgatatgatacaccggaacggtcttttcgattgacaattgctttgccacttcatctgaagggaattcgacgtcaaattgaatgatgcggctttcgatttgtttgttggcaagaagcttggtcagcccaaggttttcgcggtctgttacactgacgggaagctgctgaatcgatgattttacaatgaaggtgccgtgtccgcgcttgcggtacagcatgccttctgacacaagaatatcgagggctcttttcatcgtcattctgctgcaggaaaattccttggcgagagaaagctcatcaggtatgggctgatcaatcggatagtattcctcctgaatccgcctcctcatttcgtttgaaatatattcgtattttctcatgttttaaccaccattactaaggattctgtagcctgtaacaccttctttatcattatatcggttttaatgcggaaataaaaagatggcccaactgaccatcttttagcccgagtccctttttaaaaaccgttgttctcggcaactttcttaaaccagtatccgctttttttaatcgttcgttcgccgtttttgtcaaggttgacagatacaaaaccgtagcggtttttataggcgttcgtccatgaccagttgtccatgaaggtccaaagatgatagcctttgacattcgctccttcctgaatggctctgtgcacccattttaagtgttcttttataaacgaaattctgtagtcatcgcggatcatgccgtcttcgccgcggaaacgttcttctccttcaacgcccatcccattttcagaaataaagcattcaatatttccgtagttttctttgacattgattaaaatatcatagattcctttttcatatatctcccagccgcggtggcggttcatttttcgtccgggcatttcataatggtcaaaaaaccgttccggcataaaaggcgcgtccggatgaggcaggtgctccttcgctttcacccgtctcggctgataataattgatgccgagcagatcgacagtgtgatttttgatcagctccaagtctccttcttccatgacaggcaaatagccttcttcttttaatatatctgttaaaagctgcggaaactcacccttaacggcgggatcaagaaacgatcggttaaagaaagcgtcggctatttcagatgctcttacatctgccggatgctggcttcgcgggtaggacggcgttaaatttaaaatgatgccgattttgccgtcgcccccgagtctgcgataagcttcgacagctttagcgtttgaaagaatttcatggtatgcgacctggacggctttttgaaagtcgacgatgttcggatagtgaaaatcgtatagatagccgccttctgcaggaacgatcggctcattgtgggtaaaccattttttcactcggtccccgtacagcctgaagcacgtttccgcgtatgaagcaaagtgatcgacgacttgcctgttttcccatccgccgatttgctggagcgcaagcggcatgtcaaaatgataaaggttgacaaaaggctcgatgccagccgcaagcagttcatcgatgactcggttataaaaggcagctccttctttgttcagccgcccttttccatcaggaaacagacgagcccacgaaatggagaaacgaaaagagtggtggccaagctctttcatcagctgaatatcttctctgtaagtctcgtaaaaacgcgaagtcttctcagggcctactccgtcaaaaaatcggtttggctctttttcgtaccagtgatcccaaatgttctttcctttgcctccttcggccgccgctccttcagtctgagtggcggaagccgccgacccccaccagaagccatttggaaaacggtattgaatttgttctagctgcggttctgtttttgacatgtcatcaatctccttttaaagtcctagtgttgtcttttcttgttccgcttcattgatctcctgctcttttttcatattcatccggtcgatgaatttcaaaaatgggaaccagatcataaagacaacggctaaattcacaatctgaagaatgccgccggcaagcgaattggtcgccatcattccgctgataaagatcggcacagtccaaggaatcgtgaccccggtcggcggcggtacaagcccggacgccatcgcgaaatacgtaatcaaagtgacgatcatcggcgagatgacccacggaataaaaatgagcgggttcatgacgatcggcagaccgaaaatgatcggttcatttacgttgaaaattcccggggctgctccgagttttgcgacctgcttcatctgcttgctcctcataaacagcaggatcgcaataatcacgccaaggtcatgccggttccgcccattccgacggtgtagacttccataaactgcttattgataatatgcggcacttctcctgttgcggtatagctattcaaattttcgatcgaaagcgtattccagatcggatccataacggagttgatgataatttgtccgtggagtccgaaaaaccagagcagctgagtgaaaaatatggcaatcaaggtcggaatgataccgcttccaagaccgacaagcggagcctgcaccaggttgtaaattaaatcgtgcatattcgtattgaacgcttgggttacaaggatattgatcaccaagtagacggacaaggtcatcaccgccggaatcagcgcggcaaaagattttgctacagcaggcggaacgccggcaggcattttgatcgtatagtttttctggacaaaaaatctgaaaatctcagcggatgtaaaggcggtaatcattccgaggaacatccctttcgcaccgagcctgtcaatcgggatgacgttcggaatcacttcccctccttcgccgtttaatacaaacggagtcagcagaaggaacgatgccaaagcgacgactcctccaaaaaccgcttcgacttcataagttttggacaaataatacccgatcccgaatacgacgaaaacggacatgatgctgatcgttgcgctcggcgctatgcttaaagccgactggaacgtttcaagcgcggatttgctcatcattttattgagaaacggcaaattggttaaaacgacaatgatcgatccgaaaatggtgagcggaaaagccagcataaatgcatccctcagcacgcctaaataccggttattattcagcttcccggcaatcggcaccaagaggttgctcaatttttcaaacatggtctcttatcccccttcgattttgccatgcagtgcgaatcatagacttttctctttgaacaattccaataattcagaaacgagttccttcatcgtgagcgtcgacatcaaatggtcctcggcatgcaagagcagcaaagagaactcattttttcccccgcccgcttctttttggatcatttgaaaatgaatatcgtgggactgctgcaaatcgtcttctgcctgttgtagcagctcctctgctttctgaacgctgccggcgcggtattccctgatggactgaataaccttgctgcgggcgtttccgctgtgaagaatgagctgaaagcaaatttgttcgcctgttaattcatcgagctttaatttttccattatcgtcaatccccgatcaggcttagcgcctgttcataagctttctttccatcagccattccgtaagccagcatatcaatcacatcaaccttaataccgtactgttcagcttccttctgcagctcgccttttaaaaagctcatttgcgggccgatgagaacgacgttcgcctctgccatctcttttttcgcctggtcctgtccgaccgcccaaatttttgcctcgtcaccgattgaatgcgcgtattcctgcatcttggtaaccaggagacttgtcgacattccagagctgcatgcgagtaaaattttcttcatggtgatctcctccctttattaaaagcgctttcacacaactattattatatctttttatttttaaatgtctagacatttaaaaataaatgtatgtatttattttgaacaataaaaaaacccctcttctttccagaggggttttcaaataaattatctggcgtattttttgaatagctgaactgcttctttaggcacgtagaaggatccattgctttcaacaatcacgctgtctagttcgtattccttcccgttgattctgataatgtttttgttcacaggcatttcggcttttgcttttttgcgcgctgcgacaagaactgggttagccggatctttttgatcgatcgttacgctggctccggcttttttaaatgcctgttttgcttcgataaataattcgtttgttaatttgtctaagttgaagcccattgcctttgccatcgttttggcgatatcggtgttttcgacgagaccctgcggcttttctggaccatacgaatacaggaagacgtcttcacccgtatgaccgcctgttgtgaatccgatgttggcccggttgctgagcagcttggtaaataatgaagccgcttcttttttgtttttcacgcttttcagctgttccttctctgccggcgttaaatcatcaagtccgtaaagcttcgccgcttcttcgatattcgataagtcgtcttttaatttgccagttgcgccttccaccgtcattttagcttttttcagcggatcgacataggctgataccggtgttgtgtcatagcctttcgtcgtgttgctgttgccgatggagatgccgctgttgccatggtctgagacggcaataaccattgtatgtttatcttttttagcgaaatcaagcgcttctttcaccgcgttatcaaacgccaatacatcgctgatcatgccgatcggatcgttttgatgcgctgcccagtcaggcttgcttccttccacgaataaaaagaaaccgtccttgtctttagaaagcgtctgaatcgattttttcgtcatctctgcaatagtcggctgctctggatgcgttgcgcggcggtccatgtcatacgcgagatcgcgctgtgagaaggcgccccagatttttttcgattttgacttgaggagttgatctttcgtttcaacgaaatcgtactttttatctttgagcacttttacaaggtcttcaccgtctttgcggcttttatcctttgtacccggctgaagcgattcttttcctccgccaaggacaacatccatgttttgataaacctgctgttcaccgagcacttcaaaattattgcggtctttatgatggccggaatagccggcaggcgtggcatgctgaatttcagatgttgcaatgatgccggttgctttccccttctgttttgcgccttccagcacgtttgctacaggccggtaatgatctttttcacggaccttctcgactcctggtgtattcacttttgaaggcagcacaccgatataggaagaatttgattttcgtcccgttgccatcgcagttgctgcaggtgcagaatcagtgatcgccgattctgccgaatacgtccggacaccgccgctgacgatctggtccattgcgagcggttcgcctttataccagcgtgccaaagttgttgcagaagagcttgtcccatccatgaccatcatgatcacgtttttgaccttcggctcttctttttttttcgctgtttccattgccgcactgcctgttcccgccgatcctaaagcgactgcgcctgccagtgtaatgccgacgattctgttgcgtaagaaacccattcttatgtactccctccataactgcattttgttgacacacctacactatcattgctatgtaaacagcacttttgctttctattaatcttatgtaaattttcatgggcttatgatgaaaagaaggcatccgccttcttttcacccttttcccgcttggaatcccgggtattttgtcatcccgccgtctacatacagcgtcaggcccgtcacatagcttgcttcttcggatgctagccaggccgcgcaggctgcgacttcctccggctttccgatataccctataggaatcaattcaataacgccttttttcaattcgggatcagcgaatttttcggcgttaatcggcgtatcgattgcaccggggccgatcgcgtttacccggattcctttcggggcatattcaagggcaagggtttccgtcagcagttttgccccgcccttgcttgccgcataatggacaaaatgcggccacgggatttgctgatggacgctggacatattgatgaccgagcctttaatattatggtcgagcatatagccgatcgcttcccggcatcctagaaacatccccgtcaaattggttgatatgacgcggttccagtcctctagagccaaatcctcagaaggtacttcattttccacccctgcgttgttcaccatcacatcaacggaaccgaatgaatcaacagcctgtctgatcagcgcttttacatcatcttcttttgagacatctccttgaacggcaatcgcgcgcgctccgctgctttctattttctccaccgtctcttcaggattttcttcttccttgaaataattgatcactacattggctttttcagcaccgaagcgcagtgccatcgcttttccaaggcctgtacccgcccctgtgataacgaccgtttttccctctaaacttggatacatgggttgattcctccttattgaaactcacttttgagtaggtttccacacaaccgcttaaacatgcatccttccgaaaatcaaaaaaaccgcaagcttttcagcttgcggttttacatcttatttcatccactcagtgtggaaaatgccttctttatctgtacgctcatacgtatgggcgccaaagtagtcgcgctgcgcctgaatcaggttggccggcagggttgcagtgcggtagctgtcaaagtaagcgagagcgcttgagaagcaaggtacaggaattccttgttcaaccgcaagagaaatcgttttgcggagggctccctgatagctttcaacgatatttttgaagtacgggtcaagaagcaggttgtcaagctctggatcgcggtcatacgcttctttgattttttgcaggaacgccgcgcggatgatgcatcctccgcggaaaatcatcgcgatatcgccgtatttcaaatcccagccgtattcttctgatgcggctttcatttgagcaaagccttgggcgtaagaacagattttgctcatgaagagcgcttttctgaccgcttcgatcagctcttctttgttctcagcggcaggtttcgcttcaggtcctgccagaagcttgctcgctttgacgcgctcctctttcatggaagagatgaagcgggcgaaaacagattccgtaatgattggaagcggaacgcccaggtcaagagcgctttggcttgtccattttcctgtgcctttttgacctgctttatcgaggatgacgtcaacaagcggcttgccggtttcctcgtcttttttcgtgaaaatatcagccgtgatttcgatcagatagctgtcaagctctcccttattccactcggaaaagacttcgtgaagctcatctgatgacagaccgacaatgtgtttcaaaataaagtaggattctgagatcagctgcatatcgccgtattcgatgccgttatgaaccatttttacataatggccggcgccgtcaggaccgatgtatgtcgtacacggttcgccgtccaccttggcagaaatagcttcaagaatcggcttgacaagctcatgggcttccttttgtccgcctggcatgatagacggccctttcagagcgccttcttcaccgccggaaacgccggtgccgatgaagtgaatgccgctttcggccagctccctgtttcttctctgcgtatctttataatatgtatttccgccgtcaatcaaaatgtcgcctttttcaagatgaggcagaagcgattgaatcgttgcgtctgtcggtgttccagctttgaccattaaaagaattttgcgcggtttttcaagagattcaacaaactcttcaatgctgtatgtaccgacaacgtttttgccttcggcttctttcagaaactcttcggttttctcgcttgatctgttgtagacagaaactgaaaacccgcggctttcaatgtttaaagccaagttttttcccattactgctaaaccaactacacctatttgttgttttgccatgtctaacgtcccttctaaagcgtttagcattatagtttaatttttatttaaattgaaattaccacactttgacctacattttcaagctattgatcttgtctctcgtcttggaaaaaatctttgttaaagcttgttccgctcgttttgctttcttttttcacaatcctgaccccttttttgatgaggtctgttccatatttttcattcagttcggccatcactttttggatcggctcatctttggcatcctcatgaaaggaaaacaaatcaagctgtttgacggcttcctttcgattgacgaggtctgttcccgtcacgcccaaaagcctgacagggcttccgtgccaatgctgcctgaaaagggctttcgattccttcgcaatttcgtcttttgaatcggtcggattcagaagggtcttgcttcttgttatgttcgtccagtccgcaaagcggatcatgatgaaaacttttgctgccatgacctcttttcgcttcagcctgtcgcttactgagattgaaagcttgtcaatcagtccgaacagctctttctcatctgtgctgtcatgcgggagggtcgaggaattgccgacgcttttgaattcgtatattctgtcgggattcacttctcctgtgtcgatgccgtttgcccttctttttaaacgggggccgttgatgccgaggaggcgctttaaagcatactcatctgcggcagccaaatcgccgatcttttcgatctcgagcgtcttaagcttttcggcggttttccggccgactccgtacatctcgctgatgtccatgggccaaagaatccggggcacttcacgctttctcaaaatcgtaatgccgagcggctttttcatatccgaagccattttggccaggaatttattcggagcgatcccgatgcttgacggaagcagcagttccttttgaaggcgctcctgaatttcctttgccgtttcgcatgcccgatttctgtatggcgtatccgttaagtccatgtacccttcgtcgatcgaaacaggctcgacaaggtccgtgtactccctgagcacttgaaacatttctcttgaagagcttctgtagcggtcgaaattcggcggcttgacgatcagctcgggacagagccgcttcgcttcccagagcggcatgggcggtttgacgccgcgtgctctcgcctcatagctgcacgtgacgacgattcctttccgctccttcgcatttcccgcgatggctagcggcctgcctttcagcgaagggtcatacgccatttcaacagacgcgtaaaagctgttcatatcgatatgaaagatgactctccccttttgtttatcagcagacaaaacggctccctcctggcactctgattagacatcccggctttcatatagtaagatgttaaatgaaacggaagtgataaaagatgattcttgaatctttcaacgatgctttttttctgattgagtttttcacaatcgtcctccccgcactgacggcgatcggtatcgccctgatcctgaaggattgcagtacgggagacagctggaaaacgaaacggtttgaagaatatcatgcaatacagtttgtttctgcagtcgattttctcatcatcctatatcatcgcattacggtatggataagtaaagtcattcgcatgaaagcttcatcgaacgacgatgaagaccaccgtttccttcttctttcaatttaaacgtgaagggcgtccggcatacgggcccttatttagaaggaggagaacgtgttgaacacgaaactaaagcaattgtttgcgactgcaatgtttttgatcatgactatgtttataggtgaacaagcttcggcagccaccggcagcaccggaggaagcgacaacttcttccaccattatgtcgtggtgcctttttcagagctgattaagggaatcgccggaatcttccacggaaactacggattgtcgattatttttgtgaccatcatcgtccgggttctcgtttttccgctgtttgccaaccagtataaaaagcagcgggcgatgcaggaaaaaatggcgcttgtcaaacctgagctggatgcgattcaaagcaggttaaaaaagacgaaagaccccgtgaagcagagggaaatccagcaggagatgatgcagctttaccaaaagcacaacatcaatccgctggcgatgggctgtctgccgatgctgattcagtttccgattctgatcggtttctattatgcgatccgctcgacgcctgaaattgcttcgcactcttttctctggtttaacctcgggcattctgatattatcgtatctttaagcgccgggttcatgtattttatccagttctatgtgtctcaaaagctgaacgcacagaacgcccaatcaaatccggcggctcagcagtccgccaaaatcatgggcttctttttccctgtaatgatgacgatcttttcgatcaatgtccctgcagccctgccgctgtactggctgacaagcggactgcttctgacgattcaatcggtcgttcttcatcaagtttaccaaaaaaacaaaaaagccattcagcctgctgaatcggctacaaaataaaaaagcttgcgcctttaaaggcgcaagcttttttgcgtttccctttaatcttctcgatcgcgactaaagggctgatgagaataatgagacggctcttttgttcgagaacgccgctctaagagctgaaacgaacggcaacttcccctgtaaaaccccgcctttatgaacgattcgctacttcctcaataatggcaacgaccatttctgcagttttgacaagttcctcaatcggcattttttcgtttttcgtatggatctgttcatatccgactgcaaggttgacagtcggaatgccgtggcctgcgatgacgttcgcatcgcttcctccgccgctcgtcaacagctcgtacggacggccgattttcccggcggcttttttggcaatttcaacgacaagatcaccgtctttgtatttaaagcccgggtacatgacttcgatttccacctcggctctgccccccatttcggcggctgccgattcaaacgcctgcttcattttttccgtctgcttttccattttttccggaacaagcgaacgggcttcagcaagaatgtcgacttgatcgcagacgatattggtttgcgttccgccctcaaagcggccgatgttagccgtcgtttcctcgtcgatgcggccaagcggcattttggcaatcgcttttgaagcgatcgtgatcgctgagactcctttttccggctctacaccggcatgagccgtttttccatagacagttgctctaattttcgcctgtgtcggcgctgccacgataatattgccgaccttcccgtcggaatcaagcgcatatccgtaatcggctttgatcagcgaacggtctagagccttcgctccgacaagccccgattcttcaccgaccgtaatgataaattggatcgttccgtgcggaatgtttttttctttcagcacttttacggcttctagcatcgctgcaaggcctgttttgtcgtcggctcccaaaattgttgtgccgtctgttttgacatatccgtcttcaatgaccggctttacgccttttccgggtacgaccgtatccatgtgggatgtaaagtaaatcgtgtccgcttctttcgttcccggaagcgtgcacacgaggttgcctgctccgtgcccggtttttggctttgtgtcatcttccacgacatccattccaagcgccgcaaatttttctttcagcaccttgcagatttcagcttcatgttttgtctcggaatcaatttgcacaagttctaaaaactcttctaacaagcgttttttattcatactagtttcccctccattttttaaagcggtatatttccatgctttttgtccagccggatttcttttttgctcttcagcatgtcaaacgtttggatcagcttcttccgcgtctctttcggatcgatgatatcgtcaaccatgccgtatcttgcagcggtaaaagggcttgaagcctgcatgcacttccggattttttcctcccgggcggcccgcgggtcgtctgaccgttcgatttccttcgcaaacagcacgtctgcagcttccgaggcgcccatcactgcaatttctgcattcggccacgcaaacacggcatccgctccaagcgccttgctgtttaaagcgacatatgctccgccgtatgcttttcttaaaatgaccgtcaccttgctgacagtggcttccgcatacgcgtaaaggattttggcgccgtgcctgatcaccccgccgtgctcttcgcgtattcccggaagaaaaccgggacaatcaaccaaagtcaaaatcgggatctgaaaggaatcgcaaaaacggataaaccgggcgattttgtcagccgcatccatgctgaggcttccggctaaatacttcggctggttggccacgaccgccgccgtttcccccgctatccttgcaaaaccgatcaccgcgtttttggcaaaatggcactgcacttcaaaaaatgttccgccgtctgcgatttccgcgatgatctgtttgacgtcatacggacgctgaccgtcttcaggcaggatcgtcattaaagcaggccttatctcatgatctttcgcctttctcgccttggcgggaggcttttcttcgtgattctggaggatgtaggacaagagcttgcgcacctcatggaggacggcctcatcggaatccccggaaaaatgggcattcccgctgattgaattatgtatataggcgccccccaattcaccggagctgacagcctcgcctgtcgccgttttgatgactttcggaccggtaataaacatctgtccggttttttcgctcatgaaaacgaagtcggtcaaagcgggggaataaaccgcgccgcccgcacaagggccgagaatgacagagatttgcggaatgatgcctgagcaaaggacatttcggtaaaaaatatgaccgtatccatctaatgatagcacaccctcttgaattctcgcaccacctgagtcgttcagaccgatgaacggcgccttatttttgagggcaagatccatgacggccgctatttttttggcgtgcatttctccgagcgctccgccggtgacggtaaaatcctgggaaaatagataaacgggccgcccgtcgatctttccgaatcccgtgacaaccccgtcgcctaacgggccgccggactgccggcttctggcaaaggcattcagttcagtgaacgtcccctcatcaagcagaagatcaattcgttctctggcggtgagcttgcctttttgcttctgcctgtcgatccgttcctggccgcctccgagcgaagctttttggcggctgttgtttaaatcgtcgactctttcaaacatattcatcacgttctgccccttctctatttgattccaagaacgaaacttgtccgatgaaaaaaagcagtataaaataatgggagattaaaaaacagaggtgaaaagcttgtctcgaaaattcatcaagttcatggttattttaatgatcggcgtcatggtgctgaccactctgcttaccggaatcagcatgattttttaatacagatcatgaaagcaggcgattcttttttcggagaaacgcctgcttttttcgggctcaggcttccgggaagaatagaaaaaaccgcacaagcttctccctgtttcattagattgaccaatgaaggagaaactcatgcggttatgcaggagatttaatacctttaaagtaactcttaatcacaagatactgttccatttcgccgagaaaaatgaaaagagcagcgcgcgcttcaaattcttctcgtgtcgtcggcagctccatctcttcgatttcctctctcattttcacgagccgcttcaaaaatttatgagccgtatttccgggatggatggctcctcttaaatcatggagaaacgccgcgatcatctgcccctgttcaaccgtcatcgaaatcgacgtgattttcggcagaaccctttcgataatttcaaattgcttttctctcattttaaagtagtgataatagaggttttcgtgcctgagaaaatgattttccacatcgcggtatgccagggtcttcgcttcattgatcaaacggtgcgtctcaggaatctcttttcccgtccaatcctgctccccggtcagcaaataccgttcgatttcttcaaaaatcttggcaaagttatcttctattttctgctgatactgtttgagctctttatcgaggctcggcatgtacagattcatcagcagggctacgccgattcccgtaatgatgataaggaattcgttccaaacgagagaaagggtgatcccttccgacatataaaggtgaagaatgatgaccgaacttgtgacgattccttcttttattttcagaagaacggttgtcggaataaagaacagcagcatcagaccgatgacagcaggatgatagccgatcagctcaaaaaatgcgtatgaaaagacgatcgcaagaatgcatgctgcaaaccgtgcccatgatgcctgaagggaccgttttttcgtcacttgaatacagaggatcgtgatgatccctgtcgacacaaaattatggaggccgagcagctgtgcgatatagatggccgatgctgttccaagcgctgtttttaatgtgcgataacctattttaaacatcgttaaccccaatcttttctgctagtcttagtgaataaaaaagaagaagatcagcatcttcttcagcttattttatagtattttctctaaaaagtcttgagctcttttcgattttggagaagaaaaaaacgctttaggatcgtcgtcttctacaatggttccttcatccatgaaaagcactctgtcggcgacttctttggcaaatcccatttcatgcgtcacgatcaccatcgtcatcccggttttcgccaaatcctgcatcacttggagcacttctttgaccatctcgggatcaagagctgatgtcggttcgtcaaacagcatgatatccggattcatcgccagcgccctcgcaatcgcgacgcgctgcttttgtccccctgataaacggttcggataatcatcttttttatcgagaagccccactttctcaagcagttcttccgcttttttcacagccgcctgtttgctttcttttttgacatggacaggtgcatacgtaatattttcaagaaccgttttatgcggaaacaagtgaaaatgctgaaagaccatgccgatgttctctctgattttcagcacatttgttttcgggcttgtaatctcttgatcctgaatgaaaatgctgccctccgtcggcttttcgagcaggtttaagcaacgcagaaacgtggacttgcctgatcccgacgggccgatgactgcggctacttcgcctttttcaaaggaaacggaaatatgtttaagcacctcgtgctttccgaaagattttgagagattgcgaacattaatcattgacattcagcttcctttcaatcgctttgccgacaaacgtcaggatcaaaacgagcacatagtagatgaggcctgcaaacagcatcggctcaagcgggctgtagatcgcagctcccgcctgatagcttcgcctcattatatcgccgagtccgatgacggtgacaacagccgattcctttgtcagtgtaatcgattcgttgatcagcgcgggcatgatatttttaaaggcctgcggcagcaagagatccttcatcatctttgcatacgggacgcccagagccatcgccgcctctttttgccctttgtcgatcgcattgattcctgctctgatgatttctgatacataagcagcggaatttaagccgaatgcgatgacggccgcccaataagcatcaatatcaaagcccagcacctgaggcagtccgtaatagacgatcatcagctgcagaacgagcggtgtcccccggaatatggaagtgtaaaagtctgcaatccatgcgaggggcttgatcgaactgatttttaaaagcgtaatcaaaacccccagcaaaaatccaagcacggccgcagccgcgaccacttttaaggtaacgcccaagccttccaggatgaaaggcatttcgggtactgtactagaaaaatcaagaaaattcatgatgactctccctctcccgcctcatgatcaaagaggcgtacatcgctttagaaaaaaaaagttcaacaaaaagttgaactttttacgcttacttttttgtttctccgccgaaccatttttctttcagtttatcaagttctccgcttttctccatttcttcaagcgctttgttgaacttctcggtcaaatcgcttccctttttaaaggcgatcgcggagccggctttttcatccggttctttcggcagattgtagccaaccagttcttcatttttattaatatatttttcggcaacgatatcttcaatgattgcagcgtcaaaggtggcccgctttgatttcttcagttaaatccgaaatgcggttgcggttttcaacttttaaatcgtaatccggcgtgagctcctttgctttttcttcctggatggagccaagctgtacgccgaccgtttttcctttcagatcgtcaagcgatttgatgccgcttgatttttttgtaacgatcatgttgtgagccgtatagtagacatttgaaaaatcgacctgttttttgcgtttaggcgtcggcgtcattcctgaaagcacaatgtcgactttgtttgttttaagagcggtcaccaagccgttgaagtccatgtctttcacttcgatttcatggcccgtcttttcagccagtgcttcggccagatcaacatcaaaaccgacaatcttatccccgtctttcgattcaaaaggcgggtaatcggcagaagttcccatcaccaatgtttttttatcatcagagctgctgctcgtcccgcaagcagtcaatgcaaatgtgacacatgctgtcactaccagtaacatccattttttcatgttgtgtatccccctgaacctgtttgaatatttattcgttgttatgtattttaaacattttccgaggcggatgcaataccattttgaaaaataactaaacaacctttaaataagcctttaaataccaattgaacgcctgtgcctttatctttctgattgcatacaaaaagcatttttatacacaaaaaaagcctgccatctgttttggcaggcagtttttccattatacttcttcacagtattcttcaaacagtccttgaagcttggtgatgacagccatcggctcatagccttcaatttcatggcgctccaccatttttaaaatcttgccgtctttcaaaagggcgaatgacggagaagaaggcggatatccttcaaaatattctcttgctcttgccgtcgcttctttgtcttgtccggcaaaaacggtgacgagatgatcagggcgcttatcgtaatgaaccgcatggtgcgcggcaggtcttgcaatcccccctgcacagccgcagacggagttgaccatgacaagcgtagtgccttttttcgtgagcgcttcatcgacctcttcaggcgttttcaattcggtgtagccggcagccgttatttcttgtctggcctggcgtacgacatcgttcataaacagattaaaatccatgttcactttaagatctctcctttttagcgcttatagcatgatgctaaagccgctgtttgctcatctgttctaatgatactttgaaaccgcccggaccgcaaatcaggcgattcgtgttccttcaggtttacggaacgggcagcccggggaaaaataagtaaagaccctataaacaaaggagtactttatgaaccgaaagaaagcaatgctgatttacaacgggaatgcagggcaaaaaaatgttgaaaaaacactcggtgctgccgtaccgattctttcacaagctatagacgaactcatcgtgaaaccgacgagaaaaaagcgcgatgcgttcgaattttgcctggagatcggggaggatatcgggcagttgtttatcttaggcggtgacgggacggtgcatgaatgcattaacgggattagccagcttcaaaccaagccagatatcggcatcctccctggcggtacatgcaacgacttttcgagggcgctccgcattccccagaacatagagaaagcggcggaagcgctcgccaatggaagtcccgtcccggtcgatgttttaaaagcgaatgatcattattgtctcaacttttggggcatcggattgatcacggaagcttccagccatatcaatcaaacggaaaaagcgctgctcgggagaatcagttattttacaagcgcactgcggacaatctccaatcttgagcccttctcttttcgtctgtcgatcgacggagaagagtttgctgacgaagcggtcatggtcgtcgtgctgaacggcccctttatcggaacgaacaagatcccccttccgcagctgagcatcaacgacggaaaagcggacattctcgtctgccggaatacgaatctggctgcattgaaagagctttttgcaatggatgatcccgaatgggattcctttaaaggcgagctatcctattatcaggggcaaaccgttcgaattgaaaccgcccttcccatggaagccgatacagacggcgaaatctgcacaaaaacgccggcttcaatcgaggtgctaaacgggcacctccgcatgctcacccccttagaaaaagaaaaaagctgaccctaaacgggccggcttttttaatagatggacgtatgatcatcgatctgttcaagaatctctttcacacgggcaaggaatctgccgcaaatgaggccgtcaagcactctgtgatcgagggataagcataggttcaccatatccctgaccgcgatcatgccgtgctccatgacgacgggacgcttgacgatcgattcaacctgcaggatggcagcctgcggatggttgatgatccccatcgactgaaccgatccaaacgaaccggtattattgaccgtaaacgtacctccgctcatatccccgctggtcagcttgccgcttctgaccttatgagccagttcggagatttcccttgcgatgcctttaatcgttttttcatcggcatgcttgatgacaggaacatataacgcatcttcagtcgctactgcaattgagatgttgatgtcttttttctgaatgattttatctccggcccacatgctgttcatttgcgggaattccttcagcgcctgtgcgactgctttgacaaaaaacgcgaaaaaggtcaggctgaagccttcttttttcttgaattcgttttttattttgttgcggtagctcacaagacctgtgacatccacttccatcatcgtccaggcatgagggatttcatgcttgcttctgaccatgttggtcgcaatcgcattgcggattccagttacaggaatctcaacgtctccggccgcactttgaggcggtgcagcttgaggtgcggcttgcgccggtttttgatcaggttcaatcgctcccgcggcatttgcacccggctgtttttccggcgctgcatcagtttgaggaacagctccggaagcaatgatgcgctggatgtcttttcttgtgatccgtccgccggcgcctgtaccttccacctgctccaaatcgatgttgtgctctccggcaagtctcagcaccgccggggaataacgttttttctgagatgtatctttcgcctccggtttggccggctccgcttcctcttgatctggcttggaaacagcctcagcctccggtttcgcttcttcatttgtttcgactttgcagatgacgtctccgacttgcagagtttcgccttccttcccgactagctcggcaatcgttcccgtgaacgatgaagggacttcagcattgaccttatccgtcatcacttcagcaatcggatcatatttgttgacgtgatctccgacgctgacgagccatttgctgatggttccctcagtcacgctctccccgagctgcggcattgtcatttgttccactgccatacgatgtgtcctccttcgctatattaaaactcagccaattctctcatcgctgcttctgctttatccggattgaccataaagaatttttccattgtaggagcatacggcattgccgggacatcagggcccgccaaccgcttaatcggcgcatccaaatcgaacaggcaatgctctgaaatgatcgcggccacttcactcataatgctgccttccttcgtatcttcggtcatcaaaagcactttgcccgttttggaagccgcttcaataatcgcttcctgatcgagcggatataccgttcttaaatcaaggatatgtgcggaaatcccgtctttggcaagccgttcggcagcctgaagggcgaaatggacgcacaatccgtatgtgatgacggtaatgtcttcgccttcccgcttcacgtccgcctttccgatcggcagcacatagtcgtcactcggcacttcgcccttgatcagccggtatgcccgtttatgttcgaagaacagcacagggtcgtcatcgcggatggccgctttcaaaagccctttgacatcataaggcgtcgaaggcatgacgattttcaggccgggctgattggcaaacacggcttcaaccgactgtgaatggtacagcgcgccgtgcacgcctccgccgtaaggtgcgcggatgacgatcggacagttccagtcattgttggagcggtagcggatttttgccgcttccgaaataatctggttgacagccggcataataaaatcagcaaactgcatttcagcgactggtctcatcccgtacatggcggccccgattccgacgccggcaattgcggattccgccaaaggcgtgtccatcacccgctcttcgccgaactggtcgtaaagaccggctgtcgccttgaatacaccgccttttttgccgacatcctcccctaaaacaaagacgcggggatccttttccatttcttctttcaaagccaaagtgacagcatctatatatgacataactggcattgttcttcccccttactccgcataaacatgccgcagcgcatcttccggatctgcataaggtgcatgttcagcataatctgttgcttcattgacgatttttgtgatctcatccgatatttgcttctcagactggtcgtccagaagacctgcttcttttaagtattgtgcgaatttgttaagcggatcatttttcttcgcctccgccacctcttcgcgctctctgtagcttcggtcgtcatcatcgctggagtgcggggtcagccggtatgatatcgtttcgattaatgtcggcccttcgcctcttccggcccgttcccttgcttctttaacagctttgtagacttcaagcggatcatttccgtcaacggtcacgccaggcatgccgtaaccgacggcgcggtcggaaatgttttcgcaagctacctgcttttcataaggaaccgagatcgcgtatttattgttttcacacataaaaatgacgggaagcttatgcacggcggcaaagtttgccccttcatggaagtccccttggtttgaagagccttcgccgaacgtcacaaaagttgcaatgtctttcttgtcaagccttccggcaagcgctacgcccaccgcatgcggaacttgcgtggtcaccggcgaagagcccgtgacgatccggtttttcttttggccgaagtggcttggcatctgctttcctcctgaattcggatcctcggcttttgcaaacgccgacagcattaaatcttttgccgtcattccaaaagcaagcacaacgcccatatctctgtaatacggaagcacataatcgttctcccggtctaaagcgaaagccgctccgacctgggctgcttcctgtccttgacaagagatgacaaaaggaattttgcctgaacggtttaagagccacatccgctcatcgagttttctggctaaaagcatggttttgtacatgtcgattgcttgttcatctgttaatcccactgcttcatgacggttattgcccatttttttcactccttcatgctttctaaaaatgaatcgcttttccatccacggcaagggcggcttctccgatcgcctccgacagcgtcggatgcgggtggatcgtttgaccgacttcccacggggtggcgtcaagcacctttgccagaccggcttcagatatcatgtctgtcacatgcgggccgatcatgtgaacgcccaaaatgtcatctgtttcgcgatcggcgacgattttgacaaagccgtccgtctcaccgtacacgagcgctttgccaatcgcctgaaacggaaatttgcctactttaacgcttttcccctgcgccttcgcctcaccctctgtcaagccgaccgatgcggcttcagggcttgaatagatgcattttgaaacaagcgaataatcgatggcgtgcgggttttcaccagcaatatgctcaacggccgtaatcccttcgtgagaagctacatgtgcaagctgaaggccgccgatcacatctcctatcgcatagatgtgggattcttttgtctggtacatgctgtttgtcacgataaagccgttttccacctggatatccgtgttttccagaccgataccctcaatatttgcctgccttccgaccgatacgagcattttctcagcggaataggattgtttttctccgtctttttccgcttgaatgctgaccgcatcgcctttctccaatgtgtcgggcagcacttttgctcccgtgatcattgtgatgccttttttcgcgagctgcgcctgcatttccctagaaatatcggcatcttcagtcggcaaaatccggtctgcatactcaatgacggtgacatcaacaccgaaatcgttcagcatggaagcccactcgatcccgatgacacctcctccgacgatcagcatggaagccggaagctgctcaagttcaagcgcttcgtctgatgacagaacgttttctccgtcaagctcaagccctggcagcgacctgggccttgagcctgtagcgatgatgacgtttttcggtatgagcatctcattttcatccccgttcgccatctcaacggaaaccgtcccaggcatcggggaaaaaatcgacggcccgagaatccgtccgattccttcgtaaacatcgatctttccttttttcatcaagtgtttgacaccgttgtgcagctggtcaattattttttgttttctgctttgaacttgagaaaaccgcagtccgacttcaggaatgaccactccgaattcgtccgccttttttgctgtcctgtatacttccgcgcttctaaggagcgccttcgacgggatgcagcctttatgaaggcacgtgccgccgagcttctgcttttcaacgacggctgttttcagccccagctgcgaggctctgatggcggccacatagccgcctgtgccccctccaagaatcacgagatcgtattcagttgccatgactttccctcctctggttcggatactgttttgcctcttcttcgccgttcaatacgcgaaatgcaccttcagccaatgcttgaagttcattttctcctggaaagacgacgacatccgaaatccagtctatgtattgtctgatcgaggaaataaacgattttccatatgccagtcctcctgtcaaaataatgacatcgacttcgccttttaagacggcgctggccgccccgatttctttggcgatttgataagccatcgcttcatagatgagcgcagctttttgatcgccttccttgatcattttctcaacttttaccgcatccgtcgtgccgagatagccggcaagccctccgccgccgacaagcattttcatcagctcgtctttcgtatattcgccggaaaagcacatatcgatcagatcacccgcaggaatggttccggcccgctctggactgagcggaccttccccgtggaggccgttgttgacgtcgatcacccggccgcggcaatggacgccgatcgtaatgccgcctcccatgtgggtgatgatcattttcatatcttcataacgcttcccaaactgccaagccgctttccttgcaactgctttttggttgagcgcgtgaaaaatgctgcgcctttcaatagccggggtgccggaaatttttgcgataggagccatttcatccacaacaacggggtcgacgataaaagcgggaatatttaacccgtcggcaatctccctggcgatgatgcccccgagatttgatgcatgctgccccgcatagccgtttttcaaatcgacaatcatcgcatcattgacttcgtaagtgccgccttcaatcggccgaagcagccctcccctggcgcaaacggcatccaatttagaaatattgattccctgttcatgcagggtttcgagtatcgcctgttttctgaacgaatattgatcaataatggtctgatattgctgtagctcagcctcgtcatgacggattgatttttcgaaaatcgaacggtcatcatgaaaaacgccgatctttgtagatgtagatcccggattgatgacgagaatacgtttttcctgtacctgcattgaattaaaacctccaatagagaataggggttatgattttaacgtctgcttaaaatgtgatggccgttttgcaaaaattggcttctcgattggcgcatgcgctcaattcgttcttccgccagacggtctgcggccaagtatgtcggaatgcggtcgcgcttcgaaatttcaaggacgcgttcaatgtttccgtagatgccttcgactttcttcagcgcgcgctccgaattatagccgtaaagctcgtcagcgacattgatgacgccgccggcattgatgacatagtccggggcataaacgatgcccatgtcgtggatttgatcaccgtggcgggtttctttcagctggttgttggctgccccggcaatcactttggctttcagctgcggaatcgtatcatcgttgattgtcgctccgagggcacacggcgcatatatatcgcattcctgcgaataaatatcatccggatcgacggcgcgggcgccgaattcggcgactgcacgttcaactgcttctttgttgatgtcggtcacgatcagtttcgcgccttcttcgtggaggtgccggcacaggttgtaggccacgtttccgacgccttgaaccgcaacggttttgccttcaagcgaatccgttccgaatgccgctttcgccgccgccttcatccctttatataccccgtaagctgttaccggagaaggatttcctgatgaaccgaaagcaggtgaaatgcctgtaacgaaatcggtttcgtcatgaatgatgtccatatcttcaacggttgtaccgacgtcttcggctgtgatgtatctgccgttcaagccttgaatgtagcggccgaaagcgcggaacatttcttcgtttttatctttgcgcggatctccgataataacggttttgcctcctccgaggttcagtccggccgccgcatttttgtaggtcattccccgcgcaaggcgcagcgcatcttcaattgcggcttcttcactttcgtatgtccacattcttgtgccgccgagagccggcccgagcgtcgtatcatgaatcgcgatgatcgcttttaaaccggactgtttatcttggcaaaataccaattgctcgtagtcatactgttccatatatcgaaatagttccattttttattcctcctcatgtcgtgcttcagacgtacacagcgccaaagcaatcgaatacaacttgttttctgcggaatcggccctgcttgtcaaggcgatgggtgcttttgcccctgctaaaatggctcccacttttgcacccgcaaaatgaatcaatgatttataaaggacattgcctgtttcaattgaaggaacaagcaggatatcggcctcgcctgctacgatcccggaaatgtttttatgccgggcggcaagcggcgatatcgcgttatccaatgcaagaggcccgtcaacaacgcagtttttgatttggccccgatgattcatctgcgtcaaggcagctgcattcaatgtcgcttccatcgcgggattcactgtttccactgcggcaagacaagcgactttcggcatttgcacgccgaccgacctcgccacgccgactgcgttttctaaaatctgcttcagctcatcaagcttggggctgatattcatcgccgcatctgttacataaatcagcctctcaaacccgctgacttcaaatgctgctacatgtgacagcacgtgcgaggaacgaagcccgtactctttattcaaaacggcttttaatagcacagctgtcgggacattccccttcataagaacatccgcattgccgcttttgacagcttgaacggcaattctcgcagaatccgccggcgattccgaatgaatgatatccacgtgccgttttgaaatattctgctctgtcatcatatgtctaagtttttctctgtgcccgatcagcaagaaccgggcaaattgtttgtcgaccgcaagtttgaccgcttgcagcacttcgtcatcttccgcatgtgcgacggcgaccgttttattgtcaagctccgccgctttttgcaatagttgtttcagcttcatagtacccacctttctaagcaaacatccgcccactatatcatgcaagtttcgtgccagtatgaaaaaagcggttcggtactgtgaacctgtttacagtttgcatgattttgcactcgtttttgcaatttattgcatgctatcttttgcaaggttgtatttatccattttgtaatagaggttgcgaatgctgattccaagagcttttgccgttttcgttctgttatattgatgcttttcaagcgtttctttaatgatatgagcttcaaaccgttcgaccgcatcagacagcttttcatcttcaatttcagggaaagcttcgccggcttccaccttttttctcggacggtccgcttcaggaagatgttctagatcaatccattccatttgcggttttaaaaaaatcatcgcccgctcgaggacattttcaagctctctgacattccccggccacttccgcgcttttagcgatttgagggcgtttttcgtaagcccctttacattgcgcccgtactcttggttgatcttccctatcaaatgcctgctcaaggcttcaatgtcctctttccgctgtctgagcggcggaatcgatatcggatagcgattgatccggtagtacaagtcttcgcgaaaccggccttcagcgagcgccttttcaatattgacgttagtcgccgcgatgacccggacgttcacagggatcggtttggtcccgccgactctgacgatttctttttcctgaagaacgcggaggagcttcgcctgtgtgtttagcgagagctcgccgatttcatccaagaaaatgcttccgttgttcgcttcttcaaagaatccttttttcccgccgcggcgcgcacctgaaaaagcgccttcctcatagccgaaaagctctgattcaagcagtgattccgatatggccgcacaattgacgcggacaaacttattatactttcggtcactttcgttatgtatggcatgggcaaaaagctctttacccgttcccgattcgcctctcagcaaaatcgtcgcaggcgtcttcgcccccaatttcgcctgttccagcgcgacgagcatctgctcgcttgacccgatgatgtcggcaaatgtatatttcgcctcaagtgtacggataatctgccgtgctctgttcagctcgtttgtgagcgattgaatttcagatacgtcgtgaatgacgccgacgctcccttttaaaatgccgtcgacgataatcggcgcaacattgacgatcacttcttttttattcgggccgactttcattctgacccctctgacagggcgcctcgtttcgagcactttcaaatgcatgctctcgccttcagatatgtcggtattagccggcttcccgatcacctggtcttttgtcagacctgtcatcttcgtatatgccctgttgatcatcattccgtttccgttttcgtcaacgaccgaaatcgcttcatcggaagattgaatgatcgcttcaagcatcgttctgacttccttcaggttggtcacctcttcagccagctcgaccgcatcggtaatgtccttaaatatgctgagcgccccgaggagcgttcctccgtcatcaataatcggaattcgggtcgtgacaatctgcctgttcggatggagaaattgtttttgatgatactcaggctctctcgtgttgagaatacgcggcagcttcgtcgtcgggatcacgctttgaatatgctggccgatcgcttcgctgcgctttgttccggtcataacctccgccattttgttaaacaaaatgatctcttcgttaatgtcgataaaaatcatgccgtcattcatcgagttgaaaatacggtcgtgtttatacgtctgctcttttaacatttggatgagctgctgcttttcattcatcagctgagagatgatataagcgagcgatcccggcaccacgatcgttctgtcgtgcttttttcgcatcagctgctttaacacgccggcgtctccggtcgtctcaatgatgatgtcgatctgttctgtgatgtatggcgtccagtcgagtgccgtttcgatatcgtttttctgcgcgacgaaaagcccgggagcttccggatttttatcgatgaccgcctcgatatgcatcgtctttgttttcagcagcaaatccaagagggcggtccccccttttccagcaccaacgatcagtactttttgcatcatccctttacccctttgtatgaaaaattttgcacactctcacgttctcttgcaacaatttgcacaacatctatgttatcatgttttcctttcttgacaaacttttttttcaaatagacaataaaggtaaatctttggtaaggggattcgtgtatggggagaatgatcgcactgctcgttttgctgatcccgggaggcctggctgctctcggaattaaattgatgcgcgacacggttttcggcattttgatcggcccgtttcagatcctttggcttcaggggctggcggggttcatatgcttcgcaggcggcctttatttgttaggcggatttattctatacagagacagaaaacgcaaccaagtaagcccccgtttcagaaaaaagcagagcggccgcgaggtgtgatatctgtgaacaagaaaaagccgcagacaatatctgcggctttttgcatctcacatctcggcctttaattttaacgctttttcgggaaagtcggtgaagaaaccgtctattcccgcagcaatcagctttttcatctcctcttcacggttgatggtgaacggcctgaccgctttttctttcaaatgggcgtttttgatcgtgtcatccgacattgaacggcgatacggatgaaatcctgaagccggaatcatctcaatgtattcctccggcttgtagatgacatccatgtaaagcgcagccaattcaatacttggattcagtctgtggcataacgcaaggctttcatgattgaatgatgaaagaatgatccggtcttgaaggtcgtacgcttcaatcatcgacatcactttttcttccatcccttcatagcggataatgctgtttttcaattcaacattaagaagaaattcagcatctgccgcccactcaaacacttcttcaagggtcggcacagggacagaaccggttttttcggcaaaacggtggcttgcgtctccatgttttatttcctcatatgtaagatctttcacataccctttcagtgaagtcgtcctgtcaagcttttcatcatgaatgacaacaagacgtccgtcttttgccatttgaacatccaattcgatgccgtcggcaccaatggccgccgcatgcttaaacgccgccattgtattttcgggaaaagtgcctgaagcccctctgtgtgcaaatattttcgtcatttctggttcacctctacaagaattgcaagtttataacccattatgaaggtcttactgttttctttccacacataaggccttttttaacataaacataacacaagaaccccggtcatataccagggcccttctattattcataataagatacgacagcgtcagcaatcgcgtctgcagctttttcctgatattccggactttcgagtttatctgcatcagttttgtttgtgataaagcccagttcgactaaaacactcggcatttgagaatttttgatgacataaaaccctgattcttttacacctctgtcccgagtgcccagcgcatccggaagccgctcttgaatgtcagatgccagccgttcgctgtcagcggcttgatacgtggaatcgaaatatgtttctgtaccggacgcttcagggacggccgagtttgcatgaatgctgataaacaagtctgaagcatttttgctcgccttggccacccggtcttccagcgtcaaaaacgtatcatccgttcttgaggcgactgtgtcggctccttcttctttcagcttttcatcaatcagcattgccacttcaaggttgacatctttctcaagcagcccgtttccgacagcaccgctgtcttcacccccgtgacctgcgtcaacatataccgtcttcccggaaagcggctcagccgcaaaagcagctggaaaagccgccataaacgaaaacagcagcaaaacaaaactctttattaacagtttcacgatttgttcctcctacaatccctttttgcaaacgatcattctttctttttcatatcttcaagctgtaatgttccgtcctctgctttcgtgtactccacttccacctttgtatcatcctcgatccctttatatttgtcccgtttttcgggagggacctgaaacatcgtttctttgccgtcaatattgacggcgacggtatgctggtccgccaaaccgacaaaggtgccttctttcacgagcgtttcctcgcctgttccttttcggctctcatcaccgctttgcccattatgctgcgttgtgccgcagcctgccaataacagcatagcgaacagaacaaggatgactcctttcctcatgtcgaccacctcacccgctgaattttttacaccccgtaccttatctttaatacccggggctgtaaagcaagccgcagcagcaggttttcgcccgctttccccgtccaattccccaaggatttccgaattgttagaagccatccgcgtaaaaacgtctgtgaaaaacgatctacccaaggcgaaaaatggctgtaaactggaagaaatcagatctttttcatcatttttatttttttgtataaaaaaacgtcttttttcttatgaaaaaagacgttttattcggctttcgctttatatgatccagtctatgacagcaatgctccgagcgtgagacaaactttgagaaatagacggaaacacaactggctgccgcgctatgtagtttttttgtcagaacttgcacgaatgcaagatcaaatattctttttaaatcatttttacatttaggccttcatagcggatgatcagcagcgctgctccatttctcatgcttgtatttgccgctgaacagcttgcttccggtctttatttgacggcgcctctttaatctttttggcaggcatgccggctattgtaatattttcctcagtgaaagatttgttgaccacggcgtttgcgccaattgatatgccgtcagcaatgtgaatgtcgccaaagagctttgcccccggcccgatccagacattgtctccgattgtgggaacatcgcggcgagcgtgattttgtccgatattaaccccttgatgaatgtcacagtttgcacctatttttgcattgctgtttacgatgagcaatccgtaatggttaatcctcaaccctggcccgaaaaaattcaccggatagcgaagatctgttttcgtaaagatcatcataccacccgcttatttcatacttttaactcgagatcggctcttcgaagagttttacattctccgccatctatttcctacttgatactaaaaggaaaacaaaaaaaagggggagccccccttttttggttcatccttcataaaaaccaacccaagtattaaaaacattactgtaaaatttccctttgaaataccatgttccatcgctatcagaaaatttgttactgaaaactccagaagatgattttacacattttgatgatttactgcttttgaatgagcttggcaagtcacttggacaattgatatattgagcagtcggatgtgcaatcacctcagatgaatgcgatgcagcaaataccggcgctgcagaaataagtaaaccaacagccagagtcgtaccagttaataatttattgaccttcattttaaaacaactccttttccatttatttcatttctatttcatcatataacatgcaggtatgtccaaaaagtgtacaaattacaatatttcggaatcaatagataagcttttaggatgactttacacaatacacactgtgctgaaatgattcacctttttgatcttacatcgcaaacagtacatttgcgggcaaaaaaacggcctcgtttataaaaacgaggccttcaaatactgtattaaacccttcggatcgtagcacaatttcatcgcaatatgggcgaaaaattcatcggaattacgataaactattcgttagaaacaggtcgaaaattcgacggttaaatcttcgttaaaactgcgtcatatcaacgtttaagaagccttatgctccagtctcagcttgtctgcgaccatcgcgatgaactcactattggtcggctttgcttttgacatgctgactgtgtagccgaaaagtgacgaaatcgagtcgatgttgcctctgctccatgcgacttcgatggcgtggcgaatcgcccgttcgacgcggcttgcagtcgtgttgaattttttggcgatatccggataaagcacttttgtaatgctgccgagcagttcgatgtcgttatataccatggagatggcttctcttaagtacaaatagcctttaatatgagcaggtacgccgatttcgtggatgatggtcgtgatgctggcgtccaggtttttcttcggcgattcaggctgcggccgaagcacactgctttgagaggacggggcacggtgtgtcaattgagatccgtttccgctgacctggcggatatgtccgactaaattctccatgtcaaaaggcttcaaaataaaatacgacgcgcctaaatctacagcttttttggtcacgtcttcctggccgaacgccgtcagcatgatgacattcggctgctttttaagctgcgattccctcagcctttcaagaacggccaatccgtcgagatgaggcatgattatatccagcacaagcacgtcgggctccttgtctttaaacaaagaaaggcattcctgtccgttgtatgcgacaccaagcacttccatgtcgctctgtccctcgatatattcgcttaataggccgacaagctccctgttatcatcagcaacacatactttaattttctccacgtttcttcctccccaatgtgtatgttgataaatttcatcattctttttctaatatgtttaattcgacagcaccactttattccctttttttaaaaaggatttttccaataatagtggtatgtctagctttttctctgtttttttctgattttctcgatttttcgacttaaaatgcgacttgacaaaccggggaacgtgaatttgtcgaaaaatcttttcttctttcattttaacgcacaacgcccaagaaaaaaaggcgaaatcaaaaactgccggaggaatccggcagtcagcttgctttttcttttttataaatatcgattcccgcttcagacagcatccattcaatatgcacaccgtacccgctcgtcggatcattgacgaaaacgtgggttacggcgccaatgatctttccgttttggatgatcgggcttccgctcatcccttgaacgatgcctcctgttttactcaacagcctcgggtcggtgattttcagcaccatgccctttgtggccggaaacttctgaggtgtcgtactgacgacctgaatatcgaatttctcgactttgtcgttttcaataaccgttaaaatttgggcagggccttcttttacttcatctgaaaatgcaatcggaatggctttgtcagcgatgcggtttttaattgactcgtgaagcgttccgaagatcccgaatggactgtttctgttgatatcgccgatcacttttcgttctgatgcgaaacgagccagtttctctccgggatttccgcctgttcctttttcaatcgaggtgacggtcgatttcacgatttgtcctttttcaacaacgatcggttttttcgtatccatatctgaaatcacgtggccaagcgctccgtattttttcgatttcggctcgaaaaaagtcattgtgccgattcctgcggcagagtccctgatatataagccgattctgtatttgtcttcagcctggtcttttttcggaacgagcttcgttttgatttcctgtttatctctttttatcgacagatgtaaggtttctcctgtttttccggccttttgaataaaaggggtaatgtcattcattttctcgattttcgtgccgttgatttcggtgataatgtcgcctaccgcgattccggctgcttcaccgggcgattttttgccttcagaggtattgatttgatgaaaacccacgaccaatacaccaacggaatgaagttttacaccaatggactgcccgccgggaaccactttcaaatcaggcaggacatttactttcgtttttttaaccggaaatccggcaaagtcatagacgagttctgcctttccattcttttcgccttttatttccacttcgttttgattttctttcaatgtgaatgcttctgatgatccatctttcggagtactgacggataagctcgtttcaaccgcacgggtacccgtctcaaaaatgttcaaattttttggtattacaatgtattctttcaccggtttgtaaaatcctacacttattaaagaaacaaggagaattatacccacagcttttctgattttttcaacatccaccttttcactctcctcgcacctaacccacaccatataaatttctttcgctacattcattacttttgccttccggacggcgatttataactgtgaacggaagaaaaacattggataaaatgataagaaagagtttgtataagaaaatgccgacaaaaaaataagctgttcaaaaaatgaacagcttatccgctggttttgactagcttagcttgatttaaaagttctttcgcatggcgcttcgtcaaatccgttacttcaacgccggcaatcatccggccgatttccgctattttttcctgttttgacaaaggtgtgacgcttgttgttgttctcccgtctttcgactgtttcgtgatcaaaaggtgggtgtcagccatcgcggccacctgcggcaagtgggtaatgcataaaacttgagagccgatagagacgcggtgtattttttcagcgatcgcctgcgcgactcttccgcttacaccagtgtccacttcatcgaaaatgatcgatgtaacatcctgctgagcggagaaaatgcttttcatcgccagcatgattcttgagagctctcctcctgaagcaacctttgacaaggatttaagcggttctcccgtgtttgtggagatcaggaaacgaacggtgtcaatgccgtgctttgtgagctgaacaggcattccgttgacgacgggtgcatcatcatcccgttccgcttttttcacatgaaattccgtatcaaatgtcgatttttccatatacagatctttcaattcctgctgaatctgtttggccagcttttccgcccatttttttctgatttcggacacattggctgcttcaatcgccacatccttgccgattgattcgagtcgtgattttaaagcctgcaagtggctgtcccggttttcgatccggtcgatttcttcctctatcttagccgaataagcttggatgtcttcgacagtagcgccgtatttgcgtttcagctgtttgatttcgtttaaacgcgattcgatataatcgaggcgctcggggtcgtattcgagttcatccagcatatttctgatctgaaaggttgaatcttcgagaatgtagtaagcgttggctaccgattcagatactttattgagcccttcattaatgcctgagacgttttcaagctcgcttgaagccatgccgacccagtcaagcccggcctgctcattgcgaagcgcattataggcattttgcagcgcttcgtatattttttcgaaatttgcaatttgacggcgctcttcctgaagaagctcgtcctctttcggctcaaggtttgctgattcgatttcgtcaagctggaactgtattaaatcgagcctgtgagccatttcctgctcgctttcagaaagctctttcaccttcttcatgacatccatgtagcggctgtaaacttcctgatacgcttttaaagcattctcgatttcttctcctgcgaacctgtccagaagctgaagatggtgctcgtcctccatcagcagctgattgtcgtgctgcccgtgaatgtcaagcagcagtctgccgacttcccgcaatgcggcaatggtgacaagttttccattgacgcggcagatgcttttgccgtttgcgttaatatctcttctcatgacgatcatgtcgtccgaggcttcaatccccagctctgtgcacaaatcaaaaaccggatggccgccgtcaaggaggaaaagcccttccaattcggcccttttttcgccatacctgacatattcggacgatccgcggcctccgacaagcaaagagacggcgtcgatgatgatcgattttccggcacctgtttcaccggttagaaccgtcagccctttttcaaaagaaacggttaattcttcgataatcgcaaagtttttgatcgataattcagctaacaagctttcatgacacctcttttcaggccttcgtttataaaagctccaatattttcttctgtacgactttcgtatcatcatgcgtccggcagatgatcaaaatggtatcatctccgcagatcgttcccatgatttcttcccaatccaaattgtccatcagcgccccgatcgcctgcgcgtttcccggcattgtttttaacacaatcagatggctggctgagtcgattttgacgaatgcgtccattaacgatctttttaatttggaaaggggattaaagcgctgatcagcaggcaggctgtatttgtaggaaccgttgtttgtcggcaccttcaccaaatgaagctctttaatatcccgtgagacggtggcctgcgtcacattatagccgtctttctttaaaatatcgacaagctcatcctgcgtttcaatttcattcgcggtgataatctccctgattttaatatgcctttgacctttgttcatttcacacctcgttttatacacaaattgtgtatgtttatacatttatgttaaatgattttgtcggaaaagtacatgtttgcagtaaaaaaggaataatagcccactattattcctttttgcgtgccggccaaccctcgcattcgccgtacggccctgcaagggtttttaatcacgctgatccggttttttcgcttttaatgtcttgtgagcctcttcgacaatttgattgatcgtttcttccgctatcggcgttccggattgcgcctctccgtcccaatgcaaatggagaaggaattcgatgttgccgtcgccgccggtaatcggagaaaacgaggcgtttcggcagtcgtatccttctcgagccgcaaaccggctgatgtcatcaagcacagctttatggacgaggggatcgcggacgatcccttttttcccgacggattcccgccctgcttcaaactgcggtttgacgagagcgatgcagtcgcttcccggcactaaaatgttcttcagcacagggaggatgattttcagtgagataaaagagacatcgaccgtcgcgaactccggcagcccttccgtaaaatcggcaggtgtgcaataccggaaattggtgcgttccatcacaacaacccgctcatcctgcctcagcttccaggcgagctgattataaccgacatcaacggcatatgagcaaagagcgccgttttgcagcgcacagtctgtaaagccgccggtggacgagccgatgtcaatcatcagcttgccttgaacggagagctgaaactcctttaatgctttttcaagttttaatccgcctcttgagacgtattttaacgggtttcctttaacggtcagcgggatcgtgcggtcgaccttttcgcccggcttgtccagtctgttttcattcgtatagacaatgccggccatgatggctcttttcgctttttcccgcgtttccattaaccctctttctactaataaaacgtcgagccgttctttttttcctgtcatgatccaattcctttatgagtctttacgggcgtcaaaagtcttattcgtctgatgacgtcttcttttgtcattccgatctcttccagaagcttggcgacgctgccgtgttcaataaattgatcaggtatccccattctgtcaatgatcggactgtaagactgatgttcatgggcaaactcaaggatcgagctgccgaatccgccttgaagcacagcctcttcgatcgttaaaatcggaagcccctcgttcaggatttccttcagcatgttttcatcgagcggcttgataaaacgggcgtttaccactctgaccgaacggccttctttttgcagctcctccgcggcagcaagcgccatcggaatggtggtgccgaacgttaaaatgaccgcgtctgtcccaggtcgcagcacttcccacgttccgatcgggatcgtttttaattctttatccattttgacgccgagtccgtttccgcgcggaaagcgcatggcaatcgggccgtcgtcgtatttgacagccgtgttgaccatgtgctggccttcgttttcgtcttttggcatcatgagaaccaaattcggaatatgccgtaaaaaagcaatgtcaaacacgccctggtgtgtttccccgtcggcgccgacgagacctgctctgtcaatgccgataaatacatttagattttgccggcagatatcatggacaacctggtcataggcgcgctgaagaaatgtcgaatagatcgccagaaacggcttcatattctgtgtcgcaagtcccgccgccatcgttgccgcatgctgttccgcaatgccgacatcaaacatgcgctccggaaattcgctcgcaaacccttcaagttttgaaccgacaggcatggccggagtaatggccacaatccgttcatcctcgcgggcaagcttcctgaccgtttcgcttacgagcgagctccatgatggtgcagcagctttcggtttgacaaagtcaccggtatcgattttatatgggccggttccgtgccatgttccggttttatcagtttccgcaggcttgtagccttttccttttttcgtaataacatggaggagtaccgggcctttcgttttcttcgcatactgcaagttctcaaacagttcatcgtaggaatggccgtctacaggccctaaatacgtaaatccaagctcttcaaagaacatcccggatacgagcagatatttaaggctgtctttaatccgttcggctgtagcggcaagctttccgccaacagcaggaatccgcttgaacaaatactcgagctcatctttgacccattggtattttccggctgtacgcagccttccgagcatggaatgaatcgctccgacgtttggagcgatgctcatttcgttgtcattcaaaatgacaatcatatctttttgttcatggccgatatggttaagcgcttcaagagccatgccgccggtcagtgcaccgtctccgatgatcgggatgatatattcgtttgtgccttttaagtctctcgcagccgccatccccatcgcaccggagagagaagtcgagctgtggcccgtttcccagacatcatgttcgctttcattccgctttggaaaaccgcacagccctttatgctggcgcagcgtggcgaagtcctttccgcggccggtcaacagtttatgaacatacgattgatgccccacatcccacaagaacttatctttcgggctgtcaaattctttatgcaatgcaatggtaagctcgacaacgccgagattcggaccaatgtgccctccggattcagaaagcgtttcaattaaaaaacggcgaatttcagcgctcaagctttccagttcttcatttgaaaggttcttcaaaaatgcagggtcctttatcgataacagatccaatcggatcaactcactttcagcatgatttctgcaagtatgcgccttgcttcgttttaggttttcagcttgaattattatatgatgaattcatccccatgcgcaaacttgcatatgcggacgcttcgtttgaaaaaacagccgctaacacaacgtgataacggcgcggcgttttagagttcaactctctacattttatcacaataagcctttgatgctcaaatggaagccctgtatcaatgatccctagcggcaatcatatcgcagaactcgtacataagctctttttcaagcggaagctctgaaatcagctgttttgctttttcaatatgttcatcaagtttttggctggcgccctcaagcgaaaggagcgacggatacgtcgactttccgtttgaagcgtcggatccgatccgtttgccgatcttatcctccgagccttcaaggtccaaaatgtcatctctgatctgaaagccgatgccgatatgatggctgaattcgcgcagcttttcgatctctttttcagatgcatctgcaagaatggctcccgcaatgacgctgaagctgaggagtttagccgtttttccttcgtggattcgctgcagttcatcaagagatacagactttgattccgcttccatatctaaaatctgaccgccgaccatgccttcggcccccgctgccgaaatcagctcgttcaccagtctgatgcgcttttcagcggatacatcagaaggcatattggaagtgatcattttgaagctttcggttaataaggcgtctcccgcgagaatggccgtcgcctccccgtaaattttgtggtttgtcggcttacctcttctgaggtcatcgtcatccatacaagggaggtcgtcatggattaatgaatacgtatggatcatttcaaccgcgcatccgactggaattccggcttcttcgtcttttccgtacgcatgaagaagcgcaagaaccaatatcggtctcagccgtttccccccggcttccaatgagtacagcatggattccttgaggatggacggcgcttgcaagtctttaatatacatcggaaggcgctcttcaattactgtttttctcgattttaaaaatccttcaagtttaccggtcacctttttcctcctcccgaacactgaaaggagctaattccccgttttcccgcaaaatgaagtccatctgtttttcgacattttgcagtttttcgtggcatattttcgaaagagccatcccctcctggaaatagtcgatcgccttttccaaaggcacgtccccttcttcaagctttgatacgatctgttccaaacctttcatcgcctcttcaaatgtcaggtcatcccggtttgttttgttttcttcagccatttgtttcgcctctcttttgcagtacctcacaggtcagcgtcccatcgtttaatgtgacgcggatctcgtctttttcatgaacctgttcaatacttttaatcaattcgttttctttatatgtcaaactgtaccctctttccatcacttggagagggcttaatgcattcagtttaccaagaaccgtttgaaactgcgagtgaatctgcttcagctgcactttcatattccgcttcagccggactgtttgctcttcatgcctttttcgcgcttgtttaagctgctcctcgggatgaagcatctccagcttgtatgtctgttcgttcagtttttgttttttgcggtcgacggtcatcgccagctgtttttggaaacggtcgaatatcaggtcgaattcctgttccttttgggcatatagccgcttcgggtatcggaaggcataggaggactgaaggtttttcacccgctcctgccgcttttttaagtcctgctgcatcgattttgtcattctcgcttcgagcgttttcagacgctccagcaaatcaagcatattaggtacggccagttcggccgctcctgtcggggttgccgcgcgcaaatcggcgacaaaatcgctgattgtaaaatccgtttcatgcccgacggcagaaatgatcggaatgtcagaagaaaaaatggccctggcgacggcctcttcgttaaatgcccacagctcttcgatcgatcctcctcctcgaccgacgattaatacatcgcataagtctctgcggttagcctcttcaatgctgcttacgatggactcgcccgcgtttactccttgaacgagcgtaggaaggacgatcacttttacaaggggatatcttcttttaatggtggtgatcacatcgcgtacagccgctccagttggagacgtgacaacaccgacgacggatgggaacgcggggatgggtttcttgtatttttcatcaaataagccttcttgcgatagctttttcttaagttcctcatacgcgagatgaagcgcacctatgccgtccggctggatttcttttgcataaagctgatagctgccgctcggttcatataccgaaatgccgcctctcaccaatactttcatcccgttttcaggggtaaaggcgagattcctgttttgtctggcgaacatgacggattggatgcgggcgttatcatctttcagtgtgaaataaatatggcctctgctatgtattttaacatttgacagctcgcccttgatccaaatatcttcaagatgagggtccacgtcaaatttgcgcttaatatattttgtcaaagccgtgaccgtgacaaatgatatttcactcatggcacagtctcctttctaagaaggcacaagaacgttcatccgccggcgcgagaccaggcggatgaacggctgtacattaaagttgaattgtacgcttcgctgatttaaccgtgttgtgggccagcattgtaatcgtcatcggaccgacaccgcccggtacaggtgtaatataggaagccttttccttcgcttcttcaaaatcgacatcaccggcgagctttccgttgtcaaggcggttgacgccgacatcgatgacgacggctccctctttaatttgatccgctttgatgaaattcgcctttccgacagcgacaatcagaatgtcggctttttttgtatgagccgtaatgtcggccgttcttgaatggcagtacgtaacggttgcgttttcgttcaagagcagctgccctaccggctttccgacgatattgcttcgtccgacgacaacaacctcttttcccgacaggtcaatctcggttttctttaaaagctccacgatccccgcaggcgtgcaaggcagaaacgtatcttcgccaagcagcatcttccctacgtttaatggatgaaaaccgtcaacatctttctcaggggatattctctcgatcaccgcttgttcggaaatatgatccggaagaggcagctggacaagaattccgtgaaagtcgtcattttgattgtactggtcaatcacttcaagaagctcctgttcagtgaagcttgcatcgaaatgatccagctgaaaacgaatccccattgcttcagctgcttttttctttccccgtacatatgaaagagacgccggatcatcaccaattaaaataacggccagtcccggggtaactccttgttttttcagctcttcaacttccttggccagctgcccgcgcttttcctttgctgtttctttcccgtcgatgatggttgctgtcatttgctctcctcctagattattcaagatcggatttaatgttagaaagaacaccgtttacaaacttcgccgacttgtcatcaccaaattgctttgccagttcaatcgcttcattcatagagacgttgacaggtatgtcatctaaaaagatcatttcgtaggcggacaaacgcaaaatcgcgcggtcgacattcgccagcctgtcaagcttccaattgacgagatgccgcttgatcatctcatcgattttctctttgttctctaagaccccgtaaacgagctgttcgaaaaaagcatcgctttcctgcccgtccaaggcatgctgcatcgcttcattcggttctatatcactgacatcaatctggaatagtgactgcaaagccttttctcttgctgttcttcttttcattctttctttttctccttttaccctctttgctgcttgccgtttaagccacaaagagatcatatcatatttttagtctttccgcatgcaaaaatcgcggttttatcgtcaataaccgaataataaggaacaatcgtttattatcattcgtttttcgaacttctcaacaaactctccggttatcttatttttgatcgatatcggcggaaagatgcttttaaacgtcattttttaaaacggaacatgaaaaaaccaaagggccgtcattccccttggttcttccacttcaccgcactacatctcttgatcgatttccacctcgtgcgtttttgaatcgaattgaatgccaacgatgtgaatattgatttcattaatcgaaagagctgtcatattgagaagcgtctggcggatattatcctgaacggcattcgcaactttaggaatcgacacgccaaacatcatcacgcaataaacatcaatgataattccgtcatcggacaaatcaactttgacgcctttgccgtgattcttttttccaaaccgttctacgacacctgtcgcaaaattgccgcgcatttcagctacgccttcaacttcggaagctgcgattccggcaatgacttcaatcacttccggagcgatttccacttttcccaaatgattgtcttcatggctcatttccaataagctgttgtcgtctttcaatatgttcacctccgttaaaattacgaccccattacatcatatatttctaaaaacttcgtattaaattctccgcttacgaatgtttcgtgctcaagcagcttcagatggaacggtatcgtcgtatgaacgccttcgatgacgaattcgctcagcgctcttttcatccttgaaacagcttcttccctcgtctttccgtaagtgatgactttggcaatcatgctgtcgtaataagggggaatcgagtatcccggataagccgcggagtccactctgacgccgagccctcccggaggcagatacatctcgatttttcccggagaaggcatgaagtttttctcagggttttccgcattaatccggcattcgattgcccatccgttaaaggtgacttcatcctgggtgagggttaatttttcgcctgacgccactctgatctgctctttaatcaaatcaacgcccgtcaccatctctgtcaccggatgctcaacctgaatgcgcgtgttcatttccataaagtagaacttctgctcgcggtaatcgtaaataaattctaccgttcccgctcccgtgtacttcacggcttcagccgctttgacagcggcctgccccatctgctccctgattccttcatccagagcaggtgaaggggtttcttcaagcagcttttggagccttctttggattgagcagtcgcgttcccccaaatgaatcgtgtttccgtgtgtgtctgcaagcacttggatttcgacgtgtctgaaatcttcaatgtatttttcaatgtacacacccgggttgccgaaagcggtggcagcttcctgctgagtgattttaatgccgttgatcagctcttcttccgtccgggcgaccctgattccttttccgccgcccccggcagttgcctttataatgacaggataccctatatcgcgggccaatgaaaccgcatcttcaatatcttcaataattcctttggagcccggtacgatcggaacacccggcctgctgcattgtttcccttgcaacatcctttgtcccatcttggaaatcgcgtctgctgtcggcccgacaaaggttacatttacctcttcgcaaagctcggcaaaatcggcgttttctgccaggaagccgtagccggggtgaatcgcatcagcaccggtcattttggcgacgctgacgatgttcgttatattcaagtagctgtcttttgaaagcttaggtccgatgcaaaatgcttcatcagccatctgaacatggagcgcctctctgtcggcctcggaaaagacggctaccgtttcaatccccagttctttacaagctctgataatcctgacagcaatttctcccctgttcgcaattaatagctttttgatcatcttattgctccttactctgcttttactaaaaataaaggttgtccgtattcaaccagctggccgttttcaactaatacttcaacgatctcgcctttcacttcggcttcgatctcattgaagagcttcatcgcttccacaatgcagacgacagaggactctgttaccttcgagccgactgttacgtaagggtcggcttcaggcgaagaagatgcataaaacgttccaaccatcggagaggtgatcttgtggaagtttccgccttcttttgccgcttcttcttttgcaggcgcatcctgaacaggcgcttgcttggcctgagcttccggagccggtgcctgaacaggcgccgcagccacttgctgaatggtttgcacggttccgctttgttttttcagttcaaccttcgatccttcgttttcgtatgtaaattcatttatcgaagattcatcaattaattttatcaactgtctgatttcatcaatgtttaacatgctatcgcactcctaatgaaaaagattttacgcatttatcagttagtactaaaagtacatactatattcatcttacaggagaggaatgccgaattcaactacaatcatggacgccctgcaccaacaggggccttaggcataaaaaaatcccgctttttgcaagcgggataggtttaatctgctggctcgaacgttacagccacatcgtttaagtttttcacttcttttgcgacgatgtcgatgatatcggtggcagcggctttcgagtgctccttcgccttcaccgtaatattgactttatcgccgtcggcgttgaccaaggcgtctttatagccttttgttttgatgagggtttcaagggtcttttccgttccttcagcttcgctgagctctgtcatcttgtcgtaagcttcgcttttttcttttgccgtcgctttatcgcttctgacgatttcggttaattcctccctctccctgctgcgctgatcgtccatttccatgcggtatgttgtgaataaatcttcatcacccgatgattcctctgtgacaacctctccgttctgctcactcgcagacgtttctttatcttttgtatctttccctttagttttgtctttagcaggcgcggtatcatctttgccatccttggcaggctcttctttcatcggtttttctttttcagcggcaacttgttccttgtcatcaaccgtgacgacattttctccttcgggcgacataatgtagtagacactcagtacaacgacgagacttaacatggttaaaagccaaaccgtttgttttttcagcatcatttatgaatcctccttcatttttttaggggcaacagcgacgcggtggctcggaacatcaagaacccttgtcactgcttcaataatggtcttttttatttgaacgttgtcgactccctgagcgacaacgagaacacccctgatatcgggctttttcgtctgaacgacgacaggcgtctctttatctccgtttttgatgatgacgatttcttcgtctgaagacatttcagacaccgtccgcttgcctccctgtttatctgtctcattcgttgaagtttcctgggtttttctgtttttctcgaatattttcaatgaggttgcatcaacattgacgacgattgacacgtcctcaacgccgatgatggtttccaatatgtctttgagctgattttcatattcctgttcgtaatcttggatcgattccttcggtttgtcatctgaggcgggcttgaacacttctttttctccttcaccgctctgtacggtgctttcagacgtagctttttgtgaagccgccggctgatctgccgctggctcttgggaaggttcggaagagaagatctggctgacgagcatgaaggaaacgccgagaacaaaaagcagcagaaagtagtgatatttcgtcagcttttttccgtctttctcgtctttcgggagcaggtggccgatcagcttttcgatccaggttcttttattcattgccgcttcgttctcccccttcgatatgaactgtaatcttgtcggggcttatttcccagatgcctgctagctgttctctgacttcccccgtctctttcttttctctttcctgcatggactggtagctccggtccgtattgatctcgacaggagcgacggcttggaccgttttttccgatgctggtttcaagaataccgagacttccgcatgcttactgaggtctttctctgttttcagctggctgtcagaagagacctcgactcggtctatcttgtatttgtcgcttgtaaacctgccctctgcgttcttttccaattgaacagccatctgttctaagatatatgcttgttgtgaggcttgtatttcttttttttctgaattcagctgattttttatttcgtttgactgaacttgtccgttttttgtaagcttctcaaaaatcacatccggatctgtcctgaataaagagaagatcgggttcagtattacaacgatcaagagcaggctgatcaccattttcgcgtatttttgcatgctcgaattcggcagaagcatatcgatgacgatcgccatcagaataaatagaataatattcgtgagccactctgtcagaaattccatctcatccctccctacttcatcatcatcgtcagattccccgctgtaatgatcacggttaagcttaagaaaaacatcagcgaaacgatggccatggccgcgaaaatgtagatgacgcttttgctgatgacatccaggcagctgataaccgggccgcctccgagaggctggagaaccgccgcggcaattttgtatatgagcgcgagggaaaggattttgatcgcgggaaaggctgcgatgcaaattaagattgccacaccgagtatcccgacggtgtttttcagcaggagagacgcgctgatcaccgtgtctgtcgcttcggtaaacatgcggcccaatacggggatgaagtttccggtaatgaattttgccgtccgcaaagtaatgccgtccgtcactgcggctgaggcgccctgaaccgagatgacaccgaggaatacggtcaaaaatgcagccagcgtgccgatcgccgcatttctgaggagctgggccagctgtgtgactttatattggtccgtcatcgtgctgacaatgcttaaaatcgctgataaaaataaaagcggcaacacgatatattggataaacaagccgctcgtgttcatgagaaaaagaatgaccggatgaaagaatgcggctgaggcggctccccccgaagtcgccatcagcgccagaagcagaggtacgagcgacaggataaagcttgtcatcgtctgaatcgcttcattcgcatatgtgacggcaacccgaaagctgttgagcgcaagaataatcagcaccatgtagacaattgcatacgccactttgctgacggtgctttgttgaaacgcgttttgcaaaagctgaagcaggacgcagaagatggtcaacaggatcagcgtccccagcagtttcccgttagccagcacttcatggaacaagtaggaaaacagcgctttgccccattcctcaggcgaaaagtgcttttctcctttgacaaattcaagcaggcttcctttttgactttcgggaaggtgtcccccatactctgtcaaaatgttgttccagaactccccgacccggtctagttccaaaccttcagcctgctctcttgcaatggcttctgccgattcttctgcagcggtttccccagccggctccgcttcttttggcgaagcttgtacattatgcgctccaaagcatacgattccgatgaccaagagccagaacagaaaacgcttcactcaggaaatcctcctttctgactaagacatggaagggatgagtccgatgatcgtttcgataatcacggttaaaataggcacagccatgactaagatgaggattttgcctgccaattcgatcttcgaagcaatcgcaccctgtccggcatcctttgtcagctgggcgccaaactccgcaatataagcaatcccgataatcttcaaaatcgtttcgacatacatcatgttgatgttggcattggcagctattttttcaatcatccgaatgatttcgtagacctgatctactaagaataaaaaaatcgtgcagccggcaaaaacgacaatcaaaaaagcaaacgtcggtttttgctctttcacaatcaagctgaggaaggtggcgatcattcccagtcctacgatttgaacgatttcaatgagtgagcccccctatccttgaaatagaaagacagcttttatcttttggaatagatcatcgacaacagttgccaccatgaacaatatataaatgaatcctaaaagcgtgacccattgggcatattccttcttccccatttgatccagtatggtgtgaagaaaagcgacgacgatcccgacgccggcaatttgaaaaataatatttacgtctactcccatttcgtgtatgctcccctcttcattacatcaatagaagaatcagtagcagtcccgtcaaaaatccaaggcttttgaccattttttcatttttcgcctgggcgagatttgcttcagcttcctctgtctctaaatgggttaacgccagtttgatatgtttttgctgagaaatcagatcatgacggcccagcgtttcgccgaattgccgtaaaatctcgtattctttctttttaagagccgtttcgggccatactttctccaggctgtcttcccatgccgtccctgctgaagcgctgcctttttcaagctgttctgcaaatgtctgaaacaaagaggctaccggctcggtaagctggtgtgcgatctgttttgatgcctgacggagcggtgtatgcccgtacatgatttcagcctccaaagactgcaaagcggccaacagctggcggatttgcttcggcctttccctgaaaggcttcgccatttcaaatcctgtccatgtggctgctgccaaaataagcacggcacctaaaagcttcagcatgataacatcctctttgctgccccgagcggctctccgttcccatttaggatgcggctcaggctgccgggaccgttctttctggaaagttccacgattcgctcaaaaacccggtgctcttgaagcattttcaatgatggacgcctggcgagatctgcatatgtgtagccgtgagccgaaacgatgacagtcacccccgcgtggaccgcttccaagagcgcttctgcgtcttccattctcccgatctcatcggcgatcattacctccggactcatcgatctgatcatcatcatcagcccttccgcttttggacaggcgtcaaggatgtctgcccggtcgccgagccgatattgcggtatgccgtttacacagcctgcgatttcagacctttcgtcaacaatccccacttttttggcaggggcgttgccgcttcccgaactgatcagcctggcgaggtctctgagcagtgttgtttttccggtttgcggcggaccgataatcagcgtgttcagccacgagttttgaaataaatgggggacatacggtttggaaatgccgattttttctttggcaatgcgaatattaaatgatgatatttctctgattcctttgacggccccgttttcgacgacaacccggccggcaagccccacgcggtgtccgcctctgatcgtgacatatccttttttcaattcctcttccagtgtatacatgctgtaatttcccaatctgtttaaaagaagcgccgagtcttcaggcgtcgccacataagggagaaagcgcggctttcctttgttcaccagttccagcggacgacttgtccgaacccgaatttcttctatctgatcgatttcatggtcgccaagaccgctgagcgcgcgtttgatcgtatcggggagaatctctgtgatgtggtgcaaaaacactccctcctctttttgcttgtcttctataaaaatgtatgatcaaaggaagacattatgacaagtcggcctctcttatcatgtgtcgctatttatagatccccgcgatgatcaaaaccactcccataaagatcaaaatcagctttgcgtaagaaagctgccctgcaatctgatagatgccgattgtcattgtaataataaagatgagcggcccgaccatggccagtacgctgttgaccgccacagcttttctgacgtcgtttgtcaaaagcatcacaacagccgccgtcagttcgatcaaagatgataccacccttaacgccgccattgtcaaaaccgtcggattgacttgtccaaagaaaagcttcatgatcttaaacctccagtaacacttcctctttttttacactctatgctctcctttgaaaaagtagtcttccgatttttctatttggcatgtgagaggtaaaagatttcagacagcaaaaaaagagccggcttcaatgaagccggctctttcccgctgttacctttatgctcttgatacgtaagaaccgtcagaagtattgacaacaagcgtatctccttcgtttacgaagaatggcacgttgacgacaaggcctgtttctgtttttgctggttttgttccgcctgaggctgtgtcgcctttaatgcccggttctgtttcaacaactttcagttcgaccgtgttcggaagttcgattccaatcgtctctgtctgatacatcatgatctgaacagacatattttcaagcaggaatttgagctcgtgttcgatttgcttctcgttcagctcaagctgctcgtaagatgtcgtatccataaaaacgtgctgatcgccgttggcatacaagtactgcatcgtttttgtttcaatttgggcgcgggccactttttcacctgcgcggaatgttttttcctgaatcgcacctgtgcgaagatttctcaattttgagcggacaaatgccgcgccttttcccggcttaacgtgctggaagtcaacaacgcgccaaatccctccgtctacttcaatcgttaaacctgtgcgaaaatcgtttactgaaatcatgattatcctcctattgctccaatcaaacggattataaaataattaaatctttcgcggaatgggtaagggattcgtttccttcctctgtcaggacaatatcatcttctatcctgaccccgcctttgcccggtatgtaaattcccggttcaaccgttacaaccatgcctttttcaagcatctggtcagaacgtgctgaaagcgccggactttcatgaacttccatgccgaggccatggcctgttgaatggccgaaataatcgccgtagccttgtgaagatatgtagtcccttgtgtatgcgtcagcctgtttcccggtgattcccggcttgatgctccgcatgccgatagcctgcgcctcaaacacggtttgataaatgcgtttcagctcatcatccggctctcctaccgcgactgtacgcgtaatgtccgagcagtaacctttatagtaagccccaaagtccagcgtcacaaggtcgcctttctcgatcgctttgccgcttgccactccgtgcggcagacttgagcgtacgcctgacgccacgatcatatcgaaggacgaatgatcggctccctggctccgcatgtaaaactcgagctcattggcgacttcaatttcggtgatgccgggcttgatgaccgtcagaatatggctgaatgcatcatctgcaatctttgcagcttcctttaatatcttaatctcttcacttgacttaatcaagcgcaacttttccacagattgagaaacgggaacgagttcagctgcgccaagctgctctttgtaggcggcatacgttccgtatgtcattttatcctgttcaaaaccgattttgtttatccccatctctttgatcacttcggcggtcttttgaacgattccgccggcatgctgaacgatgtcaaagcttttgatttgatccttcgcctgttctgtatagcggaaatccgtaataaagactgcttgatcgtctgagatgaccgccagtcctgaagatccggtaaatccggtgatgtaccgcaaattaacgccgctcgtcaccaatataccgtcaatgcctaaaccgccgaaaagctctctcaatttgtttagtttcattgtccactagtccccctatttgttatttgtgttcataaaataagagatggccagcttataaccttcaaagccgagtccggtgatctggcctcttgcaaccggagcgatgaccgagcggtgccggaactcttcccttgcatgaggatttgaaagatgaacctcaatcaccggtatgctgattgcagccaccgcatcgcggagggcatagctgtaatgcgagaaagcccccggattcaagacgattccatcgtattgctcctctgcctcatgaagagcatcaatcaggtccccttcgtggtttgactgaaaaaaagtcaattctgtctgaatgccttcggcaaattgaaaaagtctttgttccaaatcggttaatgtgtctgtcccgtatacatcgggttcgcgttttccaagccggtttaaattcggtccgttcaaaattaaaatatgcggcaactctgcctcccccttctcatcacgcaaaaaaatgtccacttacagtgaacattttatcatattgcttcctgatcaggcactattctcttgtttctccaagggcgcgcgtcagtttttcagaattgagctcattgtattcaaacgaaatggaatagccgacgaataaaccgtaaagcagataaatgcacagcgtcgtcacaatcgtttccctctttaattcagccactgtctgaacatcgggaaacatcggattgaacaggtaaaacacgacagcccacaaaacggctccatagacaatgcctgcccacatgcctctgacctgcttcaaagtgccgtagtaaagcaaggcagccccgatggaaatcactccgatcaagagtatgctgataaacgttccgagaaatccgtttttccagtcgccgatgacaaaaggctggagaatcatgttcgcattgacctcggagaacttaaaaaggtacgccagctcaccgagtgcactccagagcactccgccgacaaagccagtcatgatcacccttccggtgaaagtcatcggggtttcacgcttattctgctcaagctcttccggctgtttttgattgtcttcattacccatacagtccagatcacctccatttccagtatgtccaaaaacagccgcggcaacatcagctttcccagatttttaaaatccgagtgtaaaaagcatgaaaaagggtatactttaattagatttggctttgtaagaggttcgaatttcttaaatttttgagcccgtcaatctagaggtttcagcgtttttcctgtacaataggtgtaaggaaatggttaatgtactcatagattgatacagataggttgatgcaaatgtcaaatcaaacaaaacagcccgcatacggagggcaggctgtcgtcgaaggcgtcatgttcggcggcaggcgccattatgtaaccgcgatccgcagaaaagacggaagcattgaatttttcaagctgcctcggaaaaccaatccgacgcttgaaaaattaaagaaaattccttttctcagagggattatcgcgattgttgaagcgagcgctaacggcaccaagcacttgaatttttcgagcgaacgctatgacctcgacccttctttagacgatcaattgaaagaagagaagccgtccaatctgacaatgatttttggtctcgccgcagtcggcgtcctgtcttttttgttcggcaagtttatttttacgctcgtgcccgtttttttagcggagctcacccgtccggtctttcagtcggacgtcgcgcagattatgatcgaaagcttctttaagctgctccttctcctaagctatatttacgctatatcatgcactccttttattaaaagagtttttcaatatcacggagcagaacacaaggtcataaactgttacgagcaaaatctgccggtcacggttgaaaacgttcagcggcagtcaagactgcactaccgttgcggaagcagctttattctattcaccgtcatcgtgggcatgtttgtttacttgcttgttcctactgaccctctctgggttcgtattttgaatagactcgcactgatacccgtcgttctcggcatttcatttgaagtcctgcagctgacaaacaaactgagagacatccctgtattgaaggcgctcggctacccgggcttatggctgcagcttttaacaacgaaagagccgtctgacgatcaggtggaagtggcaatcgcaagcttcaatgagcttcttcatatggaaaccaaagcagaggacgaacagaaggaaccttctaatatcgtaatgtaatgtaacgaattggttaattttttgggaggtggacagttatgaagcaacgcgtacatcctgtctcagctttaattattgcgtttggaatttttgggtttgtttatttcgccgtcacaagtccgggccgcctgctccaatacttgcttgtttttgccgcggtcggcgccatcatttatttcgtgatcaggcgcatttccaatcgcaatatgggcagtgagggagccgcttttaagaaagcagccaaacaatccaacaagcgttttcaggatcataaaaaacgctctgtaaaaggcagggtcaatcacctgagaagcgtaccgtctatcaataaatcgaagccggtattggtgaagaaaaaaagccagacccagctgacagtgattgaaggcaaaaaaagcaaaaagaaaaacagggctttcttttaaaacgtccactgtttcaaaaataattctgttcgtttttttcctagctcgattagagctagttttttttctgccgacatcgcgaattcagtcgacaaaacttcctcaacaggcaaaaaaatgatgttccgctcatgtttcgtggcaatgtgcctggcgtcatgcgcctctttcatcgtctcaaacagcgccccgaacagctcgaacgcatttttaatcgttttcttcggcctctctttttcattgggcatcagcgtgatgcccaataccggccgttttttttctgttgtaaacagccacatcggaaaattgctcagaactccgccgtctacgacgacgctgattccgagaggtgacttgagcttcaccggctcaaaaaaataagggatgctgcagctcatccggaccgccctggcgacggaaaatcgccctggattcaaaccgtacctgtttaaatcgtcaggcagcacaagcatcttgccgttcgataagtcggaagcgatcaacttcagctttccctgttcaagatccccgaacactgaaatgcccttcgctttcaacttttcggaaatccagttttccaatttatctcctttatataaaccgagccgccaataaatcgatgcccattgcagcaatttcaaaggcaagagtgaaaacctcgggtcaaggagctcgctttcatttaattcctccatcatttggcggatctccgcgcttgtatagccggccgcgataaatgaggcaatgatcgaaccggcgctcgttccggccagccttttaaatcggaagccccgtttttcaagcgcttcgtatgctcccacaagcgcaacccctttcatgccgccgcctgaaaaaaccccgtcgatgtacatcgcgatctcccccccttaaaagatggctctacatcattttaagaaacggacagaaaaaaaagaccatgagacaacgagcggcatccggaaaaaatgatacgaaaagaaaaaaaccgccgttacccagcggcttcagcgtgtcgacaaaccctcgcattcgttgtcaggcctgcgcgtcggtgctcacgaattccaacattcgctccgctccgatgctcggccttcctagactgcaagggttttcaatcacgctgaaagggatgacaaaatcccaaaacaaaaagtcgttttgggatttgtcaacaatctgaaaccgccgttacccggcggcttttattgattttcctgttcgtttcttttttggacgcttctcaaatcgtcgattcttttgctgtcgtcttcaaaatactgcacaagatctccgatacggtcaatgctgttccagcttaaatgatgttcgattccttcaacatcatcataaattttctcttcgtcaacaccaatgattcgtaaaaactgctccaataattcatgtctgtatactaaacgcttgcctattttctttcctttaggcgtcagcacgaggccgcgatacttttcataaatcaaatattcgtctttatcgagtttttgaaccatttttgtaaccgaggagggatggacggccagagcttcggctatatctgagactcttgcatatcctttttcttcaatcagcatataaatttgttctatgtaatcttccatactcggtgttgtcatcgaatccctccaaattacacctattcaaatcataacaagtttacactatgtgcatgcaaaaaacaagcaacaggataacgttttcacccgattaccttctataattccattcatctgtcgcatacttcgtcctggcgagatcttcgacaaattccgtttcctcttccgtcagttcataaggctccaaatgaatgttaagccctttttcaaacccttttttaaaagcttcgctcgcttcttcaatcgtgactttttctttcgtcagctcattgatggcgaccgctttttgtttgaagtttctctgcatgcgctctctgaggcggtcatttttgtaaataaacaaatcaaagagcttgtcctcatccagatcaagaaggatcgaaccgtgctgaagaatgactcctttctgccttgtctgggcgcttcctgcgacctttctgccttcgacaacgagctcgtaccacgacggggcgtcaaagcagacggaagatctcgggtttttcagactctgtttctctttttccgttctcggtatggcgaaatacgcatcaagctccagctctctgaagccttcaagaataccttcagagatgacgcggtacgcttccgtcaccgtcttcggcatttccgggtgttcttcagacacaatgacgctgtaggtcagctcttggtcatgaagcacgcctcttcctccggtcggccttctcacaaagcccaaaccgtgttttttgacggcatccagattgatttccttttcgatattttggaaatagccgactgaaagcgttggcggattccagccgtaaaagcggatggtcggcggaatcttattttcgctgtgccaaaaaaggagcgcctcgtcgagcgccatattaaaagcgggatcccgtcgtcccgaatcgataaaacgccatgtttctttttccataacctaccctctttttctttggtataaaataagtctaccattccctcttaaaattgaaaataaattcggcgaatcagatgacagatttctgaggctttactataatagtacttgtcttaacatatcgttaaaaatctcccgcatacttacttaggcgggacgaattcaaaaaggagtcggatcagattgtctaccagcagcattgtcgttctcttgatttgcgccgcgctcatcatctacgcggtcgcttcatacatctatcagcagcgcattatgaaaaccttgacagaagaagaattccgggcaggctatcgcaaagcgcagctcatcgatgtgcgcgagccgaatgagtatgaaggcggccacattttgggtgcgagaaacattccgctttcacagcttaagcaaagaaaaagcgaaatccggcctgacaaaccggtttacctgtactgccaaaacaacgtcagaagcggaagggccgcccaaacgctccgcaaacacggctgtaaggagatttacaacctgaaaggcgggttcaaaaaatggggcggaaaaattaaaacgaaaaattaataaccgaagctgtctctgctatggaaggcttcagttgagtccagcatcctaaagcggtttaacgttttaggatgttttttttgcatccgggaggattcgggtgatgagcggttatccctttccggcaaaaataagccggcgagatgggttcgccggctttgttcgttattttttcaagtcttcgattgaattgacatctttcatatatgtcggaacgacaaggccaatttttacgcctgtcatgctagtaccgatatcttcgtatttgcctttgtatttttcagcatatgttttatgcgtttgcggcagccatgcagcaagtgaagcatcgacgcttccatttgcaatgccagtccacatcgggcctgcttctacttggctgagcgtaacgttgtatcctaagtcttcaagaacttttgcgatgacattcgtgctcgcaatttcgctgtcccatgccacatagccgagcttaattttttcaccgtccgctttatcgacgccttttgtccatttcttaactagatcttgatgttttttcacgaagtctgctgcagcttcttccggttttttgccttcctgaacggcaagcatgacttctcccatatcatcctctgtccagctgaattggctgagcagcttgtttgcgcccggatggtcgtccttgaatcctttgcgcgtaacagtatggatttcttcggcatcgccgtaggaacctttaggatcttttaaatatttcagatcgtattttgcaaacatccaatgcggcgtccagcccgtaatgatgatcggatcttttttgtcataagcttttttcaatgcggctgtcattgctgagcttgatcctgacgttacagtccacttgctgagatcgtagtccttgagcgcctggtccgtcgcattcataatgcccgctccaggatcaatgccggtaattttataattgacttgatcgcctactgacgcattttcattattattgctgcttccgcaggcagccagacccaatgtgagtaccgctgcagtgccgattcccgctatctttttccacattatgcattccccctgctctttttcaattttatattttgtgtaacccggtcaagtacgatcgcaataataacaatcgcaagtccggtttctacaccggtacccgtttgcagctgggtcacagcccggtaaacttcttctccgagtccgggcgcgcctaccattgatgcaataacgaccattgacaaagcaagcatgatgctttgattgataccggccagaatggttttcgtcgcgagcggcagctgcactttaaagagccgctggcttgtcgttgaaccaaatgcttctgtagcttcaatcagatcttcaggcacctgctggatccctaagatcgtcatccggattgtcggaggcatcgcaaagataacggaagcgacaacacccggcacaaccccgatattgaaaaagaagatggccggaagtaaataaacgaatgccggcattgtctgcattaagtcaaggatgggcgtaacgactctccgaaccgttttcttttgggagccccagattccgaccggaatgccgataatgacagaaatcagaacggatgtgacgacaagcgccaatgtctggagcatggcgtcccaatatcctaaataatcaatgataaaaaatccgattaaagtaaacagcgcaatgcctcttttgctgatcagccagacgagcgcggcaaaaataacggtcaacataaccggcggaacaaaacccagcccttggacaatctcatcaacaaacgattccactccgctggcaattccgttaaatacaccgccgaacgacaccgtcagccagtcaacaaactgatcgatccaatcggctaaaggaatgcggggaagcgatgataaagtaaacattatctcacctcctgaataacagcttcatgggctggttcatgagcattaatataccggtcatttccggcaagcgctccgattaatgcgcctttgacgatgatccctttcatccgctgtttttcatcgacgacagcaatcggaatgctggcatcagagaccaattcaaagatatccgtcaggacaacattctcttctacggttgtgatttctcttgagatgacgctctccagcgtctggcttttttcggctgctttcttcgctgtttcagcatcgacggagccgaggagcctattgtgtttgtcaacagcataaatcgaggagatccccaggtttttcatcagcgtcagtgcaacgcgcggccctttgtctacgcgcacggtttcagcccgtttcataatgtggccggccgtcagcactttagataagtcgacatcttcaacgaatttttcaacatattcgttcgacgggttcattaagatctcttccggcgtaccgatttgaacgatgtttccgtctttcatcaatgcgattcgatcgccgattctcagcgcttcatcaagatcatgggtgatgaaaataatcgtttttcctactgattcatgcaaatcgaggagttcatcctgcatatccttgcgaatcagggggtcaagcgcgctgaacgcttcgtccatcagcagaatgtccggatcgttcgtcaatgcgcgggcaagcccgacgcgctgctgcatcccgccgctcagctgatccggatattgctgttcatacccttcaagcccgacaagctttaatgattccatagcttttagccggcgttttcttttatccactttttgcagttccaatccgtactctgtgttttcaagaattgttttgtgcggaaacagagcgaatttttgaaagaccatgctgattttttttcggcggatttcccgaagctggtctttggacatatttgttatcatgtcaccatctatgtgcacatgtcctgcagtcggttcaatcaaacggtttaaaagccgcaccaaggttgatttaccgctccctgatagacccatgatgacaaatatctcaccttcatacacgctaaaatctgcttggttcaccccgacggtcgccccggtttctttcagaatttcttttttggttttgccatcggcaagcagctgcgttgctttctttgtattctttccaaacactttggacactttttctacttttatcttgattcgcttttcgtctgaattcatatttctcctcccgtatgaagcaatctaatataccgtaacatttatgtaacatatgagacaaacggcatattcgctatcattttgtatcataccttcatattcatcgttgtcactctccacccttgcgaatccttctaaatgctccataatcctcttctttcaaggtaaattaaaccattatctcactagaaaacattgaaactatcgcgttttgcaaagtaatttttatttttacttttaaatttgatgaatttactatttaatacgggagacatccttctcattcaatcagtaaatcgcttacataaagatattatttttcacataaaaaaaaccggcgaaatcgatccgccggctttcttatcatttttcatagcgcagcacgggcttccgcgcagcttttgtttcatccatgcgtttcacaacggttgtatgcggtgcttcctgaacgacttcaggcgtttcctccgcttcttttgcgatctggatcatcgtatcgataaacgcatcgagcgtttctttcgactctgtttctgtcggttcaatcatgatgcattcctcgacattgagcgggaaatagatggtcggcggatggaagccgaagtccaaaaggcgctttgcaatgtcaagcgttctgactcccagctttttctggcgccttcccgacagcacaaattcgtgcttggagtgtcggtcaaacggcagatcgtagtaaggagcaagctttctcatcatataattcgcatttaaaacggcgttttccgtcacttctttgagcccgtccggccccattgaacgaatgtacgtatatgccctcacattgatcccgaagtttccgtagtaaggtttcaccctgccgatcgaatgcggacggtcatggtcaaaagtatagcgtccgtcttttttcacaagcaccggcttcggcaaatacggtatcaattccttcttaacgccgacaggacctgacccaggtcctccgcctccgtgcggtcccgtaaaggttttgtgaagattcaaatggacgacgtcgaatcccatgtcacccggccttgctttgctgagtacggcgttgaggttcgctccgtcatagtacagctttcctccggcactatggacgatttcagccatttctaaaatattttcctcaaaaaggccgagcgtatttggattggtcagcattaacgcggcagtttcttcgtctacgacacgctttaaatcttccagatcaacaaggccgtcgtcattcgatttgacggtgaccgtttcaaatccggcaacagtcgcagacgccggatttgtaccgtgggccgaatcaggaacaataaccttcgtccttttatgatcgccgtttgcctcatggaacgcgcggatcatcatcagcccggtccactcgccgtgcgcgccggcagccggctgaagggtgacctcatccattcctgtgatctcttccaaatgctcgctcaagtcgtacaaaagttccagcgcaccctgcacggtcgcttcatcctggagcggatggatcgcagaaaatccagggattctcgcgattttttcgttaatcttcggattgtacttcatcgtgcacgaaccgagcggataaaatcccgaatccactccgtggttgcgcctagataaagccgtataatggcgcataatatcaagctcggacacttcggggagatctgccggttcgtctctgatatacgcttcgtcaatgacgtctgtcacatctgtttcagggacgtcaagctcaggaaggctgtagccgacccgcccttcttttgatacttcaaaaataagcgattgatcctgattattcatggcaatcccccaattcattcatgagtgtatcgatttcctcttttgttctgagctctgtcacggcgatcagcatgtgccgttttaaatccggatatgaagcgccgagatcgtagcctccgataatatttttctcaagcaggcgttcattcgctttttcgacaggttcattgagtctgatgacaaactcgttgaacatcggcccctcaaacgcgacttcaagaccggcccgtttagctgcttcttttgcgtaagccgctttttgcaggttctgccatgcgatttccttgacgcctttttttccgagcgccgtcatggcgactgacgcagcaagcgcgttgagcgcctggttggagcatatatttgatgttgctttatcccgtctgatatgctgctcgcgggcctgcagggtgagaacgaatccccttttcccgttttcatcttccgtctgaccgactagacggccaggcacttttctcatcaattttttcgtgacggcaaagaatccgcagtgcggaccgccgaaagcagcagggattccgaacggctgggcatctccgacaacgatgtcagcgcccaacgccccgggcggtgttaaaagcccgagagccagcggattggcggaaacgatgaacatgcttttccctttatgggcgatcggtttaatgtctttcagcggctcaattcgcccgaaaaagttgggatattggacgatcactgctgctgtatcttcgcagacggcttcatcaagagcctcaagatccgctgttccgtttttggaagggacttctaccacatcgatgtactgtcctttcgcatacgtttttagaacctcgcgcgattcgggatggacggtttccgaaacgacgatttttttcttttttgtatgtcctgaagcaagcattgccgcttcggctaacgccgttcctccgtcatacatcgacgagttgctgatatccatgcccgtcagctcgcaaatcatcgtttgaaattcgaaaatcgcctggagctccccttgagaaatttctggctgatacggtgtgtaggccgtgtaaaattccgaccgcgaaatcacgtgatccacgatgacgggctggtaatgatcgtatacgcccgctcccaaaaaagaggcgtacgtcactgtatctttatttttagccgcgagtttcgtcagctcttttgtaagctccgtctcggactttgcctttttaatttggtattcccctttaaatctgacgctttcgggtatatcggagaatagctcgtcgattctctcgactccaattgcctcaagcatctcctttttatcctgatctgtagctggcaggtaacggtgcttcatcttcagtctcctttcaaggtcttggcaaacttacggctgccgtttgtaaaatggggttttcacgattttggctttcaaacgtttatttctgatctccacttcaactacggtgtcgagggcgcaggcttcttttttcagcaatgcgaggccgacgtttttctttaaagtcggcgactgtgtgccggttgtcacctcgcctgcttgttcgccttgataatagacggcgtatccgtgtcttggaatgcctttatcgatcatttcaaggccaaccagctttctgtccgctccatgttccttttggcttgccaggacggcttttccgatgaaatccgaggctttgttcgttttgacggcaaatccgatgccggcttcgatcggcgtaatgtcttttgagagctcctgtccgtaaagcggcagcttcgcttcaaacctcagcgtatcccgagccccgaggccgcacggcaccaatcccgaatccttgcccgtttcaaggagcagcttccaaatgcaggctgcatcttcattccggcagtaaatctcaaagccgtcctctcccgtgtatcccgttctggacacaagcgcctgcacgctgccaaccgctgcatcatcccggaacataaacggctttaattctgcaaggtcatgatctgcgacctgttttaaaattgcttcggccttcggcccttgaagggcaaggagcgcaatctcgtcagatacgtttcgaaccgacacgtcaccctttatatgcttgttcatccaatcgacgtccttgtcgatattggctgcgttaatgacgagcatatagacattggccgcttttttatagacgaggagatcgtcgatcgttccgccgtcttcatagcacatagccgtatactgggcgccgccttctttcagcgtcgaaacatcgtttgtcaacagcttttgcaagaacggaaggctgtccgttcctgtgatttcgacctctcccatgtgtgagacgtcaaaaagccccgctttcgtcctgacggcttcgtgctcctctttaatagaagaaaattggactggcagttcccagccgccaaaatcaatcgttttcccgccatattccttataaaggtcaaataaaggcgtacgtttaagcattctgcttcccccttcgcttttcaaactaaaaacaagtttgccaatcatcagaaaacaagaaagatttcaacatcaacaggatggctgcgccgctttatacggcacaaaaaaggacagagaagcccctttgtcagtttggaggctctctgtcctggcacctgaaagtttactttgcatcaaaagcaaagatgtcccctttggtggtttgcaaaacataatatgatacaaactctctccagagttgcgtcaagcaagagttcttttgcctgagagattcactgtttccccagcttgctccttcggcgccgcttttaggtttccctctgccggtctctccccttgccgtcattcgctcatattcatttcttttcatggacatactatataaagcttacgatttttttactgatgatctacaaatatcctaccatcatcacaacgattgggcaacagaaaaaaccattaacaatttattatttcagaataagaacgttcgtgttttgtttatttcttagtaaaatccgtttttttcacgcaagatttccttttaaaaaagaacatttgaatctcagaagagaaaggcggcatgacgatgagaccagacattcatttcgacaacgaatggccggaacagttcaaaaagcatcttgatgaagacggcccgtgggcgaattgggagctttaccagctttcctgtgaagtgcagaaaaggcttgcgattccgacgtttgaaggcttgcaggccccataccacctccccggcttcacaccgcttccccaccagctcgaagtcgcccggaaggtggtcgaacagatgaacggaaaagccatcttggcggatgaagtgggcctcggcaaaacagtcgaggcggggctgatattaaaagaatacatgattcgcgggctggccaagaaaatattaatccttgtccccgcctcgctcgtctcgcaatgggtaaaggaacttcgggaaaagtttttaattccggccgttgaacagaaaaaaagctatgtatgggagcaatgcgatgttgtcgtctcctcccttgacacggcaaagcggtcgccgcacagagagacggttttgtcgatccagtacgatgtggtgattattgatgaagctcacaaactgaaaaacaataaaacaaaaaattacgagtttgtccgcagcttaaagaaaaaatactgtctgatgctgacggcgacgccgatccaaaacaagatcgacgaaatatttaatctcgtctccctgctaaaacccggacacttgggaaatgaaagcaacttcaacaaagattatacaaaacagatcaattcagctgaagcacacgagcgcttgaagtcccttatcaataaagtcatgatcagaaacaggcggcatgataccggcatcacctggacaaagcgtcatgtcgaaaccgtgcctatttccttttcgcctacagaacaggctttgtatgacgagattaaaaagctgaagacaaatcatcagcattcatcaagcatgttctcaatcatgacattggagcgcgaatgctgttcaagcagggaggctgtctatatgacgctgaaaaacatgcttgaccgaaaggaccgcgaagcgccggtaatctctgaacctgtcatccaccatttgatcgaaaaggtcaacgaggtcgcacaaaattcaaaagcgctgaaagtcgttgaactcattcaagaactcgatgacaaagtcatcatctttaccgaatacagggcgacgcagatttatctgcaatggttcctccagcagaacggcatcagttccgtaccgttcagaggcggatttaaaagaggaaagaaagactggatgaaagatttgttcaggggcaaagtgcaagttctgatcgcgactgaagcaggcggcgaaggaatcaaccttcaattttgcaataaaatcatcaactatgaccttccgtggaacccgatgcgcctcgaacaaagaatcggcaggattcaccggctcggccaggaacgcgatgtctacatttacaatatggcaacaaagcataccgtagaagaacatattttaaagcttctttatgaaaagattcatttgttcgaaaaagtcgtcggagacttggatgatattttaacaaaaatcgaggtcggcaattttgaagagcacctccacgatattcttttttactctgcgacagacgaggaaatgaaaatcaaaatggaaaacttaacctctttcatctcttacggaaatgaagacgtttcaaaccatacacagataggaggctaaattcaaatgcgtcaggaagaaatctacctgtttttagaacgttttttcaccgcaaacggctgcacgatcaccgacaaaagtccaggccacatgaccgtgcagctgacggttgaggtcgataaacaaatcatgaacaggccgttttactggcactggcttgaaaagacgggaggagagccgaatccgatgaaaatcacgctgatcacgaatgaagacgaggccccttccgatatcgaaggggagtttattcattttggatcaccaagactttttcaaattttccaggcagtgcaaaaaaacggcaaatttattcgcctttatgagaaaatccgttccgaaggggctcatatccctctggaaccttggctcggcatgaatgtgacgatctcgtaccagtccgacatgaaaaaagataagcttctgtcccttggccttcacttaatcagcggccagctgaccgaatcgtttcaagagcaaatggaagcacgcgagctttcctcacagatctctgactactgttatacgatgtcgccgttgattaagccggaaagcggcataaaacggcttgagcgctatatcgaacaggcggccagaagcgaaccgcttgattgggctgaagcttccctgaaacgttggaataacgacctggcactcttaaaccaattttacgaggatactgaagaaaaaccggaggaatacgaaattgagaaaaaggccctccaaacgctttacgagcctaaaatcgatattaaagttcaaaacgggggattattttatctgcgtaaaaaaaattcaggataatttttccaattcgacatcgttcttgtttttattcagagagctggaattataatagaactaaagagaaaagagaaactttcgtaacagcatttggacaagcttggaaaagtgttgagccttgaggtttatctttgtttatcacaacatggttgtctgaaatacataatcaagtattttgggggggaaatgtatgaataaagataaaaatgagaaagaagaattggatgaggagtggacagacttgattaaacacgctcttgaacaaggcattagtccagaggaaatacgtatttttctcaatttgggaaagaagtcttcaaatccttccacatcaattgaaagaagtcattcaataaatcctttctgaatgtgctataatatcgaaaggaaggtgatgacattgattggccagcgtattaaacaatatcgaaaagaaaaaggctactcactatctgaactagctgaaaaggctggggtagcgaagtcttatttaagttcaatagaaagaaacttgcaaacaaacccctccattcaatttctagaaaaagtctccgctgttctggacgtctcggttcataccctgctcgatgagaaagatgaaaccgaatacgatggtcaattagatagtgaatgggaaaatctagttcgtgacgctatggcatcaggggtttctaaaaaacaatttcgagaatttttagattatcaaaagtggaagaaaagacaggaaaaggagtaagggaaacacatcttactccctttggcattttttacgctgaataagccgattcctcatgaacataaaaaaacggatcataaagatccgttttttaaattgcaccattatttatcttcactgtgcgctctttcgttctctttcacataacctttttcatcggcatgttttttgccgtcgattgtcaagccgttccattgagtagcttcgaatgagaagtcaagctgtacagaatcaccttgatatttgttctgtaccattctgccgctggcgtctgttgttttgtcatttacaaactcaatcaccaattgaactttatcaaagtcatatgggtctttcggaatgccgtcgtattcaggcgcagtttttccgttgattgtcgctacattgattttgccattgtcatgcaggaactctggctcaatggctttcttcactttttcatatgcgttcttatcttttttcgcggacatattgtacagatcataaaggttggcttcatctaaaatgatgtttttaggatagccgttaccgccttcaactccgacagtcagaacgctgactttaaattgtttcaggaagtcttccgctgtgctttttccgccgtttttcgcgtttccgtcaacgaaattgctgtagccaacctgcatcagcacttctttaatcgcaagtgatccgtcatttttgaactcgaaatctttagtgaatttgtcgcctggttttaagttggacaagttcactcttgcagatgtatctttcgcatttaagtcaagcgtacctgctgcataagttgcttgagttgtttcgatgtcgttaaacgcagcccaagttcctcctcctactaatgccagtccaagcgcagcagacgcaacgcctaatcctagttttttctttgtacccattgataactcctccttttataattaagaaaatctgtatatatggagacctgaatgttcaggtgaccaacgaagattacatggaaactgattgatcttttccagcggcttcaattgctttagctttttggtcaatctctcttaaagccgcggatacagtaattactgcataaagaatcaacaagagtcccggcacgatcagcaaaatggctgtgccgatcggtttacttgcaaagtccagcaaatacccggcatacggaaccgtaatgcccgaatacttagcgacaacattttccgccagtaccggatcggaatcagggttttggttattgtcaccctttgtcttgaacatgagatttgatttattttttgttataccgataattcggtgggtaaccatggtgttttcgtcttgcatgaatgtaatgatatctccctttttcaaagacccgggattttcaactttttgaacggcaatcacagaacctgttttaaactccggctccatcgatccggataaaaccgttttcaattgatagccgaagagctgcggctccccgccggacgactttgtcgaaatcacgacgatgaccgcggcgatgatgattgtgaaaataatcacatataagaaattgctgatccatttcatcacatgtttcatgacgcttccccgctttctaatgaattatcttcttttctattttctttatctacggattcactgtcctttggtgtttcctctatatcctgttcagacttttgcgttgtttgagtctgttcagtttgctttggttttgctgaagcttttttaggaggcttcggtgtttcttcattgcagtcttgaagctccattacatttgaccaaatgaaaggtttgccctttttaacatctggatggccttcaggtctgatcaatttaaaagcgtatagccctccttttgctgcccgctttgactctatccggtagatgctgctttcggcttcttttttgaacacgcctttatcgatcacagtcccgtcctctagcggctttttggaatgaccgagtttatgaagctcccacttccattcagagtcggcgatttgactgccgcggtttttatattctgcaaacaatgtcagcggtgcacagaccgttcctttcgtcttcgtctgcttttgaagcttcaaatcgctcccgtcccactgcttctcatcttgaggaaaagttgaggccgctttcattgtcatgctgtatgtttccacatcatgaaatgatgcgtttgtatgctgtgacagctgactccccaatccaattaacaggtatatgatcagcagcgtttgaaaaacgataatgttttttccggctctttttcggcatctcctagttcgagataatcggaacatgactaccctcctagcgagtatgtaatggcttttgtttccgttcgttttaaagaactttatagttagagtataaagaacaagtgtgccgtttgaaaactgtcaaaaaagtcgattaagttcgttctaaagaacattttcgtttaattcctcaaaaaacctctcaaattctcatctttttgaaaagtttgtagttctttatagtgtacacaatttcttcttaatttttgtataaacactgttgacaaggaaaaaataggatagaaaggatgatgacccgtgctgaaaaatgtcatattatgttcttttttactgctttctagcattgggccgctcaatgcccatgcggcagcttacgaaacagcccgcatgtctaagtgggaagaaaaagcggttgaggaagcaaaaaagagatatccggaagcagaagtgcgcctcacgaaaaaagtatgggatcgaaagcgggccgatgaagcggtcaaacaataccatgtcacattgagtgaaggaaataaaaatttcggagtgtttgtcacaatttcatttgaacctgcgacacacaaaattaacaaagtcgtcgttgtggaagaatataaataagccgcattgcagtgcaaagcggcttgtctttatttatgctttttaaaaaacatgatacagccaaggggaagaatgccgaaccattgatatatcctggacggcggctttaattctttacgtttttctttcatttcttttctttcctgcttaggcgtgtccatatattttacgagctgttccgtcatatatttaacataatcgttcgttttcatcgcatcacctcttggggagttctgtcagttgaagtgttgtcatccgaatctttttttatacattcttcatgatttggacacacaatttttaatattccttccactgcgtgattttttgatttcttaaatcatattgaaattgagcgcttgtttctgtgccggaagctgtcgttacctgaatctggactcgtgtgagctgctgatgagccgggctgacagaatacgatatcaagccatgctgtttttgaactttttcttttgtctcttcgtgaatatgggacaaggcatggagaattccattttggagaaggttttgctgaatgtgaaattcttttgtttgctgtgcaaacgttcgctgattcgttaataaagcggctgagtgactcgcgcagagcatgcaaatcacagctgcgaaaacagcagcgggataaatgaatccttttgaatttttcacgtgatcacccttttacatatgatagagcggaatagacgtgcggtatgatttgccgcttagacttgtcgcttcaaggatcagcaggtgattttcaatcataaacctcatttttttgacatgctgtaatagaggcacatgaccttttccattgaccctttttcgaataactgtctgatattgctcatagcgaacggtgtcaccttggcggtttgtcatcgctagtgactgatgatcaccggcacttcttatgtcaatcgaattcctagactccttcaatatttgctcggcagtaatcgtccattcacgggggtgaatatccgaaccgtttctttccggggataaaaacagatgaaatatcgaggccatcgtacctgcaacgaacatgtgcaccattaaggaaaacattatattaagaagggtatatcccctttgcccgcaaaatggtgaaacagtgcctttggctgtctctttttttaatagagatgcatacttcataatcatctcccttctccttccattcaataaagtaagatgtattccggtaaagcacagcttctttagcctggaaccgtccggtcagcgtgtagcggctgatcttttcctccaatatgcgatatgtctcttcttctttttcggacgcttcgcgctgcaatgacagctgatgaagcatagggatcaataacatggtgatcattacccatatgccgaatgcggaaacagcttcaaccgttgtaaagcctttattttttttgaacattaatctttccgcttcctaaatagatcgtcagtataaaagaggcatgctgtgtatcgatcacgatctttcccccttgattcggaacaccgcttggattaaaagtaagaattggtttgagcgtcgactttttgattgcgatattgcagctgtatgtcctgaccagttcaggcgatgagccttcgtccgaatgcttcatgatatagcggcagccggcaaagtcaaactgcaccttaaccgtcgtatggcggacgagagccgtctgctgagcgtaaagcaaatcctcttcaagctgtgagacaaagtgctgaacgattcttttttcataaatgggaggcagtagagcaaagagaagagagaacataatagaaccgatcatcaatacagttaaactttccaaaagcgtaaatcctttttgattcataaccgtcaatcagcctgtgctttgccgtttgaaattttaattgctttcccattcggacactttaagttcttttttatgtaaccttcagattcaagctccgccctgttcggcgttttcccgtcatgatccatctgataggccgtgatctgcgcttgaaccatattgattaatccttcgcatcctttcttttggatgctttggttatgcttggtcacattcggaatggtgatcaacagcaggatggagataacgagcatgacgactaacatttctatcagtgtaaatcccttttcattcacagttccgtcctccttatagctggttcatcatttgatacattggcaaaagcatggacaaataaagaattaatatcatcgccgcggttagcccgtaaatcaatggctggatcaggcctgtccatttttcggcctttctttcaagccgctcaatcaaaaactgactatatgaatacagctctctgtataagtgcccatttagttggccgtgtgcaacagcctttgctaaatcattttcataaaacggatgtccggccagcatctgctccagactctccccctgtttcagccgctcgatcaagcgcttcgcttcatttttatgaaatcgtaaaaacggctggctttcaaatgcttttaaactgtcatatacagacagacccgcttgcaaaagattgctcagctggagcgataaaaaatagctgttgaatagtttgaaggtttggcccagcaagggaattgtaatgagaaaggccattttgtcttctggaggtttatggcggaatgaacacagataatagagggatagagctgcggcaaccagcggcagtcccgcgaaaaaaagataaaagtgatcgaaaacataaaagatgagagtcgttgcaaaagacgtttcaacgttcatcgattcatagatggcggaaaattgcggaactattgctgatttcataatagagatgatgacgcagaccgttaaaactaaaaacaaggggtatctggcggctttctttaatttttcgctttgagcgatcttgcggtgaagcagctctccgctctgcctaaaggcaaatggcaaattcccgtgctgttcggcaaagtaaacaatggtgacagcatccttgtgaaaggaaatcatttcaagaacttgaaacacaggacacccttctgtcagcttctccatcgcaaatgtcagatccgctcttcgtctttcattcaattgcaatttcagcatacttaaagcatccaaaatcgtatagccactctgcatcatgtctcctagttttttcagaaggtccgcctgttcccggacaggccacttcattttaatcttcatggcctatccagcgttcataagttttcgacggcagatatccgagtgctattcccttgcggatcagcatttttaaggtgtctgttttgatgccaccgcatctgccttttgcttcttcgatgcagagattaaggctttttccgtacaaaagttcaaagacgcttgctcttctaactggtctcgacaatctgcaatacaaagtgcagctgtcgccgcaaaacggacagacgatatcgacaagacgctgggcgctgactgcgaccaatgtttgttcaatttctgtcatatcaacgccgagctcgagcagcctgtatatcgcacctttagcatttttcgcatgcatgctcgatagaacaaggtgtcccgtcaaagctgccctgactgcgatttgggctgtttcggcatcgcgaatttcccctaggatgatcatgtccggatcgtggcgcagcaccgccttcaaccccgcagaataagtcatgcccgctttttcgttcacttgtacttgcaaaatgttttcgcttcttgattcgaccgggtcttccaacgtaatgatatttcgcttaaaatgccgcttggcgtagtcaattaaagaatagagtgttgtcgtttttcccgagcctgtcgggccggtgaaaagcattaatccgtgggaatgcttcagaaaagacagcagcttgaatgttgcactcgggaacaatgagagctttgtgagcggcttgctgctcatcttgggaagaagcctgatgaccaagctttcatcatggatggtgggcagagtggacatccttaaatgaacgggctcacggttgatataaagagttaaagccccgctttgcggcagccgtctctcgccaatgtccatcgaagaaagaaatttaaagtgagaaatgagtctagagcactcatttctcgttaatccgtctttttgaaacagttcgtcatcaatcctgaagcgtaccaccgcctctttttcaccgggaacaatatgaatgtctgacgccttcattctatatgcctcgtcaattaatcttccgcttaatgattcgatcgtgtacaaaccattgcgcctcctttctaagcgcagtttatacgaaaaccatcggaagcatcaaatccataaaaagcgcaaatcaagccgaatacgtaacaaaaacggaatctccgaataccgatttgactattttattcgacttcaagccgctgaaatagaaatttaaacctgctcttcggccttgccgtcttcatggatgcagaagcctttattgcaaagcgccttagcaagactctgttctgttttaatatgtgaaaaatccatgccgagcttcacaactgtttgggcaatctccggtctcaaacccgaaagaaccgtttcaacgccaagcagctttgtgctgtctacgactttgaacaactgatgggcgaccatcgtatcgacaacaggaacaccggaaatatcaataaaaagatgcgagagatgaagctcagcacactgcgtgagcgcagattcaatgatcaccgttgccctgtgagtatcaatttcaccaatgagcggcagcacaccgatgtgctctgataccggtatgaccggtgcgctcagttcgcgaatcatctcggtctgcgccttcaattggctctttgtcgtatgctcatattcaagaataaactgctctatgacctcatccatcattaagtgaagctgtttattccagataaaaaaatcttttttcgaactgtctggtgcatgttcatctgaaaattgctcgatctcatctattaaaagttcacggcacactttaaaaccatttatgctttcggtaaccggaatttggctgacagccctgtcgtaggcaatttccttggcgcacccggaagctttattccagcatagcgcctgttcatctttggcaaatacctttgaaacagccagtataaagtccttgtattgctgtgccgttttttctttttcagacgctgttcgggacagccattcatctgtgattctgtccgcctgtttgaccagatactcataaagggctgcatgcttgttttccatgtcaatcctcctcattgttttccctttaaatcaatcgcttaatgaccaactgatttgaatgctatgtataaaacgaaatcgattgtcaacactatatgtaagcgcattgggctatagccaagcggtaaggcaacggactttgactccgtgacgcgctggttcgaatccaccagctagcccagttacacaggcgaaaaaacgaagatatgctgaacatgcaatatgtcagcaatcttcgtttttttcaggaaacagaacggtgtaaggtgtgtttttttaattttaagagttcgccgggattgtatccgacgaccagcttatcgccgtttacgataatcgggcgtctcagcagctttggcttttgaattaacaattccagcacttcgcttaccgttaattcttcaatatcaagatttaactctttaaatgcctggcttcttgtcgccaatatttcatcgattccttcggtcgtgagagacaaaatatgtttcaattcatcctggttcggcgtttccctgaaaagatgccgttctgtaaaatcaacctggttcgctttcagccaatgtttcgtttttcggcatgatgtgcagctcgggtatgaataaaaggtcagctcttccatgaatgattcctccttaaatgtactgactttgtctttgtatgtttcagtacccgtgatgttttccgtttaaacacgtgacaggttattttttaaattccttatcacaaaattgtaaaaaatgaattgtttttcccaaaatgaaaatgtttacattttaagataaattgatttataatgaaatcaaaggggctttttgggagggatataaatgaatcgcatgttccgtgtgttaggtttctggacaggtatctttgcggtcatgttttatttaggaaatatgaaagatgcatcactgctgttcttcggtcaaactgtattttttgtgttcttatcgtatctcaacttgaccgagcggatgtacatttatattttcggtgcttacttgacaatcttttttgccgcatttacatattattctgtgttcattatggttcccggacagggaggccattaaaaaaagacgatccagatggatcgtctttttttatgttttacaaagtaaatccgttgatgaacgggttttgttcctgttctgttgcaatgtccgtctcggggccgtgcccgcttaacacaagcgtctcttccggaagtgtcagcagtttttgatgaatactgtccatcagcaccttttgattgccccccggcaggtctgtacgcccgatccctcctttaaacaaaacatcgccggaaacgatcaggttttcctcttcggcataatacgagacgctgcccggagaatgcccaggcgtaaagagcatgcggagcgtaaaagggccgattttaaggtctccctcttcttcgatcagatgatctgctttttctgctgtgatcgtctgccctgtaagcagcgctgaaccgtttaatgaaggatcagtcagccattcagcttcatttttatgcacgtatacaggaatgttccattcttttctgacattgtccacagctccgatatgatcaaaatgagcgtgagtgagcaatacggcaagaggtttcagcccgttttcttttatgtatgcattcagcttccctgattcgctgcctggatcaaatattaagcaggtgccgtcatcattggataaaatataagcgttcgtctggataggccctaaaggcattcttctccatttcattattttcacctcagattcatctttctttgttccattatgaaggttttgtgagaaactttcaatgaatcatgttgtcctcgacaaatttgatgaaaacggttaaaataaaattggaaatatactgcaggggatccaagcgaagggggtttatattgatgttgctcgtgatcattttcggtctagtcacgatattatctgctcttggggttcttcgttctcttaaacaaatcaacgttcttggcatcttgttcggcggggcggcttttttagtgttcggatggtttaccgtcatgacaattattaacagcgggtatccgacagtccactaaacccgatgcctttagacaaagacagccttattccgttatttcggaacaaggctgtctttcttattgactgaaatgacgctgaacgcttgcaagcttgccctccatcgtcgttttcttatcacggcggtcgtcaatcctgatatttgtcgctactctgtggatgcctttttggaaaggcgcttcgtgaatcgtctgaatcacctgaaataaatcgcttagttccccttcaatcaaagtattcatcggtgtcagctgataattgattttgccctcttttttaaatccttccaaaatggtttgaatctccgctacatacgcgcttacgctcggagtctcggtaccgatcggtatgatggtgacgtctgctatggccactgtccattctcctttctattctttggtcacaaggggcgctgctgtttttgagttgagtgaaatgatttgatcctgagtatagccgtacaatgcataatccccgtcaggagataaggtaatcggaagcatttccactttttcacgaatgacttcccgcttgcctgatttgaggttgacggaaatcagatcatacaaggagcccgactcatttggctgatacgtataaaacagctcatgccgagggtcataaccgtattccatcggtgacaggctgccatattccgagaacagcggcaacttgaaagagattttcttttccgatgaagaaacgtctgaaaatatgtaggtgccctggcgctgatcggatgaaggcgttacgatgagccgcatatcgcctacaatatcgagaagtacggcatcgcctgcgagcttcttttcccgtccgtccgctgtgctgtaggaataaacaggagccggcttttcccggtcccgttcattccatttgatatattcaaaagtgtcggcggaagtccaatgaataaaggcggcctgtgcgatgtttttttccgtttgctcttcttttgcatcaattaggcttgattcataattccagtctttcgtgaatgttgtgacatataaaagagaaggatcgaatcgattccagtccacttgcaactcatgcgtgcgaaatttttttgcaaacagctgtttcccctgtaaattaagcaaagttaacttcatttcagagccgtttccggcggtttggataagaatcatgcctttttcactgttgacttccgacgctatcagcctgtcatctgtcttgtagatcgttttgcccgtccctttaaatatatcatatgatttgatttcacttcctccgaccggatcggttgcggtgtatataacggtttcattatcaagccatcctgccgtctcatcaaagtgccggtccttcagcgctatcacttttttatcttttactgctgcaccgctttctcttttcccttccggctcctcatgatgaacgctttttgatccttcttgatgctgcggcgtgcaaccagccgcagccacggccatcagagcggcaataatcaataatgaaactctcaaaccggccattctccctccataaatgtttggctgtctaatttacgattttcaccgtgaaaagtttcagctttcaaaaaaacaggatgcccaaagtattcctctgcttttacaatatatatcgtcaaattgtttcagcggtaaaggattttttcctttgccaagttcaacagtatatccttctcttccgtaataatgaataaaccaatctctaaatcctgcatagctgtctatatatctgacgcccttataaccgctcaggcgctcaaatgtttggatcacatcagctgattcaggaggctccaatcccttgtatccccaataaatttcctccccctgtgtgtgaagcgccacaagccggtcaggcggctcgtttgcgattaaatccctcatcgctgccgcttccggttctgtcagcggttcatctccggggtagtctctgtaggaaggggatttaggcggttttctttgtttttcgatctcccagaaagacggaaactgattatttaaatccactccgtttatattggctttccattcccggaaatccggctgatgctcgttcatctcatccagcgcttctctcgcgatcccaagatgaccggggccgttaagtacaaggtcaacaccgtcgggattaacgatcggcacgacggaaagctttgttgatgaaaaaatatcgagcggcgaaaaacctaaagcggtctggcctgtacataaatgataacagtattctttgagccatttcatcaaaacagaagtggtgatccattcattggcatgaaaagaggcattcatatgcgttctttttccggcattttcagctccaaggagcagttcatatataggctggcccatgcttgagcggccgatgatacgggaagtaacaaacggaaagcattccgtcaatctgccaatttcctttttcagttctgctgaatcgtaaacggctgtttttgtcagccactgttcatcttcaaacgtgtattgattcgccaataattgcagctgttcatatgtttctgctgcttgaacgttttttcctgcatgaaaagatactcccggaaaataaagttcgtccgcggatacatttgcatttgcactgattaaaagcggttcgggtatgttcagaatgtcagacagtctttccatattctgctttaactccggtttgatgttgatgaatgccatcaatgatccctcccacaatagcatatgaggaatgctcgtttaaaaactctcccggcttgcacttgaaaatcgctttttcaatgagggttcaccccggtttcgcgcgcaaaaaaaacttccgcctgacaaggcggaagttcttctattttgttaagttttctgtaataaattcgagctggccctctaatgaaatcggatcggaaaaatagaagccgacagggtcgattttatagacatgttggtttttgaccgccccaaggttcttccaaatggatgtattaagcacggcgctgtcgtctccgcttgattcccaaggtcctataaatatataatctccagcgaaatcaggcagcttttctaaggaaatgctcgtgtagcccgggccttcgtcgattgctttttcctttgtcagctttgtcgcctttaagccgagatcttggtaaacaatgcttcctccccttccgaattgatcgccgaatacaaagatttctttaccgttagtttgcataatggaaaccgttttgttcccgacagctttttgaacttttgatttggccgccgcaacttttttgtcccattcagccagccatttctccgcttgatcttcagtgcctgtcatttttgcgaaatccttcagccgttcagtgctattcagactgtcatatttcaacgcgaccgtcggagcgattttttccagcttttcgatatcagcgccttgggtcgtccatacgacaatcaagtccggttttaattgaataaccttttcagcagaatttccttcacctatgtttgtcacaccatcggttttccccttgaaataaggattcttgaaaaccctgtcaggggcgcccactacattgagaccgagtgtcttgaaatagccgaaataatcgtcagccatgacaaccacccgcttcggatgcttcggcactttaaccgttccgttttcagccttgtatgtaatcgtttcttcgctttttgatttagaagaagaatctttgctctctgtttgattgccgcatgctgtcaatgctgcgatcaataatagtacaaaacacgctgccgcgatcgtcttacctttaatattcactcttcataccttctttcctgtttgatcacccgataaagagaatcattatcaattatatcataaccggcatcggtttgatcatgatttttatgacggcctcttgtcattaaaaacaggccggaacgatatccggcctgctgcatcagctttctccgcctaaaaagaagcttactcgtcttttggcttggagtcagattgcttttttaagcgctcgctgtcataaaacctcagcaagtcgccgtaaatgatttgatctgagtatgaaagctcctgtttggctttttcaatgtacggctcacagccttttttatctttagacggctcgcctgtcgatttatcatagcatatgccgtctgtgtatactttgtctttcgtaataaagctgccgtcgcggagcactgtgaactccgttttgtctttggcaaacaggtcgtttccaaactggatctgatcgcttgaatcgattccgagaagattcagtatagtcggtcgaatgtcgatttggccgccgaccgtgtcaatggttttcggctctttatccgtcactcccggaatgtggatcacaagcgggactctttgaagctgcacttcctcaaaaggggttacttctctgccgaggaattggctcatcgcttcgttatggttttcggaaatcccgtaatggtcaccgtataaaacgataacagaattatcgtagaggccgtcttctttcagcttttcaatgaaacgtttaagcgcttcatcctgatagcggacggtcgggaaatatctgtttaacgtacggctttttgaatcgaattcattgatcagtttatcttcctcatcaagctcaaacggaaaatggtttgtcagcgtgatcagacgggtataaaaaggctgaggcatttctttcatcagctctgatgtttgttcgaaaaattccttatctttcaatccccatccaactgaattttcttcgtttacatcataggatttgatatcgtaaaacttatcgtatttaaacgtttcgtacataatatcccgattccagaagcttttgttgttcgcatggaaaatcgaggaatagtagccgtggttcttcaatatttcaggcattgccgtatattcgtttcctgcatttgtaaagaagaccgctccccttccaagagggtagagagagttgtcgacaatgaattcggaatcagccgttttgccttggcctgtctgatgatagaaattctcgaagctgtagcttttcttaatcaggtcatttaaatacggcgtaatctctttgccgtttaacttttggtttacgacaaagctttgggtggattccagagaaacgaggatcacattccgtcctttggcgatcccggccagatccttgttggtgtccgtgcggtttgcgttgacatagttttcaatctccgtgaggctgttgctgtcggccagcgcacgctgcgcagactgcttcgactggatcagcccgtcatagatatggaagttgtaaaggctgatgtttttcacaagaacttccctatcaaacgatcttgtcaaaagctgcggtctttctgtttcagaaatccctaaattaaaaaagaaaacggcagcgacaaatagatagtaagccgcgcgctcctttcttgtcgcctttccgcctgttttggcaggctggcgcttgtacagccaaattaaaatggcaatatcaacgatgagaagcaaatcggccggcataaacaaagagttgatgctgcttcccaaatcgcccatattattcgtctggaacaaaacaggaatggttaaaaagtcgttgtaaaaacggtagaaaatcatgttggcaagcaagacaaacgtcaggacgatgcttgccccgataataaaccggtttctgtttttttctttaaaaaacaggccgattccgaatataaacagcaaaaagcttaaaggattgatgaacaatataaactcttgcatgaagttttcaattttaatgttgaagcttgttttgtagacgacatacgttttcagccacatcagcaatgtcgcgattaacaaaaacgaaatttttgaaaaaaatgactttcgcattccaaacctccctatgcagcaagacgcatgtttctgcaaacggcatttccacatattgtttattttagaaaaatcgctaaaattactaaatcatatcttaacctgtctgtacaaaaaaatcaatcatttttcacattggcttaaaagtgttaacaatgctgcaaagcggtccgaaaatgctttataaaacaggctgcgcctggcttttcagccattggttttttgcgatccatgcaccgccgatcacgcctgcgtcgtttccaagtgaagcgattacgatctcagccgcctcgccggcccgcgggaatacaaagcgcttgaaagattgttcaactttggagcgcaggatttctcccgcttttgacacgcctccgccgattacgatctttgaaggattaagcgagctcgccaagttagcgaggaccattcctaaatgacccgccacataatcgacgacttcgccggcaacaggatcgttttttctggcggcttcaaagatgtcgcgcgccgttatgtccagacattcacgcaagcttgtatctcgatggtcagattctattttttctttggcaatcctgacgatgccggtagccgaagcgatcgtttcgatacagccgctttttccgcagttgcacggcgctccgccttctggaacagaacagatgtggccgatttcaccgcctgctccgttttgcccgcggacgatttccccgtttacaataatgccgcctccaacgcccgttcccaatgtaacaagaatcaaatccttcgcgccgtctcccgctcccttccacatttcgccgagagctgcgatgttcgcgtcattttcaatgaccgcagctatccctgtctctgcttccagatggtctttcaacgggtagttttcccagcccatattcgtcgttttataaacgatgccggtctccgtattgacgggtccgggagcgcccatgccgatccattttaagatgtgcttcggtttgccgagctcgttcaatttgctgtcgatggctttcgcgatgcttaccgtaaccgttttccctgatttatcggtcgggatttcccacttgtgcaggatttcgccataagcgcttacaaaagcgagttttactgttgttcctccaaggtcgaccccgaccagccagctgtcattcatactgatccccctctaatccctgttttattttctctttatatttgtgagttcattctgcaaaattgaaacaccttgaacccattgttctttttctatcaaatttgaaagaaacatttccttcagttcgtccatcatgtattcaagttcaagctcgcgatctccaaagtaaacataacatccaaactgcttcagcaaaagctgtacatcataggctgttttcatctgatttcaccattctttaaaggtctaacattagagtattcataaagctgtccggcgtcaagcaaaaaaaaagcctgttttcctgccggaaaacagacattcagcggtcgggatcctggggatccaaaaatacgggtcttctgtttttcagcggcatcggcgtgcgaattgcgatatcgcggaaggctctgtagtcaaaaggaataaacggccataaatacggcacatgaaacgacttcattctgacgagataaatcacccagcagaatatcgcaatgacaaagccgatcggtccgaatgcacctgcggcgatcaggagaacgattcttgcaagcctgttcgctatgctcagctcatagctcggcgtagcaaacgtgccgatggctgcgacagcgagatacaagacgacttcatgcgagaaaagcccgacctgcaccgccacttcgccgatcattaaagcagctacgagtccgagagccgtagcaagagacgacggggtgtggattgcagccatccgcatcatgtcgacgccgatttcaataatgatgaattgcgcaagcagcggaagggctccttttttttcaggccctatatattcaagggcgtccggcaaaagatcgggatggacggaaagcagaaaccacagcggcagcaaaaagatcgatgccaagacagatataaaacggactattcgcaaataagcacccgcaagaggtttgtttctgtactcttcggcatgctgcagatggtgccaaaaagtaacaggggtaatcagcgcgcttggcgagccgtccacaaagacgagaatgtgcccttcgtacaaatgaacggccgcagtatcaggtctttctgtatagcggaccgtcggataagggttccaatgacggccgccgatgtattcttccagcgtcttttccgccattgtcaaagcatccgtgtcgatcgcttcaagcgattgtttcagcttttttacactttccaagtcggcgatatcttccaaataacagatgacgacatccgttttgcttcttctgccgacctgcaggaactccattctgagggaacggtcgcggattcttcgtctcgtcagtgcggtgttaaacacgatcgtttcgacgaagccgtctcttgaacccctgacaacgcgttcattgtcgggttcctccggatttcttgccggatacgtccgcgcatcgataataatcgcatggtcaactccgtcagcaaggaggacagccggcccggacagcacctggtcggctgctttgtcgaggtcatcttccgtatcaatttcgatgtatgggatatgcgttttgatcagcttttcaagcggatcgtcttccagattttcaggtgtgagccttgagagatttttaagcaaatgatgcataatatcatcttttacaaagccgtcgacaagataaagcgacatgtctctatcagcataaacgacatcaagccggatcatgtcgaagcttttgtcgacaccaagcttttcatttaaatattcaacatttttcgctaaatttttttggaccgcatgcttttttttcattgtatattaaaagctcccgtcaaatgagtctgttctaaagaccatttttaacataacggaagcttttcatacttgattaccgggcgctttctttctttatttcgtcccgaagctttttatacatctcttcatcaggcttttctgccaacgctctttcaatggactgctcggctttggcaagctcgcctctttgggtataaagccaggcaagactatagagagaggcgtggtccgatggatctttttcaacgacggcctcaaaccttttctcggcgttttcatactcgccgagccgaatttcggaataagcgagcagccttaaagtgtcgctggaagcgtccggttttgagcccgcttccttcaaagcatcctttactttttcatactctccctcttcataccatttcgccgcctgatgcagcatggcattttcctgcaccggagccgaatgtgtcccaaagtacagggcccctcctccgatgacaaagatgaggacccagcctgccagccgctggagcggccttttttttccggggattccgaccgccaaggccgtcaggagaccgccgatcaatccgccgatatggccagcattgtcaacatttgaaatggtgaaaccgaggccgaggttcagaatgatgatcacaatgatatttgttccgatcgtttttaaaaaagctttccggtttgaaaaagccaggtacaaaagggctcccaagcaaccgaagatggctcccgaagcccctgcagacggatacggactgaacagaaagctgccgatcgatccaaaaatcccggctgatatgtatatgacaagaaagcggaatgatccaaacaccctttctgctgcggctccaacagacaataatgcaaatgtattaaacatgagatggaccaatccgatatgaagaacgatcggcgtgactagccgccaccattccccggctaacaggaggctgttttccttcgccccgaaccggacgagcgtttcggtattctggctgccgcccgacatttccagaagcagaaacatgaagacttgaagcactgcgaaaatccaggtaaacatcggtttgcctttctcaaatacagccgcttcccgccgcctttcttcttctcttgctttagccgctgccaatacttcggctctcttctcttccacattttcgtatccggcatcctgcatttggcctgtcagctcatccggctccatgtttaaagccacggcgagtttgcgtaatccttcttcagccgaagcgtgatcaataaaaaccggcacgatgctgatccgcttatctgcgaccggatgaccgacaacatcttcccactcatctacaggcgcttcctgcgacaaatagacattcaatatcgagagctttcgctgacctgatgctgctctcaggcgctccgccctttcataaagagattccaggtcgcggacgagatcctgtctgaagtcgatatccttccggaaaacgcgaaccaaatcatacggcgcgctccccctcgcttcaagccaggcttctccgaatgaagcaggtgcctgcacaagctcaaaatccctgtctaaaaggttcccgatgaaattccaatacaaataatcgattgaatacataccgacgctccacaattgtttttgttcattataacaggaaacgcgacactctgcgtcttttaagagctttaaaaaatcccgttttcaaacgggattcagaatgcctgctggataaacttattgcgaaaaaacggaattctcatcatcaaatggatgaaatagtggcggatttggttttgaccaagaatgaaattgataacacgataacggttttgaaaaaatacaagggctgcaatgacgcctactacaataaacgtaacttttctcatatgatccctcctataacctataaccgtatcgtgtctcattttttaataattattcagcagtgtcgaggcagttgtaaacggcgtcttcggtcaaaacctgcttgaccgggatgtcgtgcggctcatttggaacatgaccgatcacttggcactcgaaggcaagcgacgcggtatcttttgtaaagccggccaggtatctgtcataatagccgcctccatagccgattctgtatcctctccggtcatagcaaattcccggcacaaggatgaagtcgatgtcttcgggttccatccgctcggttttgtgtacgatcggttcctgcaggccaaaatacacgacttcaagatcgctttcatcctgatagctgcgaaagtgcatcttttttgtttcaggcatacatttcggaatgcacaccgtttttccttcaagccgggcctgttcgataatcggttttgtcggtacttcgcgatttctggataccgtaagggcaataacagacgcttttttccactgttttgattggaaaagcttccggtgaatcgcttccgcctttaggtgaaactcctgttccggcatgttagccagcctctttctgacctcgcttcgtaaagaacgcttcacatctctttcccccttaaaaacagaaaaacagcaggaaaatccctgctgcttactttgtttcgcggtgtaatgttgattttttgtcacgtgggcaatactttttgaattcaacgcgatctggattgttacgcttgttctttgtagaaatatagttacgctcgccgcattcagtgcaagctaaagtaatattaacgcgcatttatttttccctccaaactatatatcatttctgttcagacttatctataataccacttatgatgcaggaatgccaggcgttttttttagtttatcacggtttgttaaaaagacgtatgatatacatgatgcaaaaacatattttttacatatccaggatcatgcaaatcaaatatataagcctttgccgtttgtccgaccttgagcagctgctccttattgccgacaatttctgcgagcgcatttgcagccttatgcggatcactaaaatcaattcgaaagccggtcacccgatcgataacgaaatcgttccagcccccgttgattccggcagcgacggcagcgccggcggccatgctttcttgaacagcaatgccgaacggctcataagaacttggaaaaacagccatttcacaaaatgccagccagctctctctttcctcttcacaaaggaaaggaagaatggtcacactgtccttaatgcccaattcttttgctatggtctcgatcccgctttgaagcggcccttccccggcaatgacaagttcaagatcaggacgccggctgcgtagcttctgaaagacgtgcagcaattcgataaaccctttttccggaacaaatcttccgtaggaaaaaaagtagggcgcgcttttcattcgttttttcaccgtgcggctttttatgcgcggatgtggaatgacccggatttgctcaaaagaaagcgaaaacgccttttgcatgtctgacttcatcatgctgctcagcacgaggatttgatcgcttttttcagccagaagccgttcgaggattgccctgtatgggtggacatatccgtctgctgccttttttcggccgctttcaaggccgtgcaccgtggaaatcagcggcaccgccagcacctcgctgagataaacggcggcaggcgcggtgacaccatcgtttgcatggacgaaatcaaattgtcctctatgctccagcacgattttgatcatctgaaaattcatggcggctaccgcctcttcaaaagaagcgaacgcttttaaatcaagcggaatctccagcgtttcccatccattgctgttttgcccggcagccgtcgtgcagacggtaaagctgacttcgttccgcaatagttcaaggtggcttttcacatagcgccccgctccgctcttcgatgaaaggggattttccagcgacagcagcaatacgttgatcaacggggccgctcctttccttctattaaagaatatctcgtatatgcggaaaattgagtcgtccaatcctgctgattgtcttgatgctgaaaacagctgctgtttgaatggattccgttttccccaaggtagaagcagtcggatgagagaacggccagtgacatgttgagcgaattgtatatccggtattccgctttgtagaaagcgtttcctgcagcggggaaaaccgaggcctcccctttaaatgcaccggtatggatcgtccgtgcgctgcgctctccgttttttacgcaaaaaagaaggatttgcttttcgacgtctctaatattttcaaacagcaccgcttcagccgctgaaagcgcagcctctgagatttcccagctcagccgaacggtttcatgatccggcgaagttatttttaaaatatcgttacaaaacgaagaatcgcctcgaatactatgttgaaaaggttttttcccgatgattgtccttttcaccgcgcgccctcccgttaagccttgttatgtatctatcctattggaaatggccccgcaggcgcaacgaaaataaaattcttcgacaaaatttttattttttgcattaactccttttgaagcaagcgtttttatggtataaaaaagaaggagaaaattagaattgaaggtgatgaacgtggaaattgctatcattgcgctgctcgttgtcagtattgcgctgattgcattctcatattttcaaagagaaccgatcaaggaagttgaacaggagttggaaacccttcagctgtccgccatgcaggaaatctataaactgaaaaagaagatgaccgtgcttgaggaagagctcctcgattcaaatgtggtcgtccgcagaccgaatgccggaatcagccagcatattgcgaagcagattctttcaaaatatcaaaacggcatgtctgtagacgccatcgcaaaagctgagcacgtatctgtcgaagatgtcaaagcgatcattaaagacaatgagagggtgcttgtatgaccagacaaagtgtacaagcatttgccggaggaatgattttggctaccgccgttcttgcaggcgcattttatttgacggataacggaaaagctgaagcttccaaggaggctcaaaacatcagcgaagccgatgtcaaaacctatttaaaggacaatcagcaggtttcgctgaaacgcgaggaataccaacagctgctccactataaagagaccgcgctgaagcaggatgctgcgtctcaaaacaaaaaagagcaggatgatgcgaaaaaaggttccaagtacaagcttgaaatcaaaagcggcatgagcacggctgagatagcagacctccttgcaaaaggaaaagtaatttcttccgccgatgacttcaaagattatgtgaaaaagaccggaaacgaatctaaaatccgcgcaggtaaatacgaactgaagcgcggtgacagcttgaaaaacatcgtcaaaacgctgtccaaataaaaaagcaggctggaacgaatcagcctgctttttttattgtctcgccgccggtgaaaaaagaggctgccgctttaaaacggcagcctctttctcatccgaaccggcctgttatataatctttcgtccgatgatcgtcaggacttgaaaacattttgaccgtatcattgcactcaatcagctcgcccatcaggaaaaacgccgtttgatcggaaattctcgaggcctgctgcatgttgtgcgtgacgatggcaattgtatatttctctttcagcttgagcatcagctcttcgattttcaaagttgaaacgggatcaagggcggatgtcggttcatccatcaagagaacgtcaggattggtggccagcgcccttgcgatgcagaggcgctgctgctgccccccggaaagtccgagcgcctgggaatgaagacggtctttcacttcatcccacagcgctacatccacaagcgccttttccactctctcattcagttcttttttgtttttcaatccatggattcttggtccgtatgcgacattatcaaagatcgactggggaaacgggtttcctttttgaaacaccatgccgacttttttccgtaactcgacaaggtcgactttgctgttgagtacgttcgttccgttgtagctgatctctccggtcattttgacattcggaaccatattgatcatgagattcagcgttttaatgaatgtcgactttccgcaccctgacggtccaatgatggcggtaatttcgtactcgggtattgtcaagttaatgttctttaatgcgtgatgttcgccgtaccataaattcaagtcgttgatctggtatacatcttctggctttacagctgttacagcgctcataccggcccctccttatccaaatctgccgttgatgtaatcctctgtctttttttctgaaggattcataaaaatcttttccgtacgatcgtattcgattaaatctccgttaaggaaaaacgccgtttgatcggaaattcttgaagcttgctgcatgttatgcgtgacaatgatgatcgagtattcctcttttaaaccgacgattaattcctctattttcgcgtttgaaatcgggtcgagcgctgaagcaggctcatccaagagcaggacttcgggcttcatcgcgagcgtccgggcgatgcagagacgctgctgctgcccgcctgacagcgaaagagccgactcatgcagcctgtctttcacttcatcccacagcgcggctttcgtcaagctttcttccacgatctcatcaagcacggatttccgccgttcgcccgcatattttaatgcgtgggtaatgttgctgtaaatcgattttggaaaggggttcggcttctgaaataccatgccgatctcccttctcagattgacgacattgatattggaatcaaggatgttaagcccttcataccgtatttctccggatgttctggctgatggaatcagatcgttcatccggttgatgcttcttaaaaaagtcgattttccgcagcctgacggaccgatcaaagccgtgaccgcatgtttgtcaatacgcatggaaatgtcgttgacggcccgcttttctccatagtaaatatttaaatttttcacttctaaaatatgctctttcgcttcagggaacggagcgattccgatattgtcgcgcacggtttccaaaaccggcatctgaacctgagccatatgatttcatccttccttcttatttgtttgccgttaactttttatgaataaaagagccgagccatcgggctgccaggttaaagatcaagacggacagaacgagaacggcggatgcgccgtttgcgatcgcttcagcatcggggatgatcccctgtgtgtttacattccaaatatgaacggccagcgtttcagccggtctgaaaatattgagcggcgatgtctcagaaaacggattccaatcggcaaaattcagtctcggcgtggttagtccggctgtaaacagcaaagcggcagcttcgccaaatacacggcccgacgcaagaatcgcgcctgtgatgatggacggcaccgcgccaggaatcaataccgttttaatcgtgtgccatttggacacgcctaaagcaagggaagcctctttttgctccttaggtacggagcggatcgcatcttctgtcaccctgaccatgacaggcaggttgaaaatcgtcaaagcaagcgctcctccgataatgctgtacccccatccggtcagatttacaaacatcagcatgccgaacatccccataacgatcgaaggaagggatgacaaaacttcaatacagacacggataaaatcggtcaatttgtttgcgggcgcatattccgccatataaattcccccgccgactcccaggggaaccgtgatcagcatcgtcagcacgagaatataaaacgagttgaacagctgatctcgaattcctccgccgcttgacagcgcacttgaacgcgaagttaaaaagctgaggctgatatgcgaaacaccattgatgatgatataagcgaacaaaccgacaagaatagcggcgattaccgcagcaatcaatccaaaaacaccggttgctaaacgatctgttactttgctgttcattacagtttcctcctggatgacagatagcggatgagcaggatgaacaagaacgacatgatcagaaggacaagccccattgaccagagcgtattgttttccacgctcccgtatgttgtatggcccatgttcaacgtaatgatcgttgtcaatgtccccgcagggtctaaaaggctctcaaacagatttcgggaatttccgatgaccatctgcacggccagcgcttcgccgaacgccctcgccattcccaagacgacggctgtcagaagcgaaggcagcgctgccggtatcagcactttgcggatcgtctgccagcgggttgcgcctaatgcgtatgatccttcgcggagatttttcggcagcgacatgagcgcatccgttgaaatcgaagtgaccgtcggcaaaatcatgacagccaggacgatcgttcccgccagaaggctgtggcccgatccgcttgacttaaactgtgaaatgaacggcactaacactgtaaggcctatgaatccataaacgacggaaggaatgccaacaagcaattcgacaaccggctgcagcacttttctgccccatgatggcgcgatttccgtcatgaaaatcgcacctcctattcctagcggtgcagcaatcaaagatgcaagaagggtcactgcaaaagatccgagtataaacggaagtgctccgtattcagggttttcgttcgttggattccaatctagactggttaagaactcaattggacttacaccattggccagaaaagattgcaaccccttatttccgagaaaaattgtgatcgaaatcgctgccgccatcatgataaaggcgcacgacgcaaccaaaatcctcccgcggatttcatccattttgcgattatgcttggagctgatcagccgctctttcgcggacagtttctctattttttgaaccattttttacactcctataagaacaagtcataagagggaaagtgtcaggagcacactttcccgccttctattgtcattatttatcagtttgctttccatccgcgtcgcgttttacttccatgtctgttactggaatgtagccctgctccgtcacgatggatttttgaatgtcatcgctcatcaaatagtcgaggaattctttcgccaagccttcaggttcgcctttcgtataagaatgctggtaagcccagatcgggaatttgcctttttgtacattttcggctgtcggcttaacgccgtcgattgaaagcggagtgacagtatcatccttgatatacgagaacgcaagatatccgattgcaccaggcgtttcagcgattaactttttcactgtgtttgaagaatcttccgtgattccttcagctggagtctctccatcaagtgcatatttgacaaaagtcgcgcgggttcctgaagaatcaggacggttgacaagggtgatcttttgatctttcccgcctagttctttccagtttttgattttacctgtgaatacctttttgagatcttctaacgaaatgtcatcgatgcctacttcagggttaacggcagctgccattccgacaaccgcaacttgatgatcggtaagttctttggcaggaatgccttctttttcttcggcaaagacatcggagtttccgatttggactgtgccttcagccacttgggaaaggcctgtaccagaacctccagcctgaacttgaatatcggcatcaggattttcatccatgaatttttcagccgctgctaagacaagaggctgcatcgccgaagaacccgaaatcgtcaaagaacctgaagccttattctctgttttatcgctttgtttgccttcgtctgcattgttgtttgtactgctgcttccacaagctgctgcgaagacaactaaaacggacatgatgaacatcagtgtgatttttttaaatggtttcacttcttaatcctcccgcgtaaatgtgtaatttgtcctacgggtatagcgtaacttttcagtattaatcttgtttaaatgaattattaaggttttgtaaattaagcttgaactttgtatagaatgcgcacgaaaagaacgggcgcacaaaaaaacacctgcatggttcaatgcaggtgttttaatgaaaaagtcctattctgtagcttctttttcgattttgtctttatttttttcgacagtattttcttttgattgttttgatttcagttcaaaatacttatcaagcacttttcggccgatttcgtttgtgatcgaatatctctggccatagtcattataaacccaaggaacgacgacggaaatagcgacttccggattatcgtaaggtgcgtaggcaacaagcgttgtattgtatgtcgatgttcccgttttcgatttgtccggtccgtcatagaaagactgggccgttcctgtttttccagctggtttatatgaagcagaggcaaactgtcccgctgccgtaccttttgtcattacgcgcctgaatcctttctggacttcttttatatattcatcgctcatgtccactttgttcaatacttcaggctgcacagactgtgtaacggctccgattccttttttcgaatcgggctctctgatctctttcacaagctgcggcttcatgcggtatcccccattggcaatcgttgacacgtactgagccagctgcagcggtgtgtatgtgtcatactgtccgatggaaaagtcaagcaggaaaccgggcagtctttgagatcctttgtagcctgaagcttcatttggcagatcgattccggttttgacgccgaggccgaactggctgaaataatacctgaatgtatcaaatgcttttgtttgaaggtcgagcggctgatgcgccttatattggcctttaccaagggcgatcgccgttttaaacatgaacacgtttgaagacttttcaagagctccctggatacccagtgttcccaagttgctcgcccaagattttttcggttttccttttccgatatagagcggttcatcaagaaaagtcgtatttaaattaatggctcccgtctgcagacctgttaaaacagtggcccctttgacagccgagcccatcgcataagaagacgtcatcgcgccgagcgcatagtcgtcaacctttaatttgccgctttcgtttttaagctgtttgccggcaatcgataacacttccccgtttcgcggatccatcataacgacgaatgcgcggtcgagaagcggagcgctatgcttggctttggcagacttcagttcatcctcgacaattttttcaatcgctttttgcatatcaacatcaatcgtcaagactaaatcctttccgcttttcccctcggaaatgacttccgtatcgacgatatcccctgatttattggtaatatttttcactttctctttctgtccctgaagcacattttcatattcggcttcgaggtagctttttccgacgcggtcattccggttgtagccgagcgacaaataatgatcaagcaggcttttcggaagcccttcatttgaatcggatatgctgccgatcatcgttctgagcagaccgttataaggataatcccgcttccaatcagacgtcacatcgactcccgggagctcgtccaggtgttcgctgacaaccgccatttcttttgcagttacacctttgtttttaatatactgcggagtcagcgcgtatccagaatccatctgacgcttgattgccaagactttcaaatcttgatctgtcaattcattcagtttatcttccgtgatcctgtcaagctgcagctggtataaatcgtcttccttcagcttgccgtccttgacttttttccggtcctcatcggtgatgagcttctcggcttctttcgggcgcgttaaaatccagtagtcctttttatcgcgctccgttattttatctgtatcgattttgatcatttctgcaagtttttttgctattttgagcctgtcctcctgagaggtcgatgatgtccttgtgtatgtaatggcattcatcggtttatttttcacgatcgtattcaagttccggtcatatattttcccccgcggaacgcttgtcgagacatcgacttcttcctgcttctgcacttcgttcgtatagtcttcgccaaagacgatctgcaccatgccgaggcgcacgacgacgatggtgaaaataataaaagcgagaaggaacaatatgttcaacctgatggggagcgatttgcgtttttcatttttcatttttttgttcatcattagcatcacctttttgaaataaagaaaagacaccttatgaaaaggtgccaaatatattgtaaagtttttttcggcatttttctactattttcccttggggcttacctttttccttctaaataattcggttcagctgtttgtttatgcgcatcttttccgaccgtttcgcgggcgggctctgtcagacggatatctttgacgaaatagtagatcagcgtgtggcctgcccccagcaaaacgagagaaaccggaatgcccaagtcctccttcagaagcgacacgagcagcaaaaaaaccaaaatcgagacaatccgtccgatgtttaaaaaaacttctctgacgacaatgtattcgatccgcgctttccgggcatacctcgctttaccgatcacatcatatgtgagcgatgaatacggtacgagcaaaatcggatagccgatcgcaatcgcaacagcatacagcaaaagcgtcacatacgtcatatgaaacaaaatcagaaagagagcgccgaacaggacgagaccgcccattaaaatcgcctttttgcgcgctccctttttaataagccgcgttgcgaaatagtatgcaaaaaaagaaacagctgaattaatcaagccgaacttccccaatgccaactcgctctttgtcgtgataaagacaaagacattgattaaaaaaacgaaaatcccttctctcagcccctgaaaaaaatgagcatttgtaatgctgcgccaattcgggtctgaatttcgttccgtccagatttttttcaaaatgtagcggccgcgcgattcacgcctttttaaaaaaaagctcgtaatgacggccactgaaaataaagccaaggacaggctgaaaatcaccgtgtatcccgtgttgtcggcaagccttgaaatgacatagccggcaacaatcggaccgatcattcccgcgccggaatttaaaatgccgaggaacccgttaaaaaaatctctcgtgtccggctcagtgatttcaaatgtcaggacattaaacgcaagccaataaaatccgtagccaattccgagcacacttccgagcagcaccagccgtgatcccgcattttcccccgccaacagcacagttaaataaaatacagctaaaaacgaaacgccaaacctgagtataaaaaccctgtcgatttttttggcaaggcggccggcgaacataaagataatcggctgcatcacgacgatcgacaaattataaatggccaaatcgacaaactgtccggactgcttccacagatatacattcacaaacgtattggaaagggcaatgctaagagaataaaggccgccgactgcaagcagcagcaggaggtccctgtttaattccacatcgcctattatgtttttgattctgctcataactgactcccctttactgatcaccattagtctgtctcatcaaaagtcagttatgtacttcagagcaaaagaaacgaaaaacaaacagaccggcttttcgccggtctttcagcagacgctccgcttcgcggacaacataaaaaggcccgcttctcgcgggcctcttttctcaagctggattattttgcttcgctgtaaaggcgtgcaacttcatcccagttaacgacgttccagaatgctttaatgtaatctggacggcggttttgataattcaggtagtatgcgtgctcccatacatcaagacctaagataggagtcttgccttctgaaagaggagaatcttggtttggcgtgcttgtgatttcaagctctccgttattgacaacaagccatgcccagccggagccgaaacggcctgctgctgcagccgcaaagtcttctttgaattgatcgaagctgccgaatttgctgttgatggcttctgccaattcaccagttggagcgcctcctccgtttggagaaagaagtttccagaacaatgagtggttggcatgccctccgccattgttgcggacagctgtacggatgttttccggtactgcatcaaggtttgcaacaagctcttcaacagatttgctttcaagatcctgtttgcctgccaccgcttcgttcaattttgtaacatatgtgttatggtgcttcgtatggtgaatattcatcgtctctttgtcgatgtgaggttctaacgcatcgtaagcataaggtaattctggaagtttgtaagccattatcaattcctccttaatattgtatgtattgaaatgccgcctttagcaagcctttcctctttcaatttatcaaaagaaaaggcttgtttcaatggaaatgctcacaaaatgatcacaaatgcatttcaagcgctcactaaactttatccttttccccttctttttaaacatgcaggggaaaattttagagcacagtatataaaaagtagccgatcattatcagctgaatcacgcttttcgcaaaaacgcctgaaataaacccgatcaatgaaccgattccgattctggccgccgtttttaaatccttctgatggacaatcacctcacccgccaaggccccgataaacggacccaaaataatgcccgccaccggtatcacaaacggtccggccagaaggccgatcgtgctgccccatatcgctgccctgctgccgccaaagcgcttaatgccgaggagatttgtaatatagtcggcggcaaacaatacggctgtaaaaatgccttcaatgatccaaaataggtaggagtaatgcccgaatgtaaataaaaatccgtatagaacaaagccggctacgatgaaaacgacgctcggaataatgggatagacaaggccgatgaaagcaatgacgaacattgccgcaatgatgatccaatacaaaacatccatccgaatccctccaatcgattgtgatgcttcatattatacccatttttctgaaaggaaacttccagagcgcctgttgatcgataagttttcttgtattcgtccttttgtgacgatacaataatgcagatacattatagaaataggaagtgaaaaccgaatgaatttatttcagcgattttttaaaagtacatattcccctcaagctattgggaaaatgcgtttccaaggcataggaaaaacgattttatacgtatttttgctcagcgtgatcgccgctctcccgaacctttaccatatcagcagcggagtggtgaatacgatgaacagctttcagtcagctgtgaaagaattccccgctttctccataaaagacggcacactgcaaacagatgcaaagaaagcgattgaatcacagtcattcggatttgtcatcgtttttgatccgagcggctcttatgaaacaaaacagatcgaagacaaacgcaattccgtcggcatcctgaaagataagttcgtcatcgccattgacggccaagtccaggaaatgccgtacacaatgcttcccgaggacatgtctaaggatgatattctttctttagttgatcaaaataaagcggtgattgttcccgtcttgtgcgttctgctgttcctggcgacggcagccggaaaattcattgatgtctcggttctcgccgtcatcgggctgatcattcgcaacgggcagaagaaaatgctctcctataagcagctttgggtaatgtctgcttattccatcaccctcgcaaccgtgttttttgcaattatggacgcgctggaggcggtggttccaagtcagttcctcctgaactggtttgtgaactttatcatgctgtttctcgccattaaagaaacgccggcttctaaagcagcgaggtaaagcgggcaggagcaaatttgttgtcatgttggaagagggacaagcgtaacataataaaaaatgcacgaaatggggacaaatcagatgaaacgtgtcattgtgctgttttcgattttgctcgccctgttcattgtttattatgacttgaaatcaggcaccatccctcaaaacgccttaccggcttcaaccatggcagcggaagctccggctgcaagcctgcaatataagtccgttacggtaaagcccggacaaacggtattttcaatcatcgggaacagcgccgttccggctgacaaaatagccgaagattttgaagagttgaatccgaatgttgaggcgggccgcattcaagcaggtgtcacctacaagtttcccgtttatcctgataagcgttaatttcttgtcagtttcatgaacgggctgttacaataagacttgtaaacgatttggtataagaaaaggagcaaccgcctccgaattatacttaaggagcgaattcaagtgagtgaaatcacacatcgtacaaaaacgcgtcccgttaaagtgggacctttaacaataggcggcaataacgaagtcgtcattcaaagcatgacaacaacgaaaacacatgacgttgaagcaaccgtcgccgaaatcaacagactcgcggaagcaggatgtcaaatcgtccgcgtcgcctgtcctgatgaacgggctgccgacgccattccagagatcaaaaagcggatatccatccctcttgtcgtggatattcatttcaactataaattggcattaaaagcgatcgaaggcggagccgataaaatccgcatcaatccgggtaacatcggccgccgcgaaaaggttgaagcggtcgtcaacgcagcgaaggaaaagggcattccgatccggatcggcgtcaatgcaggctctctggaaaaacgaatccttgagaagtacggctatccgacagcagacggcatggtcgaaagcgccctgcaccacattaaaattcttgaggatctcgatttccacgatatcatcgtcagcatgaaggcgtctgatgtaaacctggcgattgaggcatatgaaaaagcggctaaagctttcgattatccgcttcatttaggcatcaccgaatcgggaacgctgtttgccggtacagtgaaaagcgccgcgggtctcggcgcgatcctttcaaaaggaatcggcaatacattgcggatttctttaagcgcggacccggtcgaagaagtaaaagtcgccagggagctcctgaaatctttcgggctcgcttccaatgcggcaacattgatttcctgcccgacttgcggccggatcgaaatcgatttgatcagcattgccaatgaagtcgaagattacatcgcgaaaatcaaggcgccgatcaaagttgccgttctcggctgtgccgtcaacggtcccggagaagcgcgcgaagccgatatcgggatcgccggcgcacgcggcgaaggacttctgttccgcaaaggcgaaatcgtccggaaagtgcctgaagaaacgatggtcgaggaattgaaaaaggaaatcgacaagctcgccgaagagcattatgccaaacaagcggcagaaaaagaaaaattaaacacataataaaaaaaagcttgacggatatccgtcaagctttttccgttagaaaaacggggtgatgaatatgccaagcaccaaggaaactgcaccgatacccattgcccatgctcctaagccagctgctccttgtcttctggctatataaccgacaatgatccctgcaattcctaacagcactggaagcataaacaaggaaataatcgaaagcgcaagcgcaatatatccggttacacgtccgccggcagcatcggcatcgttacgcgcttcgccgttgtccccgttatccgtacgataggtcggggcaacttctgctgctgtttcttctaaaaattcatcattatctaaagtcgcatcgactaagtcagcatcataacctgctcggttacgatcgcgaacattttgatctctttccattcgatatcccccctctttaatccaggagcatttatagtttaagcattttagcccgattcatgtttgctaaactttactgtaaatgttaaaagattatgatacactggaggaatggatgataaggagtgtggacatgttacatttaggaatcgatattgatggaacgatcactgcccaggatacttttgttccctatttgaacgagtcgttcagcctctccattacattggaagatattaaggaatatgacctgacaaagctgctgaatatatctcaagaagatttttggaaatggatgaacgaaaacgagccccgcatctatcaggaagcattgctggctcaatatgccaaacagacgctggatgagctgaaaaagcagcataagctgatatatattacagcaagaagacatcacctggaggatatcacctatgactggttcgagaaacgcgacattcattatgaccatatagaacttgtcggcggtcacgataaattggaagccgtcttcagacatgagatcgatgttttctttgaagaccaccacgggaatgcaaccatgatcgcaaaagaagcaggcattcctgttctgttgtttaatacgccgtacaatcagcttccgaccgattcaaacatcgtcagagtcgacagctggcttgaagccgccgaatggctgaaaaagaacgagaaaacgcttaaagccgcaaaaagcatgtaagaggttttatcttacatgctttttgcgttaaaaaaaggcatatggctttaaccgccatatgccgctccctttactgcgcttccgtgctttcttcttcacagcgcgggcaggttccgtaaatttcaaacttatggccgctgatctgatagccgtcaagatcgtctgtcagcttttccatcggacatagctcaatttctttcgttttgccgcacaccatgcaaataaaatggtggtggtggtgagcagaagaacatttaaaacggaacagcttttcaccggaaagctcagtcgtttccaaaatgccgagttcttcaaacagcgacaaattcctgtagattgtatcaaagcttagccccggataatcatcatttaaagcggaaaggacatttttcgccgttaaatatttatctgaatcactaaacagctgaagcatatcctcccgtttgcttgtatatttatatcctttttccttcagtaaatcaagcgcttcctgtacgttcacggcgaatcctccttttgactttattataactgatgcacagtatcaggataaagatcgacagcatcacgatcgttccccccggtgcaagatcgagatgataggcaagcacaaggccgacgatgacggaaagttcaccgaacaggatcgataagaaaatcgcctgcttaaatcctttggcaatgcgcatgctcgcagcgacagggagcgtcatcagcgctgaaacgagaagcgtaccgacgattctcattgaggcggcgataacaagcgcaacgatcaaaataaaaataaaatgaatccactttgcggaaatccctgaagcttttgcatgctcttcatcaaacgacagaagaaacagctctttaaaaagggaaaacaccacgatcaaaacggctgcggaaatgccgacgatcaccagcatgtcttcccgtgaaacagcgctgacgctgccgaataaatagctgaacagatccgtattgaatccgtccgcaagcgaaataaaaataacggaaatgccgattccccccgacatgataatcgggatcgccagctcctggtaatgtttataaaccgttctcagcctctcgatgattaaagagccggcaacggaaaacgccattccgaaatagatcgggctgactcctgcgagcactgcaaactgtttgcctgcatacaggctcgctgctatgccggctaaagagacgtggctgagcgcatctgcgatcagcgacagccgcctgacaacgatgaatacgccgagcaagggcgcgatgaggccgattaatattcctgaaataaaagcgttttgcaaaaactcataatgaaaaaaaggtgtcagcattattcgtgtcctccatgatgatggtgattgtggctgatggcttgaacatcatgcccgtaaaattgagacaagtcttgatctgtcatggactcaaactcttctgtattgccgtgaaaatgaagatgcttattcatgcaggcaacgtgtgtgactttatcggaaaccgtgccgacatcatgggtgacaagaatgagcgtaatgcctttttcacgattcaatttctccagcagcttgtaaaacccttcaactgttttttgatcgactccaaccgtcggctcgtcaagaatgagcagcttcggttcgctcaccagcgctctcgcgatgaaagttctctgctgctgtcctcccgaaagctcgccgatgtttctgtctttcagggacgtgatgccgacagcttcgatcgcttcatccaccttctgcttatcggctttggacatgcgtctgaataagccgagctttgcggttaaaccgcttgccaccacttcataaacagaagcgggaaaaccggtgttaaagctgtttgctttttgggatacgaagccgattttgctccagtccttaaattttctgagaggaacgccaaacagtttaagttcgcctgtctgcggcttaatcagccccaaaatgcatttcagcaatgtcgtctttcccgatccgtttggaccaaccaggccgagaaaagtcccttcttcaatttgcaaatttatatcttctatcacattgcgatgatcataggaatatgatacatgcttcatttcaataataggttgtttcaattcgttcaccttcaaattctccagaatcattacgatttatcgcacaaaaagaaaatggcagccgaaaagcagcaagccattttcacgattgaccagttcatctttaaattatacatataaactttaaaaaagtaaatgaaagcctaatggatggcgtttttaaactttcctccgcgcgtttcgtgcgtgtccataatcgttataaaagcattgtgatcaatatcgaagacaatcgatttcagcttcgtcacttcaagcctggtcacaacggcataaatcacttctgtgtcctcgtcggaatagccgcctttccctttgagcttggtcgttccccggccgaggcgatgcagcagcgaatcggaaatctcctcgtattgatctgaaacgatgatgaccgctttcgtctcttcaagcccttgaatgacggcatcaatcgtcttcatcgcaatataatatgtcataaccgaaaacatagcctgctcaaggccaaacacaaagctcgcccatgcaaaaataaagacattgacgaacatgacaaattcgccgacagaaaacggcagctttttcgtaagcaaaatgccgagtatctcagttccatccatagaaccgccgttacgaataacaagccctacgccgaatccgagcagaagaccgccgaatacggctgccaggacgggctgagtcgtaaccccttctacatgatgcaacagtgtttcaataattgacaagctgacgattccgattagtgttgaaattaagaacgtttttccgatgtgtttgtagcctgaaaacataaacgggatgttgagaacgacgacgagcagagcgaagttgatatacgggttatctttaaagaggtagtccaatattaatgaaatgccgataatgcccccgtcgatgatgttattcggcactagaaataattcgatgctggcggcagcacaggcagccccgataagaatcatgacgatcctaaacgcttttttgaccgctgattcttttttatgctgtttttgagtctttgccattctgtctctccttttcacaaactggccaaaccgttccttatcactatcatatcatttaacagactgaaataaaaaaatgacacatttttaattttacgccatacattagttcagaggggaggaatggacgtgattttatttcaaaagatcgtgctgcagcgtttaaatcaggtcacggctgacgaggtgctgaagtacgctaaacaatacggaattcaagtaacaagaaaacaggcgcttgaagtggaaaagcttgtgaaaggaaaaaacatcaatatttttaatgaagaagaacgcaataaactgctcaagcaagtggaagcggtcacttcaaaagaagcggtgcagctattgaaccagctgtttgctcaatacgtatcataaaaggggagctggtgtgcccccctttttttattgctgcttgattttttcaagcagctcttcatcaaactgtttatttttgagcatttcaatttcaaaccggtaaggcggctttttgttctttttatcttctcctacataaggcgtttcaaggattttcggaatatctttcagctgatcgtggtgaacgatgtattggagcgcatcaaaaccgatttctccgaatccgatgttttcgtggcggtcctttctcgcacctctgacattcttgctgtcattaatatgaagcacttttaaacggtcgattccgacaattttatcgaattcgtttaagacaccgtcaaagtcggatactacatcgtaacccgcgtcatgggtatggcatgtatcgaagcagacggataaatgctcgttgtgtgtaacgccgtcgatgatctgtgcaagctcctcaaacgtccgcccgcattctgaacctttcccggccatcgtttccaaagcgatctgcacattctgattcgggtcgatgacctcgttcaatccttcgatgattttttgaatgcccgtttctgcgcctgcgcctacatgagctcccgggtgaagaacgatttgtctggcgccgatcgccgacgtcctttcaatttcagaacgcaagaactcgacaccgagctcaaatgtggccggattcgttgtattggcaatattgataatatacggggcatgaacgacgatatcagagatgccgttctcttccatgtgagcccttcccgcttcaatattcaaatcctcgatttttttcctgcgcgtgttctgcggcgctcccgtatagatcataaatgtattggcgccgtaggagcttgcctcctgactggccgcaagcagcatatgttttccgctcattgagacgtgtgaaccgattttcaacaaaactgtttcccctactttccttttctaaattgctttcttttttgctgtctttttattttttggatttccgtctgcattttcttcttatatccaggcttgacttttctcggttttttcacaagccgcttggcgacctcatccgtttcatcaggcgttctttttcggttctgacggcgcttgcggtcatcgatctttttccactcgcctttttcaatcctcatgttttcaaacacgatccccatctgttcaagcttcacaagtgcatcttcatcagatgtatcataaaacgtcaccgctgttccggatgttccggcgcgcgctgtacggccgacgcggtgaacgtaaaagtcaagatcatcaggcagttcatagttaatgacatggctgacgcctttaatatcgattccccttgcagccaaatcagtggctatgatataggtgaattccagatcgccgatttgcttcatcactttttttcgttcccgcggcgtaagccccccgtgcagaagtccgactttcatccctttgtccgtcagataagcggcgatctcgtcggccgttgtttttgtattggcgaaaacaatcgccaaatacggatttaaatgggtcatgacctcgagcagcagctcatttttatccctgtgcctggaaggtatcagcacgtgttcgattttttcagccgtgatgtgcttcggctcaacatgtgcatacctcggattggccatgtattttttcaggaaaggctttaatttttcgggaatcgttgcggaaaatacaagcatctgcaagccttccggcatatgcgacccgataaaatcgacatcttccaaaaatcccatatcaagcattaagtccgcctcgtcaataacgaacgaaccggctttatgaacatcgagcgcctgctccctgatcaggtctgcaattcgccccggcgtacctaccaccagatggggctgcgtttttaatttgtcaatcgatttttgtttatcggtaccgccgatgaaacatttcgaacgaatcgcttcatcaggccctaaaaacttggtgattttcagaacttcctgatgaatctggttggccagctcccttgtcggagccgtaatcacgacttgaacgaactccttttcaggatcgatcctgcttaaaagcgggagcagataggcgtgcgtttttcccgtacctgtctgcgactgcccgatcgcgctctcccctttcagcgccgcagggattaaccgcttttgaatatcagtcggctcataaaatcccaagtggtgaacagcctctataataaacggctttaaatcgtacatttcaaatttcgtttgtttcattttcccaactccttcttggaaagccgttattccggcgctccaagctttatcctatatggctgaattgtgcgcttatgtatccttttttatgccgcactgctaaaaaaaaggctgatatcatgtccatcattaaattataactgatcctgcagaaaaaaaccatcacccccgccctaatcgggccggcggacaaaggcactttgccaccgttggtgcataccctatcaagagaaggattttgaaaggaggtacaagtatgtttcagcaacagccgatgagaaatcagccaagaccgcaggcgccgcaaaggcccggcagagccttgatgccgagacatccggggatgggaatgcagccccctcaagcgcagcagcgtggcctgcagcagatgtttcagccaatgggcgccgcccagcagcaagcaggcgcgcgaggaggagggattcaggggttgctctcgaaatttcttcccggatctgccgcatccgggggaacaggagcgggtctcggcggaaccggaagcggccttggaggcattcagggtctggccaatccgtctaccatttcaaatatgctcggcaatgttcaaaaagcgctcggcgtagcccagcaagtaacaccgatgattcagcaatacggaccgctcgtccgcaatctccccggaatggtgaaaatgttcagacagctgaattccgatgatacggaagcagaagacggcgaacaacaaaaagacgaaccggaacacaagaccgaaacgagcggcgaaaagaaagaagaaattaaagtgtcatccaaaaaacccgaaaaatccaaacccgaagaaatcagaaaaaaacagagccgttcagcccctccgtctgcaaaaagaaaaaccggaggatctaaacctaaactgtatatataacattctttgatatctcctgcgggatcagatataatgaggtctatagagactgcaaaaataagccgttttttacggctttttatcatgcccggctcttacttctttataggaggactaagaatgaacgtaattaaaatatcgccgcgcggctattgctacggtgtcgtcgacgccatggtcatcgcaaaaaacgcggctctcgataaaagtctgccgagacctatttatattttaggaatgatcgttcacaataaacatgtcacagacgcatttgaaaaagagggcatttatacgcttgacggcccgaataggctcgagattttgaatcaggtcgacaaaggaacggtgatcttcaccgctcacggcgtttcgcccgaagtccgcaaaatagctgaggataaaggtcttgtcgcgattgacgccacctgccctgatgtgacaaaaacacacgatttaatccggaaaatgaaagccgaaggctatcacgtcatctacatcggaaaaaaaggacacccggagcctgaaggagcggtcggcgtcgccccggatatcgttcatcttgttgaaaccgaagaagatgtggaaaggctggacattgaagcggagaaactgattgtcacgaaccaaacgacgatgtcccaatgggatgtccacgatattatggaaaaggtaaaagaaaaatatccggatgttgaattccaccaggagatttgcctggccacccaagtgcgtcaggaagcggtgtccgaacaagcgaaaaaagccgatttgacgatcgttgtcggcgatccgaaaagcaataactcaaaccgcctcgcccaggtctccgaagaaatcgcgggcacgaaagcataccggatcggtgatttaagcgaattaaagctggaatggcttgacggcgtagaaaccgtcgctgtaacggccggcgcatcgacaccgaccccgattacaaaggaagtcatccgctttttagagcaattcgatcatgaagatccgtccacatggaagatcagtcacgaagtaccgctgcataaaatcttgcctaaagtaaaagcaaaaacctgaagcgctaatagcttcaggttttgttttttatacaaacgtaaacggattcgtattcgtatccgatggaaagaccgagacatcaaattttttctcccggcacatcgctgtcagcttttttgcaaccccgtttttcatgatttgttcagcataatggccggggtcaactacattcagcccgatcatcatggcgtcgtgcgccgtatggaaatacaggtctcccgtgacatatacatcagcgcccatacgttttgcatgatggatgtatttgttgccgtcaccgcctaatacggcgacctttttcactttcgcatcagacttgcccaccatccgcgctccgttcgcatccaacttttccttcacatatcgggcaaacgcttcgagtgtcatctcttcattcaattcaccgatgcggcccagccctttttgaagcggattctgctcgaccggataaatatcaaaggccacttcttcatacggatgggcctcactcatcgctttgatcacggatttttcaatacccgccggataaacggtctcgattcttacctcttcgacccgttcaagctcgccccgcttgccgataaacggatcagcttcagatagcggcttgaagctgccgactccttctgcagaaaacgcacagtggctgtaggcgccgatatggccggctccagcgtctccaagagctgtgcgtacctgttcttcataatctttcgggacatagacggcaagttttttcagcggctcttcataggttggaaccagaacttttgtgttctttaattccagcgcttccgctagcatgtcgttgacaccgccgtcagcgacatcgagattcgtatgagccgcataaaccgcgatatcatgcttgatgcacttttcgatcagccttccgccgggctgatctgtgatgacatgtttcagcggcctgaaaacagggggatggtgcgcaataattaaatcaacgttctttgcgatcgcttcatcaaccgtttcttcgagaacatcaagcgtgaccatgacattggccaccgttttgttcagcgtgccgatttgcaggccgattttatctccttcaacggctaaagacttaggcgagaactgttcaaacaattgaatgatttcatgcccgtttatcgtttttgtcatcttctaagtacctcctttaagatctctatccgttctgacagctcaagcaatttttgtcgattttcttcactcggaggagccgcttcaatttgtcgatagatgttttccgtatgtttcagctcctgcgaccattttttgataaaaacatcattttgttctttgaccaaaaatgggccgacaagcatgcctgccgcaaaggaaaccccatcgtaagccgcatcccgatcgcccgcttcagccacgagaacctcatagtacttgccgtcttcttcaaggatctcttcattgatcagtgcatagccttcctggtagagccactctctaatatggtgagcgtggatattcggctgtaaaaccaaacgctccttacctgagagcttatccttgcccgtttttagaatgtgagcaatgagcgagccacccattccggcaatcgtgatcacatcggcttcgcccttttcaatcacttcaagcccgtctcctttcctgacggatatgagcgaacttaactgcagtttctcaacctgctgtttcgcagaaagaaacggaccatctgtgatttctccggcgatcgcggcgcttgccaggcgattcagcacacaatagcaaggcaaatacgcatgatcagacccgatatcagccacaacagccccttttgttatgtattccgccacagtctgcagccttttcgataacttcaattcattcacaatcatcactacttttctagattcattttacttttactatcatataaaaaatcgctttactttccaagctggaacagcaaatcaacattctactcggtcaattttggattctctctgtaatatccacgtaaagtatgggtctcaagatccgcgagccgaaccggaatcggcagcctgctttctcgattgattaagctcatcgcgatgtcataactgctgtctaaatcaatcaaatgtccgcatgatagaaatatcggtttgacatcttgccttgtccgcaccgcacgtccgtagacttcgccatcaatcacaatatctgtataagcgccgaatttattatcaggcatcacaaaatcagtttgttttattttcaagtaagttttcgcaatgccgatcgttgggttttcgagaaaaaacgcagcatgtgtcgcaatccaatatggttaatatggagatagccattcccgtcaaataaaaaaacatccggttcaatcgtcagctttttagctgccttaataataagcggcagctccctaaaagcaagaaaccctgcgatataaggcacggcgattttccctgcacaatgtactttttcaatgacacgcttcgtatgaaaatccagcacgatgatgctgcagacaccaaatgcttcaccatctttctcccaataagctaaatcaacccccgcacaggtttgcagagcgtctttactgatggggttttctagattgatatgtttttttagttttgtttgtatcgttaagaagtcattttcttggtttaaattaaaatcgtgtatattgttgatgttcatctttaaaaaccaactttctacatgcctttttttgaacgcctttatctagatcatatctaaattgttcagttcattaccgggacatcactccgatgccggacagcaagatgtcttatagaatgatcattgtaaaaaaagagccccttaacaagcaaaaattcgggagctctgtttgtctttttgtaaatcgggtgatgttttaatcattcattattattctttatttctcagcttcatcgtcatgctgtttacaccttcaaaaagggcgtcccgtatgatttcagtgtaattctggtaactgtcgcttttggctttaatgatatctaaaacttgtttaaattgtccatctacgataatcgtaatgccttcgaccttttcacctgtctgatcattctcaaattcctcattcaacatggttaccgtatcattactattcattagaaactctcctatcttttttaaaataaacttttccctttatgatttatccaatacttttaatttgtaggaactagacttgtaaagtcctcataaactccaatccaatgattttggtatatattcttcataacatgctggttctaggtacatggaatacaactttttctgactaaaatcgattaataatgaggggctgaagtcaaacaaagcatcggctggctatttatattgatgttcggctgctttttgaagggcggcttctatgtggtccactaatttttccggtcttctcgtttccatgtcttctaacgggttttcccagtccaaattcttaattaatagcatataaaaagtgcctgaaggctcaatatccacgtaccagccgacatctaaaatcaagcggctttctttatgctccaactgtagtaatgatgacgtaaagttaaaccagtcatcactgtcctcctctaactgatctggatcgatatcaattagtttattataagagacggtccatccttgaggaattctaagacgtaaatagtcaggaggcccttcaaaaatgaaaaagttccctccaaatgccgccgcttctattttccaaatgatccgttccagctcttttactagctgcctgcgatcttcaacattgattgtgtcaatcgtttctctatgattgtcataaatatgaataagatattcatcctggcctttaatgattttgaccgcagcatgatatctttgtttttctaattctaataatttggtatttggttcaactttttcatgtgtgtcggttaagtcattatatttaacgaaccagccgcacggtatatttataggttctaatgattttatggaattagacaaatcgttcactcctgatttgtatattcgtctcttgagttcaggtcttgtcctcttatttgttttattaccaagttttatacaaataatgtgtcagtactttactatttgcattagatgactgacggagatcattttatttcacagccagaccaaactgccgacactagaatacaaaggactgtgtccacaagctctcctacttggagcaagcaataatcatgatcgtcttcttgtcttttatgtatgacaaaatgaaatatgaataattctatatagatcaaaatccatggtcaaagtctatttcatacaaatctacccattctataaaagtcggcattgatttagtggtagtaaactcattaattatacggtaagctaaaccacgatctacatagctgcaagacggaatcttcattggctccccacctactaaatgttccaccgtttctatttcaacatttttattcattggaacgaggtagtctggatgtctcattataaagaacccatatggttcatcataaaagaaaattaaccattcatcacagccctctacttcaaaacatgaatccccgcttccttgcttccaataatcctcgcctttttcaaatacaatacttcttataaaatcatcattcgggttttcaattggttcttcaaccggtccattatacgtgatcatattaataccaccttatttggtagcctcaattattattggcttgttactcttccgtgtctttcataagccctgcatgagattcagcatgagttagttgagcatgtcctaagagttttaggtgtactctttttgagcgggacccactgtacttcccttaaaaatatagtggccttttgcgattctaatatgacagttgaatttacatcaaaatgagttctacttttagtcgatggtgttttgcctagttgtttgctctttagatattttatcaatataatcgtccagcgtacaattgtccaatgaacgatagcactgatgcttacggtgattttatctatttccagcttgagccccgagacaatttccgcccctttcaaatccgcgtttttcacttcatgatccaaaaaagggtcttccatataagaatcgtatcccctgtgcttggcaatcaagtggtttattcttaactttaggagcggttattaaacatatatttaacttgcgattgagttctttcataattaaaataactttataaacgcttctctatttgtggggatctcctcttttgcactctgataaacctcaatgccctttcttatcttttcaacctctttcgatgtgataaaaccagtttccaccgtactatttaaaaagatggtaatgctatctttatttataccctctaacgcttgtggcaaatgttttactttttcttttttataagcttcccaagaagtataagcgacagcatcaactagtagcgaccacagcctggcaatattcgagtcttcttcttcctcagcaaattctgaaattcctgtaaagtctgcgttatcaattagctcgtataagtcatcaccagtaacggcatgagattcaacccataaccaacatttgtccaatgcttctcttccttccggatgcctttcatcatctttgctgattacagaaaatactctttcggcaactgttaaaacaaagcctactttaactttattttgcaaattgtccaaaaatatattattcatgataccctcccttattcacgcagacaattggagtgccgatgtggtcggctgttctacgaagacgcttttctttatgctcaaacctgtaggaagtgataggctgaacttcgttgtaattcatttacctttatatacattaactcattgtcaacactaacctgtatcaaatttctaaaaaaccttgaaaagcatacagctaatcaaggcttgaaatgattatatttattttttcttattcattgctgttagatgggacaaacacaataaattcccctttaggatatgttcccttccaaccgcaaggccatccgccttctttatataactcaaaaaccttttcataaaaattatttgtttttccattgaccaaccgatttaaagcacacattgtgaggtctccttcaatctcctcatgaatatctacataatcaaacggaagaaaatgttcagagtaattttcatagtcaccgaaatactcgtataattcatcttgctgagtagctaaatctaaatcgtatatcttttctgcaatattttcagtttctaatgacttaacatgctcccacactgtatcaacttctttaaatcttgtgaccaggcaaaattttgggcatcactaaaattattaatgactcgcaaattagggacattaaagttctcattgaaaaacatcttgttattacgaataaagctcattacttcttcgactaattgagtgttcttaccaaaattcatttagataaccaccttttcaataactcttcggttgcttcaccgcctctgttccaaatagggagctttttattttttccacttttctaaaattcttgatattcccatccattagataaaataagaaagctggaatatcccaactttcttatttttattctacactattaagtaaaaaatcttgaatgctctccctggaaatttttttctccccctcttttttcaaaaacttcaaaaaagctttttctttttgacctggatttttagataataaactaaagtgactatgaaattcctcaaataactcgtaagaatcaatagattcgatggtttcaggtaaatactcatctttctgatatttatatgctttgtaaattgtataagatattgcatcagcaatacatatccaagcatctagatcatcttcatttgattcaagctgcattaaagttaaaatccctgtgtcatctaaattttccaggtaagtataaagatcgtctgcttctatattcttgtgttcaagccacttccagcaggcatctaatgcttcttttataaaattgaaatcatttgattgttttaatgtaggaactattgcttcacaaagtcctaaataatatgcagattttaaatcatcattcaattcttcccattcttgaaacatatactacactcctcaattaaatatattcaccatttttaataactaaattcaatcttccgtttggcttgattccttgaatagtctcagaagttacttctatcgtcaaattaggaaacatctcgctaaattgcttaaatactccagctggtacattcggattatttagtccttgaatacaggttggacaaacccctttaggattagattggtgaatttttaatgttcctgttatttcagcaggattttttcctaaagcttctactttgcttataaaatcatttaacacgccttcttcagcatgtcttgttgcacttgcgatttttcctggagattttataggtctatctggcattactgagtctaaatcgggaagcccggcttcttttctaactttaggggatccaccctcaaatactaaattttccaaaccttccacatctgtctttccaaccgcaacagtgtcagttttaggaacattccatttttggcgcagaacacctaaatcagcttttccaacatctattttactaccagtcctggctcccttactgacgttccccccaccactcaccatcttcacaattccaagctctttcaccggcgttttttcaacattcacgcggacaattggggtgccgatgcggtggcctgttgcggaggcaggctgttcgacgtagacgcggacgtttgtcgggacttggaaggatttcaccttttcaaggatgttgtttcctttttgcaccagagctgcttttggcgatttggcgagcggaatgtttttgccggccgttttggccaatgtttgagcgccgtggtttgccgtttttgcgacagcacctgcaccgacgaggctcaaggtggcttcgatcaggccttgtttccgcctctcttcagaaactttgtttccaaacatgtccttgcccgtgacggcttctgagaacccatttgaagcgacaaggccgtaggcgcccatttccgtcattttcaagacgttcaacgtttttgaggctttgtaggcgtcaagcgcgtgatcagcggcgatgagtccttttcctgttttataaatggcttttccgcctttgaaggctcggcctgcccaccctacgatcggaataaatcctgctgccgccattgctccggcggcgacacgctggccgtctgtcagcttttctcctgtgaccgggtcgacgccttcagcggctctcttataatcataatacccgctgacttctccgacaaatgttccggcagcgtcaagcgcttttaaatcccaaggcttgttcgcttcttcttcttgtttttcttgaagcctgcgcgcttctgcctgttcatttttgaattcaatataattggcggcttgattttcgacttctatcgtatttttatagatctcgcttgagtggaacgatttcaagctaaaatacatcggtgaggcggtttttccatgacttgtagcttccatcagcccggaatatttgccgagcacggcgctgtcgagcgcttgtaagtttgtgtattcggtcttgagcgattcatccagtttattcacagcgtcgatggtgttttgccgagttgtttgcgctttagacattttatcaatataatcgtcaagcgtccaattgtccaaatcaacgatatcgctgatgcttgcgatgattttatccatttccagcttgagccccgagacgatttccgtcgctttcaaatcagcgtttttcagttcatgatccaaaaaagagacttccacataagaatcggacagctttttgtcttttatgtcacctgatacaccattaaaaaaagcaatctgcgcttcaacaagctttaaccagctgtcaacgatctcggcctgtcccttgtagaagtctttaatgttatccgcacctttcccctgaaaatcatcacctaaatcggcgactccgagaaacgcttttttgagcgtttgcagttgatcctcaaaggtttcgtattgtttcttgcggttattcgctgcttcaattaaagaatgcgcttcaaatactttcattgaattgtcctctctaacctcaggctattttctggcgattgctttgtcctgctctttcagcaaatcgacattttccttcgtatcctttatgtttttgtgtacggcttttttgtaatcggccaccatctgatgaatgttctgctcgcgttcgtggcactttgtcgtatatgtcaatttatttttccctgcagctttcggagggtttggcaggtctagggcatcaatcgccgctcttacggcctccagctttttgatgaccgtttcatgtttcagcttgattgtcgtcattaaaaccagctccaactgtttttgattgagcggattttatcgctcaactgatcaaccgctttttcccccagagaaagcaaatgatccgcctctttagctgccgctcccgccaattcaaggctgtgcttttcaacttcgagcgcaaaaatttttctctccagctgggaaatatagccttcgtactttccgttcacgatgttgtacatagatgtatgagcctcatcccgttcgccatcaaaatcgttggcgaagtcccctgtccagtggctgttcagatgagggtgcaagatttgcctgatctcgacaatcccggtttcgtgttctttctcaatccccttttttgctgttttaactcgttcaatccgcctttctacatcggccagcttttggttaatcgtgctgtggatatgattcaatgtgctcgcatgactcatttgattcacctcagggaaatactcaaatagacggatgacaacagggcatccgctgcattttttccatttatataatagtaaaatagatgcaatcttacttaaatagggtggattgcttatttttcccttgcaaagatgagtgaatcctccagaaaaagtaataaagacctactttcgatagcgccgcaccgcctgaaaggatggaatcgcagatgctggaatagtacaaatcaccctatcgaggcgactctttttctagcaagagcctcattgaacaaaaacagaaaaaggattcgcccgaaagctcttttcaaagctttctttgcgaatcctttaagtgattaaacggttttagccaatctgggaaagctatttaatctctgacacccatttggccatatcatcaagcttttccgccgggaccagtcctcccggcattccgttgccgcctttttcaatcttttctttaatcgcacctgtatccatccggtccccgacgcctttcagtttagggcctgacacaccttcataattctcgccgtggcaggttacacagttcgctttgtaaatttcttcaggcgaagcatcggctttgtcttcttgagctgttttattcccttcgcctgcaatttcttttgcgtcataaaggccttttatagataagataaaaaccagtcctatgcccataatggcgattaacaaaaatggtatcaatggattgcggttcattttacatccccctttttaatttgcccctgccccttatgtaaacaattctaattctactttaattttacaaaaagtaaaccggttatgaaacaaaagctgatgaagttcacattttagacaaaaaaatggacgatgaagcgattgtttatttcccatttaaaaaccagtttttgaatacggttacaacaaccattataaagggcttttccttcgatctcaaggttataatgactcaaaatacacttttggatatttgcaaattcgaaagaaattaagtaaaatataatcgggttaccaataatagcgctttcatttcttttgtgaaaaaaagaacggatctcctgacccgttcaagtttattcgagaaaatctttcaagcgtttgcttctgcttggatgtcttaatttacgaagtgctttagcttctatttgacgaattcgttctcttgttaccccgaacaccttaccaacttcttctaatgttcttgtacgaccatcatcaaggccgaagcgaaggcggagcacattttcttcacggtctgtcaatgtatccagcacatcttcaagctgttctttcagcaattcatatgctgcatgatctgatggagaagtcgcttcctgatcctcaatgaagtctcccagatgtgaatcgtcctcttcaccgatcggagtctcgagtgaaaacggttcctgggcgatctttaggatttcacggactttctcaggcgtcagatccatatcttccgcaatctcttcaggcgttggctcgcggccgagatcctgaaggagctgcctttgaacacgaatcagcttgttgatggtttcaaccatatgaacaggaatcctgatcgttctcgcctggtcggcaatcgcccttgtaatcgcctgtctgatccaccatgtcgcgtatgtgctgaacttatatcctttgcggtagtcaaacttttccaccgccttcatcaggcccatgtttccttcctgaataaggtcaaggaaaagcattccgcggccgacataccgttttgcgatgctgacgacaagtctcaagttggcttcagcgagacggcgcttcgactcttcgtcgccttcctcgattttttttgcgtattcgatttcttcttttgcagacaaaaggtttacccgtccgatttctttcaggtacatgcggacagggtcgtttatcttaacgcccggaggcacgcttaaatcgttaaggtcaaattcttcttcggccttggccagctgttgaatattaggatcctcagtttcttcgttctcgctaattaattcaacgccttgttctcctaaaaattcataatactcatccatttggtctgattcgatatcgaagctggacatgcgctctgcaatttcttcatatgtgagcactccgcgctttttgccggcttctgttaattgatccctcacctgttcaaatgtgaattcagtttcggtctcgtgagcttgtttatcagccattcatggatccctccttccaaaacttacagacgaattctaaaagcatcccgcttttttgttcctatttcacgagtaaagccttctctctcatctacggcttcacgggaaagcaaatcataaattgacaatatattgattaggacaagcagcttttgctcctccgttaggattcattgccaagagcttttcctattatatataacggtttatttcagcgaacggttcaacttaacaatttcctgcgccaaagtcgccgctttgataaagtctttttgcctctcggcttccgcccttgcagcttctttttcttttatcattgaccaatttcgataattcaacactttttttacataatcagataattccgcttcacttaattcttcgttcacctgaagcattaagatatctgtcagaagctggccaagttcctgatcctcgactctcttaaagagctcctggatggaaatgtccgctccttcttcatacatggcgtacaaataagcggcaatcgctcggtgctgatcaaggttgaattcaaagcccacccgttccaaaacctttcgaatgacgtcccggtcatgaatcatgtgggccaggagcatccgctccgcattctcatgagccggccgaagccccgtctttctccgaggggcgcgcgatacggccgcctgccgctctttagagtcctggcggctgctttccctgctgcggcttgcagcctgcttttcaaatacggaaagctgatccttcaaggattcaaatgagattgaaaattcatttgccagctgtttgatgtatatttcctgttccaaaggaccgctgagaaggctgacttccttcagtacatcgttgatataggctaaacggtctccttcatcagacaggtttctgcccttgcggaaatagttcattttaaacgtcatcatcgtaacgctggcccctattacatcatttttgaatttctcgctgccgaattttttgatgtagtcatcgggatccagcccgtcaggtatcatggccaccttgacgttgcagccttttttctgaagaatctccgccgctttcagcgtggcttcataaccggcatgatccgagtcatagcacagtatgacctctccgacatttcgcctgatgatcttcgcatgttcttccgtcagcgatgtacccatcgtggcgatcgattctttcacaccggaggtgacggctgaaatgacatcggcaaatccttcaaaaaggacggccctttcttctttccgaatgtgaaggcgggcctgatggaaatgatagagaagcttgctttttcgaaaaagcggcgtttccgggctgttcatgtattttggctgctccccggtgaacgtccttccggaaaaagcgaccgttgtgccgtgatgatcatgaatcggaaacataatcctgtttctgaaacggtcaaaatatccgtcgccgttctcgcgtctgatgatgagtccagctctttccatcagcgcaagatcaaaacctctccgttccaaaaacttcgtgatgaaatcccacgagtcaagcgcgcatccgatttcaaactgctcgatctgctccatcttaaagcctctttcaagcaaataatcgagcgctgcctggccttcctttgtattgacgagcaaatgatgataaaatttctttaacagatcatgagcttccgccattttctgttcatccgaactgcctgtgctgtatgctgatacagctgcgacctgctccggcagatctatttgatatttgtccgccaggtgagagacagcctcggtaaatgaatagccttccatttgtcttaaaaatgaaaaaacgttccctcccgctccgcagccaaaacaatgaaaaatctgtttttctccagaaacagaaaaagatggtgtgttctcaccatgaaaaggacaaagcccaaaataattacgcccctgttttcttaactggacgtactctccgataacttctacgatatcagctgatttctgcacctgttctacaatttcgtctggtatacgattgcccatgttccaacactccgtcgtacataattcgctgcttagtacgtaaatccttcaattttcgacaagattttttgcagctctttgacaaatcgctcccggtcttccttgaccagttttttcgggcctttcgtgtaacgtccgcttcttctcaatttttgtgcgacgtgacggcggaaaagagcatgatcgatggagttctcttcgaaaagatagcctctctccgacatcacatagacctttttgccaagcaaaagcgatgccagcccgatatcttgtgtgacgacgacatcaccaggtcgaacatggttggcaatgtacagatccgctgcttctttgtgcggatcgacatatgtccaattctcttcttctttccttgtgatttgaaaatgctcgaatgaagccacgaataccacctttacgtcgaaatccgccgctgttttgagcacttcatctttcaccgggcatgcgtctgcatcgacaaaaatcgtcctttctttttcaagaagactaattctccatccctccatcaatctcctgctataaatacaggcaaaatcacacaggtttcaaaattaatcgatctataagaatttgtcgaaagtttttttcgggaaattcttgacacgatacccataatagtttattcgttctgtactaagcttaaacctaaaagttaattattttatcacaattttttattataatacaaatgggttaaagatgctatcattttcacttttcccaaaaccatcaaagcaaaaacccaggatggggtgtcctgagttttattcttagaccctttttgtcatcatgttgtgaataatgttggccgtttcctccaccgctttatttgatacgtctacgacattgcagccaatgcggccgacgatcttttcaaagaattcaagctcttctttgatgcggttgatattagcgtaaatggctttgtcgttgaggccgagcgatttcaggcgctccttgcggatatggttcagtttatccgggctgatttttaacccgatgcatttagccggatcaacggtaaagagctcttcgggagggtccacctcgggaacgatcggaacgtttgccacttttaaccgtttatgcgccaagtattgggataacggagttttggacgttctcgacacgccgatcagcacgatatccgcttttaagatgccccttggatctctgccgtcgtcatatttaaccgcaaattcgatggcctctaccttcttaaaataatcttcgtccagctgtcggactctgcccggctcatatttcgcactgaagccgtagaccgactccattttctcaatcagcgggccgatgatatcgtaatacacgacattcgccttttcggcttcggcgattaaaaattcacgaatctccgggacaacaagcgtaaaacagatgatgccgccgtccgcttctgccagcgagatcacttcttttattgttccgcggtcttcgacataaggaatccgcctgatatttgtctgctcggatgaaccgttaaactggctgatagccgctttgactacgagctcagcggtctcgccgacagagtctgatacaacataaatcgtccgattactcatgatatccctccatttgaagttcactctacatgatttcattttcagataagccgactaaaatttttgtcatgttcgttttcgtaattcttcccacaacttcatagcctttttctgtatcttttacaacaggcagtgcgtcaatttgtttttcgatgagcatcttggcaatgtccaaaatgaaatcgtcgcgcctgcaaagcgtaatgttcggcattctcgtcataatgatatggacgggtattgaagggagctcctgtttgccgatgctggctctgagcaagtcttttcgtgaaagtacaccgactaagatggcattatcatcaacgacaaaaagcgttcctacgtcctctaaaaacatcgtgcaaatcgcatcataaacggagacattttcatgaatgaccaccggaatggactggaagtctttcacctgcagttttttcagcttatcagccaagagctgcgtgcccgtctttcccgtgtagaaataaccgacccgcggccttgcttccaaaaatcccgacatcgtcaatattgccaaatccggacgaagggtagccctcgtcagattcagcttttccgcgatatgttctccggtaatcggcccgttctctttgacaatctgcaaaatatgctcctgacgtttatttagttcgatcgtactcaccacctttaagccgaagctcacaattcgttcgttatgtataaaagtcgataacatattataacgcatatgaagactaaaataacagcaattacaattgaattctatgaaaaagacaggcggtatttgacaaggatgtgaaaaatcgatttgagcaaaaagacgattgccagcctgtcagcaaccgtcttctgcggtgtttattttacaatgatggcattgatgtttgcaaaagatcggatcagctccgccaagcttgccatttgcgccaggcggtttgcttttaatctttcatcttcggcatgtaccatcgtatgatcaaaatacgcttcaatcggctctttcagcttggacagctcactgaaggcgccctcataatcttttgcttggtaaagggtctctatttgctgcctgcacgcctcataagctttgaaaagctcctcttcttgagggttttcaaacagtgaagcgtcaatggcgctcgtttcgctctttttgctgatcgaaataacccttgccagcgcttcagccgtttctttaaattccggtttggctgcagccgattcaaggacggcggcttttttgacagccgaatacggctcaaggttcgtgctttcgagcacggcatccacgacgtcgtatcggatgttttccgctgttaatacatatttgaggcgctgtttaaagaattcgagcagttcgctgtttgcttcctgtccggcaaacgcagccagttctttgaatgaaatgccccagttccggtcaagcaggatttggacgatgccgctcgcctgtcttctcagtccatacggatcctgagatcctgtcggaatgacgccgattttgaagaatgaagcgaccgtatcgagtttgtccgccaatgcgacgacggcgccggcgattgatgaaggcgtttgtcctccggcttgtctcggcatatagtgctcattgactgcgagcgcaacttcttctttctcaccgagcatccgcgcatatttttcacccatgatgccctgcagctcaggaaattcgtaaaccatgtgtgtcacaaggtcgaattttgaaatgtgcgcagcgcgcttgatcagctgcaccgtctcttgatcggcaccgatgacttcagcgatccgttcagcaagcgcctcagtgcgtctcactttatctccgagcgaccccagttcttcatggaaaacgatcttttcgagctttctcacattctcgtcaatgtttaatttttgatcttctttatagaagaaggaagcgtctgaaagccttgctctcagcactttttcattccctctcgccacgttttcaagggcgcggctgtctccgttgcggacggtcacaaagtaaggaagcaagctgccgttttcatctttgacagggaaataacgctgatgctctttcattgttgtcacgagcacctcttcaggaattgcgagaaattcctcttcgtaagaaccgaacagtaccgttggatattcaaccagatggttgacctcatccagcagatcctcgtctctcggaatgtcccaggacttctcagcagccagttcgtcaagctgcttaacgatcagctgcttccgtttggccggatcggcaatcacaaactggctttccagtgtcgcttcgtattcagaaggtgcgctcaagtcggctgcttttccgaggaagcggtgtccctgcgttgtgcgtccggtttcgacatgagcgactgaaaacggaacgacttcacttccgaacagcgcgacgatccatttaatcggcctgatatattttaaatcttcgctgccccagcgcatgtttttcggaaagtggaggcttgtcaccaaatcgcggagctcaggaagcaatgaaaacgtatcctggcctttttggaatttttgcacaaatacatattccgttcctttgatgtctttaaaatacaaatcttccggacttgctccttgcccccgtgaaaagccgatggccgcctttgtccattcgccgttttcgtcaagggcgattttctttgccggtcctttcgcttcttctttcacatcatcctgcttctccgccacgttctcgacaagaacggccagtcttctaggggagttatacagcttgacggaaccgaaggcaatatttttttccttgagccagctttccagcttctcacccagctgagtcatgctgtcatgcatgaagcgcgccggcatttcttctaatccgatttctaaaagcaaatcttgattactcatgtgaagcctcttcctccttcagcattgggaaacccaacttttcgcgttcatcataatacgttttcgccacttttctggccaggtttctcacccttgcgatatatcctgtgcgctccgtgacggaaatcgccccttttgcgtcaagcaagttgaacgtatgcgagcatttcaaaacataatcatatgcaggatggacaagtccctgatccatctggcgatttgcttctttttcgtacgttgcaaacaattcgaacagcatgtcgacgtcagatgtctcaaacgtatagacggaatgctcgtattcagccatcttgaacaggtcttttatcgtatagccgttcgtccattcaagatcaaagacgttttctttatcttggatataagaagcaaggcgttcgataccgtatgtgatttccacggaaaccggtttgcactcaagcccgccgacctgctgaaaataggtgaactgggtaatttccatgccgtcaagccatacttcccagccaagcccggcgcagccgagcgacggattttcccagttatcctcgacaaagcggatatcatgctccagagggtcgattccaagggcttttaatgaatctaaataaagctcttgaatgttgtctggagacggcttaatgatcacctgaaattgatggtgctgataaagcctgttcggattgtcaccgtatcttccgtccgcagggcgccttgacggctccacataagcgactttccaaggctcaggcccaaggctccgcaaaaatgtatatgggctcatcgtgcctgcacccttctctacatcatacgactgcaaaagtacgcatccttcattggaccaatgcttttgcagggtcagaatcatttcttgaatattcaaatgaagcacctccacaaaacgtgttttcaagtttaatttttggcatagggctggtttgggcagaaaaaaactcccgtccctatgcttgtttacccacaaacatagggacgagagttctcccgcggttccaccctaattgctgagaggaaatgtctcagcctcttttttaaaagttgctcagggaatgcctttcattgcgctctcatccccggctttcaccgccccggagtcgcttcaatgaggctgtgcgcaattacttctttccgtcaacgcaacatcattattgaatccaatcttcatgtcatgatcttataaaaagatgaagaggttgtcaacttttgttttcatcgcccagcatctttttcatattgtccatttgttccatgaagcgccgcgatttcaggtagatccctgagtactcgtcatagtacgtctgaataacccttttcagctcatccttcgtctcctgtttgaccgagacatttccgagccttgacaggtcaaaataaaaaaacagtctcaacagcctggcggatgcgggagacagcggtatcctgtatggatctttcgcaaaacagcggtggcagataaagccgttgtcgcggatcgaaaaatgaaatgtgccgtctttgcttttgcagtgcacacattcatccagctccggatacagccccatcacgctgagcattttgacttcgatgaggttggcgataatgtcgggatctgtaccgtcattcagcctcctcattgactgaagcagcagctcaaataaaaacggattcggtttcttttcctccgttcccttgtcgattaattcagcgatgtaggccgcgtaagctgttaaaaacagatcctcgcggatattcctcatgctttcgatcatctcgccctgctccaatgtgccgaggccggatgatttgcggaataaaaaagatgcataaaggaacggctgggaaatcgctgacaagcggctgttcggctttttggcgccccttgccagcacaccgattttcccgtgttctctcgtcaatagcgtaatgatcttatttgtttcaccatagtcgtttgtacgaaggacgataccttcacatttcgtcagcatatgtgcaccatccaaaaattggaggggtcaagcatgatcacaaaattggaaagtcaatttgcgctagctcttcttcaagtacttcgggtctttccaggttctccttttccaattctttaaaaaggaggtacgtgtcaacgcttcctgtttgtgaaaatacattccaagtaaaattcaacataaaaagccccacctttctgtttataactagctatttaaatatccaagttcttaagattatcttgaccttgtatcctccatttcatgttaaacaattttttctaatatatctttgatttcgagagatattgtcacgattaaaccgcggtcaagttctgtccgttaatactcgtcttctctaaatccaaaatcacgaagctgagacatcttgttgcgccagtctttctgcactttaacccacagctctaaaaacaccgatgacccgagcagcgcctcgatatcggttcttgcccgcttgccgatttctttaagcaggctgcctctttttccgatgacgatccctttttgcgaatctcgctcgacgacgatggtcgcgctcacatacacagaaccgttttcccgttcttgaatggactcgatcgagaccgcaatgctgtgagggatctcttcccttgtcagatgcagcactttttcccgaatcagctcagaaatgataaatcgctccggatgatcggtcacctggtcactcgggtaaaactgcggaccttccggcaaataatcctcaatttgctttaaaagcgtatcgatattatttccctcaagggcggagatcggaacgatttcctgaaacggatacctggttctgtactcatcgatcagcacaagaagctcatccggatgaatccggtcaattttgttgacgatcaaaaataccggcgtcttgactccttttaatcgctcaatgataaattcgtcgccttttccgtagccttcctccgcattgatcatgaacaagatcaagtcgacttcctttaaagtgttgtgcgccaccttcatcataaaatcgcccaatttatgcttcggtttatgaatgccgggcgtatcgataaaaatcgtctgggatgtatcggttgtcagcacaccttgcactttgtttcttgttgtttgcggtttgtcgctcatgatggcgattttttggccgattacgcgattcaaaaaagtagattttcctacgtttggtcgtccgataatcgagacaaatcctgatttaaagctttcctgtgtcatgtaagtcctccgatgaaaatgctcctggcagtaattcttgaaccgtcatttctttgacttggccattcagattggttaagatgacaggcatgtttggcgaacaaagttcggaaatcacctgtctgcaggcgccgcacggggacaccggacccggcgtatccgcagcaacggcaagcatcttaaaggatttttccccttctgaataagccttgaacagcgctgtccgctcggcgcagttgcacaggctgtatgcagcattttcaatgttgcagcctttgtacaccttgccgtcttcggttaaaagtgcagcgccgactttgaatttcgaatacggaacatatgcaaattcccttgcttttaaagcttctgcaatcaattcttgtttagtcaatgtgtgtattccttcctatagcagtgatggtaccgctaacacttttattttacataaaaatggcttctttttcacgcccaaatcgcaaatgtaaaatttttgtaagaatagcgcacgacgaagggcgggcatcaaaacaattttgacaaaaagataagtaacccaatcatacacgaaacggctgcaaacacgcaaaccgccccggctgccgcgtcctttgcagcttttgcaagcgggggggttctcttttgtgaagaggtcgaccgtatgctcaacagccgtattcatcagctccaaggcgagcattccgccgatcaggatcaagatgacggtccattcgatcagcgtcagcctgaagaaaaagccgcaggcgatcacgaggatggcggctccgcagtgaattctaaaattgcgctctgatatgaacgtcttgataattcctgtaaaggcgtttgaaaaactcattttcagacggcgccattcgttttgtttatgaggatcttgagagcccatatcgattcaaaatttccttttgcttagtgaacatctctttttcttcttcctctgtcatatggtcatagccgaggaggtgcaaaaagccgtgaaccgtcagaaaacccagctccctcatcagtgaatgtccgtattcttcggcctgttcccgggctttatcgacgctgatgatgatatctccgagaacgggcggcatatcagcgccgataatttcaacctctccttcgccgtcttcttcgagggcaaatgaaatgacgtcagtcgggtaatctttgcctctgtactctttgttgattttttgtatctcttcattgttgacgatcgtaaccgagacttcggcgccgtctgcgacgccttcctccgccgctgcgaattgaagaagcttttcaatttcagcaagccggtcttcagggacgcgtccggtctcgtctgtgatatctagaattaaactcatgtatgtttcaccttctgtttaggattagcttccggatattctatccgggaatgaaaaatgcctttcagcgtttcgcagagcgtcttcgcgatagtattgagctcttttaaagtcaaatcacattcgtcaaactgcccgtcctgcagcttatccgctatgatcccgcgcaccagcttttcaatcctttcgggattagggttatgcattgagcggacggccgcttcgacgctgtcggccaccgagatgatcgccgcctcttttgtctggggcttcggaccgggatagcggaactcttcttcagtcgtctgatcgcctttttctttcgccttatagtaaaaaaacttgagcagcgatgtgccgtgatgctgttcggctatgtcgacaagctccttcggcattttatgatccctcagcatatcggcgccgtccgtcacatgggcaatgataatgtttttgctcagctgcggagaaagcttgtcatgcgggttatcaatattcatttggttttctataaaatattggggccgctttgtcttgccgatatcatggtaataggcgccgacccttgccagcagcccgtttgctccgaccgcttcgcatgccgcctcagataagttcgcgaccataacgctgtgatggtatgtgcccggtgtttccgtcagaattttgcggagcagcggatgattcggatttgaaagctcgagaagcttcatcgtggacaggatgccaaatccgctttcaaaaaacggcatgagtccgagaacaagaactgacgatccgatgccggacaccgcccccatgacaagatatgtacccatctcaagcccggtttgcgccgtgttttgaatcagctgcagggtaaacagaacaacgatgttgatcagagagacaaataaaccggcctggagaattttcgccctcgcgttatgcttccctaaaaacagtatacccgccatcgagctgattaagaaatacgttccgattccatagttgaacgtgcctgtcacaccctggttaaacatcatgcttccgcaaatggaaagaatcatgctcgacaggatcgccagcctttcattgatcagcagtttaatgagcatcacgcccatcgcaatcggcacgagatagccgatatggccgatttcaagctgctgaaacaggctgatcacttccatgacgattaaaacgatccctgtgatcaacgaaaacagcatgagcgacttgtttttcggaatccggctgctgtattgcttttcgaaatagtaaaccaaagctgagatgaaaagcgcgattaaaagcagcagtccgccgacaggtttgaagatgttggctccgctcaagagccctgtcaattcgagctttcgatagacttccctgtcgatcagctgattttcctcaacgagtatctgcccctgcttgatctgtacctgctgtacgctgtcagccgcttcttgacgcttctgctccgtcttgtcaggatcgtatacgtaattgggaatgatcgcaaagcgtccgatttcatcagcggcgttttttaattttgaaggtatcgaattgcccttcagttctttcgttacatgttctttcgcttcatcgagctttcctgcgcggatttctttgctcatcacgtcattgacggcggtgatgaccgaatcctgcgtcatggaaagctctccgtcgctggccctcagcaggtgtttgactgaatcctgtgacagcgagtccgtcacatcggaagtcagcttttcttcaacagatttgatctggtctttttcagatggggcctgcttgtcttttttctctttttctgcgctttcttttttcacttctttaatgatgtcgaaaatcgatgagacaaggtcgaccctgttgtcagagtactcttttttcaaagtgtactggtcgggaacttcctctctcgcttcctgctttttattagccgttgccttttggtcttcaactgtcgccggcgcatagatcgtattctcgctgatcgaaaataaatcgaggtcgagggactccggcctcacatggaaaaacagcaggatgaacatcagcgcggataaagccgcataaagaatgacgggaaggaagcccccgttattcaagcggataagccgaaactttccgcctctttttttctttttcaacaaaagcacctcttttcccgcgggaaactaaaaaatgacccgataacgggcgatcgggccattcggagttattttgacttttcgtatgcttcaataatacgggcgacaagcgggtgtctgaccacgtccgtctgatccagttcaacaattgaaatgccctcgatatcaaggagcatcttttttgcaacggcaagccctgatgtgacgccctttggcaaatcgatttgcgtaatgtcgcctgtaatgaccattttagatccaaaacccaatctcgtcaaaaacattttcatttgtgccggtgtcgtattctgcgcttcatccaaaatcacaaatgcgtcgtcaagcgtccgccccctcatgtaagcaagcggcgcgatttcaatcgttcctctttcaagcagccgtgccgtatggtccgttccgagcacatcatggagcgcatcgtacagcggccttaaataagggtcgactttctcctttaaatcccccggtaaaaatccgaggctttcccctgcttcaacagctggtcttgtcaaaatgatctttttgatgcgtccgtttttcagttcatgaacggcctttacgacagccaaataggttttccccgttcctgctgggccgatgccgaagattaagtcgtgccttttcatggcggcgatgtattctctttgaccgatggttttgactctgatcggttttcctttggcgtttttcgtaatttcctcttcatacatgctttcaaaaaactcaagcttctgctttttcgccatcttgatcgcatacaagacatcgcgttcggatatctcgattcctttgcggatcagatttaggagagaggcaagcaggctgtccgcgatttcaaacgtttcttcatctcctgtcacatacacggtttctccgcgcgtgacaattgaaatgttcagctcttcctccatcaacttcaaatgggaatcctggttcccaaacagcgcttgagcctcattcggactttccagttgctgatgaatcgcaagtaagtgttctgtcattctttagtctcctgaacaattggtgttgtttgaacaatgttttcaataacctggtaaaggatgatcaatttaactttaccattctcgctcgtttcgtgcaaaactttttcactgataatgttcccgtctctgccgatttttttcctgatgtctctttttcccatttcgattccttcaagaactgcttcttttttcgagtacacccttttgatttgttcgctctccctcatatgctccttttcataagcgacaggaagcttaaaattcataaaatgcagcgagtgtttttcggtctccgtcttcgggcgcgagaagtcttcttttttaaatgaaaagccccagatcggcacggaaaatgatccgagggatagcttgtgacttgtccttactttacccgtaaaaacgtcaaatgatgtctcaagaggaaccgttactgttgacttgtaccaggtttcaccatagattttcccttttgctccgactttttgcttttcctcttcgcttccgatcagcccggaaacgagcatttgccctttttcaacgtgctggttcaccgtgacgagcggctcgcctttttccacgaacattttcgagatggtcgccccttttttggcgacgatgtgcctcggaccgatatatttttctttgtcaggttcattcttttcaacgactttcatgtgaagggcggtaccgtttaactcaatgcccacccaagtgatgttttcgacccgctttgtgagcgcctgctgaattttttccggggtcagcattgaaaactgaaagcggccttttttgacgccgatttgatccaattgctgtctgatttgatgttctgtctctggattggctcctgtaatatcaattttccaaagcatgttggacaataggaacatgatgataaaaaatgcagcaactccaaaagtgaagccgctattccgtttagacttctgcacgaggaaaggaaacccttttcgtttgatgaacctgcacttgcagtcgaagcctctgatgaccttccggaaggcatgtacatcagaaagcggaatataaagaaagacggcgtctttctttttctttacattaaacatcgggatgttgcgcctggtgcattcatttaataaccgttcgatcccttttcccgttatcttaagctggatctttcctgaaaaaaaagaaagccatttattcttcacgcttctttccccccgacttatgaatcgatatagcggacaagctcaatcgtgccttcaagcagaatttcctcaggcaaaatcgttttgatgacaaagtctttgccttgaatgatgcactgcccctgtttgagcatcagccttacttccgtatcgctgaaaagcaaaagccctctgtggttttcaatatatatgtgaagtcttcctatcatcgtaattctcggaagatccatcatgacatcagggggaatttccagtgttcttgtcagccacgctttgatgcggttttttctttgcgccataaaaaaagaaccccctttcatctcatatgtatgagtgagaagggggttctaatacttaaattttaggccggcgcctcattgtgtaatgcggctttctcgaccgcggagggccgaatacttcactgaggacaatgccttgaactattgtttttttattcatgtcgagcagctcttgcttccggttgatcacccggctgctctgctttttaatggtccgttcaacggccggcatggaacgctcggcatcttctttgattctgcggagctctgcttccatatctgcgctgtttgcagctgccgctgccggccgctggtttttattttttgcaggacggtgctgcgccgtctgtttcggcttcggcgtctgcgtcctctgctgttcaggcgccggttttcgcttcgcttcttcattttcatcgttttttccgagcttgttgaatatgaaggaaatggctgcgatgatggccgccatgataatcggattgtcgaacaggatatcaagcaatgagctccctcctttttacaggggcttgtttatttatgatcctcttcattttggtctttcgtcatctttccgaaagaatcgcgcatgtcagtgtcggcgtcgatgtttttcatattgaggtagtccatgacgccgatttttccgctgcggagagcttcagacattgcaagcggcacttcggcttcggcttcgacgactttggcgcgcatttcttcgacgcgggcgcgcatttcctgttcttgcgcaaccgccatggcgcggcgctcttccgctttcgcctgggcgatgtttttatcggcttcagcctggtcggtttgcagaatcgctccgatgtttttgccgatgtcaacgtcagcgatatcgatcgatagaatttcaaacgctgtacctgaatccaaccctttgctcaatacggtttgtgaaatcatatctgggttttcaagcacttttttatgattatcggaagaaccgattgtcgaaacgatcccttcgccgacacgggcaatgatcgtttcttcgcccgctcccccgacaaggcggtcgatgttagcgcgaaccgtgattctcgcttttgctttcacttcgataccatccattgctacaccggcaataaacggcgtttcgatgactttcggattaacgctcatttgaacggcttcaagcacgtcacggcccgctaaatcgatggccgcacatctggcgaatgtaagttcaatgtttgcacgttgggcagcgataagcgcgttgacgacccggtcaacattaccccctgcaagatagtggctttccagctgattgatggcaacatcaagtcccgctttgtgcgctttgatgagcgggttcaccacgcggtttggaatgacgcggcggagcctcattccgatcagtgtgaaaatgctgattttaacaccagcggccaaagccgagatccacagcatgaccgggacgaatgtaaagaagacagctagtaggatgattccggctgcgataataagtaaaagaaacagtgttgacggatccattatattcctcctaaaaatgtaatttataattctctcacaacaatgcgtgagccttccactttaaccactttcactttcttatcctttgcggtgaacgagccttcagatacaacatcaagccgttcatcgtcgatgatgaccgttccggacggtctgagcggtgtatacgtgacgccgattttgccaattaaatcgcgccggctttcatttgacacgtatccgctttctgtgcttgtcgagtcggttaagatcaattttttaaaaaatttcatacgcttacccaacacccttgtcaatagaatggatgccgctatcgaaacagcagttgcaatcaaaatggagacggccatgaccttaaagcttcccgaagctaaaaagaggctcgcaacaattgcgatcaggccggcaatccctgctattccgcccggcagaaaaatctctaaaatgattaaaataatgcctgctgcaaacagaaggatcgtttccattccggcaagcccggcgacgagatgaccgtagaaaaagagcagcaatgcggtgagtcccataaagccggggatcccaaaaccaggagaataaagctccacaatcagcccgaggcttccgattgaaagaagaatcggaatcacgaccggatgcgtgataaacctggccaccttttcggcaaagcttacctcggcacgctcgattttggcatccttcaaattcagctttttcaaaagatcatcaaggctcgaaactgtgccttcggaatagccgactttcagcgctttgtcagggcttaatgtgagcagctcgccctttggcgcccctacttctttagcatcgacgtctgcatcggccatcgcgagagcgtatttcggatcacgtccgttttttttggctgcgtcttccatttcagccagccacagcgattccgactttttgtcagcggcatttccctgcgtgtcaatgatcgcggcagctcccatttttccgccgggcgccatataaatatcgtctgcattcaaggcgaggtaagcgcctgcggacagagcccttctattcacataagcggtcaccggaatgtcggagttatgtatcgtatcagccatgtcaaggactgcgtcgaccgctccgccgggggtattgatatcgagtatgatatgtttggcatacatatcttccgcttcttgaaatgagcgctcaagaattttgaaagcctttttcaacggtttcttcgatcggaatgacatacactgtatctccatccgctttcacggtcaaatgaacgcctagtaataagaataaaacaaaaccgcaggccagagcaacaaaaattctaaattttttcagcagcaatgatggatgaggcctccttcccctattatcattaacattacatacgttatacatgtagcaaaggtttcatctttctactacttttctattgtatgaacacgcacaaaaaaagacgcctttaattgcttaaaaggcgtctttttctcaagacagttgtttgctgacaagcttattgacgagaccgccgtccgccttgcctttgactttcggcatgacagcgctcatcactttgcccatatccgcttttgaagaagccccgacttcggcgatcgtctcgttgacgatgtcgagcagctcttcttccgtcagctgttcaggcatataagcttccagaatgtctaactctttttgaactttatctactaaatctgaacgattagcgtttgaaaattcatggagggagtctttacgctgttttaattcacgagaaagaacagtcagttcttcatcatcggtcagcctgtctttcttaagcttgattgcttcgttttgaagcgaagctttgaccatgcgaatgacagtcagtttgtctttctcacggtttttcatatagagcttcatatcttgattcagccgctcaagaagactcataaatccaccctcttttagtatttgcgctttcttgcagcttcagactttttcttgcgtcttacgctaggtttttcataaaattcacgctttcttgcttcctgcaaagtacctgtctttgatacactgcgtttgaagcgacgaagagcatcttcaagcgattcgttttttctaacgaccgtttttgacattctctttccctccctccgaatacaccaatcgactgctttaaaaaaagacatacatataaacatgtactttgacattataatataagcctccggtaaggtcaaccaaggagaatcgttttattgttcagtcatgatttcggcagcttgtctgtatatatttataaaggaggctgttcgaaaaactgatgatgatcttgatcttgttcgtattattgatcgttctttttctcaaaggcatgagcatgctgagaaaaggcctgatttcactaacatttgaaaaaatcgaaaagcggctgctgtttttcacggatcatccggtgaaagcttttttggtcagtattatatttacggggattttgcaaagcagctcggcatttatggtgatcgtcatagggtttgtctcagtaggcgctctttcatttaaacgttcgattccgctcattttagggacaaacatcgggtccactttcacaacggaatttttggcggtgaagctggaatttttgatttttgcccttttggccgcaggtgcagctcttttcattgccggaaaatccccttttcggcaagtcggcgtaagcatgatcggcttgggggttatttttttctgtatcagcggtttcagccggcttgccgtgccgttgtcacagctagactcgggcgcttatatcgtgcagcttgccgaagattcatcgctttacgctttgttcatcggcaccgttttgaccgcgatgattcattccagttcggcgtgtgtcggcatcctgatgagctttatggatcaaggtgtcgtcggattgaccgaagcgatgagcgttgttcttggctccaacatcgggacatgcattacggccgtgatggcatccttcaaaggcggagctgcagccaggcaaacagcttatgcccatgttctgtttaatgtcattggtgtagcagctgtataccctctgctctcatcaatcacaggctttatctccggactgtccgaaagccccgcccagcagattgcccatttcagcctgctgttcaacgtcgtcacgtccctattgtttttgccgctctcaaatctgtttcattcgctgatcatgtttctcattccaaacaaaaaccaggcccgataaacgcctggtttttgtttgattagtagtcttcatccgctgttaaccctttgacaatcgacacgccggcgctcgctccgattctcgtcgctccggcttcaatcatggcaagtgcgctttccttatcgcggacgccacctgaagctttaacgccgatatcaggtccgacagcttcccgcatcagttttatatcccggactgtcgcaccgccgccggaaaaaccggtcgatgttttgacaaagtcggcgcctgcttttacggccagttcacaagccagccttttttcttcatccgtcaaaagcgacgtctctatgatgacttttacaagagctttgccgtcggccgcgtctgtcaccgccctgatgtcatgttccactgttcccgtatcgcggtcttttagtgcaccgatgttgatcaccatatcaacttcaccggcaccgtctgcaattgcctgcctggtttcaaaggcttttgtttccggagacgctgcacctaaaggaaagccgataactgtacatactttcacctctgactctttaagaagctcggcgcaaagcttcacccagcaagggttgacacaaacggaggcaaaaccgtaaacacgcgcttctttgcaaagcgcttcgatttcggatttgacggtatctggcttcaatgcagtgtgatcgatcattcgcgcaatttgttttgtcatcatcctgactcctttttaggtggttgtttgcttaagatattcgcaaaaaaagccggaacaccttttttgtgaaccggctgaattgatgatttatgacgataagcggatgttttcgcggacgtcgtcttccgcgacgcggacgaactgtcctttgttgtacggatagccggcttttaagatcttcactttaacaagctggccgatcaggtcttctgaaccttcgaaaacgactttaatatagttgtccgtgtagccgacaagcaggttgccttcgcccgtttccgtgaacggctcttccggaatgatctccagaacgtcgccttcatagtctgatgcatattctttcgcaagctggtctgaaagagcgatcagtttatgaaccctttcgtttttcacgttttcgtcaacctggccgtccatgcgtgctgcaggggttccggtccgtttgctgtacgggaagacgtggagctcggaaaacttgtgttctttgataaagttatacgtctccatgaattcttcttccgtttcacccgggaagccgacaatcacatcagaggtgactgcaagccccggaagagcttttttgagttttgtcagccggtcggcgaaaaactccatcgtatactttcttctcatccgctttaaaacgctgtttgagccggattgaagcgggatgtgaaggtgtctgacgatcttgtctgagcggtcaagcacttcgatgacttcgtctgtaatttggctcgcttcgattgaagagatacggattcttttcagacctttcacacggctgtccaattctttcaacagctgcgcaaagttgtagtctttcatatcttctccataaccgccggtatggataccggtcaaaacgatttctttatagccggcatcaacgagctgctgcgcctggcggatgacttcctcagggtcgcgggaacgaagcaggccgcgcgcccacggaatgatgcagaatgtgcagaaattgttgcagccttcttgaattttcaaagaagcacgcgttctgtcggtaaatgcaggaacatcaagctcctcaaacactctcgctttcataatattgctgacgccgttaatcggctgtctttcttcctggtactgcttaatatagccgagcattttttcgcggtcttgtgtaccgacgacgatatcaacgcccgggatcgccatgatttccgccggggaagtctgggcgtagcaccctgtcacgcaaatgacggcgtcaggattttggcggatcgcccgtctgatcacctggcggctctttttatcacccgtatttgtgacggtgcatgtattaatgacgtatacgtccgccgaactttcaaattcttttctttcgtagccggcttctttaaaaagctgccagattgcttctgtttcataatggttgaccttgcagccaagtgtatgaaatgcaacggttgccattgttattcacctcttaataactctgtatgataagaaactgccgccaacgcgtacagcggagctgtttccgcccttaagatccgcggaccgagcccgcaggcgagggcacctttttcttttagcgcctcaatttcctcttctgtaaatccgccttcaggaccaaacaccatgagtacggatgatccttcagaaaggcttttgagcacggattgaaaccggctcgtctcgccttgctttgatgactcttcgtatgcaacgacacatttatcgaagtcctcaaggctctcaagcaaacgttgaaacgtgtgaaccggcgccacatcgggaatcgcgtttctgtgggactgttctgccgcttccttggcgattttcgcccacctttcccgttttttctttgcctttttttcatcaagtttaacaacggagcgcgatgcctgaaaaggaataaacgagcttgcaccgagctctgtccctttttgaatgatccattccagcttatctccttttggaaggccgtttgcaatatggatctggacgggcagttcgcgtgtttcccccgtccattcgataacgctcaataaaacctcttctttagtgacggactcgatccggcatttcgcttcatggccgtcttttgcacagcaaatgacctcatctccgggagacatcctcatcacagtcgcaatgtgatgaacgtcttcgcctttgatcgagaatgcgggtgcggctgtgacctcttgttttgattgttcgataaaatatcgttgcatacgcttgtcacacctactaacgattattttttagcgatgatgctgacccagtcctccattgaaagaacctcaacgatcgtaaagccttctttcaccagtgcatctttgacttcctgttttttctgctggatgatccccgaagtgatgaaatagccgccgtctttcaacaggctgtatgcttgatccgtaaagcgcaagatgacctcggccaggatattggcgacgatgatgtctttttcgccttcgacgccgtcaagcagattattttgcttaatctcgatatgatcgctgactttattgagcttggagttcaagcgggcgctttcaacggctacaggatcgagatcatatccttcaacctgtttggcgcgaagcatggctgaagcaatgctcaaaatgccggttcccgttccgacgtccacgaccgaatccccttctttcacatacctttcaagcgcctgtatgcaaaggacggttgtcgggtgggtgcctgttccaaacgccattcccgggtccatctcgatgatgagttcatccgtatgaaccggtgtgtactcttcccaagtcggaacaatcgtaaacttctcggaaattttcacgggatgataatattttttccatgctgtcgcccattcttcttcgttaacctcgctgatggtgattttgttgcgtccaaggtcaatatcatacagcagcagattattgatcgtttctttgattccttctacggtctcccccaaaaagctgttgatcggaagatacgctttgatgatgactccttcatcaggataatcattgggatcgagctggtagatttctccgtatacattctcacgctctttaattaaatcaagcggatcttcaatcactactccactcgcaccagcttcatgcaaaatattcgagatgggctcaaccgcttcatgtgtcgtgtgaatgcagatttcggaccatttcatactaccaactcctcatccaatcattaatcgcctttaaaggcgcgctttactttatcgaaaaaactcatttcctgttcatccggcatatttccgctcacttctgcaaattcgcggagaatatttttctggttttctgttaaattcgtcggtgtcacgacgcggacaacgatgtgctgatcgccttgtccgtacccgcgcacgttggcaacgccttttccttttaagcggaacttggtgcccgtctgggtgcccgccggcacttttaattttacttttccgtgaagagtaggcacttcgatttcatctccaagggcagcctgtgcaaatgtcagcggcatttcgcagtaaatatcgtctccatcgcgctcgaaaaattcgtgctcttggacgcggaaaacgacgaataagtcacctgacggaccgccgttgatccccggttcgccctgtccggctactcgaagctgctggccgtcgtccacacccgccgggatggtgacattgattttcttgcgttttttcacttttcctgtgccgccgcaagttgaacatttgtgcttgatttgcttacccgttccattacagtaatgacatactcttctgttgacaacttttccgaacggtgttgactgctccatgttcagctggcctgatccgccgcagtgtgaacatgtttccggctttgttcccggttttgcgccggagccgctgcatgtttcgcacgtttcttcacgcggaatttcgatcgtcgtctcttttccgaaggctgcctcttcaaatgacagtgtcatcgtatactgcagatcggcaccctgcctcggggcattcgggtctctccgccttgcgccgcctccgaaaatgcttgagaaaatatcgtcaaacccaaagccgccgaagtcgcctccgccgaaacctccgcctccgaatccttgatttgggtcggtgtggccgaactggtcgtaatgggcccgtttttggtcatcagaaagtgtttcataggcttctttgacttctttgaatttttcagccgctccggcttctttgttgatgtccgggtgatattttttagaaagcttgcggtaagcttttttaatctcatctttagaagcgctcttacctaccccaagcacctcatagtaatcacgcttactcatctcttcacactcccgattttctcacataaattagattgtatcatttcaaattatgttttttcaattccttttgtcctttaggaagaaaaaagtcaaagtcaagagatcctgactttgactttcatcgcctgtaaggtcatgtgctgtgcaaaccggggtaagcacagcacattttatttcgattatttttgatcttttgtcgtcgtttacttcttcatattcagcgtccacgacattatcatcggcttttttagcgccagctccgccgtcttgctgagcctgagcctgttttgcggcttcttcgtaaagcttcattgaaagctcttgaacgatcgcttgcagctcatcttttttcgccttgatttcatcaaggtcatttttctcgatcgcagcttttagcgcgtcttttgcttcattcgcttttttcacctgtgcttcatcggctttgccttcaagatctttcagcgttttttcagttgtgaagacaagctggtccgcttcgttgcgaagctcgatttcttcttttttcttcgcatctgcttcggcgttttcttcagcctctttcaccatacgctcgatctcgtcgtcagaaaggcctgaagaagatttgatcgtgatgttttgctctttgccagtgcccagatctttcgcgctgacgttgacgataccgtttttatcaatgtcaaatgacacttcgatttgcggtacgccgcgaggagccggcgggatatctgtaagctggaagcgtccgagcgttttgttgtcggcagccattgggcgctcaccttggagcacgtggatgtcaaccgctgtttggttgtcggccgctgttgagaacacttgggacttgcttgtcgggattgtcgtgttgcgctcaatcagcttcgtgaacacgccgcccatcgtttcgataccaagtgacagcggagttacgtccagaaggacaacatctttgacatcgcctgtgatgacgccgccttgaattgctgcaccaagggctacgacttcgtcagggttgacgcctttatgcgcttcttttccagtttcttttttgatcgcttcctgaacggcaggaatacgtgttgatccgccgacaaggatgactttgtcgatttcgcttgcagaaagtcccgcatcttgaagagcctggcgtacaggacccattgtgcgctctaccaagtgtgaagacagctcttcaaacttcgcgcgggtcagtgtcaattcaaggtgcagcggacctgcttcacccgctgtgataaacggcagggaaatttgcgtagaagatacgccggaaaggtcttttttcgctttctcagcagcatcttttaagcgctgaagcgccattttgtctttagaaaggtcgatgccgttttcttttttgaattctgagacgagatgatcgatgatcacttggtcaaagtcgtctcctccaaggcggttgtcacccgctgtagagcgaacttcgaatacgccgtctcccaattcaaggatggaaacgtcgaatgtaccgccgccaaggtcgtagacgaggatcgtctgatcttcttccgttttatccagaccgtaggcaagcgcagctgcagtcggctcgttgatgatccgctcaacttcaagtccggcgattttaccggcatctttagtcgcttgacgctctgcatcgttgaagtatgcaggaactgtgatcacggctttagacacggtttcgcccaaatagctttcagcatatgatttcaaatgctgaaggatgatggcagacacttcttgcggcgtgtactttttgccttcaatttcaactgtatagtcagtgcccatgtggcgcttgatcgacatgatcgtgttcgggttcgtgatggactggcgtttcgccacttcacccacctggcgttctccgtttttaaatgcgacaactgaaggagtcgtgcgggctccttctggatttgggatgactttcggctctccgccttcaagcactgcaacgcatgagttcgttgttcccaagtcgattccgattactttgctcatgatttttacctcctgctatgtatttattgattgacttttaccatagaaggacggatcacccggtccttaagtttatagcctttttgcagttcctcaacgactgcgtttgattcgtacgcttcatcctcaacctgcataacagcttggtgcatgttcgggtcaaattgctctccgactgatggaatctgttcaactccttcatttttaagagcctccaaaatttgacggtgcaccatttccattccttgaagcaggcttttcgtctgctcattgtcaggatcgatctgaagtgcgcgctcaaagttgtcaagcgccggcagcaaatcgctgatgatgcgctgggagcggtacttttcagcagcctcgagatcaaggcgtgcgcgtcttttgtagttttcaaagtccgcctgaacacgtaaaagttaattttctttttcttcaagacgttcttgaagttcttttagttgtttttcaagcatttcgtttgagtttcttctgccggggcatcagcttcagcagccgtttgttcagattcgactgtctccgcttctgtctcggtcagttcctcttgttcgtttagctcttcgttttgtttgtcatctgccatctgtgttcacctcccttaaaggatgagtttcatgataaagaagggattcctcccttctgtttgttttcaggtactgccttacccatcatacaaacttgtcagcgcttttgacaagtcagatgatacgtgctgaagcaagccgacgacgcgggagtagtccatgcgcgtcggtccgatgaccgcaatggagccgatctgttttgagccgaccgtgtatgttgcggtaatcaggctgcagttttccatctcttcatagtcgttttctttgccgattttgatggtaattccggactcagtcgactgaaagagccggagaatctcctgttctttctcaatgagcgacaatagcgatttcactctgtcaatatcgtgaaattcgggctggttcagcatgttaatcttgccgccgaaaaacagccggtcggtttgaacagatgaatccagcgttgcgccgagcgcgtgcaaaatcgtatcgtaattttgaatgtgcgacttcaagaagatgacaacctctttgaaaatcctgtctttcagttctgagatcggcacgcctctaaggcgttcatttaatatattcaccagcttctcgagatcggaaagatcgacctccgccgggaaattaatcgttttattctccacatggccggtattcgttactagaatggcaacggccttcttgggctgaatcggtacaatctggatctgtttgagatggttttcactcagtctcggaccgaggacaatcgatgtataatttgtcaggtcggacagcacttgggccgacttctgcacggctttttcgagttcaaagattttttctttgaaaatcgaatgaataatgtttaagtccgtttttgacagctttccaggtgaaagcagatgatcgacataatagcgatagcccttttcagaaggaatccggcctgaagatgagtgggttttttcgataaaaccgagctcttccaagtcagccatttcgtttctgatcgttgccgagctgaatgtgatatcttcctttttggaaagcgttcttgatcctaccggctgagctgaacgaatgaaatcgttgacgataacctgcaagattaacagctgacgatttgttaacatccatatcacccctgttagcactcggcacaactgagtgctaattgtatatcaaaattaccaaaccgaaatcaaaatgtcaattataactcacccaggaatgcctgaaatacttcatttcccaacagttttccattatgtgttagaaacacgtttttgttcgtgttcacaatcaaccctgtttcttccagcgaatggagcaccttcggaaagagatcgtcaacagatcttccatatgtttcgaaaaagcgctctttgtttactccctcagtttttcgaagaccgagaaacatttcttcttcaatctgttcattttttgtgaccatgtgcttttccttataaggaaagccggattgttcaatcaggtcgatataatgtttgacagggcccgcatttaccgttctttcaccattgatataaccgtgtgcgcccgcgccaaaaccgaaataatcctcattgttccaatatgtgaggttatgtttgctctcatatccttttttggcgtagttgctgatttcgtattggccgatgcccgcttcttccattttccgcataacgagttcgtacatttcagcttcctgatcctgcggcggcaggtgaagccggccttttttcatcaagttgtagaaaacggttttcggttcgacgatcagcgaataaaccgaatagtgttcagcaccgagggcaagcgccgtatcgagcgatgaagcgaggtggccgatggtttgtccgggcagaccgaacatcagatcaaggctgatattatcaaaccccgcctttctcgctctttcaaacgaaacgagtacgtctttttgctcgtgaaccctgccgatttttttcagcagctcgtcttcaaacgtctgcacgccaaagctcagcctgtctacaccggcagcttttaaaacatccagcttttcagctgataaatcgtcgggattggcttccactgcaaattcagcaaggctttcggacggtttcaaaacgcgatgaatggaatcgaggagccgttcgagctgagctgccgacagcgatgtcggcgttcctcccccgataaagatcgttttcagctccggatgtccggttgcctccattgaattggccatttccttctctaaggaacgcaaatattcatcaacgggctgagattgaataaaaaacttgttgaagtcgcaataatggcaaatgtgctcgcaaaacggaatatgtatatatgctgctttcattgttttcaccttcttttacaggaagaagccgcagtgtgttacgctgcggcggctcatgattatgatttcgggccgctgtcgtccattttcaggactgccataaaggcttcctgcggaacttcgacagagccgacctgtttcattcttcgctttccttccttttgcttttcaagcagtttgcgctttctggaaatatccccgccgtagcacttcgccaaaacgtttttgcgcattgctttgatggttgaacgggcgacaatttttgtaccgatggctgcctggacaggcacttcaaactgctggcgcggaatgagctctttcagcttttcgacgataacttttcctcgttcataagcataatcgcggtgaacgataaaggaaagggcatcgattttttcgccgttcagcataatatccattttcacgagcttggacggtttatatccgatgagttcgtaatcaaatgacgcatagcctttcgtatttgatttaagctgatcgaaaaactcgtagacgatttccgcaagcggaatttcgtagacaatgctgacgcggttcgcatcaaggtactgcatatcaataaactggccgcgcttgccctggcacagttccatgaccgctccgacaaagtcgttcggcaccatcatcgtcgctttgacgaacggttcttccacccggtcgatcttctgcggatcaggcatgtttgacgggttatcgacgacgattttttcaccgtctgtcatgtacacgtcgtagattacgctcggagccgtcgtaatcaaatcgatgttgaattcgcgttcaatccgctcctggatgatttccatgtggagcatccctaagaaaccgcagcggaagccgaatccgagagcttgggacgtttccgcttcgtactgcagggctgaatcgttcagctcaagtttttcaagcgcttcccgcaagtcgttgtatttcgctgtatcaatcggatacaggccgcaataaaccatcggattcagctttctgtagcctggcagggcttcgggtgcagggttttccgcgctcgtaatcgtatcccctacacgagtgtctccgacgtttttgattgcggccgtcaggaatccgacgtcgccgacagtcagttcgtcagccggaacggccttcggtgtgaaaacgccgacttcagtgacttcaaattcctttccggtcgccatcatcttgattttttgaccggcttttacggtaccttgcacgactctgatataggcgacgaccccgcggtaagcatcatacagggagtcaaagatcagcgcctgaagcggcgcttccggatctccgcttggtgcgggaaccttttcaacgatctgctccaatatttcctcaattccgatgcctgcttttgctgaagcaaggacggcttctgaagcgtcaagaccgataacatcctcgacttcctggcggacgcgttcgggttctgcgctcggaaggtcgattttattaatgaccggcaggatttcaaggtcgttgtcaagcgcaaggtaaacgtttgccagcgtttgcgcctcgattccctgggcggcgtctacgacgagaatcgcgccttcgcatgcggcaaggcttctcgaaacctcatacgtaaaatcgacgtgtcccggggtatcgatcagatgaaaaatatattcctctccgtccttcgcctgatatttcagctgtacggagttcagtttaatggtgattcctctttcacgttccaaatccattgagtcgaggagctgttctttcatttccctttgagtgattgccgccgttttttccaagattcgatccgcaagcgttgacttgccgtggtcgatatgggcgataatagagaaatttcggattctcgactgccttgtaatcgtttttctttatctgtcacactaatcactcctactatgaaacgcaatatgcgctagcttagattatatcaatagggttgtgaagattcaatgctaagtcacatatgctttctaaacccgaaaaagaaaaaacgagtcctgcatccggctcgttttttcttttacctattccgttttttcctttatccagtcatacaatgaacgggctgtgtttgtgaccgaatcggccagggctcggccggccgaggaaaagaggttgaaagcttccagctgttccagctctttttgtttttcctccaaatcgatttgatggccgaggactgacgcctctttcgcatccccttcagatatgctgagcgctgcttttaaatcagggtcctcgtaccctttcatttcaatcattccgttgttcgcctgctgcatgccgagaagaacgccgaaaaacatgacagcgcaagccaatatgcattttcccataaaagaagccacttcgatcacctgcctctattgttttttcttatcgtcttcaccggagtctgcatcaactttttcagcattccagtacatctcgctgaatacatccgccatcgcttctgcagcccgctccagctcttcgcggttattatctacgccgccaaattcgattaagacggatctttcgtttaaatcctgattatatatgccattatccccggcagctcccttagatataactccgcggctcaaaccgggatattttttttccatccgttcatgcagctcttttgccagctttaagttcgattcgaaattagagctcttcttgccgagcacaaacgcaacgcgtgcatagctttttcctttgacagtcgcggttgtcgctttcttccgttgcgaatccctgtgaatatcgataaaatactgcaagtctttgttctgggccatcgcctctttgacgaccggccttgattcatcataggaacgggcataggcccagccttttttccgcaaattcgcctgaaaatcggttttatccaccatcgccccgacgccctgcgatttcatcaaatttgcgagcatatcgctgacaagcgtaacatttgctttcgaatgaatcgcccgatcaggatctgcctcaccttttaaaaagggaagatacgattccgtattgtgcgtattgtagataaatacgactttgcggccgcccgtcgattgttcaggaggtttttccccgtctgttttctttttctgtttcccttcaagctctgcaagattcgcttctctctcctcttttaagacctcagtcggcggcggagattctgacggcatattcgtataatccgtcccttgcccggcaatgaggatttccgagtcaaaatgagagaatcccggaagctcccgtccgagaaaacttcgcggatctttcaaattaatgctggtcgccagcttcaggacgaggggggaaagctcaaagcgcttattcggttccggcaattctgatgcaaagtagtggttttccattcccaaaatgagcccaaaggtctcgcccttcagttcatcagccacccggtacaacgatgaagacggccttaactcaggacgcagcgatgtgagcacgcctgataaaataaaaacgagcagcaggctgacgataaataagaatactgtcttaaccgcgcttcttccatttacagccagcacaaactgacgattcctgcctctttttctcattgtaaatccctccagagcttgtctagtaaatagactatgtacaagatagaggaagtagaacaagttccggcaatgctaaatgtcatgaaaaaaagcggccgggccagccgccttgatcttagtggttatacattcctttattgtcttgcgatacattttcatggagcgctgtgttcagaccgtttgcaatcacatttgccatatcatcgataaatgtatcgacctctttaggggtcaccattaagttatggccgagcggagcgaggacttcatggatcagctgccttttttcatcctctgcgaggcctccgactataccgagaaacgatttgcggtgctcttcatcgggaaggtcttcttcggtgaggacctttcttttcccaaagctcatccccgcgggaacgagcgacctggacggactgtcgtctctcatctctcttccaaaatgcttcagcatgtaatcaatcgtgtcgctcgtgatcgtgacggcatcgaccactgtcggaacaccgatggcgatgaccggaatgccgagcgtatccttgcttaactcttttcttttattccccacaccagacccggggtgtatcccgctgtctgaaatttgaatggtagaattcacacgctcgatccctcttgatgccagcgcatcaatggcaatgacaaaatcgggctttgagcgatcgatcaccccttggataatgtcgctcgtttcaattccggtcaagcccatgactcccggggaaagcgcactcaccggacggtagccttcctctacattttcgggctgcagctgaaacaggtgcctcgtcacgagaaggttctccgtcactagggggccgagcgagtcgggcgtgacattccagttgccgagcccgactattaagcagctggcatcccgcggaatgcccaaataatcgagaaacgaggaaaattcctttgcgaagacatcgacgactttttcctgcaatacggaatcctgctgtctgatcccttgtgtttcaaaggttaaatagcggccggcttttttccccgacagcttcgctccttcttcatcaatatccatcgtctgaattttgatcccgtctttttcgtattctttgactgtaaaccctttcagctctttctttggagaagcttccttttcctctgccagatccctcgcttccacggctaagtctgtccggactgcatattgacttaaatcgagcttctttttctccatatttgcattccctccaaaaacataactggtgttagtgtgcccacaaggtctgcaaacattcccgcgaagcggagctttcaaataaaaatactttacatttatattgcaatctaagggtgtgtttgatagaatacaatttgttctattgttgagatctaacctatagaaaaggaacagaggttatgtcttaggaggtgaaacacattgccaaacattaaatcagcgatcaaacgcacaaaaacaaacaacgagcgccgcgcgcacaacgcaacaatcaaatctgcaatgcgcactgctatgaaacaagttgaaactttcgtaagcaacaacgaagcagacaaagcgaaagcagctctatctgcagcagcaaagaaaatcgataaagcagctaaaaaaggtcttgtccacaaaaacaccgccgctcgttacaaatcaaacctagcgaaaaaagtgaacggactttctgcataatagaaagcttggctatgccaagcttttttgcttgcgtgaaggatgaaaaaaacggctctctttaaaggaggccgtttttttcatgaggctgcagcagcttcagcaaaaacagttcaagcaggagctgcttgtcttttttgcctgtcttcatttcataatccatcacggcgagctgctcgataatgttcctaagctcctgctctgaaaaaagcctcgcctgctcgatcgccagcttcaccctgaacgggtgcactttaaggtttgaggcgatttgcttttgtccgtatccctggtcagaaaaatatttggtctgcatcagcagcctgaactgattagcaatcagcgccatcattttaatcggctcttcattttgctttaatagatcgtagaaaatctgcagcgcttctgtacgtttccgattgacgaccttattgatcagttcgaaaatattttgttcaagccctctcgctacaagctttctgacatcctctatggtgatctctccgcggtcaccggtatatgtactgagctttttaacctcctgggcaatggctgacagacttgcatgacataacaggacaagctcctccgccgcttccggttcgatttgtttgccttccgacttcgcgaggcctgcgataaagtcagccgtttctttggcggttaattccttcgcttccaccatgtgcgcatgctttttcaggagcttggtcagctttttccgttcatcgagcttttcataaggcgcaagcaaaacaaacacggaataaggtgccggctgcgtaatgtaagcttccagtacaccgagattatgctcaagcttatccttctttttttcagctgttaaaaacgccgggtttttcgccacgacaagacgcctttcccccataaacggaaaggtttccgcatcctccacggcaagatcgagcgcgtcttcttccagatcaaatatcgagaagttaaagtctttcgtctcttcatcaacaacggcttgtctgatcctttgaaccgtctcctgcagaagatgcgtctctttcccgtacaagcaataaacgggatgaatgtcgccttttttcaagcttttccaaacatcaaataccgtcatctgcactttcccctctttcatccttcctttctatcctaaagcgtgttttgcaattagtaaagagagaagcggagtcacccgctctctcatttataataaacgccttccataaacccccgggtcagtttatagaagacgatgttcataaattttagaaaacggttgcatgaagctcctagatttttgcaaagaattgaattatactggatatcaataggaggggtaaattgtgaatgaatttgaaaaagacgtgcaaagcaaacgtaacgatcttgtagattcaggtgtcggttttatcgtgtcttttggctttttcgctacaatgtttattatcgctactgttatacatctggccgcttaatcaagccaagtcatggacaccgctttactctccgtcaggcaagcggctttttgacgactgctgtttttcagcagtcattttttcttgcggggaatgtactttatcatatggaggatgtagcaaaaacgttccgttcccgcctcgaaataggtgctgaatcgaaccgtgccgatccgttctgaacaccttcacatcgtggcggtttaggatgtccagcacttccccgtggggatgcccgtagcggttgtgctcccccgccgaaatgagggcggttttcggctcaatttgcttgatcagctcttcacccgtcgaacctttgcttccatggtgaccgactttcagaatatccgctttaagattcggatacacttccatcatctccttttcgccctccttctccaaatctccagttaacagccacgaaaatccgcctgctttcatccacaatacgagggaaccattgtttttgctgtttttgtccgcctctttcggtgaaagaacataaaattcaagattgccaatatgaaggatgtcacctcttttggctacattcacctcgacgccttccttcaaggcaaggcgaagcagcttttcatcagacggttcggctgcgaagcctttcggcacgatcaattgcttcactttatgtttttggatcagcacatgcgcttcaccgatatgatcctgatcagcatgggtcaaaattaaagcatcgagcttcttgacccctttggttgccagaaaaggcattaacacgctctcccccaatgaaaaatccttcttccgctttctccaccgctctttccggaaggatacggttcctcccgtatcaatgaagaccgtgccattctgaccgggagcgctgacatacatgctgtccccttggccgatatcaagcattgtaacctctccctcacctgcaagctgaggaagacatgcgtgaatcacaaacacagcagcaagcaggccggacggaatcatgaccgcacgaagcgacatctctttttccagcaacagcaaaaacagaaaaatggctgtgaagtagaaaaacaacaaaagatccggcggcttagccgcagaaaagaccgaaacatccgcggcagacaccgttttaacagcctgatggctccacacaagcagacggtcaagaacggcggctgccgcctcccccaagggatgaaaacatatgaaagcaagcaggcttccgaaagacagcggcatgatgatgaaaatataaagaggtataaaaaatagattcattaatgtgctgagaaatgaaaactcttgaaaatgaaaaagcagaatcgggagggaagcgagctgagccaaaaatgaccccaatagcagctgagagattcggcttttcggcctggtcaatatctcctttgaaagaatgaaaacgaaggatacagcaaaagaaagctggaatccggcttgaaataacagataaggatgatacagcagcagtccgaggcaggcaatgctgatcacatcggcacttttgaagttctttttagacagtgatgccagcagatagatttcagacatgaaaaccgctctcatcaccgacggggcgcctccggtcaaaactgcggcaacgggaaggccgatcacgagcagccattttgcgcattccctcgtgacgccgaagcgaataaatatgtaaaacagagcggctgagagcagaccgacatgaagcccggaaatcgctaaaaggtgaatgattccaagacgctgatagccgtccaggacatcttgttcaatgagaaaccggtctccgaaaattagcgctcttccaataccggcagccgagtccgccatattttcctctataaaatcaaggcccgcttttctgattttcaatagagatggcatcaggccgccgcccggcttgcagcttgtaatagactgaactgcaaaaatccagtgaatccctttttgatacatggattctttttgattaaaagtgccaggaaccgtctcttttttcggctcttttaattcaccttgcatgacacagaggctgcccggctgaagagctgagagcgcccgtttttcttgtggagaccggagcgtatatcccgctttcaaagcttctccctcatctgtttcggctgtgaaagaaagccggtctccgtctattacgggaatatcctgaacagaagcgagcgtgtgaaatttgccttcatgataaatcgttgtattgaaatggtcgatcacgtaaaaagaagtaaaatataaaatacaaaccgctgcacataaagcgaaaaggagtatttgttttttgaagaaacagaggataaagaacagaaaaaaaccgacggcgaggaagagataaagagaagagtgagcggaggcgattccggctgccgctgaaatcgctccgcacgggaagatgcgatgtctgtccattggttacacgtagcttgtaaacagtttgttggcctcttcgtgtattttcctgatctcctcttcctcaaggcctttatcagccagctgtttgatcagatcggctacaaacgccaacttttcctggtttttcaagtcgataatcatctcatcgagctctacctgctccactttaacagaagcctgatcgaaaagttcaaccgcgtaaggatggtttttgtaatccttcgcatagtatatcgttttaatacctgcctgaatgatcgatttacagcattgaatgcacggaaaatgtgtgacatatatttcagcgccttcggtcggaacaccgaattttgcacactgaagaatcgcgttcatctcggcgtgaatcgttctaatgcagtgcccgtccaccatatagcagccttcatccgcacagtgaacgcctccggcgatcgatccgttgtagcctcccgctataattcgtttatccctgacaatcgtcgctcctacagcaagccttgtacacgtgctgcgaagcgccagcaaatggctttgcgccataaaatattgatcccaagaaatccgttccacttgttttccctccaaaaatacgatgtcgacttccctaagtttacatatgatgatccgcaaacgtcaatttactttaccgtgattgcagattttattctttcaaaagacttttctccaattcccgaaacgtttgttatgtcttctaccgtgtgaaacggtccgttctcctcgcggtattcgataaccgcttccgcttttgaagggccgatgccgggaatcgcctgaagctcctcagaggaagccgtattgatattgacgatatcgacggaagcgccatctgcccttgaacccgctttcgagaaagaatcagcagcctcttccccctcaaatggaatgtaaaccaccataccgtcctgcaaaacggctgcaaggttaatttgcttttgatccgcttttttctcggtgccgcctgcttttttcaatacatcgtggaccctgtctccctctttcatttgatagacgcccggatttttcacagcgcctttcaaatcgatgataaccgcctcttttcccgcgcttttttcccgtttcacctcctccttcttgtcatacgtctgtgcagaagcctcctcgggaatggagaggccggatgaagtttcacgctttccgcttaacagcatgaaggcagcgctgatgatcaagacgagtgcaacgcctcccgcagcatgccatttatattgttttagccaatctgtcaaacctgctcacctgctttcatacatattttgactgaagccttcatatcgtttaaaagatacaggttcaaaggaggggagaacgattgaatatcggctttatcgggacaggaaatatggggaccattttaattgaggcgttgattgaatccagagcggtcattccctcatctttaacaattactaaccgaacgatcgacaaagcgttaaacataaaaaaacgattcccagacattcaggttgcagaacggccggaagaagtgattacggaaagtgatgccgtgtttatctgtgtaaagccgctggatatttatcctttgctaaaacggctttcacccgtcttcacccgcgatcagactgtggtaaccattacgagtccggtgcaggtcgaacagctggaaaccatcgtctcctgccaggcggcaagagtgatcccgagcattacgaacagagcgctgtccggcgtgtcattattgactttcggagaaagctgcacagctgaggcaaaagaaaaattgacggctttagtaagcaagatctcaatccctctcgaaatcgaaagcgagattacgagggtcgcctcagacattgtcagctgcggccctgcctttgtcagctatttggttcaggagtttattcaggcggctgtcgaagaaacatccgtgtcaaaagaggacgctattttaatgacgaaagagatgctggtcggtttgggaaggctcctcgaaacaggcctttacacactgcccgccctgcaggaaaaggtttgcgttaaaggcggtgtaaccggtgagggaattaaggcgctggaaagcggtgttcaggatatgttccgccagatgttccgaaacacccatttgaagtatgaagaagatatcgctctagtcaagaagcaattttccgtttgattcattgtttcacgaatgtactgagatctcaacaaaggaaaaatgcattatgaaaaaccatcgttacgattaaacgatggtttttgttttttttgctgtataaaaatgacgttccgactctgcgctaggctccaattttgaaaaatcagcactgatgcactgcacctcaaatccggcttgccgcaataaactgatgtacttttccgtctggaaagtccgctgttcatgcgattcatcaaacctttcgtatacgtctctattttgtacaaagaaggtcaaatcgtgaacagctgaatgaggctcttcccccgcatagctttgccagatgacgctcacttcttcatcctgatcggcatacgtacttcccggaaaaatgacatccattttgtaaacggaatgaacatcaaacagaagaagaccgccctcttttaatagagaaaaaacgtttttaaaagtattgaaaacgtctttttcgctctttagataattcagcgagtcacagcagatcgcaaccgcgtcaaactcttgtccgtgcccggcaagttcgcgcatatcctgctgaaagaactgaatatcgagctgcctgacggctgctttgtactgggcctgggcaagcatgtcttcgctgatatcgattcctgtgacatcatagcctttttcagccaggcggacagatatttcacccgttccgcacgccagatcaagcacccgtatacgttctttctgctgcgcgccgatcgtttgttcaatccagctgacccactgatcgtaaggagcatgagacatcagcttgtcataaatactggaaaatcctttatagatcattcattaactccgaacgaaaggtcttcaatcggcgcgtctccccacagcttttcaaggttgtaatagcctcgttcctctttgtggaaaacgtggacaacgacgtcgcccaaatcgattaaaacccatctggcttcgtcaaagccctccattttcttcacatcaattccattttcttcagcttgatccttaatttcccgggcaatggcctgaacctgtttgtcagagttcccatggcaaatcagaaaatagtcagccacgagggaaatcccctgcatattcaaggcgataatatcttccgcccgtttatcatcgcaggcctctgcggcaatttttaaaattgaagcttgatccattcagtaattcctcctaatgtctatcgtttactaaagcattatatgtggcgaccgtttccggataaacggcctgattttttgaaattaaaaaggtaatcgtatttttcaatgcctggatgagcgccgaatccaaatcttcctcagcgagagtccgaacctcttcaacccccggaaaacggcggcccggctcgatataatccgctacataaaccactttttcaagaagagtcatattgggccttccagatgtatggaaccgaatggctgacaggatgtcttcatccgtaattccgacctctgttttgacaagcgctgctcctgccggcgcatgccaaagttcatgatgaaaattgagcacttcaagcggcccgcctccgtcgaggatgatttgtttcatctcctcttttgggcgaaatttggcgtagtcatgaaagatcgcggcgatttcggcttttttcagatctgcgccaaaccgttcagcaagtttgacagccgtctccatcacgccgaccgtatggatgtagcgctgttctgtcagctgttctttcacgcaggctaaggcttcctcacgtttcatataaacgattctccttcacatagaccttcacttcgtcaggtattaaataatctgtcggctgccgatttttaatgcggtccctgagcaaagatgatgacacttcaaaaataggcacatcgacaaaaacgagcggatacggcgtctcaatttgaaagccgggccgcttcaccccgacaaactgaatcatgttgacaagcttgtcaatgtttgaccatttcggcaggtattccaccatatccgcgccgataataaagtaaaactcatgatcagggtatcggtctttcagcaggcgaacggtatcaaatgtataagaagggccttccctttcgagttcgatcgtctccagtttaaattgctctttccccgaaatggcgagcttcagcatttcaaccctgtgcatacttagtgaaaacgagtttttttgtttatgcggcggaatttggttgggcataaaccagatttcatcaagatccagtttgtacaggacttcatttgccattaataaatgcccgttgtgcggaggatcgaatgtccctccaaaaatcccgattttcctcatgattaccacctttaagcattaaggaagctcaatttttttattttcttttgactccttatacagcacaataatgtttccgatcgtctgcaccagttcggcgcgcgctccgcccgccagcgcttcggctacttcctctttaggctgctcgcagttttgcagcacgctcaccttgatcaattctcttgcttcaagagcttcgctgatttgtttgaccatattttcgttgactccgcctttgccgacttgaaaaatcggtgacagatgatgcgcttcccggcgcaaatagcgtttttgttttcctgttagcatgattttcctcctagttgctgcaacacaattgatttcattttttccatattcggctcatgtcctgtccacagctcaaaagcaagggctgcctggccgatgaacatgccgactccgtccaatgttttcaagccttttgcttcagcctcatgcagcagggccgttttcagcggattgtagataatatcgcatacaaggcacgtttctttcgcattcgccaatgaaagcggggcagcttcgacattcggatgcatcccgaccgacgtcgtttgaatcacgatatcatatgctgacaagtctgcttccgcttcctgcagtgacaaggcgcgtgcctctccatcaaaacgctgagtgaatgctaatgccttttcaggcgtacgattcgccacatcaagccgcttgggcgtctcggctgccagagtggtaaatatcgccctcgccgcaccgcctgctccgatcaacagtatcgagagctcagaaagcggacgatcaagggatggcttcagcgatttaagaaaccctgctccatctgtattatatccgaccagcccttctttttctcttctgacagtgtttaccgccccgagagcttcggcgctttcatcaatacggtcgagatgcttcatgatcgatactttgtgggggacggtcacattaaacccttgaatgccaagggcccgcatacctttcacagcatcttcaagatcttcgttttccacgcgaaaagcgtgataatgcccttctaaagaaagatccttcaaagccgcattatggatgtccggagacatggaatgggccaccggattgccaatcagtccgtatatcggtttcataactctctccccttagcacttatattagagatctgcgcaaaaacacgtgaacgcctttaggggcgtgggcgacaattttttggtttgccccctggaccgttacccagccaaggcccgagaacacaacgtccgttttcggctctttaatcgtaaacgtatgtttgacaagcgccggaaacgagtcaagatcttcttttgcagggggagcaagcatttccccagcgtgcttttcatacagctgatccgcgttttcaagctttgttctatggatcttgagttcattcggcatatagcatacaaacgaagacctgcctccgcttgcataatcaaaccgcgataatccgccgaaaaacagcgtctgttcctcgttcagctgaaaggtgcgcggcttcagctccttcttcggcgtcaatattttcagatcgcgtttcgcgacatagtgcgccatttgatgatggttgatgattcccggcgtatcatacatcgcagatccatcatccagagggatttcaatcgcatcaagcgtcgtccccggatattgggatgtcgtgataatgtcgtcttctccggaaacctctttaataatccggttgatgaacgttgatttcccgacgttcgtacatccgacgacatacacgtccttgccttgtctgtaatgttcgatcgcgtcgatcgcatctttcatcccctgcccgcgcccggcgctgacgagcagcacatcaacaggccttaagccaagctctttcgcctcgcgcttcatccagtttacaaggcgctcgcgcttgactgatttagggagaatatctgctttgtttcctattaataagatcggattacctccgacaaagcggttcagtccgttgatccagcttccgttgaaatcaaagatgtcgacgattttcacgatgagtgaatccgtttccccgatgccgtgcagaatcttcaaaaagtcatcgtccgtcagtgaaacatcttgaatttcgttataatttttcaatctgaagcagcgctggcagatgacgtcttcttttaacagcgatgcttcaggcgcatagcccagtttatttttatcttcggtttgaatggcgactccgcatccgatacaaactaccttttccattcattattcctcccactgaatatggcctttccgttttagagcgctgagaattctgcgttcgacttggcggttgaaacgcgtaaaaaagccgtcggaagcagccacaggcacgacaagaatggtatggaacccgttgcggttccctccaagcacatctgtcatgagctgatctcctatgacaacgacgtcttcttttttaagacccatatttttaacggcttttctgaaagctctgcccatcggttttttcgctttgtaaataaacggaatattaagcggttcagaaaatattttgacgcgtttttcattattattagagacaattgtcactttaatcccgtgctctttcatctcttcaaaccactcgataagacgcggtgtagcactcggcctgtcccattctacaagcgtattgtccaaatctgtaataatcccttttacattgcgctcttttagtttttcaggggtaatatgaaaaatattttttacaaattcatccggcaaaaaaaacttttttaacacaaagccgcaccctttcctttcaattactgcttcttttttcaatgtgtcgaatcaaatctaaaagtgtcttaaaaaatcggctgtccgaaaagttttcgacatataataggattcttcaacaggtgtggataaaattacacacagtatccactcatatttcatcgaccttttattaaattataaacatgatacccacaagttatccactttttggtgtggataacagaacgattgttctcgcccaatattcatgatagattataggtacttcaaacaaagatcatataacttaacattttatgcttattccaaacaggttattccaattttcatgaggaggtgtcttccccattaaatgggtaccgagtatgaaaaagctgtctgatgaacttttaatagaatcatacattaaagcaaatgagatgaatttgaaccgcgaattcatcgagctgattgaaaccgaaatcaaaagaaggtcgctcggtcatctgctttccgtctcttcatagctcaagcactcccgggcgctcttgccgctttttttcacttaggttgatattatatcacttgaataatacgcttactactgtttttcatgaaaaaacacctctctataaaagaggtgctatttgaagaatccgcgaggactaagccagtagaacccgccgatgaccagcaggacgactaaaaggacgacaacgaacgcatatccgtatgcggcgcctgcatatccgggataagccgggtacgaacacggaccagcgggaaaaggatatcccatcgcatcattcctcctttggtctgttatagtaacagcctatgaagaaaaaggagaaatggctaggccttttacttaaatcaagacgtttttatgattttgcttttgttaattccttcaaaaataattcgcgcgccttttggggttaagtgatttcccgatgggtcgataaacctcgaatggatcagcttctcatctgtagctccgcccgcttttttcacgatgtttttccagttgtcgataagcggaacatcaagttcccgcgccgtttcccttgtgacgtcattataggaatcgtgccatttacgcgctccaccgtatttttcaaacgaagaagcccggtatcttgcataataaaagatgttgtccccgcttccttcgacgatcggcaggcacgtcattaaaaccggctctatcccgcggcggcggctttctttaacaaaataataaaggttttctttaaacctttttttggatacgcgcggcagccctttcgtaagaattgctgcatcatttgttccgaacatgataaaaagatatgccggctgcttgtccagcacatccttcctgaaccgaaacctggcgtcttccgtcgtttctccgcctattcctgcattatttattttgtactgcccttgaagggaagtctgaagtaaattgacccacttttccgcttttggataatcgcgaaattgccaatttgagccgcgtgtattgctgtctccaaatgctacgacttttctgggatcgtcctctccgcagcctgaaagcagaagcagaaaaacgagaaccatcaccaagctttttttcattcgttccacctccaaaagccaatactacgatcatataggagagaagccgcactttcaacgggagaactctttgtcatcctgccgcatccagtccttgctatgcctttaacctgtcccccctgtttaaaaacattcgtattggttcacggttttccgacaaataaagaataagttttgacaggtcgaaaacctaatttttcagcgaggcggatcgatgcgcggttttgccggtcgcaatcccaacgcggtttcaaacggttctttattgcatgtgcgataaaggcgctggcgcagctgactgcaaatccccgccccctgtaatccgggtgtgttgcgatatcaacttcggcaaagcgttccgaacaaaaaatggtgacacattcgcttgcgaccacacctccatgcaacactttaaacccgaaaccgttcttcaaaaaacggctggcccctccccaatactcatcagcgtatttttcagtaaaattcgcgcttttttgaaggtcatcttcagtaaatctttcaaccccggcaaatgctgcgccgcaatcacgctcctcttttccgaggaaaaatgacacgcgctccatttgctgcagaggatcgccaagccccccgattaaaaaagcgtcccactcttcagaagccgaaaacacggtaaagcgcgctccgctcctctgttcatttaaataatggagccactcgcttcttccgctgtccggagggtttccagcgacataataaatcccggaagatgttcgaaaaagagcagtggccggtgtgaggaaatcatcgacatagacgtttccttcgatgattccttcggctatcgcatgcgcgaatgtcgggctttcttccgctaacaaagcctttgcttttcgtttttcactcgatttcagttcaatcatcatgactccccctcgaacttgagacagatcatcaagccccgccggctgattcggcgacgccttcaatattgcggtcaaagataaaaacagacactgcaatatcctcctgaattttgatgtccgtaaaaaggtgctctagcttcgctccgataagctcctccattccttccggcacgtgattggagtagtgtttctgaatcagggtcgtccttgccgcatgcaccatttcccttccctccggcgtgcttgcgataaactgctcgctcgccgtcaaattgccgtacagtgtcgaaactgccatattgtcgacaaagaccgttcgtatccgttcaggccccttgccaaacagctcttttcgaagcttgcgaatcatatcgttgaattcatggatttttttagacatcatgcataccccttccgtttaaaaccttacacctgtctcgatgtccccttagacatttcacttggttaaaattttcctattctattgaattataatcaatatcactttataattaaagccgggctgatggatttgtaataccgtcgtgttatgaatctatcgaatctgacaatataggattggtctgttagtaagctttgctagtaaactattccgccatgtatgtttataccgatttcccgcgccggaaatcggtatatatgtacatggcttttttgattttgaacatgatggagggaaatgaagatggacggaaagccaatcagtatccggatagacggcaaagaatttgaagcagtggccggggcaaccgttttagacatattgaacaaaaacgggtttgaacacccgcaaatatgccatgtaccagagacggatcctattcaaacgtgtgatacgtgtattgtggaagcagacggaaaattaaaacgggcatgctccctgcgggctgaagacggaatgacgatcagcctgtcagcagaacgggtcaaagctgcacaaaaagaagcaatggaccgcctgctcgaaaatcatttgctctattgtacggtatgcgacaacaacaacgggaactgtaagctacataatacggcagaaatgatgggaatcgaagaccagaaatacccttacacgcctaaagaagacccgtcttgcgccgtcgatatgtcacaccccttttaccgctatgatccgaatcagtgcattgcttgcggacaatgtgttgaagtttgccaaaacctgcaggtcaatgagacgctctcgattgactgggagcttgaacggccgcgggtaatctgggatgaaggcgtatcaatcaacgaatcctcatgcgtcagctgcgggcagtgtgtcacggtctgtccgtgcaatgcgttaatggaaaaatcaatgcttggaaaagccggtttcatgacaggcatcaaaccggatgtcatggagccgatgatcgaccttgtcaaagatgtagagccgggatacagcagcatctttgccgtttcagaagtcgaggcggcgatgcgttcacagcggaccaaaaagacaaaaaccgtctgtacgttctgcggtgtcggctgttcatttgaagtatggacaaaaggccgtgacatcttaaaaattcagccggtttcagaagctccagtcaatgccatctcgacgtgtgtgaaagggaaattcggatgggatttcgtcaattcggaagaacgtttaaccaaaccgctgatccgcaaaaataacgaatttgtcgaatcgacttgggaagaagcgcttgactacgttgcccgcagattaggctcgattcgggagcagaacggaaaagacgcagtcggatttatttcgtcttcaaaaatcacgaatgaagaaaactacttaatgcaaaagctggcgcggcaagtatttggcactaacaatgtcgacaactgctcgcgctactgccagtctccggcaacagacggattgttccgcacggtcggcatgggcggcgatgcaggcaccattcaagacatcgcgaaagcaggcctcgtcatcatcgtcggcgccaacccggccgaaggccacccggtactggcgacccgcgtgaagcgcgcccataagcttcacggacaaaagctgatcgtcgccgatcttcgcaaaaacgaaatggccgaacgctcggatctgttcatcagaccgcggcaaggaactgatcaagtatggctgatggccgtgacaaagtatatgatcgaccagggctggcacgatcaggcgtttatcgatgaaaacgtcaatttctttgaggaatataagcaatctcttgagacatacacccttgaatatgcagaaaaaattacaggcatccataaacagacgctgattcaaatcgctgagatgatccgcgacgccgacggtacatgcattctttggggaatgggggtcacccaaaacacgggcggttccgacacgtccgcagcgatttcaaacctgcttttagctaccgggaattaccgccgcccgggcgcaggagcttacccgctccgcggccacaacaatgtccagggcgcctgcgacatggggacgcttcccggctggcttccgggatatcagcacattacagatgacaaagcgcggaaaaagttcgaacaagcttacggcacaacaatcgacgaggagcccggacttgacaacattgaaatgcttcacgccgttgaagaaggcaaaatgaaagccatgtatatcgtcggagaagatatggctttagtcgattcaaacgcaaaccgggtccatgacattttatcaagccttgaattccttgtggttcaggatgtgttcctttcgaaaacagctcaatacgccgacgtcgttctgcctgcgtcagcttctcttgaaaaagatggaacttttacaaacacggaaagacgtgtccagcggttgtatcaggcgctcccgccgctcggagatgcgaagccggactgggttatcattcaagacatcgcaaaccggcttggagctgactggagttacagccaccctggcgacattttttcagaaatggcaagcctgtctccgctgttctccaaggcggattatgacgcaattgaaggatggaacagcttcctgtggggcagcttgaccggagaaagcacgcctcttttgtatgaagacggctttaactttcctgaccggaaagcgcgctttgccatcgcagactgggcagagcccgccgaatttcctgaggagtacgaccttcacattaacaacggccgaatgctggagcattttcacgaaggcaatatgacaaacaaatcggcaggcatccaggcaaaagtgccggacgtctttgtggaagtctcgcctgagctcgccaaagaacggggcatctgcgacggatcgcaggtcaggctgatctcgccgtttggcgccgtaaaattaacggcgcttgtgacagaccgggtcagagcgaacgaactttatctgccgatgaactcgacagataaagaatcggcgatcaatttcttgaccggtcccgcagtagatgcgcgcaccaatacaccggcttacaagcagaccaaggttcgtatggaagtgctcggcggatgtgcagaaccgccgcttccgaaaacaaatccgcgcaataagaaacgccatccgcaaaacggggctgaagtcgagcggaaatggaagcgtccggggtacgttcatttaacagactaaatcaaaaggaggtcatcacacatggcagctcccatcaccgccatccgcaaagaagaaaaatctgaggagcaaataaagcttgaaaaactcgaagaactcaaagcccttttggctgaacaggaagccgccgtttcaaaaacgatgaagcttctcggcgaactgaacggcctcgggatccttgatgccgcagacagcatgatcggcgcgaaggaagacatcgccaaaatcgtcctcggccagctgtccaaagagccggccaaaaacctgatgaatacagccattgcagcaggcggcgctctctccaaagccgaaccggaagtcatggggaaacttgtagaaagcatcgtcgccggcacaaaacaaggagaggactttttaaaaagcgataaaaaaaccggagtcctcgatctgctgaaagccatgaacgatccggacatcaaccgggccgtcggcttcggcctgcaatttttaaaaggcatgggaaaagcgctgaaagaataacaaataagaaaaccggctcaccactttgagccggttttcctattggcgatagaagcaccgtcgctttctgtcgcctcatttgctgtgtgtttcatcttttttattcagcgattcttttaaaatattaaaaactgccgccgcaataacgacagtcattaaccctgtcgtcagcaggtttgggaaggtttcctgaactccgatcatgaccacgctcaacacaatcaacgaaagtatgaacagacgtttgtttttcatctgccgcaccggaccggctggttgatagcgtttacgatatggtgaaccgtccggcaccctcacccccttacctttattatcccgctcttgttaacttttgtaaacggctaaaaaatggaagcgattgcaacggtcgccctttccggcgaaaacaagcggcttcatgccgaacagaacgccggaatatttggcagtccggcaattttgccgggtacagacacagacatcccccctcccacatacatttacatataggcttctgcctacatacattttgtggaggtgccgttaatgacaggtgtttttgcagcgctcggttatgtcatcaaggaactcgtttttttagtatcatatgtgaaaaacaatgcctttccacaaccgctgtcaagcagtgacgaaaaaaagtacttggagctgatggcccagggggatgaacacgcgagaaacatgctgatcgaacataacctccggctggtcgcccacatcgtcaaaaaattcgaaaacacaggcgaggatgcagaagacctgatttccatcggaacgatcgggctgatcaaagcaatcgaaagctattcagccggaaaaggaactaagctcgccacttatgcggcgcgttgtatagaaaacgagatcctcatgcatttgcgcgcattgaaaaaaacgaaaaaagacgtctcactccatgacccgatcggccaggacaaagaaggcaacgaaatcagcctcattgatgtcctcaaatcggaaaacgaagacgtcatcgacaccatccagctcaacatggagcttgaaaaagtgaaaaaatacatcgacatcctggacggcagagaaaaagaagtcatcgtcggccgcttcggccttgatttgaagaaagagaaaacacagcgcgaaattgcgaaggagcttgggatttcgcggagctatgtgtcgcggattgagaaacgggcgctgatgaagatgtttcatgagttttatcgggcggagaaggagaaaaggaagaaggcgaaggggaagtgagatcgatgaagaggctcggaattatataaacccggcctctttttatgcgagctaatttggctgggtaacgggcgcgtcttctgcttgatgaagtttccccgtatggaataaatcagccaattttgaatgctcttggagcgtgtaaacttcaccagtgagcatttgtttatttggcttttttatgtgtgggatgaagattatggcaaggacaattgtagaaactaagaacccggcatgataaccttttaagctattcgcaatcgttggttgcaatccttccatgacagttgcgccaacggttgcgatcacagctgaaccgaagcttgaaccagggttttcaatattattaataccgacacctgcttctggaagttgttttctgtcaagccctgtataagcgtcactcgccaacggaagatttcccccgatactggtgcagcggatgaacaatacgatggaaatccagatcaaacttgttttatcggtgattaagataagcggaaaaacaagactgatcataaccacggatttcgcaccaatcttatcaatcatttttccgatcattggcctggtaacgagcatcccgattcccaaagcaaccaaacagatttttttatttcatctgcctacctttaggggagcatataataacacgtagatcattttataacaaaaaaccatttatatccgtccagccgatagcaatagctttgaaataatcttcaccgaattgtatttgttttgttgtgctctgccttccacctagcttttcataaaaatttatcgatggattaccggctaaaacccataccaataatgattttatgtttttctttacaagctcctctacaatcgccttcattagtcgagatccgattccttttttctgatactgtaacaacagataaatcgcggaaacttcacccttatatttgctaagatgatcgcggtttggacctccggaagcaaagcctataattttaccgtcggtttcttctgcaacatagacaatatcttgatttttaggatcacttaatgaagttctccaaagctttgcctgattttcgacagaaagcttagataacgtgtcatcaggcaatactccttgatatgtggttttccaactttccacatgaactttggcaattgaattagcgtctgacactttggcttttcttattaaaatcattttccctcctataattaatatttttcttaaagaggatatcgcaaatatcggcggcttctcttaaatggttaaaatctgaatatatcttttatcttttattggattacatcgaaggtctaggggtattgttttgaagaaggcctcgccttacacctggcaattcttcaatcaaattacttctaggaactagagcttcctgaggtatatctcccccaaaattctgggagattacatttatattttattagcttccctgaattgatataataagcaacattggtttcggggtcttgaattaaaatgctaatttccattgattcctcaacaggagttatctctgtcagttcttgcaataactcttcattcgaacagctaatgaagttatggtcaaaactgtttgttttactctgctcgcaggaacccttgtctatacctgtcaaagaaattgccgctccaaccaaagtgcctgccgaaacgttatttgttatagtccccttgtacttctttgtatgctgacaagcctcattcaaattctttttttgattctaatattacaccgtttaataagttcatgcccgttgacggagtcataaaacaagcacctgcaaaaaaagtgctactctcccacttgaatatacaaatcattaccttttattttataaaaaggagttttttacgcaatacttttgtcaattccaattctctaaagtcaataaatcgcttttggtatgtaacatgctattgtaaaactctttttatctgaacttttcacctgaattccaaacagtaacctatgggccgccacgaaaccagtctcatcgatgtcctcgggatcagaaaacgaagacgtcatcgacaccatccagctcaggcacaggcctgaaaaagtcaaaaaatacaacgacatcctcgacggcagagaaaaagaagtcatcgccggcgcctcagccttgatttgaagaaaaaaacgcagcgcgagatcgcgaaggagctcgggatttcgcgctgcgatgtgtcccggattgaaaagcgcgcattgttcaagatgtttcatgagttttaccaggcggagaaggggaaagggaaatgatgtcatggaagccggcctaaaacaccggcttccatttctttctgccaggcccttaataaagcttgttatccaattacagaggcctgttgaagttacttttaattttcttctgagtttatttgtattgctataatgttcataacatttttcataaatttctcttttgtgaatgaagcagtccctccaccttgagcgaacattttatttcccccaccttttccatcaataagggaaagagcttcttgcattaggtctctcatgttcattttatttgcttcacctcgcccgcaaaccaattggaagcgatgatcgttctctgacaagaaaaaaataagggcccgtttttctcgatcagcaatcatttttgctagcttttgaagttcttgaatcgatcgatctgaaaacgtttctatcaccattacagtatcattttgaattgcgctttttgctaataattcattggcttcatactgaaggtttttttcataagattctagaagcgctttgtctagcttctttacattttcaagcaaccgtttgatagcttcgcttaattccccttcaggacgattaagtaatccagtcaattcaacgattgctttttgtttttgatcgaattgggttatgacccgattaccgcatacaaaatacagacgaatttttttcctctgtctttcccaattcaatacttttattgctccgacttctcctgtagcgctcgggtgtgttccgccgcatccgttgtaatcaaattcatcaatcatgacaagacgaatattttcttttacagatgggagtttacgaatcggataatttactaagtcatcatattctacccactttgcgactatggacctattttccgttatgatctcgtttgcaagcttctctgctttgcctgccatttcctctgttaattctgatacatcaaggtcaatggtaaccgtatcatttccaagatggaatccaactgtatgaagatcatacagctgcgcgaatgccgccgacaaaatatgctgcccggtgtgctgttgcatgtgatcaaaacgccgctcccaatcaataaccccaacaacctgatcatttaaatgcggcaaaggcctttctacataatgacgaatttctccatctatctcatcaacgtttaaaactttgactccgttcaatgttcctgtatcatgaggctggcccccgcctgttggataaaaggctgtttcctctaggataatataaacatcaccttttttgtcctgttgttgtttcaagattttcgtttcaaacgtttttagatagggatctttgtaaaatagtttgtgatgattcggactcatgccatctccccttattttttaaattattgaagtcttcctctagcttcaatatttaattcatctacaacctctccattatcgactaaataggctttatcgtgcaagttgcatactgggcagatatgatttggaataattcgcaccttatctccaatgcttacttttttgttgaattcttcatgataaataatagcatgttcgtcgaatacgccatgaatataaacgtcctcgtattctttgatacggccaagccctttggttgcagtaagcccttcgcttcgtgtttgggcggtaattcccttggcccctacgtctgtaatgactcgttcttttgttggtttactaatcacggttgtgagtacagaagcagcacagcgatcatacgtaccaattacatttgcttgtgaggcgtccataaaaatgtaagtgccaggtctgatttctgtcaccccttctggaatatcaaacttaaacatgaagggaggagtagagccaatactaaccactttcggctttagatccatttcttccgcaattcgggcgaaatgtaatgttcgttctacactttctttatagagttctttacaatgggctacacttttcgctttataagaatgtccgtcatgtgagaagattccttttagctcgacattttgacacgttttgattaattctaataaagtacgaaaatcatcttcttcaataattccggagcgttgttctcctacttcaatttccaccaacacttgggctttctttgaagctccttcaaatacttcttcaatttcacgtacttgatacgcactatcgattccaaaagagatatcaatcgtttcagatagttttctaatacgttcaagctttgatttcccaacaatttcatttgcgataaagatatcttttaagccatttctcgccatcacttcagcttctcctactttcgctacagcgattcctacagctcccatctcttcttgcagtttagctaatttaggcattttatgtgtttttgtatgagggcgtaagcttaccttctgttcgttagcgtaattttgcatatccttcatattgcttaacatcacgtctttatcgattaaaagagctggtgtatctaattgtaaatcattcattgtgcctcctcctttatcgctgcaatggcttcaacttcaacaagacacccggcatataaatgatttgatggaacaactactcttgccggtttatgattgccgaagaaatgagcatagacctcattgatatccggccaatactttacatctggggtataaagtctgcataatatcacatcttccttggctaatccccgttccttgaggacaagctccatatttgccaatgcctgttttgcttcttcttttatgcccccagctggaatttttcccgtttctggattcatcgacaactgccctgaaatatagagaacatcattgtgttccatagctggcacgtaatggcccccatcccgtgttgaatacttcgtgtgtacaggcttcaatataatctccccctattattcttaatatttaaagctagcctcatcaatcttctgtccagcagccagcaaaacagcgagtttgatccttgctttcttactgtcatagctgccgccaagtatgattccggcatctgcatatgttgaagcacttcctttgaatccatatactcccttgacttcaccttcgtgagcacttgttgtcagaacgacaggaatccctttctctgcggctttctttgcactttctaatattgctggagccgtatgccctcttcccggcgcctcaataatgattcctgcacttccgcacttaactgcataatctataaactttccgtctgatccaagtgaacacttaataagttccacatttggtaatggttgaatcagctgatacgtctcacgcttgattaatctttgatgaattgcgatctcatcttgatcggcagttcccaaataaccgaatcccggtgagaaaaaaccatcaacatttgacgcatgctgttttttcacatatcgagcagcaaaaaccctctcattaaacaacactgttacccctaagcctcgcgcatcaggatgtgccgctaataagaaagcttgtcttaggttcacaaacgcatctgtaccttcaagtgtcggtcctctttgcgaccccgttaacacgaccggcctttcatcagaaataaccagatgaaggaaatacgaagtctcttcaagggtatctgttccatgcgatatcacaattccggcaacatcctcattccggaagaaactctctatattttgcttgagaatgtcaaggtgatgaaaagtcatatgactgcttgacatttaaaaggctgacttgatttcaatctctatatgagaaggcagtcgacacatttcagaaagctcttcacctgtcatagcacctgcttctaatagacctgtttcaggatcaggcttacttgcaattgtaccgccggtactcagcaaaatgattttcttgttttccatgctaactcccccattttcatattaaaggtttctctcttagttcctaattagatttaatcccagccccgcataatggaatcacgattttttcatcagaagaatgactgtattttaaatatcctgcatagttagccgctgttgttggctcaacataaaagcctttacttgctaatgctgtacgagcttttagaatctcttcctcattggttgtaatgatttgaccgtttgtggcacggatggtttctaatatttgagcagatcttgccggtttggcaatcgcgatgccctctgcaagtgttccgctgcttttgacgggttcagcagctttttgattgttgataaatgcctttgccaacggcgcacaattctctgcctgtatcgcaaccagccttggcattttgtctatacatttgttctctaataactctttaaatccatagtaaaccccaagcaataacgtaccattgccaactggaataataagcgtatccggcgctccattcatttgttcccaaatctcaaaggcatacgtttttgttccttcatagaaatatggattaaaaacgtgactggcatagaattttttctctatatccacagccttttgcgctgcttcagccacatcttctcttgtgccttcaatttcgcgaacgttggctccatgcgctttcgcctgcgcgattttcttaggcgatgtaccctttcgaagaaagatgtcacatgcgatttcagcccgcttggcgtaagctgcaatagatgtccctgcatttccgctgctgtcggcgatcacatgcttcactcccagctcctttgccttagctattaatacagccgcaccgcgatctttaaaagacaaagtaggcatcatatagtccactttcacaagagtattcggctccccgctgtctaacacgattaaaggcgtgtatccctcccccatggtgatgccgctccatatggcggagtcgcgatcaaatggcatagcttcaatatatctccacatagaaggaatatctttgagcacttttgaatcggaccattctactttttcttttacaaggtctaacactccgccacactggcatttccacacctgttcagacacattgtatttcgtacggcaagaatgacattgatactgttccattatttttagaccctcctattatatatttttttatattttatatatttttttatatgttttagacaaaaaaatatattacagactggcgattgcttcaatttcaacctgaaaaccgtaatgcagctcggtcgtcgaaacaactgaccgtgctgggcgataatcgtgaaaaaaaccctgacagacattgtcaacacggtctaacaaattgatatcgtgaagatataaggttatctttaaaatttttcctttatgactgccggctttttttaagatatactctatatttgacaatacctgcaaagtctcttcttcaatggtgccaaatttcttttcctgcgtgattggatcaatggcaaattgccctgatacatagaccgtgttttgatgaatcacagctaaggcataatgaccgttcgattttaaattccctgcctcaaaaatactctccactttgttcactccgattgtcttttttttacttcatctaaatagctgtagacagttacctttgaaatgcctaattgttctgccactttatcaaccgcacctttcatgaggaatatccccttttcatccataaacctgatcagctcgattttttcccggcgtttcatcatagagtgtttgcggttcgctacaatttgttcaattaactggttcgtgatctcttctacattctgaatcgaagcttcctgctccgccgtattcgaagtttgtatttgatttttcttttcaacaccaggcataaatgcatctaacatttctttcatttgaatcattacattcatgtcgtaattgatgcaaaaagccccaatcacctgctgctggccatctctaatgagggtagtcgatgattttattgttctcccatcatctgcttggatttcatatccagctaagtaatcctctttaaattcattggataaaagaacttttttcaccaaatggtcaaaggattggccaacctctcttcctgttacatgattgttgattgtgaaaatgacggaagactcgggggttgtcaaatcatgaatgacaacctcacaatttggaccaaacatttcccctatcgtttttgcaaatggtatgtaactttttaaaacctgttttgcttcagtcaaaacctgaacacctaactttcatttacccgcatttatctcaagtgatttcattcatggattcattatataattttttatacaaaaatgaaacaaaaatatatttttttatacacagaattgatcattcattaccttcagtttgtatctttttattttgtcatcaaacaggaactatttagatattgttcggtatctttttagttcagtccctcaacctattaaaacctgtgagtggcattgaaatcagcctcattgatgccctcaggatcggaaaacgaagacgtcatcgacaccattcagttcaagcacagagcttgaaaaagtcaaaaaattcattgacatcctggacggcagagaaaaagaagtttattgccggccgctttagccttgatttgaagaaagaaaaaacgcagcgggaaattgcgaaggagctcgggatttcacggagctatgtgtcgcggatagagaagcgggcgctgatgaaggtgtttcacgagttttaccgggagaagaaggagctttttcctaatttggaatataaaaagaccgcaaagctttcttaaagaaacgttgcggtctttgggtctctttcttgcttagtataaagtcaatggatttccagcgcgaatccagtggacatacatccattgattggcttcccctgctcgagtgaatgtggagaaacctgaatatgtcaatcagcttcggaattaaatgcgtgttgatgttcctctgcttgactatttaatatgcgatagctggaccctccaatatgaagcggaacatccaatttttctaaattcggcatgcctttttttaagaaaagctctttatcttgatatctctgtaaaacttctcccgcaatccactcttgatcgcccaaagtggaaatactgtgtactttacactcataagcaaaatatgcatcagttaaaatcggtacctcggcttttagcccttcttcgtattgaatatgaaatgcttcaaacttattgatatctctgccgctgtgggtgcctaatgcttgaattaattccgagcatctccccggaagaaaattcacaccgaaaacgccacttttctcaatcaatttgtaagtaaatgtctcattatttaacgatatcccatacattccgggagaagatccgatatacgtatgccacccggaggccatggcgtttttttcaccttcatattgagccgtaacgacagctaccatgccgggataggcgtaccaaatgggttcatcaatcggtgctctcatctccaccgctcccttttagattcattttttattaaaatttgagaggctcgcatctggatcgacatgttctcgtcaaaaggaccgttcgttttagctgcaagccagtttaataaatgggctcacagcaggctgtttccgacttgctattgccggcatgagtaaacgaagcgtcttattttctgccacttatatacccttcctttcaaatattcataagaacgatgcataaatgataaaccctatagcaactatagggtcaaggagttcgttattttttcagcactctgaattctgtgaggaagtcttcttcttttaatgagttatagctgtttggaaaagaaacttgatatacttttccatccgtttgaatgccatgagtttcaataaaatggtacagtttttgatagtatgaaaaataatttgttgaagagcaatcaaatgaaatacacacatattcaccggatgggatcgtatccatcccaatattttgttcttctgtatctatctttgctccatcgtaaatcgtcgtataaacactgttgcaataaatgtcacctgaatttttataaggctttaaatcataaatcagtccataatagttatcgaccatatctcctctttcttccaggacctcagccagttttcggtaatacaaatctgattggtcatgaggattcacttgaggtgtcgctgcttttaaaatggtttggccttctatatgccgaacatacaccagaccttcttcttttttagcgcgtatctccaattgttcatgaagctggtcctttcttctttgaagcaattgcctggcacgttcgagtttttccatttcacgctcaataacgttttcttgctcctcaagaaaggtttgcatcagttcaggggcagatgtatgtgagataatgcgcttaatttcttccaaaggcgttttaatggatttgagatattttataatatccaaataaaagaactgtttaacatggtaatatcgatagccgttatcccggtctgtacattgaggcttgaaaattccgatcttatcataatagcgcaatgtttgaatggaaatgttatttagacgggctgtttccccgattgaaaaatattccttcatgaatcccatcctttcttcttagttctaagaattatccttcctctccacaattaccttcaaaaagtgaaaaattacatcaacatcttggacggacggaaaaaagtcatcgacagccgtttcggccttgatccgaagaaagagaaaacgcgaagaagcgggcgctgcggatatgtttcagaagtgtgatcagacggagaaggaaaagcggaaacactatcagtcaagaggccgggagtaagacatagcggcctcttgactttttattccatgcgcttgagcagagaaattttctttcattttaattcgctgcaaggggttgaaattgcaagcccgtctttctgccattggacaatgccgccgcttaaactcaatacttgtttgaaactaccgttagcttgcaggatgctggctcctattgcagatcgggctccggaatggcattgcacaagaatcggacagtcttttctaatttcatcgagccgttctgggagcgttcccagcatgatgtgttgcgcattcggaatgtgaccttcctgccattcagtcagattgcgaacatcaagcacttgcacaaagccgtcttccactaattttgcgatctcacgtggtgtgatctcagcgtacgattcaagtgaaaaagcaccgtctgccaagattttgtcacgatcgataaaccctgccgcgttgtcaatgcctacggagcgcagcgcttccaggagttcgttcacttctgccggattcgcgattaagtacacaggacgattgtagtcgatgagccagcctgcccagtttgtaaaccccttgttgaatggaatgttgatcgtgcctttgaggtgcccttcagcaaattcccgggaggagcgggtatccacaatttgctctttcccctgcaaatctttcacttgttcaatcgacataatctctaaaacggcagaaagatctttgagcaatgcagggccttctttattcactcgtttcatctcagcaaaatacttcggcggttctggttgtccatcaagcaaggcatttacgaattcctcttcatcggtgtaagccattgcccagttaaacatcttttcgtagccgacagtcgtagttggaatggctcccaatgccttgccgcaagcgctccctgcgccgtgagccggccaaacctgcaagtaatccgggagctgtttaaacttcatgagggacttgaacatcgctcttgcccccgactctgacgttcccttaatccccgccgccttttcaagcaaatcgggtctgccgatgtcgcctgcaaagacgaaatctccagtaaagatgccgattggacgatccgcatttcctccgccgtccgtcaacaggaaagaaatgctttccggggtatggccgggagtatgcataacctcaaacatcaggttaccaatggaaaagcgatcgccgtctttcacaagttgatgtttcgattcatcgacatattggtatttccaatttgcgtctccttcatcggaaagatacagcttcgcttgatgtgtagcgccgagttcgcgggcaccggaaacaaagtcggcgtgaatatgggtttctgcggccgctgtgatgtttagcccttcttccttggctgcttgcaaatatggttttagattgcggccggggtcaatcacaatggcttcccctgttttttggcagccaaccagataggatgcatgggccagttttttatcgtaaaaatagcgcaataacatgttgtattccccctcttgaaacatttatcgtaatatatccttttttgagttcgcatcatgctttgtcctgtcttacatcagtccttttaacatgccattccaatacatgatgggaagcagtcttctttttaacaggtacatgctgaatcgttccttggactgatcaaatggaaacgtttcttgcggcaccttgtgatagtcaaactcggccagcacgagtttgttgtaccctgtaaccaaggggcacgaggtatatccatcgtactttgcatctaatgaagagccttttatcaaggacatcagatttcgcacgacaaccggagcctgtttgcgaactgccgcccctgttttggacgtcggcaggttggcacagtcaccaattccgaaaacattggcaaactttttgtgctgcagagtgtacggatcaacatcgacccagccgccggcatccgccaatgcgctttcttttatacatgaaggtgctttcatcggtggagtcacatgaagaagatcatatgtgaatacttcctgctcccccgtctccaaatgttcgaacaaggcttcttttgaatcaggccgaatttcgattaagtttctcttgtacatcgtttggatatccttgcgcaggacgactttttcgagcgcatttgcgtatttggtgacatcaaaaatgatcgatttcgccgatgcaaaaataatctccgactgatggcggacatttgacttgcggaaatagtcgtctgctaagtacataattttctgtggagctcccccgcattttacgggagaatcaggatgagtgaaaatggcggttccgcctttaaaattgcggatgttttcccaagtgctgtctaccgtatgatatgaatagttgctgcaaaccccgttttttccgaccgcatctttcaagcctttgaccccgtcccaatcgatttgcaaaccggctgctgcaacaagataatcataggaaacgatcgttccttgttttgtaagaagtgtgttctgattcggccgaaactccgttacagcatcgccgatcaagtcgacaccagcgggaattaaagaagccagatctcgctcggactcttccttcttcgctgcgccgcctccaactaatgtccacaaaggctggtagtagtgctttgtttgcgggtcaatgatggcaatttgtcctttgagttttttagaaatccttacgagacgggcggcgacagagatgccagcagtcccggctcctacaatgacaatggaataacgagcatgtcttgccatggtcaacccccatatttttatagaaagctgctgtttttcttaatgatgcgtctctctttttttaagttaacatcaatcttcctttttctgtataggggaactcccctacttttatgtgagctccgtcttcacaagctgacaggggttaaggggccgtatgttacaacgacagatcgagatatttatttttgatcgcatattgaatcaattcgtgtttcgagtccagatctaacttctgcatcatattcgttttgtggttttcgacggttttgacgctgattgagagtttatcggcaatctccttattggcataacccagcacaatgaatctgagaatctccttttcgcggacagttaatacagaggtcggctttttgggctctgaattgagccattgatcaatgatgtcttgcgatacagatgttttgtaaaagagattgctcctgtacacttcgacaatcgcctgataaagcaaccgataatggctgtttttcaagacgtagccatgcgcccccgcctctattgctttttggacaaaaatttcctcatcatgcattgtcaaaatcacgattttaacagaaggattcaactttcggatctcactgctcgctgtgaatccgtccaacccgttcggcatcgacaaatccatcagcacgacatccggctttaactgtccggcgctaagaacggcttcgttgccattattgctttctcccgcaatttcaattccagaaaagccttccaaaaggacacggatgcccttgcgaatcatcatatggtcatcgaccagcaataccctgatcactctccttcccctccttgtcctgtactttcactttaatcgtcgtgccactctgaagtgcagagtgaattcgaagacttccatccatctgatcgactctctctttcatatgtttgaaccccaggccttcctctgtcagcccgcgttcaaaaccaatgccatcgtcctgaatgatcaaaacgagctcgccgtcttctttgtaaagtatgacttcaataagtgtcgcctgcgaatatttcagggcattatgaagcgcctcctgaatgatgcggtacaaattgatttcaaaaatcggcagcaagcgattgctgatatcgcttgaggcaaacgtaatagaaacatcctgatgcgtcttgtttaagctggaaacaagatgcttgacagcagggatcagccccaattgatcgagactgtgcgggcgcagctggagagagtagagcttgacgtcttggattgctttttccagttcatcgatgatgtcctgcatgtaatctttaaatgtttcttcctgctccatgcgcgattgaatcgcttgaatgcctactgaaaccgaataaagcgattgccctacaccatcgtgcagttcctgggcaagccgcttgtgttcgttttcctgggcctctaacgttttttgcagaaccagcttggagatcttcgcttcttcctcctttttcttcattgttaaatctttcaggaccaaaagaacttccatttgatcgccgttttcggaaatgacagccgtactcatctccatgtcgacgaatcgcccttcataggtgggcatcgaggagagaaaataaggaatttcccgcttggccagcaaataacaacgctcttctcccgcttccagttttctcgtttggcagtaggaacagtacggaaccttatcccctagtttccatcccgtcatcttctctgcggacggattaatcaccagaattgtgcgttcctgatccatcatgatgatcccatcctgcaaatggtcgaagatctgccttaaatagccgctttcatttgacattccttcttctgtataccgagccgggttttgacacatcatggaccctcccttagctatctattcctcgtacaactgatagactctttttaacttctgttcaagctgttcaaaatgaataaaacgcgcttctcgtagacattcggttccctcaataaacaaaagaagcacaggaactgtgaagactgaaaacctgccggcaacctcttccactatgtcagcatttatatgtcctaatttgatctttggaaagcgggccaacagtgctctaagctgaggcagaacagcgtgacagactgtgcattgaggtcttgatatatatataaaacttaattgatgatcagttataaatttctcaattgacaccattgaagttagttctgcagcttctttcatccaattcctccttcaagacggtcaatacagtaagatatcaacccaaattttcactgttgtaagaaaaataacgaatatcaaaataccttgaagaactttagcattcactttcttgccaatgaaaacacctagcggggatgcaatcagactggcagccattacaaccaaagccggcataataggcacctgtccaatgacgagctttgtagctgttgttccaatcgatgaaataaatgtaactgcgagtgatgttgcgattgtgattcgtgcaggtatttttataatgactaacatgagcggaacaagcagaaaagctccgcccgcaccgactatacctgaagccaaaccgaccacaaaagtcatgattgaggttaatatctttggaaagcgaatgtgatcactttgattaccttctgttcctgtctttggaatcaacatgatgatggctgcaatgatcgccaataatccgtaaaccatgtttatggcatcttcggagaaaaaatgtgacccatagccgccgattagacttccaagcaaaatacttaaccccatgatgaagatcagttctttatttaagtaaccgtctttccggtaagcccacacaccggaaaatgcagcaataaaaacctggactgccactatacctgaaacctggtgtgcgttaaagcctgtaaaccctaataaagcaggtatatataatagcaacgggtaattaataattgctcccccgacaccaagcattccggacataaaagagccaatgaatccgatgaaaaatataagaagaataaaagatatgtccactacctttcctcctttccatcaataaaaagggggaatagcccccttttatcacatttaaccttttttaagccaaaactttaatataccatcttcctctgtatctttaagcaactcatgaccgcctgacttcgcccatgctgttagatcgctttttgcccctttatcagtggcatgtacttctaacacttctccggattgcaattcatccatcgctttttttgttttcacaattggcatcgggcacgcaaatcctttagcatctattactttatctgatttcattttttatctctccctatcttcaaatctatattcatccatgaaccgcacaacggttcggtcccatttccatctcgctttgcctgtcagcatcaggcattattttgcccatgttggtttgacggatttcctgatatgcatttggctgtggcggcagattttctgatacagcccctttgaattcattttcatccagatttaaaccggcattctttttatataaatcactcagcttagcttggacttgcccctgatcgcctaattcactgactgtcgaaaagtgagctggaagaacaatcaagtcacctgatatttgtttgtattttacatacaatgtgttacgcaaatcctctgcccaatccccggcttttccagctaagtccggccggccaatcgattcaacaaataaaatatctcctgttaacaaatagcgattatcaatcattaaagaggtgctaccaatcgtatgtccaggtgagtaaataggttctgctttcatacctgcgcttcctacagaaatattttcatcttcaactagcggttcatatgaaaatagcacttcctccgcatcttttggcggcaggtagtatgcagctcctgtacgcttacgcagtaaacgtccgcccgaaatatgatccgcatgtaagtgtgtatcgaccacatgtttaatcgtaacgtttctctctttcgcaaaatctatatatgcatcaacagaacgagcagggtcaactacaattgcttctccgtcggtttcgataaaataggataaacagcctttccccattcttacgaattgatagatcgtccctccttctttcaagtctccgattttgactggatgtaaaaatttgctccacgccttcataccgcctttaagtaccagcactctttcaaaaccggcatccactaaatgctgtgcaaccatctctgaagacccttgtttggcgcaaacgactagaacatcttgatctttaggaacttggccatcaattttttctataccatcaattaaatcaaaatacggaacatttaaatgttcaacccggcttccctcgattttccaatcactaagggcctctttatttcgtacgtctaaaataaaaaatgattcttttcttaatagcttttcagctacttcttttggtgaaacgaatgtaaaattcacatttaaacctccttaaaatgttagagcccaaatggcatcagaacttgttgcaatgattgcaacttttacggccattcaaatcattcctccaatttttcttttattgatttttttcaacagggcctgaccactccgccataccttggacaacattttcaacatctttaaagccattatccgcaagctgtttagctgccagatcgcttctattacccgtacggcaaacaacataaattttcccgtctctattcagttcgtgcgctcttttttcaagttcacctaatggaattgaaatcgctccgggaatatggccgaaacggtattctgcaggttcccgaacatcaactactgttagccgctcgcccgcctctacctttttttgaagctcttcattttgaatcgtataaggaaacgtttttactttctttatttcagagtgacccgcttttcgaagataatgctttaatatatctccgtcttctgttgtaccgagatactggtgaccgcttccctttgcccatgcccgtatatcagcaagagaccctttatcagtagcatgcacttcaattacctgccccggttttaactcattcatggcttttttcgtttttacgacgggcattggacaagcaagcccttttgcatctaatacgcgatcagttttgatgttcatcaatcatccctccatattcattttctgttttatatcactgttccatttggctgcttcaggatttcctgttttgcattcccgaagaagcaaccgttcaatttggagattatataaataaattcacctttgcttcgttggcatcgcctagataagcggcaacacctgcataatcaaggccgtcgatgagttcttctttttgcaagcctaacaagtccattgtcattgtacaggcaacaagcttaactccttgttcttgcgccatttcaatcagttgaggcagagacagtacgccgtgctttttcatgacatgtttgatcattttaggcccgataccggcaaaattcattttagataatccgagtttctttgaaccacggggcatcataaagccgaacgctttttcaagcggtcctttctttactggcaccggttcatcttttcttaaagcgttaagcccccaaaaagtatgaaaaactgttacctcatgatcataagcagcggcgccatttgcaataataaaagcggcaatcgccttatctaggtcaccgctaaataaaacaatggtcgttttttctttttggtctgacatataacaactctcccacttttgtatacttatacccgtacaggtatataaaaactaaaaaaaatataagtcagctttttataccctaaagggtataaaaacagcaaaatttcttttaaccaggggtatatagaggctgtatcataaacaacagccatctaaacattatctgcttttaaccaataaattaacggcttcttggatgaggtcttcggtatcttctcctctttcaatttgaaggcggacgcatttctccaagttactgcttacaacaacaccgatggcccgatctaatgcagaacgaacagctgacatttggcttacgagttctttacactcttttccttcatccatcatctttaatatccctcgaacttgaccttcaactcgtttgatcctattttttaattgatcatcgtattccatcacataacctcctatttccttatgatgatgacatatccttcaacttttccgcaaaccgttactacgcagatatgaactgtcctgcatttctgtcacattcgttaagaccagtgatggctttttgtccagacaagctttatcctaatggaccatcgcccgcctatacatatacccctatgcgtataatactgaactgctgaggataaatcaaatttttagttctgcaaaagtataataagcgccatctttaaaaacaaaaaaacatcgacaaaagaagtcaccgtcggccgtttcggactgaattaagaaaaaaagcgcagtgcgaaaccgcgaaggagcttagatttcgcgaacccgagaaacgggcgttgatcgaaaatgcatgatgagttttaccgtccagagaaaaagaagtgatgaaaaaagccgggtcattttccggcttttcctatttcattttaaaaaaacaagaaatcactttatgctgctggatataaacattgaagcatcttgattcataaaaatacgccggccgtgaaaaaatgtcttcatttcagttgatttaaatccaacatcggataatctttttttcaattcttcgtgcgaaaaaccgttgtgaactttcggatgttgtattttgtcatttttgtcaaaatcaataattatgagcttgccgccatcatttaaaatgccgaacagttcttgtaaaattttatttgtatccggaatatgaagaaggactagtgacattaaaacgatgtctgccttcagttcaggagtttcttgggtgaaatctgaataaagcgtctttgcgttggcgattcctttgcgagaaattttagctttcgccacctccagcatttgtttggatgaatcgaccagcaaaatagaatgtactaaatctgataattctaaactaatgagacccgtaccgctcccatagtcaattaaagattttgattgactgtttcgcaattccggtcttacttcattcacgatcactttagctaattcaattctttcttctgtatcatatcgctttgcgatctgttcaaaaacgttattttccatattccacttcctatttatttttagatggtttactgaaaactatgctaacaccttacatatttccgtttgaaaccgagacggcctctatcaatatctttttgaatatttttggaagcattcaggatactgctttttttcttgccccgcctgagttcgaccgggcctactgcttttgcggtttcaaccgccttttcatgaagcggcaaatatgaaatcccgactgtgtagataaaatgattcatagccgattttgttcgatctggagaatcgtgaatcgtacgttccacctgatcaagcatactggcaattttagctacattaaattcatcgtccggtcgattacctaaaagccagcagtaacagctccagcctgccgacattttaagctcttcaccgcttgagatccatttatcagcaacagcctgcgcaaaatcggtttctgccaaagttacggcaacaacataatcagatagcatatagaaatacgccgcatctatccaccgctcaaaatccgcttcagtcattgtcattgggtcagcaataatgccggcaaaatacatggcatcgtagttcccggtagcgtaaagctgctccgccaagggctgatttttcttgattttctttgcgagcggcttcattttgcctgtagccacgccaaacagcggttcgtgtgcaccattcgttatgtatctttttttcatgttttccgtacccagcgcttccagttctttcataaccgtttcaagatccatgctttcacttccttcttaaattaaattcattactttaactccattatcatgctctttcacttcatctaatcattacaaatccactttatttgttttaatgctctccatcaacggctacatcagcatgaaaagatcagttgccatgtatgatcctcatcttttttagcggttgttttgtttcctaagtctgatcaaaactaaacttcctctgcatatcatttatgtttattatatgaaacatattaacaagcagaaagggggtgtttttgaccgccttttctcttcatgcgtcaatttcgaatgccaccgatatttgcaaaaagaagactcttaaaaaaagagtctcctaacttgatcaataaaacgagccaaatcagctgatcacagcttttgttttttcaggtatgttttcatacatccattttgcatctggaatcgcaagcctgatacatccatgggaagctttttttcctaatttttttgcttccttttaaatgacttttttatctttgttgaatggtacgctatgaagacgaatttttatgggaaagaccatcagatcccattaatcggcggcacgttttataaacctaatcttcagaacatttatcaatatgaaccggatttggtgattgggattggcggtgttcacgataccttaagagacggaagtccgtcttcgagcggattacatatggacctgctcatttgcagctttcattttttcttccatttttttaatgcatcggcagaattttggcggctgttttcgtttatctattaagcgcttataccaagaagatgtcgtctgtctttttgttaaacggcatggttaatttcagcggtattgcaagctgtgacttcatttattttacttagacatcaagaagcgcttggaagcattttattgtggacgatcggatcactgaatggaagggtttggattcacttgaaccttttatggccaattgcagttcctgcgctcattgcgggattgttgacagcgggaatcgcaaatgcctggaggctggaacagaatcagctgtgctcctgggcctttctttaaagaaaacaaatgctcttttatttttcatctctgcccttttaaccgcaggggccgtttcgattgttggagcaattggctttattggtttaatcggccctcacattgccaaacttgatcgttggagaggatgcgagaaaaagtcctatcatttccaaatctattaaagaatttagattggggagtttttcatttataaatcggttaaataattgtatattatttgattgtccaacaaacaggccagaagttcatagccgtgagctccggggttttggattagcaagccaaggataagtaagggaattatggtttcatcaccatcgccatccgcgcctcgaattccgcgtacgtgattttacccgaagccaaatccatgctgtgaaggtaaatctgttctgttttagaatagtcaccattcactttcagtgattgctcctctcccgaaatgggtttcaggatatggtactttttcgaaaaagcctcgaaatagcggtaaccgaatttgcgttgtgaagctgcgtctaaatgaatgccatcaggattcgcagtcaaacctgccgcagcaacaaaataacaattctgttgttcattagcaaaacgcagcaattgttcattaacctgtcgaaattcggtcgcgtgctgtccaaaaccggtcttcccaagaaagtcaccaagccctccaataatcaacggtacctcatcaagtttcaactcgtttcttagcgtctcgatgataagggttaatttctcgtaataagtttcatgtagcgaacgataactgtcactctcaccctggtgccaaaggattccacaaatttgactggagcggagggcgaagcgggcttcggccaaagcatgctgaaaaaggatgccttccggatgccagtcattcaatgaactgccaccttccgcacaagggatcaagccaatttcttcatcgggatgagctttcgaccatgcatctgcaaaagatgccgccaggccaacgccggaaaccggacggtcgtaattaatcggctctgtcatcatctgccactgcccattgcgcagcatttttattttttcattatagatagggtctacttcattcaaaaatccacggcctgccatattcgactgccccaacattaaaaaagactttatcatctaattttcacttctttacatcaatattttggtctaattagactatagtcaattcagtttgtcttgtaaagttttaacaaggttttatttattatcagtatgtatgaaaaacaaactaatatgaaaatttggtggatatatttgtgaaatagcaagttcttttgcttttcttattcaactatcgggggctttagttgaataacgatcttccacaatcgggcgcgattattgaacaagaactaaaggagttatacatattagtcatgtaaaatatatataactccttattttttatgactttttttgatttaggtcttgataaataacgaaatttctcgtataaaaatacacaattagatgaccgggtgtattgctgaaacatacacccggtcatctttatgcagccttttcatttactgctttgaatgtgcaggagttcttcaggaaagcggtcaacttcccctgcctgccctgcaaggaaaaacgatcaatagatcatcctacaatattaatctgaatccccttcctttttttgatctgtttggtttggaacaggatcaaagcctcccggatgaagagggtggcatttcagtaatcgtttaataagcagataactgcctttgataaacccgaacctttgaatcgcttcaagcccatagttggagcatgttggataaaatctgcaagtcggcgggaaaagaggggatatcgccttttggtagaatcgaatgaatatgatcgctgcccgtttcatgattcctcccgaagaaattttgctatatcttttgcaaaatatgtaacaataagatccgcaccggccctcttcatcgcaagcatgctttccaacactgtatttttttcgtcaatccagccgttttgcgatgcggcttttatttgggcatattctccgcttacttgatatgaaaccagcggaatctggagagaatttcgcatatccctgatgatgtctaaataaggcagaccaggtttaatgcttgttcatcacggccttctattagatcgaaacgtaataatggcatttgcttatcccctttttgatcattttaaatttcgttagagaaataagaggttttacctgtccctgatcaattgtttcgcttttggtacaaagaatgatttctgctaacttgataaaaacataacacataatcaaaatatatccaataattgaccatatgttcatcataatagaagatacaagagctatatcattaaaaatcagctcgcacccaatctttaggtgattagtatataaacaacactttatcaaaatgtgacaatgatatgactatcagcactctacttatttcttaaagaaagcacaagctttctcaacccgaatatgattaaagcagcaacaataatgaaaggtataaatccaatcaggctaaaacttgtaagcatgacaagctcctttcctcaatgtccaattgatttttcattttacgatattcacattttaaaatcataataaagatgtaaatgttatgttaaaaaccggttggtatacaaaaaatcaccgtccgagatagcggatggtgattttctttacatgaaggtttatttattcaagatttgcatgatttgcgtacatgttatgagtattcagcccttttatttccattattcgcaatatgatagcatcataaatcaataaaagagtctgttcaaaaagcgatcccatcggttgtatagtctgtttactgcccgtcgtttgatccttgggtgaacccggcagctgcaggatcagatcagctatttcagcgattggcgaatctgaagaggtcgtaactgccgctacagtgcctccgatatcttttgccttttccgccatatgaagcaaactttctgttttccctgatcctgtgcccacgataagcaagtcgttttcggtaaatgcaggtgttacggtttctcctgttacaaatgcattgatacccaggtgcattaatctcatagcaaatgacttccccattaaaccggaacgacctgcaccgtaacaaacactttttcagaagacatgatactggatatgaagttctctattccttccgcttgagtttgagacgttgcatgatcaagctctgcgatgatcgcttttacataatcatgggtcttcatgattgctggatcatctgcttcatttttgcggctgccgcagctttatcatcttgatttgcaataccgcccccaacaataatcaaatcgggctttaatttaacgacttcgggcaatgtgtccaatttaattccgcctgcaatagccgttttagcgttttttactacattcttaatggtcattaagtctgcaaatgaattttggccaatggcttgaagatcataacccgtatgcacacaaatataatccacaccaagtacatccaactcggcagcgcgtgattcgatgtccttaattccaatcatatccaccaggattttttttccttgagcttttgcctcttctacagcgcctttaatagacatatcttcagcggctcctaaaatggtgatgatatcggctcctgcttctgaggctttcattacttcatacccggccgcatccataattttaaggtctgccagcactttcaaattcgggaaagcatctttcatctcttttactgcacgaaggccttcatttatcacaaccggcgtaccgatttctacaatgtcaatgtattcttctacttcttttaccactttgattgcttccggtatattgactaaatctaatgctaactgtaattccacttaacgtcacccctgttaaattaagaattccgcggatgattctcttttgatatttctgttacatcaaaagtataacaaggggaaaatgcctttaatagtacgcactttttttttacatactatacttttcctcatatggtgtagaaaaagatactgtctctagaacaatatctcaaagtcaattattctatttgtcatcttttgaaaagttggtttctatataatttttaccccactcatacatcgcctctaatataggcattaaactttctccctgttttgtaagggaatattcaacttttgggggaacaaccggatatacttccctatgtacaatatgatcttcttccaattcacgcagctgattcaccagcattctttgcgtaatgccgggcatcagggcttttaattctccgaatcttttcgtaccttcttttcctaaaaaccacaaaatcagcattttccactttcctccgataatgttgagcgtcaactccttttcacaattaaatgttttattctccattcgtgacatatgaattcactccttatctaaatgactaatatatgatcatcaattacatcattgtaaaagaactttgtttcattaatcaatcatcgcacgttttagccgttccttaacttcacctgcttgccaccttaccatgcggagttgccccatcatgatattgtcaatcttcttatatccattcgagttaaggaaacatgacaagtgtcatgtttgaagcatgatgtgtgctactacaaagacatctctctgtgccgtaaacttaatttaagacctatttatgagaggataactttactatgactgaacaaaccattgcccataaacaaaaacagttgacaaaacaggttgctgcgtttgcacagcctgataccaagaacagtctgcttcagcttttgaatacgtttattcctttcttcggactgtggtttcttgcctatttcagcctcaatgtctcctatctccttactttaggaataacggtgattgccgcagggtttttgacgagaattttcattatttttcacgactgctgccatttatcctttttcaaacaaaaacgccttaaccatattctcggttttttgacaggcgttctgactttatttccttatcttcaatggcagcacagccattcgattcatcatgcgacaagcagcaacctggataaacggggaacgggtgacatctggctgctgacggtaaatgaatataaagccgcacctctgcgcacaaaaatcgcatacagactttacagaaatccgtttatcatgtttattctcggaccgatttatgtctttctgatcacaaaccgctttaacaaaaaaggagcaagacggaaagagcgtgtgaacacatacctcaccaaccttgcaatcgcggcattggctgctgtctgctgcctgatttttggctggcaatcatttttgctcgtacaaggtccgatctttctgatctcaggttcgatcggcgtttggctgttttatgttcagcacacatttgaagattcttattttgaagcggatgaaaattggagctatgttcaggccgctgtggaaggaagttcgttttataaactcccgaaactgcttcaatggcttacaggcaatatcgggtaccaccatgttcaccatctcagtccaaaggtgcctaactataaacttgaaaccgcacatgaacagcacgaacctttaaaaaacgtcccgaccatcactttgaaaacaagcctgcaatcactcgcgttccggctttgggatgaagaaaaaaagcaatttgtaacctttcgggacatgaaacaaacatcttcccatccttcgccggattcaacgaaaaaacagaagctgcggaagaacgcctgacgataaggaggtcttcttatatcaacaagaagacttcctttttattgtccgatgatgcaatcaggctccggcaatggtaaagttactctaaagatgaaaagctgaaaatgaggttataacatgttcaaaaaacattttacatttcaaaaactgaacgggatctcgccgtatatatggacaatatttttcatccttcccttctactttatcatgcaatcatcatctacacttgttatcgtcgtcggcatcattttgacgcttttattttttgcggtatacagatttgcttttgtctcaaaaggctgggacgtttatttgtgggcgtttattttaatcggcatttcaaccgcttcgattatgatgttcagttatatttattttgctttttttatcgcatattttatagggaacattaaaaaacgggccccttttcatattttatattacgtccacttaataagcgcagccgtcgctgccaacttcagtctcgtgttaaaaaaggaattttttctgacacaaattccctttgtggtcatcaccctcatcagtgcgattttattgccgttcagcattagaagccgcaaggagcgtgaacgcctggaagaaaagctcgagtatgctaatgaacggattgccaatttggtaaaattagaagaacggcagcggattgcccgcgacctccatgatacacttggacaaaagctgtctcttatcggtttaaaaagcgacttggcgagaaaattaatttacaaagatcccgatcaagccgcgcgtgaactgaaaagcgttcagcaaactgcgagaacttctttaaatgaagtcagaaaaatcgtatcctccatgaaaggcatccggctcaaggatgaaatcataaacatcaaacaaattcttgaagcagccggcattgcgttcatctatgaagaagataaattgccggaaaatatctcattgcttaatgaaaacatattgagcatgtgcttgaaggaagctgtcactaatgtcgtcaaacacagccaggctaagacctgccgcgttgacatccagcagctctggaaggaggttgtcattacagtgactgacgatggaacgtttcaaggtgaagagaagtgcttttcaaaaggacacggcttgcttggcatgagagaacggcttgaatttgcaaacggaagcctacacattgatacaaaaaacggcaccaagcttaccatgtcaattcctaacaactcaaaataaaaaaaaaggatggcttacatgattagtatatttattgcggaagatcagcagatgctcttgggcgctttaggatcgcttctgaacttagaagatgatatggaagtcgtcggcaaaggcactaccggacaagatgccgttgatttcacaaaaaaacatcggcctgatatatgcattatggacattgaaatgcccggaaagacggggcttgaagctgctgaggaattaaaggatacaggctgcaacattattatcttaaccacttttgcccgccccggctattttcagcgagccattaaagcaggtgttaaaggctatttgttaaaggacagcccaagcgaagagcttgcgagcgccatccgcagcgtcatgaaaggaaagcggatctatgcgcctgaactgatggaagacatgtacagtgaggccaatcccctcacagatagagaaaaagaagtgcttgaacttgtggctgacggaaaaaacacaaaagaaatcgcccaagaactcagcatcaaaagcggaaccgtacgaaattatatctcaatgattcttgaaaagcttgaggtgaaaaatcggattgaagccattactcgttcaaaggaaaaaggctggtttaaataaaaagaggatcttgccatatgtccaagatcctctttgacgaatcagccgctcccgcgggtgaaaaatattccttatctacacgaacatcttcttgacaagctcgcggttgcgctctttgaaaacctcattatgcgacgacaccatcgcactcttgtgcgcttcgggatcgataaatcgcttggcgctgttgaccgcgtttgccgcatcttgaaacgctccggcgatcaggtgcagcttgccttcgtaatgcacaatatcccccgccgcatacagaccgggcacggaagactggcagttggaagtacctgcaatataatagtcatccactcgggtaacatcaaggcggctgttctccagaagtgaggtgtcgcgttcatatccgtggttgataaccacctcgtcgacaggcagttccatcacctcacctgtttgagcgttcgtgagctcgacccgttcgatcacctcatgatcttccgaagcgatcagcttggtaatctctgtatgaaagaagcagctcaccgagctgttcagaagctgatccacctgggcctcatgcccgctgagcgcatctttgcggtaagcgaggtagacctttttcgctacaggttcgagttcgttggcccaatcgacagccgaattgccgccgccggatacaatgaccgttttatctttaaaatgctgcagtgacttaaccgtataattcagattggacacttcaaaacgctctgcgccttctatctgaagcttttgcggattgaggatgccgccgcccacggcaacgatgaccgtcttggaaagatgcacacctgaggcagccgtatgtaattcaaacaacccttcttcattgcgggcaatcgattcgactttctcattcagcagcacttcaggatgaaacgttaacccctgctgcaccagctgttctatcagcttggctccggaaataggcgttaatcccccgacatcccagatcattttttcaggataaacgtgaacctttccgcccagcatcggctgatattcaataatctttgccttcattccccgcagtccgctgtaaaaggcggaatataacccagccggacctccgccgataacggtcacatcaaacaattcatttctgctcatcgctcttcactcccggtatatgtcatgagttcacaaacaccaaacgcaaatgattatcattatcattaagtgtactttgattgctccatttttacaatccattttaataaaaagttcatgcttcgcccacttcgattttgccgcttccccctttccgctcgttcttcatgggttgccgccgctccctattccgcagcatttagatagttcctatatcttacattgacaagggtatgccccctgcataaaatgaaaatgattatcaacttcatttaggaggaaacaaagcatgatgagcggaaggattagtttgaaaattaaaattatttttatattaatgctcgccttttctattttattagccggatgtacaacctcaggaaattcaacagagaaaactcatgaaaacttggtcacaatggcttggcctagagatataggcgaaatgaatccgcatgtgtataatccttcccaattatttgcccagtcgatggtatatgaacctttggttacctatgaagcgggaggaaagcttaaaccgcatttagccgaatcttgggatatatcaagtgacggtaaagtatatacgtttcatttgcgtaagaatgtaacattttcagatggaacgaagtttgatgcgaaaattgtgaaaaagaattttgactccattttaaaacatactgaattacatagctggttagggtttatttcaaaaatagcccaaacagaagtgatcgatgaccatacatttaaattaaaattgactgaaccatactacccgaccattcaggaactagccgttgtacggccggtccggtttttgggagaagcgggcttccctgaggacggcgatacatcaaagggtgtcgaaaaaccggttggtacgggcccatgggtattggaagagcataaagctgatgaatatgcggtttttaaacgcaatgaacattattggggtgaaaagccaaaagtcgagaaaatcaaagtgaaagttatcccagatgccgaaacaagggtgctagcatttgaaaaaggcgagcttgacctcatttacggcgaaggcgttatcagtttggatgcatacaagcagctgcaatcgacaggtcaatatgaaacaagcctttctgaacccgtggcgacgagacagctcgtcatgaatacgaaaaaagaacagctttctgatgagcgcgtgcggcaggccctgcaatacggttttgacaaagaagccatggtgaaaggcatcacctcagggttagaagaaaaagcagatcatattttgccgacagacttcccatacacgtctgatattgatgtaaagcaaatcaactatgatacagaaaaagcaaaagagttattagatgcggccggctggaagcttccgaatggcaagaccgtgcgcgagaaagacggaaagcctcttgaatttagtttaatgtatgattcagctgaatccattcaaaaaacaatggctgaaacgctgcaggcagaatgggcagcgatcggggtaaagctgaatcttgaaggcgtagaattggcaacccaagtcaaacggtttaaggcaaatgagtttgatatgaacttctttagcaactatggtgcgccttatgacccgcatacatttttaaacattgtcgcgtccaaaggattcggatttaatgaagcgatctcagcctatccaaacaaggacgagctaatcaaacagatggcaaaggtgcctcaaacgactgatgaaaaagagcggcaggagcattactcatctattttaaaatcacttcaagaccagggagccatcgtacctgtttcttacattaaaaagacggcgatatatcaaaagaatatcaccgactttacgttccctgctaaccgtgacgaacatccatttacaggcattcgcgtcaagcagcaacactaggaggcttttatgggcaactatatattgaaacgaatcatgtcgattattccagtttttcttttagctgcacttctgacaactggaatgattcatctctcgccggttgacccagctgaagcatacttagccgcagcgcatatccagccaactgatgaaattttagcgcaaaaaagacatgagtttggcttggatcagccattttttattcaatatgtaaactctgttttgaagatatgccagcttgattttggcatatcttatgtttcaaaccagccggtttgggacgaagtggcacaccgaatgccggcaacggtcgaacttgcgcttgggagtttattgattgcggtgcttgtcagtgtgccgctcggcttcttagcgggaatcaaaagaaatggtgcagttgatcatatcagccgcttcatttcctttttcggggcatccatcccaactttttggttagggtatatgctggtttttttcttttctgttcaattagaccttttcccggtagagggcgctgggacatggcagcatctcgtactgccgtctatgacattggcgcttcctttaattgcgatgtatacaaggctgctccgtgcaagcgtcatcgaaaacctgcaggaaccatatgttcaatttgcacgcataagaggaatagcgaagttgaacattatggccaaacatgtattgcgaatggccatttctccgatgattacgggtctgggaatgaatcttggcaagctgcttaccggcacaattattgttgaagtcgttttttcttggcccggctttggccgttattttattgaggccattttcaatcgggacatccctgtcattcaatgctatgtgttcttagccgctaccttttttatattgagcaacttaattgttgatctcattcaaatgtatattgacccgcgcatttcaaggaaagaagggcagcatcgatgatgataagtatacgcaggatattcaaaggccaaaaagtgattacggtatgcaccactatattaaccatcctttttattatcgctgtattcgccccttggattgcgccgcaccatcctgctgatgtccatatggtatataagctgcagcctccatcctgggaatttcctttaggaactgatcatctgggaagatgcaacttatcccgccttttgtacggcgcccggatttctttgggattcgcgatgcttattttcatttcctccctcgttatcggcctcattgtcgggacgatttcagggtataaaggcggctggattgaccagctgttaatgagatgctgcgatggtgtaatggcctttccgaacttaattttagttcttggcctcgtgggcattttcggccccggacttcctcaagtcattctggccctcatgcttgtgcaatgggtctattatgcgagaattttcagaggaatggtgctgagtctgaaagaggagaactttattgcggcggcaaaaatcaatggatcttcacaatggaaaatcattaaaaatcatatcatccctaatgtcctccctcccctcgtcgtcatcggtacgttggaaatgggctgggccattatggatatctcggctatgtcttttctcggcttgggcgtccagcccccggcggctgaatggggagcgatgattcatgaaggtaaatcgtatattcggtcgaatcccgagttaatgatttatccaggggtgatgatcatgattgtggttgtgacattcaatttattgggcgaagccttatcagatcaatacggtgtcaaacgtcgattttaaaaaggaatgaggaagttgggaacagaacaatcaacggtgcttcgagtcagagatttgcatgtacaggttaacaaccaaaaaggacattcaacccttgtgcaagacatcaattttgatttgaagcgcggccaagtccttggtctgattggtgagagcggttgcggaaaaacggtaacaagcatgtctattcttcagacgcttgatccaaaaacaactaaggtggaaggaagtattgcattgcgaggccgtgaattgaacggattagcagataaggaaatgcgtaaaatccgcggcaaagatattgcctatatcatgcaaaatccgatgaacgcttttacacccgtttttacgataggacagcaaatgaccgaatcgattcgctctcatacatcttttagcaagaaacaggcgaaagagcttgcgaccgaagcattgcatcatgtgaacctaccccaccctgctaaacttttacattcttatccttttcaattaagcggcggaatgcttcaacgggtcatgattgcaattgcatcatgcttaaagcctgccattctcatcgcggatgagcctaccactgcgctcgacgtgtataatcagaagacggtgctgaaatatttagacggcatgcgttctgacttcggcacggcgattttgcttatatctcatgacctcggcgttattgctgaaatggcggatgaagttgctgtgatgcagaatgggagaattgtagaaaatagagatgtgtttcagctgtttgatgaaccaaagcatgaatatactaagaagctattaagtgcacggttgacattgccggtggatcaacttgcgacttgagtcagtatgaggaaggccggcatttgagatggggtgaacaagtgagtttattacaagtgaaagaagtcactcatcattatacagcgcgcaaattattcaagtggaaaattcaatcgaaacaagtcctttccaatgtcagcttttcgattgaggaaggcgcatgcttaggcatggttggaccgagcggagccgggaaaagcacattgggaaaagtgatgcttggtttggagcggccgcaatcggggcaaatcttttttcaaggacatgatctctataaagcagatcagtcaatccggcggaaaatccgccgcgaccttcaagctgtttttcaagactcctattcttccgtcaacccgagaatgacggctgaacaaattctagcagaaccgctagaaaactatgaaaggctcacaatcgctgagaaaaaacggaccattatcgagctcttggaaagagtaggcttaactgaaaaggatttaacaaaatatccgcaccagttcagcggcggccaattgcagcggattaatattgcaagagcggtctcgctcaagccgaagctgatcgtattagacgagtctgtcagcagcctggacatggtaacccaaacgcttatattgggtttattaaaagagctcaaagacgatttcggaatgtcttatttttttatcacacatgatttaaaagccgcctatcaattgagtgatacactaggtgtattagaccacggccaattggccggactttacgataaacatcgttttttaaagtcagaccacccggttgtacaagaaatgaagcgttccatactggcagaacacccgcgctttcgttcgatcagaacaagagcggttcggcaataaattagccgggagctttcctgaatgagcttctttaatcaaactgtatacagatttttttattcgcagtgaaaaaaatatggcaaatgagggcttccaatgatggagccctcatttatttttaaaaatcctcaatagattggtttggcaaaaagaattgttttgcatcgaacagattgcttagggatactgggcctccttattgaccaggcatgtattttcacctaatgtcaatagtagacttaatacataattccgataaccgaatagctctgtatttggtgatatcactaaaacgaacagatgaggtgaaacatgatgaacaatcgattccgtgtaggagaagtagcaagacttttcaagctgcctgcatcgactctgcgttactatgatgaaatcgggctgttcaggccaaagtataccgatcctgaaacatcttatcgatattatggtgttgaacaatttcagatcctggatacgattatttttttaaggaaaaatggattttcgttaaaagatattcagcatcagttagatcaaaggactccggaaacaacgatggaaattttgaagaaaaagcttgaggaagtcagagcggaaatttttcgtctccaacgcaacgcggcgagaatcgagaacaaaatttccacaatcgaagaaggaataaaacttgccgaacatcctgctttaacatttcagtatttcccaaaacgggctatttcctacctgtattttgacaagcctgtcgacctgatggaggaaggcgacgacatttatttaaaggataaagaaacgctttcaagccagtcgattgagaataacggcttcttcaccggagacattggaacaatcgttgatatggagagcttgaagcaagaaggaccggtaaaatatatcggcgtatttgaattgctgcacgaggaagacagtgaagactatttaaacgaagggttgtatgcgagttacccccatattggtccctacgaggacatcaggaaaagttatcagctcgttttaagccagctgaaagagaaggaatacgagctggcgggaatccctgttgaaatctcatttcttgatgatgctgtgatcaaggagtcagctcgttatgtcactttaatccaaattccggtaacaaagagttttgattgaccttcaagtaacttgaaggtttagaatactcctgtagctcattataggaggaatacatgatgacagaaacacatcagcagctcatgaaattaccagtaaatcaagtgttttttaaatatttcgtccctgcaacgcttggattaatcctgatgtcagcgaatattttaattgatggcctgttcgtaggcaatggcattggaaccgcagcactggctggagtgaacctttcctatccggttatttcactcattatggccatcgctctttggattgggataggcggagcaacaaagtactccatcagcatcggggagaatcgccccaagaaggccagcagcattttttcattggctctcttcttggcgcttatcatcagcgtgcttttaggagtattcgggattctcaacattcaaaccatttcgatatggcttggtgccaactccgacacctcttcttttgtcatagagtacttaagtgtcatgtttttattcggctgggtcattacattagaacaggtcttaagtatttttgtaaggaatgacggcagtccgaagctttcgatgatggctcttgcaacgacatcgattgtgaatatcattctgaatttttatacgatcatgattttggacatgggggtaacaggcgctgcgatttcaacggtgcttggcggattcgccggactgcttgtattatccctgcacttcttcaaccgtcaagcgcaactgagaaggccggcgtttcagtggtcttggaaatcccttatgcacatctttgccatcgggtttccaagctttctggcagaggccgggctcctcgtatttgttacaggatacaacttggcaatggcaagcctggcaggcacggaaggagtcgctgccttctcggtcattaactaccttcacgggttcatgttcctgtccttcttcggcattgaaatggcacttcagcccatgattagctattatcatggtgctgaagaaaccgaacaaatcaaaagcagcatgaagattggggagaagaccgccgtaatcctgggcatacttttgctcgttatcggctggggggctgccccattccttgtaggcttattcggaatagaatcaaccgaaatccagcagctggccatcgatggaatccgcctgttttttatcggctataccttccttggctataactttgtctatatgagttactttcaatctattggccgggccggctcatcggttgttatcattatattgcgaagcttcgtgtccctgttcatcctgctttggattttgccaaagtttattggcgtcacgggagtttggctatccttgccgctttccgagttttttgttgccgtcctcctctttttcattgcaagaaaacatgtgatgggaaaaggaaatcccgctatcgggaagggatgattttacagccgggagattttccccgcttgttgtcctatagaacttaatttgtccattcaaggaaaagaaatgtttgtgctgtttgaatcccctcctattcgaaggacatgatagattaaaggcgcctgcctgtcacagccttcgtacgcatatggcgggctgacacgttcggcgtgatcggcaagttaaatgtcgctctttgctagttacagatcgacaatggttaggtaaagttataactgtcccgccaacaaggctggacagaatgacgaccaaacgagcgaaggtgcagaaagttaaaggagtgctcaagatgtctcatactcgaattaaattcccggcaggattttgggcaggattgcgtcaattaggaattaacgcccctgatgtgcttcgaaaagcccggctgccgctcaccgtgatgactgaaccagttgtcaccgccgcccaatacttcgcgatctggcaggcgtattccgaccttgttgatgacgtttccaaaggaatcatcaagcttgcgaccggctttgagccggcacattaccctccggccgtattagcggcttaccatgcccgtgactaccgcggcgcgctaaaacgaatggcccgctacaaacaattatgccctcctgaaagcctgcgtatcaccgaagaagatgagcactgcgcaatcgaactggaatggttggatgataagctacccggtccgccgctcttgattggcattacactggcatttcttctggaactcgggcgccggggcacaggtcagccgttgacagcgaagtcggtcgagtttgcacacccaatgggcgacatgcaggcgcttgaagcatacttcggctgccgcatccggagcggtgcagctcggaaccggctgacgctgaatcgaggagatcttgaccgcccttttgtctcgtataacgcggagttgctggagattttgactcccgtgctggatcaatcgttgaatgatcagcaaaatagcctttcaatcagcggagcggtcaagtggatcatgaaacgcacgcttccaggagggcaccccgacattcagactgttgcgagcgagttgggaatgagcggccgcaccttgcagcgccggcttactgacgaaggcactagcttcaaacagctgttgatccaagtcagacatgagcaggcgcgggagtacttggcagacccttcgctcgatattaaagaagtggccattctgatcggatatgaagatcagaactcgttctaccgggccttccgcctttgggaaggcgagactccttctaattggcgtaagaagacccggctgaatggatttaactagaataggagaaatgtttaatggatatgggattaaaaaataaaacagctttagttaccggatcgacgaaaggtataggaaaagccatcgctattgaacttgccaaagaaggtgttcatgtactcattaacggacgaaatgaggaagaggcagaacgaacagtcaatgaaataaaatcagcttttcctgacacctttccccaaaacgccgcggctgatattgtggatattaggcaaagggaagctttatttaaaaaacaccctcaaatcgatattttagtaaacaatatgggcatttatgaactgatgcaatatgaggacgttgacgatgaagtatgggaaaaatacttccgcaccaatgtgctggctgcaaacggtttatctaaattttatttgcctaaaatgctgaaaagtgattttggccgcatcatctttatcgcaagtgaagaagcgatgatgccttcaggccagatgcctcagtattgtatgacaaaatcaatgctattatcattgtcaaaaagcttatcaaaattaacaatcggaacagaagtgacagtcaatacgatcatgccggggccgacgctctctgagaatgtgaagcaaatcattgagggaatgtaccccgatgaagggatgactttttcagaaaaagagaagaaatttatgacgacaaacctgcctcaatccgaaatacagcgatttatcaagcctattgaaatcggcagactggctgcatttgtatgcagtccctatgcatccgcatttaaagggtccccgatccgtatggacgggggaatggtgccgactattttttaagattccccattcaagatgtacagccattctggctgtgatttcatcaaaactaaaagcaagctggcggcagtatgcgccagcttgcagcttttgagtgaatcctcttgcagatcagcttctccccttttgctcaactttcaactgaatactgttggatttatagatgatcttcactttatacttgcttggcaatccactggtctcgacggaagaaaatgatccatgacgcttgcggaaggttatgatcgccgatccgtcagccggtacgtaattgtccgtaaaattgagacgcaatgtccctttcaatcttgcttttcccttaattttcaactgatcttttttgccgctgagctgaagttcaagtattcctttagcagattgtttgtagtctccttcgatgatcagttttcccggcgcatcttccttaaggatgcctccgtttagtgcaacatcacctctcccgaaagctgtctccgaaccgccctcaagtgttccttgatcaatccgtgtaccgccggaatatgtattatccccttccagcttcaaagcgcctgtcccttttttggtcagctttccggtgccggagatgtcgttgcgccagcgatcggctgtatggaagccgccttttgcggaatccatggtcacggtaacatttttggtaaaagccccatacccatctgccgcggaaaagagattaagccttccccatccttctcgatcatcaagaacagggtagccggccggaagaccggtagtggctaaaaccgaacggcgctgctttttgtcaaggtaaggaaaacgtgtttccagcaggacttcggctccctttggaactgccattggtttggcggttttgttcatttgtcgaaatccatatgtcaatcgttccgtatattgttttttattcttctcataatcgctgtatctgtcttcagctgtaccggtttgcgttaataatttacggcgggcttcatcaaaagccgttttcttcaatctttcatttgcggggtcagacaggattgctgcagacaaagctgttgccattactcgtccccccatgacgtccagcggggaatgcataccggcaacaatccggttatgaccgagttctgaagcgcgagtcagcagctcctgataacgctccggtatcgcataggccatagcaaaagcgctgagatatgcggcgttcgtgtgtccgcttggaaaacctccgtctttgttcggatcaggattgatgacggggataagcgttggaacaatgatcgaattgtctttccagcgaaacgggcggggatagttgaaatagcttttagccggattcgatgaagaatagttgccgcgtaaagtattgaccaaacttacgacatttccaagttcagagctggtgctgcccgaattggttccttcatcattgtattttctaatcgaggcatctgccggaatgctggtgatcgttgtcgtcgctcccgcgttcattcgatagacgccggcaagcttgccgaggccgtcaattatactgtagctctggctccgccgatcatcaaaataggcagcattttcctcaagcatcgtgcggcgttcagcaatatccacgactttttgaatgttggcatccagcaccctgctgttcagtttagtaccggtattccatgtctttccgggagtccaaagtttattaaattcggaaagcaggccgatgacaggattggattccgccgtcgtattggcagagatattatttttgtaatggtctacgaaaaatccggaagattgcggcgaatctgcagttgttggtttagttgccgggctcgcatcgcttacaatcggggaacttagaagaagtgccaaagtacagacagctatcagtaaatgcttcctcatccttaatcgtttcattctcacatcatatctcccttgctcttaatcttctctcaaaatgcttttcccaatcatcaagttctatatgatcgtatcgtaaatttgttaatcaaatggcttgattttattaatgttttgtttatattttgggaattttcagatcgatgtcttatgagtaagggggtgccaagtgtgagaagaggccgaatttaacattttcggcctttctctgctagtttaacagctgtttatatcctttcagcaagtacatgtaggaagccgagtcggccgtttgatctatttattttccttctctaaaaacgccataaccgcttttgtcagattctgcgcttctgccggtgcatctggagagccgaacatcttgtttaaatcactgtgagataagctgttgacttgatacacaaattccgttgccttcgctttgtttgcggtttccgcgaacttgtaaacggcagggtcttcccagcgggtcacaagataggccggcggcaattttgagttgtttatgtatgagagcggcgatgcttttgtccacaccttttcgtctgtgccaaacacttctttataagacgggatcgcttcgatgaatcgtttcatatccaaggggccatctaaaacaacaatcgaattgagtgcggccggcgtgaggccgacacgatttaaatatgttgaatctgcggcaattaatccggccaagtgtccccctgccgaatgtcccatgacgttgatttttgacggatcgatttgatactcgtccgcatgatccatcacccattttacggccttggccgcatcatcagccatttcatcatactgaacatcgggatgaagccgatagttgacagatacaaaaacatagccgttatccgtaaaaaatgccggcttcgaagcagccctgcttttgtcgccgcttgtccatcctccgccgtgaaggtagatgagaacgggatgtttttcgccctcgtttgactgcggtgtataaatatccaatgtttgtctgtcgtcttttgcataatgaacattttcggcattcctgttagaagtacacgcaaacaagccaatacacagaatcgccaatcctgcccatttgatgaatcctctcaaattaaaaaacacctttcttctttagccagtatattttaaagagcctcacataatattccgggaatgcccatctgtcaagcggtttcaacaggtgccggaacattaacatatgtttctaattataaacagaaacaagaaacttacaaatattaaaatcaataagaaagttaaagctgttgtgcggtaaacctgcgaggaaaatatgagaggaggcattcgtgaaagcgaacctgaataacaatagaagattaagccggcaagaggagtactccccgtcatatcggggagtacgatttttttatgagccttgtgatagagatgaacgtctcatcgtctgatgttctattttcaagatgaaaacattcccataccttctcttgcccaaagtggcagatagcacatcacagctgatcgcaaatcccatcatttaaaaagataatggcagctcttctaaagctctcatcaaaaagttgcctttccatttgatctgctccctttcgcctttaatctctatatgttcaaagcggcgcagcaaggtttgaatggcgattttggcttccaatcgggcaagcggtgcgcccaggcaaaaatggctgccatggccaaaggctaggtggcggttatcctttctttcaatatcaaagcggtcggcattcgaaaagaccatataatcgcggttggccgaggctaatgaaatgatgaccacatcttttctcttaatctcctggccgtgcaatgtaaacggttcggccgcccagcggagggtggttaattccacggggctgtaaaatctgagcgcctcttcaatggctgagtcgattaaatctgcgttttggcgaagcttttccagttgctcagggtggttcagcaaggccaaggtcatattggttattaagtttaccgttgtctcatgtcctgcgacgataagaagcataatcgtcgcatacagctcttctatgcttaatttcgttccttcgctttctgcctgaattaatgcactgactaaatcctcagccggctcgtccctttttttgcgtaccaaatattccaggtattcagcgaattcgcctattttatacttgtattcctccaggctttcgggcgtgtcagaaaaatcaataaccgcctgggaccaaactctgaatttttgccgatcttcaagcggaataccaagcatctcgctgatgacaatgatcggcagcgggaaagcgaagtcgtctacaagattcatggaatgattcggttctacttgatccaataaggaatcagctattttttggattctgttttcgagctgtaaaaccatccggggagtaaatgctttctgaacaagagaccgcaaacggccgtggtcggggggatctgcgttgagcatatgctttgataaaggttcttcattttccagagcggagaagttctctaattcttcttcggtaaacgcattttcgtaattttttttcactcttgcatcctttaatatatggaccgcatcatcgtacctcgtaatgagccagccttcgcccagctcccccatcgatacgggacagacaggacgggaagcgcgtaatcgcttgtaaaattcatacgcctcatctttaaatgctgcagaagacaattctctctcagttaatatggcgaagctctcctcttgttttgaagacatacatccaacctccatctctgtttttgtaaataacagcctgcatcggaattgtataccgaaataatgcgttaggctgttcacatccactcattcacaaatattataattccaggaaaatccacattcaatcggcaatcaagcgggaggtgttcattaatgaacaccttccgcattccttgtatagaaatgagacggagagatgtaaaaaaggaatgaaaacaagctgagaccggtgctatgccgatctcgctataagtaaatttaaaaataaaaaatcctcttagttaacagttcctttttaaggaacggcagtctaacaggagcccttcggttgtccgatcggaatctattcgtttgttgacggcgacgtccatgaaagcctaaagccgtcgcagagttactgattgaacgcttgagcagtttgatcacttgttcttatttttacaacaatatagacaatagctgatatccaaactgcgataattccaatataaataaccggatataatgctgtttgatcgatccacgaatggataagcgttcttgtgttgacgaggatgatcagcccgccgaccagaacgcccattaatcgggcatgcaccttctgcaccagccaggcggcaatcggtgccgcaataattccgccaatcatcaatgcaccaacccacagccaattgacttcttcccagccgagcgaaatgaaaaatcctaacgttgccgaaacggcaatggcaaactcgcttgtgtcaacagttcccactacttttctcgcactgacgccttttttggataacaaaacaggagtggcaatcggcccccagccgccccctccggttgcatcggcaaaacccgcgatcaatcccaggggaacggctttttttctcgaaaggctgatattgtttttttgctctcctattttaaacatgaatagaaatcgaatgagcacatacacgccgagaacaagcagaaacattgaaatataaggtttcgcaagctcacccggaatgttgcttaaaaaggaagcgccgagaaatgccccgagcgatcctgggatgacgagtcgtttgaccgtttgtttatcgacgtttccaaactttatatgcgacacaccagatgccgcggttgtaacgacttccgccaggtgaacggatgctgacgcaaccgccggtgcgatgccgaaggcaagcagcaatgatgacgatgtcaccccgtacgccatccctaaggcgccatctatcagctgcgcaaataatcctatcaagacaaacacaatcagctttttcatgttggcctcccacttcaattggtttatttttattgttaaatataatctatactatgcctacctgtaaagtgcgaattttaaaaaatataaattttttgtatttttcatcgacaccagcaaaaaagagcatatgcatgcaaaatgagcgcctatcccccggtcttttgtcttaatgaaagacagtttatggatgctgcttgcaaaaaatgcatcgtgcagaaaaggcgtcggggagtaacgcctcattcgtttcattggcaatgatgatataatcccccatgtaatgacttcaaaaggaggctcaagccatgaaattcagcaaaatcggtgccttactgctcactttggcgtgtttgcttttgcctttttcttcggcgactgcagcaggtgccggtgtatgggataatatcggcacatacggcatgacgtcgcaaactccgatcatcaaatcaagcggaggggaattttattttcacaacaacagcttttacggctttacatttacgctgtatgaagttgacggggcgggaagcacgcctgaaatcgcaagaaaaaatttctacgtcggaccgaaaagcaacagtccggcgatcgatgtcagcagttttgcagatggtgcgaataaacaagcagaactcgtcctgtttaaagggaatgatacatatatcaccgttacttgttatgattgaatgtcccataaacagcaagcccgccgtttacagccggcgggtttttttgatcaagttccctccttatacctataggcacaaaaaagtgcctatatgacttaaaagtgcgtacttccgttttggtgtcttctgttccataatcataattgatgttttgtttgacattgttctgtttataatgaaaagaaaacggagggatcaatgatgaacttggatttacggggaaaaagagcgttggtgaccggatcgacgtccggaatcggcaaagcgattgccgcttcacttgcgaaagaaggtgcgtctgtcatcattaacggacgccggcaagaaaaggtcaaccaaacaatagacgaattgaaaggccaatttcccgaggctgttcttcaagcggccccttatgaccttggcactgaaaaagggtgtcaaagcctattagcagcattcccggatgttgatattctggtcaataatttagggatctttgaaccggcggaatatttcgagataccggatgaggattggttccgctttttcgaagtgaatattatgagcggggtaaggctctcgcggaggtatttgcaaagcatgatcgagaaaaaagaaggccgggtcatttttattgcgagcgaagccgcggttatgccgtcacaggaaatggctcattacagcgcaacaaaaacgatgcagctttcgatttcccggagcctggcagagcttgcggcaggtacaaatgtgaccgtcaatacggttatgccgggctcaaccttaaccgaaggcgttgaaacgatgctgaagaccctctatccggatgaaaacctgacagtcgaagaagcggaaaagcggtttatgaaagaaaaccggccgacctctatcatacaaaggctgattcggccggaagaaatcgcgcactttgtcacatttttaagcagtccgctttcttcgccgatcaatggtgcagccttgcgtgcggacggcggattggtccgcagcgtcttttaaaggaaaggctggaatgcccggcattccagccacatgatcatcgtttggcataaacatgttggaagactgcggtcgcatcccatgcattcaaaccgaaggctccatcggcaaacgttgaatcccgggcgcttatcaccaattgatcatcaaggtaaatataaaagtttgcaccgcgggccaccgttttcaggtgatatttccggccggtttctatcggtgtgcggtgttcggcaataacagaggccgagccgtcttcaaatttgaaaaacttcaccacgtcatgcttggcatccacattggcaaggtatccgtttttaacatcctgatcggcccgaaacacgagagcccctgcccctcttccatttccatcctttatcgcgacatctgcttcatatgtgaaatctgttgcttttgctgaagataaaatgaacgaatctccttcagagcgcccttgttttccatcaatcgtatcggcccatacaccgtttacggtcgtccagccggtcaaatttgattgaaagggcgacgctccccatacttttttcagaggatgaaccgtcatggaattcagcttgacaaacccgtttgatgcgtatacttctagccctttgctggattggtccggcaaaataatgtcggtgatcacctgcctcccgtcgttgccgaatacttcgactgaagagcggtcgacataaatgcgcatcttcaccttcccagcgaccggttccagcggggccgcatgctttccagtgttaaagttcggattaaaggagacgtttcctgattggctccggtcgacgaacagtgaagcgctgtttttgctgtagccgattttcgtatactcgttttcccctgttcggactttaaagccgaattcggccgcagctccggtatttacttgaaattccgcattgatttcataagcatcgcctgacagccctttcagcaaatttccgtttcgaggcgaaatgatcttgtttttccacgtttgcgatgctccccgtatcgactgcagctccgctaccggagcttgaatcattctaagcccttcggaaaacgctttcaattttacttctctcgggatcgacattgcgcttctccacggggaagtgggaacatcgtttgcgtattgccaattgctcatccaccctaaccaaagccttcgtccgtctgacttcgggatatcagaccagctgacagctgcgtagaagtctttgccgtaatctgtccatagtacgcgattcggcgggttttcatttttaaaggttgttccgtcaaaactgccgacgaaatattgcatgcctgatcctcctgagacagcaccgtctccaacactgacttgcatcacccatttcgtttcattcggcctgccctctacaggaagctcaaacagatccggacattcccacacgcctccatggctgccctctccttcgccgaattcgctcgcatatgtccaccgcttcaagtcaggcgatgtatagatcagaattcgatcgccccccgcaagcaacatcacccacttttttgtctgttcatgccaaatgactttcggatcgcggaaatctctttttcccggatttggaatgacagggttgcctgagtacttcgtccatgtcctgcctttgtcattgctgtaggcgatgctttgcacttgttccccgctccggtcctgcgtataaatggcaacgagcggcttctccgtccctgtttgaaaccctgtagtattatgccgatcggcgacagcgctgcccgaaaaaatcgttcctttttcatccggatacagtgcgaccggcaaatgctcccacttgactaaatctttgcttaccgcgtgcccccaatgcattggcccccagcgcaagccatatggatgatattgataaaacagatgatattcccccgcgtaatacaccatcccgttcgggtcattcatccagtttgcttccggcgtgaaatgatacttgggccgatgatcctcgttatagtagtccgggtcggcagcagctgcggaaaaggcttccgggaacatcatagcccctatgatccccatctgaatcattctctttttcatgactttttcccccctcttcttcactcggttttttaggcaggaagtccaaacagccgcccccttttttgcggccgaatggacctgcttctcaaaagctaagaaaagaacacccaaaacatgttatgccaaaaaacctgcccaatagccgacaatcccgatgataaaaataccgaaaatcatgagcagaggattcacccctttgcgaagcatccaggcagcgagcaatgtcaatcctaaaggcagcacaccaggcatgatgctgtctaaaatgttttgcacggtctgtacatcgactttgcctgcatcatccttaattctcgacacgacgatcgggatattgattgtggtccacttggaaacgagagctcccatcacaaacagcccgagtattgaagcgccttccgtcagtttttgaatgcggttccccaccaagtcctgcaatatttccatgcctttcacatagccgtactttaatccgtagtatttagtgcttaatctgacggcgttgattaaaaagaaaaacaaaagcgggccggcgatgtttccgcttaaagcaagcgacgctcccaaggccgccaaaaccgggcgcaacgtcccccagaaaatcgggtcgcccacgcctgccaacgggcccattaagccgattttcattccattaattgctttggcatcaatctttttattgttggccatttcttcttccatcgcagcggttacgccaaatatcggcgctgtcagccacggatgtgtattaaaccattccaaatggcgctggagcgcttcgctccgttttgctcccggaccgtacagttttttgatcgccggaatcatgacgtagcagtagccgagcgcctgtacacgctcaaagttaaaagatccgagcaaaaagtttgagcggataaacatactgaaaatctctctcttcgttaatcttttttctgtgcccattattcgtccctcctttaatttttaagcatccagatcatcgtcatcatcataagcggccatgctgccgtcactggcggcagcaaccgccccttgagcatgatttttttgcatcacttgctgatataaaaatgccagacagagcccgagggcgccgaagccgactaaattgaaatcggtgaacgcggccagcaaaaaaccgatatagaaaaacggcttcaaatacggaatgttcatcatgttgatgaccatcgcatacccgacaacaacgataatgcctccgcctatttgcaagccttttgtgatgacttccggaatatttcccaaaaacgcctgaacagcgctgacactgatcagagccacgatcaatgtcggaatcataacgcgcagcgcctgaaacgccatggcagttatatgcataatttcaattcctttaaaattgccatcctttgcgtatttgtcggcgcggtgaattaaaaatacggtgatcgtccggacgaaaatcgtcagcgcctgacccgcagctgccaaagccaccgcgacggcgatcccttcgccgattccctgatcggcggtaatcactaagatagtcgaaatcacggaagcgatggccgtatcgggggccattgcaagaccgacattcatccagccaagcgccatcagctccagcgttccgccgagaatgatgcctgttttcagatccccgaggacaaggccgaccaaagtgcaggcaatcagcgggcgatgtgtctgcccttcgtccaatacactaccgatacctgttatagcagcgatgacaagcagcaaaatgatttgaatcgttgacatgcctttagaacctccttctaggattttgttgcgtttcttaacatctgcataaagtcttcgctcgaatctgacggcagctgcctcagttccagcttcacgcccaattcatgcaattgttcgaacgatttgatgtccttttcagtaacgcttaccgatttcgtgatttgcctgcggttattctcgaaacgcatcccgccgacattgactatttcgatcggaacgcctgcttcgattaaggaaacaatgtcgcccggattttcgaataacagcattgccgtcgtatcttcgtaccgcggactgtggaacgctttggccattttggaaatcgaaacggcgctggcttttacatttgaaggtgcaacagaaaggatcagcgtttttctcatttcgtcctgtgccacctcattggagacaacgataatgcgatcagcagcgtggattttgatccatcttgttaatacttggccgtgaataaagcggtcatcaattcttgccaaaacgattttcattacaattcatcctctcttccctgattggactgactgaatttttccaattgctcgctgcatatttggaagcattcccggctcatctttttcaactggttcagcagttgtttgagcggcatatgctccctcaagctcaatgcctctaacaaaatcggcaggttcactccggctgccatatcgaatctccgctctttcgcgatgtaaggggtcgctgcgttatatggcgtcccgccgaaaatatccactaaaaaaagcacctcgtgttcctccggaacatccttcagcgtctgatgatatttttcttgcagtgtctgaatgccttcccctttcagaaacggcaccgcgatcaggctctcctcttctccgaatatcatccctgaagattcttttaatgctatgggaaagtttccgtggccgctgataatgactgtaatcatgtacatttgctcctttcttttttcgttcgcttatttataatgcaagtatcgtgccaacaaaactgtattaagcgttttcattgtatttcaagacgaattattttcatatttgaaacacgtttaagcataaaaataaacctgtattaaaatgggggtccacttaatacaggtttacatgaaaaaattgccgatgggaaacagctataactcttcagcaaagatggacgcgataaacattttttcatcttcgctgatcgcaagaccaagcttttcttcgtaaggctttaatgttttctctgtgatgtgaagaacgttttcaagctgatcattcatctcttcctcctccggaaaagcgatcgggttctgtttgatcaccctttcaaaagcaaaagcggtatgcatgatgactttgatcagcacagcgttgctgaatgtcatacgcagttcgtcttgaaccgtctgaagccactccaacagcatgtctatcacatgatagggattcaaaaagacaagatacttcttcaggctgtcttcgcaaagctcctttacaaccacattttcaccggataatccgccgctcatcgggatatcgccggttgcaatcacctgctgaatcactttttccccttcgccttcaatcaatacttctaaagggacgtgcggagcatcgattttagggttcttcgtgccaaccgtggcaagaatctcatacgctttttcaatttctttgatgcggcttgctaatttgatcgatggcaccgtcaaaatgctgatttgttcatcagatgtcctgctcacgattgatgttaaaatctcttcgagcttcttcgccgttccgccgcctgttgtgcaaatggagacgatcgccttctttttgcctgagacccgcggtttatcggcccataaatcgatgaaatcctttgtaaccgaatcgtagatggcgtgcaaattcaaattcaaataattcaccttgcggacggcatcgagcaccatagatgtcgtaacattgctgatcgtttttattttaacgcccgtttgttgttcaagcctgctttccagcatcgcaagcgatcccatgtcgacaagcattaaaacgccttctccttcatcaacctgcttcactttctccgctaggcagctgacgatttccgagggtgaaacggtcaaaggcatatcaaccgcagcgatcggggtgcttcccagcagttcagtggctacttcaaccatagagcttgccgtgctgtttccatgggcggccacgacaatgcccgtccttttgttttctttccatgatttaatcgactgaatgagcatcgtcaagtagatgacttcgatttccggaacggttactttgaaatatgcttgaattttatctttgaaaatgagtgcgacctcgtattctttcacatgggtttccctgatttcatctgtttcctgcgaatttaagacatcaatctgctttccgcgctttaaaaatgcggcgatgtgcatgctcaggaaatagatgaatttacggtcgaacttgcagtcaagctcatgttcggcgactccctttaattctttcgtcatctgaatcacgtcgtcttcaacgaatttgagtaaactgtggttttgaagcattttctgattaaaaaagcttctgacgtgcaaatgaatatccgttaatatatattgattgatttgcttttttgttaagccttctttattgaggattttcgctttttcttctatgacatgatacaagttaaaggagtcatcgattttcgttgcttcatcttccacaatcggagagatgatcgttgtaatgttgacatattcagaaatcattttgctccgttcaatatttttgctgctggacatccagtcctctttgatctcgtccggaagatcccggacggtcagttcaacaacctcgtctttgtcaaggttatttaaaaacccgtgcgcacagaccagctgtacatttgatttcagctgcccgacatttccgaattttgcagaatgaatcagtgcattatagacatcgatgtgcacatttaagttttttttgatccgctctgcttctttccccaataaaaacgttgtcagctccactctttctccaagggaccgttcattgagcgaagggatatgtacggtcatcggaattctccgcaaaaatgtcttcagcaatgcagagctcggattttctgttgtcgcacagataaacaggacttttgccgttcgtttatgctctgtttcaccaagcctgttgtatgtgccgctgtctatgaaataaaacagcatttcctgcccctccggcgggaggcgatggatttcatccataaacagaatgcccccgtccgcctgctcgactaatcctgctttgtcttcacccgcacctgtaaaagacccttttttatgtccgaacaattgagagagcaataattgagggttgttatagtaatctgcacagttgaatgtgatgaacggggaatcgggcttcaatatgtcagaataaacggcgaactggtagatccgattcgcaaacagcgatttccccgaacccgtcggcccgagcagcagcatatgcaagccgtgcggaggataaaagactgccgctttcgcctgagaaattgcctttttcaagctccctttagccccgatcatgagctcgaggggatcggcggatatattgcgcgccggctttttttggccgtcagccagccgcctcagttcttcaacctccatcaactctgaattccatttgatgttcaagacgttttcaacaatttccaccgggatgtagcggacggggaacgttttaatcttgatcacctttttggcccgaacgagattgtttaattcaaagctgacattggaacgctccatttgcagctgcccggcgatttctttagccgaattcccttgtatctttaaaagctgattgatattcttttcgcgaaaattatccagcagctgatggtagattttatctattcttttcatatgtatcatcctttgttctcgattgatcagcaaaaggctggggactttcttgaagattcagaattccaaaagcgtatcacgggataaaaaaagatcttttacagattgacaaccccggttcaccctacttttatatcgattagagagagctctcatgacacatttggtgtttttgcttcatcggcatctatggaaacaccctcccaaagtagcagcttgtcaatagtgtatcatcattgagaaaaatattggtgaaaacatcctgtatttttctttaaatgcaaatgttttgtgacgagctctgctggttcgaggtcgcttcgatatcgtatggccgaacgatcggctgcctaagtcattaaaaaaagaccgttgacgatgaacggccattttttcttcatgattcatctcccttgaaaatgaacgtttcctttaaaagtctgccttcgcttcctttttccgtccaaatcatgtccacttccaattcggtcgcattctctgccataagcagattgcggtgcttgacagagcttccgtgatttaagcttttggctaaagaaaccggattttcgtgaggaatgttccaaagcgaaaatttcgttgaagaattaggctcgttccgatagacaaaaatttccgccgaagccacatcgtgtccaatgtttttgatttcgacagcataagtatgaaacgctcctttttccggtttcgccattccgtttccggcttcggctttaccgatttgaacttcccattgttttgaagcttgtttaaccggcaattcttcaaacgtcagcgctttcgtttcaaatgacggaacaatcaagccgaacaggcacgatgcacatatgaataaccgcatatttttcactcctggatggtttatttccccatatgttttcctaattcataaatcctatgtataccggcgtttcactccggcttccggcagggtaaataaaaggattggagtgatcaagcaatgccgcaaaacaataacaaacgatatgaactctttttcaaaaaaagatacaaagttctacatacattaaacgattttctcatcggccttttattccttgtcgggagcttctgctttttctccgaggaactgaagccggcgggactatggatgtttgtgatcggcagctttcagctgttaatcaggccgacgatccgtttggttcatgattttcactacagaaagtttgttgagagccggcgttccaaatgccgtgagtaaaatcacacagcagtgagagatgttaagagacccgctaagaagtacatataaaaaaggccgaatcatatcggcctttcctctgtcacacaagccactcctcacaatcggcggcaagccgttccaactcgtttataaaagcgccggcatgatagccgtcacacactgcatggtgaacttgcaaggaaacgggcaaaaatgtttccctgccttctgaaaagtatttcccgtttgtaataatcggcagcaagtgttcgctgttatcaaggtttaaattgaagtttgaaaagcgcacccatggaatagaagaaactgaaaacgtattgggcgggatgtccggcttagcccaaaggccccttttgtctccaaagcgctcggcgtccagaagatattgatgataaaactgcgaaaaatcgtctgagtattccgtccagagggcggaaaacgtttggtcgtcctgatgaaaaatcgcatagcacggatgcatttgttcccaataacccagctgtcctttgtcatcaaacgttgttctaaactcagggcgcgaatgaatgacccttgatacgatataaataaaagccggatacagcttgagcttctttttcttgagcacggcgagcaaatttgtcacattgacgtttgccgtgatgctgaaagaacatttcgcttccttcatgtaatggtcaaaataagattttctataccatgtgtcaagctcgattgtttgaaaattcatgttttacctcctaaaatatagatttttattttaggaggcctgcttcactgattccggcaatattctcaccccatcctgtgttgtaaatgaattgtagcgcgtttcggaggtccaggcaacagtctctcttcttctttgtcttcttgctgtgccgttctccgcctctccacctccggctgtcatataggttatactgacatagatcggggtgaagatatgaacagcaaatcacgattgacgcctgaaatgtggcgggcgattacggaaaacgattccgcctatgacggagtttttattacgcggtcaaaacgaccggcatattttgccgcccttcctgcaaatcgagagttccgcaaatcgacaatgtgcagatctttttcaatgcaaaagatgctttatcagaagggtaccgcccctgcaaacgctgcaatccggccggggcgctgctgccggatgaagagctggcacagcgtgtggtggaaatcatcgaggaatcttatcgcgatccgctgtctctgcaagctttggctgacaggtgccatatcagcccttttcacctgcagcggacatttaaacgaatcaaaggcgtctcgccggcagaatacatcctgcagaaaaggattgagaaagcggtcgatttgcttgctcattcagaacgatcgatcgcagaaatcgcttcaatggtaggcattgcgaatgcggaatattttgcctctttgtttaaaaagaagactgggcaatcgccgacgtcgtaccggcaaatgaaacggaggtaaacatatggacgatcaaatcgtatactggcgtacgcttatttgccgaggttggcagattcacattggggcgactgcccgcgggctctgttttacagggggatggaatcaaggcttcgaggatttggccgcttgggctgaaaaaagatttacacagccagttttcattcgggatgacaaaggattggcagaatacgccgagcagctgcaggcgtatttgaacggcaagcgaactcatttcagctttcctgtcgaccttgccggcacgccttttcagctggcagtgtggaaggcgctctccgaaatcccttacggcagcacttgctcctattccgatatcgccgagcatattgaaaagcaggccgctgtgcgggcagtaggcgcggcgatcggcgcaaatccgctgttaatggtggtgccttgccatcgggttatcggtaaaagcgggcagctcacgggataccggggcggattggatatgaaaaaagaactgatgatgatggagtccggcggtgtaaccgcacaattcaattaaagccccgttcgaatgtcgaacggggccgttttgttaaaagtcaaagttatcgggatcagggccgacacgggtgttttcattcagcgcgtcaatttgcttcatttcctcggtggtcagttcaaaatcaaatatgtccgcgttttgggcaatccgctccgctttagtcgacttcggaatcgtaacgaccccgttttgcaaatcccagcgcaaaatgacttgggccggtgtcttgccgtacttgtccgcgatatctttcagcagtggatggctgagcaattggccttgcatcagcggcgaccatgcttgcagctggatgccgtgcgcacggcaaaacgcttgcagctctttctgcgtcagccgcggatgatactcaacctggttgatcgccggtttgacggcggcatctttcagcaagtcttccagatggtgaatctgaaaattgctcactccgattgcttttacgcgtccttgttcataaagtgtttcaagcgctttccacgccgctttgtagcgtccttcaacaggccagtggatcaggtataaatcaaggtagtcaagtccgagcttttcgagactcgcctcataggctgcaatcgtttcgtcatagcctaaatcgtcattccagacctttgatgtaacaaacaggtcttctcttgaaatgccggcttctttcaacccctcgcggattccttgcccaaccccctcttcattaccgtagatggctgcggtatcaatactgcggtagccgtgtttaatcgccgtttttacggcttgtaccagttcgggcccttcttctactttaaatacgccaagtccaaaccaaggcatagctgtcccgttattcaatttgattcgatcttgcaaattttttgctgtcatcatttaattggcctccttatattttgtatgcgtcatgcgcagttttcctttaaagcttgattttgtttttgatcattttgtttttgatcatttcgttccagcgccctgctccagcctgtcagcacgacggcgccgagcaccatcaaagctcccacccatggagtgtgaatcaatccgatcgattgtgtgatggcgcctcctgtataagaaccgatcgctataccgacgttgaacgccgcaatattgacagctgatgcgacatcaaccgcccctggaacaaaccgttcagccagaatcaccacataggactggagcccggggacattcatgaaggctaaaaatcccatcagcatgatgacgataaagcccgctgcctgataaggagcagccgccgttaagatgagaagcacagccgcctgggcgatgaacatatagaataatgcagtaagcggttttttgttggccgctttacctccgataatatttccgagcgcgacggcaatgccgtaagcaagcaaaatgacggcaacagcttcctgtttaaagcccgtcacatgctgaagcagcggggataaatacgtaaagacaacaaatgtccctccataaccaagcgccgtaatgatgaataaaagcagcagccgcccattggtcacaagcttcaactggctcttgaaagacgttcggacgcctttcggcaaatcgcccggaacaagtaagctgttggcgataaacgccagtgcgccgacagcgacgatcgccgcaaaagcaatccgccagccgaactgctgaccgaggaacgtgccgatgggaactccggtaatcattgcaatcgtcagcccggtaaacatgatcgatatcgctccggctcttttatccgccgggactaggcttgccgcaatcgttgaaccgattgacataaatacgccatgagaaaacgccgaaatcacgcgggcggttaataaaacaccgatgcttccggcacatgccgcaagcccgttgccgatcataaaaatgagcataatcaccagcagcagcgcttttctcggcatactggatgtgacagacgtcagaacaggtgcgccgactgttacgcccagtgcgtataatgatacggtcagtcctgccgtcgtcaccgaaatattcatgtcttcagcaattaaaggcagaagccccacgctgatgaattcggtcgtgccgatggcaaatgcgctggccgccaaggctaaaagcgctaatatactgcgttttttatcatgaacagaggtcattctttttctcctttcttttttaaggtatagcaaatggctgccggctaatgatattatggtacatatcatctgcgaaaaaaagtacgcacttttaagtgtgataggaaccaaaaagtgagataggtacttttcggtacctatggattggaggagaacatgaagccgaaaaagtataatatatctgtcgaagctacacttgaagtgatcggcgggaaatggaaatgcgtgattttgtgtcacttgacgcacggcaaaaaacgcacgagcgagctcaagcggctgatgccgaacattacgcagaaaatgctgacccagcagctgcgcgaactggaggaggacggcgtcatcaaccggatcgtgtaccagcaggtgccgccgaaggtcgaatacgaactcagcgaatacggatggacgcttaaagacattttggattcgctgtgctcctggggcgaaaaacacattacaaaagtgtatggagacaaatttgctgttttggaggacagcgtgctgaatgaacaattacaggaaacatgataaataagtggaggtcaggatgggaaaatggtttctttccggaggcggagatgcacaccaaaccgaacagctggatcggcattttgcccggagcatctgtcctcataagccattattgtatattccgattgccatggacgccgacaggtatgatgacggcttcgactggatcagccggctctttcacccgctcggcatcaaaaacattgtcatgtggacggatgtcaaaggtaaaaccgtacacgatttagacgtgttttctgccgtatatatcggcggaggaaacacgtttcgtctgctaaaacaattcatcgaatcgcattttaccgcggttttaaagcgctatgccgaaagcggcggcgccatttacggcggaagcgccggcgccgtcattctcggaaagaacattatgacttgctcttatatggatcgcaacgcttgcggattgcgggattttaacggcttaaagctcctcggagactattcggtttggtgccactacaaggctgaacatgatccgctgattaaaaggtttaggaatgcttttggcactcccgtcatcgccttgccagaggaaacaggaatcgcagcaagcacttcagacatccgggtcatcggaacaaagcccgcccgtatgtttaaagaagacggcgcagtattcgtctcagatcaatttgttttataaagcaaaaaacgcttcggctcatcagcgaagcgtttttcttgtttttgcggatgcaagccgtttgaccaggcgttccgtcagaaaaaacacggctaagcctaagcctagcaaaaaagaaaaattcgcaatcaacggctcatgatcaaaatattcaaaagtactatttccaaaagtatcacggcccagaaaataaaagccgcacggcaagctgcatcttcggcttttttccttttgggtctgcatctttaaaaaacatcacaacgcccccaaggagactcccacaccccaatctgctgatttctttcgcacttactgtgttcttatcccctcttccgtttcataaaaccgcgctagctccacaatcatcgctcccatccgttcgagatccggagcgagaaggcgttcgactccttcttctcttaaagcttctgccgtcacttttccgacagcggccgccaacacgctgtcttgaaaagattgaacaattttctccgcatagccgttttctttcgcgaaatgaaaaagcgagcggacttggacagccgttgtaaagcaaaccgcatccacttcacggttgatgatctcgctgcacaataaagcgacggtttcccggtctggagcaacatgccgatacggcagaagcggaacaacgtctgcacctttctcttccaaaaactgaagcagtgacggagcgttttcgccgtggagctgaaccatcacccgtttgccggaaaaatcgtgggattggagcgagtcgatcagtcccttggtcgtgccgtcttcatccgccgcaacgggcgtaatgccgagcttttttaaagcggcgattgttttgtagcctctcgatgccgctttcgccctgcggatcgcttgtaaatagcgctctccgatcccaagtttctcagctaggctgacaagcgtttccgtcccgattccggtcgtgaaaatcacccagtcggctcccgtttcaacgaaggcacgcaaatcagggcctacttctttttcggccaaaaacacggtaccctgaagggagcgaatgaggggaaccccgccttgctttttgatcagcgtgctcatttcatccgtttttcgcgatgctccgatggcaattcttctgccgttcaatccttttcccaatgcaatccctcttttccgtaatctgttttttgtcaatgcaactgtttactagcatcttccaaatgagatatgattgaattatctaaaaataacaggaggttttttcaatgcattctcaattcgaaacccgagccgagcatttgacgaaacatgcccgttttttcgagtataccactgcctctgacccgattggaagcggaataatcagcccggttcctgtgaaagagttcgggcctgaattgtatgagacaggtgaaacgcggatcatcccgctggacatttccgaagaactgaagacggattatcccgcttcaagcccttcccttctcgcccacttcatcaagattcgttcaggcgacacgatacacactgccccccgtgcgacaagcgaactatattacattgtcagcggcgcagggaaaaccgaaacgggcgaagatacgattcactggcagaaaggcgattttttgactttgcctgccggttcaggcagccggcataccgcagcagaagatgcagccatttattacatcaccgattcacctctcctgaattatttgggcgtaaagccgtcggaatcccgctttcaaccaactctctacaccgctgaacagtcaaaagcaaaattggctgaagcggccgccgctcctgacgcccgttatcgcaaccgcatttccgttctcttgaacaatgaaatattcgatcaaacgctgacgatcacccatgtattgtgggcaatgttcggcatcgtgcctcccggctccaatcaagctcctcacagccacaagtcggtggctctcgattttgtcgcctatgccgcacccggcacgtatacattagtcggaagcaaaatcgatccggccacaaaggaaatcattgatccgaaacgaattgactgggtaaccggaaaagccttcattacaccgccgggattatggcattcccaccataatgagtcagatgaagccgcctatatcatccccatccaagatgcgggcctgcaaacgtacctccggacactggatattcaatttcagcattatgaaaaatgaaaaagcgggaagccggatcattcttttcggctccccgcttttctatttatttttcgctttcttggaaatcatgtcggcgatttcttcggcctgtgcctgaacagcgtttggatcatacggccaaaatctgtccggatcgaggaaaaagaccttgccttttttcaccgcgtcaagcgatgcccaaaccggattgtcctgatcaagctttccgttgtatgattcgtcgacaaatatgtagtctccggcatatttcggcaggacctcgaaagatatggctttatatccgtcagctgtatcaatggcatcctttttaacagattcaggcggcgtcagtcccagctgcgtatagatcgcttctccgccccgatacccgtatgccccgtagacatataaagattttgcatatgcgccgattaaagagaacgtttcaccttttacagatgcatctttaattttcgcgcgggcggctttcattttttgattaaacgttttcgtccactcccgagcttccttttccttgccgagcagcttgccaaacgttttcatttcatcgcgtgcatctttaaatgtgccgaacggatagacgacagtgggagcgatttttgacagcttttcatattcttttgaatcgttcgtcatcgatacgattaaatcgggtttaagttcaagaactttttccacagatactgaaaaaccgtcttttcccccgatatcctttattcctgaaacttgatctttaatataaggacttccgaggtactttcccgtttctccaagcggcttgatcccgaatgcaagcatggttcccgcatagccaatcgtcacgacgcgcttcggattagccggtacagtgacatttccgttgatggttttcaccactcttgttttctcttcatttttctctgatgcagcctgtttctggccgctttgacagcctgaaagaaatacagcgaaagcgagtaaaagggtgaatatataagaatattgctttttcgtcatatttaatcctccaattgataataattatcattatcaatatacaggatatttgtcatcttgagaagtccttatttgagttacggctgatcagaccgttcgttccggcgatagtattcaattacaaattctttaaagttgcgtgccgccggcgacaaataatggtctttcaggacggcgagaccgatcgtcctctcagaacggtagtctgacactcggcaaaatgccactggagaatggacgtgctccgccgttttcggcaggattgctacaccgagccctgctgatactagtcccaaaatcgtcgacacttcttccccttcaaaagcaagcttcgggctgatggacagtccccggcacatttgatcaaacacatatcgaagaccatagcccggcttaaaacagacaaagtcttcgtgtgcaatcgaccggatcgcgacttctttccgatctgcaagcgggtggtcggctggaagcaccagataaagcggctcagtatccaacaccgtccattcaagatgctcgtttggaagcggcggagagctgaggcagatatcagcttcgcccgtctccaccatgtgctgaagatgttcatttgcggcctgatacagacggaaagcaacattcgggtatttctttttaaattcggcaatcagctgcggcatgagccgcgaaccaagcgtatgcaaaaatgataccgagatttccccggcattcggattgacgctttccctgatttgctgaacgccttcgtcaagggcaaggcgggcctgcttcgctttgatgaggaactgctcgccgtactttgtcaggcggatcgattttgtttttcgaataaacagcgggacgcccaattcttcttcaagctttttgatcgacctgctcaaagccggctgggaaatccgttgttccaaggctgcttttgtaaagtgtttatgcctgctcacggcaataaaatggtcaatttgatagagttccaatgctcatccgctccttcataaataaaacgcatgatgatgatagttattataaattagacacatcacaaatgaaagcgtaccatgaaacatagattgtcattctagaaaagaggagctgccatgacctacatacagccgcattcgaaggattatcacaaagcgagcatcgccttattcatcagcggttttgtgacatttgccacactttacaccacacagccgctcatgcctctgtttgcggaggaattcggcatatcggcggcagctgcaagcttaactttatccatttcaacaggcatattggcttttgcattgctcacggcagcagctttatctgacgggttcggccggaaaacgattatggcaatatccctgtttgcgacatcagtgctcggcctcttgaccgcctttagtccgaacttcgcggcgctcttggcgatgagagggctgcttggctttttccttgcaggcgtgcccgcgatcgccatggcttatgtcggagaggaatttgatccgcgagggctcggcaaaatgatggggctatacattagcggcacaagcctcggaggaatgagcggaaggcttttgaccggccttttgacagacttgttcagctggcgcgcggcgctaggaatcatcggggcattatcagtactattaagctatttgttttggattttgctgccccggccgcagcactccgctaagcgaaaaacaagtgtgaaaaaagcgagcttggcctacggcgccgtcttgatgaacaaacggctgctgtcaatcatttcacttggatttctattaatgggaagctttgttacgctgttcaattatatcgggtttcagttgatgggacctccgtacagactctctcaaactgtcatcgggttcatctttatcgtttatttggcggggacgctcagttctgtctatatggggaagaaagccgatcgttttggcagcccgttgatgctgaaaatcgggattgccattatcgcaggaggcgcattgcttacgcttctgcctcagcttcctcttaaaattgccggaatcgctgtttttacatttggatttttcgggtcgcattcgatcgcaagctcctgggtcgggcagacggccggcgaacagcgcgttcaagcttcctccctttatttgctgagctattatctcggctcaagcttagcggggtctttcggaggcttcttctggacccattttaaatggccgggaatcatctcattcattatcgggctgcttttgatcgcttatccggtcattttctttgccgaagccaaaagaaacaaacggcaagacaattcacaggtccgaaataaaagctaaactttcttcaccgcatgccgatatttaaatcaaagccagcatggcgattcctcctgaagatcagccgtttttagaatgattgaacacagcctgtcatgttggcttttcctttatctccctctataatggtttgagggggggaatcaccttgcttaaaacaatcggattttatggatttttggcatctgtatgtttaaatctttttctcaggtttgggctcaagataaacggcacagcgaatgatatcatctcaacggcctccctcgtattcgtgctggtgtacgtatgggacgacttgaaaaaacgaagtgcaaaaacgctcatcttacagggaatcactctcatcatctttgtggcgttattggtgtttgtcatcatgaaaggacaaacattcattgcttctctgccttttttcgagggttgggaaacgccggcaaaatgggtgtatattttgctcgttttgttcttgggatcaaaccttttcatctatatcaatgaaaaaataacaaactctaaaaaagaggcatcctgatcaattcagaatgcctctttttgtttacgttcttgcaatgcagtccgccttcacattatgttgggaaacgccgccgtcccatacatcctttgcatagcgcccttcttctaaaagtgcggacagccagctttgcgactcttcccgactcgcaccctgtactatgcgatacgcctcgcacaaagcttgttcaacagctggagccatgcggcttccgtctccgcacacatacaggcggccgccttcgttcaacaagtgaatcagcaaggctgcatcctctctgagcaaatcttgcacatatgttttcggccggccctcaagccgggaaaacgctgtatgcagatggacgattccgtccttttccgcttgctccaactcgtctcgatacagaaaatcttcgttcggacggcggcagccgaagtacaaatgcgcttcaccgagcttcacaccggcatcgcgctggatgcggcgcgcctgaagaaatccgcggtaaggggcgattccggtgcccggcccgaccatgatcaccggtgtttcaggatcttcgggaagccggaagcctgactgaggctctctgatgaaacacgaaatcgcgtctcccggctcaaggccggcgagatagttcgatgcaactcccttataatgcccgcggccgctcaacgccgggccacttacgacagagacggtgatgcttgtttgccgcgggttaagctgcggcgaactggaaatcgaatagtacctcggttttagcggaggaagaagcgccagaaaacgggcgaacggcagttcacaggccgggtattgctcaagcaggtcaagcattgtcagccgcttattcaacacttgatccttatagacgtcatctttcagcaggtcttcaagctcgcgctgatgaggcggacaaacagtatgagccgccagctcgcgtatctgggcccttgtggccggttcctggagctcgacgcaatgttgaaaaaggtctttgacatgaacgggcctctccaaaggcaaatgtgatgcttgattccggccgctaatcagaatttgttcatttccgttcagcccaaaccgctgaaaaacgcggccaatcagcacttcgctgttttgcggtagcacaccgagatggtctccctcctgatatgcggcgccttcaggaagcgatatttcaatatgccttgtgcttctcccgctcttttcacactgcagttctcggtttgccgatatcttcgctgtgaacacctgataagctttagccagcggcgaagccgcaggtgcgtttacgaactcgacagataaggcttgcctgtctgtttctgtttgattcggctcgggttcggccaatgaaaattcggttcttaaaagcggccacagatcatatttccatgactcaaactgtccttcaaaatcatcgcctgcatccccttctccaagcttgtgcagcctttgggcgccttttttttccaatacgctgtcaatcaggcgcggaatccgctggtaggtgctggcccagctgcggttaccgcagccgaataccgcatatttgacaccacgcaaatcgtctgtctgatcatgctcaagccaattgacaaattcctttgcgcaatcgggcgggtttccgttataggaagccgtcacaatgataacagccccttctgccgggatggcgcctgcgtattgatcaagctccgccgtccggctgtgaaacccttgctcacgcgcttcttcagcaagctccttcgcaatctcttcggctgtgccgagatttgaaccgtagagcacaagaagaggggttccgtgcgtattttccgccgccggtgcggaaggccgttcttcctgccgtccgttctcttcaggctgagcgcccggcatcgccgtcattgcttcttttttcctcggcctcacccggattgtgaaaccatccggttttaatgtcagcgattctttgatcttcaattggtagtttgcatgatcttcaagatcaaagtactgaagaatcatgccgagcacaagcgtcgcttcatgaagggcgaactgcatgccgatgcatgccctttggccgttgccaaacggtttgtatgcgtgcgccggaatgctgtccatctgctcgaaccgttcaggccggaatgcctcggcatcttctccccagacgctttgatctctgtgcagttttgggatgagcactgtaacgctctgtccttttggaatcaaatattttcccccgataaccgtttcttcttttgcataaagagagaaagccggtgccgtcggccaaagccttatcgattcattcaaaatcattcggatgtatttcagctgctgaacctgtttgtaggatgggacgggatcggtcagcacgcggtctgcttcttcatacgctttcttaagcttatccggatgcttcaggagcagatagattgcaaacgataataaaccgctcgtcgtctcgtgtccggcaatcaaaaatgtaataatttgatagcggatattctcatcatccagtttttcgccggtctcagggtctttcgcatgaagcataagcgacaagaggtcatttccgctttcactctcggcctgcttccggtcagcgatgatccggtcaacaagagaaaacatcgactcgacatcgctgttaaaccggcgcttcgtttgaatcatcagcttatcctgcagcgggaagcgcttcgtctgtctcatcgcttcgctcaaaccccggaccatgctctcaataaacggatgctgcccttcacggtagaagctgttaaagcggtagttaaacccgcataagccgatcgtgtccagcgtcagccgcgtcatatcgtccggcacatcaatgctttcatcctgattgagacgggaccacttttgaatgagctggacggcgatatcctgcatcatgggatggtatcccttcatcgctttctggctgaagctcggcagaaggatgttgtgggctttccgccaattgggttcttccgtccagcttgtaaagagcccgtctccgctgaactcgcgaactttcaatagccccttccccatgtttttgtcaaaacgggattcttcagagacttctttaaccagttcatggctggacacaaaaaccccaatcgcatccgcaaacttaaattgaaagataggccccatctcatccgcgattttccaaagtgactgggagaccctgtttttgtcaagcaaaggcaggttgccgagcggcccgtaagttttagggattggaattccatctaacttgttcatgaaaatcatcctttctgttttggaaaaaagcatttcatccatgatgtttaacagcatcccaggaacattcttcaatctcctccatcagttcggtagggtcctcgaattcccctgctcttaccaacttctgaatatgaacgaacgctccgaatacaacagccgacaaaatgtgggaaggcaaagggcgaatcatgccggccgctttccctttttcaaaaaataaatagatgaaatccagcagttcgttcaagacctcgcggcttttctcagtcaagtaatgagaggtcttgtcaatttccaaaaaatacagcgcatggatattttcctgagaaaactcgaaaaggcagcggaaaatgtgctgaaattgtttttttatgcctgctgaatcttcaggatagccctcctctatcttttctttaaatctcttcacactgtcttggaacaagacgtttacaagtgcttccttgctgtcaaagtagcggtagatggtgcctgcaccgacgtttgccttatcggcgatcatcggaatggttgcggcgtcaaagcctctgtccgcgaaaaggacgagcgaagcctcgataatcttctgatatttgctttccgattccattgattttgccctccaagtcagcggaatgaacgttcattccgctgtttccaatacattcactttttgacagaacacccgaagattccttttttaatataaaaatttttaagggaaaatgaaaaaagggataataggaccaattggcgatatgagctgaaaatcacaaattgaaaacagacagtgcagatttaataatattcttatatattaattttgatgaaaaaaagaggaactgatatgtcatcagttcctccgctatcggattattttgcctttttgacttttattttgctcactttgctcgtattgccggctttatcttttgcagtgaccgctaaaacggtgtttgccttttgtttttttattttgacaaaaaacgcgccttttttatcggccttgccggttccgatcgttttctttcctgatttgacgatgatggcggcgttcgcttctgctttccccttaacggccgtgctcttgtttgtcaccggattcaccttcggcgcagacggcggggttttgtcaagcacagtgacggctgtcgctttgctgacatttccggctttatcctttgctgttacaccgatgacggttccggctttttgcctgctgattttcagcttgtattcaccttttccgttcgctttgccggaagcgatcgtctttcctttagcttttgcgctgacttgcgcgtttgcttctgtttttccctgaatcaccgtacttttatcggaaacctgataaactttcggggcgcctggcgggatgacgtcagccaccgtcattttgacatcgccgctttctctgtggtcatcagcagatgcggagacatacaaaacggcatattctttttgcttgttgattttcactttaaacgctccggatgcatccgctttgccttgcgcgatcacttttttggacgcgtttttcactttgatcgtgtagccggctgccgttctacccgttacggcagtatctttgttcgtgatgcgtttgacggacgggtttttcggcgctttttccacgacggttctgagcgaggtttccgcctgatggcccgatgccgcgacatgaagaacttgccccgccttctgggccggaattttcactgaaaacgcgcctgattttccggccgtgcccgtccccaatacttgcttccctcgcaagattttgaccgtcacaccgcttttggctgtgcctgtcactgccgtatggcggtttaaaacgggatgaaccttcatgttcagctcaaaaacgctggctgcatgaaaaacattcagccttccccacccggagacgaagtcatatccgggaatttgtgcagccggttctatatccaggtcataatccgggtttggattatcctgctcttcaaatgccacatctgctgtcgtctcggtcaataggcttgcgatttgctttggtttcaaggacggattctgtgacaaaagaagtcctgctgcagctgccacgtgcggcgccgccatcgatgttccgctcatataagtgacattcccgtccggaacgaggcttggaatatcggttcccggcgccaccatatcgagaccttttccataattggagtagtccgagacaagatcgagattattggtcgccccgactgaaagcgtatatttcgaagatgcagggtaggaaatctccgatactccgtcatttccggtggcggcaacgatcgtcacatttttagaagccgcatatttaagcgcatattccatcacccggctgtatggcccgccaagacttaaattgatgacttttgcaccgtggtcggcggcatagatgatgccgtttgcaatctgttccgtatctccactgcctgaagaatccagcactttgacaggcagaattttggcataagcattgattcccgccatcgaaaaatggttgtcttgcgcggctgcaatgatgcctgacacgtgtgtgccgtggccattgtcatccatcgcatccgccgtgcggccgacatagttatagccttcgtcttttttgacgctgccgcttaaatccgcaagggtatgatcaacgcctgtgtcaacgacggcgattactgtatctttcagctttttgcctttcatcagcttctgaagctgttcaaattgtatgtcagcattcgcagcacggtttttgccgttatttttgagcgaccattgatatggatattgggtgtctcttgacagtgcttcatattgctgaacctgttcgacgaattccacttcaggcatcttggcgatcttggaggctgccgcctgatattgctttgccgccgctttgaatccggaagaacggctttccttcatttccacaacgtacatatctttaaatgccgttttgcttttaccgaggggctctaatgcctggacgccggatgattgggctttagatttgaaagatcccggttttttgccttctttcaattttacgatgtaacggttttcgggcgcgcttgatgaagctgtcgccatccccgctttttcaagcacagccgatactttgctgcctgttaattgttcgatgccgatgtctttcgcgacttgatccagctgttttttcaacggctcgggaacggacgcgcgagctgtttcgtacaggcgactgatcgctttttgatcatcattcgtaatcgagtatgcgctcacttgtccgtttttagcgacatctgcaaacagcggcttcagctgcaccaggtctttgtagacactgtctctcatcgatttgttaaagagcatttttgcgctgatgaatggagctgctttatagtaaagggaagacagctcttttcctttttcagtttttgaaagaacttcatccctgatcgttcttaactgttttaatatgcccttgcctgtttccctttcggaaacgcttaattctgccggacactcttcttctgcctcttggattgacggaggcagggtgacgccttcatagctgatggtgtaagaaatatctgtaattgaagtggtttcgttttcctcatcatggtgattttctacttttatgtagtaaggacctttccaggcaatcggaaaatcgattaaagcaggattattttcataggagtagccgttgtatcggtcaaacgtttgatgaccagttgcattttccaggctggagtagacggaaatgttcagctctgcatctgatttcaatttgacgcggaagtgcgtatagtttgcgatttcctgatttgaaggattgactttataccaatgcacctcgtcatcgctttgaaacgaagcttcaacaggggacgcgctggtcaatgtggtttcgttattcggaacgctgtcttcggctgccattgtcttcggtaaaggcagctggccaaaaattaatgcggcaaggagaaagaaaacaattgaacttttcacgatccttttgttcataaatacctccggaaaatatagtaaaaacgttcactttgatattaaaccatgtttgctatgttaatggaatacttttctttaaaaatcaaaaatatgatatttaagatccagtttcaactctatcaaacataaaaaatcccttccgtattgaaagggatgatcatacaaagttcatgattttaccgcagaaatgcagcagtaatttttgttcatatgtaccgtgatgtctctgaaatggctttcctcaagcagttgcttgatttgctcttctgagtataaggaaaagccttttgtttttttcgattttttcatttgcccttccagatgcacagcgagaaacagcgtgccgtcaacctgtaaaacacggtaaatttcttttaatgcctgtttgaaatccgtccaaaaataaatggtgtggactgaaaatactttatgaaaagaacgatccggataaggaatttgttcggcatggccaagctttaattcggcttttccttcttctttcacatgacggattcgccgcattccctgcttgaccatgctttttgatgcgtctatgccgcaggccttgccgccctcaagcatctccgcaatccgataaagtgccgctccgcttcccgttccgatttcaaggatgcgctcatgcggacagatatccatcaagttgatggtccattcgtttatatcatgattcccgttttccatatatgacgcgacccatttcgacaaaatgcctctcgggctccgcaattgttttccaagccattgttcaaacacgttaaaacacctgctttaattctaattagcccgatttttgctgcaaatcgtacaaacgggcctttccccactcatatcggccaatgaaccgaatattaaaagcatttgcaaaaataactgcattgttttgttacattccataactagacggcttcagctttgaaaagtttcgctttaagaaaactgtttttttaatgaattggtctatccgccctttccacaacttaatcccatgcatagtatatatggaattttcactaaaaggtggtgctatttatgggctttggttacggcggcggatgctgcggcggctggggtggctaccctggcggatacggcggcggatacggctatggaggcggattcgcgcttgttgtggttctattcattcttttaattatcatcggcgcttgttacgtctgctaaatgaacaggaggggggctttaaagctcccctttcattttgccatttagtttgttcaaatgaaaaagagcagaaaacaaaccgttttctgctctttctcaataataccaataatgcggccaatacccgaagtggcgcaccatctccattctttggcgccggtacggattaccgtatccgtgcttgaaagaatggggcatcgatgtatacccgtggccgataaaaggcattctgccgtttttctgcatgcttttcacctgcattccttgaattgcttgcttcatattatgcagaaaagcggagatgcggaactcgttttgccccggctaaacctggtccttctcccgagtgtaatgtgccaacagttcccttctataaatcatcatgatctcctcctttattttttttcgcgctttaagttagcgctggctgttcaggtaaagatattttagctgcagatctttcatttcattgtacatttgttcaatttcgtattctcgctcgtactcttccggacttttaaatcgtctctgaatggttagtgttaagaagaatagattaatggtcacatcgctcaccccctttcaagttcgctaaaaaacaaaaacagcccgcagatcatctgacaaacctgcgggcgcaaacaaaaaccgccagataaaaacgaatcgagtctttatcttgcgggaggagcagcgtattattatgcctaacttcctaacgtatcggctgtgctgtaaaagcatcggttaaggaagtgcacaatctctcccacaggtttgatgaatcatggtattggcattcacaaagtctaatgtatgtagtcagtgctggtttcatgttcatcaacctcctttgctttttgtttactttgtaagtatatccatcaaattcctgtttgtaaaccgttttttttaaaaatggacggattgatcgagcaaaaaaaaagcagagaaccccttcaggagtctctctgcttatgattcttccatttcgtctaattgtcttttatatttgagcgagcgcttcacacaatagaaagctcctcctaaaaagccgcacgtcgcgagcatcattgtcatcttttgggctgtttccaaaccttgtcccggaatgacagatccgatatataaaaatgcgcttacgctgagaagcgtaaaagcaaactgcttatagtcttccatcagcgatttgacttttttcttctgcatgtcatgatcacctgcttttgtttcataatggatatgatttgagaataacatagattgacagatgaccagacatgtaaattcagccattttaagaaagaggggccagcgcttgctgcaagtcttccaacagatcgtcaatatcctcaaccccggcggaaatacggattaatccgtctgtgatgccaagctccagcctgcgttcaggcgggatcgaagcatgagtcattcgcgccggcaccgatatcagactttcaaccgcaccaaggctttcggcgatcgtaaaccatttcaaacggccaaggacaaggtccacgttctcttcttttccgatatcaaacgagatcatgcctccgaagcccgtactttgccgcttggcaagctcatgtcccggatgggacggcagccctgggtaataaacctttttgacggcgggatgatcgtctaaaaacgccgcgattttccgggcattttgctcatgggcttccattctcaagccaagggttttcatccccctcattaagagccaggaatcctgaggcccgagaatcccgcctgtagagttttgaatgaaatggatctcttctgcgagttccttcgaggctgctacgacaagtccgccgacgacatcgctgtgtccgcccaagtacttcgtcgcgctgtggaggacgatatcggctcccaacgagattggattttgaaagtacggcgtgtagaaggtgttgtcgacaatcagcaataagtcgtgctttttcgctgtttcagcagttttcttgatgtcagtgattttcaataaaggatttgtcggcgtctcaacataaatcgcttttgtattcggcttgatcgctttttcgatgtcttcgatgctgctcgtatcactgaaggtcgcttcaatgccgatgcgattcaatacctttgtcatcacgcggtaggtgccgccgtatacatcatctgtcaatacgatgtgatcgccgcttttaaaaagcatcatgacggctgtgatcgccgccatcccagagccgaacgcatagcctgctgcaccgccttcaacatccgcgatcaaggattcgagcgccgttctcgtcggatttcccgtccgggaatattcgtatcctgtatgctggccggcgcgaggctgtttgtacgtgctgacctgatagataggaaccgataccgctcctgttttttcgtctcctgtaattccgccgtgaatcattttcgtttttggcttcatatcatattcctccttcgtaaatttttttgcttaaatagcggtcgctgctgtcgggaaaaatcgtcacaatgtttgtgccggctttcgctttttcggcttctttcaatgcggcaaacaacgcggcgcctgatgagcttccaatcagaagcccttccttttccgcggcttcttttacgagtcgaaacgcatcttcgtcaagcactgtgtaaatctcatcgaaatagctttcctccatgtattccgggatgaattccattccgattccttcggtcttatgcccatgcggttcccctccgtttaaaatcgagccttccggttcaacaataaccgttttaatggacggatttttttctttcagaaacttggcggttcccgcaaatgtgccgcctgaccccgctccggcgacgaagacgtcaatccggccgccaagatcattccatatttccggggcaatcgttttatagtaagccaatggatttactgggtttttaaactgcaaaacgcaataagaatcgggaatctccttctcaagttcaagtgctttttcaatcgcacccttcatcccggcacttctgggggtatgaactatccgagcgccgagcgctttcataatcgactgtttttccatgctgaaatgctcgggtacgcaaaaaacgggtcgaatgccgtgctttctggcggcgagagccagaccgattcccgtattgcctgctgttgcctcaatgaccgttccaccgggtttcagctttcccgaaccgatcgcttcagcaatcagcacttctccgagccggtctttaatgctgcctcccggattcatcatttcaagttttgcatatatgttaacgcctttagggattcgaaaatccaaaatctgcagaagcggcgttttgccgatcaattcggtgatatccttgatcacattcatgttccttcctccttcaagaggtgcaaaacagagggggagcctcccccctgttttaattgattcttttaatcatgcgaagcacaagatctgtcgaatgcttggcagcctgttccaaaaattggtcaaatgaaatttcagattcttttccggcgatgtctgagagcgccctgatgacaacaaacggcgtattaaattgataagaaacctgcgcgacagccgcagcttccatttcaaccgcgtaaaggtcttcaaacttgccgcggatgaatgcgacgcggtcaggatcgctcataaaggaatcgcctgttgctatcgttcctttgacaacctgaatgtgccccagttcagacgcttcgtcttccgccgcttggatcaatgcattgtcggctttgtatgcagccggcagattcggaacctgtccatattcataatcaaatgccgtgacatcgacatcgtgatggcggacttcggtcgagatgacgatatctccgacattaagcgaatgatgaaagccgccggctgatccggtgttgatgacaacgtccggtttaaagcggtcaagcagaatcgtcgtgctcatggctgcattgactttgccgatgccggactttaaaagcacgacctcttttccttcataaaacccgctggtaaattcacagtttgcgatgacttcccggttcgtctgttcgagtttgcttcgcaaaatcgtgacttcttcttccattgctccgataactgcgattttcatatcttaaaacttcccttcaaattacaattttgccgcttccattacccagacaaaatcattatgcttttgaaaggcgatactgaaatgttctgaggtaaagatcgtttccatctccgaaatcgtcggataatgttccgtttcaaggtcttccgccaattgcagaaacccgttttccttcgcttttttaacagcggcagagaaggcttcccgattcttgaagacggtatcagcaaacactattttaccatgcttcccgagcatttttccatatcgcttcacagcttcccgcttctcttcgtttgtcagatggtgaaacgcataagaactgacaatcgtgtcgggagaaaacggagggtccggaaagtcaataaagtctccgtcaacgatcactgcattctccggcagctttgcctcggcaatttccctcatcgcttttgaaggctctacaccggtgactgcctttccggccgccagcaattttgcagtcagattgcctgtgccgacgccgaattcaagaactttatgccccgagcggctgacgacatcatccaaaatgccgtcgtagtcgcgaaacacttctttgtattgaagatcgcggccaactactgtatcatcataagaatttgcccagttctcaaataaaggaatgaactctcttcccattttgtcgtcactctccatctatttttacaattcctataagtatagtatgatttattcgattgattagttcttatcctaccacaagtcattcgttttgggtacaaaaaaggcttggttatatttcccttgtcacccggccgcttctctgctttaataaaaaatgacttgaaacgaatggaggattggtttatgaacttcggcctcgatctgatcaaagataaaattgagttttttgaggcactgagcttagaggagcttgaaaaaaagatcagtcagcagattgaaaacaaccaggcgattttgctgagggtccattcggtttcccaccatacggcggttattgacggacggatccactacagcgcagtcgttcattttaaagccgaatcataaaaaaagcgcccggttttagcaaccggccgcttttttctttatttcaattgttcaacttttgtcggcttccagccttttccgtcaacccaagtaatggctacctggtatttgacgccagtgtccttcgcccgaatggttcctttcgcatcttgcgggctgccgttgtttccgagccagatcaccgtcatgttatccttagaaacccctgtcgcatatgaaatggcttcaagcatttccttccagtcttgtgaagaggaatcatatgttgcggtatgctgtccgctctgttgtgtgccgacaggctcccagtcaggattgatgatcgttttttcaacattggcgcttgaaccgccttctgtcacttcggctccttcaaacggatcatctgatgttgacttgtcctcgtctgaagcagattctttatccttgtctgagtcggaatcgctgtcttctttatcggcagaatcgctttttcctttgtcctcatcttttacatcttcatcagatgtttgtttcttattgtcggaagcaggcgcttctgtcgtctgttcagaatcgtttttcgagacatcttgctgcgcctgctccttcggactgttcatcatcagactgctggcaacgacaacgattaataccaatacgatgcctattaaaatgttaagcacaagattcgctttcctgcgcttatcacgattttcaaaacgagattcccttgtttcgctcaagttcattgcactcctttttccctcttgcctcgcttcctattttatcatcacctgaggcattcttctatgtctggttcttttcaatttcatatacttttttaacaatatcataaaatacggcatttgtcgcagccttgctatccggcgtatccatatggacgacgacgagcgcatatttcggcttgtccgccggaaaataaccggcaaaccatttatgatagagcgtttttttgtcatctgtcgtcctgcctgtctgcgctgtgcccgattttcccgctacatcgtacggaagatcgctgaagcgccggcccgtccccttttcagatgtgacaacttttctgagcagtttttgcagcttttgcgctgtatactggtcgattttctctcctgggagctcgtgatctttaaaagccgtcatcaatgtgccgtttttatattcgatctggtctgcgatcttgacttgttttttctctccgcctcttgcgatggtcgccatcatgttgacgatttccaacggagtcagcttcacattcttttggccgatagcggtctgggctacagcttttttaacttttttgtccttttcatccccccagattgatcctgcagtttcatgataaaactgtctgaactcatcttcatgatacagctttccttcccagccgacccgtccggtcagcccaagctttgcagcagtatcttcgatcacggagctgtttttttctacgagctgtccggcaagatttgtaaacgtgtagttgcagctttccgcaaaactgtcttccaggctgagctttcctttgtcctctccggcctcaccgtacaggttcaaattgcagttaaaggttttagacggatgatccaagccgttttcaatcgctgcagcggcaatcacggttttaaaaaccgagccgggatataccggagtcagcatatagttctgccttgttttttgcgcagccatgtttaagtcgggcttgctcgcaatcgccaccacgccgttcgtctcgatgtcaagcaggaccgcccagcctttatcgagctgatggtcatcaagtacatcttccattgcctgctgaacctttttatcgagcgttgttttgacttgcagcgggtaaaacggatttgcgtctgctgtatatttgacgtccatgccgaacaaagggtttcccaatccgtccacatgatacaacagttttgtgtcttgttcaggcagcaggaattcatcaaacgtccgctccatgccgaaggtgccgattttcgtgctgatggagaggccctctttatcgggatatttgcgtctgaggaggtccgggtcttgattggtcataccgagcgtatgcgaagccagcctgttcttttctgtttcttctatgtatacgccgtaaacgcccggatatttcagtttattgattttttcgagagccgtctttgaaacggacgctccgtcatgttttgtgagaatcacgggtttttttgcatggtccagcttgcttccaagctcatcttctgtcatgtttaaaatttcggctgcttctttggccggccacggctgattttttaaaaaagggaacaagacgatggccggtttttggctgacggacaaatgttcgccgttccgatctaaaaaagatcctctcccgtctgaaatccgaacttcctccgtgcgctgtttgacgctttcctggattaagttcacattccgtttagaaaaggactcggtaaaaaacagttgaatttcagccagcctgatcagcagaaataaaagagcagccgaaatgataatcgatacccacttcatacgcttttgccatttcattataaaaacacctcatccacattgtggacgaggtcatcgtttgctaaacaaattttatgaaattttcacaatttttacaagcatttcgccgccaggtgtttgaacggttacttcgtctccaacctgcttgccgagaaggcttttcgcgattggggaatcgttcgagatttttccttcaaacggatcggcttccgcgctgcccacaatcgtataagattcttcttcaccgtcaggaagctccgtaaatgtaacggtttttccaaggctgacgatgtctgagtttgcaccgtcatcttcgatgatctttgcgttgcggatcatattgtcaagggttgtgatgcgcccttctacaaaagcttgttcttcttttgctgaatcgtattcggagttttcggaaaggtctccgaagcttcttgccactttaatacgttcaacaacttctttacgtttaaccgttttcaaatactcaagttcttcttccagttttttctttcccgtttctgtcataggaaatactttctcttgtgccatgttccttcactccttctagttggttcctcatcacttgtatgtgagagtatagacttgaatatacaagaatgaggacaacccttgtccccttcttctctcccatatttgtaaagtatcatataaaccggatggaaggctccggtaaatggtgcttatacagttaaagaagggctcaggatgagaacccttcaatttctatacataatatggtcagagttgtgtttgtctatgctatgttattataaaatcgcgttttgttcaagaatagtttgtatttttgttaccatcaggtcgatggcgacgcggttttggccgccctccggaataatgatatcggcatagcgtttcgtcggttcgacaaactggttatgcatcggtctgacgactgagatgtactgctcgatgacagaatcgatcgaacgtcctctttcttttatgtctctgagcatccttctgatgatccgcaggtcggcgtccgtatcgacatacagcttgatgtccattaagtcgcggagcctttcatcctcgagaacaaggattccttccaaaataataacatctttcggatcgacgtgcacgacttcctctgaacgcgtatgcagcttgtaatcgtaaatcggctttttgatcggcctgtacgcgagcaattcgtttaaatgctcgatcaaatagtcattgtcaaatgcaagcggatggtcgtagttcgtattcagccgctcttcaaacggcagatggctctgatctttataatataaatcctgttcgagcattaagatcgaatgacctttaaactgttcataaatggatctggtgacgctcgtttttcctgatccggagcctcccgctatgccgataactaccggttttttccccatgccattactgcccctttctcatcatgttgctaggataaatcttgttgtccactctaaatttgacgatctgcaggggatggcgggctgcgtcaagcacattgcctttttcgtcccaaatcgtgtcaattttgcatgtgaaattttcgatttccggaccgaaaaattcgacttcatctccggatttaaagaagttccgctgctggagcgtgaccatttttgtctcttcatcatagtcaaggacaagtccgacaaagtcgtatgttgtctttttgccgtggacgccgaacatctgctcttcatatcctggcgttccttcaaagaaagcaggcgccgtgtctctattggcgcatttgtccagttctttcagccattcttctttgatgacgaagttttcaggatcagcgcaataagcatcgatcacttttctgtacacactgacgactgtcgcaatgtagtggatcgatttcatccggccttcgattttcaggctgtcgatgcccatttcaatcatttgcggtatcgattcgaccagcttcagatctttcgggctcatcgcaaatggagcatcgccttcttcatatagcggcagtgcattcgtcccgtccgtctgatacaaatcatagtcccagcggcatgactggcagcagcctccgcggttggagtcccttgccgtcatatggttgctgagcacgcagcggccggaataagcgatacacatcgcaccgtgaataaacgtttcgatttcaatatccactttttctttcatttccctgatttcaagtgcgctcgtttcacgtgcgagcacaacccgctcaaggccttcttccttccagaactgaacggctttccagtttgaaagggactgctgtgtgctcaaatgcacttccagcttcggcgcaaccctgcggcacgtttcaatgatcaggggatcagcgacgataatgcctgacacgcctgctccctcgagatcgcgcaaatagtcttccagtccgtcgatattttcttcatgcgcaaaaatgtttgtcgtgacataaattcttgcgccgtattttttcgcgaattcgacaccttcagccatttcttcaattgaaaagttatctgcgtttgagcggagtccatattcacgtccgccgataaatacagcgtctgctccatagtggacagcgattttcagtttttccaaattccccgccggagcaagaagttctggctttttcgtaatgacgcgttttccattaacgattttggaaattttatcttttactgcagacatggctatccctccttttagtatactgtttctttgaaaaagaatccggtatcaatgctgcggtttgcaggctgcagctgttcgatccgctcgatccattgttctttcttgtcttcatatgcttccctgtctgcgatgcaaaggtcgatggcttcgcggtacatggccgttacttcagtcatgtattcgaccgattttaaaattccgtcgattttaaatgaatcgatgccggcatcgattaaatcttcaagctcatcaatgatgcagacgtcattcggactcatgatgtgcgtgccgttttcgtcttcgaaaatcggatatttatttccgcgttctttatcatggagatacatgcctttttcttttttcttgccttcgatatccatgacttttccctggtattcaaaatagttgccgatcagggagcgctttgactggaacatgcatgtcatgccgtgaacctgaatttcaatctcgacttctgctttctctttaatctcaacgatactgtccatgttgagctctcttgcaagcaccgcgcgcttcgcgcccttgcgcccccaatagttgcaggaataatgattggttgcggtcgtttccgtattccagtgaagcttcatgttcggcgctgattcccgtgcagccatcagtacggcgggatcgccgaagacaaccgcatccgcgcctgcctcgtccaagaatgaaaggtagtcattcagttccggaacccggtcattgtgaaaaatcgcgttcacagcaacatatacttttgcgcctttttcatgagcctgaatgatggcttcttttacttcttctctggaaaactccccggctaaacgcagaccgtacctttgttcaccgatgataaacgcatcggcgcccgcctctgccaaaggcttaatatccgaaacagaagtcggcgtgacaagcagttcaggctttttcatatccgttcacctcttttttgactgacggccaatccgtcgcccacaggcaggatcgccgtgtggtagtcaggatgctccatcagccaatgattgtaatgatctattttcgatacaagctttttgatgcgcttgctttcgatctgattgtattctgatgcgacaaggcctttgaaaaggacattgtccgtaaaaatgatgccgtcatcggcaagcattttttcatatatactgaaaaacttctgatactggccttttgcggcatcgataaacagcgcatcatagggagccatcgattgaacggggtcagactcgctgagcgcatcgccgaagaacacgtgaattctgttttcaagctggaatgaccggatgtttttcagcgcttcccgatacctgtcctcatcgcgctcgattgtaaaaatctcggcttcgggaagggcaagcgccatccgaatcgccgaatagccgatggcggtaccgatttcaagaatttttttcggatttttgaatgaaagaagctgcaggagcacttcgattcctgtcggttccataatgggcacgccatgctcttcggcataggcctccagtttcataatttcagccggccgcggctttagcagcttttcaagatagccggtcaattcttcgtgtccaatcttcacgggcagatggcctccctttcataaaaaagagccttaggtcaggtgttcagcactctcctaaagcagttgactgtcttttctccaataaacaacccgatatattttatcataaaacctttgtatttgcgaataaaaggagagtattttttactctcctttttcctcgtcctgcgtgttcgtaatatatttggcttttgctttattgtgttcttcaagcgtttttgtaaagacgacttccccgtttttctttgcaagaaaataaacatagtctgtttgctccggatttaatgccgcctcccaggaagtctctccagcgtttgcaatcggcccgggcggaagaccggtatgtttgtacgtattatatggggaatccgcttcaaggtctttgtacatgacgcggtttttatgttctcccagtgcatataagacggtcggatccgtttgcaatggcatatttttgctgatgcggttgtagaaaacgcttgagattttgtgccggtccgctttttcggtagcttcttcttcaattaacgaagccatcgtcaaggctttgtggacggacatctttttgtctttcatctgcttttcatacttttcagccagctgatctgtttgtttgatcatcgcttcgataatggcatcaagcttcgtctcagggtcgtaaaatggatatgtcgcaggatgcaggtatccttcgagcggatgcttgatgttcttgttcaacacgtcgtctgtgatcagtttcggatacttctgttttaatcggctgatgaattccctgtcatccagctttttcataatgtcctttgccgagtagttcgtttgtccggcgatgatgtctgcgatttcctggagctgccttccttcaggaacggtaattttaaatgccggcacatgtgaagcggttgtcagcttattaatcatgcctgccgcatccatcgactggctgagctgaaagttccccgcttgaaagccggaggcatttttaaatttcacataagcgataaatactttttcatttttaattaggtcctcttttttcagtttggcggcgatggacgtaacggtcgatccttccggaatatagacattgaccgtttttgcattatttttatcgaccggttcgagcgccgatttaacgtagagcgaaacagcgcctgcggttaaaatcagcagaaccgcaaccacagtcagccaaaactttattttatgtttaaggagtctttttataaacggtttctttgtctgatcttcaaacattggtgtcctcctctcctcccatggtatatactacatgattcgttatcattcggcaatttattacaaaatgttttaataaaaaaagccgcctgtcggcagccgggtgagaaaaattgcagatcacgctttaaagaatgacaaaatcctaaaacttcaatcgttttaggattttgtcaagcagtctagccgcttctttattcttcttcgtcttcatccgctaaaaacgtgttcagcgtctcctcaatcatatcccactcttcttctgtttcaatcggcatcagttcgccgtcttctcctgcttcattcggtacgaagcttgaagcatggatctcgatctcttcatcgtcctgtgcttcaatcggataataaagcacgtatgacttgttaaactgatcgctgtcaaatgtaaagagcacttcacacagctgttcattccctttatcgtctacaattgtaatgtttttttctccgtgttccatcgtaatcacctcatgagtttaggctgtcgagatatccttgaaggatcatcacggccgccattttatcaattactttttttctcttttgcctgcttacatctgctgaaatcagcattctttcggccgccattgtcgagaggcgctcgtcccaaagcacgacgggaacttgaaacgtttcttcaagcacttccgcgaacttctggctcgcttcccccctcgggccgacggttccgttcatgtttttgggaaaaccgagtacaatcttgtctattacatagtctttcgtcaattcggcaaggcggttcaagccgtagtcaccgcccgcctcgtcgattttaatcgtttctatcccttgagccgtccagcccatttcatcgctcagcgctacgccgagcgttttcgaacctaaatccagacctaatattcgcatgcttgtttacgcctctttatgctgttctaagtacgatttaaccaattcttcgattatctcgtctctttctattttccgaatcaggttgcgtgcatctcgatgccttggaatgtaagcgggatctcctgacagcagatatccgacaatttggttgatcgggttgtagcctttttcctgaagcgcgtcatggacggttatcagcacttcatttacattggtttccatcgaatcgtcggaaaagttgaatttcatcgtcttatcaaatgagctcaccgttttgcacctctttcccaaattcgcaggcaaagtttcagcctgattaccttctaatcaccattctacaccacaatggctatttataaaacggattttacccattcttccgcagatgctaatgcttctgccagccgctcaggctgttttcctcccgcctgcgccatgtcaggacggccgcctccgccgcctccgcatgcttctgcgacttgcttgacaagcttgcctgcgtggaaaccccgctctattaaatcttttgtaactccggcggaaatattcactttttcgttttgaaccgccccgagaacaataacggctgagcccagtttcgccttcagatcgtcaaccattgtgcgcaggtgattcatatctttggcattcactttttctgcgagcagtttgattccgtcaatttcttttactttttccaaaatctctccggcttctttattgcccagtttcgccaataaagattcgttttctctctgagcatctttcagatcagactggagcgcttcgatccgtttcggcacttccttcacgttggttttcaggacttctgccgcctgttcgagaagctccagtttggcgttcatctcttcgtaagcgccctgccctgttacagcttcgatcctgcgggtgccagccccgattcctgattcggatacgatcttaaagaggccgatttcagccgtatttctcacatggcagcctccgcacagctcgatgctgtagtcgccgacttgaacaacgcggacgatgtccccgtatttttcgccgaacagtgccatggctcccatcgctttcgcttcagcaatcggttttaagtcgatttgaaccggaatcgatgcccaaattttctcgttcacttttgtttcgatttgttcgagttcttcctttgtcacctgtccaaagtgagagaagtcaaagcgcagacggctgtcagtgactagcgagccggcctggttgacatgcgtaccgagcacatctttcagcgcctggtgaagcaggtgtgtcgcggtatggtttttgacgatgtcttttctgagccgctccgtgacttctgcggtcacgctcatgccttttttaattgcgccgctttccacgatcccttcatgcaggtgctggccgtttggcgcttttttaacgtctgtgacgcgaatagccgcatcaccgcttttaacccagcctttatcaccgatttgtccgccgctttcagcatagaacggcgttttttccagaatgaactgaaccttttggccttcctgaacgagatcgacaagttctccgtcttgaagaagctcggcgattttcgtttccgttttgatatcggaatagccgatgaactcgctttctgtcatgatatcgcggagagcgccgccttgaacctgcatgctgccgacgtcctggcgcgcctgccgggcccgttcgcgctgcttgtccatctcgcgctcaaatccttcatgatcgacttccatgccttcatcttcggcgtattcttcggtcagttcaacagggaatccatacgtatcatacagtttaaagacatcttccccggaaatgatgcggtttccttttgctttttccttttgaataacttctgagagaatcgccaagccttcgtgcaatgtttcatggaagcgttcttcctctgttttgatgactttcgcgataaagtccgctttttctttgacttcgccgtagaaagcggccatgatgtcggcaactaccggtacgagctcatacataaacggacggttgatattgatggacttcgcatagcggacagcgcggcgaagcagccttctgatgacatagccgcgcccctcgtttgacggaagcgctccgtcgccgaccgcaaacgcagccgtccggatatgatcggccacaaccttaaacgccgtatctttttcagcagatgtgccgtacttttctcctgaaatggcttctgtcgccttgatgatcggcataaacaaatccgtatcatagttcgtcttggcgtcttgaataacagataccatccgttcaagacccatcccggtatcaatgtttttcttcggaagcggtgtgtatgttccgtcaggattgtggttgaactcggagaacacaaggttccatacttctaggtaacgctcgttctccccgcccgggtaaagctccggatcagacggatcatttccataatcttcaccgcggtcatagaagatttcggtatttggtccgctcgggccttcgccgatatcccagaagtttccttccagtctgatgatccgttcctcaggtatgccgattttttttgaccataattcatacgcttcgtcatcttccggatgcaccgtgactgacaggcgttcgggatcgaagccgatccatttttgatcggttaaaaattcccatgcccactcgatcgcttcttctttgaaataatcgccgatcgaaaagttgccgagcatctcaaagaacgtatggtggcgggctgttttcccgacattctcaatatcgttcgtcctgattgatttttgagcgttgcagatgcgcggattctccggcacaacccgtccgtcaaaatattttttcagcgtcgcgactccgctgttgatccaaagcagggagggatcttcatgcggaataagagaggcgctcggttcaacggcatgccctttttctttaaaaaagtctaaaaacatttggcgcacttgtgcggatgttaatgtcttcattattttttcctcctttaatgatgcacatgcaaattaaaaagcccccgccccatgcaaacaacgtttacacagggacgagagctcctctcgcggtaccaccctgattatgtgcgtaacaaaacgaaacgcccatcaccttgatatccgaataacgccggatgaagacggcaggttttcgcctgcactcaggattagcttctactgatcttctgttaaagctctttcaccgctatggagcttctctctataaaacagggcttcagtatactcggatccgtcaatcgagatacgtatgtatgtctatttcgaaattatagacaacggaagccgttatgtcaaacttctgccgcttacgcttttcttgccgctaaaaaatggacgagcatcactttgataacagccatgacaggcacagccagaatcatgccgatgatgccggcaagctccccgcccgccagcaatccaagcataatgacaaccggatgcatatgcaggcttttgccgacgacaaggggcccgaggatattgccttcaataaactgaagaatcaaaatcgtaatgatcaccacgaaaacgagcctcgtcgataaagcggctgctaccatgacagccggaatcgcgccgatgacagggccgaaatacggaatgacatttgtcgcgccgatgacaaggccgaggatcagcggatagggcaggtcaaaaaaccaaaatgacaggctcgctcccaagccgatgacaaggcagacaaaaagctggcctctgatgtagtccccgagagaatcatcgacatcccggatgaattcgctgcctcttgctctccatgaagaaggcgtcaaataccataccgcctttttcatcgtatcaatatctttcaccatgtagaatactaaaaacggaatgatcgccgccaagagcatataatcaaaaacgaatcggatgcttcgtatcgtccgttctacccagcttgcaacgaattcttccgtctgattgacgaacctgtcgactctgtcgtgcatgccgtcaggccagccgtctgtatgatgatgcagctgatccagcatgttttcgtatgatgcggcaagaaccggaattccctctgaaagctctgtcagctgtttaatgaggatcggcacccctttgtaaaaagcgtagccgagacctgcaaaaaacagaaaataaatcagcaaaatactcaatgttctcggcacgcctgcccggtgtatcttttccacgacaggcaaaagcagataggtgataaaaaccgcgatcgccagcgggatcagaatcgacttgagcagcacgcagacaggctcccaaatcattctcagctgcaaaaagatatagacggttaatagcaaaagcataaagatcgagacccacattaaaagctgcagcggttttttcagcatgtttttcaccccttgttagcttttgatttctgcttgtaattattccctaagaaaaaaagggacaccccttttaagggtatccctttctgcttaaaacattttcatgacgcgtcttctcagctttctcatgtttcgcttgttcatcatatcgttctgagacgccatgtagtacattaaagccccggctcctaaagaaatgagagaagtcattgtacgattcaactttctaacctccattcaaaggttgatcgttcgttcgtcatctgtaaacagatcgtccaggctgctcaatgttccgtcctcttcgacttgatgggtcgaaatttttccttttgatagggtcagctcaataaagcatccccagcagtaatattgatttacaccgattttgccgatgtttttgcttttgcaattcgggcaaacgagcatttgaacacacacctcttattcgttcaagacgattgtgcttctgcctacttcaagcggttccccagatgagtgaatctgctttttgtcgcctgacaaatcggcaaaaaaaccgtctgatagttcatatgctacgattatgcccgtgtcggaagaaaagtatacatcttccagcatgcccagcgtatctcctgctccgtttttgaccattttttgcttcatctggtcataagaaagactctgcttcggaacttgcatcggcttgaactcggtgaaatcaacgtatacgccgtcacgtccgatttcggtgaccgcgggaagcggaagaagcgaacggggattgtaaaagcgccgcttctcttccataatcaatccgagacatgtcccttcgtgagaaaaacagatatccgttaccaccccaagcgggagagaagactgtctgtcgtaaacattgagtccttccagctcattgcatgttctcaaagtgtgatcaaccacctttttacgaacactcttatgatctgctgttgcgccgcgactcatacgatgaaatggattccatgaaaaacacttattctgcttccttttccataaaatcaaaaggtgtaatgccttccatcccgatattggcgtcatagacgctgaatggcagctctttttgaagcgccatgagctcttcatcctcttcatgtgccgcctgctgaagccgtcttttaagcgatgtctgcctttctgatgattccttatttttcacgccccattcaagggcttcctcttcgccgcacagaatcaggaattttttgcttcttgtaatagccgtgtaaagcaagttccttctcagcatccggtaatagcttttgacgaccggaaggatgacgatcggaaattcgctgccttgcgatttgtggatcgaacagcaataggcgtgcgtaaactggttgaaatctttttttgcaaacgtgatttcattcccgtcgaaagagacaacggccatatcttctttttccgtattttctttcgcataaaaaatcgagacgatctcgcccatgtcaccgttaaacacgttatgctccggctggttgacgagctggagcactttatctccggtacggtacacgacatctccgtacttcatttccctgcctttcggcttcggcggattcagtatgccctgcaaaagggcgttcaactcattgatgccggccgctcctctgtacatcggagccaaaacctgaatatccctggccgaatatcctttttgcagcgcgtttttgacgactttttcgacgacttctttgatctgctgctggcggcagcgaataaaagaacggtcttttgtcggggcggccaagttttccggaagctttccctgtttcatttcgtgcgccagttcaacgattgaagagccttcagcctgtctgtaaatgtcggttaatctgacagaaggaatcacattcgatgccaacagatcccttagcacctgtccgggaccgacggacggaagctggtcttcatctccgaccatgatcacctgtatccgatcggggatcgccttgaataattggttggcaagccatatatcaagcatgctcgtttcatcaataatgagcagccgtccttcaatcggattgtcttcatcgtgcgtaaatccttcggctccgttccagccgagaagcctgtgaatcgtaacggccggcagaccggtcgactcgctcatccgcttagcggcccggccggtcggtgctgccagcacaaacggaaacgtttcatcttttttgtaatcagccggatttaagcttaagccgtgcagctcgctgtacaactcgacgattcccctgatgacggtcgttttcccggttcccggtccgcccgtcaaaagcagcatcggcgacatcagcgctttttgtatggcttctttttggcttggcgcgtactgcactttcatccgttcttcaagctcccctaaagcgagcaggaattccgattcgggaaactggtcatcgtattcggtctgtccggcgattttctgcacccttttggcaaagctttgttcagcgtagtaaagggacggataataacacctttcatcttcaatgaacagctctttttgctcccctaaggaaatgatcgcgtccgccacatccatctcggttactttttcatcgcctgctgactggtttaacagcttttgcgtctcgatgatgagctgtctcgtttctatgtacgtatgcccttcttgaaggcatgtcgcttcaaccgtgtataaaatcgccgctttgatccgctcttcatgtttgcctgagatccccattctgccgcccagttcgtctgctttgataaagccgattccttcaacatctttgacaagctggtacggattttcgcggattttatcgagcgtttccgcttcgtacgcctgataaattttcatggacagctgggggccgaagccgaattcgctcaaggagatcataatctgctcgagcccctgatgctgctgaagggcagcggcaagcttatccgccttttttttggagagcttcgggacatcatacaggacggcgccgtcgcttaaaattttgttgattgccccttcccccagcttattgacaatttcctcggccgttttcttgccgattccttcaaataaatcgctggccaagtattggatcacgccttctttcgttgtcggcacttcctttttgaaatgatccgcttgaaattgcaggccaaatttcggatgggaggcggtttttccgtaaaatgtgtagatatcgtcttcatggatcaaaggaaagtaaccggtgacagaaacggttttgtcttcaaaagactctgatgtttcttccacttttactttcagtacggtatacaggtttgtttcattatgatatatgacagccgttaccgttccttttacaaatgaagcttcttccatttcgatctggtccgggttatggcgctgcatcactgttatcccccctccattcaaaatcggtcatgacggcccttgatcaatcaagcttcttctaaaagctgcttggcgcgaatgctgagcatatgatccggctgaatgtccagcgccttgttcagcatgtcgagcgctgttttccgatcttccttaaacgcataggcaacgcctaaattataaaatgcatcggcatgggacgggtcgcgctccgttacatttgaaaattccgtgatcgcttcgtccagcatcccttcattggcaaggcacatcgcgtaatgaaaacgggcttcgacatccgcatcgttcagctcggcggctctttgcaaatacggcattgcgagcttcggctgctcaagcttcacgagcgtggttccgagcatataatataagtcgctgttttccatgcccgtccgatgcgctttttcgaacatgtccttcgcttcttgataccgctctttcatgacatagacattccctgctccataataagccgctcctgctttctcatccaaagcagccgccctgtcgtaaaacttaagcgccctgtccaattcgccgactgcagaaagcaggttggcaaagttgatataaggcaccggatctccgctgttttcatcaattgcctttgtaaaggcttcagcggctttttcaaagtcgcctttttgcattgcatctattccaatttgattgtaatccaaaagccctctccctttcacgaactattttaaaaaggccgccgacattgccggcagccgttcgagaagctccggggtgtatccagagccccggttttatacataccaaagttgttgtccgtctttaaacacatcatcaatcgttccgccgccgaggcattcttcgcctttgtaaaagacaaccgcttgtcccggcgtcacggcgcggaccggctctttaaagacgacctccgcttcatccgtcccggtcattctgacagtgacttcatgatcggcttggcggtagcggaatttggccgtgcaggcgagctcctcttcgccgccgaagacgcccttatgcacaaagcttacgtttgtcgccgtaatcttatcggagaaaagcagcggattgtcgaaaccttgatctacatacaagatgtttttttcaaggtcttttccgacgacgaaccacggctctccgcttccgccgatgccgaggccgtgcctttgtccaatcgtatagtacattaaaccgtcgtggcggcctttaaattcgccttccatcgtccgcatatctcccggctgtgctggaaggtactggctgagaaacgttttgaaattccgttccccgataaagcagatgcctgtgctgtcttttttggcagctgtcgcaagccccgcttcttttgcaatttccctgacgcggcttttttgaagctgcccgatcggaaacagcactttgctcagttgctcttctgtcagctggtttagaaaataggtttgatctttattttcatcaagccctctgagcattttaacacgcccgtccgtacggtcgacccgcgcatagtggccggtggccaaataatcggctccaagcgacaaagcatgctccaaaaaggctttgaatttaatttctttattgcacatgacatctggattcggcgttctgcccgctttatattcatcaaggaaatattgaaaaaccttttcccaatactgcttttcaaaattcaccgcataatacggtatgccgatttgattacatacctttatgacatcttcgtaatcttccgtcgctgtgcaaaaaccgttctcatctgtgtcatcccagtttttcataaaaattccgatgacatcatagccctgctctttcaaaagcaaagccgccacagaggaatcaacgcctccggacattccgacgaccacccgtgtatcttcaggccgcttcgccattttcatcaactccaataaatcaattcaaaaacttgtcctttcagatcatatcatcattttcgggcaggatgcgaatctttagctcggagcatggcttcccgaaatttatgacagacgcttaacaactttagcaagttctttcgcggcgcgctcaacctgttcctctgtattgccaaagccgaagctgatccggacggatgacgtgagccgatcgtcttcttcgccaaacatggcggagagaacatgagacggaagcacagacccggccgtgcacgccgatccgctcgatactgcgattcccgccatatcgagattgacgagcagcgattcaacagatactcccgggaaatacagattcaaaatatgcggcagactgtgccgcctgctgccgttcacatcgaatgagacgccttctgcttccagcgtacgggtgatgatgtctttaaaccggcggtaaagatccgatttttcttctctttcccgacccgagagcaaaacagcttcaccgagccccgcgattcccgggacattttccgttcccgcccggcgtttgcgttcctgctctcctccgaaaagaagctggctgagcttcacgttttcgttgacgtataaaaagcctgttcccttcggcccgttaagtttatgtccggagacagacatcatatcgatacggcttttttgcacatcaatcggcaaaaaaccgaaggcttgaaccgcatctgtatgaaacagcgcgggatggtcctttagcagatcgccgatctcatctatcggctgaatcgttcccacttcattgttcccatacataaccgtcaccaggatggtatcgtctcgcagtgcgtctttcacctgctcggcggagattcttccgctttcgtcgacgtctagatatgtgacgtcaaatcccatttcttcaagcctgttgcacgtatgcagaacggcatggtgctcgatctttgtcgtgatgatgtggcggccctgcttctctctcgccagcgcgcttccgagaatcgccatattgtcggcttcggttcccccgctcgtaaaaacgatttcattgggatgcgctccgatttcctgagcgatcagctccctcgtgctgtcaagccatttccggctctcccttccaaaggaatgaatgcttgaagggtttccgaagttttccgttaagtaaggcagcattttttccactacccgggggtcagtcggagaagtcgctgcatggtctaagtaaatccgttccatcctaccattacacctcgatcttaaatgtaaaacatatacgcttcctgctcgccctctgtatagctggccaagtcttcaagcgtcgtggagtccagcacttccttgacagcatcgcgaatcttgatccacagttcgcgctttgccggctcctcattttcaagcacttccaccgggctgatcggcccttccaggacgcgaatgatatcgcccgccgtaatcgccgcaggctcctcaccaagaatgtagccgccgtaggccccgcgaatgcttttcacaagcccggcgttccgcaaaggtgaaacaagctgttccaaataatgttccgataaatcgtttgtctgagcaatacttttcaaagaagtcgggccttccccatgctttttcgcaagctcaatcataatcgtcagcccgtatctgcctttagttgatattttcaaaataaacacctctaacctataataaatcatgccttcaggacgaaggtactcggcgtttttcgcaggacgcgaaagaccttagccgagtctcctttcacaccaggacgaaggtgaccggcgtttttcgcaggacgcgaaagaccttagccgagtctcctttcacaccaggacgaaggtactcggcttttttcacaggatgtgaaagcccttagccgagtccttttcacaccagaacaaaggtgctcggcgttcctcacagcaaacaaaagcccttaagccgagtcccgttcaggcgcagaaagcgccgcggtgcatcctcataaggcataagccgatctccaagattgaaacaccggcaggaagccggctgtcggattcaagcgtctgttatatattaaaaactcggttgggacaaggttccggccttgtccgtctgatagattacaggttattatagcacactttatataaactttcattttcggccttatattcagcttgccatattcatttcttttctaatcgtcttttttccgttactctataaaaagaatacattcgggagagatcaatcatgaaaccactcgcatttcgaatgcgccctacaaaaatcgaagaggttctcggccaggatcacctggtcggggaaggaaagatcattcatcggatggtgcaggccaaacacctttcatcgatgattctgtacggccccccgggcatcggcaaaacgtcgatcgccacggcgattgccggcagcacgagcatcgctttccgaaagctgaacgcagtcatcaataataaaaaggatatggaagccattgccgccgaagcaaaaatgtcggggcaggttatcttaatccttgatgaggtgcaccggcttgacaaaggcaagcaggactttctccttccgtatttggaaaacggcatgattatcatgatcggggcgacgacagccaacccgtaccatgcgatcaatccggcgatcagaagcagaacgcagattttcgagctgcatccgttagaccctgaacaaatcaaaacggccattaaacgggcgcttgaagataaacacagaggcctcggttcgtatgacgttgccgtcgatgatgaggcgcttgaccatttggcccgcggctgcggcggagatgtccgctcagctttgaatgcgctcgaacttgccgtattgtccacaaaggaaaacagtgagggagcgatacgcattacattggaaatcgcagaagaatgcctgcagaaaaaaagctttgtccatgacaaagatggagacgcgcattatgatgtcatttccgccttccaaaaatcaatcagaggctctgatgtcaatgctgcactgcactacatggcaaggcttattgaagcgggggatttggaaagccttgcacggaggctgcttgttatcgcctatgaggatgtcgggctggcgagtccgcaggctggtggaagaacgcttcaagccattcaaacggcggaacgaatcggatttccggaagcgaggattccgctggccaacgccgtgattgagctctgcctgtctcctaaatcgaactcggcgatccttgcagttgacgaagcgctgtcagacgtccgctccggaaagatcggcgatgtgccgaaccatttaaaggacgcccattacaaaggagccgctgagcttggcagaggtgtggaatacaaatatccgcacgattacgagaacggctgggtcaaacagcagtacctgcctgatccgctgaaaaacaaagtttactatcagccgaagcagacgggaaaatttgaactcgcactgaaacaagtatacgacaagctgatgaaacaaaaataataaacggcctgtttcttttcattaaggaggccgtttgtcttgaaaccaaaaacgacagcacctctgctgtcgtttttgtattacttatctttcacccttttgatcggaatatctttcaaaagctccatgatcacatggccgcccataatcaagcctgcgactgacggaacaaaagcatttgaagacggcggcatctgcgctttgcggattttcgcttcatcatttccgacgacttggcgtacgtcttcacggatcacgatcggactttcgtcagaaaagacgactttaatgcctttcgtaatgccttccttgcgaagcctcgtccggatgacttttgcaatcggatcggtgtgggtttttgaaatatcggccacttgaaaccttgtcggatctgttttattggccgctcccatgcttgagatgatgttgatgccgcgcttcaggcactctttcattaagtggattttataatgaatcgtgtctgaagcgtcgattacataatccggttcatatgcaaaaaactgttcatacgtctcttcggtatagaacatttttaaagcgatgacgtcgcattccggattaatatcggcgattctcgctttcattaagtcaactttcggctgtccgaccgttgaaagtaaagcaggcagctgacggttgacattcgtgatgtcaacatcgtctttatcgaccatcacgattctgccgacacctgaacgggcgagcgcttccgcggcgaaagaaccgaccccgccgacgcccaaaacggcgaccgtgctgttttttaaaatatttaaaccttcttttccaatcgctaattcgttgcgtgaaaactgatgtaacaagaatctcactccatctttataaacagttaccgatagtatcttatcataatcgggtgattaaacaagcggtctatttcattttgccgtcatattttttcgcttcgcctcatagatatcctatgtatggccgaaaaacggccttttcaagcacaaaaaagtcccgattgtgccgttgtcgtattccttcgtttgatcccgctctcggcaggtgggtgttctgttccaaactttgcaagtcctcctgagcacacgagtgataagaggcatttgctccattcggaaacatcgaactcccaagtaaaaaaatgttcggtcaaaactaggtgtacaacaaacacatcaggactttatttgttaaaaatgatatcatacgtccctttgattttcaatgggatgtacagccgtatattttacaatttactgtcgaattttgcgtttgatttcaaggtgcagctcatcaagctgagcattgtcgacctcgcttggcgcttcggtcatcaggcagcttgcgctggccgttttcggaaatgcgatcgtatccctcaaattcgtacggccgctgagcagcatcaccagcctgtcaagaccgagcgcaattccgccatgcggaggagccccgtaatcaaaagcctcgagcaggaacccgaattgctccttcgcttcttcttctgaaaagccgagaaggccaaacattttctcctgaacgtctttttcaaaaatacggatcgagccgccgccaagttcatagccgtttaggacaaggtcgtaagcctgcgctttcatgtcctgcggattcgtctcgatcagcttgagatcctctctgacaggcattgtgaacgggtggtgtgcggcatagtagcggccttcctcagcatcgtactcaagaagcggccagtcgacaacccataagaagttaaacaagctttcatcgatcaggttcagctctttaccaagctttaaacgaagcgctcccagcgcgtcattggcgacttcgagcttgtcggccacaaagagaagcagatccccgtctgcggcgtcaagcgcctgaacaagtgcctcctgtttttcgccggcaaaaaacttcgcaatcggtcctttaagtccatccgcttctgttttcagccaagccagcccttttgctccatagtttgcagcgaactctccaagcgcatcgatatctttgcgagagtagtttgcagcggctccttttacattgatcgccttgaccgctccgccgttcgccacagccgaagcgaacactttaaagtccgaatccttcactgcttctgacacatccgtcaacagcatgccgaagcgcgtatccggtttgtctgagccgtatcggttcattgcatcctcatacgacattctaggaagcggaagcgagatttcaatgccgtgcgtttcacgcatcacatgcgccatcatttcttctgagagcttcatgatgtcttcctggctcataaatgacatttcgatatcgatttgcgtaaactcaggctgacggtcggcgcgcaggtcctcatccctgaagcagcgggcgatttgataatagcggtcaaaccctgacaccatcaagagctgcttaaagatttgcggagattgcggaagcgcataaaattccccttcatgcacccggctcggtacaagatagtcgcgcgcgccttcaggcgtgctttttgttaaaacaggcgtttcaatatcaagaaagccgttgtcatccaaaaagcggcggacagcttttgtgacgttatggcgcattttcagggagttgaacatctccggacggcgcaagtcgagatagcggtgctttaatctgatgtcttcagatacttctgcagcctggtcgctgatcgcaaaaggaggcgttttggccgcactcagcacatctaccgattccgcctgaatttcgatccttccggtcttcaagtttggattgactgttgcttcttcacgggcaacgactttgcctgtaatgtcaagcacatattcgctgcggatgctttcagctgtttccagggcgtctttggaaacgtctggattaaatacgacctgcacaatgccggtacgatctctcaaatcaataaaaatcaagcctccaagatcgcgtcttttttgaacccatccttttaaaacgacggtttctccgatcgccttctccgttatttcgccacaataatacgttcgtccaaacaaagcggtcctctcctttaactttcagtgtttgttttcaaaaaacggatgaaatcatcaaggccgatggcctgttgatctcctgttttcccatctttgacattaatttgattttggttcagttcatcctcgcccaaaacagcgatatatttcgcattgagacggtcggcggatttaaactggcctttcatttttttctgttcatagtcgatttccgcggatatccccgcttctctcagtttatagagaagggatacggaatagtctttggctttgtcgccaagtgtcacgatatagcagtcaatgccttcatccgctccgacttttacattttcagcatccagtgcggcgagaaggcgttcgatgctcatcgcaaagccgatgcccggcgctttcggaccgccgaactcctcggtaaggccgtcatagcgccccccgccggcaagcgtcgtaatcgctccgaagccttcggcattgctcatgatttcaaaggccgtgtgattgtaatagtcaagccctctcaccagattcggatcgacctcaaatgcaatgccgatgtccgtcagatattgctgtacctttgcaaaatatgctttagattcttcatttaagtagtcaagaatcgacggagccgttttcagcagttcatgatccctgtcttttttgcagtccagaatccgcagcgggttttgccggagccgtttttgacagtctgaacaaaactcgtcgatccgcggctcaaagtggcggatcagcgcttctctgtgagcggttcggctctctttgtcgccgaggctgttaatgacaagcttcaggttgctgagacccgctttccggtatacactcatcgccaaagcaatgacctccgcgtcaatcgccggatcgttcgaaccgatcgcttcgatgccgaattgataaaattggcggtagcggcccgtctgcggcctttcatagcggaacatcggtccaatgtagtaaagcttcgtcggctgaaccggatttgcaaaaagtttgttttccacaaaagagcgtactgcagatgcagtgccttcaggacgaagcgtcaggcttcttccttttttgtctgcgaatgtatacatttctttttgcacaatatcggtcgattctcccaccccgcgggaaaatagttctgtatgttcaaaaataggcgtccggatttctttatattgatacgcatgacacgtttctctcgcaatcttttcgacatattgccagcgttccgattctccggggagaatatcttgtgttccccttggaatattaaatcccatttttaaaatcctcctcatgacttaaatgcttttctcatttatggaaataaaaaaacccccgaacctactataaaaccaatagtagggacgagagttatacccgtggtgccaccctagttggaacgataaatccgttcccgctcatgcctttaacgcaggttcacgtccgccgcctaattgctcgcatgttatgccgggctttcagcgggaaaccttcggagtgttcattcggtcaagataccgtgcagaccgctttcagcccagggcggttcctctcttttcacgtactcttgcctactattctccatcttcagttcagctcatatgtacactaatttatattataatacgagtgttacgtttgcatgtcaaccctatttgcggttctttttattctgaattgattctttggacgtcagccccagctcagtggccgtttcttccatgaagccggcgcgctccgggtccgcatgctcctttagatgcagattcgcatcttgctcatggatcgccctgcccattctttgattatacctcatgcagcaacatccttttgatatcttttttctatagtataaacaaatcattttcattttattaaaaaaacggcaaggaatatacgatatagaagaagaagtagtgttccaagttttttaccgaaaggaggagatgggaatcaatatgaaaaaaagagcggtattgatcctatcgatgatgctggcagcacaagcagccttttatacatcgtcaaacacagcttctgcagccatcggggaagccgtgattgccaccgatgaaatcaatgtcagaagcgggcctggactgagccacgaaatcgtcagcgtcgtcagcaggaatgaaagctatccgattcttgaagaacgcggggattgggtgcaaatccagctgaacggcgggcaaaaaggctgggtcgtatcctggctgatcaagaaaaagagccaagtctccagcggatctgattccgcatcgggaaaagtcacatcttccgaagcaaacttgagaatcagaaaaggccccggcacttcatatgaagtccaaggcgtattccctgaaggagaacaggctgacctgctaaagaccgacggaaaatggataaagatttcctatcagaacatcacaggctgggtctattcagattatgtcaatcaaggttcaggcgcgaaacagtctcaatcgtcttcatcacatgcttcatcatcaaaatcgggaacggtcggcgtatccaccttaaatgtcaggagcacagcttcccatcaaggccggattattgccacgctccaacggaatgcaagtgtgacgattttaaacgaacagcacggctggtatgaaatcgaatttaatggacaaaaaggctgggccgcaagccactatattctcgaaggaaacacacagaacagcggaacctcggaaacaagcagcagctccgaagcaaaacggcaggccaccatcgtgtatgaaggcacaaatgttagaagcgggccttcgacatcctcagcgatcgtcaaacgcacgggaaaaggcgagtcttacccgatcgtctctacaaaaggagactggtatgaaatcaaactgtcaaacggcgattccgcttatgtcgcaagctgggtcgttcagactgttgaccaggcaggctcagccggagattcgaaaagcgcagcaccgcctttggcaaagcggtcaagctcgggaggcacaatcaaaaataaaacggttgtcatcgatgccggacatggaggacatgacagcgggacaatcggaacgcgggggacgctcgaaaaacggctgaccatcaaaacggcaacgcttcttgccgcgaaactgagagccgatggcgtcaacgtctatatgacgcggaatgacgattctttcgtcagccttcagtcgcgggtcgcgacctctcattaccgaaacgccgacgcttttatcagcattcattatgatagctttccaaatgcgtccgtcaggggaaatacggcctattactacagcccgtccaaagaccggaagctcgcagcagacgtgcagtccgagatcgaaaggcactcgcctctgccaagccgcggcgtactattcggggactacttcgtattaagagaaaataaacagcccgccgcattgtttgaactcggctacttgagccatcctcaagaagaagcggtagtcagcacgaacgcttacagagaaagagtgacagacggcatcagaagcggtctagaaaactattttgactaatttaaaaagctcccaatcgggagctttttatgctttcgaatccataataaacgtgacgggacccgaatttgtcagcttgacatccatcatttctccaaatcttcccgtttcgacagtgacgccttttgcgcgaagcatgctgttccactcttcgtacaattgaagcgcctgatcgggctttgccgcttttgtaaaattcggccgtcttccttttttcgtgtcgccgtacaaggtaaactgagaaaccgataaaacggagcccccgacatctaaaagcgacaggttcatcttttcgccttcatcctcaaaaattcgcagattgacaagcttctccgccaaatatgcggcatcctcgctcgtatcttcgtgcgtcacgccgacaagcaccatcaagccgaggccgatttcgccgacagtctcgcctcctaccgaaacgcttgcatctgtgacgcgctgaacaactaatctcatgacgcttttcctcctaattcatcaccctgcgcacggagtaaatatctttgatctgcttaatccgttcaactactttatgcaaatggttaatattttgaatgaagatcgccatatggatcgtcgccactttattgcggtccgatttacctgaaacagatgaaatatttgtttttgtctcattaactgcctgtagaacttcattaagaagaccgcggcggtcatagccgagaatctcaatttcgacgttatattcttttctccgctgggtctgcggttcatgctcccattctacttgaatgagccggtcgagcgcttcatttgttaaaacattcgggcagtcctcgcgatggacggatacgcccctgccttttgtaatgaatccgacgatcggatctcccggaacagggttgcagcattttgacagcctgatcaaaaggttgtcaacgcctttgacgcgaacacccgcttcgcgtttcttcccttggtaaggtttcacttcaggcgttacgtcctgaacgcttttcacctgttcttcctgatctctgatcttccgttctttttccgtaaggcggtttgcaacttgagcggctgtaatgccgttatagccgacagcggcatacatgtcttcttcattggcaaagttgaatttgtcggcgaccttctgcagattctcggctgttaagacgtccttcacttcaaagtccaggtttttaatttctttttcaaccagttctctgcctttttcgacattttcctctctgcgctgctttttaaagaactgacggattttatgcttcgcttgagatgtctgcgcaaggttgatccagtcctgactcggaccgtacgaatgcttggacgtcagaatttctacgatatcccctgtgcgcagcttgtaatcaagggtgaccattttgccgtttactttggccccgatcgttttattgcctatttctgaatggattcggtacgaaaagtcgatcggcacggatcctgacggcaattcgatgacgtcccctttcggcgtaaaaacgaataccatgtccgaaaacaaatcgattttaagagattccataaattcttcggcatcgctcgactcattctgaaattccaaaatttcgcggaaccaggaaagctttttatcaaagcttgaatcttcattggcatttttgccttctttgtaagcccagtgggcagcgattccgtactccgcaatttcatgcatttcaaacgtcctgatctggacttccagcggatcgcccttcggaccgatgaccgtggtgtggagcgattggtacatgttcggcttcggcattgcgatatagtctttaaatctgcccggcatcggcttccagcacgtatgaatgatgcctaaaaccgcgtagcagtccttgatgctgttgacgaggatccggactgcgagcaagtcgtaaatttcgttgaattgcttgttttgcatcgccatttttctgtagatgctgtaaatatgcttcggccggccggaaaagtccgctttaatattgacctcttcgacgcggcttttcacttcgtttacgacctcttcgacgtacaattccctttcggcccgctttttcttcatcaaattgacgatccggtaatattgctgcggatttaaataccgtaaagcggtatcctcaagctcccactttatttttgaaatcccaaggcgatgagccagcggagcaaatatttcaagcgtctcatttgaaattctgcgctgcttttcctgcggcagatgcttcagggttctcatgttgtgaaggcggtccgccagcttgatcaaaatgacgcggatgtcctgagccatagccacaaacattttccgatgattttctgcctgctgttcttcctgtgatttatatttaattttcccaagcttcgtgacgccgtcgacaagcatcgcaacttcttcgttgaatgcttcctttaaatcttcaagcgttacgctcgtatcttccaccacatcatggagaaatcctcccgctattgtggcggggtccatttctaaatcgacgaggattcccgcgacctggatcggatggataatatacggctcgcccgatttgcggtattgttcgcgatgtgcgtcttccgcgtactgataagccttttttataaaagcaacatgttcatcggaaaggtaacttttcgccttctcaatgacttgctcagcggttaatacttgttcgttcgccatggaatcaccttttttataattgaaaactgtattgtaattattatcaagaaaaatgtcacagatgtaaagagaagaaattcaaaagggcttttgccggccccggaatacttttatgaataggaaaaaaagcacccgctttttatgagtgctttttatagtataaaatttgtttagtattgcatcaaggttaaaatatcatatccgtccagtttatttcttccttcaagatatgtcagttcgatcaggaaagcgattccggccacgacgccgccgagctcttcaacaagcttgatcgttgcttcaatcgtcccgccggttgcaagcaggtcgtcagtgatcaagacgcgctgccccggtttaatggcatctttatggatggtcaggacatcttttccatattccaatccgtaatcgactttgatgacttcgcgcggcagtttgccttctttgcggacaggcgcaaaccctaccccaagcgcatatgcgacagggcagccgatgataaatcctctcgcttcaggtcccacgacgagatcgatctctttttccttcgcatacgttacaatttgatctgtcgcgtagcgatagacgtcgcctttgtccatcaatgttgtaatatctttaaattgtacgccttccttcgggtaatccggcacaattgtcacatacttcttcaaatccatctgtcttcatgtcctcctcatactttataagcgccggctttttccgccatccgcttatccagccactgtttaagctcatccgccgaagaataaatgagcttttgctccaattcaatcaggcgctgtttttcccggtaggtttcagaatctgttaaatcgcgcttttcggcatgataaacaacagataaaacaccattctctattgtaacaaaaccgagctcaaaaaacacctttgtcataaaatcaattgtgtcttttgtccagcctttatgtctggcaagctctccgccgtatttcggcaagtcaaaagaacctcttttcaggaggaaagcatagtaccatttaaaatattcccttgttgggaatgttgagaaaaaatgttcgtctgattgataaaaaatcagataaatgcgctccagctttttgccgtttattacatgatcaaagatgtcgagcgactgcggaatatctataaataccgcataacggctctcaaggtcgagccgctctgcatcttcagggccgctgatgacggtcagctcttcttcaaggcctgtccctgccagctttgcttttgtttcctcgcggaagcagatgcacgcccgtttcgcagggtccagcttcaatattttttcttcccatgaccgttttccccgcagatcaaacagctgccattcattgacggccgcatctttgatcatcagctgcggtttttttctgttattccattcgttaatcgacagttccccgacaatcgagatctttgctccaggaacgattccttcttcgatatcgcctttataaaatccgatgcaatcgagcttgttcccgtcgtctgcaagcacaagcttcaaatgattcttgttggcgccgatttttctggcgtcatcaatttttacgtcgctgacaagaacgaacggcttcgggtttcccgtgccgaacggcgccagcaagttcatttcggcaatgctgtcaaccgatatatcttcgagccggcagcacaaatcgacgtcttggacggggataaaatctgcctcggtcagaaccgcttcagcctgacggttgattctctccctcagagccgaaacgtcttccaggttgagcgtcattccggctgccatcgggtggccgccgaagtgcgggagaatatcccggcactcggaaaggttttgaaataaatcaaatcctttgatgctgcgcgcagatcctttggcaattcctttttcttcatcgacgccaaggacgatggcgggcctgtaaaaccgctcgacaagctttgaagccacgattcccacgacgccaggattccagcccggccgcgctacgacgatcacaggctggtcaaggccttcctcctcgatcatctgaacggcttcctctgtcatctgattgacgattttttggcgctccttgttcaaggcgttgatgtcctcagcaagctcttccgcttctctttcgtcttctgtgttcaggaggtaaacggccgggtcagcctgttcaattctgccgaccgcgtttaagcggggcgcgatttgaaaaccgatggtctcttcatccgcgttatgtatctccgctccggcaattttcgccagcgcttttaatcctggacgcttcgttttcctgaactgttccatgccgcgcttggctatctgcctgttttcatcatgaagcggcacaagatcggcaatcgtaccgatcgcacaaaggtcgagcaaatcttccggaagctctccgttcaaggcatgggcaagcttaaatgccacaccgacgccggcaagctctttaaatggatagccgcagcccggctgtttcggatgaatgatcgcataagcatccggcaaaacgggacccggctcatggtgatccgtaatgatcaggtcgatgccgagctctttagcgacttcagcttcatgaacgccggcaatgcctgtgtcaactgtaatgatcaatgaatagcctgattctttgatcccgcgaaaggccgcttcattcggaccgtacccttctttaaagcggtcaggtatataaaaatcggcttgtgctgaacattttttcaacatttgcaaaaggacagtcgtgcttgtcacaccgtccgcatcataatcgccgtaaatcataatcttttcttgatctgaaattgcctgtttgattcgccgtacagctttttccatatctttcagcagataaggatcgtgaaaacgtgcatcattgccatataaaaatgaagatgctttgtcggctgtatcgtaacctctcatgacaagcaatgaggcggcaaggggagtaatgcctaaccttccggcgagctgctccaccttttctttgtcgggcgtttgcacgtcccaacgcatttttgacgctaacataaattcacccctcaaccacactattatactagagcggcatgaggggattcaatttatttcgtacaatctttctagtctttctggttttcgggcgccgccggttcggcttcgagttcaggatgctttgcccgttcttctttcttgagcgccttgagctcttttttcagccgcatgatctggaaagcgccggccgagccgatgataagcgcccccatcaataccgacaccaaaatcaccaggatcaaaggccattctgctgtaccaaaaagaaaatcaaccttcaccggttcaacattaatgaccgcgaaaacagcaacaattaatgtaaaaataagtgcagcaattaacgtccattgtttgttcatgagatactctctccattcgcgtcgttttctagcgttattttcccgctctgctccaattttaaacaaaaagaagatcgatagaaagccgccaaaacaactttttttctattcaaatcaaaaaaagaccgcccggcagtgcgggcagtccattatttattcttctgcaggcttgcgcttcggctttttcagttcgcgccctttccagacaagccatagttgagctgcgatgtagagtgatgaatatactccgctcaaaagtccgaccaacagcgcaacagagaagttcgaaatcgatgcagcgccgaagatgagaagtgcaatgacgacaatgacgacagtcagcaccgtattaatcgaacgcgtgaacgtctgctgcaagctcaaattcacaatatgcgacaagtcgctgaaggttttcggtttgcgctttttcatatgctccctgatcctgtcaaacgttacaattgtatcatttatcgaatagccgatgatcgtcagcacggcagcaatgaaagtaacatcaacctcaagccttgtcaggctgaagacggcaatgatgaaaaacgcgtcatacagcaatgaagtaatagccgcaatcgccatcttgtattcaaagcggatcgagacatacaaaatgatcccgattgacgcgatgatcaccgcataaagcgcatttctcgccagctccttgccgacggtaggcgatacggtgctgacatttggttcgcttccgtatttgtctttaaaataatctttcacttcagcgatctttttctgattcggcacgccgacaaacctggcgacgccatgatcatttttttcgcctgaaagaacgatcgagtcaggatcaagcccgacttgttcaaagtccttttcgagctgctgggttgtcagcttatgatcgctttgaacttcgattctcgatccgcttgagaaatcgatgccgaggttcagcttaaacacaagcaagacgataagaccagcggccagaagaacgcccgaaaatgcaaagaaccatttgcgcttcccgacgaaatcccatttggaaaacgggttcggaggctccgtattttcgtctgtctttctgatatccaaaatgtcttttttgcgcaccccaaaccagccttttttccggtcaagccagcggctttcgaccagcaggccgagcaggaagcgcgacaggaagacagctgtaataaagcttgtcaaaatggataggatcagcatggtcgcgaagcctttgacagagcttgtaccaaatatgaaaagcacgattccggcaagcatcgtcgtaatattggcatcaaaaatcgttgcaaacgatcttctgtttcctgctttaaaagccgaacggaccgatttgccgagcttcagctcttcttttatgcgttcatacgtaatgatgttggcgtcaaccgccatcccgacgcccaatataagagccgcgatccccggaagggtcagaaccgcattcatccagtcgaatatctgcagtgtaatgtagatgtagaccgaaagcgtaatgaccgcaataaaaccaggcaagcgatagtaaagaagcataaataagaaaataatagcaataccaatgattcccgcaaacacggtatcattcaaagcctgctccccaaactgcgctccgacggatgtcgaatacttttcaacgagtttgacaggaagagctcccgcatttaaaatgctcgccatgtcttttgcttcctgaatcgtaaagttgccttcaatcatcacgtctgacgtattcagcacctggctgacattcggagcggaaatgtatttatgatccgctttttgcgattcctttttaaaagagtcgccttttttgtaatcaagccagatgacgagctggttgttcggcttcatatcgagcactttcttcgtcacttcgccgaatttatcggcatccttcagcttgatcgtcacgatcggctcattcgtatcctgcttgaacgactgtttggcgccgttttcgacaagatccgcaccgttcaaaagctctttgtcattcgtatccctgaacgtaagttgagcctgtgtcgataagatttcccgcgccctgttctggttgtcgacgccggcaagctgaaccctgatccggttgtttccttcaatttgaatgttcggctcgctgacgcctaatacattcgcccggcggttcagcgcttcaaccgtgctgatgagggcatccctgtcaattttgtcgccctgtttggcaggctggacttcatacagaacctcaaaaccgccctgaagatcaaggccgaggctgatgttgtctgcagccggcttcgtgaacattcccagtcctgtaccgatcaagagaacggtaaggaaaaacgcaatcaagcgtccttttttcattatgtatttcctccttaaatcaaccaaaatcaacggctacctcagcagctcatcgagcatatcctgcccttctttgctgtcgagtaaattagacgttttaaacgattctacggttgcatagttcataaattcgccaattttcacagataaaatatcaccggccagctggtgaatttgaacatccttccggttcttccatttcttattcaataagtatgaccacaattcctctatttcaatatcgtcataaccgagtattctaaactcttccgtcttgctgcgaagaaagggttttaaatgatccttgtacagatcagccggatgtttgcccatgccaaagccacgctcctttcacattttttcagagagacttgtcatgcttggacgatgtatgcgcatatcttattgtatatgattaaaggttgtttgagaaggcaggggactctagaaatgacgaagcagacgtttttaaaaggaacgctcattttaatagcggcgggtttgattacgagaatgctcggctttatcaaccggattgtcatcgcaaggttcatcggtggtgaaggcgtcgggctttacatgatggcggccccgactttttttctggccgtcaccctcacccagttcggcctcccggtcgccatcagcaagctggtcgctgaagcggaagcgcgccgagaccataggaagacaaaacagattttagtgatgtctcttgcgatcaccgggacgctcagcgccatcatcactccggtgtttctcatttacgccccgctgatggccgatacgctgctcacagacaaaagaacgctttatccgcttttggcggttacgccggtcgtgccgatcattgccgtttccagcgtgctgaggggctattttcaagggaagcaaaatatgcggccgcttgccgtgtcccaggttctcgaacaaattgtccggatatcgctcgtcgccgtctgcacgacagcattccttccgctcggcatcgagtatgcagcagcgggcgccatgctgtcttccgtgtttggcgaattggcttcactcctttatttgttcgtcgcctttaaatacaaaaagaaaatccgcatcagaaaacgttttttccaatcgcttaaagcggggcgaacgacttttttcgagctgatgagcgtctcgctcccaacgacgggcagccgttttatcgggaacctgtcatggttttttgagccgattgtcgtagcgcaaagccttgcgatagcaggggtcgccgcttccgccgcaacgagccagtacggggagttgaccggctttgccctgacgcttctcaccctcccgagctttatcacatattcgctgtctaccgcgctcgttcccgccatcagcgaaggaatcgagcagaaaaaaatgcaggttgtggaatacaggcttgagcaggcgatgaggctttgcctattaagcggcggaatatcagcggtcattttattttcgtatgctgatgagctggtcagcgtgatgtacgggtcgtcaaatgccgccatttacgtcaaaatcatggctccattctttttgttctactatttccaaggccccctgcaggccgtcctgcaggctttaaacctggccggcgcggcaatgatgaacagcttggtcggcgccgttgtgaaaaccggtctcatttttgttctcgcttcacggccttcgcttggcattatgggggctgcgcttgcgatcttgacgggaatcatccttgtcactttgctgcacgctgcaaccgtcagcaaagtgcttcccatcagcattaacctgaaagaatatatcgtatccttcggcgtcattttgatatcagggtggggcagccttctgatgaaagaacacctttttttagcccagtccgagccgatgcgcctgcttttatgtatcgcggttacaagctgtctctacgttttccttctgattgccttcaagctggtcaaaaaggaagaaatccagcggtttccgctgttcggccgctggatttcatagctttctttttaaggcttgaattcatcctttatgtcaataaaaaaagaacctttattgtaagtgcaataagaaattttggaaagatcgcggtgtcctcttttttcaagcttttgctcaagccactcttgatccttcccgatcttttccaattcttctttctgaacaactccgtcaacaatcaacggcagttcgatcattttgttcggcccgtcttttgtaaacactgaaagcttcccggtcggctccaaaatcgcatatgaaacatccccgattcgttccacattcttatctctcagctgcgtcatcaaatcatcgtaattatagcgctgtgtcctcatggcgtgttcatcaatttttccgcggtctatgataatcgtcggttttccatcgagaagccggcggattttttgatttttcaatgacagatatgcaaatataacctggatcagcgtcaaaacgagaatcgggatgatcgtatggagaaggtggtcatcgagattttcaatagccaaaaccgcgatttcggccatcatgataaaaacgacaagatccagtatgctcagctcgcctatttccctcttccccatcaagcgaaacaaaataaagatgatgaaatacaaaacgatcgtccgaaacgtaagagctaagatttcatccattacggcccgcctccttccgcctatcatgatcataaacatagcctttgttaatttgagtcttttatgtataaaaggtcgggggagctagtctatttgcgaaacatgcagaatacatttaaaaagacgagcccgtctattttgaaaggaggatcgtgatgaacgaaccaaaacaagtcggcaaagggattttatacagcttggtggtcattttcgctttgatgtttgcaggaagcctgcttatttcgctgctccttaccttcacatcattaaccgaaagttcattcagctggttgattaccgccatatcttttattaccttgttcatcggcggttttattgcgggaggaaaatcgaaggaaaaggggtggctgagcggagggttgacagcgctttgcttctcccttacggtgcttttgtttcaatatctcggctttggagaggccttcaatttgaagcagctcctctatcattccggctttttgggagtcagcatgctgggcggggttttcggggtcaatctgcaggggagccgtgcataaaggcagcaaaaagggagcggatgtccgctcccttttcccagtgcccgcaggcttctttcgtcattcacatcagaaacaaatgcagcttcctaaaacaataaggaacggcgcttatagcgcgcggacgtccccgtccgaacagcgccgccgtcacgtcgtgtgaaagcccgatttccgatgtttatgtatctttcggctattctgctgacgcctctctgattgcgcggcggtcgaatgtcagacgggtattgtcgcctgttttgatgacaaccttgctttcgtcaattgaatccacgatgccgtgcaggccgccgatcgttacgaccttatccccttttttcagctcctcctgcatctggcggacagccttctgctgcttttgctgcggacggatcaaaaggaaataaagaaccgcaaacattaaaataatcggaagtaatgttccaagcatctccattattttttcacccctttcaaatggctttatcgctttcttcgtttatgtgtcagaaacttttagcatttggtttattaaaaccgtagcgctcaaaaaactcttcccggaaatcacctaaacgatcttcacgaatggcatctctcacttgccccattaattttaacagaaaataaagattatgataagaagttaaacgaattccaaacgtttcgttgcagcggattaaatgtctgatataagcgcgcgagtaattgcggcacgtatagcagtcgcactgctcatcaatcggcctgaaatctctttcatattttgcatttttgacgacgaggcgcccttcgctcgtcatgagcgtaccgtttctcgctatccttgtcggcagcacgcaatcgaacatatccactccgcggatggctccgtcaatcagtgagtccggtgaaccgacacccattaagtagcgcggtttatccgctggaagcagcggagttgtaaactccagcacacggttcatcacgtcttttggctctccgacggatagtccacctatagcatatcccgggaaatccaatgaaatcaagtctttcgcactttgttttctcaaattttcgtactcgccgccttgaacgattccgaaaagcccctgctcgtcagggcgattgtgagctttcaggcacctttccgcccagcggctcgtgcgttcaacagacttcttcatataatcgtactctgccgggtatggcgggcattcgtcaaacgccatcataatatccgagccgagggcgttttggatttccatcgctttttcaggagataaaaacagcttgtctccgtttaaatgattgcggaaatgaacgccttcctcttcgattttgcggaactcgctcagggaaaacacctgaaagccgcctgaatccgtcaagatggcgcggttccaattcataaactgatgaagcccccccgcctctttgacgatgtcatggcccggtctcagccaaaggtggtacgtattgcttaaaataatgtctgcacccatttctttcagctcttccggcgacatcgttttaacggtggcgagcgttcctacgggcataaacaccggcgtttcaaaagagccgtgcggggtgtgcactctccccagccttgctcctgtttgtttacatgcttttatgaactcatagcgtatcggttgctgcgacaaattatgagccctccaatctttttgaattttatttgatcaacatggcgtctccaaagctgaagaagcggtattcgtgttccactgcggtccggtaggcggaaagcacatgctctctgcctgcgagcgcgctgacaagcataatgagggacgatttcggaagatgaaaattggtaatcatcccgtctattgcccggaatgtgtagccgggatagataaaaatcgatgtccagccgctcgcttcccggaagcggccgtcatgctcggaagcgattgtctcaagcgttctcgtcgatgtcgtgccgacggaaatgatccttccgccttcctgtctgacgcggtttaacaatgctgccgtttcttccgacatttcataaaactcggcatgcatgtcgtgttcctctacattttccgcactgacaggccggaatgtcccaagaccgacatgaagggtgataaacgcaatatgcacgcctttttccctgagcgcatcgagaatctcttccgtaaaatgcagcccggccgtcggcgcagccgccgatccttgtttctttgagtaaaccgtctgatagcgctccctgtcatcgagctgttctttaatataaggaggcagaggcatttcaccgagcgactcgagcacctcgtaaaaaatcccttcatagcggaattcaatttttctgccgccgtgctcgagctcttctgtgcagaccgccgttagacggccgtcaccgaacgaaagaacagttccgcgcttgacccgctttgcgggcttgacaagcgtttcccagacgtccccttcctcctgttttaacagaagaacttcaacctttgctcccgtctcttccttgactccgtacaagcgggccggcagcaccctcgtatcgttcagaacgatgcaatcgcccgcgttcagaaaatcaatcacgtgcttaaacgtgctgtgagtgatctcccctgtttttttatccagcaccatcagcctggacgcatcccgctcttttaaaggaacctgtgcgatgaggcgttcaggcaagtcaaaatcgaataattctactttcatcttttttcaccttactctatctatagacttgaatatcgcatcatttcattcgtccgaagaatgaaaacacgacggacagaatgatgctgatgacaatgcatgtaacaaccggaaagaaaaacgtcacgtttccctttttcacaaaaatgtcgccgggaagcctgccgatgacttgcatgaataaaccgatgccaaaaatgacggcgcccagcaccattaaaatctttggaaattcagtcatggttcggaacctccattttaaagtggctgtaaacatcaggggttacgatgcgcccccgcggcgttctttgaataaaaccgatttgaagaagatacggctcatacacatcctcaatcgtgtgagactcctcaccgatagtagccgaaatcgtatcgatgccgacggggccgccgccaaatttttcgatcatgcccatcaaaagcttgcggtcgatatggtcaagcccgagtttatcaacctggaggcgttcaagcgcatcaaccgccacttcctctgtgatggagctgtttccaagcacctgggcaaaatccctgaccctccttaaaagcctgttggcaatccgcggcgtccctcttgaccgtctcgcgatttcgagagccgagagcgaatcgatgtcgacttcaaacagctctgccgttctgatcacgatctctgaaagctcatcacgcgtgtaatactcaagcctcgacagaacgccgaacctgtccctgagaggcgcggttaaaagcccaacccttgtggtcgcgccgacgagggtaaaaggaggaagatcgagcctcacagaacgtgccgacggtcctttgccgatcacgatatcaaggcagaaatcttccatcgcaggatacagcacctcttcgatcgaacggtgcaggcggtggatctcgtctataaataaaacgtcacctggctccagagccgttaatatcgccgccaaatcaccggggcgctcgatcgccggacctgacgtcgttctgagattgactcccatttcgttggcgatgatcgcggcgagcgtcgtttttcccaatcccggcggcccgtacaataagacatggtcaagggtttcctcccgcattttcgcagcttcgatgaaaaccttgaggttatctttcactttttcctggccgatatactgagcaagtctttgcggacgcagactttgctcaatcgctgattcatggttgtctagttcacttgatacaagccgctcatccatgatatcaccttactttaacaatttttgcaatgcttttttaacgtattgatctgtcgaaagcgcctcttcctttttcaaatgaggctggacttttttaatttcccgatcggaatagccgagcgccctcaatgcttcaagcgcttcctcaagagccgttgccgcttcatgaatttgctcccgctcttcatggttaaacagatcggcagcgatttcaggaacggcatccgcaagcttccctttcaggtcaaggatgatctgccttgccgtttttttgcctacgccgggaaatttgacgagaaatgcttcgtcctcattctcgatcgcttcaatcaccgctcccggatcgccggaagcgaggatcgcaagcgctccttttgggccgatccccgtaacattcagcattttcgtaaacagcattttttcttcccttgtcgaaaagccgtacagcgcattcgtgtcttctcttacataatggtatgtatagattgtttctttgctgtttttcttataaataaacggatttggcgtgaagatctgatagccgatcccgccgttttcaatgacaatatattggggcgatacataatcaatcgtcccttttacgaattcgatcaacgttcattcacctctttgactgctcttcattgtaacacaaaacaggcaaagctagaatgaaaaagttaacatatgttcgctaaaaaagcttctgtctgcagctgaaaaaagacataacagcgtcatgtcttcatatcttctacatgatgttggcttccggatgattttacggcttcaatgacatgttcaaattcctttttcgtgcggtatggtatccctttgcgcagatcatccgccatccggctttccagccgctttatatcaatctgaaaaaacgattgaatgggttctgataagatgcccgggcgaccgtgaaaagtcgaaatcacgccatcttcagtcactccgatataaccgtttgttttgctgaggggagaaatgtcgtccacctgtttgcgaaacagaataaacccctttttctgatcgatgagctgccaccctttataagcagctttaaagtcttccagtgtgcgagcggcctctactttattctcaattccaacgtctccgtccagataaaccttttcaagctggatttgaactttagccggcttttcggccaaggcctccaggtgaaagctgagcgcggccagcagacttccaataagcaataaaccgattttgaacttgcttcggctgtacatcaatatcaccttcttttttgccttaacgatcatatccttagtttgaccaacgcttttaaaaattaatctaaaaaagcaagcgatctctttttagatgacaaccggtttacgaatgttacattttcaaaccaatatgaagaactcaaaagcatttaaggtgcaaaacagcccattctcatgtataaacaacattatagagagtttttcgtttgaccagcccttaaaaagaaggtgagctcagcgtgaaaaaggcgcatacctatgcagaagccgtaaagtatgatacgaaaaaaaagttcaacaagcttatccaaaaacccgatgacttggaattgatcgggaaaggcaggagcgcatacgtttttaagctgactgaagagggcggcagggaaatggctcttaaagtcttttttcctgaatttaagaacatcgccgcaagggaagcggagatttacaaaaagctttctgattcgaattattatcctgatatatatgaaacagggccatcatatattttaatggagtatattaaaggatatactttttatgagtgtttaaacaaaggcattcggatcgatgatgacatgatctgcgaggtcgaccgcgcattgaacgatgcgaggcggaaaggattgaatccatccgatatccacctccgaaacctgatactgacgccgtctggaacaatcaaagtcatcgatgtcgccagatttttgcagacgaaagaatgcaggcagtgggatgacttaaaaacagcctatcaaaccctttacaaaaaaagccgtttcccgcagaggcttcctaagatgtggatggaattgatcgcttatctttataaaaaaagctggcttcaaaaacaatgggcctccagaaaaaacaaatttcacccgtaatctgaaacttataggaagcatgctcgtatatgaaataaccccattaccgtcaagaaaggagaaacattcgttgaagaaaaaaaataaacgtaatgatgacaaatgggattatctttatctcgtcgatttgcttgagccattgttttatgtgctgaggctggcagtaagaggacttgcgaaaattataaattaaacactcggtctttcgggtgtttttttgatggctgtgtggcaggcaaatccaaaacaaaaccccttcctcagaaggggtttctttttaatgttctttcaaatttgcgagcggcacttcctgctcgttctccggctggccgagcggaaagattcttgcggtttcattttgttcgtcgacacgctgaatataaatcggcctgccgttataagtaacatcaaccatatcgggtgattcgacgatttcctgggcacgctgcgtattcacctgacaccctcctttagcttttactcataatgtgtactcccgggtgctttcgtattcctttttaaccggttttctttcaaggagggctctcaggatcaatgaatctttacatacaaaggcagatccgtgtgtcccatttcacggacataaacaaacagattgcctttgtggtgaatttcgtgtccgatcgcgagctgcagtagctgttcgccggctacttttcgtccgaagacgccggtcaaatcgacttcacgatccaattcttcatccgtaaaggattcaagcagcgtttttgttttttctgtatacgttttggcaagctcgctcaagcttgtccctgtttcttcgggcttctttttaaaaggctctccgttcccttcctttgccgccgaagcaaaggtatagaaagattgcagcatatgcgtgacaagttcctttgctggcatcgacgtttcagtcggtttgtaatcgagatgtttttcatcaattttttgaatgagttcttctgtcacaaggcggtgggacataaattcctgaacgatgcggtctttccgttccattcttttattcctccttcatgttttagcagttcatacacagaataacatgagtttccattttcagcatctgtcctgcagcaccttgcggaccgccttgacatattttcggaatgttctcgtttttgtctcttccctctctttataggaaaagtcttcgaaaaactctttcctctgagccgtgctgatttcaagctgcacgctcattcctgtctggctttcattattgatgttttcctcagcagttccggcaaatttcccgtccactttgaccaattctgcggaaaagtcagactttttcagagatttgacgatggcttttgccagctttctgtccgttcctcccacaagcgtgtgcggacggtcgcccgaatagccgtggaatgcgatggtatagcggtgttcttttattttctgcaatgccagaggctcgtcaaagtttgtgctggtaatatgaagatcggagttgttctcatccttttttccttcgaataaataagttgaataatcatcattaaaagctcggacaagctcgctcactccgccttctattcttcctccatggggcgaaaagattaaacagtcgcttcccgctttttcgtgataatcaatgtcatagccgcttttttcgttttcctgcaattccttgaagttcttgtatttgtccccggcctggatctgatagctttcccgggttgttttttcggaccacctgtatacaccatttatcatcactgctgcgatcaccaagtagatgagtacttttttcttcattggttattccccttttacactacctttcgatttataggcatgtcctccatgcctcattgtatatttggcttttttgtgacacagttattttacgctttagacatgacgcgttcaattatgaataagtttgataaaaaataaaaatttaaatatttttattaaaacaatactttttctttagtttaaaagatcgataaattttaagaagaaaatctcataagaatgggctcctctggttgcaggtttttcccaaaagcccatccagcttgagaatgaagcattctatcaggaacggggtatacggtttgataaaagtgagaatcatctgcggccgccaccggcagatgttatattttcttttctcccccgttctgttatcctataaccgacaataaaagtgcaggtgataaaacatggaaacagaatatgaaacaaaaggctacgacctgacaaaagtttatgattacaatcaatatccggatgtccgccacggacggtgcgacaattgcgattacaccctttttaaaagctctgtgaaaaacgggcagtttttgcgcgaatgccggcgctgcgggatgaaaaaaagcatttgaccgttacagcaaaattttcgtatgtataaaaaaaacttgtcgacaaggctgaatgcagctttgccgacaatattatcatgctgtccaatatttaagcgtctttttgatctttgcttgtgacgatgccttggatcgattcaccgatctttccgctgagatcggcattcagattgttgagattttgaatgtattcgctgataatattttggatcgcttgattcagttccgcattctcgctttttgtgaagtcagcctctctcagatcgatgccgctgtttttctgtaccagctcatagatggattcgccaaatccggtgataaggctgccgactctctcgatgatttgagcggtttcctgatcttgcgcaccggcgcccatagccgtgaaaggcttctcatttccttgctgttcagccatttatagatcctcctctcatagatgacagattccttcacaatatatgatcaaaaatcaaatcatgtttccgctggagcttgatacggctgctaaatggtttgatgaagcataaaaggacaccgctaatcttgagcggcgcccttttctttaatgaacgttcgtatacacttcctgcacatcgtcatcatcttcaagcacgtcaatgagcttttcgactttttcctgaagcgcttcatcgacttctgcataggtttgcggaaccattgtaatttcggatgttgccagcttgtagccgcgctcctccaagcttttcttcacttcttcaaactgttcgggctctgtataaatctcgaacagctcttcgctcgtttcaagctcctcagcaccggcatcaatgacctcaagcataaactcttcttcatctatctcaagatcttcacgttcgattgcaatatatcctttccggtcgaacatataagaaacgcatcctgtttctcccaagctgccgccgtttttgctgaaagcggttctgacgcttgtcgccgtccggtttttattatctgtcaaacatttgaccatgacagccacaccgcttggtccgtagccctcatacgtaatttcctcatagctttttccatcctggctgccggaagcttttttgatggcgcggtcgatgttgtcatttggcatgtttgcatttttggctttatcgatgacgagacgcagacttgcgttagattcgggatctggtcccccttctttcgcggctacatatatttctttggcaagcttcatgaaaattttgccgcgtttagcatcttgggcattttttcgtctctgaatatttttccatttagaatggccagccataactttctacctccaaaataattctcgtctctatgtacactttatacggttttccccgtttttgtaaaggaatcggccgagcgcttataaaaaattgccggggaatccccggcaattccctgcttgttattggttccgcaagcggttcaaattgttattcgtcgtgtctccgcgatccctaatgttctgaggatcatcgttcatttcgcgcagccttgtaaatgcgccgtcgtcctcgacaacttgaacggtccggtctccggcaaatgttttggctgcttttctaatttgagttctctcgttatttgtcagccttttatcagaccgtacggcgatgatgaccgtttcattcgttacgactgcctggctttcgtcaacataattcaatttgttgacgcgcccagtgatattccttgagattttacggttttccggtctgtcatagcctgtatccgccgtattcaccaaatggttgtgataattcatgtctccccggctgtaagttccatcgcctgttggaacgggattgccgttgcccgctcgattgtttacgtttgttgcaccgtttctcccgttcatgttttcaagcatttctgtaacaggaccgtcattatcaagacctgcattacgatctgcatcatttgaataatatccgatcgggcgcgtattgtttccattatctatagcgtcgttcgttccgcatgcagatagacctgctgtcaaaagcaaaatccccgaaaacactttcagcttgctgtccaatggtagtaccccccgtgaaaaccgctgaatttgagcattgcgctcttttttaggatgtgcgggatgcgaagagttacccttgacagttatagacattcccgttaaatagcatgaaaatgtttatagcggtccacaataaaaaaggaacgatagatcatcgtcccattccgaatcagtcttcatcatcttccggtctgttaaacatctgtccccctgcaggctgctgtccgtatccccccataccgtacggagctcccatttgcggcatctgtccatatggcgccgcacctggaaaacctcccgggaattggcccggcccgcacccgcagtcatcttctttgccgtgtgccatattagggtccccggcgtgaccgacgtttggcggtgcaaatcccgggaacggctggtaaggcgcatatgccggggcagtcatcggctgatgatggtatccgtgatgaccggcattgtcatgccccatgttgtcatcatcgtcatattcagcaggagatacatagctaggctgatgcatataaggcatttgagcaggatatggataccaaggatggcacaatcccgatccaggcagcaccggtgaaacaggaatccagcagcctccaggatagaacggataaggatatggatggtgatgatatcccgctgcagctacattcggcatgccgtgaaactgcttattttcatcacctgctgcaccgacatttggcggctgcggaacattcggataattgacattttccatatggttttcctcctcatttgtccatggattatacatgttggggcctttctcttgatgttcataaggttttggaggtacgtacggctgatgaagctgattgacgctttgatacaaattcgaaatgtcgccttcaggcaaacttgattgtccgatgttcgggacaggcggaacataaggaaccgaaggcttttctttcggttttatatcttcaacatcaagcttgcttttcggcttttcttttgcaaatggatgttcctgctgttttttcggtaattcctttcgcatattgagctgttcttcttttttgaccggcactccccctgacggtactttgattttcatgcccggcatgatcaagtctggattgctcagctgcgaattcagctttttcagttcttcaaagtccacttcatatctttccgcgattttttccagagaatcgcccttttggacaatatgaattttcaacgttttcccctcctatgcaaaaacgtgaacgaacagatgagaataacaaatatgcttctccacaaatttatgcgcatagcggaggggttatgataaaaacttgttctccaaaaagttaacggatcgttaacatccgattcagcgcaagaatggcatcttttgcaatatcttgatccactttgatcacgcctgtcggttcacctttgtcgatctgctccagcgaccacagcaaatgcggcatgtcgattctgttcattgtcaaacaaggacacatatcagggttaagggattcgatttgtttatcaggatgttcttgaatgatgcgtgaaacaaggttcatctctgttccaatcgcccatttgctccccggttttgcttcattaatggagtcgatgattttttttgtagatccgctgaaatcgctgagcgcaacgacttcgtgggtgcattccggatgaacgataacattgatgtccggatcccgctctttaacacttttgatattcgccacggtaaatttttcgtgaactgaacaatgccccttccacaaaatgattattatgtctttcatatcgccgttatactcaagtttttctgcaattggatcccataccgccatcctgcttagaggaatgccgaggtcaaatgccgtgttgcgtcccaagtgctgatccggaagaaataaaatcctctccttttgcgatagcgcccatgtcaacatgcgcgccgcatttgaggatgtcacggacgctcctccgtttcttcccacaaaagccttaatttcagctgtcgaattgacatatgtgagcggaatgaccgtatcgccaaacagcttcgtcagctcttcccaggcgcgatttgtctgccgcatattggccatatcggccatcgaacagcctgcgcgcatgtccggcaaaacgacaatctgttcgtccgaagtgagcatatcggctgtttccgccataaaatgtacgccgcagaacacgatatattccgcttttttatttttttgggcgacctgtgccagctggagcgaatcgcccgtcgcgtccgcaaattgaatcacttcgtctttttggtagtgatgccccgggataaacagccttgctccgaatttctttttgattttcaaaatccttccggccatttcttcctcagtcaattctttatacacctccggcatcatgccggcgttcctgtcatgaatcacttttaaaatagacatctgtaccctctccaatcccgcttattttttcagatcaacattcatgctgatatcaaggcttttcgccgaatgagtcaagtagcccaatgaaatacagtgcacccctgttcccctgtaagcggggagattttcaaatgaaattccgcctgaagcctccgttataatgccggcgggtgtcatttcagcaaatgctttcaccgtctcgggcgggcaattgtcgaacataatgatatcggcgccggcctcaatcgcttcatgaagctcttgttcagattcgatctccacttcgatcttgaccatatggccgcacgctgaccgcgctttttcaaccgcttttgaaatcgagccgcaggcggcaatatggttgtctttaatcatgatgccgccgtccaatccaaagcggtgattgctgcccccgccggttttgaccgcgtatttttcaaggatgcgcaggcccggggtcgtctttctcgtatcgcaaatcgcgatattcggatcattcagcctgataatggactgctttgttaatgtggcgatcccggacattctttgaatgagattcagcacaacccgttcaccggtcatgagggaagctgcacggcctttgagtcgcgcgatcgtttcccctttacgaaccgcttcgccatctgttttcagcatgtggacggcgatcgtttcatcaagcagccgaaagccttccagaatcactaattctcctgcaaacaagccgtcatccttcgctgtgatgacagcttcgcattgatgattgtcatcaaaaacggcttctgaagtgagatccccccggccgatatcttccttgaaaaattccttaagcatgttcctaagtatgaaccgctgcatatttcacaatcccttcgttttgtctgatcttgatcccgccttttgtgtgaacgatttgcttgccgtgccagtttttatcatcaggcgccggacaatccgaacggtaatggccgcccctgctttctgtacgaagcagtgccgaggccgtcatctgtttggcagtctgccataaatgagctagctcgagctgttctattgtgatttctttcacatttacgatttgaaccggcattcgctcaagccattctttcaccttcgtcaattcatcctccgtacgcacgatcgccgcataatctgtcatttgtttctgaatatccttcacatctgtcaaaggaacagaatacgtcacattctcaggctgaggagattggcctctgacaggctccggtttttggcaggcttgaatccgctccgccgctctccttccgaagacgatgcattccaagagagaattgcttgccagacggttggcaccgtgaaagccggtgcaagcggcttccccgatcacaaaaaggtttggaacagccgtttctccccatttattcacagaaacgccccccattaaaaaatgcatgcccggtgaaaccggaatccggccctcttcaatggaaataccggctttttcgcaaagagaagaaatcgtagggaagcggcttttaaagtctgatatgcgggaaatatctaaaaatacgctgcttccgcaggcaagcttttggtgtatcgcccgagatacaacgtcccgcggcgctaaatccagcaaagaatgtatgccttccatcacccgctgtccgttttcatcaatcaacacagcaccttctccgcgcacagcttctgaaacaagtccgtgcgcgcgcccgtctttgacaagcaatgtaggatgaaattgaacgaattccaagtctgcgagctctgctcctgcccgatacgccaaagaaatcgcatcgcttgtcacagaacggttattcgtgttgatttgaaatagatttccgcagcctcctgccgccagcacgacaaaatcggcttttctgagaaacgtcttcccacggctgtctttcgtccagacgccacagcagcgtccgtcttcaatccataaatccgccgccgtttcgtattctttcagcacgacgtgcggaccgagccgtccgattaagtgccggatcaactcctgtcctgttgcgtctcccccggcatgcaaaattctgttcaccgaatgcgcgccttcttttccgaggctcagctttcctgattcgtcagtatcaaaagggaaatgctgaaggatcagctcatcaacaaggcgctgtccgtctttaatggcatcatggaccgcttcgatttgattgtggccgcacccggcatacaacgtgtcgtccgcatgaagcgaccaggaatcgcgaggcaatacagcagatgcaattcctccctgagcgagggttgaattgctgtcttttacagatgcttttgtcatcacaaccacttcataagacggcggaatggatgcagcaaaagacaacgctgcggcacctgctccgacaacaataatcgtctgatgagacatgtcgactcctcctgtaaatttacatgtgtcttgacacctatatttacacatcgataaaataaactcaagtattttttataaagaatgggagacgagcgccgtgatttatcttgattatgcagcgacgacaccggcatcaaaagaagccttggacgcgtttcaaaaacttagcacagacgtatacggaaattcgagcagtctgcacgatgcaggagggaaagccgaaaacattttgcgctgctgccgccaaaggatggcagaacttttatccggagaagaagaaggcgtttattttacgagcggaggcaccgaagccaactttttagcgattcactccatcttaaatggacttcccgccgggaaaaagcgctttttaatgacagaaatggagcatcagtcgatccatattttgaaacggcatctcgagatgctgggatttgatgtcgacttgatgaagccgaatgcttcaggcatcattacaacggatatacttgaacggcacctccgcccggatacgggtctggtttcgattcagcatgccaattcagaaacaggcgtcatccagcctctggcaaagctctcggcttacctgcataagcgggacgtgctcttgcacagcgactgcgtacagacatttgccaagattccggtccgcattgatgagctcggcgctgatgccttatcggtctcaagccacaaagtatacggcccaaaaggagttggggctgtctatattcggccgggtgtaaactggaaacccgtctacccgggcactttgcatgaaaacggctttaaaagcggcaccgtcaatgtccctggaatcggcgctttcattaccgctgcagattcgacaataaaccgcatggatgccgcgcatctcaaattccaggagctgcgcgcaggttttctggaaggagtaaaagaccggaagcttcccgtctcccttgctgtgcccgattcggcaaattcgcatgttctgccgcatattataggttgtttttttcattcctttgaaggacaatatactatgctggaatgtaatcggagaggaatttgcatttctaccggaagcgcgtgttcagcgggctatcatgagccttcgaatacgatgaaagcccttttgatccctagggagctcgcgcttcaattcgtccggatttcattcggatgcgatacgacaagcgaacatgttgataggctgttggacgttcttgaagatatgatgaatgagaaaggagaccatcggattgacagacggattaaaacttacgggagctgagcggcgccagcagctgctggcttggctgaaggagtcagaggctccgcttacaggaagcgagctggccaaaagagcatctgtttcacggcaggtaatagtacaggatatttctttattaaaagcaaaaaacgaaccgatcatcgcaacaagccaagggtacatgtatttgcggtcagccctcggcaaaaaacagccggttcagcggatcatcgcctgtgaccacgaacccgaaaaaacggaagaagagctgaatctgatcgtcgactttggcgtaacggtgaaagatgtaacgattgaacatccggtctacggagacttaacagcttcgatcagggtcagcacaagaaaagaagtcgcggatttcgtcaaaaaaatctcttcgacaaacgccgcttatctgtctcagctgacaaacggcatccatctccacacattggaggcagatgatgaagagaagatcgaacaagcttgcggcgccctgcaaaaagcgggcatcctcattcccgaataaaagaaaaggtcctttgccgttatcagcgcaaaggacctttcttttatagtgtatatgcgttgtaggcaccgagcattttcaccttgcagcccaaagcttcaagctcagctattgcacctggaatcagcacgtcatccagggccatttcaatatcaataatgaagaaataattgccgagaccggtttttgtcggccgcgattcaattttagaaagattcaaatttctccaggcgaaagccgacagcacttggtggagagctcccgatctgtccgaaggaagggtcaccagcaaagtcgttttcggtcttcccttgagttgagggttgaccggaggggatgcctcgcgatccggatgaagcatcacaaatctcgtgtgattgtattcatagtcatgcacatctcttttgacgatgtctaatccgtaagtatctgctgccatttcattggcgatcacgccgatgttctcttccggattttcgctcacgtattttgcagctgctccggtggatgtcgcatattcaaacggaatggagcggaaccggctgtgcaaaaatttatggcattgcgcgatggcatgggaatgggaataaaccttctgaatgtcttcccaagcctcttttctggtaggatgcacaagcaaatgctgacggatgggagcggtgatttctccgacaatataaagaggctgttcgtgaattaagtagtctattgtcagattcaccgatccttcaatcgcattttcaagcgggacgacagccagatcgatctccccgttcatcgccgcatccatgcaggccggtatcgtgttaaatgcttgctggtctgcatctgaaaagcaggagcagacggcaaggtgcgtaaaagttgcttctggacctaaataacctactctcatactcatgatatatgtcattctctcccttaagcgcccgaacctagtatttcgaccttttctacgaattccagctttcttaatttgttcatcagcaaatcgatattttcatccatgcctctcgtactgacagagagcgtgacattcgctcttccttgaagagggatggtctggtggatcgacagcacattgcagcccgattcagctaccacttgcagcagatgggacagcgttcctgagcggtcctccaaatgaaaaaaaagcgtgataatctgttccttgaccatcgtataaaaaggaaaaaccgcatctctgtacttataaaaagcgcttcggctcaaatctaccttttgtacggcttcagctacagattccgcttttttccgctcaatcagctttttgacctcaagtgttttccgcattgcctccggcagcacgtcttccctgacaagataaaaggtctcctctttcacagacttttctctccttttaaaaaccctgattcctttacattgatcctgcgaaaggaagggcgttcctttcagctaaaagtcggagagcttgcttggcaaactctccggtatgatcagtcgataaattcaaattcaaattcgagaagacggatcgtatccccgtcttttgcaccgcgggcccgaagcgcatcatcgacgcccattccgcgaagctgtctggcaaaacgcttaacagactcatctcttgaaaagtccgtcattttaaataagcgttcaagcttggctccgctgagcacgaaggtgccgtcaggatcacggctgatctcaaacggcgcttcctcatcctcaagcttatacatgactctgttttcagccatgtcttcttcgtcgtagagcgggaattccggcgtcgtttccaaacggtcggcaatttcaaacagcagatccctcaagccttgtctggtcaccgcgctgattggaaaaacaggataatcatctgtgagcttttctttgaaagccttcagattttcttccgcatccggcatatccattttattggcgacaataatttgaggacgttctgtcagcctgagattatactgttcaagctctttattaatggtcacataatcttcatacgggtcgcgcccttcaagacccgacatgtcaataacgtgcacgatgacgcgcgttctttcgatatgcctgaggaattggtgtccgaggccaactccttcgtgcgccccctcaatcagtcccggaagatccgccattacaaagctgcggccgtcttccgtttcgaccattccgagattcgggttcagcgttgtaaagtggtaatcggcaattttcggcttggccgaagacacgacagacaggagcgttgattttccgacgcttgggaagccgacaagaccgacatctgccaaaactttcagctcgagaacaatatagcgctccttgccgggttcgccgttttcagaaagctgcggcgccgggttggcaggcgtcgcaaaacgtgtattgccccgtccgccgcgtcccccttttgcgatgacggcttcctgtccgtgctccgttaaatcagcgatgacctgttttgtatcatcgtcaatgacaaccgtgccgggcgggactttcacaaccatgtcttcggcatttcggccgtgctggtttttagacatgccgtgttctccgcgcgctgccttaaaatgtctttgatatctaaaatccatcagcgtgctgagaccttcgtcaactttgaaaacgacgtctccgccttttccgccgtcacctccggcagggcctccttttggcacatatttttcgcggcggaaagcaaccataccgttgcctccgtctccgccttttacgtatattttcacctgatcaacaaacataatgtcctccgttctattcctaaaaaaccgctttacttgatatgaatttcggcgatgcactcacggtctgttacatcaaaccgcttgatttcataaaagtcggccagtgaatgatgaaagtctttgataccggtcagctttgtgaatacgccgtggaaatcgagaaagatgacgaggcggtcgtccggaccgtccgtctgcagcgtgatcgtcagatgattgtcgctgcctttcaaaacggcatcgtcaaaaatcccaaacagctttctgatgagaacgacgagcctttcttcataagctgacaaatccttgacttgaccgatcacctcatattcaagcgtcagcgaatgggccatccagttaaatgtaagcagctcatacgccgcgcgcgggattctaaggtttgaaagctttgattcatgctgagcttcgatgaccacttcatcgataatttcaaatacgcggtcatacttttttaatgttaagtttcctttaatcaattgcagtttattcatccagtcgtgccttgagtggctgagcagatggataagctcatgggtcaaagccttatcgtccatattcttttctcgttttttcgaagtttcttccattttggcactcccaatcgtttggtctctcttttaggagtctgattcagtttgtactttgaattataacagagaaggcagtataaatgaaacacgtttatatactttaacgaagcagaatcagagcggaaacccggccttatttaggcgtcgggaaggtgttttaagcaagtcatggtgctgaatgtaaaaaactccggtcagaacgaccggagtttcgtttaaaggttaggctacaggatatacgctcacttttttgcggttacggccgaaacgttcgaatttaacagttccgtcgacttttgcatatagagtgtcatctccgccgcgcccaacgttttcacctggatagatttttgttccgcgctgacgataaaggattgaaccgccagatacgaattgaccgtctgcacgtttagcacctaggcgcttcgcctcagagtcacgtccgtttttcgttgaacctactccttttttagatgcaaaaaactgaagatctaatcttagcatgtagctcacctcctatattttgttcgtcgttacttttaagtaacaaaaaaaaaatagttcgatcgaataaaaaaaagacgatcatgccttcgagaaggagctgcgccttttcaaaagcctcacgatccgtaccgtccgggaagcggaaagataaaaaccccccgtcttccccgaggtcaatgaccggctcaatgcccgtcagcttcattacggcattgacggctccaaaggcgaccgccgacgcccctgcgcaaacgagatcctgaccatgttcagcaaaattcgcatgtcccgacatttcaaagcccaagatgtctttgttcgatcgggatcttgtaatctttgcatgaatcatatcatacacgccttaagcgttgattttttcgataacaactttagtgtaaggttgacgatgaccttgttttttgtgttggtttttcttcggcttgtacttaaatacggtaatttttttagcgcggccttgtttttcaactttgcctgttaccgtagcaccttcaaccgtagggctgccaactttaacattttcaccgccgacaaacaatacgttgtcaaaagtaactgtttcgccggcttcagcagcaagcttttcgacgtatacagtttggccttcttcaactttgatttgttttccgcctgtttgaataattgcgtacatctctgcacctcctaataaactaagactcgccagtcacagggggctaagaaagcacttaacgcctgtgctgagcggttgtagcacgggtgctacatccataacattaaaaaatataccagaaaagagcccgagtgtcaatgtcttttagaaggatggtcaataaaccagaagcagatcttccattgaggaagtcgtgcgcttgtctgtaaaataagcgtggagaacttcattttcatccagctggctcagtttttgtccgtccttctcaataatgatcgggtgtttgcagccccttttaaacatgagcatgacctcataaatctgctgttcggcgcacaccgtgatcggtgcgagtcgccgcacttccctctcatttccatagtagcgctcaagcaaaaaacggatatgggcgtaatgccgattgcgatattcctggtaaagggatgcagccaaaaatacgagaagcacccaagcgctcagctgcgacggggagaccagcagagtcgccgcgattagaacagcgcagcaaaagcacgatacagccagcatcatccgctgcgctttctgatacggaaggtgttttgaaaacagcagaaacagcagcttcccgccgtcaagcggccaaataggaaacagatttatcaagaggatggtcagattgtaaaaagtaaacgtttcaaatatatgagggctgatgagcgaattgaccgccaaaagccaggctgcaaattgaagccaaatgtgctgaacaggccccgcggcgatgacggcaagctcttcctttaacggtctgttgccgtgttcatcgacttccagcgttcctccaaaaggcagcaggaaaatgcctttaattctccatgaaaaataaacggcagcagcagcgtggccaagctcgtggatcaaaataatgatcattaaacaaaacagcgctttaatatgtcctgtcatgataccgatcgccatgacaagccacagcagcggatgaatgtgaagcttggtgaagagctccgtccatttactcaaatgtgatcacctgtatcggatcaacaaattcctctccttgtttgatcgcaaagtaatagatgcctttttgatttttatcctgctcaatcgttccgagcttcgttcctttatctatataatcgtataaagcgacatccgcttttttcagctggccgtagtaggtatagctgttgtccgcatgctgcaagaccaccgtcaggcctgtttccggatttttgtccacttcaatgacatagccttccttcatgctgcggatcgtttcgtcttctgtttctaccttaatgccctgccctgagaatttctcctgaacctttcctacggcaggtacagcgagatcctgattcacctcgacctggccggacggtttggcgcctttcggctgaaagaatgcgaggggatcgccgaacttggattcataccaattctggagggccgcaaattggaactcttcagtaaacacctggctgataaccggtttgatttggtttgcgggttcaaactggcctttgtaggcaatggcggacacaagaacaaggcatgccgacagaagacatttcaagatgagcgcatccgccttgacaagcgggtgcttcccgtttatcagcagggaacttccttcaggcggagggaagtctcctcctttttcatcttccgaaaaggctgtccatgcaggcggcttgagcggccgctttttgccgtctgatgaaaagggctgtttgtccggtgttttccgctttcttttcctggccattctttttcgaatctcatctgctctatgactcataaccctcatcctttacattcaggttcgtttgttcaatgatatgccttgtcccagggaattatgacggaacattgacataaaactaaaaggtttcatataatagaaaggaaaccatttggttttacttttttctaggaggtctattatgagcaatcaactagtgcctgatatacataaacaggctgtttttcacgcatcgatagaaaaagtgtgggaggccgtcgccaccagtgaaggcatcgccgcctggtttatgcctaatgatttccgcccggagatcggctgcgaattcaccctgcagtctcctttcggcccctccccgtgcaaagtgatcgagcttgatgcgccgcatcgactcgctttcagctgggatacgtcgggatggatcgtcacatttgaattgaaagagctttctgcagaaaaaaccgaatttaccctgattcattcaggatggggtgcgccggaagaaacggtttcaaaagcgggagaaaagcaagcggatgtccgcaatcggatgaatggcggctgggaaacaatcgtcaatcaaaagctgcgtcaggcagttgagggctagtgacatccgccgcaaaacatgatgtgttccaagccgtttccgatccctcccggcgaaaaatgctggagctcctcgccggcaaagaattgcctgtcacagatatcagcagccatttcccgatgagccggacggctgtttcaaagcatctcagagttttgtccgaagcaggcctagtcagcgggagaaaagcgggcagagaaaaactgtacaggcttcatcccgaacctctcgccgagctgcagcagtggctcgcctacttcgacatgtattgggacaataagctttccttgctaaagcataaagtagaaaacgatcaataaaactgcaaaaaaagcaatctcgctttggagattgctttttgcagttaagcgcgtacgccgaaaaatgatttaatctttgcgaaaacgcctttattttcttcttcaaacgactgtaaaggcacagattcgcccagcacgcggcgggcgatgttccggtatgcgattgaagctttattattcgggtccatgacgacaggctccccgttattggaagctttaatcacttcatcatcatccgcaacaataccgatcagttcgatcgacaagtgctgaatgacttcatcaacatccagcgtatcgccgtttttcattaagtggttgcggatccggttgacgacaagtctcggcggctcaatattttcttccttttcaagcaggccgatgatccggtcagcgtcacgaacagcggagatttccggtgttgtcacgacaatcgccttgtctgcgcccgagaccgcatttttataaccttgctcaatccctgcagggcagtcaatgacaatgtagtcgaagtcttgtttgagctgctggatcagcttgaccatctgctcgggcaaaacagccgacttatcgcttgtctgagcggccggcagcaaataaagcaaatcatcaaagcgcttatctttcacaagcgcctgatggattttgcatcgttcctcaacgacatccaccaaatcatatatgattctattttcaaggcccatgacaacatcaagattgcgcaggccgatatccgtgtcaacgagacatacccgtttccccaaaatggccaaggcggtgccaagatttgcagacgtcgtcgttttgcctactccgcctttccccgaggttattacgatagcttcacccaattttacattcctccctcaagccttgttaaactaggtcttaaatgagctaattgctgaaggcggtcaatgaccatattctcattttcatctaaataagcacattccatgtcgttcccttcttggatgttgtctggggagcgattgagcacatgattgatacgcaattgagtcggtctcatatccgaagccgcaataacagctcgtttatttccattaaaaccggcgtgggcaatccctcttaatgagccgaggatgaaaatattccctccggctttcaccattcctcccggattcacatccccaatgagaagcaaatcaccctccgtttcaaggacttgcccggaacggacaatcttagcgacagaaataatttcgctttccgcttttaagcggtttgcttcatctttggtcatgacttcactttcaatggagtggatgaacagattttgtttctcagtgatcacatcggtcaggatctgttcttgctcctcggtcacatagcggtggccgagcttaacgagaacattgattttctggccttttccatccatataatgttcgagtgacagcatatcctgaagaccgtacaataattcttcaaaagagcatgtgtcatcaagatgaagcgtcaatccatttttcgttcctttaattgttacgtattgctgcttttgggtcttcacggtgttcacctcaacatcatactcttttcgacatcggctcataaaatcctctttttactcattcctcagctctttcttaagactggtaaaaaaccatttgaacgggtaaatgagcagaaggccgccaacggcgttcagcgcaagcgtgggcaggagcctgccgagcacaaattgatggaacggcataatttccggacgtatcagcatctgcacgccatattggtaaaattcaagaacacagacggcgagcagcgaaataaaaatgacgaccagcgcgtttgtctgcaatactttgaacgcttttgacgataaatagcaaataccggcaaaaccaaacatatatacacctaaaaggtcggtgtaattaatatcatataacagtccgaaaataaatccatatgtaatggcaaaaggctgattgacataagccgtcataaaaactaagacaagcagcagaaaacgcgggatgagctgctgttcttccgtcacaaaaggcaagttgacaaaatccgcatagacgctgtcagatactaaaacaaacatcatgacgacgggaagaaggaagcgtttcacgacccttcctcctcatcgtccatcttgtcgacatccaccgtatcaagcgttctgtcgacgacgatgacgttatcaaggttatacatatcggctgccggctctacataagcgattttcgtcaaaccgtaggaatctggttcaacctctgtcacttttccgattgtcaggcctttaggaaaaacgccgcccgcaccggaagtttcgacgaggtcaccttttttcacttccctgtcttcatcaggctcgatgatttccatggaaagcgcctttttatctgagtcgtagccgttgatgattccgttcaccgttttcttgcctttatctgcagcgataactgtggagattctgttgtttctgtctgttgcgcttaaaagctggacggtggaagtgaaattgttcacttttgtgcttttgatttttccgatcaagttgccgttttcatctgttaccgccatatccttctcaacgccgtgctttgaacctttgttgatcgtaatcaggttccaccactcatacttatcgggatttctggcgataacggtcgccagaatcggcgtgtagtctttaattgatttcagatggccgagctcttttcttaaagacttattttcattttcaagctcctgcagctttgcctcgtattgtgtctggccgtcgagctttttccgcaggcgctcattttcgctgtacgtattttttaagtcttcgatattttcaaagaagcccgcaaaaaattgagcgggcgtatgaaaaatcgtctggaatacaccagttgtatcgccaataaatttttcgggccaagttgcattccggtcattctttaacgaaaatccaatcattgccactaaaatgatgatacaaaggagtaaaagcatcaaccgtttatttgtaaaaaactgcggcatgattatacacctcttctattccctgtgtccttaatttttgcctttaaatagatgaatttgctcgagagctttgcctgttccgatcgctacacagtcaagagggtcttccgcaattaaaaccggcattttcgtttcttcgctgatgactttgtccaggtggcgcagcagtgcgccgcctcccgtaaggacgattccgcggtccataatatcagccgcgagttcaggcggagttttttcaagcgtattttttacggcatcgacaatggcggtcacagtgtcgcgaagagccgctgtaatttctttttcagtgatttcaatcgttttcggcaggcctgttaaaagatcgcggccgcggatctccatgctttctccgttttcagaagcttcggcagaaccgatttcaagtttgatcgcttctgcagtccggtcaccgatcatcaagttatatgtttttctaatataagtaatgattgcttcatccatttcatctccggcaacgcggatagactgggatgtgacgatgccgccgagggaaataatcgcgacttcggtcgttccgcctccgatgtcgaccaccatgcttccagtcggctcccaaacaggaaggtttgcaccgatcgccgctgcaaacggttcttcaatcggatatgcatctctcgctccggcctggcgcgtggcgtcgataaccgcacgctgctcgacggccgtaattcccgacgggacacagaccatgacatacggctttctcgcaaataagcctttgtttttaactgctttgctaatataatgcttcatcattgtcgctgttgtttcataatcagcgattacgccatccttcatcgggcggagggcaacgacattgccgggcgtacgtccgatcatgtttttcgcatcatttccgactgcgacaatctgctttgtgtctgtttgcagtgcaacgacagaaggctccctgacgacaattcctttacctttcacaaaaacaagcgtattcgccgttcctaaatctattccaaggtctctcgcaccaattccaaacatttgtatgtatcttcctttcttaaaacaatattcctaagcaaaaacccataaattctattatagcttaatttaatgaaaaaaaaagtgttacaaatatcctttttcttttaagctcacaaatttttgatcaccgatgatgatatgatcgagcaattcgattccgagcagctgtccggactcgtgaaggcgctgtgtaacttctatgtcttcgcggcttggagccggatctccggacggatgattgtggacgcagatgaatgaagctgcggagcgctttaaagcttctttaaacacttccctcggatggacgattgaagagttcaggctccctataaaaaccgtgcgcttgtggatcacctggtttttcgtgttcagatacacacatacgaagtgctcctgagagagaaagcgcatatcccccattaaaaaattggccgcatcttcgggaaaacgaatcacataacggtctttgcaagccagactgtgaatgcgccggccaagctcaagggccgccaaaatctgcacggcttttgcgcggccgatcccggaaatgcttgaaagctcctcggcggatgcttcttttaacaaacggaggccgtcaaacgtttgaagcagccggcttgaaagctgaagaaccgattcttttttcgtaccggttctgagcagtatcgcaagcagttcatggtttgacaaactttcggcgcctgtgttgagaaggcgctcccttggcctttcttcatcaggaaaatcttttaatttcaatggcagatcgcttatgataaaccctcccttttgattcccttctcgttcggtacatcaaaaggagtggagatcaaacgttttcagcattctcatcgttttggaaatcggaaggcccacaactgtataatagtctccttttatctgtttgacaaaaagcgcgccttttccttgtattccgtatgaaccggctttatcaaacggttctcccgtagcgatgtaagcgctgatttccttttcttcaagaggccaaaaagagacttcggtttcctcaaaaaatgtttcgcatctttcgccgtccttaatgcagacgccggtgagcactgaatgggtctgtcccgaaagcatgctcagcatccgttctgcatcttcggcatctttgggcttgcccaaataagctccgtcataataaacaatggtgtcggcgccaagcacgacggcatcaggatattgttcggctactgcacgcactttttgttccgccaaccatttgacgttttctgctggtgaaaagtttcgaattaatttttcttccgcattgctcgtaacgatgctgtacggaatctgcaggagatcgaggagttcctttctgcggggtgattgtgaagccaatatgagctgtcgggtcataagaagccatcctttcaaaggtttttgcataggaaaaaaagatacctgttttatcctaccaaaagaacgccgccgccacaatttcagaaaaataactttttaatgacaaaaatcgcgaaaataaaaaaaccagcacgtctgctggttttctatttatttaatttggcccagcaatagctgctggctcttccagccgttggctgcggtcggtttctccagaaggttgacggcttccagtatgctcttctttacctcttcagagccttttgattgggccccgtcaagttgagctttgacatcggctatgttttgagatgtaacctccgcgccgagaatcgcttttgccgacagctcagccgcttctttaaaaggctccagcaaaccggactcgattgcaaccggaagctcttttccgccccacgcttcaaaatcgttttcgattaatattttgccaagttcagatgtcatctgcttttctcccgttattccggcgattacataaaacccgtcgtccttggcaatcgacacggcggcataccccttgtctgcgatttgagaggccagcgtatccgctccttctttagacgaaaactttccggcctgaacggcgaagctgttaaaagattctcccgcttgtccgctatttttttctccgctctttttctcctcggcaccggagtcaccggctttaacggtctggccgttttcagcatccgccccaagactgccggaagccggcactccttctttatgcgttgcgagattcagcgcaaacagaccgagtcccgtcccgagcaaaacagcaaagacgatggtcgcggcaaatcgcttcacaggatacgtaagagacgttttcgttttgcggttgtttttgggctcgtttttcttttgataaggcgccaccactttaggatcgtctttgtagacggtttcttcttcgtccggtggcgtccatgtaaattcacctgtttcatgtgtgccgtcctcttttgaagccgatatttcccgttctgcctttctcttttcttcccagttcgaaaaggtaaacttcttttcttcatttctgttggaaaactctttttcatttccgtagatagtctcttctctgccgttgatcatcactttaagcgggtcttgttcgggcgcttttttagctgagtttttcttgcttttccgttttttcatatgcttccctcgctttctgttaattgttttatattgatttaggcggcagcttggccgctctctatacgctcggcagagggaagccagaaggaaggaggagttctcctaaaggctgtccctcttaatgtccacactttatcacagcctcaaaaaaaaagaacaagacttttgtcgtcttgcccaaaaaggtttcgtcaaatttttcaccaccatgccgtttgaaggtaccactcgatcattggttcgccatagaagcagctcgtcagcgtcccggccagaatcgcgggagcaaacggcattggttcatttttcttcagtttgcctgccaggagtgcaataagaccaagcaccgttcctgcggctgccgagaggaaaaaagcgagaacgaggaggcggctgccgagcgccatgccgattaccgcaaacagctttacgtctccccagccgatcccccctttcgtcaaaagcagcgtcaagaggggcagcataccgccggccatcgcaccgctcaaacttgagtgccactgttccagaggaacaaggaatcgtccgacggcaaagacaggcaggaaaaaacaaagaacagcatccggaatgatcatgtgtgtcacatcagatacaaagacgatcaaaagcagagatataagagcaagcacaatcaccagctccccctcatgcccaacgtgcatgccggcaaacgcaaacaggatggcggcggagagctcaactgccggatacacgatcgagagcggggtttgacatcctttgcacctcccccgctgcatcaaataggacaaaaccggtatcagctccgagaagcccagctgccttttgcagacgcggcagagggaacgcggagcaatcaatgatatcttttcaggaatgcggcgcccggccgaattaaaaaaagagccgagcactaaacctgccgtaaaaaggtaaaagatgaacatcgttatcaacctcgcagaatcaaatttcatgaaaaaagctgctgcctagcggctgttattttagcaaatatgaagcgcctcctcttttcctaaaacataaaaatgcgccgtcagccggtggccaaaagcgcatttttatgttttattcagttaaagctgccctgacggcggaaataaaataaagcgacccggtgataacgaccaccgctttttcctcttcagctttttcttcgatataccggaaaacagaggcgatgtcttcatcaaatgttttataatcagcggtactttgctcaaacagcttttgagcggattccgccctcgggaaatcaaaggatgtgaagtgaatcgatgacgcaaacgactcgattttgcggatcatgtctctgtacggcttatctttaagagcgctgaagcatacgtgaatattccgcccggcgaagtgggaggagatcgtctcggccagccgctccatcccttctttgttatgagcgccgtcgatataaacaagaggcttgttcaataccttctcaaaccggccgggccatcccgcgttacgaatgccgcgtttcagctctttttcgccgatcgccgcatgtttttcggctgtcagccattcggccgcaagtatggccaaagacgcgttttgccgctgatgggtgccgatcaggcttgtttcaattccttcataatgatgtaacggtgttttcaacgaaaactgctctccctcaggcaatgaaagctccccgtacagctggcaatcctcgtgaagggatataaaagcagattctgtctccatcgcctttcgctttatcacctcagccgcttcatgctgatgaacggctgtgataacaggaacgccgcgtttgatgatccctgccttttccgcggcaatctctttcaatgtaccgcctaatatcgccgtatggtcatggccgatcgaagtgatgaccgttaacatcggcttcacgacgtttgtcgaatccaaacggccgcctaagcccgtttcaaaaataacaaaatctgtccgcctgtatttagcaaaatataaaaatgcgcatgccgtaataatttcaaattctgtggcggctccgaattcggttttttcaagctcaaggacaagaggcccgacctcattaaagagcgccgtccattcttcatctgagatcggggcgccgtcaacgctgatccgttcgttaaaggtgatgatatacggtgatgtgaaggtgcctgctgtataaccggcttcatttaataccgaacggagaaaagcgatcgttgaaccttttccgtttgttccggcgacatgaaccgcattgagctttttctcggggtgcccgagctttctcagcagccattccattcgttccaaacccggcttcacgccgaatttaagccttccgttaatccagctgagtgcttcatcaaacgttttgaacaagcgcattccttcccttcaattgatgaaggtgttttccagcggctttagaaagacctggaaaacacctcctttttcgtgttatcagtttttcaattcggcgattcttttttctacagcttcacgcttcgccgtataatcggcttctttcgcccgctcttcttcaatgacatgtgcaggtgcttttttcataaatccttcattgcttaatttcttctgaacccgttcaacttccttcgtcagcttatcgagttctttttgaaggcggctgatttcttcgtcaatgttaatcagaccttcgagcggcaagatcagctcggcgccagatacgacagcggtcatcgctttatcgaccgcttgaatatccgttccgatctgaagaaggctcggattcgtaaagcgttctacgtacgaacggttttcttcaagtcgttcagcgatttccggcgtgctcgttttaatataaagttcaatctgcttgctgagcggcgtgttaacttcgctgcggatgttccgtacggcgcggatgacttcaacgagaagcttcatatccgccgcggcctcggtgtccgtatattctttgacggcctcaggccatttggcgactgtaatggattccccttcgtgaggaagatgctgccaaatctcttccgtcaggaacggcataaacggatgcaggaggcgcatcgtttgatccagcacatacgctaaaatggagcgggttgtcttcttcgccgcttcatcttcgccgtaaagcggaagtttagccatttcgatgtaccagtcacagaaatcatcccagataaaattgtagagatggcggccaacctcgccgaattcgtacttgtcggccagctgtgtcacggtttcaatcgtttcattcaaccttgttaaaatccacttatcggcaacggatttttcccctgacaggtcaagctcttcgtatgtcatgccgtccatgttcatcagagcgaaccttgatgcgttccaaatcttgttcgcaaaattccatgttgactctactttttcaaagctgaagcgtaaatcctgacccggagagcttcctgttgcaaggaagtagcgcagcgaatccgctccgtacttgtcgattacatccatcggatcgacgccgtttccgagcgatttgctcattttgcggccctggtcgtcgcggatgagcccgtggatcaagacatctttaaacggacgttctccggtaaattcgataccttggaagatcattctcgatacccagaagaaaataatatcgtagcctgtgacaaggacgttcgtcggatagtagcgcttgaaatcttcctcatcgatatcaggccagcccatcgttgaaaacggccaaagagcggaactgaaccatgtatcaagaacgtctttgtcctgctcccagttttctgcatcttccggcgcttcaacgccgacatagatttcaccggtttctttatggtaccatgccggaatccgatggccccaccagagctggcgggaaatgcaccagtcgcggatattttccatccagtgcagatacgttttttcaaaacggtcagggacgaagttgactttgccttcgcttttttgcaattcgatggcggcgtcggcaagcggctgcatttgcacgaaccactgtgttgacaaatacggctcaacgactgctccgcttcgttcgctgtggccgaccgaatgcgtatgttcttcaatcttgaacagcacgccctcttcctgaagatctttcacgatctgcttgcggcattcaaaacggtccatgcctttatattgaagggcattgtcattcatcgtgccgtcttcattcatgacgagaatgcgttcaaggttgtggcggtttccgatttcaaagtcgttcggatcatgggcaggcgtaattttgacggcgcctgaaccgaattccatatcgacatagtcgtctccgacaatcgggatttctctgcccgtgatcggcagaatgaccgtttttccgattaggtgtttgtaccgctcgtcttccggatgcaccgcaaccgctgtatcgccgagcattgtttccggacgggtcgtcgcaatttcaatcgagcctgaaccgtctttcagcggatatcgcatatgatagaacgcaccttgtacgtctttatagatgacttcgatgtctgacaaagccgttttggttgccggatcccagttaatgatatattctccgcggtaaatcagccctttttcataaagctttacaaatacttcgcgcaccgctttagaaagcccctcatcgagggtgaaccgctccctagaataatcgaggccgagaccgagctttgcccactggctgcgaataaaatcggcatattcctctttccaattccatgtttcttcaaggaatttttcgcgtccgagatcatagcgcgtttttccttcttcacgaagcttcgcttctacttttgcctgggttgcaataccggcgtggtccatacccggcagccagagcacgtcatagccctgcatccgtttcattcttgtcacgatatcctgcaaggtggaatcccaagcatgccccaagtgcagcttacccgtcacattcggcgggggaatgacaacggtgtacggttctttttcaggatcgtttttcgcttcgaaaaatttgccgttcacccaatagtcgtatctgtctttttcaactgcagacggatcgtattttgtcggcatcgtcagttcttgattatccattttcaaacctccaacagtattaaacggctgaacaataaaaaagagtcctcttgatcctgttaaaaggacgaagagaactctctcgcggtaccaccttttttcatgaatgcaaaaaaaacgcattcacgcacttaaatgggataacgggactttcccgaatttctctacttttttgttcgagaaattgcgctcctgggcgaccttccaaaaaagactgactgggagcctttcagcgaaccggcttccctctctgcaagcgtctgtttttgtactcttcccattcaaagcgggtgatcattgacttttcagcacgtactttttctttttcttatattactaaatctttttcattttcgtcaatcatcttttccgtttttctgttgttttatacgagattgggccatgcacacaagctccttttcctcatatgatgctgtaacgaaaaggagaggaggcataagatgcgaaaaaaattcaacacatattcattccagccgtggctgaagcaagtcaggcttgttgctgttcaagtcgtcctcccgattacgatattccagggcatccgcacgatcatctttcctaccacatttgatgtcctccttttgggcattctcatattccttgcgtgcgcctttcaccttgactggatttaagcacgaaaaaaagtccgcatcatgatgatggggactctgtttcttcctgcagttttctgttttcttccgtctcgtgaatgctcatcacaagcggctcagcgtttttcatttgccagtacgcctttaaaagccttgtacaggcttctttttccccgagccccttctcatgttcgtagcggttcagtacgccgaatacaggccccgggtaagccatatagctgaggaataagccgatttcttcctcccgcaaaggatagacattgtgatacgtataaaaccagtttacacattccgtgcacataacggggttcgtcttaaacattctagtaaaaaatacgatgagatcatttgcaggcggcgcatgtcccgctttctcaaagttcgtaaagtaacccgttccggtatcgttatagagaaaatgccgaacggacaggtgcccgtggtttaagaccattctggcagactctttttctctcatggcttcatgccaatcttcaaggcgggcgagcgcaaagtcggcagctgatatcgtctctttgaaatacatggccgcctgaagctggaacggggacatataccattcgttttccgctttcatgatgaatgcttcatatttctgtttttgctgttcccatttccgttttgtccgttcatagtgtccgagtatttcttcccgcctcacgccgagctctttttccgtccgctggtgaagaagagcgatttctttaaacatatattcgtgtttttgatcccgctcttcctccctttcaagagtaagccagggcatgagatagcagacatcttctccggcttgcgttaaaaattcgcctgtgcggtttcgatagacaggaacgaactgcctgtagcctttttcctccagcatgatcatctgttccgtgaagcgggtgtttcttgaagccgccaattttttcagagcaaatacaccgtgatccgtatacactttccacacctttgaactgacggactccatatattcaggcgtaagaccgtactcatttaaaacagactggatgccttccatcggcttcaccacatttttatcaatgcattaggcatggctgttttgataatccggtatataaaggatctgtccctcttttaattcctcgtcaagggaaagggaattcatccggatgagctgctggacgttaatatcatagcgctcgcacagaagatcaatcgtatcattttgctgaacgatgcacatcctcattcgagtaaactcctcctctccctgctttgtaaacagctttgtcaaatagagtgcgttgtcgttttcctttgctgacacttcctgttcatccgctgcctgcatttcatctctttcttcttcgggctccgtctgctcatgaaacgaatattccgggatttcaatcgtatgcccggcttcctcttcttcatcaatcgcttctgcttcctgtgtcacctcaacctcaaaagcctcaggctccctgtcattctggtcttccttcagaagaggaggaacactgtagaacgggttctctttcagttcctcgtgaggttgataagagctgtgcgacagctccggctcttcttccgcttcttctcttttcagctcatattcttccggttcctcttccactttctctcttttcagctcatattcttccggttcctcttccactttctctcttttcagcttatattcttcttccggctgttcaagagaggcttctttttgattttctatttcgcgcttcgtacgctctgccgccgacaaagacgctgtaaaaaacggtttagcttcctctgtgtcgtttccgagaaacgactggtaaatcggaaccgtttcctcaccggtatcatgttcttccgcctgttcttcgtcctgctcttcgtaaggtctgtcaagctggatcaaatattctttctcttcaccctgatcttcgtcgtttgaaggtgatctgtaggcaggttcgagctcctcttccggatggacggccgcaggcatagtgcgcggttcttcttcacccgcttcaccgctcacattcaagaggccttcaatcgccaaatcagcctgaatcgtcagcatcctcgcatctgtcagctgataatcgaaagcgtcaataaaaacaaatacgtcgtttaaatgattgactttgtctttcgggatggtgatatccactgggaaacaatgcgtcagctctgcgctgccgtcccctttcagctttacatcttctacaaatcggcttgtcgcaggcagctctgcatactcccgggtttgatctatgttgtattcgcctgtcagctctaatgaccctcgtatggatacataatcatttacttcctgaacggtaatgtcaggatccaatgaaatcgataataattcggatacttcctgtcctttttgaaaacagattgactcttctacagaaaattgcaaacgattgttttgcggcaaactgatatcctcccttcacctaatttttaaaattagatgtcagtaaagatgtatgtgaaaagcaggcagaatatgaacagaaaaatcagcagccgttttcggcaccatgcaaaaaagagccgccggcaatgtccggcagcccttttctttatctggagcggctgattctttcgaatacgcgttcagcagctttaatcgtatgctcaatgtcgtcatccgtatgagcggttgacaagaacagcccttcaaactgtgaaggcggcagaaacacgccttcatcggccattcctttataatattcggcaaacagtccgaggtcagactgtttcgctgtatcataattgatgaccggtccatttgtgaagaaaaagccgatcatagaccccgccctgttgaatgtacacggaatgccatttttctctgcagcttcagaaattcctttttccaagcggtcagctttgcgggagaattcccggtaggattcaggggtcagctgtttcaacgtttcaagtccggctgtcatggcaagcgggttgccggacagcgtcccggcctgatagatcggaccgctcggcgcgatcttctccatgatttccgcctttcctccataagcgccgacaggaagaccgccgccgatcacttttccgaggcatgtcaaatcaggcgtcaccccgaaatagccttgggcacagttgtaatccaccctgaatcctgtcatcacttcatcaaatatcagcagggcgccatgcgtctcagtcagctcgcgaagcccttcgaggaaccctttaaccggcggtacgacgcccatattgccagcgacaggttcaacgatgacgcctgcaatgtcatctccgaattcttgaaagacaagtttcatgctttccagatcattgtaaggaacggtaatcgtgttttttgcaatgctttccggaactccggggctgtcagggaggccgagtgtcgctactcccgagcccgctttaatcagcagggaatcaccgtgtccatggtagcagccttcaaattttacgattttgttacggcctgtgtatccgcgcgccagccgcaaggcgctcatcgtcgcctccgtaccggagctcaccatccggacgatttctatggaaggaacgcggtcgatgacaagctcggcaagctcggtttccagttctgtcggcgcaccgaagcttgtcccgtgttctgccgccttttgaatctctttcaccactttttcattgctgtggcccaaaataagcggtccccatgacaggacataatcgatgtattcgtttccgtcaatatcatagatttttgatccttttccccgctccataaaaatcgggtccatgttgactgatttaaaggctctgaccgggctgttcaccccgcccggcatgactcgttgcgcctcttcgaatgccgctttagacttctcatagctccgcatcctctaaaacccccagttcaaattcttattccgaaatccattttgccgcgtcttttgcaaagtacgtaatgatcaaatcggcgccagcccgcttcatgcttgtcagcatttcgagaacaagagctttttcttcaatccatccgttttgggcggcggctttgaccatagcatactccccgctcacattgtatccgacaacaggcaggttaaattcgttcttcacttctctgacgatatcaagatatgaaagcgtcggcttgacgatcagaacatcggcgccttcttccacatcggattttgcctcccggagagcttccctgcggttggcataatccatttggtacgtcttgcggtcgccaaactgcggactgcttcccgcagcatcgcggaacggtccgtaaaaagcgctcgcatattttacagcgtacgacatgatcggcacatttgtaaatccttcctgatcaagcgcttccctgatagcggcaacgaaaccgtccatcatgtttgacggcgcaataatgtcagcacctgcacgggcttggctgacagcggtttttgccaaaagaacaagcgattcgtcatttaaaatttcaccgttttccaccaggccgcagtgaccgtggtccgtgtactcgcataggcacgtatcggcgataacgacaagttcaggaaagtcctgtttaatttgtgcaatcgctttttggacgatgccgtgatcgtgataggctccgcttcccacatcatctttgtgctcaggcacgccgaagacgatcacagattgaatgccgaggcttgcgacttcctccatctcctctttcaaacggtccaaagacagctggtacacgcccggcatagaaggaacttcgcttttgacgttctcttcctcggtaacaaatatcggataaatgaaatcagatgctcttaactcggtttcccttaccaatttccgcatacctgctgtcgtccgcaggcggcggtgtctttgaaatgatgcttccattagtcattctccctttcttgaaatgcggcacatttcgcgcagcattccgtcgattgtatagacgtccggcatatatgatggaattccgtagtccgacagcgccttctttgtcaaaggcccgatcgtaataaaagccgtccggttcttttcggcccacgctaagctctcctctttcagaatggacatgaatgtatgtaccgtcgaagaactggtaaacgtcacaaaatcaaaagacgcgtgctttgctgcttccttcaggtccagaattcccctttcatcacgcacggtttcatacaaaatccattccgaaacttgaattccgagaggagagatggttttcttgatgacgtcccgggataaattcccttttaaaacgaccactttgtcatgacgtccggcattttgcttaagtgcctccgccaaatgttcagccacgtataactccggcatcagatcgacagaaagacccctgtcgcgcaaataccgggctgttttttcaccgacagcagcaaccttcgcctttgatgcgggaggatcgcacaacccggcgtcctttaaataagaaaaaaagaattttgccccgttcacgcttgtaaaaacaagccagtccgcactttcaagatctgctcgaaagcgccgggcctgttctggcggaagggcgggccgaaacgaaatcaatgacgttaaaacagcttccccgcccaaagcctccaccttttccctgaaagattgggcttgcgctttattgcgggtgacgagcactttctttccctctaaaggaagatcatgcttcatggtcttccagctcctgtttcacccggtcaatcagtgcctttgctcctttttccgacatgactgcggcgcattctctgccgacagcctccggatcttttccttttactgtttctctgtatacggtttttccgtcaggcgatgccacaagaccggtcagttcgatgacgccgtcttcgtccatctttgcaaatcctgcgatcggcacttggcagccgccttccatcgcatgaagaaaagcgcgctcagccgtgacggtcagctgtgtgtagcggtcgttcaggcgcgaaaagagagacagcagctcctcatcagagcctctgcactcgatcgccaaagcgccttgcccaacggcgggaaggcagctttccggatcaagaaattcagtgacgacatcgtccttccaccccattcttgacaggccggccgcagctaaaataatcgcgtcgtaatcttcggtttcaagttttttcagccttgtatcgatatttcccctgatccacttgatctcaaggtcggggcgcatttgcaaaagctgtgcgcttcttctgaggctgctcgttccgacaactgcgccttgtttcaagtcagccagcttttgacggccttttgaaatgagaacatccctggcgtcttcccgttttggaatgcagccgaccatcagcccttcgggaagcaccgacggcatgtccttcatgctgtgaacggccatatcaatttccccggagagcatcgcctgttcgatttctttgacgaacagaccttttccgccgacctttgacagcgtaacatccaatatccggtcgccttttgtaacgatttcctttatttcaaacgtgaaatccggatttaattcctccagctttttgatcacccattttgtctgggtcatcgccaatttgcttcttcttgagcctacaatgatgtttctcatgttttcttcctcccaatccgtcacgggcaaccgttttaactaactaaaccaatgaaactgcgaaaagctgccgagcaaaaagaaattgattaaaagaacaagaaaagacgcggcattccacatggccgcgatccttccctgcagctctttgacaatcctgataaataaatagtatccgtataaaaaaagcagcacgatcgatccgagcactttcggatcggcccaatacagggtttcaagcgatacatacgaccagataatccccagaatcaggctcagcagaagcatgggaacgccgatgatattgaggacataagccatatgatcaagttttgacaaatcttcgattctcaagagccatttcccccacttcttctttttcaataagcgatactgaaaaagatacagcacggaaaagacaaaggacaatgaaaatgctccatacgaaagaatcgccattgtaatgtggatgatcaagagctcggacacgagcctgcccgaaagctccgccgactgctgagccgttggagtaaatgtgtggatcgccgccattgagaagccgatgagattggtgaaaaaaacgagaaattccactttcaaaagcttcgtcaaaacgagagacagcgtgacgagcacccacgcgtaaaaataaagcccctgcgcattattcaaaacaggaaactgatctgtgtactgcatgaaataaaaaaggtataccgtctggagaatccagacaatagaaagcaaccagaaggccgcttttcccgccttccggttgtgctgtaaaaagtctataaaataaaagagaacggtgaacgcgtacaacacgattgtaacttcgttaagccttgctaacaatgtgtctgtcatgtctgtcactcgctcgcgatagaagtcaaaccctgcggattttgccgcttaaacgcatgaaccggctgacgttcgtcttgtctctcaccgtcaggaaaagccgcttcttcaatatcaaaaatctgcgtgaacagtgcaagcttttcttcggcatcagcttctgacgcaaactccttcacttttaaaatcgggtcgcgcaaaagctggttgataatgcttttcgtatgcttgtttaaaagttttttctcccttgtgctcaaatgagggagcttccgttcgatgctctgcatcgtttccgcctggatcgtcaaggctttttccctgagagccgagatgaccggcacgacgccgagcgtattcagccattgtttaaaagaaacgatctcagcttcaataatcagctccacctcttcggcaacggcctggcgttccttcaaattttcttcgacgatcccttcaagatcgtcaatatcgtacaggaagacgccttccacttcgctgagagccgggtcaagatcccgcggcacggcaatgtccaccataaaaagcggacagcctttgcgaagcttattgacatgttcgatcatctcttttgtgacgacatagccgctggcgccggtcgaactgatgagaatatcggcttccatcaaagcgcattgcagctcattcaagcttttcgccgcgcctgaaaaacggccggcaagctccttcgcttttgaaaatgttctgttgatcaccgtaacctgtccgattccgtggccgtgcaggttttgaaccgcaagctcacccattttgcccgccccgagaatcagcacgtgtttatcggaaaggtcgccgaagattttcctggcaagctcgacggcggcatagctgacggatacagcatttgaagcaatgtccgtttcggcatggcagcgctttgcgaccgtgaccgcctgcttaaacaaatagttgaaaacggtaccaattgtcttctcttcctgagccagcttaaaacttgtacgcacttggcccaaaatctgcgtttctccaataaccatcgaatccaatccgcacgatacgcggaacaggtgttcaacggccccgtcgttttcataaaacttcaagtaaggcgaaatgtcctctttgcttaatccgaaccagttcgccaaaaacattttcatataataacgtccggtgtgcagctgatcaacgactgcatacagctctgtccggttgcatgtcgacacgatgatgttctcaagtatgcttttttcttctttcaattgcgccatcgcctgccccagctcatccggctgaaaggttaacttttcacgtatatcaacaggggctgatttgtaatccaatcccacgacaagtatatgcataactcttgcttgcacccccaacatctatctaaattagaatgattataatatagaatttattattcaaaacgattataacatatattcactattttctcttcccaaaatgtgaacagattttaaaaaattgatgtgatatagtagaaaatgtgtttctatttctttcactacatcaagaaggtgatactttgaaaaagaaatctgttttgcttccattgctgttgatagccgttgctgtctacgcctttttgcggtcgggccggatcagcctgtttgacggccaggaagaatggtctgtacttgcaggtctcgtcggactggctcttttttatcagggacagaaggaagccgattccgcccattcctttgcagggctcttaatgacagcgatcggcgtttatttcacatttaaagaggactatttcagccgcgcggatgattttgcggtcatcgtgctgatcttcggtgcggcgctgcttgtcaaatcgtttaagacaaaagaatatcaatatgaaagtctgctgatgatcgcggtcgccctctatctttactttttccggcaaattgccgcctggctgaagtcggtgaatatcgagacggcatatgtagaagcttattggccggccgcttttatcgcggttagtctgctcttattattcttaaaaagaaaatagtttattcaagaaaaagcacttgcatcaatcccgcaagtgctttttcttttatctcgcgatcatttgctcgatcgccgaccatgcttcttgtttaccctttttcgtttcggaggaaaacaatatgagccggtcttctttttctatattaagcgtctctttgacgactttggcatgcttttcccatttgcctttagggattttatccgcttttgtcgcaatcacgatcacaggaatttcataatgctttaaaaagtcgtacatcatcacatcatcctgtgaaggagcatgcctgaggtcgacgatttgaacgaccgctttcagttcttcgcgggatgtcaaatacgtctctatcatacggccccaagcctcgcgctccgttttggagacttttgcaaatccgtagccgggcacatcgacaaagtgaaggacatcgttaatgatataaaagtttaatgtctgtgttttgcccggttttgaagatgtcctcgctaagtttttacggttgatcattgtattgatgaatgacgattttccgacattagatctccctgcaagggcgatttccggcagtcccccttcagggtactgctcgggtttcaccgcactgatgacaatctctgatttcgttactttcatttctcttctcctactagcgcatgctttagaacttcgtccaggtgagcgacgggaatgaaggtcaagccttcccgcacgctgtttggaatgtcctcaatgtctttttcattatctttcggcataatgacagtctttaagccggcacggtgtgcgccgagcgccttttccttcaagccgccgatcggaagaacgcggcctcttaacgtgatttcgccggtcatgccgacatttcgcgaaacaggtcggcccgtcagcgccgagacaagagccgtcgccattgtgatccccgcggatgggccgtccttcggaacggctccttccggcacgtgaatgtgaatatcgtgtttttcgtgaaaatcagggctgatgttcaactcttccgcctttgaacggacatagctgaatgcggcctgcgccgactctctcatgacatcgccgagctttccggtcaaaatgagcttgcctttcccgggggaaagagacacttcgatggacagcgtatcaccgccgaccgtcgtgtaggcaagacctgtgacaacgccgatctgatcgtcgagctcagcctgtccgtacctgaacattctttttcctaaatagtcttcaaggtttttgtctgtgaccgtaattctttttctttcccctgatacgatcagcttcgccgcttttctgcatatcgctgcgatttggcgttcaagatttctgacgccggcttccctcgtataatagcgaatgacgtccaggacagcctgctcccgtatttgcagattggattttttcaaaccgtgttctttcagctgttttggaagcagatggtctttgacgatttcgaccttttccacttccgtatagccggcgatcgtgatgatctccatgcggtctctgagcgggccggggattgtggccaggttgttcgcggttgcgataaacaaaacctttgataagtcaaatgtctcttcaatataatggtcgctgaacgtatggttttgttcaggatcgagcacttccagcatcgctgaagcgggatctcccctgaaatccgacgccattttgtcaatctcgtccaaaaggaatacgggattgttcttgcctgcttttttcatcccctgaatgatacggcccggcatggcgcctacatatgtgcggcggtgaccgcggatttcagattcatccctcacgccgccaagggaaatgcggacgaatttgcgtccgagcgatttggcgatcgatttcgccagagaggtttttccaacacccggagggccggccaagcataagatcggtccttttaacgagcgggtcagcttctggacagccaaatattcgagaacccgctccttcactttttcaaggccgtggtgttcttcatcgagaatttgactggcgagctttaaatccagcctgtcttctgttgcatcgttccatgggagagaaataagccattcgatataattgcggatgacagagctttcagctgagctggacggaattttttcgtaccggttcagctctttaagcgcggtttctttcacattgtcaggcattccggcctgctcgattttttcagtcagcttttggacctcacccgtttttccttctttatcgccaagttctttttggatggctttcatctgctcgcgcaggtaatactccttttgtgttctttccattgaacgcttgacgcgctgcccgatcttcttttcaatctcaaggacttctttttcattgtgaatcaggtcgattactttgttcaatctggctttgacatcgatcgtttccagcacttcctgcttgtctttcagcttgagcgggaggtgggaggcgacaatatcggccattcttcccggctcttcaatatctgtcacagcggcaaatgtttccgccgatatttttttcgaaatctttatgtattgatcgaagtggtcaagcaatgtgcgcatgagtgcttcatcttcaacatctttttcagtctcttcatcgattcgctcgatttttacagacgtatattcatctaagtcatggtactcaagaatgcgggcgcgctgcaacccctccaccaaaacgcggattgttccgttcggcagcttgagcatctgcttgattttcgtataggttccgaatgtaaaaatctcgtcttcatccggttcgtctatggatatgtccttttgcgttgccaaaaagatcatatggtcattcatcatcgcctgttcaagtgcctgaaccgacttttcacgcccgacgtcaaggtgcaaaaccatcgtcggatagacgagtaaacctcttaaagggaggagcgggatgtttcgtttcgtttcatctgccattttgactgacacctccgtaactttagtatgaaccattataatatactttttttattcctgtacaattgtaagcccggcgaaataaaaagggtctcctgtagtataccctttctttcagttctgaaaaaggaaaagatgtcctccgctaagaaaacatgccggctcccggcttcggagaaaccgccccgaaaaaaatccccatctgaaacgatggggatttaaacggattctcttttcatttgaacgccgtcgggcatttctgaaggagggttgaccaatacgaggtcgagtacttcctgcaaggttttgacgggaacgatatgtatgccttctatccgctttaaaatcgactgaacattttcgtgcggaataatgactgtttttgcccccgcatgcttggccgctttgattttcggaatcacgccgccgatcggctttacccggccgttcaggctgatttcacccgtcatggcgacagtatggtctatcggaatcttatgaatagcggagaatatgcccgccgccattgcaatccctgcagatggtccgtcaaccgggataccgccggggaaattcacgtgaatatcataatccgaagctttgactcccattgtccgcaatacagtcatgacgttttcgaccgatcctttcgccatgcttttccggcggatcgattttgactggttgccgatattctcttcttctgcaatgcctgtgatattaatcgatcctttatcagccgcctgattgactgtgacctcaatttcgagcagcgaaccgctgttaggcccgtggacggcaagtccgttgacgatgccgacctgcggtttagaggcgattttttgttcgtatttcggtgtcagctggctcgaatggatcacccattcgatatcttcaaccgtcacctcgtcgcgctcttcagtcaaagccattccggcggcgatttgcatcatattgacgacttcgcggccgtttctcgcataccgcgtcaacaggtcgagtccttcctctgcgactttcttttgaatcttatctgccgcttttttggcgaccgtttttaattcgtgcttttcaaggtcgcggaagaacacttccaaacatctcgaccgaatggcaggcgggatttcatcaggcatccttgtcgtcgcgccgatcagtctgaaatccgccggcagcccgttttgaaaaatgtcgtgaatatgcttggggatttgcgtgttttcttcactgtaataggcgctttccaaaaaaactttccgatcttcgagcaccttcagcattttattcatttgaatcggatgaagctctccgatttcatcgatgaataatactccaccgtgtgcatgcgtgacggctccctgctttggctggggaattccggcctgccccatcgctccggcgccctgataaatcggatcgtggaccgaaccgatcaacgggtcggcgattccccgctcgtcgaaacgggccgttgtcgcgtcaagctcgacaaaggcggaatgttcctggaacggtgagcgcttgttctttttcgcttcttcaaggacaagccttgcagctgccgtttttcccacacctggagggccgtaaataatgacatgctgcggattcggtccgcaaagggcggctttcagcgctttaatgccgtcctcctggccgacgatgtctttaaaagccgtcggcctcaccttttccgataaaggttctgataaatggattgatctcattttccggagctgttccatctcttttttggactctctgtctatcgtaaccttttgggttctttgatttttgagcaaattccaaaaatataatccgatgatgatcccgaaaaatagttgtacaaaaagtgcaatgctcgtccagctcaactgatggtccctcctgaaatggtttcgtatctttagtatgtcagatagtatttcctgatcagggagggaataaacgtacagaaagggattattttgcttttgaagccgtcactctgctccgggatgccgacggtttccggatgcaaaaaaagaacctcctttaggccaggaggttctctgcattatgctgaagtttttttgtctttattgacgaccgtgccgtctttcataatgagacgcggcggttcgccgtcagtgacggttttgcctgtgatcacgcatttttcaatatcctcgcgagacggcagatcaaacatcacgtcgagcatgattccttcgataatggaacgaagtccgcgtgctcctgttttacgttcaattgcttttttagcgatttctgtgagcgcttcgtcttcaaacacaagctccacatcatccaattcaagcatttttctatattgtttaacaagcgcgtttttcggttttgttaaaatttcaaccagcgctttttcatccagcggctcaaggcttgcgatgatcgggagacggccgatgaattcagggatcagcccgaagcgaagcaagtcttccggaagcactttggaaagaagcgcttctttttcaaggtcttcatgcttgttgtcagagccgaagccgatgaccttctggccgagacggcgcttgatgatctgctcgattccgtcaaaagctccgccgcaaatgaacaggatgttggttgtgtcaatttggatgaactcttgatgaggatgctttcttccgccttgtggaggaacgctggcaaccgtaccttcaagaattttaagcaatgcctgctgaacgccttcgcctgatacatcgcgtgtaatcgaagggttctcggactttctggccactttatcgatttcatcgatgtagataatgcctttttccgctttttcaacatcgtagtcagctgcctggatcagcttaagcaaaatgttctccacatcttcaccgacatagcctgcttcagtaagcgacgtggcatccgcaatggcgaacggcacattcaggatgcgggcaagcgtttgagcaagaagcgtttttccgcttccagtcggtccgatcatggaaatgttactttttgacagctcgacgtcgtcgactttgctgttcgaattgatccgcttgtaatgattgtagacggccacggcaagggatttttttgcctggtcctggccgatgacgtattcatcaagaatctcgcggatttcctttggcttcggaacatctttgaactccacttcttcttcagagccgagttcctcttctacaatttcagtgcaaagttcgatgcactcgtcacatatatatacgcctggtccggcgacaagcttgcgtacctgatcttgtgttttaccgcaaaacgagcatttcaattgtcctttttcctcgttgaatttaaacattctttcaccccttatatccttgtcattcctgtttcttcgttaaaagaaacatcgcttgaaaacattcgttccattatgtattgcattttaccacactttccaaaaaggcgataacgttgtgtttgccgtccggcatattcaatatgtatgttgatcaaaacgacattatctatcctttcccaaagaaaagatgataagtcaaaattgtataaaacaaggcacgaaacattcgcgccctgttttatataaagtatgattatgaaacatattaacggttttctacaagaaaatcaattgctttgcgaacttttaagtcctctttcattccgtctgtagaaccgattgcttgtttgatgttttcaacaggcatgttgtatgcttcagccattttagaaagctcttcttcgacttcttcgtcagtgacttgaaggttttccgctttggcgatcgcttccagtgtcaggttggatttcacgcgtttttcagcatcctctttcatttgctctttcagcgcgttttcatcctgtcctgagaattggaagtaaagctcaaggttcatgccctgcatttgcagacgctgttcgaattctttcatcatgcggtcaagctctgtgtcgatcatcgcttgaggaatgtcagcctcagcgttttcagctgctttcaagacaagctcttcgcgaagtttagcgtccgcttcgttttcctttgcttcttcgagacgttttttcgttttttcagtcagctcggcaagcgttccaacttcctcgtcgacatctttcgcaaactcgtcatcaagctcaggaagctccttcgctttgatttcgtgaattttcactttgaataccgcaggtttgcccgcaagctcttccgcgtggtattcctctgggaatgtcacttcaacgtctttttcagcaccggcttcaagtccgacaagctgatcttcaaagcccgggatgaaagagcctgaaccgacttcaagggaatagttttccgcttttccgccttcgaatgcttcgccgtctacgaatccttcgaagtcaagaacaacagtgtccccttcttcaactttgccgtcttcttttacaacgagttcagcctggcgctcttggagagacttaagttcgttttgaacgtcctcatccgttacggcagtatcgtctttttcaatgccaaggcctttgtattcgccaagtttcacttcaggcttaaccgttaccttcgcagtgaagatcaggttttcgcctttttcgattttttccacatcgatttccggacggtcaacaggctcaatgcctgcttcctctaccgctttcggatattcgacaggaagcaggatgtccagcgcatcctgataaagcgcctctacgccaaaacgctgttcaaacaaaccgcgcggcactttccctttgcggaatccaggaatggatacttgctttactacttttttaaatgcatcatcaagggctttattaaaggtatcggcatctacctcaaccgttaaaacgccttcgtttccttcttgcttttcccattttactgacatgtgtttccctccaaaatctattcaggttgtgtcggttttccattttaaaacaagcaaacggctacgtccatcgcaagctgccgactgtgtgcagctcatgtgtttctgacagccatcattatgtatacaaagataaataatgaatctttagcggcaaacggatcaacttccgtttttcacaaatgcaaccactatattataacacaatgcctgctgctttcaacatttacaaataagaaatttcttctatgtctttgatcagcgcgcaggcttcgtcaagctgtctgtcattgaattcatagagaatatgaagctcctctttatcgatgtcgatcccgtgcatctcatatccgactttatgcagtgcagcagcccagagctcgcggtttgagtatttcggctgaaacggatagaggacgtaaatatgccttctccacagctcttcgaccgcctggtacagcgtgggattttcattccccagcgtatcatcgagcacgctcagaacatgctttaatatcggcatgtcatcaggcttgaccgtctctgtcggattaattgtcatcgaatcgccaaattttgcgacaagcgtcggcttttcatggtctgactcggctaaaagctgaagaatcatcgtttttacgacaggatgtgcgctcgggttttgcagaatcgttttcaacaagccgatatagcttgtcagattgcggtccttcagcccgtgaagaagcttaacctgctcttccgtgtcattcaaaagcctttcctgatcaacctcctccgtctcgggaaggtcttcggtgatgtcctcaggccccgggtcttccgtcatcttgcggctgaaatcaaggagtttataaaactgttccgcgctttcaggaggaagcttgttttcttcgagtacagcttcgatcgtttctttaactttttcgtattgtctgagctggattaaaatcgtcatatagacttgtaaaacggtaaaatagtggccgtggccttccttcagcattttttcgcagatgcctttcgcttcttcaagctcgccgatttcaagcaggcagatggccattcccagataaatatcagattcctcatcattatagcgcttcgcttcagaaaacagcctgagcgcttcatggtaattcttttctttgagcgcacccatccctttgtgcactaaacgctcctttacgttcgggaacggtatgatcttcgagttcttcttgtcatgcttcatttctaagttcctttcaggcacttattttttaacaagtgtatcaacccggcccgctaaacacaagaaagaaccggcggcagtatgctgccgccagcaaaaaaagcctccgatctacatcggacagcttttttatgcttgcagccaagaacttctctgtttctcaaattgttcgatttcttcttcaaggagcaatgttaaagaaatttcgtcgtaaccgttcagcagcatctctttccaatgcggatcgacctcaaaggcaatctgccgcccggcatgatctgttatcgtctgtttttcgagatcgaccgtcatcgtcaaagattgatactcatactgttcagcaagctctttccacgcctcataaggaaggcggatcggcagcatgccgtttttaaaacagttttggtgaaagatatcggcaaaagacggcgcgataatgattttaaatccgtagtcgtcaagcgcccatggcgcgtgttcccttgaagagccgcagccgaagttttcgccggcgattaaaatcgaagcgcctttgtattccggccggttcagttcaaaatcaggattgggatcgccgttatccagatagcgccagtcaaagaaagcaaaacggccgtatcccgttctttcgatcctttttaaaaattgcttcggaatgatctggtccgtgtctacgttgattctgtttagcaccgccgctattccgttatgggtctttaatggctccatcttgtcactcctctatacagctgttgtctcttggtaatattttctgacatcgacaaagcggccgtgaatcgcggccatcgcagccatcgccgggctgacgagatgcgttctggctcctttgccctgcctgccttcaaaattgcggttggaagtcgaagcgcagcgctctccttcagggacaacatcattgttcatgctcaaacacatgctgcatcccgattctctccattcaaagcccgcttcgatgaaaatcttgtgaagcccttctttttccgcttggattttgacgctttgcgagccgggtacgacgatcgctctgacgccgtcggcgactttttgacctttaatcatttcggccgcctggcgaagatctgtcatacgcgagttggtgcatgaaccgataaagacatgctcaattgtaatgtcctcgatttttttatatggttcaagacccatatattcatatgcgcgctgcgcttcttttttatcgtcttcctgcaagaaagcctcaggccccggaatcgtttcatcaaccggcagcaccatgccagggttgatgccccacgtcaccatcggagaaatggcgcttccgtccatcacgatcgtccggtcgtagaccgcccccggatcggttttcaggttcttccattcttctacagctttctcaaaatcctcgccttttggcgcatatttttttgttttgacatattcaaacgtcgtctcatccggtgcaatcaatccagctcttgccccagcttcgattgacatgttgcaaaccgtcatccgttcgtccatcgacatgtttcggaacacttcgccggtatattcaatgacatagcccgcaccgaatttaaccccgtattttccgatgatcgccagaatgacgtctttagccgtcactcctttttgcagtttgccgtcaacgcggatttccagcgtcttcggtttttgctgccaaagcgtctgcgttgacaagacgtgttcgacttcgctcgttccgattccgaaagcgagcgcgccaaacgctccgtgtgtggatgtatggctgtctccgcaaacgatcgttttgcccgggagcgtcaatcccagttcaggcccgatgacatggacgatcccctggtctacgcttgacaagtctgcaaggcggatgccgaattcttcgcaattccgttcgagcgcactgacctgccgtttagcgacatcatctttaatctcaaaccgattgacagtcggaatgttgtggtccatcgtggcaaacgtattttgaggccgtctgacttttctgttcttttgcctcaggccttcaaaggcctgaggcgacgttacctcatgtatcagatgcagatcgatatagagaaggtcaggcttcccttcaccttttttaatcacgtgttgatcccaaattttttcgatgatcgttcgaggcatcatctttcttcctccctctaccaatatccattttccttaaacgtaagcggtcatgatgtttgaaatggcattgtcgtctgccagcgcggcttttacttcccctgtaatcgattgagttgtgcaatgttccgagccttttgccaggtccttcgtccgttttcctgcccggagaacttgatcgactgcatgttcaacagcttgcgcttcagcttcaagaccgaatgacgtcctgagcatcatagccgcggacaagatcgccgcaagcggattggcaatgttctgtcccgcgatatcaggagccgagccgtgcacaggttcgtataaatgaagtccagagcttgataagctggccgacggcagcatgccgagcgatccggtcagcatcgatgcttcatcgcttaaaatatcgccgaacatgttttctgtcacgataatatcaaactgtccaggcgcatagatgagctgcatggctgcattgtcgacgagcatgtgctcaagcttgacgtcaggaaactctttcgccacttcttccgccgtcttgcgccatagtttgcttgactcaaggacgttggctttatcaacggaggtcactttgccttttcgactctgcgccatttggaaggcttccctgatgaccctttccatttccgactttttataaaacagcgtgtcaaccgcttcttcctcgccgttctgattgacgtactgctcgctcggctttccaaaatacaagccgcccgtcagctcgcgaacgatgacaaagtcaacaccttcgatatattcggtttttaacggagaagctcccgcaaggctttcaaatactttaacaggccgcagattggcaaaaagatcgagctgcttgcggatggcgagcagccctttttcaggccgcagctcagaaggattttgatcccatttcggcccgcctacagctccgagcaaaatggcgtccgcagctttgcaggcggcgacagtttcctcaggaagcggcgctcctgcctcatcaattgccgccccgccgatcaggccgtattcaaattcgaattcatgctgataatgttcagcaacgcttttcagcacatcaacagccgcgtccaatacttcgggaccaattccgtcaccgggcaaaagtgcgattcgttttttcaaattcaacaaactccttccttcttactgttatgatcctacagccgcctgttttgacaatccttccgtattcgtcttcaatacgagatagcggttcacagcattcaagtaggctttggcagatgcttcgagaacatcctgggcaaccccgcgtcctcccgattcttttccatcgatcatcaccctgacgtatacttgcgcgaatgcatcctgtcccttgcggttggattgaatccggtaatcaaggagctggacttctttatccatacagcgcttcagcgtgttgtacaccgcttcaacgcttcccgctccggtcgccgcttcctggatgacctgatccgtttcctgatctttaagggagactgttgctgtcggaacctgggaggtgccgtaatgaacctgcagtgaaataaaatcatagccgattttgcggtctgccgttttctcttcgagtatcagcgagatgagatcttcatccgtaaattcctttttctttccggtaagctctttaaaaatgttgaagaatttattgatttcttcttctccaagctggaatccgaggttttgcagcttatctttaaatgcgtggcgccctgaatgctttccgagcacaagcgcatccgttttcacgccgacaagttccggagaaataatttcatatgttgttttttcttttaagaagccgtcctggtgaatgcctgattcgtgggcaaaggcattatcgccgacaaccgctttgttccgcggcacggccatgccggtcagcttgctcactaaatcacttgtccgtttaatctcattcagctgaatcgttgattccgcctggtagaaatcttttcggatatggagggcgacggcgatttcttcaagcgaggcgttccccgctctttcgcctatgccgttgatgaccgattcgacttgatccgctccgttttcaatcgcagccaaagagttggcgacagccatgcccaagtcatcgtggcaatgggctgaaagctggactttgtcggcattgcgggcattttctttaatatagcggaagatatttccgtactcggcaggcgctaaataaccgaccgtatccggcagattgacgacatccgctcccgcggcgatcacttcgcttacaatctcggctaaaaacggaagatcagtccggcacgcatcttcggcagaccactggacgatcgggaagcgttctttggcgtatttcaccattgcgaccgcctgttccagaacctgttcgcgcgtttttttcagcttatattttaagtggatgtcagaagtggcgataaaaatgtgaagccttggttcagctccgtctttgagcgcttcccacgccgagtcgatatctcctttgacagagcgggcaagccctgttaccgaacagtttttaatcgtccttgcgatttcttttactgcattgaaatccccgggggatgaagcgggaaagcccgcttccataatgttgaccccgagtttttcaagctgctgggcgatcgccagcttctcctgcgtgtttaaattaacgcccggcgactgttcaccgtcacggagtgtcgtatcaaaaaagttaatttttcgcaccggctaccaccgcttcctttttcttgccctgcttgacaaacggcatcatttcgcgaagctttctgccgaccacttcgatttggtgttcgttttcgcttgcattgatggcgttgaaacgcggacggttgacttggttttcgacgatccactcttttgcgaatgtaccgttttggatgtctttcaatacttctttcattgattcttttaccttctcatcgacaacgcgcggacctgatacgaagtctccccactgcgctgtgtcggaaatcgaatatctcatccctgccaaaccttcttcatacatcaagtcgacgatgagcttcagctcgtgcagacactcgaagtatgcgagttcaggctgatagcccgcttctgtcagcgtttcgaacccggctttgacaagggaagtcaatcctccgcacagcaccgcctgttctccgaaaagatcggtttcagtttcttctttaaatgttgtttcaagaacaccggctcttgcgccgccgatcgctttagcataagcaagggctttgtctttcgcttcccctgtcacatcctgatagatcgcaaacagcgccggaacccccgcaccttgttcaaacgttcttctgacaagatgtcccggtcctttaggagcgacaaggaatacgtcaacatccgccggaggcacgatctgatggaaatgaacgttgaatccgtgggcgaatacaagtgaattgccagcttgaagtccgtctttaatttccgcttcatacactttttgctgctgttcatccggaagaagcaccatgacgatgtcggcctgttctgccgcttctcttaccgtgaaaacttgatggccgtcttcctctgcttttgcaaaggatttcccttttctgacgccgacaatgacgtccactccgctttctttcaggttcagtgcgtgcgcatggccttgtgagccgtatccgatcaccgctacttttttgcctgctaatacgttttctttgatatcaccgttataatatacttttaccatttcaatctctccctttttatgatttatacaatagatattgttttaatagaggccggcttttgctgagttcccctcgcaaaggccgtggtgcctgttctggctacctctttaatcccgtatggtttcaatagttcgatcagggcttcgatcttgctcgattcccctgtcacttgaatcacgacgctgtcttttgcgacatcgacgacagacgcccgaaacggttcgatgacgccgtttatttccgtcctgctcgacggaggggaaaccaccctgattaacgccagctctctttggacgatcgattgattcgtaatgtccgtgactttcagtacatcaatctgcttgtttaattgttttgtcagctgttccgtttctttttcatctgccacatgaacaacaaacgtgattctggaaattcccgcggtttcggtgtggccgaccgtaatgctttcaatgttgtaatgccgttttgtaaacaaccctgtgattctgtttaagacgccgctttggttcaaaaccgtcagcgtgatgattcttttcaaggtttcacccccaccatttcgtgcagcccttttccaggcgcaaccattggaaatactttttcagcttgtgcaacttgaacatcaatgaccatcggttcattcgacgttagcgccgcttccagcttttcttccgcttcttcttcggatgtgattcggacgcctttgatgccgtaagcttcagacagcttgatgaaatcaggctgtgatgtgaacttggagtgcgaatagcgctcatcgtaaaagatttcctgccattgccggaccattccgaggcagcggttgtttaagaccacgaccttgatcggaaggttcagatcgtgaataacagacagctcctgcagcgtcatctggaatcctccgtcgccgagtatcgatacaaccgtcgcatccttatccgcaagctgtgctccgattgccgccggaagtccgaagcccattgtgccgagcccgccggaagtgacccatctgtcggctttttggaactgataaaattgcgcggcccacatttggtgctgtccgacgtctgttgttacaatagcttcgccctttgtatagcggtggatatattcgatcagcttctgcggtttgaatccttctgtttcattttcttcataccagagcggatattcggttttccatgccgcaagctgctttttccactcatcagaagcgctcggcttgccgttttgcttgatcagctccgtcagtacaagcttgctgtcgccgacaaccggaatgtgcgtatgaacgtttttgccgatttcagccggatcgatgtcaatgtgagcgactttcgcatattttgcaaaatgcttcaagttccctgtgacccggtcatcaaacctggcaccgatgctgattaacagatcgctttcatacagagccatgttggccgcatacgttccgtgcattccggccatcccgaggaaaagcggatgatcggccggaaatcctcccaagcctaacagcgtatgtgccaccggaatctgctgctgttcgacataattttttaattcttctgacgctttcccgtgcaagacgcccgcacccgctaaaataaccggctttttcgctgcactgaccgcttccacaagctttctgatctgcagataattcggttccttcgtcggctgatagcccggaaggtgaatgtcgtggtcatagcggaattctccttctacaacggcgatgtctttaggaatatcgattaaaacggggcccggtcttcctgttgttgcgatatggaatgcttctttaataattctcggcaaatcttcggcattgcgtacctggtagctgtgctttgtaatcggcatcgtaattccgatgacgtccgcttcttggaatgcgtcagatccgataaccgatgtcgcaacctgaccggtgaatacgacgagaggcaatgaatcgatcatcgcgtcggccagacccgttacaaggttggtcgctcccggtccggatgtagcgatgacgacacccggtttcccggaaatccttgcatatccttcggctgcgtggatggcgccttgttcatggcgcgtcagcacatgaaacattcccgatccgtagagtttgtcataaatcggcaggaccgcaccgcccggatacccgtagatcacttcaacattttcctgttttaaagcctcgatcagcattgacgcccctgccattgtttgtgtacattgggcattttcagcatccaactgtacattcgtccccatttttcttcctccttatcaagtgatcatcatcactgttcattcacaattgtttttcaaaaaataatcaatatatatgtgccgcaaagcatgtatccaatctgcttttgcagctaaaaaaagccttcccgcccactgttgacgctgcacaccttgcaggccaaaggggcgaaaaggcttttctttccgcggtaccacccttgttcgcggcttttgaaagccgccttatggataatcgcttatccggtttaataacgagtgaaccttcgtaatgttcacccggccagccctactaaacatggaaatcgttcagactgacactcagaggggagttcacaagcggaggccgtcaccggttcccagcaatcccggctctctgcaggcggcgtttccgctgctacttatcctcttcaacgtttatctttattcagctgacacttaagctttgatctttgaggctgacttttaacccttcacggacgacgcgctcgcggaacttttcaagcatccggtttgtgtggactcccggtttgccgtccccgatcttgcggccgtcaacttttacgaccgcgatgacttctgcagccgttccggttaaaaacacttcctcggctgtgtatacgtcatggcgggtaaacggctcttctttcacttcatagccgagctctcgcgctatttcgatgatggcattccgggtgattccttcaagcgctccgatatagcccggaggcgtcaagagctttccgtttttataaataaatacgttatccgcagacccttcggcgacatagccttgatcattgagcatgagcgcttccgtcacacccgccatatgcgcctcgatccggacaagaatattgtttaagtagttcagcgattttactttagggctcagcacatcgggtctgttccttcttgtcggaaccgtaacaatgtcaatccccgtttcatataaatgtttcgggaatattgccaatggttcgacaattatgatgacactcgggtttgaacaattgtttggatcgagtccgaggtcacctgctcctcttgaaacgaccaagcggatgtaagcgtctttcagcccgtttttttcgactgttttgagtacgtgctgtgtcagttcttcctgtggatatggaatctccagcatgatcgatctcgcagaatcgtagaggcggtccatgtgctcttgcattctgaagatgttgccgtcgtataccctgatcccttcaaacacgccgtccccgtataaaaatccgtgatcatagactgatattttagcgtcttcttttttaacgagtttgtcgtttaggaagatccactggtctttctggtcccccatccctctagcacacctttctgttgtaaatgaacgctttaaacgattaaaaattcatgatgcgggaacccgttttcccgctgtcattcccgggaaagatgaaaagttttcaagtgatttgttcttttgtttgaactcatattacgcccctttacatgcagtgtcaaccgtattttttaaaattattagacaattttgattaatcaatctacttgtatacgcttacatgattgatataaaaggaaatgtaaaattgaaaaacaatttaaaattttttatgtaatctataaagattacataaaaaaactggcgttttatacagttttgttagattttatcccgacaattttttatactttcatccccgccggttagattttttgccacatatatgtacagactccattttacgatttttttacataaactggtgttaatcaaaaaagaaacaggtgaatatgatgtaccgcacttttcctgcgcactctgttccccgcgtgcgccaatacccgggatacttcggctacccggttacttatgtctataatccttcagcacacgggccatatacctattatccgtacggcggggtgttcaccactccgacgctcggattcggcatcggctacccgggaatttccgttccggctgtacacgcctttaccggtggattcagagacaatgaataaagcacaaaaaaagagagggcatcatgctctctctttttaccgttaaacgactccctgagcgatcatcgcatccgccactttgataaatccggctatattgcagccgtcgagcagatttccgggccgtccgtattctgaagccgcttcaacgcttctcttgtgaatatcagccatgatcgccctgagcttcgcatccgtttcttccgccgtccagtgaagccgtgcgctgttctgcgccatttcgagcgctgaaacggctacaccgccggcatttgcagccttagccggtccgaatagaactcccgcatccaaaaagcgtttgacggcgccctcttcagacggcatatttgctccttctccgacagctttgaccccatttgaaatgagcacttcggccgcctcttcgtcaatttcgttctgggtcgcgcacggaagcgcgatatcgcatggaatagaccaaatgccggtacatccctcgaaatagtgtgcttccggatgctcgctgacatactcgcgaatccttccgttcccgtcttctttgagccgcttcaccgtctcaagacagatgcctttttcgtcatagacatagccgtcagaatcgctgcaggccaccaccttcgcaccgaattgagcggctttttccatcgcgtacagcgccacattccctgaaccggagacgacaacggtgctgttttcaaagcgcatcccctgatccttcagcatttcttccacgaaataaaccagaccgtaccctgtcgcttctttcctcgttaaactgcccccgtattcaaggcctttgcctgttaacacgcctgcatcatagcggccccgaatctttttatactgtccgaacataaacccgacttcccttgctccgacaccaatatcgccggcagggatatccgtgtccggtccgatatgtctgtacagttcattcatgaagctctgcgtaaaactcataatctccctgtccgatttgcccttcggatcaaaatcagccccgccttttccgcctccgatcggcagtccggtcaaagaatttttaaaaatctgctcaaaacccaaaaatttaataatgctcgcgttcacagaagggtgaaagcggatgccgcctttatacggaccgattgcactgttaaattgaacccggaaccctcggttaacccggatattgccttcatcatcgacccacggcaccctgaaggtgatcatccgttccggctctgcgatcctctcaagaatgcggtgttcgatatactttggatgccttgccaatacagggacaagggaatcaaatatttcctttacagcttgaagaaattcgctttcgtaaaaatttcgcttctgtactgtctcgtatgcttgtgtcacataatctctcgccgtctggaaatttgtttgctccattttttctagcgtatgcaccttttttcagctccctttctaaaataaaagcagaacgaacattgtaagattttctctcatggtaaattttacaaccaatgccccatttacatcaatctggaaaacagataaaaccattgctgaattgagatgtataacaaaaagcgagaatagacgggtcataagatagaaggacagctcttaaaagctgaggagaaaaggaccaataaaccataaaataccactttatctgacaggttctttctgtacaaaatgtctattttctttgtgatcggcgcatttccccccttgtactcccggcagagaatgagcatcttatcccgtttttaaaatgaaacctactgcatacaaaacgaaaacacatagctcccctttttcatggcaacaataaaactaaaacaggggtgatctgatggacgacaaaaaagaaatgtcgaacgttgaaacgcaaagaaactttttaacagctgaagaatttcctgaaggtgcgtatggagctgcacagggcaaagacgagcccgttgagaacaaaagcacgccatggaaggaaggccagcaatactacagcaatttcgcatacgaattccgcaatcttcatcaaggaacgccgcgtcaatatcccggagcgcatccaacccatgacgaagaggatcaaaacgaggaatgaccgatataaaaaagagccgtgctaaacggctctttacagctttttattgtagaggctgttgaaaattttgattttgctgctggttttgttgattttgctgaccctgttgtccttgttgcccttgctggttaaatgactgctgcgcctgctgaagcgcctggctcatttggttcatggcctggtttgtctggatcccttgaagagcctgattcagctgctggacagcctgctgaatgctttgctgaatttgctgatccgtctgctgcatttgctgctgagattgggagctgaactgctgaatttgctgtttcagctgattgattccctggctcaattgagagctctgctggccgctttggccctgctgctgtgaccccatttgattaacagtttgctccagctgggcaagctgctgctggatgtttccgaattcctgagcaagttcggtatctgtgatgttggccccgagcagctgctcatgcttttgtttttgttgcttctgcttttgctgctgattttgctgttgttttgtcattacaacatcctccttaaaattgatcacaccctttagctttttcattttgtttgaaatgatgaaagggaatttttaggatgttgttgttttgcaacaccaaaagcctcaaacccttgtatgccaagaagtttgaggcttttttcagtgacgtcccaggggagattcgaactccagaccgatggcttagaaggccgatgacccttatggacagcatgtgacaccacttaaccgaaagcccatgatatcaaggttctttgctcttttttgttttctggaggaacgaaaaatacctgattgggagcgaatccgctccccgctcgctcccaattttccaattaattcgtaagtttaaaaagtggacattcgttcccctgttgccaaaagcaaaatccaggttttacatcatctccgttaatatcaaaggtgtactctacatcaaaaccaaaaaccgagaatatttggtcttataggcatggatgcactgctgcaggatcgttgaatactctgcggtgcttttcaattccttcaaactataaggcggctcgatgatgtcatttcctttatagtcgaattgatcttcgtaaatctgtttggtcgtttcacttggggcatttgccttgaacacggtggctttcacagattgttgagccatgctttacctcctctctctatttggccgctgccggattttcggtttctccttcagatcggtgacctcgtaatcatcgagggcataccagatggccgaaagagtgtggggatcgatcttgaattcatcttcaatgatgctacccagcttgtcctttttataggtcagcggcttgagttcaaaaatggtgttcctgcattggccggaacaaatgatctttttaaaccgcttgatctttttcgtatactgcaggcgcgaaccctggtacttatgagctcccaccatattgaaaccctgctgccggaaatactgaatcgttttaggctccgctgaatcagctttgataagctcttgggtgttcttaaattcttggagctcctctgctgtcctgtcatccgtcattcctcttttgtaatactcccaatagatatagaggtactttttcttatgatccaccgcaagccggacaacggcgttataggattcttcaaaaccaaagtccattcctacccgcttgatggggcagtcaatgttcgagacggcctgcattacttcatcgtgtggccactcttcaagctgaggaaaaacccgaaccccattcacgccaaaatgacctttcctggcgatgcggtaaaggtctggatcgtattctttcagttcatccagctgccttacatagctttctggcagaaacaaattatcttccgccgtggaatgatgatagtatgtgtcatttaagacgatcgttcgcttttcgtacagctccttatcatctaggacaaatcgattgttcagatcgtctttaaagaaatgcttgtatgtccagttgtcttccccgaccgggttcgtggaaaaaatcatatgaagcggcagtgtaggatgccgcagacggccgagaagctctttaaagccttcatatttgacctctgaacattcctcaatccatattattgagatgttgttgatcgatttcagtttggccggtttgtccagccccttgaagatgatccggctgccatttgggaacctgacttgcatcggagatgtcatacacctcacaatatgatcaatctctaagtcattgatgatcccttcaaaatgagagaatgtagaatcccgatgagtgtcgtacacttcacgaatgactaagactgtccgtttttcttcaagaagcttcaaaatgagcttgagagcaatgtgatagcttttggatgatccgtaaccgccaacgagcagctgaaatttttggttccagtcaaagagaaaatcttcaaaatgcggattgacttcttttaccgtcatttgccgtcacccttacgagtaattgtgatattcacagaattgtccacagggcgggcggtaaggcgttcaagctctgcctgtttcgtctcgtttgaaagatagatgccgcggagcttcaattcttgctcatccattaagcggatcatatcgtatttctggcgaatggctttcaaccgtttatccgttacacgagtgagcgcctcctcgatattcaaaatatcatcaatagcccgcatctcggtttcttcaatttcagtcacaacaagacgctcattcataaccggaacaggtttgactagtccattcttatccggggtttgaacgatgtccttgaccttgcgcatttgttgcagcacgcggcgctgtttttcagataggccgttttctatccgactgatccgctgcatcattctccgctcccgaaggctcaattccctgatcgttaagtcaatttgaaagagtgggtccgtttagatttctccgaacagctgtctctcatcctcgtttaaaaaatcccacatgatcgtttcatattcgccggtacgggcggaatttttatttccttttggtgcggcattccctttcgcattttcgtttccaggcggtgcattcccgcccttgtttcctttggcgtttttattgcctattggagcgctgggacgaaaaggagcgctcccattcgatttaggagcgctccctttgattttatcttcccatttatctattgctttccacttgcggacggtactgcttgagacgcccaattcatccgcgatgtcttttaatttcttggttccgctgctttctttccataaacggaacgcttcgtcacgtcttggatcacgcggtctggccattacatttcacccacctccgcaacctgaattgagtttgagtttgtttttaaatttcttcatctttctgaagctgtatatcgagctcgatgagcttttttaaatcttcaacagtgttcaccttaatatgaccgctttgaaaatctttgacccattgggtgatacctgcctgaataatttttcgatatttctctttagattgactgatgttttcaagcaattcagcgctatgcaggagaagcagtttctctttttctttatcatcgcaggaacgtatgtttgtattttctgttgccatctgcctggtcctccaatagaatagagatgagagcgtgattttcccacgaaacgcggccgcgtcttcatcacgctcttaccagggtgatggccttgggtaagggagggtgttgtcagcaccctctttataaaaataagccctaactagggcttggtgaatttgttattttaatatgaggtaattcataaatattaaatagtattaaatctaatgtttctagatataacaataaatctctccgtttcggtcgaaatatttcatgtactgtctgatttcctacatctttaatttccaagagtatccttcgttgttcctcatcaattatattcttttctttaagttcatttatcttttgaaccaaatttaaattgaccattaccgggtttttatgaccatctaacactggttctcccttcttaatcttcggtcttttatcaattccatttaccatacatattgattcaataagcattctaattcccgtattgcataataaattcatacgttggcgataagcattaattgtttcatttctaattccatttattaagttaggtaagtgatcgaattcatatttttctttgaattgtaataactgttctaccggatcctccttttttggctcttctggaaagacagtgtattcgacaaagtattctctatcagtatgataatttgaaccgactatatgaaacatatcttcatcgccgtatatttttagaaaagcaatagcgtcacaacctctacattgaactattgcataatcctcattaaattgaaaatcaatttcttcatcataatctaaattacttattgaatactttagttcattgtcatgctcatttttaactatctgatggtttgtttttctcttacaagctctacagtacaatttctccggcacaacggtcatatattccaccctttttagaaaaataataacatttttctaaatgtagtgagaattattaaaaccactgattgtaaatctgttccgatatttttttcatcatgaccggaggaacactcatcccacaaacatattgaacagatgcgtccataaaatcataatcgagtgggaaagattgcattaaaatgatatcccgttcagagatatagtagggctcatcataacggacaaataccgaaccactcccgagagtaggcgggacaaggctatttttcactaatatcgtattgaaattagattctttcccttcaatccttttcgtgatgtctcccattattatccgacggccgtcgcttcacccatcttttataaagctttgatgtttctttaagccttgcaccatggccgcttctgaattctttatatacaatcggtggctcattgaaggacaatttaagcggtagtaaattcaagtccttccttcggcaaataaaaaagacccgctctctacgttgcggggctcccattgtggcagcattcaacaagaacagttgaacatcatatccaatttccttggtccgttcaatcaccagcttcacataaccttttgcatttccgctgaccattcctttgacattctcggccacaaagatttttggccgcagcctttcaacagcatcaaggtaatgaaaaaatagatcatcaagtgactgttttgcctgtcctttacgaaaggctttttcttttccccaagccttttcccgatcccccgcaatagaaaacacgctgcagggcggggaaccatcaaaaatatctaaatcgaacaattcatcaggcagattttccattttgttaaagtctctgatgtccataagaaaaggatatatcggattatgattcttcctgtaaatcttcatcatttgcggatcgatctcacagttccccaaaagatcgtaaccggcgagcttatagccccatagaggaacccccgccccaagagaatgtactgaatactttaaggccatttttcttgatgttttttaaatcgcccaacttccaacggtactctttcttttccatgtaatcatctattcattaaatgaaaatccgcatttggggcaggtatgttggaaatgatcatcttcataatcatccaggtctaattcctggctgtcattgatttttccttcgttgccttcatgctcagccagctctcccaagatttcatctatttcactttctgagaagcctgtaagggatagatcaaaattattgtgctgcaggtcttccaaaacctgttcaagtttgtaatcatcccagtcaccgctgatcttatttaaagccaggttgagcgctttttcctcagcctcatcaaaatttacaactgaaaccaggagagtctttggattttcttccatgaggacgcaaagattataggaagccatataaaaatgacttcctgtgcaaacgggatctcaccgcttgcgttccccgtgactatcgcgcgcaatcctgcatagactccagccgctcctcctttgaagctgacgatcttcatcatcattcgatacatccgagttcacccttgataagggaaaggtgcgtctcccattctggccaataaaaaagcggccaccaatcagctgcacaacatccgtgtgcaaaagatcagtgtccgcaggctctccgtcttggactcgatattcacgttcgtttttcttgtctctatcgtatgacaaaatggaatagaaaaagtcccccattttatccccctttttgtcggctttttctcggatatctaaccattaaacagcaacttcttcataaaaaaactcccctttcatagggagcttattattaattattatttgaatttaaatactcttccaagaatctaatattatcttcatcattaggaaaaatgcctaagttcttatattcccagataatttgtcgttgagaaccatttaaatctgatttaattacatcatcataattataatccattgaaaactttccatttctctcgagtgttaaagtgagatttgtccaaacttcggaattattttgtttaaactcattttgcagatcctcaaataaatcatgaagctcaaacaataactcatcatagatatcttcactaacattgaaatgttcaggtatgttatgagaataaatataatccttattttgcggtacattaaaataaaagaaaacctctgatgaatcatctaatatttcagcatagagatagaccttttcccattcagtagggatgatttcgttaatcccctctgctatctcttggtataatttttccatcttttcagtttccataaatattaacctccattctcatttttaattcttatttttttgattttttcattcccaattttatattcgactttaaaataatccggtcttaaagagtcatttttatatatagggctgatcttgaccttaactttttttgggggaacttcttttaaagcgttcctccattcttgttccatctcataccactttccgcctcttctattaacctgagaattcataggcacaagattatctatgtcccctgaacctttaaattgagaagcaattaaatgtcctccgtcatcatctggcagtctatctggtttaccaacgttagattgagcatacagatttctttttgcttttccaagttgcaaatcggcatttacactattaattcgacccttttgatccgttttaaacgtatagccctgttttgtttcatacacaacgtttggcttcaaaacttttttacgatttaatctggtatactggtctccgtattttactgtatgtactgcatgactatctgcttttccaggttttttcccactattagctttaaaaagcacacttttctttttatcctcaagcagctccttcagcaaaggcgtatttttcacattaggggcctctcccgctctttggagcatcccttctaatgcaggagtatagcggtttttaggcggattgaaatgctgtttaacagagttaatatttttctttgctgtttgggctgcagccttgccagctttgccaagactttttgagcctgatacgacagtaggaccggcctctgccaacccccatatcgtcccaatcgcataagcaatatagtgtccgcgagaatatgaatccccatgtaccatcttttcatcccaagaatctgcgattgattgcaacatactttcgaaagcggctttgtaatcatactcaagtactgaatttacagttgcttttgggtttttaataaagtcgtctgcttgtccaataagagctttacctgtttcaatcgttccttggatcgtatcttttgcaaattcatatcctccaaccacaaagcctttcatactttctaagacatgttttccatcttccagagttcctttaattggatctgctctgaactcataagcttcttcaatggcagtaacataattcatctgttcagatgtaagattatcatatccaatctctctagcaactttgagaaactcatccggatcatcatacaacttttcaagttttttcttcaacgtatcagtatgactcataggttctattttgctggcctctttttcaagctttgatctcttatccagcttatccaacatgacgcccatcgctgtgtcttgtccaccacgtaaagcatccatctcatctggctttaaatcgagcctttttggtaaccggtaatttcaattttagggcctgtgtacattttttcaagccggcttatgtatctctgcatcgtttccaggtcgttttcagcggttttaagagcgcttgtctgttcgcggtcgaaggcgtgcagcttttcaattgtctgattgatttcctttaaagctttctgattctgttcgtgaaaaccgctgtcattcaaatcaggcaaatcgacaatgtggctgacttttgcgatcgtggcatttgttttagaaaccaaacgcttcgtagtgcggtcggccgcattcaatccttgttccagctcgtgctcaagaaagctttgcgaaataaacccgttgtggtttggttccagcgaattcagcgcgcttttcattttcttcagcgtggaactgtattcctctatgaaagtatcatagaactgtagaaaaggggtgtggcattcctcgtaaaaggcgcggatcgcgtcgccgccttttccttttaaagcatcatcaagtgatgtaatgccctctacggcttttttgactttggataattcgtctgactgctgttttaattgttccagcgtttgatcaattgcatggtgcaacgcatggacatcaagagtcttcatggcattcccctctaatactaaagttacaatcagtatagattttaccactttacggaaagaaattggtgaataaatcctgtctatccatgaaaatgaatcttattgatcaggtcttaaaacccaacacagtcgacaggctttttttgaattccaaaaaaggaaaatcattgtaaaaaaatgatcctttctgtaaaatgaaaggtatgcagaaaaaggaaatggatacttatttttttgaatatttcaaatcaattatacgaaaggaatggtgggaattggttgttaaaatacgatccgaaaaggtcgggaatatgttgaatcaatggtatgcaacaattaagttacagcaagttcataaagcaactcaaatgaagaaagaaattcagaaggctattgataatatggagaagaatcaagatgttttgctttatttcaatatgatagattctcggtataaattattgatcgaaaaatataacgaatccggaagcatcttaaaaagtcttaagtatagagctgaagaaaagaagacggacgacatgcttcagtattacttttactttttcagcgggctgtatcagttttacataaagaactttacgaaagccattaatttttatcgcattgctgaaaattggataaataaaataccagacgaagcagaacgagcagaattcaattatcaaattgctattgcatattatgaaattcaccaaaattttttctcgttaacacacgcagaaaaagcgctcgaaagctttttagcccttggaaattatgaaaatagggcagcaaccactcaaatgataattgcggcaaacagactggatctacatcaatacgaattaactgagtccgtatataaaaaagcaataaaaatggctgctgatacccgacaaaattacgttgagggactcggacatcacaatctcggtcttgcttacgaacgacaagaaaaactcgatttagcgcgtgaatccttcgaaatagctctcgacatttttgaaaatctacattccaaaatcgcaatcatcagaacttcttatatgctggcaagggttttattcaagaaaggtttattcgaagaagggacacattggtatcaaaaagccctcaatctcgcaaaagaaataaacgaaaaaacgtacgaagccaagttattagtcatacactcaatatataaagagttggataagaccttattagataaaggattgaatatgctaagagacaaaaagctttggtcagacgtagcagatttagctatcattgcagcaagacacttcaaaaagaaggaatatcatgaattagcggcgaaatacttcgatgaaggagtagtcgctcgcgacaaaattcaaacatggacggaggaacttgtctcatgaaaaaattacttttaggtgcagtaataacaggtgtatttttaactggtattttaaactttactactcaaggaaaagctgaattcggtactggagactttaaagttgctgaaaatgcgttttttggttaaatcataacgtgattcagttcggcccttaagattaaaaaagtacactttgataaagcggactcctgggagtctgcttttttgttcacaacagccctcagattatcccgagagctgtcgcaagattgtaaatggcccgccgtttgacctgatagcatttgtcctttttcaaccccatctccatataaatctcaatgtcctttattttttggggagagagatacttggcctttatgatctttaattcatcaccatcaaggctttgtttaagcgccctgtccatctgacaaactttcaattcatttaaagagtgctgatccctgagctgcaggaaaaggttattcatcccggccgcttcccgttctttccggttttcaagctgaacctttaaagccttatatctttttagctcccttataatcgtatttctgacttctttttcgtctataggcggcagaaaaagtcagttgtgtagctgacatgctaaatccctcctaaaaacaaattagacaccaataaacgtatatacaacgtcaatttggtgtccgcaggctctccgtcttggaccaatataaattcctgaatccatcagacttaattgttgtttctctcaaataatttcatttcgatggtaattcgatccctcactcgctttttcggcgtatttaccggaggcttctgcgccgtagtcaaatcggaaaaatcttcgtcgattgtgaaaatcggtttctttttcgtcaacaaaaaacgcctcctacttcgttaaattgaacggttcaaaattgcgtcggttttttaaatgaccgttacatttaacgagtagaaagcgtatgatgacgggctttatcgccccattacgtgacgtcccaggagagattcgaactcccgaccgacggcttagaaggccgttgctctatccagctgagctactgggacatgatgttgttttgtttcgctttaactatcagcgacaagatttattatatgcggatcgggacataaagtcaacaactttttagaatttttttcttcacgaggaagaaaaaaattcttcctcatgaatgtgctggcaattgtacatggttcgtcaggctttcgacttcccggccgtccaagtcataatagcgaaccgttgcattgtctttgtcaatgtttagtatagcataagttttttctttccgcacccgcggaaggcggatgctgccggggttgatcagcagttttccgtccatcagctcgcttcccgcgatgtgggaatggccgaaacagatgatatcggcgccgagctcttcagcccggtagtacacatttaaaagcgactgtttaatgccgtataaatgcccgtgtgtgaaaaaaagctttctcgatccggcgggaacgacgatttcgtctttgaactccccgtaaaaatcgcagtttccttttaccgttaagtaagaggaaagcgcgggatgggaagggtccaattcagaatccccgcaatggatgatgagatctgtttccttcccgtgccgctcagcgatcatttccagttcgtcttcaaggccgtggctgtcgctgacaatcagaaccttcatgatcggccctcctcctttacgcttgatccaataaagcggacagctttttcagcgcttccgctctgtggctgattttgttcttttcgccgcttgagagctcggccatcgtttgatctttgtctttgacgagaaaaaccgggtcgtagccgaagccgtttgtgccgcgcggctcttcggtaatgtacccttccacagaaccttcgaccgttttcgtttcctgtccgggaatgcatattgcgagcgcgcatctgaacctcgcggaacggtcttctttttccaccccttcgagctctttcaatagctttttcagattggcgagatcgtttttctcttctcctgcatagcgggccgagtatacgccggggctgccgccgagatagtcgacagacaggccggagtcgtcggcaatcacgatttttccggtttctttcgaaattgtttccgctttaatcacagcgttttcttcaaaagtctgcccggtttcttcgatttcgggtgtatagccgatgtccagtaaagatttgacatcgtagcccctcggttcaagcatcgctttgaattccctgactttcccttcgtttttcgtggcaatgatgacttccttcatcgtgtatcagcctttctcatgttattgttgaatagataatgcaacgtcgccgagcacttctttctgcttttcgaggagttcggcgatccctttttcagccagctctaaaagcccgtccagttcacttcttgagaatgtcgcttcctctcctgttccctgaagttcgacaaagcggccttcgcctgtcatgacgacgttcatatcaacctcagctgcagaatcttcctggtagttcaaatcaaggatcaatcctttttccttatcgatgcccactgaagtggcagccaaaaagtcggtgatcggcatctccttcagcgcgcctttttcgacgagtcttccgacggcaagcgccatggcggtgaatgctccggtaatcgacgcagttctcgtacctccgtccgcctgaatgacgtcgcagtcgatccagatcgtccgctcaccgagcttttccaaatcaacaaccgcccgaagagctcgtccgatcagccgttggatttccatcgtccgcccggagattttcccttttgacgattccctgatcgtcctttggttcgtggcccgcggcagcatgctgtattccgcggtgatccagcccttcccttctcctctcaaaaagggcggtacgcggtcttccacagacgcgttgcatatcacctttgtcccgccgactgtaatcaggaccgatccttccggatgcgtaataaagtcgaggtccattgtgacagggcgcagttcattgttttttcttccatcgtatctcattttcagttcacttcttgagaatgtcgcttcctctcctgttccctgaagttcgacaaagcggccttcgcctgtcatgacgacgttcatatcaacctcagctgcagaatcttcctggtagttcaaatcaaggatcaatcctttttccttatcgatgcccactgaagtggcagccaaaaagtcggtgatcggcatctccttcagcgcgcctttttcgacgagtcttccgacggcaagcgccatggcggtgaatgctccggtaatcgacgcagttctcgtacctccgtccgcctgaatgacgtcgcagtcgatccagatcgtccgctcaccgagcttttccaaatcaacaaccgcccgaagagctcgtccgatcagccgttggatttccatcgtccgcccggagattttcccttttgacgattccctgatcgtcctttggttcgtggcccgcggcagcatgctgtattccgcggtgatccagcccttcccttctcctctcaaaaagggcggtacgcggtcttccacagacgcgttgcatatcacctttgtcccgccgactgtaatcaggaccgatccttccggatgcgtaataaagtcgaggtccattgtgacagggcgcagttcattgttttttcttccatcgtatctcattttttacctccgattgtatgtacataaacctttcacaatcattccgctcttccaaaaagctgaataaagaaagaggcagctttgatcgctcacctctttttctatagtatatcaaaaatttcggcttaaaaactacctgtgttcaccttgctcggtcttgaaaccggcttggaaagcttttctcctttttcattcacgagctcggattttccgttcacggtaaccgacacacttttcacatcaggcagttcggttaatgtcaacacgatactgtttaacacttcatccgatatcacttttttctggccgtcggcacttccgtagatcgcttcgttaaagtcgagggttacatggccgtcttcaatcttcggcttgttttcaagcttgacgtcgccctggaaatcggagagcaggccgcttttattgtccggtccttcagtcagctctttaatcgccgccgtcacctgatctttttcttttgcagacgtccgctttgtcaccggaacgtaatatgtgcctttatctgattcagccaaataatagacggtgaccggctgtgtcgccgttatatctgtcacacccgccgtgtcgaggttaatgccgtcctcgcggctgagttcttctgaaatcggcgtgccgttaacaggcatttctttcaaatcatggccgttcatgcggagcttcactttatcaatcgagttaaactgcgttaacgtccatgtaatcgcctgtacgattttttgctcatcttcagctttatagtttttaaattcatttgagaaatcagcgatcgctgttccgtcttctttaatatcaacattgaccgttgtatccgccggcagcacggctctgaatccgtttggcaggatgtttgaaacagggccgccttcaacgaggtattcaagcgcttgtttagccgtcccttcctgctttggcagcggcagcgtctgcgctgtcacatagccgttcttatcaatgagataaagctctctcatgaccgtatcgcccgtttgagcggctttatcgtcgcttgtcgttttgctgcctttgtcttctgttttatctttggttttgtctgttttgtcttgctccttctcctcttttacatatgtgatgtcctgcggcggatctatctcctctgaggcttgatctgactgaaatattccgcacccggaaagaagcagcgcggaggccgtaaccgtaaccgcgattcctttcattccttttttcagcatacttttccctcctaaggcagtttgtactattatgtatacgagcccgtttttgaattagaccgctttttaaaaaaatccctctgaatacaaaaaaccttttctttaaaagaaaaggccatgaaaaaagctgccgtttgcatgtgcggcagctttattttacagcggtctcctgaagagaaatgctttccacatttttcacttcgtatccaaaccaatcgtttgcaatttttgtgaagcgggcacgctccccagttgttaaaaacaagtgttccggcggttccgccgttttgcttaataaaccgttgtatgacaagatcgtgctgacttccctggccgtttcatctccggaggaaatgatgttgacgcgctctcccatatagcgctgaatcggctcttttaaaatcggataatgcgtacatccgagaatcagcgtatcgattgatgaatctctgagcgggtgcagtgacgtcctgacgatttcatcagccgtctcatccaaaaatttgccgctttccacaaacgggacaaacattgggcaagccagattttccaccgttaaatctccgttcagcgaaagaagcgcttcttcgtatgcgccgcttttgatcgtgttttccgttccgattacgccgattcgctggttttccgtcactttaatcgcggttctggctccgggctgcaccacgccgatgacgggtatcgcaacttccctgctgatttcctctagcgcgatggccgttgctgtattgcaggcgatcacgagcattttaatatggtggcgggataacagataatttgtcatttcccatgtatatgacaggacttcttttctgtccctcggtccgtatggacaccttttcgtgtctccaagatatataattttttctttcggcagctgcctcatgatttcttttgcaacggttaaaccgccgactcccgaatcaatgactcctatcggttgatccaacaaaatcgcctcattttctgttcatttcctgctgaagtttaattaataatttttcaaacgcggctgtttcttcctcggaaaacgcctctaacatgtcttctaaatagtcctgccttttttgaatgacctcctggatgatccgctctccttccgatagaagatgaatgcggactacgcgcctgtcggacggatctttaacccgttcaacgaggttgtttttctccattcggtcaattaaatccgttgtggtgctgcacgccaggtacatcttttgtgataactcgccgatcgtcatatccccgtattcatacagccattgaagaccgacaaactggggaggggtaatcgtatattgggtgagaatttctcttcctttttgtttaatgatgcccgcaatatggcggagtgatttttcaatgtccgctatgtgattcaaagaagcattcgaattcattttctctacctcgctcgactcgttgttttgttttcaaaacacttgagtctattttccttcttttctacacaaattgcaagacttcaacatgaatatacaaattgctcttgaaaaaacaaataaccggttcccttcttgatacaagaaggaacaccggctcaatttagagctctagctcacccattcgaagaagttcaacaacagcttgcgaacggcctttcactcccaatttttgcattgcattggaaatgtgattacgtacagtcttttcacttataaagagctcgcttgcgatttcctttgttgtcttgtcttgaacgagcaattcgaacacttctctttctctttttgttagcagcggctttgattgaaactctttctccttcaagtattgtaaccctccttgctaaggtgagagctgatctgaaacgaatgggtttcgatatagtcgtgatatcatatgaaacatacgcaaggtcggtgacgtttctgacggagaaaagggttccctcaaacacctatttttcaaatcatgacacaggcatcgtttcagggctgaacttctaaggaagacattttaaaatccaggagatcagccgccatctcttcgtaatatatgcgtgcgtcttcttcttctgcacagcgctgatgatttgtgcagccgctttttcgggcgaagccgtccaaaacagatgatcaccttttgcaagagccgtgtccacgaagccgggctgaatttcggtgaccgcaatttcatcgcaaccgagttttttcactttttgacgaagtccttttaaataatttgaaacgaatgcttttgaagcggcgtaggtgacggcccctccgtttcctctcagcgcggcgatggatgaaatgccgactaaatgccctctcccgtttttgataaaatgctccatcaacacgttcgagcaggacacaaatcccgtcacattgacatcgatcgtttccttttctttgctccaatccatttcgctttccaaatatccaacacctgaacagatgaagactgcgtctgccccattcatctcatcaagcagttctttcaacagtataggcgagtgttcgctgtcggctgtatcgatctttttaatgtatgaaggtccagggaggtcgtcgcgcaatttggctagcagctcataccgtcttgcagcaagaccgacctccactcctccggctgacagctgcttggcaagcgcattgccaattccggaactcgcgccgatgattatcgcttttttcattttcctctccctgtcaattatttctcaggaaatgagttattgccaagcagttttgctttttgttcgtctgtccatttcacgggtttacccgtatctttcgcaatttgcaccataaccgccagtcctgtaaagcaaaggccgccttccccatttttcgctgcgtaatggagggtgagcgaggcgttgccgacagatgctgttttgacgccgatttttaaacgttcatgaagcatgacctgctgaaaatagtcgcattgctggctcgccacgacgggaatggccgcgctcttcccgtctgaaaggcggtccatgacgcccaggtgcttgaaataggaaatcctcgcttcttcgaagtagacaaacggtgtgacattgttcatatgaccgaacatgtccgtttctgaaaaacggacggaaacttcatcaaaaaaagaaaatgactgacaccatgtgtcaaacggttcttcgatatatcccggcaatttcaatgttttcatcccctttgatcatgaaaacacctcttcggtttgaagaggtgcgttttttcgtgttattccgtgttgtcgcttccgaagaagtttttaaacgcctgaacggtcgtatccctgtttaatgcagcgattgaggttgtgagcgggatgcctttcggacacgactgcacgcagttttgcgagttgccgcattcggccagtccgccgtctcccataatcgcttcaagccgttcagatttgttcatcgctcccgtcggatgggtgttgaataagcgaacttgcgagagcggtgcaggtcccataaagtttgttttatcgttcacgttcggacaagcttcaagacacacgccgcaagtcatgcattttgacagctcataagcccactgacgtcttctttcaggcattctcggtcccggtccgagatcatatgtgccgtcgatcggcacccatgctttgactttctttaacgaatcaaacatgcggctccgatccacttgaaggtcgcggacaaccgggaatgttttcatcggttcaaggcggatcggctgctcaagctggtcgatcagcgctgtacaggactgtctcggcttgccgttgatcaccatggagcaagcgccgcacacttcctcgagacagttcatatcccaagcaatcggcgacgttttttctccctttgcattcaccgggttccttctgatttccatcaaagcggaaatcacgttcatattcggacggtatggaatttcaaactcttcctggtaaggattagaatccgatgtatcctgacgagtgatgataaacttgattgtcttattttcactcatgatttcgccacctttttcttcgagtaatcccgtttacgcggtgcgattaatgaaacatcgacatcctcataatggaatttcggggcttcaaaatcgcctgcatgtttcgccattgttgttttcagccattcctcgtcattacgttcagggaaatccggtttataatgggcgccgcggctctcattccggttgtatgcaccgagcgtgatcacccgtgccaattgcagcatgttgtgcagctggcgcgtgaatacggcgccctggttgctccattttgccgtatcgttgatattgatgtttcggtagcgctcggcaagctcttggattttttcatccgttttcagcagcttgtcattgtagcgcacgaccgtcacgttgtctgtcatccattcgccgagctctttatgaaggacataagcattttcattgccgtccattttcattatgtcagcccacttttcttcttcctttttgacgtatgcatcgaaaacggaagaagacagatcttctgcggatgtttcgagaccttgaatgtattcaacggctttcggacctgccaccatgccgccgtaaatggctgacaagagcgagttcgctcccaggcggtttccgccgtgcatcgaatagtcgcattctcccgcggcaaacagtccaggaatgttggtcatctgatcgtagtcgacccaaagtccgcccattgagtagtgaaccgcagggaagattttcatcggcagcttgcgcggatcgtcacccatgaatttttcatagatttcaatgattccgcccagcttgatgtccaattccttcggatctttgtgggaaagatcgagataaaccatgttttcgccgttgatgccgagcttttgtctgacgcacacatcaaatatttcacgcgtcgcaatatcacgcggcacaaggtttccatatgccggatatttctcttcgaggaaataccaaggcttgccgtctttatacgtccagactcgtccgccttcaccgcgcgccgattcgctcatcagccgcagcttgtcgtctccaggaatggcggtcggatggatctggatgaactctccgttcgcatagtaagcaccctgctggtaaacgatcgaagcggctgatccggtattgatcatcgagttcgtcgattttccgaagatgatgcccggccccccggtcgccatgatgactgcgtccgaacggaacgactcgatttccatcgtcgttaagttttgggcgacgatgcccctgcacgtattgtcatcatcaagaacggctccgagaaactcccagccttcatatttcgaaacgagcccttcaacttcgaagcggcgaacctgctcatccagcgcgtacaagagctgctgtccggtcgtcgcccccgcatatgccgttctgtgatgctgggttcctccgaagcgccggaagtcaagcagcccttcaggcgttctgttaaacatgacgcccatgcggtcaaagcaaatgaatgatcgacggcgccgcttcacacatcgctttgaccggcggctggttcgccagaaagtcgcctccgtacaccgtgtcgtcaaaatgctcccatggggagtctccttcaccttttgtattgaccgctccgttgattccgcccctgcgcacatacggaatgtgagcgcttaacgggaacgatcgaaaatagttttacatttgttcctgcttccgcagctttaatggtcgccatcagacccgctagtcctccgccgacaacgatgatgcttgaattgctcatgcctgccccactccctctagtaatctagttcttttacacaaatgccaaaatcgctctcagccctacataggacagcacaacaaagactcccattgtcacaaacgtggcgattcgctgtgagcgaggagaaacagtgattccccaagtgacagcaaacgaccataaaccgtttgaaaagtggaagattgttgagaggacacctacaatgtaaaagccgagcatgatcggggagctcaaaatatcagccatcatgtcaaagttcacctctgcccccatttgggcggcaatccgtgtttcccacacgtgccagctgacaaaaatcaaggtaatgattcctgtaatccgctgcagaacgaacatccagtttctaaaaaagccgaatctgttcgcattgtttttcgctgtaaaagctatgtatactccataaacagcatgataaatcagcggaaggaaaatcacgaagatttccaaagcgtacctgaacggcaggttttccataaagtgagcggcgttattaaacgcctcttctccgcttgccgcaaaatggttgacaaccaaatgctggattaaaaatatgcccaccggtatgacgccaagcaaagaatgcagtcttcgataaacaaactctctgttcccggccattgctttaccccctagttgaaaagtgcagtaaaaatgaaaggtctcctatcccccgtcctgtttcaaatatcgcactttgttaagtttttatgacaatttcattttactcctatgagaaataggcgtcaagaaaacgcgtacataaattgaaattttctaaaatttaatcatatttttgaaaattttattttatcaaaatataaatatatcagatttttttcttcctaaatgcatgtctccgctgtaatctttcaccccatttaagctataataaacggagaaaagaggggagacattggatatgaataaatatgaagcaaacttagcgcaattaaaagagctggaagtctccgcatatggctatgagttgatcagggaagtgctgcttcccgatatgctgggacaagactacgcagatatgatgtactgggcgggaaaaaagctcgcccgcaagttcccgcttgaatcccgggaggatcttcccgctttctttcaggatgcaggctggggaacgcttgcgatcgtccattcaaaaaaacaggagcttgagtttgaactcgaaggcccgctggtttcaaaccgcctcaagtatcaaaaggagccctgctttcagcttgaagccgggtttatcgccgagcaaatccagctgatgaacgaacaaattgccgaatcttatgaacaggtgaaaaaaagagccggaaaagtggttttaacggtgaaatgggatttgaaagacccggcataactatgcaaaaaggcggagactgcaaaagtcccgcctttttctttttaaatgactgctgtctgcttcgacagttcaaaagcatcatgcagcgcttcaacggctttcaccatatcgccttcgttgacgacagtcgaaactttgatttcggatgtgctgaccattttgacctggatgtttttttccgccagcacagcgaacatttccgctgctactcccgggttggagatcatgccagaaccgacgatcgacactttggcaagcctgttttccgtttcaatctgttcatagtcgagcgcgtctttgtattcttcgagaacttcaaccgtccgttttaagtcttccgttttcactgagaaagaaatcgacgttttgcttgtgcctgtcaccgattgaatgatgatgtcaacgttgatgttctgtttggcgagcgttgtaaaaatcgttgacagcgtcgtcaggccgctcgccaggccgcatacggtcacgcgtgtgatctgatcttcaaatgcaatgcctcttacgattaaattctgttccattgatgattcctcctcgattaatgtgccggcttctttttcggtgcttgaacggacttccaaaggcacctggtagtttttcgcaaattcaacagctctcggatgaaggacgcctgctccaagattggcaagctccagcatttcatcgtaggagattccggccagcttccgcgctgttttcacatagcggggatccgtcgtgaaaacccccggcacatcggtgtaaatgtcgcatttatcagctttcagggctgctgcgagggcaacggctgtcgtatctgatccgcctctgccgagcgttgtgatttcgccttccgctgtgacgccctggaatccggcgacaacggcgattttcccttcattcaggcgctctttcagcttggctgtatcaatgttcgtaattcttgcgttgccgtgaatattttcggtttcgatgccggcctgccagcctgtataggaaaccgcatcataccccttgttctgcaaagccattgtcaacagcgaaatcgtcacctgctctcctgttgtcagcagcatgtccatttccctgctgctcggctgctcggtgatttccttggcaagcgcgacgagggagtccgtcgatttgcccatcgccgaaacgacgacgacaacatcatgaccgcgctgtttttcttcgatgacgcggtatgcgacattcaatattttttccactgaccctacggaagttccgccaaatttttggacgatgagacccatcaaataccaccctttttgttttcgttcgtgtttgtttatgtatgaagaggaaagcttgaccggcggcctgtacggttttttttgcacaaaaaaagcaacgagagaattccctcattgctttaaccaacaaaaatgccgatgatcttaaacaacgagatagctctccaagaaatgatttcttgacagcctcacatttattcaatgtaaagccagcaggaaaaacgagtggatttttccccgcttcggcgacgctcccctttcggctttcttcatcggaatccatcttcctcatcaagcctactcttgaagttcgcacctctatcttcaccatatcacacgatcttattatgaaattagtacaaattctatcagattctttttaaaagttcaacattattttttcaatgcctcttcgatcagctgcgccgttttcagaggtatgccgagcttgcggatatcttcggcgctcgcttccttcattttcttaacggaaccgaaatgttttaacagcagttttttccgctgttcgccgacgcccggtatgccgtccagcaccgattgaaatgcgctttttcccctgagctgcctgtggaagctgatcgcaaacctgtgcacttcgtcctgaatgcgctgaagcaggtaaaattcctggctgttccgctcaagctggacgatctcaaggggatcgccgatcaaaaggttggatgttctgtgcttatcgtctttcaccagaccggcaacagggacatcgagacccagttcattttccagaacgtcaagggcggcagacacctgcccctttccgccgtcgatcaaaattaaatcaggcagcggcagattctctttcagcacccttgtatatcttcttctgatgacttcgcgcattgatccgtagtcgtcaggaccttcaaccgtcttgatcttatatttgcggtactcttttttatgcggttttccatcgagaaatacaaccatggccgaaacagggtccgttccttgaatatttgagttatcaaacgcttcaattctgtatggcgtgtagatgtccagcgcttttccgagcttttcaatcgcgccgatcgtccgctcttcatcccgttcaatgagcgaaaacttctccttcaaagcgagctttgcatttttatgggcaaggagcagcaggtcttttttcgctcctcttttcggctggcgcacgttcacgtccaaaagctcctcaatcatgtccttgtcgacgctgtcaggcaccaaaatttccttcggaagaaaatggttgtttttggagtaaaattgcccgatgaatgtcagaaattcctcgtctgcttccctgtataaaggaaacatgctgacatctctttcaatcaatttgccctgcctgatgaagaagacctggacgcacatccagcccttgtcatacgaataggcaaatacatcgcggtcaaccatgtcattcagcatcattttctgtttttccatcgttgactcgatatgggcaatttgatcgcggaattctttcgcccgttcaaactgcaggttttccgaggcttcgagcatttttgcttcaagctctttcttcacttcattgtagccgccttttaaaaagcgggtaatttcttctgtgagctgtctgtttgtctcctcagacacatcatatacgcatggcgccagacattgtccgagatgatagtacaaacagacgcggtcaggcagcttggcgcactttctgagcggatagaggcggtccagcagcttttttgtttccctcgcagcctggacattggggtacggcccgaaatagcggcctttgtcttttttgaccttccttgtgacaaccagcttcggatgccgctcgttcgtgattttaatgaacgggtagcttttatcatctttaagcatcacgttatatttcgggtcgtactttttgattaaattcatttcaagaatgagcgcttcgatgttcgaggatgtgacaatgtattcgaagtcttcaatttcactgacaagacgctgtgttttggcatcatgggacccgctgaaataggagcggaccctgttttttaagattttcgctttcccgacgtagatgacggtatcctgcctgtctttcatcaagtagcagccaggctgatccggaagaagggccagcttttctttgatttttttgttcatcaaaaatccttccttatttcggcgtttttccttcatttaagtttaccatgaccgaccgtacgttcgccacaaatggagaaagaagatgacttgtaagaaaaaagcgatccctttggaatcgcctttttcacaggtttctattttacaaatgtttgttgaccagttcttcaagcgcttctttcggtttaaagccgacagatgtttcgaccacttcgccgtcttttagtacgaggagagtcgggatgctcatcacgccgtatttgccggcagtttcttggttttcgtcaacatcgatttttacgattttcagtttgtctcccatttcttgatcaagctcttcaagtaccggcgcgatcattttacaaggtccgcaccaaggagcccaaaagtcggcaagaactacgccttcgcttgtttcagatgagaatgtttgatcagttgcttttacgatagccattctttcattcctccaattgtgaaattatgctttttagtatagcatctccctttggttcacgctaacataatgcttgattatacgtttccctatctgcacagttttacacatcgggattttagcctttctgaaaatgtccatatcccatgttattttgcagaaggcggaaatgtgcctatgtcaaaagccggccatttcaggccggcttttgatcatgtgctgacgctcagctttttaaattcctccgtgagcagcggaacgatttcaaataagtcgccgacgatcccgtagtcggcaattttaaatatatcagcttccggatctttgttgatggcaacgatgattttgctgtttgacatccctgcgaggtgctgaatcgctcctgaaatgccgcaggcaatatataagtcaggtgtcacaactttgccggtctggccgatttgaagcgaatagtcgcagtagtctgcgtcacaggctccccttgaagcgccgaccgccccgcccaatacatcggcgagctcctgcagcggtttaaagccttcctcgcttttgacgccgcgaccgccggctacgataattttcgcttcagacaaatcgacgccttcggacgtttttttgacaatgtccttgatgaccgttctgatgtcccgaatatctgcttcgatgctttcgaccgctcctgtccgcgtctcatctttgtcaagcggggcgatattattcggtctgatcgttgcaaaaatcgtttcatcttcggaaatgatccgttcaaacgctttgcccgagtaaatcggccttgtaaacacgatgttgccgccggccacttcgacatcgacggcatccgatatcagccctgttcccatacgggctgaaagcttcggcgacaagtcttttcccattgacgtatgtccgaaaatgatgacgtccggattctcgcgttctatgatcggcaacaaggcttgaacatagccgtcagacgtatagtttttcaagagcgggttttcggctgtaagcactctgtcagcgccgtaatggatcagttctgccgcatgacttgaaacgctttcaccgaacagtacgccgatcacctctcccccttcggcaaccgtttttcctgcggctatcgcttcgaaagtcacattcctcaacgaaccgtctctgaactctcccaatacgataacttttttgctcatgtccatttccccctgtattttaatgaccgtgttatttctcccttcggcttcatacgacctttgcttcgcttctcagcagtgatacaagttctgccgcctgctgctccggctccccttcaaggattttcccggcttcttttttcggaggcaggaaccgttcgatcgtttttgttttcgcagccacgtcttcttcgtcgatgtcgagatcatcaagctcaagctcctcgagaggctttttctttgccttcatgattcccggaagagacggataacgcggctcgttcaacccctgctgtgcagtcgctacgattggaagcgatgtttggatcacttcaagatcgccctcggcgtcgcgttccgcttcaacatctccgccgtttaccgtcagctttgtaatcgtcgtaatacaaggaatgcccagcagttcggccaaacgaggcgcaacctgtcccgatcccccgtcgatcgccacattcccgccgagtataatgtcgtactcgcggtctttcaaatagttgtaaaggatggctgaagccgtatattggtccgcttcttccacgtcgtcttcaatgttgatcagaacggctttgtcgcaccccatcgccagagccgtcctgagttctttttcagcttcttcctcgccgactgtcacgaccgtaatttcaccgccgtgcttctctttcaactggagcgcttcttcaatggcgtactcatcgtacggattgatgatgaattccgctccgtccgtgttgatttccccttgttcgatctgaattttctcctctgtatcaaacgtgcgcttcattaagacataaatgttcatgttctgttcatcccctttgttttcacgtttgttatttccctttaaaatgcggcttccgcttttcaagaaatgcctgaatcccttccttcgcatcctcggattggaacacttcgccgaagtatttcccttctagcttgaggcctccttcatacgaatacactttgctcgaattcaggagttcaatgacataagccatcgtctgcggacttttttcagcgaatttttgtgcgagctcttttgccttttgcagcacttcttcttcattcgccgccaaaatcgtgacaagaccgtattcaaaagcttccttgccggatatcggctctgatgtcccgatcatttcaagcgctttggcggtgcccacatacttgggaaggcgctgcgttcccgcaaagccgggaatgattccgagattcagttcgggaaggccgagctttgcgctttcctcggcaatccggatgtggcatgccatcgctagctcaagaccgcctccaagagcggccccgtgaatcgcggcgatcaccggttttggaaaagattctactttttcgaaaatctgctggcccttatcagccaaatttgcataatcagacccgtccatcaatgatgtaaactctttaatatcagcgcctgccgagaaaaatcttccttccccgtgaataacgacgcttctgacatcctgacgttctgaaagttcatcaaggcatgccgaaagatcttcaagcacttgcgtcgatagcgcatttgccggcgggtgctgaatcgtaatcgtcgcaacatggccgtctacggcgtatgataatgctgccatttttattcctcctccttcgtcttttggctgctgaacccgtggatcagcaattcatgaatgctgtctgccaggtttgggagatcgtatttttgatcattcatcacccaggttgtaaccgtctcatccaccgtaccgaaaatcatctgcttcgcaaggcggacgtcaagcgtgcttttaaattctccagcttcttttccttcggtgatgatgtcttccaggatcgttaagtaccctttgagaatctcattgattttcagcctcagctcaagattcgactgcctcagctccagctgggtgacaatcgcgaggtggcgatcgctgctgagcagttcaaagtgctttttgatgaacagcgaaagcttttctgtcgccgaatttttcgctgtcatttcttcgctcatctgctcgataaactgtcccattttctctttgaataatgagatgagaatgtcttctttgtttttaaaataaagataaatggtgccgtccgccaccccggcctgcttggcgatttttgaaacctgcgcctgatggtatccgttttctgcaatcacaatgacagctgcgtcgataatctgcatatactttggtctcttttgtttcaattggcttcgttcctttcaaattaatgaatgaatactcattcatgagttaatcgtaaataaaaatggacgctttgtcaagaagctaaaagtaaatcgcatcacaaaagcatgccgtcaaaatcgacggcagactttgctttttcagacgccggtcttttcctcttgaacgagcgctcttcttaaaatctttccgaccgccgttttcggaagttcgtccctgaactcgtatacttttggcactttataaggagcgagacgcgatctggcatattcgtccaattccttctccgttattgtaacatgatctttcagcacaacaaaagccttaaccgtttcccccctgtattcatcagggatgccggcaacgaccgcctcctgaacggcttcatgctcgtagagcacttcttcgatttcgcgcgggtagatgttgtatcccccggcaatgatcacgtcttttttgcggtcgacgatataaaagaagccgtctttatccatgtagccgatgtctccggtaaaaaaccagccgtcccttagactctgagcggtttcttcatcattgttccagtagcctttcatcacctgcggtcctttgacagcgatttctccatgctcataaggcccgagaaaaccgccggtttcttccgaatagatagcagcgtctgtaccaggccaaggacacccgatactgcccgctttattcaaatcccaaataaaattggcgtgagtgaccggcgacgtttcagacattccataaccttcgacaagccttccgcccgtcaccttttcaaactgctgtttgacttcaacaggaagcgccgcagatccgctcaaacagctcttaatcgatgacagatcgtattggtgaaggtcgggatggttcaacagggcgatataaatcgtcggcgcccccggaaatatcgtcggcttttctttatcgatcgttttcagcgctgcgcgcgcgtcaaatctcggcagcaggatcatttcatacccctgcctgatcgtgaaattcaagacggccgtcattccgtagacgtgaaaaaacggaacgatccccagcaccttctcctcccctttattcaattgataaaaccaggcggcgcacatctccatgttggctagtatgttgcggtggctgagcatgacgccttttggcgtgcctgtcgttcctccggtatactgcaggacggcaatgtcgtgggccggatcaatttcaataccgggcggtccgcttggaacggggcgtttcatgatggtgcggaaaaggtgggtcgtctcattttcattgatctcaacggacatttgattctcttttttttgaacgatcgggtacagcagatttttagggaaaggcaggtaatcttttatgcttgtcgcaatgatgtgcctaatgcttgttagcgctttcattttatatgccgccgggtacagcatgtcgagcgtaatgatgatggttgccccgctgtcatgaagcagatgttcaagctccctttccgtatacagcggatttgtctggacgacgatgccgccggagaaaagaacgccgtaatacgcgataaccgcctgcgggcagttcggcagcatgatcgatactctgtctcctttttgaatgccgagcgacagcaggtaatctgccatttttaaagcatcctcgtaaacttcccggtacgaacgtttttttcctagaaaatgaatcgctgttttttctgaaaactgctgggcggattgttgcaggatggaatggagtgtttgatcttcaaattgcagctcgtgaggaatttgttcgggataatgacgcagccacggtttttcagtcggcataagctccccccttttaaacaatatattcttgatttgagtatatcaaaacaatattcagaaagtaatgatattttttcatttttaaaaaggcgccccttttttaggacacctttttcaagcataaaagatcatataaatcaggccgataaccacaaataccccagctgtaaaaaacaggactttcgctaatttctccatgttgatcccctttagatacccgaagccacgacaaatgacaggcctactgaaatgacgaatgaaatgaagccgactgcgcggttgtcgttttcaatctccttgtcaattttaaagcgcggcgtcagaaattcaaaaatgaagtagccgatcaaaagcaggataaaaccgaacagcccccaccccatcatttgcagcagggaattatgctggctgatcgatttttgcagcacgttggcgatgcctaaaatttttccgcctgttgccatcgcaaccgccatgtttcctttttgaatctcctcccaatttttatacgtggtgacgagttcaaacacagataaaaatatcacaagacacaaaacggaaacactgtagtacgcggcgatttccacaaggttgttctcccaaaactctttcatccttttagactccctttattattttaattcgacaatggtgactcctgatcctccctctcccgcttcgccgaaccgggagtttttcacattgcggtgggatttcaataggtcctggacgccttttcggagggcgccggttccttttccgtgaatgatcgagactctcggatagcccgcaagcaccgcatcatccaagtatttttcaacccggtgaagcgcattttcaaaccgctcccccctaaggtcgagttcgagcgagacgtgataatctttccctttgacggcggcgatcgttttttgtttctcgggttcgggtgccgatttcaggaattccagatccttttccttgaccttcattttcaggatgccgatttgcacattccattcggccgcacccgttttttcgagcagcgtccctttttggccaaaggttaaaactttgacttcatcgcccggttttaattcgcgcttgtccgtttttttctgagccggctttttcgctttttcaaacgaaggcacggcttcttcaaggcgctttttcgcctcgatcagctcatggtctttaaatgctttatggtcttctttgatcatgcggagcgactggatgatgtcgtctgcttctttcatcgctgctttgactttttcagccgctttttgctccgcttcttcgtagagcttgtcttttttctcctgccattcgctgatctgctgctgcaggtcgcggtgaagggcttcagcttccgcgcggatggcttcggtctccttgagctccgcttctgcgcgctttttgctgtcttccagcgatgcgatcatcgtatcaacttcattatgttcggccgtcatctccgcttttgcgcggccgatcaggtaatcaggcagcccgaggcgcttcgagatttcgaacgcattgcttcggccgggcactccaattaaaagcttgtatgtcggtgatagtgtatcgatatcaaattcgacgcttgcattaatgacattttcgcgattgtagccgtatgccttcagctccgggtaatgggtcgtggcaatgacgcgtgcgcctgtctggcacacctcatcaaggatgctgatcgcaagggccgcgccttcctgcgggtctgttccggcaccgagctcgtcaaaaagcacaaggctgttttccgtcatgtctttcaaaatatcgacgatgttgaccatatgcgacgagaacgtacttaagctttgttcgattgactgttcatcgccgatatcggcaaatacttgatcaaatacggcggtctctgatccttcttccgccggtacgtgcaatcccgactgcgccatcatggtcaaaagcccgagcgttttgagcgtcaccgttttcccccccgtgttcgggcccgtgatgacaattgtcgtatactctccgccgagctcaatatcattcggaacgacctcatccaggggcaaaagcgggtggcgggcttgaatcaggcggacatagccgtcagcgttgacagccggtttaaccgcttttgtcgcttttgcatattttgcttttgcaaaaataaagtccagcgtctgaagcactttgacatcgtgaaagagctcatttgtgtgctctgccgtcttttctgtcaggacgcgcaaaatccgttcaatctcctgtttttcgtttacttttgcctggcgaagcgcattgttcatatcgacaatcgcctgaggctcgataaacaatgtcgcaccggaagaagactgatcgtgcacgattcctccgtagcttgatctgtactcctgtttgacagggatgacgaagcggtcgttgcgaatcgtgatgatcgtatccgacagcattttttgcgcagatgaagaacgcagcatcgattccagccggtccctgattcttgattcaagcgtccgcagctgggtcctgattccccttaacgtctctgatgcatgatcaagcacttccccatgatcatcgatgcacgaattgatgtccctttccaattcggaaagcggtatgagcttttctgcatattgatgaagataaggaatctcaaccccgtcttcgaacaggccttcaagaaagtgcttcatctgttttgctgcgtatagcagacccgatatttcagtcaattccgccgggcttaaaatgctgccgatttctgcccttcttaacgcttttctaatgtccgtaaggccgccgaaaggggcgcttccttttaaacgcaggacggttcctgcttcatcgacttcttcctgcagctttttaacttcttcgagcgaacgggaaggtttgagttccaaaagcatttccttccccaaagaagatgccgcatgctctgtgagctgttcttttactttatgaaattcaagtgctgatagcgctttttgctgcaacgtccattaaacctccttaagatcgatggcgcgacaaaaatgcctggacttcttcaaaggagcgggtgtttaatacattggcctttggcgtccatccttttctcgctgccgtaacgcccgttttcatatcatcaagcatcgctgtgttgtgggcatccgtattaataacgagtgtcactccggcagcattcgctttgatcaagtgctccattctgagatcgagccgcgctggatttgcgttcagctccaatgctgtattcgtttttttcgcaagttcgatcagctggtcaatatcgacttcataccccgcccttcttccgatcagacggccggtcggatgagcgataatgtcaacgtgctgattcagcagcgcggtttcaagccgcttcatgatgacatgctgcggctgtgaaaagcttgaatggatggaagcaatgacaagatccatttccgccagcagctcgtcgtcataatccagtgttccgtcaggcaggatgtccatttccacgcctttaaaaatatgaaaatcggtaaattccttattcagttcatcaatttccttcgcctgcatgcgaaggcgctcaggcgtcaaaccgcctgcgacttttaaatattgggaatggtctgtgatcgccatatagcggtacccttttgccatgcatgcttccgccatttccctgatcgaaaaagcaccgtcgctccaagccgagtgcatgtgaaggtctccttgaatatcctcggcggaaacgagtccgatgtcaacgctgtagtcctcgacttctcttcctgtctcccgcagttcgggcggaataaacggaagcccgaaatgggcgaaaaactctttttcgcttgagaaagttttaatttctccagtttcaacggtttcgacgccgtattcactgattctttcgcctttttctttggcaagctggcgcattttgatattgtggtcttttgatccggtaaaatgatgaagcgtcgttgggaactgttcctctgtcaccagccggaaatccgcactgatttcgtattcaaacgcaaatgtgagagacactttcgtatctcctgcggcaatgacctccttgatgttcgaaagctttaagagcccttcccggacaagttccggatcagtgacagccataatgtaatcgaggtctttcaccgtttctttggcgcggcgcaggcttccggcccgtgaaaacttaatgaggcccgggagcccttcaagctgctcttcgatgatgtcagcgacggccaaagcgaccgcgatcgggtaccgttcagggcgttttcccgcttcacccaaagcctgcaggattttttcctccgtctttttgccgaatccggcaagcccctgaaccttttgctgttcgcaggcctcttttaaagatgccgcatcacagacgccgagctcctgatacagcttggcgatttttttgccgccgagacccggaagcttcaaaagcgggacaagtccttccggaacctcttcctttaatcgttccagcgttccggatgctcccgtgtccatatattccttgatgacagcgtatgtgcctttgccgatcccggacagggacgtcatatcatcgatttccgagaggctccggtcgtcttgttcaagagctgccgcagcctttctgaaagcggagattttaaacgggttgtccccttttagttccatatatatcgcaatcgtttcaagcaatttgatgatatcttttttatgcatgttgttcacctcttgtttcccctcgttcatcctgcttcaatcatacaaatttttggctgatcctacaacaaacaggcatatccgacagcttccggggttctcaagagccccgaaaaaaaacttccctacaaacagagaagtttttacaaagatccgtactgatgcagcagattgtttaacatgtttgataaaaacggtgttttatgaatgatcaaatcagccatgactgaaccggccatcatgttttgcaggacatcaatcggcagaagcgttccgatggacaggacgacaaacacggacagatagatttccgcaaaaccgagcacggctccgagtatttggttgatctgtttgagaaccggtatgcttgcgacggcatccaaaaacgatgcggcaactctcaaaaggataatcgtcaggataaagagaatcaaaaacgcaatcatattgtaataagcgccttcaaggcttccgtttacaaacgccagcgcagcctggccgcccgtaaagtcgggagacggaatccagccgagcttaggcgcaaggtcgccgtaataggttgcggccacagcgatcgctgcgataaacgtaaccaaacggataaactggcggataaaccctcttttgagtccaataaacaaaccggacaaaagcaaaatgataatgatgatatctaacatcgtgatgttcaatccttttcttttatttgtccttttaatctctcaagctcttccttaagcttcaaataatcgtgaaccacatttacagccgtcaaaacggccagtttatttatatcaagatacggatttttttcgttgatttctctcattttatcatccacaatcgaggcaacgtgcctcatatggctcttgctctcatcgccgacaattgtgaattgctgaccgtagatgtcaactgttgttctcgttttttgaccatcagacaacgtttctcctccattccaattatgcgagaatcctagtctatatcataacatgtttacagattgaatggaaagacgagccctccgctgttatgatacacttatgaaaacaatgatttagcgtatttaaagctaataaaggagattagaacgtgtcacattctgttttaaaagttcccccgtctgttattgaacggatgcaaagccactacgggcctgacattacttcactttccgtacagggcgcagttttccaagccaaaccccaagggtgcaccattacagcataccggtcggggaaggtgctgttccaaggaaaaaacgcggaaaaggaagcggagcgctggacggcggatgctgaaacaccggctcccaaaaagcccgcatcgaaaaaaagcatcccgtccgtctatcagccgcctgaaggcatcggttccatgtctgtgatcggctccgatgaagtcgggacaggcgattatttcggcccgatcaccgtcgcgtgcgtatacgctgacaaggcgaagcttccgctgttaaaagaactcggtgttaaagactcgaaaaacttaaaagatccgcaaatcgttcagatcgcgcgcgacttaatcaagacagtcccttacagcctgctcgttttaagaaacgaaaagtataatgaaatgcaggaaaaagggatgagccaaggaaaaatgaaagctcttctccacaaccaggcgatcggcaaccttctcaaaaaattggacggaacccggcctgaagcgattttaatcgaccagttcgccgaaccggccgtatacttcaagcatctggcaggcaaaaccgccgtcaaagaacgtacatatttcagcacaaaagcggaaggcatccatctttcagttgcagcagcctcgatcattgcacgctattcatttttaatggaaatggataagctgtcaaaacaagccggcattacgcttccgaaaggagcgggcccgctcgtcgatgaagccggcgccaagctgatcaagaaacacggcgaagacgcattgcgggtattcacaaagctgcattttgccaatacgcagaaggcgaagcggattgcgtcgaaacggtaagcggtgcggactaggctggataagcgggtccgttgcaactagacccgcatatttcactaaaacattaacaataaatgaaaaataaggattgaaaattcaaattaattgtagtatattgaacaaacttagaattgaagccccatatacaggggctttaattgttccaacagaggcaaagcgatatcaagcgctaggctgaattgcttcatgatattgtcttttaatatggcccatattcaattatctcaattttcagcttactgcacaccagatggcttttgaatgtgtactcctttgtttctggatacttctaagatataaggcggggatttggatgaagaaatcaggttcatttggcattcttttaattatttcagctctcataatatcaatgtattttatgttaaatacaaaggctttgatcttcaggatatgacttagccattcatggaatctcgtgatttcaagaactttaatgattgtgttcactttgtacttactttctaaattgggatattttcttctaaataaaaaagattagcttaatcgagctaatctttaatatatttgctacaccttttttcaagcaaactgaaattcagacaccctgctgaattttgaccggctgtgaaatgtttgaaccttctcttctttatatggcgaaatcattggacctctatggatgattattgcgaatatctccgcattccttctcatacaaatcgacagactcagaaaggaatcaccatgtcaaaaataaaatggatcatcacgctcaccatatgcacagctctggcattttctctctttattttcttcaacaaggcgaactttacagaggccagcgaaaataaagaaaccgggcttttctttgcccgaaactacatcagccatatgatggaaaacgagacgatgtcgtttaacattttcggcctgcaaaaagcaaacgccggcgttcctctaagcggtgagacggttacgtcgctcgcttttgataacaatcatatacaaatcagcgattacaaggttgaaacagggattcgccataaaggctatacgctcgtcaacatcatcgtagatgtccgagtctcaagcgataaaccggaaaaagcggatcagctgctgatatcttttaacggacgtgatagagaagcatttcaaatcggaaagatcacccttcaaaaccatcacaatgttcgaagcggcgatctgtcgcctgccggtcaatatactgcaggatatccaaaaccgtccttggacgttcggctgaaaaacaatctcgcaaaagatatttcccttgaaaagatcaccgatctaaacggcgtcatggcgtatacatttgacaaggggaccgccattcaagcgaaacaaagcaaacacatcgtcgtcccgtcttttcatatgacaggcgaatatgatttttatacggtcacccctgttttacgttatactgcagcagggaagcggaatcaatacagcatgcccggtgtactgtacggagctttagactccgatgaagagaaaatcgaacggatgctgaagcgtcaatagcttatgaccatgttgaagataaaaaaccggttcccgaatgatcggggaccggtttttctttatcctctcaatacagcctgatacgtatcctcaagtgccttcagcacttggtcgtgaacttttgtcacttcttccttggctaggattttaatatgcgggctataaatgcctttttccagaattcttgagaattgagtcatgaatttcgttctatacagaggagatatcgccccccctaacaagactatattaaactactaacattctatctaaacacagtatattcgatatattcaaccaataaaaataagaaaatgagattgtaattcctttctaaaaagaaacttttgatttatatatcaataaaaatagaatagataatccgttatatttactaaaataaccataagtgtaataatagccctacaagagacaaagggggtgaaaatatgacaatttctaaaaaacaacgcatcaacgcttctttagccttaggtctactttttacacttacatttttcacaatgttatacgcaacaacagcaccagttttaccgattgcagacctagcagcaacctatcctcagattccgggatgggctcttacttcaattagtgccatcttaaatgctgctggcactgttggagcaattgcagcggttctagggacttttggactcggagcgattgcatccctagttttttcctatgcaaaaaaatacggaattagatatgctatcgcttactaataagttttaatttaggaaagggtattatttaaaatgccctttcctccacatttaagtcaggatggttttcaatgaataataaatacttaatttattcaaaaattcttttaaccaacgacattcgaaaatttaatactaaaagcaaatggcttgcattattcgtattgatattgtcattcgttgttttccctttaataattggcagctttgctgggtacatcattaaaaatctagtcatcattcatctttctttttttctgtttatccttactgtaaatattgataaaagtattttcagagttatgttttcctccgacaaaaaacaaatggccattctgggaatcaaattggatcaatttatattaggaaaagatattagtaaattttatagttcatttttatctttaatatctttttatgttggttcatcgattgtatattatctcattcatcagtctttggaagaagtcttcgcgattgctgtgattggtttattgtccgctatactaggatatttgcttagacttcattttataaggctattagtattgcctaaattcataaatgtctcaagcattattggctttttcacaaatggaattttaattctttggatcttttttatactcaaatataatttgttatttctaaacatcaataatatgcgaattttttcaatatctataccaataatggtatctttaacaatcctgttaattatagtgtggtataaaagtttaagaaacctttccatttttaatgatcatttaaatagcaagactgatacaaatttgaagaagtctagagagagcagaagccttctatattacgagctgatccttctatataggaacccgcctgtaaggtggtcggttttattatttattttaagtttatcagcaggtttactaacaatcattttgtatggttttaacactgatcgatttgcagacactggaatttccaacgaattcagctttatgttcagcgtgctgttcccgttagtctttatctctatcatgattcaatcattggtttcttttgatattgatggtcttattatacctttgaatcagcacaagccaaactttattaaaaacaaaataaaagcaaaaaccaaaatctctgtcttagcacatgtgttatttgttttaatctatgctgcgatttcaaatttttatataaaaccggatcattttattgcattatccattatcttattgatgatagctgttactttggggttaagctgtctcacttcaactatattgtttccatattttaaatgggattacatttatcaagttcccagtactttaagcaaaatctttcttaatttagtatttggattactaatagggttagccattgtttcaacttacaacaaagttttgtatgttgttatttttatcactttgttatgtatcataacgctactgcactccataaacaagcaaatatggaaatcaacaatcaacaaaaattacatatcaataaaatctttattcgagtgagtgattatatgcttaaactgcaaaatatatcaaaagaatatcctcaatccaattttagcatgaagaatttagaattcgcttgcgggcgaaatcagattattggattgctcggtaaaaacggagcaggaaaaacgaccctattagaaattattgcaggcctcattcctccggatagcggtgaggtagtcgttgatggacatcttaccaattatttagagaaaatcggatacctagaagacgatccaaaattatttgagaatttaacgtgttatgaattaatcaagtaccaatctttattaattgaaaaaccattatcccaagaacaaatcattgaaaccttagacatgttcagtctaaaagaacaaaaagaccaaatggcatcttcgctatcaagaggaatgcgtcaaagaatgtcttttattctttccactttgcatcaacctgatgttatcttgcttgatgagccttttacaggacttgatccaaaaaacatggcggatatgaaaaagattttaattaatattagaaatcaaaatagaattattattttatccacgcatatcttacagtttgcagcagatctttgtgatgagatattatttattaataacggaaatattatccacactgaaaaaaaattagccggggagacatttaatgaagccagccttgaaaaaaaattccttgaatacctatgctaaatactctattttgttcattattatttttggtttcggtttttctcttagcttttttgtatttcaagaaatacacgagacttactatgatagctttaaaatatccaacgctttagagatttttacaaataacttaattgtaggactaactattttctttcttggattaatcagtgttggtttcctatctagtgtagtagtgtttttaaacggttatttctcaggggcaattttcttttcatatgagaagtctttaggtttttggaaatcactacaatatctcttatttcacggcccctttgaaatccttgcccttcttgctttttatgtaatatctcttgatatttcttcccgttttttaagatttctaaaaaagtctgaaataaacctaatgattaagccgaaagtaaaagagtacacaataataatgataagtgcagtaggccttctaatcttagcatctattgtcgaatactacgtaatattactaaaataaggagttcaatatgaagaagactaaattcaacttaatatgtatttgtctattatctggagctgcagccttatgtgtttccattttaaaaatgaatgagatcgatgctagcttacatgaattaaacgaagatgaatatggaaatcttattactatcagtaaatggattggcattacaatagcagtaattggcgaagcgataaaaccccttcttgagcttttatttttcactttaatcatttggctcgctattatgatttttggagcaaaggattcctttaaaaacattttttcaaaaggtgttctttcctactatttcaatcttgtaggcagtgtcttagttattgtcttttatctatttggcttaaaagatgctgaaagtcttttttctattccttttttaagaaatttaaacattttttctttaatttcgttatttttttggtgctatttatgtctagaaaagaaagaaaactcactaaaaattaaatactctttttcttttttcatattgtttttattttctattgccatatctattttctccgatattcttgcatagattaccttcgtatagactcattaaataacatatgagaattcgatacaacttaattcaaaatattttacataaatattcttgccatcctaaaataattaaaacttacaataggccgacaatttttccaatgcaaaaaaaccggttcccaaatgatcggggaccggtttttctttatcctctcaatacagcctgatatttatcttccagcgctttcagcacttggtcgtggacttttgtcacttcttcttctgtcaatgtctgttcaggattcaaatattgcaggctgaaggcgacggacttcttgccttcttccatgtgctcgccttcatagacgtcaaagacatggacttctttcagccatttgccgcctgctgttttgatgacgtcctcaagctggccggccgttgtttgtttgtctacaacaagcgcgatgtcccttgtaacagaaggatacttcggaattggtgtatacgtgatctccggtacatccaatcggaggagctcgtgcaggtccagttcaaacacatacgtgtcgctcaggtccagctctttttcaactgacggatgcagctggccgatgaagccgactaatgagccgttgtgcaaaatattggctgtccgcccaggatgaagctcttttctttcagattgagcgaattcgatgccttcggtgattccgagcttttccaacagaccttcgacgatgccttttacgacgaagaaatcaaccggctttttctcgccctgccagaggtttttgtgccacaggcctgtcacggctccggcgacgtgttctttttcgaccggtttcgtatgttcttcggctttcaagaaaacagaaccgatttcataaaaagcagctgaatcggcctgccttgccaagttgtatgcaaccgaatcgagcagattagggagcaggctgtgcctcagcacgcttctttcctcgctcatcggcagtgaaaggatcgttttaaacgatttttccaatgcgtaagccgtcgcttttttatcgtttgttaatgagtatgtgatcgcctgggaaagccctgctccttccaggaagcgtcttacttttctgcgcttgtcctgataaggtgtcagtccgcccgcaaagcctgttacttccggcagtgtcgacggaatgttgtcatatccgtacagtcttgcgacctcttcgatcaaatcttcttcaatcgcaatatcgcctcttcttgacggaaccgtcacgaccagttcacgttcagcgtcttcaactgcaaagccgagcctttcaaaaatgttgaccatttcttctttgctgatggacatgccgagaaccttcgtcactttatcaacggaaaggcggatgacattctctttgatgtcaagatggttttcttcgaccgtaccttccaagacggttcctccggcataccggctgatcaaatctgccgcgcgttctgcagcgaggcgcacccgtgcaggatcgatgcctttttcaaagcggacgcttgattcgctgcgaagaccgaggtcctttgatgctttgcgaacggtctggccgttgaaatacgccgcttccagcagcactgtcgcagtatcttcgcggacttctgattccgctccgcccattacgcctgcgacagcctgcggagaagagccgtttgtgatgacaaggtgctcagtggtcagcgttctttcttgttcgtcgagcgtcgttatcgtttcgttctcgtacgctttgcggatgacgacctcttttgagccgaagcggtcataatcaaacgcgtggagcggctggccgtattcgagcagcacaaagttcgtaacgtcgacgacattgttgtgcggtctgatgccggcgttgatcagcttcgtctgcatccaaagcggcgacgggccgattttgacgtctttaatgattttcgccgcgtataaaggattggcttcaggatcttcaattttgacggaaatatagtccgccgctttttcggcgcctgcctgataagccgtctcagggagcttgacttcgcggccgagaatcgcagccacttcataggcaacgccgagcatgttcatggcgtcggcgcggtttggcgtcagtcccagttcgagaaccgcatcgtcgagcgccaggctttgaagggcgtccgccccggtttcagcatcgcccgggaaaacgaagatgccttccgcatattctttcggcacaagcttgccttgaatgccaagctcctgcaaagagcatatcatgccgttagacgcttccccgcggagcttcgcctttttgattttaaaattgccgggcaataccgcgccaaccgtggcgacggcaactttttgccctttgtccacattcggagccccgcagatgatctggacaggctcttcttcgccgatatcgacgaggcatttgtttaatttgtcggcgttcggatgctgttcgcgctccagcacatgtccaatgacaacacctttaattccttctcccttatattcgatgccttccacttcaattccgcttcttgtaatcttttcagcgagaatctcgggagtcatcccgtctaaattcacgtattcttgcagccatttatatgaaacaaacatcacgcgtcctcctctttaagcttgtttaaattgagataaaaatctgacatcgttcgtatagaaatgacgaatgtcgtcaatgccgtacttcagcattgcgatccgttcaacgcccatcccaaaagcaaatccctgatattgtttggaatcgaatccggccatttcgagcacgttcggatgcaccattccggcgccgagaatttcgatccagcccgtttgtttacaaacggagcagcctttgcctccgcatttaaagcaggaaacatcgacttcgacagacggctctgtaaacgggaagaagcttggacgcagtctgatttcgcgctcttcgccgaacatctttttcgcgaccgtttccagggttccttttaagtcgctcatgctgatatcacggtcaacgcagagcccttcaatctgcataaactgatgggaatgtgtcgcatcatcgttgtcgcggcggtacactttgccggggcagatgattttgacagggcctttgcctttatgtttttccatcgtgcgcgtctgaacaggagatgtctgtgttctcatcagcgtatcttccgtaatataaaagctgtcttgcatatcccgggccgggtgctctttcggaaggttgagcgcttcgaagttataatagtcggtttccacttcaggcccctcttccaccgaatatcccatgctgataaacaagtcttcgatttcttcaataacgatcgtcagcggatgccgcgctcctgttttcacagggcttcccggaagcgtcacgtcaatcgtctgctctttcagcttccttttcacctcttcttcctcaaggcgggcatttttttcggcgatcgccgcggcgattttctctcttacttcgttcgccaaggcccccattttcggcctttcttcagcggacagctttcccattccccgaagcacttctgtgatcggtcccttttttcccagatacgcaacgcggacatcgttgacttcttttaatgaaccagcggcttccactttttcaaccgcttctttttcaagccgtttcagctcttcctgcatcttaaaaactcctccttttatgtagcaacctgttttttaggcaataaaaaaagccccttttataatgaaagggacgaatcgtggccgtggtaccacccttttttaaaacaaagcaaaaaagctttgctgcttacttcattggcataacggaataaatccggttcacctttacacatccctcgagggacgtggtcccggtgacaactcaagaggtgaagcgtttttccggcctgccataaaaatgcttgcagtctcaggcattttctccctgaatggcggcatgtgaaaaaacggagcctctatcactgtttttaaacatattaaattcattatagtgaattacatgatcctgtgcaaccggttatccgcggagatgataaagaaggaccgcggctgcggccgccacattgagcgactccgcttttccgtagatcggaacgtacagattttggtcggtctgtgcgaggagggccggatcgaccccagatccttcgtttccgatcaatagcgcaaacgactgcgacggctccgcttctctaaatggcacggcaccctgcagcgctgtgccgtaaaccgggacgctttttcccttcagctcttcaatcagctctgaaagctcgcgttttaaaatcgggatgtgaaaatgcgagccttgagccgacctgagcgttttggcattgtaagggtcgacagtcccttgtccgataacaacggcatcgatccccgccgcgtctgccgtccggatgatcgtccctaaattgcccgggtcctgcacagcatcagctagcagcagcttttcgtattgaaaaggtccgctttcgggcattcggcatacagcggcgaccgcctgaggcgtctccgtttcggcaatcgctgaaaaagcatcggcgctcaaaacatagcgggcaacagactcatcaatcatagccgggaagtccgcttcgtctgcgaccatgatttctttcacaacacccggtgtcttcagcgcttcctcaacgagatgctcgccttctattaagaaagtattcgtttttgtccgctctttttttgcatgaagttttttccagtccttcactttttgatttttggctgattcaattcgtttcaaatcgttttgactccttttgtctcgcaatagtcacattatatctcatcaatgatacataataaacccgaaagcgaggcagaatatagaaaaacagatgatgaaatggagtgaaaaatgatggatttgaatttgcgccatgccgttattgccaatgtatcagggaactcgcaagaagagcttgaacatacgatcgtcgatgcgatccaaagcggtgaagaaaaaatgcttccgggattgggtgtgttgttcgaggtcatctggcagcacgcaactgaatcagacaaaaccgaaatgctcgagacattggaacaaggattaaaagcgaaataaaccggcggccaaacggccccggtttatttgatcatccaggtatagaaggctccatccgcaatgccggatcgcgccaaatctccgtccattttttaatggctgcagccatgatcacaagtcccaacacaagcataatgatcgataaaatgccgtttaaaacgctgaaaccggcagcttccgcattaaaataaacgtttttgatcatccagtatcccgcatagttgaccgtcacatacaaataagcgagcggaatgagacatgtcagcatataacgccgtttgtccgcaatttttaaaatgaccgtcgctccgataattaaaccgacggatgccatcagctggttggatacgccaaacagcgcccaaatcgagctgatatcgcctgagtacagcaaatatccccacatgaaacaggcaagggcgctcgctgcgaccgaacccggaagccagtccgtttttttcagcggtttgtacacttccccgaaaaagtcttgaatcaaataacgcgccacccttgtaccggcatcgatcgccgttaaaataaagacagcttcaaacatgatgacaaattggaaaaagtaagaggccaaatggctgaaaaacggaatatccgtgaaaatataagccatgccgacggcaagggtaacagctccgcctgttcttccttcaagatcgagaccgatttcgcggctgagttcaggcagatggacgacattcatgccaagcgtccgaaagacttctggcgaactgttgatggcaaaataatcgcccggctgcaacgccgttgccgcgattaaagccatgatgccgacaagacactcaacgagcatcgctccgaagccgacgaatttcatgtcgctccacttgtcaagcatcttcggcgtcgtgcctgaaccgacaaacgcatggaaaccggaaatcgcaccgcaggcgatcgtaattgaaatgaacggccagaccggaccaggcgaaacaggtccccctccgcccgtgaactcggtaaacgccggaaacggaatcgccggattgacaacgaaaaccccggcaatcaaagcgataaacaccccgattttcataaagctgctcaaataatcgcgcggtgcgagcagcagccatacaggcagcgccgctgcaaaaaatgcatagacaggaagtgcgacagcaagcgttttcgtatcgagcgtcaaggcgtctccaagcggcgtctctgcaatggagggcccgatgaagacaccggccatcagcaaaataaatccgccggtagacgctaattttaagttgcctgtctttttataaaataagccgacccccatcgcgatcggaattgtaatcgcaacggcgaacgtcccccacggattgcgttcaagcgcatgaagcacaaccatcgacagccccgccatcgtgattgtaataataaacagcatcgcaagccccgtgcaaaatcccgcaacaggcccgagctcttctttcgccacttctgaaagcgactttcccttcctccgcatcgacgcaaataaaacaacaatatcatgcacggcgcccccgatgaccgctccgatcaggagccacaacagccccggcaagtagccgaactgcgccgccaagatcggcccgacaagcggccccgcggctgcgatggccgcaaagtggtggccgaaagacacccatttgttcgtcggcacataatctttgccgtctttctgaagatgggcaggagtcggcttgtcgtcatcaaccttcaacactttcaccatcataaatgttccgtacaaacgataggcgatcgccaaaatacagatggaagcgatcacaattgttattgcattcatccaattcctcccccctttgtctcttttttaacatagctcatattttttgtaagcgcaatcatcttttgcgcgttttttcagtcccgataattaaaacatagttgactaataggaataataagaataaaatagacacaagcttcatctgctgccttttttaaggcgtaattggcgggtatcatcggatatccgccttttttctgtcagcataacggaacgataaaaaaatgaacggccatcactagacaaaaagcggcggtccccgcgattcgattgacatttgttttgacaaggcgaagctgagaaatggtgggacagcgaaaaaaacaaaatggtgccgatcaagatgacgcccgcctctaaaagtgagtgattaagaaaccggggccggtcaaggatcgccgtgataaacagaagccaaaggtatgctaaaaatgcgtacatcaaaaaacagtacgcagccgaaaaaaacgtcttcataaatcctcctcccgttttaacttattcttcggcatatttgctgaagcctttttttcatctgaaaaaaccggcctcttcgggccggtttttcaatcattgtttcttcattctgatcacattccaggaaagcttcggaaggtgagccgtcagcctgccgtcacatactttggcgtctccgccgctgtgcggaacgacgttgttgcggtctttttcattcgtcgctttatgatcttcgtgttccagaacgatgtgctcagagacactgtacccttcaaagcttctcatatcggcttccatttcaaggccggcgtctgttgcgcggttgacggcaaaaacggttaattcctcggcttcttcattgaaaacagacacggactccaagtacggcacatccgtaaagtctttcgcatcatactttggagacgataccgccgtctgcagtaccgttcctctgccgtagacggaagcgtgcataaacggatagaaaatggtctgacgccatgcttctccccctttgtctgtcataatcggcgcgatgacattgacaagctgagccagacaggcgattttcacgcggtcggcatgcttgagcatcgtaatcagcatacagccgacgagaagcgcatcctcaaagttgtagatgtcttcaagaaggtgcggcgctttcgcccagcgttcagcttctttgtctttttcattcgagtgataccagacattccactcatcatatgaaaggtgaatcgttttcttgcttttctttttcgctttcatatagtcgcagactgagatgaccgttttgataaagtgatccatgtctagcgatctcgccaaatagtttggaagatcattgtcgcggttgccgtaatacgagtgaagcgagatgtactcgacgtgttcgtacgtatggtcaagcacggtcgtttcccagtcgatgaatgtcggcattccgcttcccgaacttccgcaggcgacaagctcgatcgacgggtccgtccatttcatcaccttcgcggcttcagcagcaagtcttccgtattcggccgctgttttatggccgatttgccatggaccgtccatttcattgccgaggcaccatgttttaattttatgcggttccttatatccgtgggattttctcaagtcgctgtagtacgatcctgacggatggttgcaatattctactaggttgcgtgcggcatcaattcctctcgttccgaggttgacggccatattcacctctgccccgacaagctttgcccaatccataaattcgttcgtaccgattaagttcggctcggttgtcgcccacgccaaatcaagtcttgtcggccgctgttcgacaggtccgactccatcctcccagttatatccagatacaaagtttccgccgggatacctgataaacggcacctttagttctctgactagtttaatgacatctttccgaaagcctgattcgtcagcttcaggatgatcaggctcataaatgccttcataaacggctctgccgagatgctcgataaaggagccgtaaattcgcttatcaatctctgccaccttatattccttgtcaatcgtcatcttcgctttgtgtacagtcatgttaaatcattcctttcaagatgatatatagtggatcagcctttgattccgcccgccgtcaaacctgatataaagtacttctggaagaacaggaagatgagaatcacgggcagaatcgccagcacagaacccgaaatcaacatgtcataattgttcccgtacggactgagcaaagcggacagtccgattgggagcgtaaacatttctttcgatcgcaaaacgatcagcggccataagaagttgttccagctgtttaaggattgaagaatgatcatcgctccaaatgccggcttcatcaagggcgccatgatcctgaagtaaatgccgaactctgtgcagccgtccattctcgcggaatcaagcaaatctctcggcaggccgagcgcatactgtctgaagaaaaacacggctacaggcgagacgataaacggcaggatcacaccggcgtatgtgtcgacaatatgaagagaaaccgtcattttaaacaaaggcagcatgagaatttcgatcggcaccatcatgatcaggagcacggctacgaacaagagattttttcctttaaagtcgtagacggcaagcccgtatccgaccattgaagaaaacaagagcgtcagcacggtggatatcaccacgagaatcaagctgttcgaaaaccattgaaaataaatgctgcctccgttaaacaagtaagtgtaattgtcaaggctcaggatttcagggctcagctttaaattcaggccgaagcgcagcaattccgaagatggcttgagcgagccgagtacaaggcagaagagcggaaacacaaacaaaaagcttaatatcgcaaacagcagaaacagagctactttcgcaatgttgaggcctccggcaggacgcattaatagccctcctttttaaaagatccagacagctttaatgaaatgaggctgcagatgaaaatgatgatcaagagcacgatgccgagcgccgatccgtagcccatgttgttgtaggcaagcccctgctgataaatgtatccgaccatcgtcaggccgatgttgcccggagagttgttctgccacagcacgtagctttcttcaaacatccggaagccgccgatgatgctgatcgtcagcacgtagacgctgacgggctttaaaaacggaagcgtaatatggtaaaacttcttgaacgtgcctgccccgtcgatttcggcagcttcatacaattctttcggaacgttctgcaagcccgccaaaaagtacaggacattgatccccatccatctccaagatgcgagcatcaccattaaaaacatgccggtatgttcattgttcagccagttgtacggcgaacctccgagcttagccaatatcgaattcgccagggatgtatccatttctccaaaaatcagcctgaaaataatccccgccacaatggttgaagtcagagccgggatgaataaagccgatttgaacacgtttttaaactttacgagtttagaatctaaaaagactgccagaataagaggaacaggtattaaaatcagcaatgtccaaaaggtgtattttacggtgttgaatagtgcggtataaaatgtaggattgtttaatgctttatagttctccgtcccgatgaagcggacttccccggggagaatgctttgaaaactcatgatgacgacgctgataagcggataaagaaaaaatatgcaaaaggagagtacaaaaggtgctgtaaaaatgtagggtgcggcttttgctgaatataataaacgtctgatctttctttttctgctcaccggcggaaacgaatgcactgtatctgttttaacagtcttcaagttatcgcctcgctttacagtaatgaaagactattgccctttcacttcagctgctgctttgtccaatgcttctttcggtgttttgctcttcgttttgagcgcttcgtacagtatgtttctgttgacgagatcggaagtcttcgcataatcctcagtaaggtaaagcggattgatctcatcctttatgtcaagaagcacggaaaagatgtgttgtccgttttgaaagtattctgtatattgatttggttttttcaattcgtccgagtcccacacatcccatctgagcggatcgaacccgagcacggtccacagcttgatgttgccttcttttgacgctttggcaaatttcaagaaatccttggccagatcgacctgtttcgcctgttttggaatcacggtggccgttccgcccattcccgctgagcggtctcccccttcttcccatgccggcagcggtctgatcgcgattttccctttcaagtcaggcatataatccaaaaaacggcccatataccagatcggcattaagacagacgccgcgccgccttggttcataaatccgtaatactcttcactgtgatgattgcctccgggcgttgtgacggcaattttgtctttctcaattaaagtctttaaaaattcgagcgttttcacgtttgtctcattgtttaatgtcaaccgcccctgctcatcaaagtaaccggatccctgctgggaaaccagcggcagaaatgaattcgggtcggtcgtttcaatcgtcgtcatcggctttccgagagctttgacgacctttttgcccgcttccctgtaatcttcccatgttttgatgtcgtccggatcaacgcctgctttattcatcatttccatgttgtaatacatcacggtagttccgacatgtgtgtcaagtccgtaaagcttgccgttcttgctgtagagcgtcagcctcgcttcaacaaacttgtcgcgttcgtcctccacaagcggcgttaaatcggtaagaggaatgtcagagcccttcaaaaagttcgaatagcgccccagctcaacatcggcaatatctggaacccctttcccggctaaaagcgagatagataaattgtcatgcatctgtccatacggatacaccactgtatttaatttgatttttcgctcgggatactttttgttccattctttcaccatctcagcataaaactgttcatgaaggccgttgaatgtccaaaatgtcagttcggtgccgtccgcttgatcggaggcaggactcgccttgcaccccgataaaagcaaacatacagcgaccgtgaccataaagatagatgaaaggaaccttttcacattttaacccctttcacgcctggtcctttgcctaaaagccccggcaaaaggccgtattgattgatgattttcagtcccgtataccggtctctgagctgatgggcgtatgcgagcgcttctctcaccagctcttcttcaacatcgagttctttgaatgatacaggcccgccgatacgcctcatccactctgccattttcttaccgtcagggagcttttcataaacggagcgaatcgcttgctcagcgtgttgatcacccaggcttgcaccgataagagatcggtaaatgtcagtcagcataatcgcgctgcagccgactttagcaccgtggagcacttgccgcttattgttctccagcgctttcatttcaaggtagtgggaaagatggtgctcgccgccggaagccggccttgaatggtcgagaaccagcatgactaggccagaaaggatcagcgattccatcaatttctcaatcccatcccgcatcttggcggcgatgtcatcttttcggtcaagacattgatcaagcgcttccctcgtgagccggctggcggccggacaatacggctcgccggcaagcaagcgggaaatctcccaatccgcaagcgacgtcaccttgccgagcatatcgccaaaacctgcggctaccatgttctgcggcgcttgacacaagagctccaaatcggcaaaaagcgcgatcggcgctgtcgtttgaaccgtctgtttctttccttttaaaatcagcggtgcgccggctgaagtaaaaccgtcaaccgacggagccgtaggaactgaaataaacggaatgccgcgctgataggcgcaaaacctgacgatgtcgtgaatcgtgcccgctccggccgcaattagtacatccgcatcaatcggtacaccgatcaatgcactcaccaatgtttgctcatccgccgtcacatcgcccgcttcattagcttccagcagcaccggaaccgtttcagccgtttcctcaagaagagaggcaatccgcttgccggctaaccgtccggttgtttcatcataaatgacagcggcttttttataggaagccgatttcacgaaagcgggcagctcttgctcaacagcattgtcgccgatcgcgattttttcgactgtaagcgggtggtggacggttccgcattcgcatgcgcccaaagtttttttcacataagagatcaagtcattcattggcagcttccctcctctattggccgtaataggcgtctgccccgtgctttcgaaaataatgcttatcctgcaaagcgctcttaatccgcttaagagacggattcagcatcagggagcggtacgccatcttggcgacttcttccaggacgacggcattgtgtacggcagttaaggcgtcttttccccagcaaaacggcccgtgattgttcacgagaacggcgggcaccgccagggggtcaagatgccggaacgtctctacaatcacttttcctgtattcagctcgtattgactcctgatttcatcgggatccatttcccgtgtacacggaatgtcgccgtggtagtagtcggcatgagtcgttccgagcgacggaatgtccttccctgactgagcccagcttgtcgcccacggggaatgcgtatggacgatcccgccgatcgattgaaactgccggtaaagatagaggtgtgtcggcgtatcggaagatggcttcagatccccttccacaatctcgccgtccatattcagaaccactaaatcttcggctttcaaatcgctgtatttgacaccgctcggcttgatgacgaccagcttattctcccggtcaataccgctgacatttccccatgtaaaggtgacaagccggtattcttcaagctgcaaattcgcttttaatacttgttctttcaaagattccagcacagttttctcctccctctaagccatcgctttaccggtgtcagaactaagggactggatgtttttcaattttttaaggcgtttcatcacattgttttgctttccgaagtacgtgtaaagctccttatattccgcataaagctgatcgtataaggaaacgttttcaggaattggtttgtacgttttatccttgatcttgcccatatgtgcgactgcttcttcgatatggtcgtaaccgccgttcatgcttccggccgcgagcgctccgaatatcgctgaacctaaagccggcgcctgcggagatccggaaattttgatttccatgttggtgacatccgcgtaaacctgcatgataaacggatttttttcggcgattcctcctgcggcatacagctcctcgatcggcacgccgctttgtctgaacgtttcaataatgatcctcgtcccgtaggcagtcgcttcaaccaatgcacggtatatctcttcaggcttagtggcaagggtcataccgagcagcattcccgtcagatcggcatcaacgagtgttgaacggtttccgttccaccaatccaatgcaagcaaaccgctttcaccgatttggagactgccggccttttgagacagcagttcgtaaatggaaatcccttcggcttcagcttctttcaaatacgcttctggaacaaagtgttgaatcagccaatgaaaatggtcgccaacgcacgattggcccgcttcatagccgacatagcccggcagaatcccgtcttcaacgacgccgcacattcccggcaccatcctgacatcctcgccgagcagcatatgacaggtagacgttcccatgatcatcagcatcttgcccggctctgtgatgccgaccgccggaaccgacacatgagcatcaacatttgcgacagcgaccgccgtacctgccagaagccctgttttcccggccatttcttcagtcagtccgcccgctttttcgcctacagaataaatatcctccgttagtttttcccgaacgatatttttcagcttcggatgcaggcttgcgaagaaatcgtcggaaggatagccgctcttattgttccaaatcgctttataacccgctgtgcaattgttgcgctttctggttccgcacagcatatagacgatccagtcggccgcttccatgatctcggctgcggcatcataaatgtcaggcgcttcttccgcgatttgcatcacttttggaacgagccactcggaagaaattttcccgccgtatgtttgaagaaaaggttcatttctttcttccgcgatttgatttaagcgattcgcctgctcctgtgcagcatggtgcttccaaagcttcacatagctgtgcggttccgacgcatactcttccctcatacaaagaggagtcccgttctcgtcaacgggcaaaatcgtgcaagccgtgaaatcgattccgattccgatgatttctttcggatccgcttttgactgtttcaaaaggctcggaatcgtttcctccagcacttcaatgtaatcggccggatgctggagcgcccagtctctcggaagctttcgctttgagaccggaagctcccggtctatcaccccgtgcgtgtactctttgacagctgtcgcgatttcctcacctgtccggacatcgacgagaactgcacgccctgacaatgttccaaagtcaactccgattgtgtaagggataagtcctcacccccttaaaacttgcgaagccgatatgcagcttcactccatttgagttcattgcgaagatttaaaatcgttgtatcacgattgatcaacaccgcttcaatgcccgacatttcggcccaatcgagcatctgctcggctgtcagctggtacgaaaggcatgtatggtgagcaccgccagccaaaatccacgcttcagccgatgttctcagagacggctgaggcttccaaagtacgcgcgccaccggaagattcggcatatcatgcggaaccttcacagcttccactttattgatgacaagcctgaaacgtccgcccaaatcaataagggagacattgaccgcaggacctgcaattccgtcaaacacgagccgcgccggatcatcctttgcacccattgacagcggatggacttcaattctcggtttgtgttcggcaatcgaagggcacacttcaagcatgtgggagccgaggatcatttcattgcccggttcaaaatggtacgtgtaatcctccataaatgacgtttcttttccgccggccatcattttcatcatcctgacaagcgcagccgttttccaatctccttctcctccaaagccatagccttcagccatcagccgctgaacagccaaacccggaagctgcttcatgccgtggaggtcttcaaaggttgtcgtaaaggccgtatagcctccgctcgaaagaaagcgctttaatccaagctcaatccgcgcctgctccttgacggattcccttgccgcttcgccttccggccactcataaagctcctcatattcggagatgagctcgcttagactctgttctgatacagcattgatctccgtgacgagatcgccgattccatatccgtcgacagaccagccaagctgaatctgcgcttcaatcttatctccttctgttaccgccacattccgcatgttgtccccaaatcgggcgactttgatatggcggctttcaatatatgcgaccgctgcgctcatccatttgtcgatcgagcgctttacttctctgtcttcccaatatccggcgattacttttcgaggaatgcccaatctcgctccgataaaaccgtattcgcggtcgccgtgggcagactgattaatattcatgaaatccatgtcgattttatcccacggaatgtcccggttaaactgggtatgaaaatggagcagcggcttattcagctcggaaaggccgggaatccacattttggccggtgaaaacgtatgcatccaggtgatgatgcctgcgcactcttcgtcccggttcgcctcttcaaacagttttctgacgccgtccagcgaagtggccaccgctttgtactcgacttgaaaccttaaatctccgtcatttaatccgttgcagatcattttggaatgctcttctacctcttgtaccgcctcttcgccatataaatgctggctgcctgtcacaaaccaaaacacatgcgtctttgcctgaatcaaatagcttcctcctcctcgtctttatggtgtctgtgtagaatagcaaactattaaaacgcttacaaaaaaacataaatcataccttgatctcaaactgtatcgcgattatatgtacgtacaactaacatcaaaaacatatttgtacgaacaacttcattatatcattatgaaaaaaactgtcaatttaatttccggtatgttttttattttttttgacagatttcagaacaaaaaaaccgggcggaaaccgcccgtcatctgctgttaataagtcggccacccttgggaatcccagtacaagtcattgatgagcagctttgatacaccattgtccagcgcgtcgtaagcatgcctgacaaggatcgagttgttcagaacatcctgatgtcccggccctttccagcggtcattgccggagtccaggatcgtccctccgccgttcatcatatttttgccgcttttatcataatagggtcccgtaatgctcgttgaacggccataggctattttatatgtgctgtccacccctttgcagcagctgtcaaacgagacaaataagtaatagtagccgtctttgtaggtaatgttcggggcttcaaccgctcctccgttattcggccttgaggcgatcgaatacaggcttcccgtcggtttcatcgtgtttttatcaagccttgtcagcttaatgccgctccagaaggaaccgaatgagagccaggggtttccgtctttgtcaatgaccagatcagggtcaatggcattaaactgatcgccggatgtcgacctgatgaccagcccgtcatcccgccattggccggatgaaatccggtctgtcgatgcgagccctatcgctgatgtgtttgaaccgaaagacgaaaccgagtagtacagccaataccggccgttatagtagctgatatccggtgcccattgatgcggttcatgatttggtacgtacatcttccaccatgacaatggagttggaaaaatactcggggcagcactccagtttctcccgtctgttgacttaatgacacgcagccctgtgccgagccctgttccaaatgtataccatgtatttccctctttaatgatagaagggtcatggatgaaattgtccccttttgtgtcccaaaacgccgctttgcctgattcaggcatcgaaaaagacagcagcagtccgaatatcaaggccgccaaagacattttccgcaacacatttttcattcagctcacactcctgttcttgtaatgaaaaaaacaatgcctccctttctttgtcaatttttcgaacaatgtttatatatgtaagcgctgtctttaacattccaaaaaacaaaaaaagctgacagcttgtaagataagctgtcagcctgctctttcatcagtcaaacgtaatgttttgaaccgtctctttatccagtcgtttaatgacttcggtaattaattttaccgcatgttcatagtcatcccggtgaagcatggccgcgtgcgtatggatatacctcgtcgcgatcgtgatcgacagggcaggcactccgttcgcggtaaggtggattgatcctgaatctgttcctccgcctgagagggcgtcaaattgatacggaatgccggcttcatctgccacattcgttacaaagtcgcgaagccctttatgggacaccattgatgcatcataaagtatgatctgcgggccttttcccattttgcttgccgactctttttcggtaataccaggcgtatcacccgcaattcccacgtcgacaccgaaagcgatatcaggcttgatcgtatgcgcggctgttttcgcgcctctcagccctacttcctcttgtacggttccgacgccgtagacgacattcggatgatcggctcctttcaggtttttcagcacgtcgattgcgatcgcgcagccgatacggttgtcccatgctttggcaagcagcattttttcattattcatcaccgtaaattcaaagtaagggacgacctggtctcccggaagaacgccccattccatcgcttcctccctgctcgacgccccgatgtcgataaacatatctttaatatcgaccgatttttttctcgcctcctgagacaggacatgaggaggctttgaaccgatgataccggtgatgtcgcctttctttgtcacgaccgtcacacgctgcgccagcatgacctggctccaccagcctccgaccgtctgaaagcggagatagcccctgtcatcgatccgcgtaaccataaaaccgacctcatcaagatggccggcaatcataatcttcggtccgtcagcctgtccagtcttttttgcgattaagcttcccagtctgtctgtcgtaacctcgtcggcaaacggttctatgtacgatttcatgacttgtctgggttctttttcattcgccggaattccttttgcatcagttaattcctttagcatcatcaatgtttcatcaagctttgccatctctatacagcctccttaattaaccctcatttactattatacagaaacatcccttttcaatacgaccaatatcgtttacagcttttttggttaaaaaatgaaaccttgcgggaactggttcgtatatattgggatatactcaaaattactttcaagggaggttctgttttaacatgattgtcatcatattgagactggctttgctggcgcttttggtctacgtcgtgtacagggccgttcaatttttggggagcccggacagaaggctgaaatcagcacaggcaaaaaagcacttttatgttttggacgaacaaaagaatacacgcaaaaatctcaagctgacatttaaaggcgtgcttttcgaaggagaaaaacacattccttcaaaagaccatccgctgttcatccatacgatttttgtatggacggaagcgcctgaagaaaagctcagctcttttacggaagaagacttcgcggaacttgaagaaaatattaaagagcactatcccgattgcaaaatcgactgggattcgaacatccaaaagtggaaaaacaaaaaagcagaagagcaataaagcctcgtctgcttttttaattcatcatataaaagccggtcaaaacagcttgcacgccgagcaaaaaaggaatgccgagcctgaaggaaaggtgttttgtcttatgtctgaaccgcatcatcccgaaccagacgcctgcggagccaaaagcagccgcaacgagccagatgcggcgctcagacaccctccatttgcctctgaccgctttttgcttatcggctttcattaagaaaaaaccgtatccgtttatgaggatcatgtatatccatatgagagtcaattgttcatttccccttgtttttcggtttgggcgcctgctgcggccggcctccccgaatcgttttacatcctgctcgaagaacaaaagaaaaaggccggagcccggccttttttcaattatttattcaattgcgctttagcagcgtctgcaagctgattgaatgcgttcagatcgtttacagcaaggtcagcaagcattttgcggtttacttcgataccggaaagcttaagaccgtgcattaaacggctgtaagaaagaccgttcatgcgcgctgcagcattgatacgagtgatccaaagtttgcggaaatcgcgctttttctgacgacggtcgcggaaagcgtagtttcctgatttcataacctgctggttagctactttatataatgtatgttttgaaccaaaataaccttttgctaatttgagaacctttttacgacgtttgcgtgtaacagttccgccttttactcttggcattagatttccctcctaattataccttttccgaaattacttaatgttggcaagctgctgcttgatgcgtttgaaatcgccggcgcttacgactgcgcttttgcgaagcttgcgcttttgtttttgagatttatttgcgaacaagtgacttgtatatgcatgagaacgtttcagtttcccggaacctgtctttttaaaacgtttcgcagatccgcggtgagttttcatttttggcatggatgtttcctccttaattacttttcagttttaggcgcgagcaccaggaacatgctgcggccgtccattttcggcttcgtttcaacagtcgccacttccgcgcaggcttctgaaaaacggtccagcacgcgctgcccgatttctttatgcgtgatcgcacggcctttaaagcggatggacgctttcactttgtcccctttttgcaggaacttgatggcgttgcgaagctttgtattgaagtcgtgttcttcaataccagggctcagccgaacttcttttaagttaatgattttttgatttttgcgtgcttccttttccttcttctgctgctcgaatctgtactttccatagtccatgatccggcagacaggcggttttgcattcgctgcaaccaacacaaggtcaagatttgcgcgacccgcaatttccagtgcttcctggcgggatttgatcccaagctgatcgccattttgtccgatcaaacgaacttcacgcgcacggataccctcattaaccaattgatctttgctaataatgagccacctccatagaatctttgaattgatttcacaactcattttgaccgtttctttgcattccacaggcaaacaaaaagtgcgggcatcgaaacacccacactgcgaacattgcatagaaaaataagaaatgtacgtttaacctgccaactacaagaatgtgtcaatcaggtgagaagcgggtgcttctgcttgttgatatatattcaattcattatccatcttacataaacaaatcctgcaagtcaagatataaaatttatcacaacatttgctattatatcaggacacatttcaaatagcaatgctatttttttatttttctttcagccgctctatccgccgatcatttgaacacataacggaacgacaaacacggtcacgacgccgacgacgacaactgcaatactcgccattgccgcttcgacttcccccatctcaattccgacggcgacgccgagggcatgtcctgatgttccgagcgccaaccctttggcgatcggatgctgcactttgaagattttcaaaaaaagcgcgccgagcgcatagacgatcactgcgttaaagatgacggcgaaggccgtaatatcttgaatcccgccgatcccttttgataaaggaagagcaatcgccgttgtggcggcctggggcagcatgcttttcatgacggctccgtcaagatggagcgcgtttgcgatcagatagacgacggcaaccgagcagacggagcctgcaataatggcaccaaggatttgcagccaatactttttcaacttgtccgcctgtttatataaaggaatggcgaacgcaattgtggcgggctccaaaaagaacttaatgatgtctccgccgctcttgtagtcctcatatgaaaaaccgccgatttttaaaaacgcgatcccaagaatcatcgcgacaaacagaggcgtgaataagaaaaaaccatttgattttttaaataaaaaagtgccggtgccaaatgcggccagtgaaacgacgataccgaaataaggtgtcatagcgtaaagaacctcctattgattcaagatgctgtttttttggctggttcaactcgtgtgtcttgacggtcctttttgccgacagacagaatgaactgtgaaaacaatcctgtcgctgcaagcagaatgacggtggccaggaaaatcacgaggacgatcggcaatccgtatttctccatgacgccgagcgaattcatcactgatattcccgacggaacgaacaaaaagccgatcagcgaagtgagcgccgtgccgagcgattcaacttgttcaagcttcagcactttcgtacacagcaatgcaaacaacagcaccaaaccgatgacagatggaggaatcgggatgggcagaaccgcggcgattccgtttgaaataaacatcataacagcaaaaataaatgcctgagttaaaaagccgtattcttttttacccttcatttcgttcacctctttggctgtgttgggttcattatataaaaagagcctccccaaaaaagcgttttcaaaataacttgccggatacggcccctcaattgcagaaatgggaagctgaaatgcaaatcactcttccggctttgcaaattcttcacaattatttaaattccagaatgtgctaatgaagctaagctgatcgtatagtggttaatgagaaattgatgaggaggccctgacccatggaccattcaagaggaggccgctttgttccgtctggcgaatttgcatctttggcaaggcgcggcttgatgcctgaagacgcttcaatcgccgcaggcgcgccccgatttgcagattatccattcaagcttggagtggcttcaggagacccgcatcccaacgggtttgtcatctggacgaggcttgcccccgatccgcttgccgaagacggattagggggaatgcctgacaaagctgtccctgttcagtgggaagtagctgaagatgaacattttcacaaagtggtgaagcgcgggacgtcctctgcgctcgctgagcttgcccactccgttcatgttgaagtgcacggtttaaagccgggaagctattattggtacaggtttaaagcgggcagggaaatcagccggacaggccgtacaaaaaccgcgcctgccccgcacgccgacatcaaggggatgtcgttcgccctcgcctcgtgccaagcttggtaccacgggtattttacggcttaccggcatatggccgaagaccatccggacgttgtttttttcctcggagactatatttacgaatatgccattaatgctaaaaatcttttccgcgatgtgactttatccgctgcccacaacgcaaaaaccgtcaccctcagccaatacagactcagatattctctttttaagacagatccggaccttcaggccattcatgcgctggctccctgggttgtgacgatggatgaccatgaggttgaaaacaattatgccggcatccattcgcaatacaacacttttccggacgattttctccggcagcgcgcagcggcgtatcaagctttctatgaaaatatcccgatccgcagcacatcgattccaaaggggcctgacatgctgatgtacaggcggttccgctatggaaacctggctgaattcaatgttttggacacccggcagtaccgcaataattttccggcaaatgaggctgaacggcttgagccatcccgctccatactcggatttgaccaggagcgctggctttttcacggcttgagccggtctgacacgatttggaactttttagtccagcaagtcgtgctggctcaaatcgaccgcgacacaggtcctggagttgagtacagcacagaccagtgggacggctttcccgcttgccgcgacaggcttttttccgcatacaaggcatacggcatccaaaaccccgttgtactgacaggggatatccacagacatgccgccgccgacttaaaagcggacttcgatgatgcggggtcagcgacaatcggaaccgagctgatcacaacttcgatatcttcggacgctgacggcagcgagaccgattctttggcgccgatctggctcggaaacccgcatgtcaaactgtacaatgcacagcgcggctatgttcgctgccgcttgacgccccggcagctcgaagccgactttcaggttcttccttatatcacacgtcccggcgctccagcctcaacttatgccaagttcgccgttgaagcaggacgccccgggctccagcgcatgttttagctaaaaaacggcggtgaaagacgaattaagcccttcaccgccgctgatcattttttcacaccatatgcagccgttttttcagctctttcgcgtatgtacggctgacagggatcgtggagccgtctttcatcaggaggttgtatgtcgaattgaaccagggtttgacctgtttaatatgatccatatttgcgagaaaacttctgtgcaccctgatcaatgccgtctgcgaaagcttttgttcgagtacaaccaatgtatcgtgaaccgtgtatgcctgatcaaaagtcttcactgtgacgtgtccgccttctaacccggcgtatacgatttcatcgggatcgagcacgacgatcgattcgtcaatgctgagagccagcctgtggtggcctgcaagctgccgctcctcctgtttgccggggcgcatccttttatatttgtggattgtctgtctgattcgctcctcatcaaacggctttgtcaaataatcaatcgcatccacttcaaatgctttcagcgcatattcatcataagcggtcgcaaaaacgacagccggaggcgccgacatttttttcagccgctgcgcaatgtcaaaaccgttctcccctgacagatcgatgtccaggaagaggatatcgggtttgcgatccgccattttgtcaaacgcttcttcgatatgttcagcttcgtcaatcgcatccacttcttcagtctgctctagtaaatatctcagctcgtcccgcgcaaacatttcatcatccacgattaataccttgagcatctctgttcccctctctttcggtttgaaaaggaatcttgaaggatatctctgttcctttatcaagttcgctggcaatctgcagagcagcctggtgcccgaacaaaccggtgagccgctggttcacattgtaaagcgccgtcccatttccttcctttgaaggggcgggcgcctgccccagctgtccaagcatctccggattaattcccctgccgttgtctgacaccttcatcaaaacgccgtcccgctctctcacagcggatacttttaccgtgcataccttttgttttctcggaaatgcatggcgaagcgcattttcaacgagcagctgcaagataaaaggagggatttccatattttcaaggccgtcctcgatatgaaaatcaatatgatacttgcccggaaatcgggcctgctccaatgataaataggcttccagatggttcagctcttttgaaagcggaatcatcagctgcctggctccctgcagattggaacgaaaataaacgctcagctgcaagagaagttttcgcgttttttccggatctgtcctgcacagagcagaaatcgtatggatggcattaaataaaaagtgcggattgacctgcgcttgaagcgccttgatttcggcatctttcaaaagcttgctttgcagctcagcctcaccgagttctagctgagtggaaaaaagcatggcaagcccttcggccagctcttccgtcacacggttaagaccggacgggtgcttgaagtacagcttcagcgtgccgattgtttcgcggttggagaagagcggcagtacgatcgccgcctgcagcggacaggaacggtgcgcacactcgatttcatcgcgcgacttcactttcatgacctttccggtttgaatgacttttttcgataaaccggtgatcagatttttcgaaggaatatgatgatctgctccatctccgacatgagcgagaatgttctctctatccgtaatcgatacggcatccgtccctgtcatgcggtgtataatgagagcggcgcttttgcaggaatcctcattcagtccccggcggaaaaaaggaagcgtctgatccgctatcgaaaataccttatgggtctgaacggcccgcgcctgttcctctttgcggataatagactgaatgatcgatagaaaaataaagctgcccgtcccgttgacaatcatcattggaatgccgatcatctgaacaagcgcaagtgcctcagcctgcggttttgcaagcacgagaatcataagcatctgcaggccctccatacaaatgcccgcaagagcggctacccgcggtgtcaccatctggtgccgattcctgaaaaagctgccgatataacccgcaatgacacctgccagcagtgaagaaaccgcgcagctcaaagccgtcgtccctcccagtgaaaaacggtgaatgcctgagagcagtccgacacccgctccgacaaacggccctccgatcaagccgccgatttcgacgccgagaattctcgtattggcaatcgagcttgacgggtcgattgcgaaaatccagtcattgttcaaaatctcgcgctcccggatttcaatgcctgtatagttgctgatgatgctgaacaaggaaaaaataaagatgagaactcccttgcccttatacccttccggatgctgtaggtgctgacggaacaccttcatatgggccaacataaagcccagaatgacgatgatccccactctctccagcatcataatcatgagttggaccatgtacttccccttgctttctttctgaatcggaatctgctcttattctatcatacctctctttattcactctttgagacggcatggctttaaaaccttttaacggccaaaaccgcttcatgagcaaaataaaaaaggcagcaattgtctgccgccgtttacttatttgctgcttcccactttgaaattaacaatcagccacacaacttgaatgatgaatggaaatataaatgcaattaacaaaacgataaatgctattaatttaagttcaggtgtttgagcaacaccagcgccatcaacatctctcagccaaacaacagctgctccgattacaaaaacggccgtccacaatatgttgcaaatccaccaaaatacccagcgttttttcacaataccattccttccatctcctcaactataaaacgattcttcctcccgcgcatgggccagcatcaccatcatcaaatagatcttagaaacgttttccaaacaatagatttcgtttcattttatcatattcaagaagctttcacactttgatactgcattacatcacattcttaaatcatttctttcacatccctttgatctattgtaaaataaatgagagaattctataaattaatggcagaggagaagatgatgaaagccgtattttttgatttagacgatacattgctctgggatgaaaaaagcgtcagcacagcattttccaaaacgtgccttaaagctgaagaaaaatacggaatccatgcggaagaatttgaagcagccgtgcgcgaagcagcgcgaaagctttacatgtcttatgaaacatatccatacaccgtcatgatcggcatcaacccatttgaaggactgtggtcaaacttcagcgagccgatcagcgaagggtttcaaaaactgaacaaaattgttcccgaatacagaagaaacgcatggacaaacggattgaaggcgtttggcatcgacgatcccgccttcggggaagaactcggcgaatattttgcggcagtgcgccgaaagagcccttttgtttatgaagaaacatttgccgttttagatgagctgaaaggaaaagtagagcttcttttgctgacaaacggcgatccgagcctgcagaaagaaaagttggcaggcgtaccggaacttgctccttattttaatgaaatcgtgatttccggtgaatttggaaaaggaaagcctgatccaagcatatttgaacactgcctcaccctcctcggcatgacaaaagatgatgccgtgatggtcggagacaacttgaacaccgacattctcggggcttccagagcaggcatccaaaccgtctgggtcaaccgcaaaggcaaaaagaatgaaactgatgttgcacctgatcacgaaatcagccatttaagcgaactgttcgatatcctccgcggacaagcagcggacaagctaagcaaaaaagcatgactcccgggcgggaatcatgcttttttcttgtttatttctttgcttcagcaacggcttttttgataaagtctgcaattgcaaccgtttctgatttttgctctccgtatttgcggacgttgacggcttcgttttcaacttcctggtcgccgacgacaagcatgtaagggattttttgcatctgcgcttcacggattttatagccgattttctcgtcgcgggtatcgacttcaacgcgaagcccttcacgctgcaggcgctcttgaacttttttggcgtagtcaagatgcacagacggcgatacagggatgacctggaactgaacaggggcaagccatgtcggcaatgcgcctttatgctcctcaattaagaaagcgacaaagcgttccattgtcgatacgacacctctgtgaatgacgaccggacgatgaggttttccgtcttccccgacatatgtcagatcgaatttttcaggaagaaggaagtccagctgaacagttgacagagtttcctctttgccgattgctgttttgacctgaacgtcaagcttcggtccgtagaaggccgcttccccttcagcttcgtaataatcatggccgatctcgtccatcgcctccttcagcatcgattgcgctttgttccacatttcatcgtcatcgtagtatttctctgtatcttcagggtcgcggtaagacaagcggaatgaatactcttccagtccgaagtcttcgtatacatcctgaatcaggcggacagttcgaatgaactcgtctttgatttgatctggacggacgaaaatgtgggcgtcattcagcgtcattccgcggacgcgctgcagccctgaaagagcccctgacatttcatagcggtgcatcgttccgagctcggcgatccggatcggaagctcacggtagctgtgaatgtcgtttttataaatcatcatatggtgcggacagttcatcggacgaagcacaagtgtttcattgtccatctccatcggcgggaacatgccgtcttgataatgatcccagtggcctgatgtttcatacaggtctttgctgccgaggacaggggtgtacacgtgctcatagccgagcgcgagctctttgtcaacgatatagcgctcgatgacgcgtctgatggtcgcaccctttggcagccaaagcggcagaccctggccgactttttgcgaattggcgaacagcttcagttcttttccgagttttctgtggtcgcgttctttcgcttcctcaaggaggcgaagatgctcttcaagctcggcttttttgaagaaagccgtcccatagatgcgctggagcatcttgttgttgctgtctccgcgccagtatgcccccgcaaggctcagcagcttgaactccttgattttgcccgtcgaaggaacgtgaacaccgcggcacagatcgaagaattcgccctgctcatagatcgataccgtctcgccttccggaatcgcatcaagcagttccaatttcagatcatcgccgatttcggcaaacagggctctggcttcctctcggctgacttcttttcttacgatcggcagattttccccgacgatttttttcatttccttctcaatcttcggaaggtcttccggagtcagcgcttcttccaaatccacgtcgtagtagaagccgttttcgataaccgggccgaccccgagcttcacgtttttatacaggcgcttgatcgcctgggccattaagtgtgcagtactgtggcgcatgatttcaagcgcttcttcgctgccttctgtaatgatttcgatggcgccgtcctcaaggatcggtgcgcgcagatcgatttctttgccgtttaatttccccgctatcgcttttttctttaagccgggactgattgatgccgcgatatcttctgttgtcgtcgcttttgcaaactccttaaccgctccgtcaggaaatttgatttttaccatatctgacatcctagtcactccttttttttacaaaataaaaaatccccgtccccctaagaaagggacgaggattaataaacggaattcgtggttccaccctttttcccgaaaacgcaaaaaacccggcgcgctctcggctttcggttctgtaacgggaagtcccgtcagtcattactagacaaattgccgttcacaactgatgttcaaaggcggtaaaaaaatgatccttggcataagagactttcagccatggtctccctctctgtcaaaccggtgttcatcttttcatgtccttatcaatacatgatatctttaagtttataccgtattataaattgtttttcacgcaaaatcaagaatgctcttccaaaatgttttcccgcggatgaaaggcgccaagcggaagaatccgcaccctctcctgaaaaatattttgaatggtctgaaccatggcgtgttcccggtcttctgtatagaggtctattttttccggcgcaatcgatacgagcggagccaggagatgggaatcaatatacattgggtgttctcttacgaaccgcctgtctatgtattttttttgttcccgttcagaaatatactttaattcccacaatacaaagtaaccgtcgtgcacaatgtggacatggtcaagcatcggctctttcgacatgacgtagtctctcagcgattgaatgaatgtctgatattcctgctccattttatactcgtcgatcgccgcctccacataagatctgaggcgttcataatacttcgcaaggcgaaacgtcataaatgaccgaatcgaaaagacgttttcctcaagacagatcgcttggagctcctgaatgatgtaatgttcgcgaggggtgtcgtccttgttgagaggaagcccttcaagttcgccctccataatgctgtgggccaattgaagaatctgctgctgttcatcccggtccaaaaagtaataatcgccttcaatgaccgaaagcatgtattcatcttctttgcattctgtaaaaaatctcgtcagaaccggctcaatataggcctgaatactgacagaggaatgggtcttttcaattccgatcttccctggcgcttcgtgaatcctgatatgccgattcgcatccgcattgcgaaggagatgcaaaaacgcggctgtatcataatcatcttcaaatgtaatttcaagcatgtttgtcccccctaacaacatctgttacatgtatatgggggtgacaaataaaatagacgtaaaaaaggatgagcccttaatcgaggagcgcctgcactttttttctgaacaaaagcggcactgtaatgaatatcaggtaaattgcggctgtaaccgcaatcgctaggatgtcgccggtcaagaggcttgacccgagcacgtttaaaataatggtgcccggtatgatacccgcggccgtcgccagggcaaacgacagaggcttcactttggaaacgcctgccgcatagctgaccgcgtcaaaatgaatcggcgccagcctcaagagcaaaatgcagaaaaagccgtttttccgcaaaagcgtccgcaggctgtcgagcttcagcggcatgtgctgaaagtatccgccgagcctgtatgcaagagcgaatgataaaaatgcaccgcctgccgcaccgataaaagaatacaaagagccaaacagcggaccgaatgcgaggccgccgctgacggcgaaaacggaagcaggaagcagcaaaaacggccggatcatcaatagtccgatatagatcaacggggcgaaaatcccaaaggataagacgccttctcttatatgagcagggctcagattcaggtatttcgcattcagccatagtccggccgccgcgattacggcgattaccgtccatttggccaaggttctttttcgcatcttcttcatctccgtgattgaagctcggtgtcaaatgattactgacgccggtttttcccgtccagccggacaggcgtcgctaaatacagcaccctttccatcagccttgccgcttttacttcttctttttctcccctttgcgaataggtgaaatggtgtttcagttcatcaggatcaaagtttgaagagaaaaacgtcggcagctgctgggacattctgtgctgaaggatggcgccgagcacctcatccctcacccagcttgacatggactccgcaccgatgtcatcgagcatcagaatcggcgtagacttgaccatatcaagcttttcctcaagcgactgatcatgtatcgcatttttcagctccctgacaaattcagggacatagacgagaatggacggatgatcctttgcggcaagctcatttgcaatggcggccagcataaaggtctttccgaccccgaacttcccgtagacgtaaatgccttttccctttcccgtttcgttatagtcatgcaagaatcccgtcacaagctgaaggaccttcaatctgctcgggtcatctccgtcaatatcggcaaacgtagcattcagaagatcctgttgaatatagatgcttttaatcagcgacctctgtctttccctctcgtccgctttctttttttccggacacctatcgtattgaacatcgattgtttttccgttcagcacaagctttggatgataaccctgtatcaggtttttgcattctttcagacccgggcagtcttggcatgctttgctttgctgtgtatattcataaagcttgttaaggctcctgtcgatcattccttgatccacttctgactggcggctgtttaaaaacgcctgaacatccttgtcagagagcactttttctttcatatcttcaaggcgttttttaaaatcgggtctcgtcgtcacgccttgcaaagcgcgtttaatcggctccatcatcttgtcacctcacattaaagagcggaatggtttttcagtttttttacttcttcgagcagcttctgtttctgctggtcaaagccttctctggttgcaggaccagcctgctctgtttccagcggtttgctgtcagcatcgtcactttcccgaagccaatcaggcagcttttcttctctgatgactttcttgttccgggaagtctttttcttcccttccgcccattcaagatattggcggttttcttctttcgcaagcttcatggcctctctaaccgtacgaactttttttctggcccagtgggaagcgattttttgcgtgtaatttttcgaaagcttcatatcggttttcagcatgacataataaatcagaacattgatgacgccgggctctaatttttggtcaagcataatttcttctataattttcagatcggctttggatggttccgctccgccgccaatatcctgcagcagctttcttggcgatacttgctcaagcaaagcgatcaaattgtcttccttggcgtttgtggacgactgttgattcggctgttcgcggagattcatcggctgcactttgtcgacgagttccggaagcgggccgccgcgctcgatctgataccagtcgctcgccgcttttctgagcgcctctgtcgtgatcatatcgtgttcgtcaacggctgacatgacgacgttttgcatctgaagcggttcgataccgtagagaaaggccagctttttaatcgtttccttcacttggtctgtcagcgcttttctcgggataagcgtgtcagataaaccggcgagaaacagttgaaagtcaaaggcgccgtctgtgactgctgccggttggctattcccttctttcatccattcatgatcttcgcgaagctccatcgcttcgatcatatcgtcggacatcttccattcgctcggctggacagatgcaaaaacttcattgaaagaacgggtgatgtcccgtgcttcttcaggaacagacgggtgggaaaaatattctttcagctgctgaaacctcgcctttccgacgcggttgtacaagaagacattcagcatgccgtcctgaaagaactcgtccggtctgagcggcggaatcaattcatatataaacaaacgttcgtgttccgtttcttttatataagttttcaacagtccgatcccctcaagcttttccttttctgagtggatcgtcttcaggctggtctgcatcgccgccatcagctgtctgtgagtcgagctttttccccagactctgttttgctccagctctccccacagcgtgagaaacaagctgaacgaaaaagagccgattaaaggctgatacaatagcgtgacaatttgccggtccaaatcctgcagcaatccgctgcttttgacaacatacggatcgacaggaagcaaatctttccaataattactcatatcttttgtcaaccttccactttgtttcttgtcctcattttacacctttttcaggccttcatgtcacacgactgtgtttttgtcatgagaaaagagctggatcaatttacagctctttaccgttctttctttattaaatctttcagctcgtcgataaatacgttaatatctttaaattggcggtatactgaagcaaatcggacatatgcgacttcgtcgattttcgcaagcctgtccatcaccatttctccgatcatgtcgctcttcacttcagaaacgccttgatttctaagctctttttcaatttcaaagcaaatatcctcaagctgcttcaaggcgacagggcgcttttcgcacgctttgatcaaaccgcggagcattttctcgcggctgaattcttcccggattccttctttttttacgacgatgagcggaatttcttccactttttcaaatgtagtaaatcgatagttgcacgattcgcattcgcgtcttctgcgaatcgatctgccttcgtcaaccggacgggagtccaaaaccctcgtcccattatgctgacatgctggacatttcattttttcagctcctattcaattgtttgaatgaacagattcctgcagctttccgaccagctcgatgtatagcgtctagacagcccgcggctgtagccaaaatcggtcggcaaaaacgtttccgctgacacattaaagtccaccgctgtatcaaaaggccgaatcgaaacgactgtcgccaccacaaaagcttttctcgtttttttaatttcggcgctgatttctcctctttcctccgacactgacgtcaccttgcagccgtcaaggccttccagcacttcctttacagcattgagcgcttcttttgacgccgctttataatagcggctcttcagctcttccgaaggatggcggtcagacgtttcggcgtgtgtagaaaaaaaccgttgaatgttttgaaaaagactcatatcccctgtcccctttgtctttcttctctatattttattaaaaaaatggttgatttccaagggaaaacaaaacagcaagagaatgccggggaatatgttttgggattttcgggagagggaaagaaaaaggagcggattttaaaagcggtgtccgctttttcatccagctcctctatcggcattaaaggtgcctgtgctttggctttggcctgtttcacctgaacaggtcccatgcctctcggtatttcaatgttctctcttgtttccgctcttaactcttctgcgatataatcggcagctacgttcggatctaaatctccgcaagtataaacatcaatgctggcatatccgtgttcaggaaaactgtgaatggtcaagtgagattctgaaataatcacgaccccgcttacaccttgaggcgcaaacttatgaaaggctacctcacgtacctcagcacctgacttcagtgccgcatttacaaacgttttttcaataaaatccatgtcattcagcttatcaaaatcgcatccccacagttcggagataacgtgacgccccattgtttccatagcatggcccccccttaacaagaattaaaaaagtgaatttccaagcaactgaaccggtcaattaccacgggggaaagttagtccggagaggtcctaaccctttaagtaatgccgaagcgctcacgaactagaagttcacgaaaaatagtatactttgtttgaatattttttgcaaggcggttttatcatttgatggttaaggggtatttatttttttatccgtccatgctcttattttatacagctgaggggtgtttcattcttgaagccgcgtatctgatcaaatcgacaaccctgcacgaatatccccattcattgtcataccatgcaagcactttcacctttctgttttcaagcaccattgtcgaaagactgtcgatcaccgccgagtatggattcgtattaaaatcggatgaaacgagcggttcatcgcatacatcgatgatcccggacatggagcctgccgccgccatgcggaacgcctcattaatatcctccgccgtcacatcgcttttcaaatcagccacaaggtcaacgagcgacacatttgagacgggaacgcgcagggccaggccgtgcattctaccctttaaatggggcatgacaagtgacagcgctttcgcggcgcctgtcgttgtcggaatgatcgaagatccgcaggcgcgcgccctcctcaagtctttgtgcggattatcaatatttttttgatcatttgtaaaagcgtgtacggttgtcaccaggccgttttcaatgccgaatgcatcatcaagcacttttgcgactggagcgagacaattcgtcgtacaggaagcgtttgaaataatcgtatgacgctccgcatcaaaatcgcgttcgttgacgcccatcacgattgtgatgtcttcatttttgcccggcgccgtcaaaataacttttttcgcgccggcttcaatatgtgcttccgctttttcctttgagttgaatttccccgtcgcttccacggcgatgtcgattccgtattgtgcccacggaagaagcttagggtccctctgattggtcagcatgacctttttaccgttaacgaacaggcagtcttctccagcctttacatcaagttcataacggccgtgatttgtgtcatactttattaaatgagcgagcgtttccggagggtagctcgcattgatcgccgcaatgtcaatctgttcatcaagcatcgcttttctaaacaccattctgccgatccggccgaatccgtttatcgcaactttcactttcatcaaatatgcaccccttattttatgtcattccacatcatgatttattcaaaataagtataacacattatttttaattagccataccatttgttgctttcacagcaaatttacgcacttttgtgaaatcgtgaacaaaagactaaaaaaaatcggccctaaagcatatatttcaaatacacctttggtgctacaatttgcaacagcgctaaattttcaccgacagaaggcagtgtcttcaaggaaggacaaccatgaaactgatcaaaaacgcatcttttatcatttcttttttggctgcggccggcatttattttttattaggtacagtcgctgcttctgcggcaaacgaagattatccggaacagatgatcaggctggaaagctcatcaggcttaaatattacgcccgccgggaatcaagacaacgcaccgctaacagcaaaacagacgagcggagaaaaagaagaaagatggaggcttgatacgtctgacggcaaacaattcaaaatcagaaatatggatagcggcaaaattatcatccctgcccattacgcactgtcagacaataatccggctgtggtctactatgacaattcacggaaggaagagttgtggaatatcatcggggccgacaaagacggaaacggagattttatcacgtataaaatcgtcagtgcacaaaacagcagccttgcactgacactggacggcagcggagtgaagcttgccaaatatacgggcagctccgtccaaaagtggaagcttccaagcgacgggctcgaaggtttcgcaggctatgcaagggaaacgaacggcaagcagaaaacaggcacaaccggcggcctgcttggaaaagtcgtctatgtcaataatctgggcgaactgaaggccaatattgaagattcaacgccgcgcacgattgtcgtctccagcaatatcggcgcttcagccaaaacggtattaacggtgggcgccaataaaacaatcatcggctcgtatgaaaaacataagctgaataacatttactttaaaacaaaagcggactctggcaacgttattttcaaaaatctggtcattgcacatgatgcatccataaatgaaaacaatgacatccctgtttacattaccgattcgagaaactactggattgaccatgtcacattccaaggccacagctatacggcaaacggccacgatctcgacaagctcttatacgtcggcgctaaagccgattacgtcacactgtcgcacagcacattcacagaccacaggtacggcctgattctcggctggcctcaagatgacaagcaataccacagtatatataatggctatccgcggatgacaatcagccacaatcgctttgagaatctctatgtcagggcgcccgggttgatgcgttacggctattatcacgtgaaaagcaattatatcaacaattaccaccttggcttcacgattacgacattggcgaaaatatattctgaagccaattacttcggcacgggcaatgagaaaggcatactggatgattacggagacggcgcgtttaaagatgtcgggtcatatccggcgataaaggggcagaaatcgcctgagacaagctggacaccttcatccaactacagctatcggacgatgaaggccggcaatgccaaagcttttgccaaacggtacgcaggtgcgcagcgcaccgctctgtactatgcgaattacagccagtttaaaaaagactaatcaaaaaagtgagcgcgacattgcgctcacttttcaatatttgaccatgtatcaagcagctgatgaagctgcgcttctgtatctttcagactgccgctgttatcgatcaccgcgtctgcccttttctttttttcgtcaagagattgctgggcgtgaattctgttcagcgcctcgtctttattaagccggtttcttttcatcagccgctcaagctgaagctccatcggaacccagacaacgatcactttatctgtcaaatgttcgagcccgctttcatataaaagcggaatatcgagaacaacaaaccgttcaccggcccggatggcttcgtcgcgctgcttgatcatcatttttctcacttcgggatggacgattgcatttaactgcagccttttttcttcattagcaaaaacaatttctccaagttttctccggtcgatatcgcctgtttcaagcagcacgccttcaccaaatgtctcagcgattttctgataagcgggcatcccctgttcaacggcctctttcgcgatcacgtccgcatcgacgaccgtgatgccgcactgctggaacatttgcgcgacagtgcttttgccgctggcaatccccccggttaacccgatgaccaatgtcaaaggcctgcacctccttcttacagtttccagatgccgatcataatcagcaatataccgggaagaaaggtcagtttatccatccagttccatttcgataaaaatcggcctgcctgtattccgcaaaatacgaacaatgagctcatgatgcctaccgtaatgctcatcggtacaggggaaaagcccagcgcggccgcgccgatccctgcgccgaacgcgtcaatagagagggcgaaaccgagaaggaaagcttctataccggtaatgattcctgatttatcaatgtcggcgcttgtcggttttcttaatatgtgtatcacgattccgagcgatttcaattcaaggttaatgagcgttttttcagagaagacgagatcctgttctttctccggcctgaaaaactgatacagcacccatgcgccgatccccattaagatgacggctccgagcctttctgttacgacaacgggcaggaatttcgccaaaagggttccgatcatcatggcaatatacatcacggcaccagagcaaaaagcaataatcaaaatcgctttaaatgggattttcagctttcgcaatccgtaagtaaatccgactgaaaaactgtccaagctgacggcaaatgccagcagcaagaaagatgcaaacatcatatcaggctcttcctttctgttgatgcgagcagtgtaagtcatgcagcctaaaggcagctttctaggcttcttatatatatgaaagaagaaaaccatccgtgtgttgttcacccgaaaaagaaacatcacaccttaaagcttgcttttaacagctatatggagcgtatgcaccgacagcttgaaccatgatacggcttgcttttgtccttctatgcgattgtcattttttctggcactttatgcaaaaatgcgtgccccttccgccaacgactgttttttcaattggagatccgcattttttacaaggttcatctttcctgccgtaaacgaaaagtttgagctggaacatgccgatctcaccttgtgaattgatgtaagatctgactgtgcttccccctgcttcaacagcttcctttaacgtttgaatgatctctttatggagaagaaccgtctgtttttttgtgagcttgttcgctgttgcctcgggatggataccggctctgaacaaagcctcgtcgacataaatattgcccagtccgacgactgtccgctgatcgagcagcgcggttttcaccgagcggtttgttttcttcaggcgctctcttaagtaatcggctgtaaattcgctgctgaagggctcggggccgagctgcctgagaggcagctctgtcagttcctctcccggcttaaacaaatgcatggtgccgaactttctgacatcccggtagcgcagctcgcttccgtccgtgaacctgaaaatgacgtgcacatgtttatcaaggggttcatcgttttgatgaagcccgtactttccttccattctcaaatgggaaaccatgacacaatcatcaagatgaaacaacaggaattttccccttcttccgatcgactgaatcgtctggccggccaggagccttgcgaattcctcaggctcctccggacgttttatgatttttgtccatctgacatcaaccgcatcgatcgttttccctcttacaagcccggcaagagtgcgccggaccgtttcgacttctggtaattccggcacatcatcacttccttttctctattttgcatcgtaccatgaaggccctgaagcgcagtccactttcagtggaacatcgagctccaatgcatgttccatgacttccggaaccagtttttcaagcactttgatttcatcttcaggcgcttcaaaaatcaattcgtcatgaacctgcagcagcagtttggcctggagatttttttctttcagcttgtccgccatgtcgatcatcgcttttttaataatatctgcggcgcttccctggatcggtgtgttcatcgccgtccgttcggcaaagctgcgcagattgaaattccggctcgtcaattccggtatataccgcctccggcttaaaagagtcgttacatagcctcgctgcttcgcttcctgaacggtctcttccatgtattctttgactccctggaagctgtggaaatagcgctcaataaacgctgccgcttcctttcttgtaattcccaggttttgcgacaagccgtagtcgctgattccgtagacgattccgaaattgactgctttcgcctgccttctcatcgcaggggtgacttcttcttctgatacatgaaaaacgtccatcgccgtttttgtgtgaacgtccatatcgttcgtgaacgcttcaatcaaatttttatcctttgaaatgtgggcgagaaccctcagctcgatctgtgagtaatccgccgcaaatatgagccagcctttttgcgaagggacaaacgcctgccggattttgcggccctcctcaaggcggatcggtatattttgcagattcggatcggttgagctgagccttcccgtctgtgttaaagcttgattaaagcgggtatgcactttatggctgtcttttttgatcactttcaaaagcccttctacgtatgtggactggagcttgccaatctgcctgtagtgcaggatatcttcgataatgacatgtttatcgcgcagcttttcaagcacatcggctgaagttgaatagcccgtttttgtttttttgacgacaggcagcccgagtttatcaaacaaaatcacaccgagctgctttggtgaattaatgttgaaggtttcacctgctgactcgtggatttttttctcgtattccgctaatttagcggacagttcttcacccatttttttcagtctgtcgacatcgacttggacaccgatcgattccatctcaccgagaatgtgggcgaggggcatttcgagcgcttcaaacagttcgagctgctcgttttcttccagttcatcaaggagcttttcgcgcagcagcgatatcgccttcgcctttctggctaaatggtcggcaagctccttctcatccggaaccgcctgtttcgctccttttccgtagaccgcttcatctgctgaaacgatgtgtaattgatgttctttcgcaacgcttgccacatcatcgtaggagtgccccgggttgatgatataggccgcaagaagaacgtcaaactcagcgcctttcagttcaatgccccgccagcgcaaagcgaccgccgcacgttttgcatcaaacacccatttctttttcgactcatcttcggcccattctttaaaacagtccgactgaacggccgtctcttccggaatgaagaaagcgccgtgttcgttgacgatcgaaaaaccgaggatcggcgcctcgtgataattgtcgccgagctgttcgactacgagtgaagccggtgacgcaaacaagtcatccgtgatgtctgttttgatcatgacatcgatctcttccaactgttcttcttctttctctcccgcctcttcgccaatcctttcgagcaaagaatgaaagccgagatctttaaaaatcttgacgaccgcttccctgtcaaaaccttcatatccgagggaatcgaggctgacttcaagcggcgcttctgtcgtaatcgtcgcaagctctttgctcatcaaagcctgttctttaaattcttcaagcttttctttcagtttttttccgctgacttcgtctattgacgacagcagctcctctactgtatggaactgtttcaaaagcttgatcgccgtcttttcgccgactcccggcacgcctggaatattgtctgacgagtctcccatcagccctttcatatcaatgatctgttcaggggtaagtccgtacttttcccggacatgttcaggcgtatagtattcgacatctgtaatgcccttttttgtgatggcgaccgtcgttccttctgtagccagctgtgtcaggtccttgtcgccggaaaaaatcttcacttcaaatccgtctttttccgctgatttggcaagggtgccgataatatcatcggcctcgtagttttcaagctcataccttgagattctatatgcgtcgagcagctcgcggataaacggcaattgctctgacagctccggcggcgttttttgtctgccgcctttatattctttaaacgttttatgtctgaatgtcgttttccccgcatcaaaagcgacgagcatgtgggtcggtttttcctcttcaagcatcttcattaagatcgtggtaaaaccgtacaccgcgtttgtatgtatccctttttcattgctgagaagaggcagggcgaaaaacgcacggtaagccaggctgtttccgtcaaccaatactaatttttttctttcagtcatctttatcctcctaaggagccgattcgtcagcttccattcaacttcgtgatcatatttgcttattttattttagcaaagttcattttgaaaggaaaatgagagtgatttcgcagaaaaataaaaaaagggacgcgctgttgatcgcgtccgtccatatggctccttggatgaaggggttcactaatgatcctatcagccaagttttaaccatatatataaaagttgttaagcctttgtaaagtttgctaaatgaagctactcggatgcgcgttttaagcggaccgtgaattcggtgccttttccccgctcgctttcgacgtcgatttcgccttggtgggcttcgactaaatgcttgacgatcgcaagaccgagaccggttcctcctgaatttctgctcctgtctttatcgatcctgtagaaccgttcaaatatcctcgggatttcggactgcttgatcccgatgcccgtatccctcactttgacttgcactgcatcttccagaacatcagccgaaatcgtcacgcttccatcttcaggcgtatatgtgagcgcattgttcaccaaattcaaaaagatctgctttagtctgtgcgggtctccggaagcaacggccggcttatccggcttttccagtgtcaaggtgattcctttttcctccgctttattcttcaaaagcatctcaatttcggcgaggatttcaccgatattgcaattttgaatattcagggtgaagttttgctgttcgattttcgacagatccaacaggtcctggatcaaggtttgcagacggctgctctcttttaagatgatcgatagaaactgcaacagcgtctcccgttcgttcatcgctccgtccagaagcgtttcggtgaaccctttgattgatgtaatcggcgttttcagctcatgggagacattggcgacaaagtccttcctcatttcttcaagctgctttctttccgtcatgtcatggaaaacgagaacgatgcctttccactcatcattgatgccgataatcggaaccccgtcgacttcaaaataccttctttcaattttgatcggcagtttaaacattttgcggacctttgcttccgtcataaaaatttcttcaatgagattaatgatctcttcgtgttcgagcacttcgtgatagaaatggtaaagaagctgatcggcttctacgtgaaattgcttttgataagcgcggttcacaaggtgaatataaccctttccgtcgattaagatcagaccggaatcgatattttcgatgacggtttgcagacggtcgcgctgcatttcctgggctcttgtcatgtcctgcaggttctgcgccagcatattgatggactggctcagcatcgtttcatcttcgttgaatgttcttgctttatagtttcctttggcaagctcaatcgccacttgtgtcgcagactcaatcggattcgtatattgagaggttattctcgccccaagcccggcgatgattaaaaaggccgttccaaggctcacgccgaggagaatccagatcttttgattgatgtcttgcaatgaatcgacaggagtgctgatcagaatatatccattcacattcccgtcatctttgagcggctgcacgtaacggtaaacggactcgtcatcagggttgatcctgaagcctcctccttcaccgtttaaatccgactcaagcgcttccttgataacggattgctcttcggcgcggcccccaaaatgaaaaagaacctgaccttttgtatcaataagcgatacacgactgtccagttcacggcttgccttctctaaaatagctccttgctccgaagacttcatgttttcaccatttgccaatgaagcgaccaaagcggcctctttttcaatatggctgctcagtttggcatcgtaagaggagtgaaacaagtgaacgagcagaaaaccgagtgaagcaaatacgagaatcaaaagcgtcagcagggcagctaaaagccgggtccggaatttaatcattcagtttcggctcctccattttgtagccaagacctctgattgttttaatgtattccggtttttttgtatttttttcgatcttatcgcgaaggtggctgatgtggacatcgacgatgcgcgtatcgcccgcgaagtcgtagttccagacagcgttgaggagaaggtctctcgtcagcaccctccctttatgccttcccaaatataagagaagttcgaattccttcggcgtcagctcgaggcgttcgttttgaaaataaacctcataatgttcaggcagtattttcagttcgcctatgatcagctcgcctgcatccggttcttccgtctcctccggctgaacggacagcgtctgtgttcttcttaaaatcgctttgacccttgccgtcacctctctcgggctgaacggctttgtcatatagtcatcggcacccagctcgagaccgagcactttatcaaattcatcatcctttgcggtcagcatcaaaatcggatacatcagcttcttctgtctgagttccttgcatacttcaatgccgtccattttaggaagcatcagatcgagcacgatcagatccggcttctcttcaatcgcctttaataagccggcctctccgtccatggcggtcaccacatgatagcccgaccgttcaaggttatattttagaagggtaacaatcgattcctcatcatctacaactaatatctttttgctcatgacatgcctccaggcttcagatttccccgacatctctttctctatcttttgttaaataaacgttttcactcctattttaacgaaagcctatccgttcgacaatttgatttttcagtgttttgcttaaaatctctctttttcggccataatccgctgttttaagtgatggaatccccatgcagccagcggcctccatcaaaaagaatgaaaatgtccgggcagatgattatgattaggtatatgctgacagcccgtgtttatgtcttgattttcataccgtcttatgtaaaaggttcgcattcaaaaacaggaaggcttgtataaagccttcctgccgtgtttattatgataatactttcatgacgtttttgactgattcaacggatttatcgagctgacttttttcggtttcagtcagttcaagttcaatgatctgttcaagaccgtttccgccgataatcgtcggaacgccgagataaatgccttcatagccgtattcgccttcaaggtaggcaatggtcggcagcacgcggcgctggtcttttaagattgcttcaaccatttctgtcagggaagcggcaggcgcatagtacgcgcttccgtttcctaacaggttgacaatttctcccccgccttttctcgttctttcaacaatcgcatcgatccggtctttcggaagaagcgtttcaagcggaatgccgcctgcataagagtagcgaacgagcggaaccatatcgtccccgtgtccgcccagtacaaaacctgtaatgtctttgacggaaaggttgagctcctgagcgacaaacgttctgaatcttgccgtatccaaaattcccgactggccgatgacccgctctttcgggaagcccgattctttatagacggcgtatgtcatcgcatctacagggtttgtcagaacgatgatgatacaatcaggtgagtatttaacaacttccttcgttacgctcctcatgatcttttcatttgtagccacgaggtcgtcccggctcattcccggctttcttgcgatccccgccgtgatgacgacgatatctgaaccagccgtatcttcatagtttgccgttcctgtaatattcgcgtcaaatccttggacagggctcgcttccagcatatcgagcgctttcccttttgtagggttttcaagctgcggaatgtcgactagcacgacatcagccaattctttttgagccgttaaaaacgcagttgttgcacctgtaaaacccgctccgatgacagatactttatttcgcttctttcccattttttctaccccttttaattgttgtttgttttaccccaaaacagccgtttaagacatgtttttgataagctcatcaccgaattcagagcatttgacttcagtcgcgccgtccatcaaacgagcgaaatcgtatgtgacgactttggatgcgattgttttctccattgatttaatgacaaggtcggccgcctcattccagcccaaatgctcaagaagcagcacgccggataggatgactgaagacgggtttactttgtcgaggccggcgtatttaggcgctgtaccatgtgtcgcctcaaagatggcatgtcctgtctcatagttgatgtttgctccaggtgcgatgccgattccgccgacttgggcagccagcgcatctgaaatgtagtccccgttcaggttcattgtcgccacaacgtcaaactcggcaggacgtgtcagaatctgctgcaggaagatgtcggcgatgctgtctttgatgatgattttgccggcagcttcagcttcgctttgcgctttgtttgcagcgtctttgccgtctttttcagcgatgcggtcgtattcggcccaagtgaatactttatcgccgaattctttttcagccacttcatagccccagtttttaaaggcgccttccgtgaatttcatgatgtttcctttatggacgagcgtcacagatttgcggccgtgctcgatcgcatactcgatcgcagctctgacaagccttgatgttccttcttcagaaaccggcttgatgccgatgcccgatgtttcagggaagcggattttgttaacgccaagctcgtttttcaggaatgaaatcagcttttgcacttcttcagagcctttcgcgtactcgatgccggcgtagatatcttcagtattctcacggaagatgaccatgtccgtatcttcagggcgcttaaccggtgaaggaacgcctgtgaaatagcggacaggacgcaggcatgtaaacaagtcaagctcttgtctgagcgctacgtttaatgagcggattcccccgcctacaggagttgttaaaggacctttaatcgcgatcaggtattcgcggatcgtatcaagcgtttcttccggaagccattcgccggttttgttgtacgctttttccccggcgtagacttctttccaagtgattttcttttcgccgttatacgctttctccacagccgcttcaagaaccctggaagccgctctccaaatatcaggacctgttccgtccccttcaataaacgggatgaccgggttgtttggaacgtttaatactccgccggagactgtaattttttcgccttgtgccacaataaaacctcccataatatgtaattcttcaatatagaaaaacatttgtttcccccgtttggcgggggacaaacatgttttttcatagattcattaattcattgcttccatagaaaagccgttgagaggccggccgaacgaagctcgagcagcctcttttcaaacggtcagcttctttcttcaatcggaatgaacctctgcatgtcagggccggtgtagtcagcccgcggacgaatcaggcggttattttcatactgttcaagaatgtgagcgagccagcctgataccctgctgatcgcaaaaatcggcgtaaacagatcatggtcgattcctaagctatgataaaccgacgcagaataaaagtctacgtttggcggcagctttttctgagacgtgacgatttcctcagtccgctctgaaatctcataccatttgctttcacccgttaaattcgtcaaacgcctgctcatttccttcaaatgttttgcgcggggatcgccctggcggtatacgcggtggccgaaccccatgatcttttctttcttttcaagcttggcgtgaatatatgaatctacgttttcaacctcgccaatctctgaaagcattttcataactgcttcgtttgctccgccgtgaagcggacctttcaaggctccgattgcggccgttatccctgagtaaacgtctgaaagcgtcgcgacgcatactctggctgtgaacgtagatgcgttcagctcatgatccgcatgaaggatcaaagctttgtcaaacgcttccacttcgacaggtgaaggttcttttccattcagcatgtagagaaagttggctgcaaagccgagttccggattcggctcaatcggctcaagccctttgcggattcttgaaaaagcagcgacaagcgcaggcatcttcgcttggagacgcaccgcttttctgtagtttgcttccgcatccatttgatctgcttcttcgtcaaacagcccgagtaaagaaacggctgtccgaagagctgccatcgggtggacttttccattcgggtaggatttgaaatggtcaatgacttctttggggataccggcattttcagaaagctgttttttaagctcggcaagctcctctttgttcggcagctttaaatgccaaagcagataaacaacttcttcaaagctagctttttctgtcaaatcatcgatgttataccctacatatgtaagagtatcatcaataattgaacttactgatgatgtagtggcgactaccccttcaaggccgcgtgttgctgtcatactcatctctccctttttttaaaaatttccccttttaaaattaaaccaaaacccaggagcaaaaacaacgcatgatgtatacatcttctttaatccaaaaagaaaatgcttacattaaatcgtttttcaaataaaacaatcgtgcgtttctatataccgttcgatactccgatatgcttaataaagattaagcatatttatattataaacaattatcagacatttgttaaatgtttaactatagtttttttttcttattttttggcccagcttacttctatttacagattcttagtagttttaactgtattatttatattcaattatgtttttttaaaaaaatacggggccgaaatttttttagtagcgaaagtttttttcaaactaaaaaaccccctgaaacagggggaccgcgcacatttctaagatgtgaaatgctggacggcctgcatgacaagataggcaatcccggcaccgatcagcgggccgacggcaacgcctttgaataaagcgaccgctaaaatcgttccaaatacaagagcggtcgtgatatgcgggtcttctgcaagcaatgtgatcccgtttttggcgatcaatgctacgagaatgcccgctccgagtgcaatccatgcgtaatatgacttcatcgcttcgccaagctgtttaaagccgatctctcctgttgcgatcggcacaagaaccgcaattgtaataacggtaacgccccagttgatccctttggattggatggctggaaacagcttttgatcgaggccgatcagcttgatcaaaagcaggacggatacagcgatgatcaacgactgatttttcgcgattaaagcgatggccaaaagcaggatcaaaaataaattagcttgagtaaacatgctgtattcaactccatttttttatgacctttctcataataacaggactcaagaataaaatgaaataaggacatgctttctaatatcaggaggatgcagaattgaaccaatcctatctcacagctgcgcttcgggcagtgtatgtgctgtttttgaccgctgtttgcggagcggtcggctactactcttttccgttaacctatccttttgtgattgcgcttattctcgccatcatgatcaatccttttgtggaatggctcgataagctgaccgggttcccgagaggcgtcaatgtcggaatcgttctgttcggctttttgaccgccggagccggctttttgacactggtcgttgccgagatcgtctctggaacggcctatttggctaaaatacttcccctccagtttaataaagccgctctttatatcgaatcgttttttacgaatcaaatcatgccgctgtataatgagctggccgctttttttgacggccttgaagccgcccagcaggaatcgatcattacacaggtccaaaatttgggcagtgaacttgcttcaggcacggctttattgctttcaaaaattcttgagacggtgcccctttttttcgcctttctgccgaatatggcggccgtgctgatcttttcgctcctggccactttttttatcagcaaagatctgcataaaatacaaaacaaggcacggtctgttcttcctgatcgtctgatctcgggtgcagcggctgtctatgcagaattgaaaagagcactggcaggctttgtgaaggcccagcttacccttgtggcgatgacgatggtgctcgtgttgatcgggctttccgtgttgaaggtcaatcatgctgtggcgatcgcttttctgatcgggctggtcgacctgctgccgtatttgggaacagggtctgtatttgtgccgtggattgtctatttagcagcggccaaacagctgccgctggcgatcggccttggaattctgtacatcgtcgtacttgtcttcaggcagcttgccgaaccgaagattttaagccggtcaatcggacttcaccctttgggaacattaatcgcgctgtttgccggtttcaaattgtttggctttctcggattgatcatgggccccgcccttctcgttcttattcaggctctctttacaacaggtatttttagagacatatggctgtttattaaaggaaatgaaaaataagcggcagcctgcttttccatgcgggctgccgcttatcggggttatttgataatgttgatccgcctgccttcagacattctcttcagcttgcgggagataaatggtttgaaacggccgcgcgttgccggcagcagcagcagtaaaccgatgatatccgataaaaaaccgggcagcaaaagcagcatgccccctatgaaaatacaaagcccgtccaaaatcgcggccccaggcatctttccgtactgaagatcgcgctggactttgtagtagacttcgattccttgttttttggcgagagcggccccgagaaagcccgtcaaaatgatcagcaaaacggtcggcagcacaccgatccaattagcggacaagaggaacagaccgatttcactcgctggaaaaatgacgagaaataataagaaaaacttcatttttttcacctcataattctaaattggaagcgaacggccgccctattttgcttgtgccgcctgcaaaaaaagaagggaaagcttcccttcttccagcgtgttgtcaaaccctcgcattcgttgtcaggcctgcgcgtcggtgctcacgaattccaacattcgctccgctccgatgctcggccttcctagactgcaagggttttcaatcacgctgaattgaaggatgacaaaatcctaaaactgaaaaacgttttaggattttgtcataaatctaaaagaaggggaaagcttcccttcttcttcaataagcgattaaagcacgcttgcacgtcctttgtatacagctccgcgggcggagtcgaccgtgatgtcttctccctctttcagaatggaagtcgcattttccattccgacgatgacagggatgccgaggcttaagcctacgactgcgcgtggcttgttaagccgccttcttccgtaatcagcgcagccggctttttcaagggatgccatcatgtcacgatccgtgctttttgtaactaaaacggcgccatctttcatttttttggccgcttcttgtgcgttttgagcgatgaccacttcaccaaatgcggatttgcgtccgatgccctggccttttgcgaccacgtctccgacaacatacactttcatcaagtttgttgtaccggcttcaccgacagctccggccgtgataacgatcaagtcgccgtggcgtacgatgcctgtatcgagagatttttgcaccgctttttcaagcatttcgtcagtggagctgtggttttgtccgcttgttgcgaaaaccccgaacacaagtgacagctttcttgacaccgcatcgtttaccgtaactgcgacaatcggcgcctgcgggcgatatttggaaatcattctcgccgtatggccgctttccgtcggtgtgacgatggcattcacatcaaggttgattgccgtatgcgccacagattggccgatcgcatccgtaattgacatgctgacttgcttgcttcgtgcggaaaggatctttttatggttgagcgcttcttctgaacgggaagcgatattgtgcatcgtctgaacggcttcaacaggataatttcccgctgccgtttcacctgaaagcatgattgcgtcagttccgtcaaagatcgcattggcaacgtcgctcgcttccgcgcgtgtcgggcgcggattgcgctgcatgctgtcgagcatttgggtagccgtgatgacaggcttgccaagcgcattgcattttttgatcagttctttttgaacgagcggcacttcttcggcagggatttctacacccaggtctccacgcgcaaccatcagaccgtctgatacttcaagaatggcatcgatgttgtcaacgccttcctggttttcgatttttggaatgatttgaatatctgccgcattgtgctcttcaagaagttcgcggatttcaaggacatccgacggacggcgcacaaaggatgccgcgatgaaatcaacgccctgctcgatgccgaatacgatgtcgtttgcatctttttccgtaattcccggaagattgacgctgacgcccggcacattcacgccttttttgtttttcaacgttccgctgttcatcactttcgtgacgatttcacgcttgtccttgtttatgtcagtgacttcaagtccgaccaatccatcgtcaagcaaaatcgttgaaccgactgacacatcgtgaatcaacccatcatatgtaactgagattttatcaggcgtaccgatgacttcgtccattgaaacgatcagctgagaacccgctgccagttcgatcgaaccgttttccattgtgtgcgtgcggatttcaggccctttcgtgtcaagaaggatgccgatatcttttcccagcttgccggctgcttcacgaatgtttttaattcttgcgccgtgctcttcgaaatctccatgggaaaagttcaggcgcgccacgttcattccggcttccatcagctgggtgagcttttcaacactttcgctggccggtccaattgtacaaactattttagtctttctcatattgcttcctcctcgggttttacactagattgacagttcttgagacaagcggtacatgctttgatcaattgtatgtttttgctcgagtatttcaatgatatcatgatgcacaagctggttattttgaattcctacacaacgtccgccttttccttcaagaagcagttcaaccgcaaatgcccctagacggcttgccaatacgcggtctgctgcagtcggggaaccgccgcgctggatatgtccaagcaccgatactctagtttcgagatttgtggcttcttcaattctttttccgaattcaacgccgctgccgacgccttccgccacaatgatgatgctgtgtttcttgccgcgctcatgccctcttttcagccttgcaataatttcttccatatcgtagtctgcttcaggaatcaaaatggattccgcgcctccggccaaacctgaccataaagcaatgtccccggcatggcggcccattacttcaatcacgtatgtacgttcatgggatgtagctgtatccctgattttatcgatggcgtcaataacggtatttagcgccgtatcgaatccgatcgtcagatcagtgcctgggatgtcattgtcgatcgttcccggcactcccacacaaggaaaaccgtgttctgtgagctttttggctcccatataagaaccgtcgccgccaatgacgactaatccttctataccatatttttttaaattcgctattcctttttcccgtccttctaccgttttaaactcaggacaccttgctgtatatagcttcgttcctccgcggtgaatgatatctccgacagaaccgatttcaagcttttctatttttccgctgattaaacctgaatacccgttgtaaattccgtatacttctacgtcatggtagatcgctttcctgacaaccgcgcggaccgccgcgttcattcccggggaatctccgccgcttgtcaatactccgatacgtttcatctttttcacctcgaaaacatatataatttaccttaacacgttcattgccgctaaaacaatgaaaaagggatgaaagttttccgaaaatccctataaaaccttactcattatacaattaaacaaaaagtttttaaataaattttaagcaaactctttgaaaaatcgcgggcggcagacacaatcctttcacttttcaccttcacccataaaaaataaacgtgagccaaaggcctcacgtttatttattttatcccaacatattggttttcagtcgaaatttttccaattgacttatacttgttatatctttgttggatcagctcgttcttatccagtttcagcagggatttaagctcgcctttcagcgcttcgtcgatgtaggcagcctgctgctccacatcgcggtgtgctccgcctcttacttcttttataacatgatctataatatccaattctttaaggtccggagcggtgattttcattgtttctgccgcttttttcgcgagtcctgaatccttccagaggatagcagcagctccctcgggagagatcaccgaataagttgagttttccagcatcaataagcggtttgcgacgccgagcgcaagcgctcccccgctgccgccttccccgatgacgatcgagatgaccggcacggagagtcccgccatttcaaaaagattcttggcaatcgcttcgctttgcccccgctcttcagctgctttgcccgggtatgctccttttgtatcaataaagcagatgatcggcctgttaaatttgtcggcctgcttcatcagcctgagcgctttgcggtagccttcaggatgcggcattccgaaattgcggcggatgttttcttttgtatccttgccgcgctgctgaccgattactgtcacaggaagaccccggaacttggcaattccgccgacaattgcttcatcatcaccgaaataacgatctccgtggcattcaaaaaaatcggtaaagagatgttcgatataatcgagcgttgtcggacggttcgggtgccttgcaatctggactctgtcccaggctttcagatttgtataaatgtcttcttcaagcctttcaagacgagcttcaagcttcgtaatttcagagctcaaatccatatcggaatcctgtgtgaactttttcaattcggagatcttttcacgcagttcgaccaccggtttttcaaattctaattctccagccactcgagatcacctccagtttggtgcattttcaaaatgctgccgagcgtttttttcatgtcagctctgtgaacgacggaatcaagctggccatgctttaacagaaattccgcagtctgaaaatcctcgggcagttcttcacggatggtttgttcgataattcttcttccggcaaagcctatcagcgcgcccggttcggcaaggttgtaatcgccgagggatgcgaagcttgcggatacgccgcctgttgtcggatgcgtcatcactgaaatgatcaagccctgctcttcgctgaacagcttcaaagcggagcttgttttagccatttgcatcaagctgagaaggccttcctgcattcttgcaccgcctgatgcggtaaaaatgatgaaaggtactttttcttctcttgccttttcgattgcaagcgtaattttttcgccaacgacagatcccatgcttcccattctgaaagatgaatccatcacggccacgaccgccggagatccgtcaatcgtccctttcccggtaacaaccgcttcattcagcgacgttttttcccggtctttttgcaatttttcaaggtatcccgggaactccagcgggttttcagacatcatatcctgattgaattcttcaaaggagccatcgtccagcaggctttttatacgctgcttcgcgttcatttgaagatggtaaccgcaattcatgcagacccttaaatttttatccagctcttttgtgagcatgatttttttacaatccgggcactttgtcatgatcccttccggtacatcttgcttcgctgattccgcgggaacggaagcgtatttttttttctttttgctgaatatatcttttaacaaaagattacctcccttttctgaagggttttcttcatgtatgcctgtcctgtttatagactagaacatcactataccgaaactattgtactttttttgtcaaacggtgtcatcctcaattcgacatttttgaccggcaaacagccgaatcgcactttatgcggttagagactgacaaattgatatatcagccttgagagcggatacaaaagtccggaaaagcgatttgaaaaaaattttcacagcccgaatatttccttacaagtgtccccaataagaggaaaaaccgaacatcatattcgataaacagcgcgtgacggctctttaggccagagcaatcacgcgctgatcaaaaatggacttttatttcccttcaatcactgcaagctttcttgttttttcagcgacttcttctggatcgacatcgattcgtgcacgcctgtttccatcgcggctttggctaccgctttggcaacagctggtgcgacccttggatcgaacggagccggaatgacatattcaggtctcagctcttcgtcggaaacgagtgacgcgatcgcatcaaccgcggcgattttcatctcctcgttgatatgtgtcgcgcggacgtcgagcgccccgcggaagatgccaggaaaagcgagaacgttgttcacttggttagggaagtcagagcgtcccgttccaacgacgcttgctccggcttcatgcgcttcggcaggcatgatctcaggatttggattcgccatggcgaagatgatcggtttgtcagccatgctttcaaccatttcttttgtcagagcgccttcgacggaaaccccgataaagacatcggcgtctttgatcacgtctttgagcgaaccgtctatgcggtttttgttcgtatattttgcgacttcttctttaactgcgttcatgccgttcggacggccttcgtagatcgcgcctttcgtgtcgcacatgatgatgtcgcgcacgccgaaatgataaagaagcttaatgatggcaattcccgctgcgccggcgccgttcgccacaactttgacggaagacatcgttttgccggacagcttaagcgcattgacgagaccggctaccgttacgattgctgtaccgtgctggtcatcgtgaaacaccggaattttcgtttcttttttgaggcgttcttcaatgacaaaacagtttggagctgcaatgtcttcaaggttgacgccgccgaatgtcggctcaagcagcttgaccgtctcaacaattttatcgacatcagatgtatttaaacagattgggaaagcgtccacaccggcaaagcttttgaaaagaaccgcttttccttccatcacagggagggcggcttcagggccgatattgccgaggccgagcacagccgttccgtccgagacgactgctaccatgtttcccttcattgtataatcatatactttgctgttatcatcgtaaatcgctttgcagggttcagccacacccggagaatatgcaaggcttaaatcgtccgcattgcgaacctgcacttttgattttgattccaatttgccctggtttactttgtgcatatgcagtgctttttctttcaatgacatgttaacaaacactccttcaagggaattttgccaaaaactttgcttcgttttctgcttaagattcttgtaagacgaaccccagaatcttaaaaatgataacacaactgaccgcatttttgatcaaaaatgctcaggatacctgctatctgagcacgacatttttctcacctacaacgcttttaagcctgtatagagcagcgtgatcagccttgatattatagctttccggcagctgcatcgtctgcttccgtttttcataatagacgcagaccggcgtttcccctttgtgttcaagcaggatgctgctgatcttcttgaaaatatcgtgggtgtgctggctttcctccactttaatatagacggacggctgctttttcgcatgaagcgattcgacgagcgatgccccggaaataatcagctggcgtttttcattccttgtctcaaggcgtccttctgcaaaaagcgatacgccttcttccaggatcggggaaagctgcctgaactgttcaggaaaaacaaccgcctccatttccccgctttcatcgctcagctccagaaaagccatcgtctgtcccgtttttgtgcggatcgtcttcatcctcgtcaaaagtccgcccagagccgcttttttgcggccagaggcgagcagctgaataatcggcagcgcacctgcacggtccagtttcttgcggtggacgctcagcggatggtcagaaaagtaaatgccaagcgtttccttctcgtgtgccagcaggtcgacgagcggcatttcctccgtctcggcgtacttcggcttgattgtcaagccttcatcgagaaagaagcctagctgatcattgtctcctgcaaacaattcggcatgctccagcgcgacatcgacagaagcgagcaaagtagcccggttttcaccgaattcatccattgctccggcaaaaattaaggcttcaatcgttttccgatttacgcttttcacagaagtcctcacacaaaaatcaaacaaatctgcgaacggcttttcttttctggctctgtagatctcttttacagccgctatcccgacgcctttaacagctcttaaactgtagcgcagcgccccgttttccacgacaaacggatagccgctcttattgatggaaggacctagaacattcagccctttcccttttgcttcatagatgtactgagcaagcttttcctcatttccgatcgcactcgtcaagaggccgcacataaagtagaggggataatgcgcttttaaataagcgagctggtagccgatcatgctgtatgcaacggcatggctccggttaaaaccgtaattggcgaatttcacaatcagatcgtatacttcattagccgcctgtacggaatatccttttttcaaacatccactaataaaatgatttctctctgtatcgagaatttccttgttttttttgccgaccgcccttcgcaaaaggtcggcttctccaagcctgaaacccgccatccgggatgcgatcatcatgatttgttcctgataaacgatcacgccgtacgtatctttcaggatatcggccaaatcctcgtgcggataagacacaggaacccgtccgtgcttcctttcgatatacagcgggatgttttccatcgggcccgggcggtacaaggcattgacggcgacaatatcttcaaggctcgatggcttgagcctttttaaaacgtttctcatgccggctgattcgagctggaaaatacctgtcgtatctccttcagccagcagcttaaacgtctgttcatcatcatagggaatcgccgagaaatcgatagtgacccgctcgcttttttcgatcagcgttttgatcgattcaatgagcgttaaattgcgcaagccgagaaaatccattttcaaaagtcccaagtcttcgagatagcccatcgaatattgcgttaaatatacgccgccatgaccttcctgtaccggtatgatattcgtcagcggctcctcgctcaatacgacgccagccgcatgaatggacgtatgccggggaagcccttcgattttctgcgccgttttaaatatgtcctgaagcttttttgagccgtttaggcgcttgtcaagttcaggtgaaagtgctctcgcctctttcagcgtcactccgggtttggagggaatcagcttcgccagctggtcggcttctttcggactgatgcccatcaccctgccgacgtctcggagcgccgcttttgcggccaatgtaccgaacgtggttatttgtgctacgtgcagtgccccgtacttatttttcacgtactgaataacttcatcccttctcgtatcgggaaaatcgatatcgatatcgggcatgctgatgcgctccggatttaaaaaccgttcaaacagcaatttgtgcttaagcggatcgacatctgtgataaacagcgtataagcgacgagagaaccggccgccgatccgcgccccggccctgtgataatgccgttatcgtgggcgaacttcatgaaatcccagacgatcaaaaaatagtcgctgaaagccatgtcgcgaatcactttcagctcatacttaagccgctcgacatactccttcggagcggcttcgaaccgttttttcagtccgagaaagcaaagctcggccaaataatcgtcggcattcttgccggaaggcgccggatatttcggcaggcgcgtctggccaaggctcaggtccacctggcatcggtccgcgattttgactgtattctccaacgcgtccggacgatctctgtaaatgtccagcatttcagcgggcggcttgagctcaagatgcagatctccttcggccttcatgtcttcgttcagcttctcgcccgctttaatcgcttttaaacacgtgtaagctgccgcgtcctccttttcgatgtagcgtacatcgccggttgcggcaatcggaattcccgtatgttcgcttagctctaaaatgcgttcagaaagaagcgggtctcccttgtacggctgatacgacaaatagaagctgccctctccaaagatcgaaaggcagcggagggcagcgtccttcgcctcttcgatcagcccttctttcaacagcgcttcaacatggcttgtcccgcccgttgtcagcgcgatgaggccttcatgatagcttttgagccatttttccttgatgccggtttttgattttgactgcaacacgctgctgattttcagcaggttttgatagcctttgtttgttttcgccaaaagaacgagcggatatgatagctgctctttttcatctgttaaaacagaagccgtcagcccgataatcggcttgatgccgcgttttttgcatgatttataaaattccaccgccccgtacatgacctcgtcatccgtcagcgccattgcgctgtagcccagctctttggctttggccgtgagatcctctacggaagcggcgctgtttaataagctgtaaccgctatgtacttgcaggtgaacaaaaggcatttctgtcaccccttcctttttcgagccgtctcttttcattatatgatgggatcgaatgagaaacaaatgttctttctttgatcaacaatcatacttgtctttctttatccatatagtgtgataaggtgaggtgatcggaatggatcctgaacagccctttttcccaaactttatcagctgttattttattgcgcttggagtgcttctcggcggttgtttaatcggggggatcggcgcctatctgtcggggcagccgcctttaacgatcattacaagtctcgcaaaccgcctgaaaatctgggcgctggttgcggcaatcggcggcacgtttgatgcggtctacagctttgaaaggggcattatcgaaggcaatacgagagacatcgtaaaacagcttctcctgattctttcggcgatgggaggagcgcagaccggttatctgatcatcaactggctcacacaggagcatatttcctcatgagaatccctccatattataaaaagcctgggtggcagcgtttttttgcgggaatgatgtgcggagccatcatcagctggttcgtgttcctgtttacatacggaacctttcaggagaagcaggtcgtcttgatcagggaacagaaagagcgcatcaatgatttaaatgaccagatcaccatttaccgcgaggatctgcataagctgaatgaagacaataaaagaaaactgctgattcaaagcgtcgacgtcaagctgatcaacggcaagcaatacaagctgtcacagccggacatgatgaactttgaggagcatatccgggataacatttcagatgtcattacaaaggatatcgaaagcgtctaccggacgaaggagcttttaaagcggacgattgaaaataaagagtatacgataaacgataaaaagtacaaggcgaaagtcaccgaactgacgatttatacgcggctttccgttgaaatcaaaatctctttttccgaataaaaattatggatttttttttacgattcacatgcattcgtcgcttttttccatattttaatttaaactgacagtaagcgatatgtaagtttttttaaaaagggaggaaagcagaatgtacatttacagttaccatcagctggcaagagataaagtcaaccggatcaagctgggctactcggcttatgcggaaactgaaagtctcgcgtcccttatcaaaaaagagttaaaggcccaaaacatccatgtttatgaggatgtaacagatatcggatcatggtttatacctgaataaacagcagctgtcgtgcgtaaaatgatccgcttacactttgctgctgtttacttttttgcaagatgcaatgcaagcgtttgcagttaaactgcacaaaaaagagggacttcccctcttatttgttttctttgcatatacgctccaggtcagcgatgacaagatcagcgtctttccagtcatagatggaagcgccggctgcgagcggatggcccccgccgttgtattttttagcgacttcattgacaatcggcccctttgaacgaagccttaccctgatttgatcggcttcctccacaaaaaacacccatgctttgatccccgaaatattgccgagcgtgctgacaagctgtgaagcttcagacggcgtaatattgtattgatgtaaaatatcgcgggtgatgaaaaccgacgcaacaccgttttcggacagagaaacattctggtaaatatagccattcagcctcacaacatttaatttcgtctcatataattgatcaaaaagcgcctgggaagaaaaaggatactcgatcagctctccggcatatttcaatgtcttttttgtcgtgttcggaaataagaagcgccctgtatcccccacaatgccggcatagatcagttcggcgccctttgttggaagcgcccatcccgcttgttctttacccgctaaatacagttcgtaaatcatctcgctcgtcgagctcgcactcgtatccacccataaaaggtcgccgtaccggtcttcattcggatggtggtcgattttgatcagcttgtcgcccaggttgtagcgcgaatctgaaattctcgcttgatttgccgtgtcgcaaacgatgacaagtgcattttcatacaccgggtcttcaatcacatctggagtatacaaaaaagcgagagaaggttcaggagctccgaccgcgaaaatatttttttcggggtaggttgccctcaggatttccgtaaggccgcattgggatccgtaggcgtcaggatccggtctcacatgtctatgtataatgatcgtgtcatataatgatatggttctgatgatttcttttttcatgacgcgccccttctttactttgttttttaaccattaaatcataatctgttgttggtggaaagtgaaagttatgactttttattgtagaaagcgaacccgattatgtatacaatgggtttgtaaaacttacaatggaggatgtcgattatgccgttttttgttttttttattgtggtttcagcgatagcttatgtgtacttcaaagtaaggtatgtgcgcaccaaaaaagcggttgaacgggaatactattcggccaagtcaagcatgagtctgggcctgtttatcatgttcttcggcgccaatcagctgattttaaaccgcggcacgctggctgtcgtcatcggcgttatttttatgctgaccgggctcgggagcatgtgggccggctacaaggcctataagcactatgtccctttgcttgcgaaagaaaacgaacgggagaacgcataagcgaaaagagggacaccgaccgcgtcccttagcttctttccatcagctgaaccatcatcatcgctttgccgactagagcaccctggtgaaaaacttctatatccattttcccgaactttctcccggcttcgagaatgttcggttttatttcaatgacagactccatttgcacaggctttaaaaaataaatcgtcatgctctctatcacgagctcgccttttttgcgcgaccgcaaaaagcggtttgcagcttcggtcaaaatcgtcgtaaacacgccgtaggaaatcgtccccaagtggtttgtcatttgcggcgttacttcgtattgatagaccggagccggcttgtttttgtcatggtccgattctttgaaaccgccggtcacgatgtcatcgagtttttctccgacctgcggctgtttttggatcatttgaagcgcctttaatacatcctgcctgctgatcatgccgatcagcttttgccgctcgtcaacgacgggaagcacttcgatcccttcccagaccatcatctgcgcggctgaagcaacagacgtttttccgatcactgtaatcgggtttttcgtcatgactttttcaatcaatacactgcggtcatatccggcaacgtccttcgaagttaaaatgccgtggattttcatctgctcgtcaacgatgggaaagcgtccgtgcccagtttcaaagtttttctcataccatctttccagcttttcatgaggtgataagcagactgttttttctaaaggagtcaaaatatcctcaacaagcacgacttcttttttgatgagctggtcataaatcgccctgttgatcatcgccgctacagtaaacgtatcatagcttgtagaaatgaccgggagctcgagcctgtcggcaagctcaataatctccggctccgtatcaaaaccgcccgtcaccagtacggcagcacccgcttccaaagcctggcggtgcgcatcgattcggttgccgacaatcagcaggttgcccgctccggtatatctcatcatcgcatcaagcttcatcgctccgatgacgaatttgttgagcgttttatgaagccctgcttttccgccaagcacatggccgtcaatgacattcaccacttcagcatatgtcagtttttcaatattctcttttttcttttgctcgatcctgatcgttccgaccctttcaatcgtgctgacaaaccctttattctcggcttcttttatcgctctgtaagcagttccttcactgactttcatttctttggcaatccgcctgacggagattttttcgccgacagacaaagaatcaatatattttaaaatctgttcgtgttttgtcgccaatcgtttcaccttcatcctctgactgctagatatatttattataaatcgttgtgcgattgaaccgcaatccgccttcacaacatcatgcccgcctaagccttatcatcctccatcaggagaagcgctttttcaagccatgagcaatagcctttttcccgctcaagcgcccgggtcaatacaaggtaatggccgaaatgaggcgagcggaacgttattgaatcacccgcttcgcgcttcaattcatcgagcttggtgtttaaaaaagcagctttttcctgtctcttttgaagctgatcgttaaaaagccttttcgcttcatcaggttccatcgaagagataaaataagctttcagcataaattcatcttttaccgtatctggaaccggcttaaattccgtaagccacccgtgaagttcacgctttccggcttctgtgatggaatacattttcttttctaattttgagccttggatcaccgtttcaaattcgataaatccttcatccgtcagcttttcagtcggataatctggctggcttgcaccctcggggaaaaaatctggggcttggtgctttgggcggcttccaaaattggcccaattcggctttaaaccggcttgtcatatcgtagccgctcaaactcccatgatcaaggagccccaaaatcgcgtatttcaataccctcataatcaccctccaagatgaatccgattcctacattatatcatggtggacatgttttgataggcgcataaccggttcaaccgaaaaaaggacccggattcgggccctctaaaacaaatttacttaaattcgattgactcaccgacctcaagcacttttccgacgcctccaggaaggctgtccgcaaatgcatgcggatcctgttcgatgacggggaacgtcgagtagtgaaccgggacaacctgtttcgctctgagccattctgcggccagtttggcgtcctcagggcccatcgtaaaattatcgccgatcggcaagaaggcaaggtcgatatgatttaattcaccgatcagcttcatatctgagaaaagcccggtgtcgccggcatgaaaaatcgtccttccttccacagtcagaaggatccccgccggcatgccggtatagacgatcttttggctgtcttcttccgtataagccgatccgtggaaagcctgcgtcagcttgacttttccaaaatcgaactggtgggagccgccgatgtgcatcggatgtacattcaggcctttccatcctagatagaccgcgagttcattcggagctacaacgagcgaattgtttcgcttggcgatttcgatggtatcgccgacatgatcgttatgtccgtgagtcagcaagatgacgtccgctttgacatcttcgggctttaaatcggttaatgagtttcctgtaataaacggatcgaagatcaactgatgatctcccgtatcaactgttaccactgaatgaccatgatatgccactttcatcatatccacccctgatttttttaatttcgcacgtctagagagaatgacggttaatcacattcaagccgcctgtggcttcaatgactgttcccgtaatgtagtcggaatgttcatcgcatagaaaagtgatgatccttgcgatgtcttcaccggttcccgacctgccgatcggcgtttcctcatcaagtgacgccctcgcttctgaaatcgaggcctctttcatatccccgacaatgttgcctggacagaccatgttggctgtgatgccggagcccgcttcttcaatggcgatcgtctttgttaaagaagccagccctacttttgccgctccaaaagcggaacgatgcagccagccaggcgcatggtcggccccctgaaatccgtaagtgatgattcggccgaaccgctggcgcctcatgatcggaacaaccgctttaaacagatggaagacagagcttaagttgccttcaagcatgtcataccattcatcatcagtataatccgcaagcttttttcgttcaaatatgtatgggccggcattattgatcagaagatcaatttttccaaatcgctcaagagcggcattcaccatccggagcaggtcttctttcctggtgacatcacccttaacaaactgcaaacggtcaagggatgaccgccatttttctttgaggcggcggacagcttcttcgtcttgcctgtaattcaccgtcactgagtagccttttcaagcagggcttccgtcactttacgccccaaaccttttgaaccggcagtaattaacgcatggcgcacatctttccctcccaggcattggttctcggtattcgcaaatgattgcattaatctacctatactttactacaaaacccttaggatatcacatttggagcatcgggaagtttcaatcgccgctggaatacaatcgacagacggaagaaagctgaagcccgctcttacgggctccagctttctattgtttatctgcgtcagctaacggctgtgcgtcatcgtgcgcgacaaacccgctgaaataagcatcagagatctgctgaacggtttctttatctccgtcggcatcatacatatatccgtgttttgactgatcttgtttcattgccacaccccttttcgattcacaaatttattttgcgtatgaagccgcacagttatgaatcgaatcgggaagtgttaaaaattgttcaaacactgcttcgccttttgaatggcttctgtcacctttttgaatcccgtcccgccttcgctcattcttttttcgacggcatggtgcgggtcgagcacgatgtagacgtcttcttcaaacagcccgcttgcctttttgaactcttcaaacggcaggccgctgagataaatgcccttttcgatgcaggtgaagacaagtcttccgacgacttcgtgcgcttctctgaagggcatgccctttttcgccagatagtcggcaagttcagttgcatttgaaaaatcctgctccgttgcttttttcatcatatttttgttcactgtcatcgttttaatcatgccggcaaaaatctcaaggcttccttcgaccgttttcacagtatcaaacataccttctttgtcttcctgcaaatctttattgtatgctaacgggagccccttcataatcgtgaggagtccgatcagatcaccgtatacgcgtcctgttttcccgcggatgagctccgccatgtccgggtttttcttttgcggcatcatgctgcttcccgtcgcgtaggtgtcatcaagctcaatgaatttaaattcctgcgagcaccaaagaatgatttcttcggagaatcttgacagatgcatcatcagaatgctgctcgcgcttaaaaattcaaggatgaaatccctgtcgctgacgccgtccaggctgttttcatatatcgaatcaaagccgagcaggtctgcggaatattcacggtcgatcggaaacgtcgttccggcgagcgccccgcatccgagaggagacttgttaatccgcttgaatgaatcatgatagcgttctttatcgcgctccagcatccagaaataagccagcaaatgatgcgcgaacgagatcggctgggcccgctgcaaatgggtgtatcccggcagtatcgtctccacgtgttcttccgctttttcgatcagaacgtgttgaaaagccgtaatcagctcgatgatatgctcagtgtgcccttttaaatacaggtgcatatccgtcgccacctggtcgtttcggcttctggccgtatgaagctttccgccgagcggcccgatttcatcaatgagcattttttctaggttgaggtgaatatcttcgcaatcgactgaaaaatcgagttcgtttttttccgctttgtgcaaaagggatgtcaggccttcctttattttgaccgcttctgcttcggttaaaatgccgcatttttcaagcatggaagcatgagcgagagaccctgcgatatcttcttttacaagcgttttgtcaaagtggatcgatgcgccgaactcatcgacccatttttccggtgttttttggaaccggcctccccacagctttttcatgctttaatctgctcctttttttggacgatgctgtttactttcgtcggcagtccccacagctcgataaagccgactgcagcgtgatgatcgaatgcatcgtcttttgtatacgtcgcaagcttttcatcatacagggagtattcggacttacgcccttcaacgatcgcatggcctttaaacagcttgacgcggacgacgcccgtgacatgcttctgcgtttctttcaggaaaccggaaagcgcgtctttaagcggagaaaaccagaggccgttatagatcacttcagccattttttgttcgattataggtttgaaatgcgccacttcttttaccaatgtcaaatcttcaagctccttgtgcgccttaatcaaagtcatcgcgcccgggcattcgtaaacttcgcgcgatttgatgccgacaaggcggttttcaacatggtcgatgcgccccactccatgtgcgcccgccagttcattcagctttaaaatcaagtctgacagcgggtagtgagtcccgtcaatggatacgggaacgccttcttcaaaagcgatttcgatcacatcaggagtatccggtgttttttcaagaggcttcgtcaaatcatacgctccttcaggaggcgcggcccaaggatcttccaggactccgcattcattgcttctgccccacaggttctggtcgattgaatacgggctgtcaagattgatcggaattggaatgccatgcttttctgcatacgcgatctcttcgtcgcgagaccatttccattcgcgcacaggtgccagcacctccaaatccggattgagcgatttaatcgacacctcgaagcgcacttggtcattccctttgcctgtgcagccgtgagccacggcttgcgcgttttctttctcagccacttcgacgagctttttggcgatcagcggtctggacagggctgatacgagcggatactttccttcataaagcgtgtgggcctggagggcggtcagcgcaaactctttcgcaaattcttcttttgcatcgataacataagaattagaggctccgacttgaagcgctttttgctgaacaaaggcgagatcctttccctctccgacgtcaaggcagcaggccactacatcatatccctgttcctgaagccactttatcgcgacagaagtatcaagtcctcctgaatatgctaataccacttttttcttttgcgtcatttcgaaaaactcctctcatctcggtgctcttttgtataaaaataagttttatttaataaaaatacatttaatatgtatacactttaacaaggaagtctggttttttcaacctttttataaaaaaaacttcattcattttttatgaatgaagttcagtgcatattcagcgttcggccggaaggctttccggccttactttttcatatcttttctcagttctctgatgacatgggcaagctcaggcacaatcagctttgacattgcaagctttacggcaccgcttgaacccggtgttgcaaatacggctttgttttgaataacacctgctgcagcccttgagaggatcgcagccgctccgatatcctctgtataactcagcatgcggaatatctccccgaaccccggaatttctttcgaaaaaagaggaacgatcgactcgattgttacatctcttgaggcaatgccagtccctccgtttaataggacggcatcgatccggtcgtcgagacagcctttcagcacagctttttgaattatttccttttcgtcctttacaatctcataggaaacgatctcatgaccggcttccgctaaaaactctttcatgagccggccgcttttatccgtgtcttccgttcttgtatcgctgacagtaatgactttgcagttgacgcagtccggcgcttcttttttatgctcttcaacactcatggccatacagcctcctttatacagtcttttttcattataaaggggaaaatgtataaaaaaacagccctccttgaaaagagaaggctgtttttttatttttagtgtgccagtctgacgacgtctcttgcaatcattacttcttcattcgtcggaatgacgatgacttttacaggcgaatgcgggtagctgataaacgcttcttttccgcggacgttattcaaggcagggtcccaatagacgcccatgaattccaaaccatgaagaacgcgctctctgacttcaacgctgttttccccgatgccggcagtgaaaataatcgcgtctactccgctcattcgcgctgcataagaaccgatgtatttatgaattctgcttgcgaatacttcgagtgctgtttccgcacgttcattgccttctttagttgcttcaacgatatcgcgcaaatcgcttgagaatccagaaatacccaaaagaccgctcttcttattgagcgtgtccaggacttcgtcggctgtttgacccgttttttccataatgaacgggataagcgcaggatcgatgttacctgaacgcgtacccatcgctacacctgcaagcggtgtgaagcccattgatgtatcgattgatttgccgccttcaacagctgcgatgctcgctccgtttccaaggtggcaggaaatcaggcgaagttcttcaatcggacggccaagcagctctgccgcgcgttcagtcacatatttatgagatgtaccatggaaaccgtatttacggatgccgaatttctcataatattcatatggcagactgtacagataagattgttccggcatcgtttgatggaatgccgtatcaaaaacggccacggcaggaacattcggaagaacttctttaaacgctttaattccgacaatattggccgggttatgaagcggtgcaagctctgaaatctcttcgatctcatggatcatttcatccgtcaataaaacggagtcgctgaacttttcgccgccgtgtacgacgcggtgaccgattccgtcgatttcatttaaatccttgataatgccgaattttgtcagtttatccagcagcatttttacagctacggaatgatccggaatatctgttgtttcagtctttttttcgtcgttgacggaaatcgtgaagatgccgttatccagcccgattcgctcaacaaggccttttgttaatactttttcgctgggcatttcgaacagttgaaatttcagtgatgagcttccagcattgattgcaataattttggacataaaatgacgctcctttttacctatagtccggtgacattatgttcaacccggaacataaaaaatatgtataaaatcgttcttagtaaattcaaaaaatatctgcctttctcatttaaacactcaaaagagtgcatttcaagtcacgatccgacatgttaacgctttcactaagaaattattattttctgaatataaaaatagatcagagaatatatcttctctgatctgcttatcttttttcagcctggaaccagctgtcgagtttggctgtcatgttcagcatcgcatcctgattggcgaatgacgggacttgcgcgagcagaacctgtttaggcgctttcgcctgttccccatgcttttgtaaaaccaaaatgctcttcgcgtgtgcttcatctttgaaaatggacagcggaagctgaagcactgcattaatatgcgcattgttctttaaaaaggtacgcagcttttcgctttgaccgctttcaaacaaatggttcggaatcataaaaaataaatagccgcccggtttcgtataggtcaagctttgttcaataaacaaatggtgtgaaaaagagtggccttcatctgcctttaattcgaaagcgcgcgcactttcgtcatcaggataatatccgacaggaagatcgcagatgaccgcatcggcatgttccataaaaatcggctgcaggctgtcctggttaaaaagctcgatttccttttcctgcaggtttgcctggacataggccagcttgatcaggacgtcatcaatctctgagccgaacgcttttcccgcttcctcagccagctggttcaaaacggcaagcagcaggtttccagtgccgaccgccggatcaaacagcgtcaatccttttttccgctccataaatttgttcacaagatatccgataaataatccgatcgtatcgggcgtcatctgcctgttcggatgaggaatatctttctggcctttcagtatggcaagctggaaggctttccgtatcgactcatgactgcactctgaaaagcgcgcacggccgatcagatccttcaccttttgttcggcttcttcggaaagcccgcggtccgcagaacctgtaaagaatgcctctccggcttccgccaatccttctatgtaagggatctgccgatcgcgtgcgatgacttccgctcctttgtcaagccattcataaatcgtttcgactggatagttttgcatgatgatgtctctccttatcaaaaaatcaaagccatgaaaagagctccggcaagatgaacacctggagcccttttatgagttgaatttacttaacgagtgatttggcagcttcgatggctttgtcgtagtccggatggtttgtcgcttcgctgacgtattcagtgtagacaacttttccgttttcatctaaaacaaatacggcgcgggcaagcaatctcaattctttaatgtaaaccccgaatgcttccccaaaagacatctccctgtgatctgacaatgtttccacattttcaattccgtttgctccgcaccagcgcgcctgtgcaaacggcaggtcagcgctgatcgtatacactttcaccgaaccgaggcctgcggcttcttcgttaaagcggcgggtctgtgcgtcacaaacacctgtatcgatagacggaatcaccgaaataaccgccggtttgcctttgatgtcctgaagtgtgacttcctcaagcgaattggacaaaaccgtgaaatcaggcgcctggtctccgactttcacttctgaacccaccagtgtcaccgggtttcccttaaatgtaattgaagccatcatcattcctccttcatttatgtatgactctactataaaagagtttaggacaaactgcaaagcttaagtccggcagagacaaaaaaagttaactgctgcaggaacagttaacttctgggactctgttgccggaaagccggggcttttaaaaaggaggcgtctggttttgacggttcatattttgcttctgcttatcgtttttcttaaacatatgctgaatccgttcgatcgtttgcggagctgagtctaaaatcttatcgatgacgtgcgtgttttcatccaaatgcagtactttaacgcctgatgatccgacaatcaaaaaagcaatcggcgtaatcgatacgcctcctccgcttcccccgccaaacgggagcttcgattcttttcgttcgcggtctccatcgctcgctttggattcggccggtttattgccgccgaactcgcttccgccagccgcaaagccgaatcccactctggagacggttaggatgacgctgccgtcaggtgtttccacaggatctccgataatggtattgacatcaatcatttcttttaagttttccattgcggttttcatcaaaccttgaattggatgttcagccatattctattcctcctatactgatgaatcattctttgttgaacctgacagattttttggcagcttaaataagccgcgcattttccctttccagttcaccacgattctgaaagctgcggttatagcatgtccaacccgaaaatggaatatacatgtcagatgcgttttggaggaacggctgttaaaggctggaatcacctcgtattccggctggctgtcaaagcaaaaaagctgatgcaagagagccaccgtgccggctttcagggaccaggcgccgcctgtgacaatcccggttaaagccgcgtcaggaaagccgaggacagaggtccattcgagcttcgtgacgtgaatccgcttcataaaccggcggatgatcggctgcatattgatgatctgttccaccaattttttgatttgcttcgtactatcgaacacttcccgatagccgatttttctcctctttttatcttttttcagagccgaattcgtctgttctttcacatcaacggtcatatcctcctggttgattttaatcaccggaatctcccttttaatgcgcagaatgccaaaagccgtccgaactttgacggtcagccggtcgtcatcgtctgtatgaagatactcgatcgctacgcggattttcattatcatcaatgctgccaaaagaatgaatactcccgcaatccatatgtaaatcatgatttcacttcctcttatactaagcattataggaagaaaactggaaaaataaacatagccggaattccgccgatacaaaggaataaaaaaacccggcagtcttcagccgggtttaaaactctcagtctttttttcgatacagtttttcatggataaccgcagtgtccgcaaagaaatcgtgaatcccttgtttcttaggcgaaaacgctgctacgagatacgtaatatataaactgttgatatagcggccgataaactccctaaacaggaccacatcccatgtcagccctttttccgggacaagcgacacgaccttcagcccgaataccatcttgcccaacgtctgtccgaaatacttcgtcatcaggacaaagtaagcaaaaaatactgccgccgtcacaaaagaataaagcgaaaaggtgaaaaaccctgattctttagggaggttcagcaggctgaaaacgggtgaaaccgctaagttgttgatgctgccgataacaaccccgtcaagcagaaaagcaaacagcctgatccaaaaaccggcataggcatgctctacatgcggggccgattcttccctggaaacgccgacattcggcgataattcattatgatcctttccatcataagtcacatccattttttcggtcccctcctatttggcatataaatacatgagtctcggtgcaccggattgagaaatcgcttctttaatgtttaagaaatcagcttcgcttttaaacatcttatttgcagtcattgaaaacagcgaggcaaggccggctgattcttcatagctgacaacagatgcgccggcaaggtttttgtggtcctttttcatcgctttgaccgcatcttcataatagccgagctcatcaatgagatggttctgtttcgcctggcggccgtcatagacacgtccgtcggcaatttttttcacgtcattttcggacatgccgcgcccttcggcaataacatctacaaacccttcgtacgcgtcatcgaccattgactgcatgatttctctttcttttttcgtcatatcgcgcgtcggtgacatgatatctttaaactcaccgcttttaatcgtctccgtttttaatccaagcttctctgcaagcttgctgtagttaaggctttccatgatgaccccgagtgaacccgtcagcgtgtcaggcgctgcaaagattttgtcggcaggcgttgaaatgtaatagccgccggacgcagccatcgatcccattgatacgtaaatcggttttttcgtatcttttttgatctcttcaagcttcttatgtatctcagcgctctcgtatactccgccacccggagaattgacgcgcagaacaatgccctttacggcagaatcgtcttttgctttttcaagcatttgcaaaaacgatctgtggttgtagccttcagagctgaacaggcctgaagcgccgccattgtcggaaatcgttccgttcacttcaagaacggcgatttttcttgagctgtttccttgttcaagcaccgtttcttcctgggtgtcattgaggccaaactgcatctttccgtcattccccatcgtgtcaaatactgcaagcaaaaggctcatcaccgcagataacgcaaaaacgcccagcgcgatgacaagtgcgatccatcttttcgcattcattttgtctgttctcctcctttgaataaaaaagctgcatgtcttagtacgtatatgaagagaaaaagttcattatgatgccgcttcatatacaagaagtttttggacatggtaaactaagggtcacaggtcattttaacatatatgttagatggcagaaaaatctaaacttaacagacaaaggggagaatgattgtgacagaccgccgaaacatttatttcttttacaaaaaaagcgaagaaaccgacgagcagtgcaaaaaactgaaacagcttgccgaagaacacggatttcgcgtcgttcaccatcacaatgaagccaatattatcgcaagcatcggcggcgacgggacatttttgcaggctgttcgaaagacgaacttcagggatgactgcctgtacgtaggcgtggccaaaaaggggaaagctcatttgtatgcggattttaatatatatgataccgataaaatgattgaagcgacaaactcggagcaaatcgaggtcagaaaatatcctctgatcgatgtaaccgttgacgggaccagctttcaatgtctaaatgaagtatccatccgttcaagcattattaaaacatttgtaatggacgtctatatagatgatcttcattttgaaacattccggggggacggaatgatcgtgtccactccgaccggaagcaccgcttataacaaatcggttgatggggcaatcgttgatccgctgattccatgcatacaggtgacagagctcgcttcattgaacaacaacacatacagaaccctcggctcgccgtttattttaagcgcggatcgaaagctgacattaaaaatcgtccaggacgggaacgactatccgatcatcggccttgataacgaagccttcagtacgatgaatgtgaaagaagtcgaagtcagcctctccggcaagatgatcaaaaccattaaattaaaagataattcgttctgggaaaaagtaaggcgcacatttctataattttgaaaaccttttcattaaaaaagagcaagacgatcgtcttgctcttttttgcgaatgcctataacgaaattttcacttccgcattcatgccgggaagcaatttggcggacggattttgaatcgaaatcttgacttgaactttctcggtgactttcgtatagtctccgctttggttcatttccggaaacattgaaaataccgaatctgtcgcatatccgatctcttcgaccttcccttcaaacgttgtatcagggtccccgtcgactttgatgtccactttgtcgtctttttcgatatcgcgtaattccgtttctttaatatgagccgtaatatatatgttatccatatcggcagtttgaccgatgacaacccccgcatttacgattttatgattgacggctgtatttttgaccagtgttccgtcggaaatggctttgacagctaccgactgctgcccgtccgatatttttccgaggttgtcgccgtctgatatatggtcgccttcttttgcatcccagccgcttaattttccggaagcaggcgccgttatttttgtcatatttgcggaaacccttgcttcatccgtcgtgacataatgtttattttgataatagtaatatccgcatacagcgacaagcgctaaagttgcgataataccaatcatattgatgatcatcaaacgtcctttactcatgtttatcctatctccttttgttgacttgctgaagggtctggcaggcgaaggcgcttctgaacgagcgatcttccttttccggtcgctgcctttccaattgaagccgcaagcatgatgatgcttagccagagcagtatcgtaaacaaatcgtgatatgcgccaagggctgaagcttttctggcatttgcaacaatcgtataggccgccatgttcttcgcatcaccaacagaaagcccgctgctgacaaaatcacgaatcatttttgacaattccagctgaatttcaggatcagcttcactgatatgtcctcttatcatctcgtagtgcaccgcattcttcattgaagcaaaccagccgatcaccggtgcagcccaggcaccggcgaaattgcggataaagtgaagcgaaaccgagcgttttgaagcttggtgaatatctccggcaagcgccgtgcccagcgctcccgataccaataccatgctgacgccgctgcccagcaaaacagcatgaagatataacgactccatcgaaacaccgggttgaaccgatctccattccataccgacgatgatcatttccaaagcgccgatacagccgagcaatccggcgccaaaatgatcatacaaaagcgtgctgagcacggcagtagctaaaatccctgcgaaaaaacacaaataaaagcgtgtcatgctttcaaaagaagcctctgcaatgttttccaaaaatccgtttatcccggcaagggaaacaatgattgcaatgtgtgaagcaacggccatgactgtcccggaaacagcttttgcggaccacagtgaacgaaacggcacaagaggttcccgggcgcgcaagtctgtaatgacaaacaacgccaaaatgatgaatccggccaaaaagaacggccacacataaaaagaatgaacacccgtcttctgcaaattgataagcggcaccgtcaaaacaaccatgagcaatgagagcataaaaacgcccgtcttatcaatcgaatgatgctcccgctcatccgctgcttgtttcggcaaagaaaagaagccgatcacaaggcaaaggacaggcgaacaaatatttaatataaacacccagcgccatgcatccgcgctgagtgacagggaaccaaaaaccgctccgatggcagaagcgccgaacaatccgctaatgacgaaaaacaaaaacaaattgcggaccttgttcggaaacgaaatcaatttgacaggaagaatcgtcaaaaataacattccggagcataatccttgtatcacccttccgataagaagcgaaaacaagcctgctgaaaatgcgtcgatcagcgagccgcataaaaataaggtgatgagtgtcaggtagctgttccgaatgccgaacctccttgaaaatatacgtccaagcggaacaccgagagcaaaagcaagatttgtcaaaatggacggaatccgcatatcgtccggtgacaaatgaagtccgttttgaatgacgacttgactgagcgtataggaaagattaagaaaatattgcggcccaatggccagtatcgttaaaaccgaaatgatcaaatacttcggaatgccgatttttttagagctcgggatcgccacatcagattgactcataagcgctcctcctttagttatatatttcatattacaagttgtattatgcaagttaaattatacatccttcccgcaataattcaaccgaaagaaaaagaaaaggctgatgatcgtctgaccaaccagcctttagccgcttatttgctccactttttaaaatcctgattcagtctgatcaagcgggtttccaacgtgttcagttcttctgttgtccagtcttgaagaacctccgtgtatacatgatagcgggccttttgcacttttttcagagcatcaatgccctccgaagtcatctccacaaggctgatccggccgttgttgggatcaggaaaacgtctgatgagctttttccgttccaaggctgaaacttgtctgcttgctgtcgacagattcagcattaaggtttcagccagcgagttgatggcgagaggactttgcttatcaagctcgcttaacagcagatattccgagcggtccagacttccaaagcgcgggctgtaggccgtcgtcagacggaccaaaagcgcgatttctttctctatgtttcggagtgagtcatgacccaacggatattccctcctctttgtgtggttattcagctttcgttttaagtgcgatttcccgttgtcttagttcaaagcgcttgattttcgccgaaggcgttttcggcagttcttcgatgaattctatctcccgggggtatttataaggggccgtcatggcttttacatggtcttgtaattcctttgtcaggtgttcatttccgcgggatgggtcctttaagacaacgtatgctttcacgatcgatcccctgatttcatcagggcttgccacaacagcacattctttgacctcaggatgcttgatcagcgcatcttcaacttcaaacgggccgattgtatatcctgagctgatgatcacatcgtcattgcggctttcaaaccaaaaatagccgtcttcatcctttcgcgccttatcccctgttataaagtaatcccctcttctttgtcggagcgttcgttcttgatctttgtaatattctttaaaaagagccggcgtgcttaagtgaacggcaatatcgcctgtttcgcccgggggacagctctttccattcccgtcaataatatcaaccaagtttccaggcgtcggttttcccatgcttccaggcttgattttcataccttttaaaatccccaccaacagcgtgctctccgtttgtccgtatccgtcccgcacagcaatatgaaaatgctttttaaatgtatcgatgacttccctgttcaacggctctccggccgaaacagcgctgtgcagagaagacaggtcaaatcgggacaaatcattgactttcgccatgaaccggtactctgtcggcgtacagcacagcacattgacttgatggcgctcaatcagccgcaaatacgtttccggcgtgaattttccatgatagataaagccggttgcaccgctaccgagcactgctaaaaacgggctccatacccatttttgccagcccggccctgctgtcgcccagacgagatccccttccgaaatgtcaagccatgcggaagctgtcgttcttaagtgagcataagcccagccgtgtgtatgtacaaccccttttggctgaccggtcgtgccggatgtgtaagataaaaatgcgatgtcatcgcgagaggtatccgccgcttgaaaatccgctgcaatggcctgattcattttttcgagcagattgatccacccttcgctgctttctccgacggcaaataacgacagtgcctcttttgaacgaacatctagaaaagcatcaagaaatgctgaatatacgacggctcctttgacgcctgcatgcttgatcctgtaatccaagtctttcgcccgaagcatttcggaacatgggatgaccaccattccagcttttaaaatggccatgtacacggcatacgtttccggtatccgcggcatcatcacgataagcttgtcaccttttttcagtccagaacgggtcaatatgctgccgattttgtaagccttttcaatcaatttttcataggaccatgacacttgacgccctgattcatcttcccagatcaatgcggtcttatcgcgggaagatttaaatttttcaatttcatcaaccgcattatacttctccggcgcaatcaaatcttctcttctcaacccttccatctccttgtcttgtgccatctttttattatacataatcctttcatacaattgtattccgaaatgcctattttgcagaacataaaaaagagtggggattaaaccccacccattatccattgctttttaattttaattattgttgtgttccacccatttgctgttgagcgaaagaaactaaacgcttagtgatttctcctccaactgaaccgtttgcacgagaagtagtttctgctccaaggttaacgccaaattcagaagcgatttcgaatttcatttggtcgatagcttgagcagcaccaggaaccaatagttggttagaactgctttgtctgttgttttgagccatgtgttctcacctccttgtgagtatagattgtgtaaaaacacatgacttcatacaaagaatgtttggtaattgtatgcaaaaacagacaaagatgtttgattgaatattcctttagaaaaaatccgcaaattgatctttcgtttccgctttgctgctcaaaacaatcgtttccgtgttttccacagcttcgttgataagcggttcgaaatctgtgtagctttcaaagtgttcgattttctcttttttcggacgcgttttcggcgcagaaggcgtaaagatcgtgcagcagtcttcgtacggacgtatgctgatatcgtacgtatcgatttccttcgctttttcgatgatttccgtcttatccatgccgattaaagggcgcaaaaccggcgtgctcgtgaccgcgttgatggcatacatgctttcaagcgtctggcttgccacctggccgaggctttcccctgtaaagatcgcaagcgcgttatggcgttcgcgcagtttgtcggcgatctggagcatcagccttctggtcgccgtcatggaatagttctcgggaatctgcttttgaatgagctcttgagtttttgtaaacggaacgatatgaagcttgatgtctccgccaaaagccgtaagccgcttagtaagatcgatcactttttgcttggcccgctcgcttgtatatggcgggctgaaaaagtgaacggcttcgatctcaagtccgcgcttcatggcatagaacccggcaacagggctgtcgattccgccggatatcataagcatcgcttttcctccgcttccgaccggcagtccgcccgcacctttttcatcccggaatgtcaaatacgtggcatcttcccgaatttcgatacgcaaatggatgtccggggagtggacgtcaacggtaagatcgtcggtgttgcgcaaaatgtgtcctccgatctcggcattcatctcatttgtatttaattcaaactgcttataagcccttttcgtcgatactttaaaggtatccccgggcttgtattgttcttgaacagaagcgagcgccgtctctttaatgctttccagatctgtccggcacttcacggcaagactgaacgattggatgccgaaaacgtgtttcagacgagccattacagcttcagcgtcttctccgtttaatacgagagtcattctgtcgcgtgttgattcataacggacgttgcggaaatcgcgcaagaccattttgatatttcttttcaggcgatcgacaaaaagctttctattctttccttttgttgaaatttcgccaaatctgattaaaatgtagtcctcattcattgtgcctctacctcataattccttttagtttgtgtaaactttcttttaaggccgtcataaacgggccgacaatctcatgattatcccggtacgtcatgctgattctgatgctgcttgaggccgcaccttcaccttttcccatttctaaaagcaccttgctcggcttatgctgttttgaagagcatgctgatgtcgtcgatacgaaaatatcccgctcctctagcatatgcaaaaggacctcagccttcaatcccggaacggaaaaattgatgatatgcggcgcgctgttttcttccggcgtatttaatataacacctttcagctcttttagctccttgataaaagctgattttgccgcctttatttcttctatataatggttataatcctgttttgacaaattgatcgcttttgcaagtgtaacggcgccggcggtattttcagttccagcacgcctgttgttctgctgttctcctccggaaatcaaaggaaaaagcgagatccgttcgtttagaatgagggctcctgttccctttaagccgtgaaatttgtgacccgagattgtacaaaggtcaatggctgccccggagatgtccagcggaaccttgttgatgccctgaacatgatcaacgtgaaagtatgcccttgtgttttcttttacgattttcccgatttcttccagaggctggatgacgcctgtttcattgttgacgtgcatgatgcttacaagaatcgtgtctttgcggagcgcttgtttcaagtcttcaagagaaacaaagccatggccgtcgacaggaagatatgtaacctcaaagccgaaggccgtcttcagctgctccaaggattccgtcacagacgggtgttcaatggaggaagcaatgatatgctttcctttttgcgcatgtgccaaagcaatgcctttaagcgccatgttattggcttctgaagcgccggacgtaaacacgatatcatgattttttagcgaaagcgccgatttaatctgtttccgcgcttcagaaagcaattgatccgcttcaacgccgtggcggtgcagagacgacgggttgccgaagaagcgctgatttacttgttcataaatttgtaataattcaggatatggttttgttgttgaactattatcaagataaatcatgatctactcctttaaaatgaacgttctttttcatgactgtatatgttatcatatcaacttgtaattgaaaattaaaaataaatgtttgacttctctgatttttaaaatataatagtctttggacttttgtcatattatatcacgaaaataaattgacagaaaatttaaacaaaatgccaggaggttctttttaatgaaaacttcactatccgctaaggaaacgacggcgattgggcttatgctgttcgccctctttttcggagcgggaaatatgatttttcctccccagcttggtcaagctgccggagagaatatttggccggctatcatcggattcttgctgacgggcgttggtcttcctctgctcggcgtcatcgcggttgctttaaaagggagtgcaaaaggcctagctgacaaagcccacccggtcttcggcacgatattaatcgtcagcatttatttaacgatcggacctttatttgccattccgaggacgggaaacgtttcatacgtcatagcggttgagccgtttttaggaaaacattcgtcaagtctttatctgttcatctttaccctgatctttttcgggatcacttatttcttggcgttaaacccaagcaagcttgttgaccgcatcggtaaaattttaacaccgatattattgactgtaatcgcaatcttagtcatcaaagcgtttatcaccccgatgggcagcatcgggtctgtgacagaggcttaccaatccgcaccgctgtttgtcggatttttagaagggtataaaacgatggatgcgatcgcttcaattgtttttggaattgtcgtcattacggcaattaaagaccgcggagtcacaaatccaaagtcaatcgccgcttcatgcatcaaagcggggatagtcgctgcagtcggtctcggactcgtttacgtttcactcgcttatttaggggcgacaagcgttgaaaccgtcggttcgctcgacaacggcggcgaaatattgtccaaagcttccgcatatttgttcggctcgcttggaaatgccgtgctcggcatcgcgatcttgttcgcctgcctgacgacaagcgtaggacttgtttcttcttgcggagagtatttttcaaatctgattccgaagctctcttacaaagcagttgtcatcattgtgacgcttttcagccttgtgattgccaatttcggactgacagaaatcatctcgttttcagtaccgattctgtctgcgatttatccgcttgcgatcgtcgtcgttttgctctcattcattgataagctgtttaatgaacggcgcgaggtctatatcggcacccttatcccgacaggaattctgagcatcatcgacggattaaacgcggcgaaaatcccgctggggccggttaacgatatcttaaaagcgaacatcccgctgttcagcatgggtgtcggctgggtcgttccggctgttatcggcgcagtgatcggttacattgtgacattttttatcgctttgccggaggacaaattaaagaacgtcagctgacctttgcaaaaaacagctctgtttaaaacagggctgtttttttatctttcatttctttagacaaaaaacccggcacacatctttggagagacccaaataaatgagacaaggaaaaaacaccccctgaatcgtattaatacaatatgattcttaggagggtgtttttctatgggcacaagagtacattacgcagaagaagtaaaatgggaagtaattaaaatgaaacaagctggaatgacaaacaaagaaataatggaacaactggggataaaaaataagactcaaattaaaacatggatgcgatggtacaaaacaggccaaacctatcgattttcgcaacaagttggaaaacaatattcctacggtaaagaatcggaggaaatgagtgagctagaagaattaaaactaaagaataaacagctagaggctcaattggcaattataaaaaagtaccaggagatcgaaaggagttggagccacgagtcattgtccaagttgtagaagaactctcagccacttttaaaataattgatattcttggagtattaggcatacctaagtcaacatattaccgttggaaaaagaagtataaaaaagttgagctaacttcattagaagagctagtaatcaagctgtgtaagaaaaacttctatcactatggtcatcgtaaaattaaatccatcttaaacagaaagtatgggataaatgtaaaccgcaaaactgtacaaaaaattatgcaaaagtttgagattcagtgtcaagttaagaagaagcgacaaaagtacatttgtggtgagagtaatattattgtgccgaacactctcaatcgtaattttaaagcaagccgattaaatgaaaaatgggtaaccgacattacctacttaccttatggctcgactatgttatatttatcaacgattatggacttatataacaacgaaatagtggcttacaaaataggtacgagccaagatattaacctagtattagacacattgagggaagctgtagaattacgtaaaccagtagggttacttcttcatagcgaccagggatctgtctatacttcacatgcatatcagaatttggccaaagaaaaaggcattaccacaagcatgtctcgaaaaggaaactgccatgataatgccgtcattgaatcctttcactcctcgctaaagtcggaaggatttaacgctcaaagtagagcatctatatccaattctaaagtagtacaaattgtaaatcaatacatgtatcgatataatcatgtacgaattcaggcaaaattaaactacctgtccccactggaatacaggggacaggcagcataggtgttttttctaagtctcattttaacgggtcagttcatctttacatgccgggtttttgctttattcaggctgcttcgcgtccgcttcaagccgggccactgctccaggcgacgctttttccaccgctctggcggctatgtcgtaagcctcttcatactgatatgcgtaaaaacagttttctgcttctttcagctgttcggaaaggatacggtcctggcttctgaagcggttgccatattgaatgatgcgttcgatcagcaaaaccagttcaaccagttcgtccgtctttgttttcacttccgtgacaagctgttccgcctcttgaagacgttcgttcaccgcatccatgttcagcggcagctcattcaactgttctgtcactttctgcacagtcgtctgcgactgtcggatcttttcggttatggcctccgggatgcctggaacattgcttttctccaggctgcgcgccgtatccttgattgtctgcttcaattgcttgagaagctctcttgcctgaagctcttcttttctcagcatttgcagcatgtccctgtattcgtcatgctcccgttgcgcggcttccatctgcttttcgatatcggcaagctcttcttttaacagcgagtaggcgacatgtttctgatcaagcctttctctcacttgttcgaactgcttttcgatcatttcaaggcgcttttcatatgactgctgcttctccagttcgccggtagtcagtctgtagcctttcttgacgagctcggtttcagcttcggtatcctttttggaggcttcaagcttttccaatgcagcggcaagctcaggcactttgcccaaaatttcctgccctgcttcgacttcatgctcgagctggttatacagcgtctggatcgtttcatcaatgatctgcacgattgcggcggcttcctctaaatcaagctcgtccaaaagcgcatcttcagcgcgcttcaattctttcaaaaggttttcgagctccttctccacttgaatatgatcgagcttataccctttatcgatcatttcctgatagccggctttcaattttgcgatttcctgcggaactgtctgcttgcagctggcaagcagtttcggcacatcgtctatgtatgattgaagctcttcaagcaaacggtcttgggcaagcagcacctttctggcttctatgtaatttccgccttctgtttcctcttcaaactgtttaatgccttcccacacggtatcgaggtcggcttcaattttcgcatagaggtctccgtacaggtggctgtatgccaaaaggtttttccgcacttttgtataacgttcttttacctcttcgatttctttgcggttctgctcttcgcttgagacaagatcggcgatttcctttaagatgtcttcaatgttggactcagccgctgataaaagattctcaatatgcgcgagcacctgtttcgatttttgaaaacggtatttgtcggcgcaatcctcggcttcaaacagaagctcttcgactttgggcatatgcgaggtgacgatttcatcccattcccggcgccatctttcaaagaattcctcagtctgccccgtcattttcagatgcttgatttttgacatctcttccacaatcgaacggttcatgatttcgattttccaagcttctaaacggtcgatctctttatatatattttttctgaataagtagcccgtagcgaataagattaaaaataacgccagtaagccaatgacaaactccataatgagcccccttgctgtttatcttgttctgtcagggtatgatatttgaaattgttatgtaaaaatgaagttaaactatcgttttcattgttcttatgataccatgtaaccaacattttttgagcagaatttttaatttttttacatcaaagtgacaacatctgactatttttttacggggtgacatcatgctgaaacgagacggtcatgttcattctcccttttgtccgcacggatcaaaagacgaattcagatattatatagaagaattgtgcaaaaaaggcttccaatccgtatcctttactgagcacgcgccgcttccgccttcatttattgatccgactccggagaaagacagcgccatgccgatctcccagctgggccgctatattgaacggctgaccgaactgaaggaagaatacagaggacagcttgacattttgatcggtcttgaagtcgattatatccgcgcctttgaacatgaaacgaaagcttttctcgatcagtacggcacacatcttgacgacagcatcctgtccgttcattttttgccggctggatcttcatacatctgtcttgactacgatgaaaaagcgtttcagcagctgatcgactgctacggcagcacagagcaggtttatctcgcctattatgacgaaatctattcttccattgtatcaccgttgggagcatttaagccaaaacgaatcggccacatcacgcttgcgaaaaaatttgtgaagctgtttccgtatacgatgtcggaaagcgttagaaaatcggtctcctcctgtctggatgaagccgcaaaacgcggacttgaacttgactttaatacggccggcctccgcaagccttatgcaggcaacgtctatatggaagaatggatgataaaagaagcggaacaaaaaaacatcccgcttgtctttgggtctgacgcccaccaagcagaggatgccggatttggttacgaacattttgagagccgctttgttaaataacggcggcttgccgacgctctctgtacaacagactgagaagccatgttttgacttccttgtaatacgcctgataaaagtacggctcgtgcggctgtacataaagcacttctgaaatatattgaggctgcagataaggcatcattaaaagcgacttcagctgaatcataaaatgggaaaggggaaaacgggaaaattcgttgtcctcatttcccttttcaatgatcagatggagaatgtacttttctttcgttaaatatgtcgacatcacttcacgattcagtgtggaatcaatcgtgacttcgcgatagacaaaccgagttaattgacgatgttcatgctgatacgatagaatatcaaaaaccaattgaagaaggcaatccgttgcacctgcatcctgaaggcgttcatggcccttttcaaggattcttaaatagccttcataaaaacgggatactaaatgctccattaacccgccttttccattaaaataataggagatgtgggcgacattgacattggctgctcgggcaatttcgcggactgatgttcctgaaaaacctttttggttgaacagttccacggcagattcgatgatcctgtccttcgtggttggagtagcgtttgatcccatcttgtttcaccccttcttacttaaaacaattccacttcaagcggagttgttcctgtaaaaagcgctcgacaaatagcatcacggcaagcgcgtttttgccatttcaaagaaaaagcgagggaaatataatgtttcatgtcgaaaaaacagaaggcagtaaagaaaaaaaatacgagcttctcctcaaacagatcgatgcgctgacagaaggcgaacctgatatgatcgccaatacagcaaacgcttccgctcttttgtatcaatcattggaagacgtcaactgggcgggcttttattttgccaaagacggtgagcttgtgctcgggccgttccagggacttcctgcatgcgtaagaatcccgttcgggaaaggcgtctgcggcaccgcttatacaaacggccgggtcgagcgcgttgaagatgtgaacgcattccccggacacattgcgtgtgatgcagcgtcccaatccgaaatcgtagttccgcttgaagttgacgggagcatcatcggagtgctcgatatcgacagcccgattaaaaaccgcttcgatgaaactgatgagtattatttgaaaaagttcacggagaagcttggagagcgtttaagcgaaaagagccggtaattccggctcttttttaatgtgtcataaacttgtttttcccgttccgctttgcattgtacagcgcgacatccgcttctttaaaaaggtcggataaagatttcggacgatcctgagaccaatgggataccccgcacgaaatcgtcaccgtcggatccgtacattccctgacaagcattatgagcctttcggcaagcatttcaccggcgttcagccttgctttcggcaagtataccgcaagctcttctcctccccaccttgctgcgacatcctgatcgcggatgtttcgctggatcacccgggcgacttgtataagaatatcatcgcctttctgatggccgtacgtatcgttaatctgtttaaaatcatcgatatcgatcaatacgaggacgccgctctcgtccaatttcatactgtacccgattttctcatcgagatggcttctcgagtagagctctgtcaaacggtctgtctgaacaagatacttcagccggtcgcgcagcatcaaattcgatacggcgagcgtggaatgcctgatcagcgtctgaaacagcttaaacatctcaaacgaaaaggagcagacgttttttttcaacacgatgacaaaccctttgttttcattattttccagcatcggaacgcccattaatgaagcatatccttcattcccaaaaagcgaagaaccgtttccgacaaacaccccgttttcctctgatatcttctctttgacatagcggatgtatggaagggcctcatccgtctgaaaaaaactagtgctttccggcagcagggtttcctttcctaagtgatttttataaaaaaagcccacctcttcggcgccgaatgaactgatcagcctttcggacaagctcttcatcatatccggaaggcgtttcgtccggttcagctgatgcgatgtttcattaatcagctccaaatttgaaatcatattctgcgactgttcgtaaagccgtgaattttcaaatgctttccctgccgcattcgaaataatgcatatatccgctgccgtatcggcagcgcctggtccaaaggctttcaaaacgccgtacgttccctgccggcctttaatcggaatgtatacttccgcttcatttttgctcttctcctgtcctgataagtatgcctccaaggcaaaagaatcggtcgattcgctttgcacatccaactctatcgcagggaggttgatgtattgatcctcatcgtatgacaagaaaagacaatacgttaaaaaaggaaacacactccttaagctttcgagcattgtcttcagcacctgctcctgatccatcagctcatgcagcagctccgtcttttcataaatctttgttttcttaagctcatcacgaaataatgcgtcaagctccagacaatgcaccaaaaacagatgaatggattccgcgagacgttctggtaatttatgtttcttttgacatgaaagttctatatatttgctgttttcttctattgttataatggtatgataatcgctcactcgtctgatcggatcaccgtcgcctctcgatccctgcagtcttgaagaaggctgcactgttagagatataaacgaaaaaaatgactctgctgccgcttttagccaggcaacagagtcgtcgtacgagacggccggcttttttaaaaaaaattgaaacagcttttgatgaaaagtcagatataggtcttcagtttgtttattcatggtcatcaccttaaaaaatccgttttttgtattttattttcctgattatatcacaaaaacaggactatatacttataaacagtccgttcctttcgggacgatccatgaatggttgactttgcccggcggacattatataatcttctttgtgtgaaataatgcagcctttttgttctgcttctatgtttcattttgttccttatttattaaggtgtatcgtgtaactctttgctgctggagcgaggatacatgaaaacaaaatggacatggctgaattgaacagatgggttttattttcacaaaaataaaaccaaaggaggagtcacattatggctcgctatacaggtccaagctggaaattatcccgccgtttaggcatctctttaagcggtacgggtaaagaattagaaaaacgtccttacgcaccaggtcctcacggtccgggacagcgtaaaaaactatcagaatatggtttgcaattgcaagaaaagcaaaagcttcgccatatgtacggtgtgaacgaacgccaattccgcaacctttttgacaaagctgcgaaaatggccggtaaacacggtgaaaacttcatgattcttcttgagtcacgtcttgacaacatcgtttaccgtcttggcctggcgcgcactcgccgccaagcacgccaattggtaaaccacggtcacgttcttgttgacggaagccgcgttgacattccgtcttaccaagttaaacctggccaaacgatttcacttcgtgaaaaatctcaaaacctttctgtcgttaaagaagcggttgaagtgaacaactttgttcctgaatacctgacttttgacgctgaaaagcttgaaggttcactaactcgccttccagagcgttctgagcttcctgctgagattaacgaagcgctgatcgttgagttctactctcgttaatagaaaatgctctttaaagagcatgggcaaaaaccctagaattgttgacatcccaacgattctagggttttttgtttactccccgttgattctggctgctgatagatctgatgattcactttcaaatgatatctgtgatcacattcatcctggttcgaaattcgcccgccggaataaaacagacccgcctcataagagtaaggtaccttctcacaagcaaacatctccttttctcctttaaacatcttcggtaaaattaaatcgttggttagacaattgaaagcggaggagtggccgacaaatgcttttgttttttgctaagtttgtcttgttctacgtattctgttcagttgcattcgcccttttcaaagtcatgtactacaatatcagcaaaaaatgggttacaaagacggcggagggcactaaactgaattgggctttgaatgtcttcttaaacacggcaagaaaatggacagcaacgactgctttgttatggggggttttagcgggatggtgtgcgatttatttataaaaagcttccgaaaaaggaccgagatccgtgtcgcgatgcagccacaactgaacttcagcgactgcttttatttagtctcgccgatttgactgttctccggtatcaccatacgatcctcaatcgctgctgagagtgataccgccaaacactcttcggtattgctggcacattgaacaaagctccgatgatattattgaagggttgctcaataaaatcaaaaattcaggtctgcttcagtatataaaaaaaccccaatcgccagatgattttctaacaattgggggccaatttacgatacatttacttttggatttggtccatattgattttcttttgcttcgccagcctgacagtaaaaaataagcagaatgacagcaccgataatcggcaaaaagccaattaaaatccaccagccgcttctcccggtatcatgcagcctgcggacattgacagccaaagaaggcaccaaaacagccaactgataaataaagatgagaatgtatccgaggaaccccccgccatacccaataatatatcctacttgatatctgtcatatccttctgctgtcatgattcctgaaataaataaacttactaccattaatgataagataaataatataaagcatatgatgccgttaaatacatgaaacaaccagtattcctttcgtcttgctctcccttcaaaattcgcataattcttcaagcctctccaataccacttcatacaatttcctccactgccaaatctataaatttgcgaaaaacatatgaattataccataaaatatcattttcgaccatttacttgaagggatgttttgatgcctgttcggaaagaacattttttctatgggctttgagcttacattcatatcataggaaaaacaatataccgtttccatttaaccattgcttctgtataatatgaatcattcatttcgcctccgtagctctagaagggaagagcgccgtaaaacactgtaggaacgggtcgcaaggcaagggtttcagaagcaccgaaaagcaaatagctgagacaggtggaattcctgtcggtgaaagtccgtagggaagcgtgttctcccctagcctatgcttacggaaggagtgcgggttcgaatcccgccggaggcattgattacatctctggtctcgaagaagaattaaaaaacagacagaagttcactgtctgttttttacggctttgacctgtcatatattaaaatgtgtaagattcgccgtcatccggcacaagtacgcgcgaggacattcctttttcctgaatgaagctcttcaattcttttcgtgataaagtccaatggttgacagcctccatatgactggaaatgattgtggccttaggtgcagcttgatagacttcagcaatatcctcttttcccatcacaagagaccctccttcaaagaactgattgtctcctccgttaacgactatgacgtccggctgatgcgcagcgatttcttcccggacaccttcataccaaactgtatcccctgccacatacagcgttttctcctttgagtgtttgaagacaacgccgcacacttctccggcaagctttaatatctctcccctcccatgctcgccttttgttttgattaattgaatcccctcaaaccccgtatcttttgttaagacctctatattttgaaaaccggcttttctcacttcctcagcatctgcttcattttggacaaacagtttgatttctttcggaagcagatctttggcagcatcgtcaaaatgatctaaatgcagatgagtgacgatgactgcgtctgtattcttgacgagctcgtcggttggcacaggcaggctgaccaaagggttgttttgctcttgtcttgctgagttcgggaaaggagggtaagcgcctttttcagccagcatcggatctattaaaaatgttttgcccgcatatttgacggccaatgttgcatttcgaatttgttgaatattcatagttatcatgcctttcctttcatttacgattagtttatactatgaccgatcaacatttaaatagataaaatcaagtctttacagcgtttgacttgatttttgaaaaacgttcatttgagaggatttgatgaaatgctggatcatacagacaagcaaatcatagaggaattatcaaaaaacagccggatgaccatgaaggaattaggagagaaagttcatttgacaggccaggcggcttcagcaagggttgctaaattagaggatcaaggagtgattgaaggttataccatacaagtgaatcaagtgaaactcgggtgttttattcacgcttttatcaatatctatacaaaaagcacttatcataagccttatctttcatttattaaagcacagcagaaatacatcattcataactataaaatcagcggagacggctgttatcttcttgaatgcaagtttccgtcaaatcaacagttggaccaatttttaatagacttaaaccatcatgcaaattataaactgtcgatcgttatcaataaaacgggtgggtaaagagactgccggccgttttattgataaaaaagagggcctctaaagaccctctacttcagccgctttgctgcattttccgtctgattcaattgattgtatccgtcagccgactgctgcacctcttgttttcgttccgtttccagctgcttgtggtaatcttccataaatttctctttggctgcaatgaacaggttcatgctacattcctccctcttcaacgatggaaacgctctacctattacatctatatttttgacatttcctgaatgaacatacatgaaacatgttgacacaaaaaaacccttgccgtttggcaagagtttttttgattacttataagtcagcaggaagtatttctttttaccgcggcgaatgacggtaaactgtccttcgatgcggtcgtcggcggtgaggacgtccgcaacatcggtgcggcgctcgccgttaacgtataccgcgccattcgtgatatcttcgcgcgcctgccgtttagacggagacagctttgattggacgagtatttcaacaagaggaagttcatccgctttctcgacctccagggaaggaacccctttaaagccgacttttacttcttcagctgtcaattgtttgatatctccgctgaacagtgcttttgagatgttgacggcctgctcaaacgcttcacggccgtgtacaagaacggtcacttcttcggcgaggcgcttttgcgcttcgcgtttttcaggcgccgtctctgttttttcagcgagatcttcaatttcttcttttgataagaaagtgaagtattttaagtatttcacgacatccctgtcgtcggtattgatccagaactgataaaactcatacgccgacgttttctctttatcaagccagatcgcgccgccttccgtttttccgaacttcgtgccgtctgcttttgtcacaagcggaatcgtcaatccgaaagcttttgcattctcttcggatttgcggatgagttcgagacctgatgtgatgttgccccactggtcgcttccgccgatctgaagcttgcattcctggtttctgtacaaattcaagaaatcgagagactgcaggatcatgtagctgaattcagtataagatatgcctgtctcgattctggagcttaccgtatccttggcaagcatgtaattgattccgaagtttttgccgacatcgcgcaggaaatcaatgacgttcattttgccgatccagtcatagttgttcgccatgatcgccgggttctcttcagcttcaaaatcaaggaaacgcgaaagctggtttttgattttctgcgaccattcgcggacgatttcttcattgttcagcgtgcgctccgctttctttccgctcggatcgccgataaggcccgtcgccccgcctacgagcgcaatcggacgatgtccggccagctggaagcggcgaagcattaaaatcggcagcaggtggccgatatgcagactgtcagctgtcggatcaaatccggagtataagctgattttctctttatcgagcagttctctcaagcctgcttcatcggtttgctgctgaatcagtcccctgaaggacaaatcatcaagtatgtgtgtcatcatcaattagctccttttttccaaaataaaacgccccttcgcaaaaacgaagggacgataaaaatcgcggtaccaccctgcttaaaagaacgcatggccgcgctcttttcactctcgttgataacggaaaagcttccgttcttctgctacagaaagcccggaaggcttttttcgcaaaagcggttcatgagtgtaattcaaaccatccatatgtgctgattttcaccggccatcagctctctaagacagggaaggatgcgttctactgatctcagtcttcaccttttgaatattcgactaaatcttttttaacataatatttttgcattgtcaatgagacatcagtcttccatcgatgagagatcgcctgccggaaggttcagctcccatgctttcaggacgcgtctcatgatctttccgcttcttgtcttcggcagtttatctttaaattcgatttcccttggcgcggcatgtgcggccaagccttgtttcacgaactgcctgatttcttcttttaacgcatctgacggttcataaccgtccctcaaggcgatgaacgctttaataatttcaccccggacgggatccggtttgccgatgacgcctgcttcagcgacggcctgatgctcaacaagcttgctctcgacttcaaacgggccgacgcgttcgcccgatgtcatgatgacatcgtcgatccgtccctggaaccagaagtacccgtcttcatccatgtaggcggaatctcctgacacataccaatcgcccggcataaaataggagctatatttttcaggattgttccagatcgaatgcatcatcgacggccagccttttttaatggcgagatttcccattctgtaaggaggcagttcatttccctggttgtcgacgattgcagcctctacaccgggaatcggcttgcccattgatcccggtttaatttccatgcacgggtaattgcagatgagctgcgatcctgtttcagtcatccaccaagtatcatgaatccggttgccgaagactttatgcccccacctgatgacttcgggatttaacggctcccctacgcttaaaatatgccgcaaggagcttagattatatttattcacaagatcgtcgcctgcacccatcagcatccggaaagccgttggcgcgctgtaccataccgtcacttccattttttcaatcgtttcgtaccatgcctcaggactgaatctgccgcctacgacaacattcgtagctccattcagccacggaccgaaaatcccgtaaaccgttccggtgacccagccgggatcagcggtgcaccaatagatgtcatcgtcatgcagatcaagaacccatttggctgtttgataatgctggatcattgctttatggacgtggagaaccccttttggcgcgccggtcgaacccgacgtatagtgaagcagcatcccgtcttcctgatccacccattcaatctcaagatcagtgcctgcttccgccgctttcgcgtaataatcaatgacaggtccttcttcctttacgccttctccaacgacaatgattgattcaagatccggaagttcatcggccggcacccgttcaagcaattccggcgtcgtcacgatgaccttcgctccgctgtttgcaagcctgtctttgacggcaccttccataaacgcttcaaataacggcccgacgatcgctcccaatttgatggcgccgagaagaataaaataaagctcgggcgatctcggcataaaaacaaacacacggtctccctttcccacatcggcatgctgctttaagacattcccggctttgttggtttcatttttcatctctctgaaagtgtacttttcttcgcggaccggatctttgtagtaaaatgccactttgtttttcaaatttgactcagcgtggcggtcgatagcttcataagctgcattgatttttcccgttttgtgccatgaaaaatgcttttcggcatccttccagtcaaatgtccggtatgtttcatcatagtctttcaagttgtaatttcccttttctgctggcagcgctttcaatttcatgcccatccccctttgttcgatcatcaaaatatattatagtatagattttttattttctcaatttttaaaaaatactcttctctcctatgaaaacgcttaatattttggtatgttatgtataaaagacttcaactaagatgtaaggcggtggatacgtggagcatcacaaaacttatcatgccaaagaattgcagaccgagaaaggctctgtgctgatagagggccctatcagtcccgaaaaactcgcagaatatgaatttcacgacgagcttacagcctttcgcccatcacaaaaacaacatgaagcattaatcgaaatcgcagggcttcccgaaggacgaatcatcatcgcccgtttccggcaaaccattgtcggctatgtgacatatgtttatccagacccgcttgaaagatggtctgaaggaaacatggaaaatttaatcgagcttggagccatcgaagtcattccggcgttcagaggtcactctgtcgggaagacgctgcttgcggtcagcatgatggatccgcagatggaaaaatatattatcatcacgactgaatattactggcattgggatctaaaggggactaacaaagatgtttgggaatacagaaagatgatggagaagatgatgaatgccggaggacttgtctggtttgcgacagacgatccggaaatcagctcccatcccgccaactgtttaatggcacgcatcggaaaagaggtcagtcaggaatcgatcgagcgttttgacagactcagattccacaatcgttttatgtattaagggagcaaaggggacctgaatatgattgttgaaaaaatcatgaaacgggatgttgtgacactatccagaaccgatacgattgaagaagcgatcaaacgcatgcgaacattccacataaagcaccttcccgtcatcaatgaacggggaacggtcataggcattgtcacggacagggacgtcaaaacagcaagtccgagtatctttgcccaaaacagatctaacgaagatttaaaaaagccggtggaactgatcatgtccaaagaagtgatcaccggtcacccgcttgattttgccgaagaaatatcagccgtcttttttgaacacgaaatcggctgcctcccgatcgtaaaaaacggaaagcttgtcggcatcgtgacaaaatccgatttgctgcatacgttcgttcagctgacaggagcccattttccaggctcccaaatcgaaattaaaaccgatcatatcgcccgaagcctcgctgatatcagcgccatcttcagcaggcgccaaatcgccatattgagcgtgctcgtatatcccggtgatgaagatgattcgaaaatactcgtgtttcgcgttcaaacgatgaatcccgcctctatcatcaaagacgtaaaatccaaagggtatcaggttctttggccggctgttcaaagggatttgccatgaaggacagcgtatttattttttctccctcatatcaaacctatcaatttcatcaagaccacccgtttaatcagctgcgagtctatgtaacatacgatcttttgaacacggtcggcgcatttgaaccgggagaaacgattgccccgcgcgcagcgacagaaaccgagctcgagcttgttcacacgggcgattatatcagggccgtccagcttgcaggggcgggaaagctcccggcagccgaaagcgaaaactacgggcttggaacggaggatacccctgtttttgccgggatgcatgaagccgcctcccttttggtaggcggaacgctgacggctgcagactatgtcatgacgggcaaagctagacacgccctcaatcttggaggcgggcttcaccacgggttcagaggaagggcttcaggcttttgcgtctataatgacagttcagttgtgatacgttacttgcagaaaaaatatcatgcgaaagttttatatattgatacagacgcccatcacggcgacggggtgcagtttacgttctatgatgatccttccgtctgcaccgtctcgatacatgaaacaggccgctacctattcccgggaacggggcaggttcaggaaagaggtcatggcgaaggctacggctatgcttttaatatcccgctcgatgccttcacagaagatgagtcttttcttgattcctaccggacggctgtttctgaaatagccgagtttttcaaaccggatgtcattttgtcgcaaaacggagctgacgcacattactacgatccgctgacacacttgtgcacgacgatgaagatttacgaagagattccaaagctcgctcacgaacttgcacacacctattgcagcggaagatggatcgctgtcggcggaggcggctacgacatttggcgcgtcgtaccgagggcatgggcaagaatctggcttgaaatgaaagggatggaaccagaggagaaaatgcctgaaaaatggctgaaaaaatgggggaaacaggcatctgtccggcttcctgccaactggtccgacccggaagatttgtatcctccaattccaagaaaaaccgaaataacggaaaaaaacgcacaaaccgttgccaaagccctttatccgattcgctctgcccagcgtaccacttaatatgaaaattgcggcacacagaaaaggccttgcttttgtgcaagaccttgctttcttctcattattgttttgcgatgacaatctcgacgcgcctgttttccttcatatggctctcagtgcggttgtccctgaccggttttgtatccgcataaccgatggcaagaaaacgcgacgagtcgagcttttccttcgacgtaaagtagccgatcacagtgctcgcccttgctgcagaaagctcccaattggatggaaaacggtaagtcgaaatcgggcggctgtccgtatgcccctccacacgaatcgggttggacaccgatttgagaaggacggcgattttatgcaaaagcgggtgagcttggtctttcagatccgctttccctgaatcaaacaaaaccgcttcctgaaggacgagaatgacgccccgttcgtcacgcttggccgcaatcaaacttgacagttcgtttttttcaatatagtcattgattttctttaataaatcatcttggcttttagccgttttttcagccttctgatcgcccgcgtcttttttcaactctgcggcggatttgccgtcggccctgtcttgaaatgaaccgactgctgctttgaatttgtttaaatcgatttgcgacatcgaaaacagtaaaataaagaacacgaggatgagcgtaatcaaatccgaaaacgtgatgatccagtttggcgatttgcggccctgctcgcgcttccttcgttcatgtctaagcttcatgaggcctgtccttttgtttcatgcggtccgcccgcttttttgtccattcttcttttgaactgaaaacgacaagctgactttcaagatttcgcggatttcttcccgattggatgccgatgatgccttcgatcatgacttgcttcttaaagatttcattctccgtcttttcttcaagcttcgcggcgatcggtataaacagcatgttggctaaaagtgatccgtaaagcgtcgtcaaaagggcgattgccatattcggaccgagcgtttccggcttgttcaggtttttgagcatcatgacgagaccgacaagcgttccgatcattccccatgcaggcgcaaattctcctgctttttcaaagatccttctcccctttctgtgtcgttcttccatcgcggcaatttccgagttcatcacattgcggatcgtctcctcatcccatccgtcgatggcaaggagcaggccttttttcaaaaacgggtctttcatttcattgacattggcgtccaatgataaaattccttgtttgcgcgcctgttcagacaggctgacaaaggttttgaccaattcgcgcacatcatcttcctccgaaataaagacctgcttcagcacagccggcgctctttttaaatctttcggggaaaagctgatgaatacagctgcacacaatccacccgtcacaataaaaaaagacgtcaaatcgataaacgaataaaaaccggaaagccccgctccagagacaacgccgagcactaaaatgaaaatacccagaataaaaccgaccggtgtcagataatcaaatcgtttcattttttcataatctctccagctcaaggaaaagaaagcaagcaattcacgaaaaaagctgtgaacacttgctttctttctcgtttatttaatgatgatcattttgttgattgtctgagttcaatgcgatgcggcagctggacaatatgctcttcgacttcctctttgttcatcagctttgtcagaagcctcatcgccacggcaccgatatcatacgtaggctggacgacagtcgacagctgcggccgaaccattaatgaaagccttgtattgtcaaaaccgatcacttcaaggtcatccggaacagccagtcctttatcctgtgctgcgtgaataacgccgagcgccatttcgtctgtcgctgacaggacggctgtcggtttttcatccagcttcattaaagcctccagcgcttccattcctgaatcgtacgtataatcgccttctacaacatactcttccttaaattgcagccccttatccccaagcgctcttttaaagccttgcagttttttcgcttgattaaccggttcagccataggtcctgagacgaacgcaaggcgcttatggcctttctcaatcagcatggttgccgcatcataaatcgcctgttcataatcgatcgcaaccgacggcgtttcccctttttcttcaacagatgccgcaagcacgatcggaactggcgatcgcttaaattcctccacatgctcttcagtcacatttccgctcataaagacgataccgtcaacttgctttcctagcatcgtattcaaaagatgaagttctttgtccatattctggtcggaattgctcaaaataatattgtacttgtacatcgttgcgatatcttcgattcccctcgccagctctgaataaaagatactggaaatatcgggaatgatcacgccgacagtcgtcgtctttttgcttgccagccctcttgccacggcgtttggacgatagccaagacgctcgatcgcttcaagcaccttctttctcgtcgtcggcttgacattcggattcccgttgacgacccgggaaacggttgccatacttacatttgcttcgcgtgctacatcatatattgtcacattactcatttttaccactccttcaactgggtacacttttcttttcctatagcataaacattttcatgtagagaaatgtcaaaatgtaaaactttatgtaaaataaacagaacaccagtttacattatttttcataacctgccaaaacaaaaggggctctctgaaattatacacggttttacctaatatgaaaacgttccctttatttttataattaatttaaataagaataaacagctttttacttaaaaataagaaattttttcgacaatttttgatgacaacgtaaaaaaaggaccgctcgcgagcggtccataaacaaatcttatgcttttacttgaacgagcggcttcagttcatttaaccatttttcaaatgtcgggatatccatttgctgagctgagtcggaaagcgcgacagaaggatcaggatggacctcggccatgacaccgtcagctccgatcgcaagcgctgcttttgctgtcggaagaagcaggtcgcggcgtccggttgaatgagtgacatccacgaatacaggaaggtgagtttcctgcttcaggatcggcacagctgagatatcaagcgtatttctagtcgctgtttcatacgttctgattccgcgttcacaaaggatgatttgatcattgccctgcgacatgatgtactccgctgcattgatgaattccttcagcgttgcggcaagtccgcgcttcagcagaaccggcttcttcactgaaccggccgcttttaagagctcgaagttctgcatgttgcgggcgccgatttggatgacatcgatgtaatcaatggcttcttcaatatgctgcggattcacgatctcactgatgacggccagatcatactcatcagcaacacgctttaagatttgcaggccttccacgccgaggccttggaagtcgtacgggcttgtacgcggtttgaaagctccgccgcgaagcagtttcaagccttgctttttagctgccgctgcgacttccgctacttgttcgtagctttcaaccgcacacggaccgacgataaatctttgttctccgtcgccgattttttcgcctttcagatcaacgattgtattttcaggctttttcttgcgggaaacgagcagcgctttgctgtgatcgtcttcctgcagttcaagcccggctttgaaaatctctttgaagatatgctggatcgtcgagttttcaaacggtccgtcgttattttcaataatttcgttcagcatcgctctttctctgacaggatcgtagcggttgatgccttgtgcttccttcgcttttccaatctcctgaacgattcttcctcgctcgttaatcagctttaatatttgcaagtttaattcattcgcctgctgcctcagcaaatcaagttcagtgttgctcatggtaatccatcctttcttttaacttcaccctctatgaaaataagaatgattcaattgattagggtttattataaacaatgtttcttaaaatgtcacgaaaaaattctttattacccaaacgcttttaagtgataaagcattatatgcagtttatcccttgctgtgcgggtgtttatcggaagaataaaaaaaagaatcatgtttgattctttaacttgataacctgtatattctctgtattgcggtttcgacgctaaaaaccctgtcattcaaggcagccgccttatcatcggcatgttcgacaatgttctccgtaaattgtccgatgttctcgatgatcgttttcgggagcctctcctgccctcttttcagttcatctatatctgtttcaagccgattcagccgcttgtccattgcgtttaagcggttttctactttgtttaagcgcccgtctatttctttgaagcgcttgtcgattgcgttaaagcgcttatctacttcaacgaagcgtgcgtccacttcatcgaagcgcttgtctatctcaacgaagcgtgcgtcgattttgtctaagcgcttgtcgattccatcaaggcgctgattgatcggactcaattcttcttttagaacggattgaagcatgtactttaattcagtgttcaactgatcacctcccgttttattaattataacgcacaccaatggatcaaacgatacattttcctaaaaaggcatttccatgaggcaaaagcatcataacaacatagaaaacggccaaaacgctatacgtcttggccgtttttagcagcggattatctgctgttttccgcaagtgcttgtgcggtaatttgcgaatgggaggcatgccatttcacattcccgtttgtaaaaatgaaggcttgaggactttcgtgcttaatcccgtattgctcagcgatatagtttgacagcgggcggctttcctgcacttttaaataataagccggtatgtcttcatgctgattggcgaatgattcgaattcttcaaacgcgcgcctgctgatcgggcatgtcacgctgtgtttcaaaaagataaatgtatcattgttttctgcaagccttttaaattcatcctctgtttgaatgagctgtttcgacacggtgatctccctttccacagttatttctgagcggtatctgctgttttccttgcttcatcttctatttcatttttggcttcttcagcctgttcttcgattgcagacgatgcttcttcctttagttcaccagctttttcggcacccttgcttcgcaagtctttgactttatccataatctgtgaagactggtcggcaacaagctgtgaaatcgaagatgtcttctctttggcgatgctgacgtactcagagcctctctccctcgcttcgcttgtgagctttccggtcttatcctttaaaacgacggcctgatttccaaggtcatcgcgaagctctttccccgacttcggcgctaaaaataaagctgcagccgccccgatgattccgcctacaaacgtgccgattaaaaaatccttagtattcattccgtctttactcatttattattcctccctcatcttcttttgtttccatctattccaaatttccaaagctgcattgctccagctgacaacttgagaaattttttcacggttttgctctgcggctgatgtgacggactgtgaaacctgctgaatggagttgttaaactgcctgaccgatgtgccgacttcctgaacggcatccacgaccgtattcagcttcaaagatttttcctgaatatcatcagcgagccgattcgtcttattcaggagctccgttgtttcagcggtgatgcctttcatttgtccttccacaccttccagcgttgatgcaacatgattaagtgtgacttgaagcgattttaatgtttttgataaatagataaccaaaataagaaagctaacagcgatgagtgcagcgcttaaatacagaataataatcatcttatcctccttcagctaagggcttacaattgatgtatacccaattgtttaaatcgtaaacctctatatttactttttctatacgcacgggtgaattcctttaacagaaactcccgcttcatatgtacaaaaaagcagcggattgactcacactgcctttttcttgttatgctaatacattttcatatgctcttaaatacttttgaatgtcacctgcgcccatgaaaattaacaccgcattttcatgctcctttaaaattgatgtgtcattttcatcgatcagcttcgcctgcggaattttctcctgcaaatcaccgatcgtcagctttcctgcgttttcccgggcagatccgaatatatcgcaaagatatacataatcggctttcttgaggctttcggcaaactcattcaggaatgactgcgtgcgcgtaaatgtatgcggttgaaatactgcaacaatgtcccgttccggatacttctgtctggctgcttcaatcgtcaccgtgatttcagtcggatggtgggcataatcgtcaatcagcacttggctgccggcatgtttttcgttaaatctgcgtttaacgccgccaaaggtttgcaatccttctttaatgatgtcgacatcgacctgttcataatggcagagggcgatgacggccaaagcgttcagaacgttatggctgccgtatgccggtatatagaaagtgtcgtagaatgtgttcctgacgaaaacatcgaacgttgtgccctcagtatttttgatgacatttctcgcctgaaaatcgtttttctcggcaaagccgtagtatacgactggaacgttcgcatggattttcatcaaatactcgtcgtcaccgcatgcgataattcccttgttcacctgtaatgccatcgtctgaaatgcatcaaatacatcatcgatattcgcgaaataatcgggatgatcaaaatcaatatttgtcatgattgcataatcgggctgatagctcagaaaatgccttctgtattcacaggcttcaagcacaaagtactcgctgttttcgcagccttttccagttccgtctccaatcagataagaagtcggttttgcttttttgatgacatgtgacaaaaggcccgtcgttgacgttttgccgtgtgcccctgttacggcaatgctcgtaaacttcttcagataatcgccgagaaatttatgataccgcacgactggcaggccttcagcttgcgctttttcaatttcgggatgagtgtcgggaaaagcatttccggcaataacagtcattcccggcttgatattttccggatcaaacggataaatcgggatatttctctcctctaaagcggtttgtgtaaaaatgtacttttcgatatccgatccttggacattatatccattatcatggagaatttgggcaagcggactcatacctgtcccttttattccgacaaaatgataaacagtcataatagtacctccaacaaacgtctatctgcttcccagtatatgacgcttatttcaatttgcaacctaaagcccggccgcatcggtgtcttcaaagtcataattatattcaggttcaggcattttcaagagcgaataaacctcctgcggaaaggatttttttgacccctttcacggaagtgctcttaaaaacggattaaaacgccgctggcggcgctttaatatacggcgctctaaaaaaacacgcccatcagctatcataccatgtttagccgaaaagtgaactactttctattaactgttccagatcagcctttgtaatcaggacttctctcggcttgctccctttcgcttcagaaatcatgccttccctttccatcatatcgattaatctggcagctctgttatagccgatgcggaagcgccgctgcaggcttgaagtgctggcgctgttttgttccacggcaaattcgcacgcttcaagaaacagttcatcgtggtcaaatccggccggattttgtctgaccaattgttcctgttcaaataaatagttcggctcctgctgccgtctgacatgtgaaacgacacgatcaatctcccggtcggacacaaagttgccttgcaggcggaccggtttgcctgaaccattctccaagaacagcatatccccttttccaagaagcttttcagctcccgccatatcgataattgttcttgaatcgacagcgcttgaaacagaaaacgctattcttgttgggatattggctttaatcaagccggtaatgacatcaactgaaggccgctgcgtcgcaatcagaagatggatgccgcacgctcttgctttttgtgcgattcggcagatgctctcttccacttcattcggagcgaccatcattaaatcggcaagttcatcaatcacgacaacaagataaggaagtttttcacccatgttctgttcccggactttttcattaaaacgctcaatttcccgaacaccggaatgagcaaataattcatagcgccgttccatttcctcgacaacccattttaatgcggcggttgccgcttttgcatctgtgatgacaggactgacgagatgaggaatattattatacggagcaagctccaccatcttaggatcgataagcagaagctttacatccctaggcgacgctttaaacagcaggcttactaagatcgtgttgatgcatacgctttttcctgatcccgtagccccggcaatcaaaccgtggggcatttttttcagatcagccacgacgggctttccggatatgtcgagtccgagagctgctgtcagaggagacggattcgttctaaattccgaacttctgatcatttcgcgtaaataaaccattttgctgtgcagattcggcacttcaattccgatcgtattttttcccgggatcggtgcctcgatccgaatatctttcgctgacaggctgagtttaatatcatctgacagatttgtaattttgttgactttcactccgggttcaggatgaacttcaaatcttgtcacagaaggcccttgggtgacatgaacgacatttgctttaacattgaagttctcaagcgtgacgtccaacagctcccgctgctcgtgtatccagtcctgatcatcctgcttttgcgccggcggcacatcaagcaaagacatattcgggaactgatacccttgaggcgctttttctttttgtttatctgaggcaaacatcatgacattaaacggaacagagcctttcttcgatcccggagcggctcctgcttcccgcttccgcggagcttccggccgatcctcgtttatccttgtagtctcccggttctcttgcctgctttcgggttcacccgcgcttggcgctgccgtttccggtgaacatgacgcctgctcttgtctccagccagtctggcggcttccgcttgtttcttcaagagcgtcagccggggtgtttgaatctgtcctatgggaagattcatcgctctggacggttatttcagaggcgcggccatgagtgtgcggctcttccggaactgaagcttccgggtcgggatgcgttttgcccgaaccgtaagtcttcccttgttcttccgtggcggcttctgcgtcctctgccagtaccatctcttctccggtttcctcaatcttatccaaaagcttttcgatttgttccggtgtttgctcagcggggattgcgtcttcctccgttatgttttgtgatgcggaggcggtctcttctacagcttcatttcgcagcgctttttcctctgcgagtcccgcgccttctgtcattcgctctggacggacttccgtttcttccggaatatgcactgacacaggtgcttctgttcgttcggattcatgccgcagcgctttttcctctgcgagtcccgcgccttctgtcattcgctctggacggatttccgtttcttttggaatctccgtggatgcctgcgggacatcttcgaattcggcgcgcaatgcaggattgcggctctcgcttttgatcagcggacggccgttcttttcagtttgcacggaagcttcttctcgtaccggctgcttatgttctgcagacttctgctctttttcaatttcttcgttaaacagcgtgacacgcgcttcagtttgtttttttgcacgatatgtatgattttccggcttggctcttttctgctcatgaaagccgtaaaccggtgatgggatgacggacggcctaaaaggttttttcgccgccgctttctcttcataatgatatgaattgccgggtttcggctgagaagctgaatatcggctcgccgggcggcgggtcctttgttcgcggctgtcgtccttttcccgcggccgcgtgttttgatcaggtataaccggaaagcggaatttcccttttggatattcatatacgacttttgcgtcggttatttgcggcatctcttcgtcctctgaagatgaatccgcctcaaattcgtctatgtgctttttttgtttttcattatcttcatcatcgcctaaaaacaggctgaacattttattaaaccagctcatgaatcatcactctctaactcccttaaatttttcggggacggttttaagtataccactgcttccccacccagaaaaggacaagtccttctccaagcgtccgccctccgaataaaaaagccgccaagtttgtctacccagcggcttctttttacatctattcgaaagttttgttcattttatgccgttaaaatgtaaaggcttctcctgctttacggccgtcgtcaagaacaagaatgcctttttccttcggcgcgtctgggagattcagctccttggcagaacaaatcatgccgcttgacgccactccgcgaagttccgcatctttaatgatcataccgctaggcatcacggcgccgactttggcaacgacgactttttggccggcttcaacattgggagctccgcagacgatttgcagcgtctcgctccctacattcactttgcaaacacttaatttatcggcattcggatgcttttctttttcttcaacatatccgaccacaaacttcggagaaaggtcgacggtcagctcgtctttcaaaccgttgcggaccagaatttcattcacatcctggacaaaggattcggaaagcgcaatagctccgctttcctcaatgctcaaatatgaggaggcattaaaaatgttatagcctgctgtttcctttgtgtctttatgaaaaattttcacgacgtctccgtaccgctcaaaagcgatctcttcacgtggaatatcgttcaatgagatgagcagcgtatcgcctacgccttctggattataaaatgcgttcatgagaaaaattcctttctatcatttctttttagggcggtttttagccagaataaagatcggttcaagctttccatcctcatacaggaaagaaagcgcagtgatcggcactgtgccgtttgcaaaaaagctcatcgacatttgcccgagtatatcgtatccggcattattgcggatgtcggcaataatcagcacatcctggtgcggaattgacacggcgagggtcccttccgcgtttttctcatactctgcgagaatcgattcgttcaacaccctgctggcgtcatagccgtcattcgctctgaaaaagtagaagtgattgcctgcgacttcgtcttcttttacaacggtctggagcgagcgaaggttaaaggaagctgtttcccgaatcctttcttttgtccagccctctttttcaagcattttttcgtcgatcagacggtatgtgttgccaaggtcgagcgcatagtaaattcgtgtttcagccgtgtggccgtcaaaaaccaagggaacgcctgcgctggacttctcgggaaaggaagttgagcggatgacgggatagatcaggctttcccgtccttccatttcctgcgactggcctttcatggcgttgagcgcttcctcagtataatagacgacttcgtcaatcgcatcatcttttttctgctcccatttcgcgatgatccccgggagctcgagtgtaatgccttttccagtgtttttatcttcgattctcaagctgtccttttccctgtcgaaatgaaaggaccagctgtcattttgcaaacgtttttttaatatatcggaaagtttccttgaggtcattttcatagaggaactctcctttcggctacttattcagtgaatcggtcaaaaattgctcgatttcctctttcgttttccggtctttgctgacaaagcggctgatttcgtttccttctttaaatacgaggaagcttgggattccgaaaatatcccactccgcgcacgtgtctataaatttgtcgcggtcaacataatagaatgtaaattccggatagttcgcttcaagctcgggcaaaaaaggttctacaaaacggcagtccggacaccagtcagccgaaaacatcaacaaggataaatcgtctttcacaactttttgcaattcttcattcgtctcgatcgttttcatcactcaacgcctccaatataagttcttatcatccattcggatcataccagactgccggctctatagccagccttttgctgcctgccggcttttttaaaagatggacgattcttatgtatcttacccgttttaaaaagggaaaatcttaaggatccgaacctctttcatatcataagcataatttttttgctttatcaagccattctcgtttaacattataagtaatagggtaaaaatatccgttaaggcgcctcgcgccgtgatcccatgacagtcaggaggagcatgtatggaatttatcgtttatcttgccggagaaatacatagcaattggcgcgaagaggtgaaggaaaaagcaaaatcgctcaagctgccgatcacatttgtcggaccgatggaaaatcacgagcgctccgacaacatcggtgaagaaattatgggcaagcaggctgattcaatcgcaaaggatgatgcagcctcggatttgaacaattttagaacttccgttttaatgaacaaggcggatgttgtcatcgctcttttcggggaaaaatacaagcaatggaacacggcaatggatgcatcatacgcgatcgccaaaggcaaaccgctgatcatcatccgacccgaatcactccatcatccgttaaaagaactgtcaaacaaagcgaacattactgtggaaactgtaaatcaggcaattaaatcgttgtcatacgtatttgaaagccggtagttgtttttccaaaaagaaaccctgggcgttaagcagcacagggtttctttgttcactcatttcgcaaaatcgactggacggcagaactgtcgcaagctttgacaagcttgatcagcaattcttttgcagcaaggtagtcatcaacgtggataatggaagcagatgtatggatgtatcttgaacaaatgccaatcacggccgaaggaacgccttcatttgagatgtgaacacggccggcgtcggttcctcccggagaaacaaaatattgatacgggatgtcatttgtctctgccgtatccagcacaaaatttctcatttcgctgtccatcaccatggtccggtcgaaaatcctcaacagcactcctttgccaagctggccaaattgatttttgtcgccgctcgaatcgtttgccggacttgcatcaagcgcgaaaaacaagtcaggctgtatcatattggccgcagtttgcgcgcctcttgttccgagctcttcctggacggtcgcacctgagtaaagattgttcggaagttctgttccttgcagttctttcagcaattcaatgctgagtccgcagccgtagcggttatcccatgctttcgcaaggatcttcttttcatttgccatcggggtaaacggacagatcggtacgatttgctggcctggtttgacaccgatgcgttcggcatcttccctgtcatccgccccgatatcaatcatcatgtttttgatatccatcggacgtctcctctgctcatctgtcaaaagatgaggaggcgtgctcgcgatgacgccggggatcggtccgttgtccgtgtggatttccacccgctgggccaataaaacctgactccaccagccgcccagcgtttgaaaccgaagcaggccgttatctgtaattgatgtgaccataaaccccacttcatccatatggccggccaccataatttttggactgccttcaggtccatgtttaacgccgaacacgcttccaagtctgtcctggatgatctcatcagcatatttttcaagctcttttttcatgaagcgacggacaagatgttcgtttcccggggcgccggggagctccgtaagcgtttgaaaaagcgttctcgtttcctgattcatctgtttccctcttttcttatgtatctctctacattttacataagtgtgcgatgtgtttccagaagagagcccatccttaacacggacggacatgttctgtataatgaaaaaaacaagctttggaggtgctgaaaggatgaaactgcgccactttcttattggagccggcatcggcattgccgcggccgtcgttgtcaaacaatatgtcatgcagccttacatttcttctgaaaaagcgctgcgcatcgtcaagtccgcttttaaacagagaggcccgatcgacggttcatggatatataccgttccggaagcctataccgtaaacggcgaaaccgtcatggtgtacaaaacaggcattacgcgttccgctttccgagagctcgaacagtacgaagtcatggttgatgcaaaaacaggcatgatcgtagatgtaattgatacagcagcatagcatcaaaaaagatgcggccatcagggccgcatctttttatatggcgcgaatcggccggtagaccggatgccacatcgcatcctgcaccgcctgaatcacatcgtccggctcgttttctgcaactccgtcttctatggctgctttgatgacagccgttgccacggttgcggaaaccgtgcgcaaatcctcaacttccggaagaagcgcggcgccgggccggcccgtatcaaccatacccgcgatcgcagccgcgctggcgtaaaacatgttgtccgtaatcagtcttgcttttgatacgagcgttccgagcccaaggccggggaatacaaaggcattattcgcctggccgatcgcataacgggtgccgctgtattccacaggcgcaaacgggcttcctgtggcgacgagcgcccgcccttccgtccaattgatcaaatcttcaggccttgcttcagataacggcgtcggattggacatcgggaatatagccggccgtttcacatgctttgccatttcttttacaatttcctctgtaaatgcgcccgataccgtcgaggttccaatcaaaatggtaggctgcactcttttaaccacctcgagcagatcaattgcatcccccgggccgttccggctgaagtcttttacctcgtcagcaggccttgcatacggttgttgaatgtcctgcaagtcgttcatatcatctgtcagcaaaccgttccgatcaacacaccaaaaacggcggtatgattcctcttccgacactccctcttgaacgagtgcggcgcgaatttgctcagcattgccgattccggccgtccccgctccaaatatgaccactttatgatccttcagcggcatttttgatattttaacggccgcaagcaccgctgcgagggtaacagctcctgtgccttgaatgtcatcattaaaggtgcaaattttgtctttgtattttttcaaaatctgacgcgcgttctgcgttccgaaatcttcccagtgcagcaaaacgcccggaaacgtctcggttgcgatttgaacgtattgatcaataaacgattcataacgctcgcccctgatcctcgaatgctgattcccgacataaagcggatcgttcagaagcctttcctggttcgtccccgcatcaatgactactggcaggaccctgttaggatcgatgcccgcagctgcagtataaacagcaagctttccgatcgaaatggcgatgccgccgactccccaatccccgattccgagaattccttcagcatcagtggccacgatcaaatcgatccggcttcttttagcggccagattttcaaatgccgttttcatgccttcagggtcattaaccgacaaaaacagcccccgcggctttctgtattcatggctgtattgctgtattgccgttccgacagtcggggtatagacaatcggcagcatttctgtcatatggtcgttcagaagcctgtagaacagcacttcatttcgatcatgaagcgccgttaaatagacgtttttgctcaaatcatcaggctgtgattggaactgtttatacgcccgttttgcctgttcttcaagcgtcagcaccttgggaggaagcaatcctgtcaagccgagagcatccctttcctccggagggaaggcaacccctttgttcaacaggggagtcgcaaggacttcaaatcctcttaaccgcgtctcgatcacttgttcatttaatttattgtggctcacccgtcgtcttcctttcaaaagttagttacccttagaatggataacaacaaagcaaaccattcaccaaaatagctagcggctttctctttttactgactctgcaatatcgccgttttcatcccattttaatgctctgtaaagggcatcgtggtaaaaaatgtaccaggcgtttttctcggcggccttcgcctgccatgcttgcttcgcggcaatcgatgtcatcggataatcgtcgtacgccagcacccagagaggattttgatgggcgtgcgtcggcataatgtcagccatatgaagggccgtttcaccggcatcttcgagaacgatcacggaatggccgtcgctgtggccgcctgtatgatgcatcgtgattccgggcaaaacttcaagcttctcgtcgaaggttctcacttgatgctgaaccgcttcccagttctctttccaatatgtatttttggagcggatattcgggtttctcatctcttcccattcgattgcagacgtgtaaatcgccgcatttggaaacacggaaacaaggctttctccctcatagcgcgtcaatccgcatgcatggtcaaaatggagatgagtcatcaaaacggctttgatatcttccgttgagagcccgagtgcttttaacgagtcatcaattgacgattcttcggtgactccgtaatttcgtttttgcttatccgtcagtttgccgagcccgataccggaatcgatcagcaggttcgtgccgtctttctgaactagtataggatctgttctaagttcgatttgatttttctcattggcgtaatacttttttgaccaaagcggcttgggaacaacgccgaacatggcgcctccgtccatgtgcgtgacgcctccgttcagccatgtcagcttgattcgtccgattgttaaagtttccatgatcatccctcctcttcctatcgtagcaaaaaatgcaacctgaatcagcttcatttgaaagcaaaaaaacagactgcaggaagcagtctgtttttttatgttcgccattcagcttcgactctgtagatcggctggcctttagcggcgaacttttcttcgtattcggtcatcacatttccttcaaaatcgctttgatgcaggtcaaggctgacgaatgtcaaaacgagtccgtattcggaaaaactggtgagggagtactcaaacaacccgcggttatcggttttaaaatgaatcgctcccttgcctccgagcacctgctcatactttttcaagaacgcatgattggtaagacggcgcttttcatggcgctttttcggccacgggtcggaaaaattcaaatagacccggtcgacttccccgtctgcaaaaacgtctgaaagcatattggcattgatgttcaagagctttacattcggcgcctctgtctgctttactttatcaacagcggttacgatgacgcttttaaatagttcgattccgatatagtttacatccgggttttgcagggccattcctgaaataaattgcccttttccggttcctacttcgatgtggatcgggttgtcatttccaaaaacggaatgccatttccctttgtattgagacggctcgctgatcacaatatgagagttttcagccaggtagtcatccgcccatggcttgtgacgcattcgcatgtacttacacctctatctgttatatcgtcttacaacataccatgaaacgcaggaatcccgcaaggcctcttccaaagcaaaaaagaccgaagatcggcctccgggtctttcgcgtataaattacagctttctgaacattttaatccatatactccgagaatgaagggaagtgccaatattatgggcttaaatcagcaaaatcagattcatctattaaaagacattctctcagaccatcaagcagactgcaccggaaccgtcgctgaatgcgaacagatggagcggattatcaagtctttaatggcaaacacgaatcttgacgccggcttgaaaggcgttttggaagacatttatttgtacagccagaagggaagatcttccgcttcgatcaacaaccacattcaggagcaccaggattatctcacgcaatgggtggaagatatcgactcattttcatgaggacctggcgagacgctccattaattcatgcagctgttccagcccctggtgaaagccttcctgattgcctttcgctttttgccagagtgtcgtcattgctttttccgccaatacgtaccaggccattctcagcctgagattgtctgtaagagaagagccgtagcgttcgagccagcttccccattcccgctcttcaacgtaatgataaagaagcggccccagatcgatcgcggggtctgcaatcatcgctccatcccaatcgattaaataaagctggttctgatctgtaagaagccaattattatgattgacatcgcagtgacagacgaccttttctccggactgtacatcttcaagatggtgctccagatacaaaagggcctggtccagctgcggtatcggatattgccgggcctggataaactgcttcaattgagtgattacagagcttggctgaaaaggctgtttgccgagtctcttcagcatatccaaaagctctttggagctgtgaattttccgaagcatctcagccaccgcctggctgttcatatccttcggcttcagctctcttcccttgagccagtgctgtgccgtaatcacatccccgttttccattcgttttgtccaaacgagcttaggaacaattccttccgcggacaggacagccaaaaaaggagagctgttgcgctttaaaaaaagctgctgtccattatgttctgcataatatgcgtctcctgtagctcctcctgcgggggaaatctcccattcgctacctagtaattgtcccaaccagttcatatcgattttcaacccatcatttcattaaaagattttaaaaagcatctgccccctagagcgggcagcaaactgcttgtattgtcgtctctttatattcaaataaaaagacggctattgagagtcatttgtgctaaacaatagccgtcttttaaattttagcgctagacgccaaacttcgtcaagcaaaactaaaaaatcccttttggttcgtataaaacataggtcccgatgccgttcagccgaagccttttttccgcttgaaccttcccattgaagaacgtaaaaggatcgcagtgcagcaagtactgtttctgatcgggcagcttaagcgtctccttttttgcaaacggacaatgcaccactatgatttcgttccagggatcaattgctgcaatgttcttcagcttgtaggccgttacctctcctgtaccgtccataaaagaaagatgctccttgacttcttcctctttttgcagacgaaaagcgggatggcttcttcgcagccggatcagctggcgcacatattcgacatcctcgcaaagctccgcacgcttttcccaatcaagcttattgatgtcatctccggacctgtagctgttgctgtccccattctttgttcggcaaaattcctgcccggcgtgaagaaatggaacgccttgcgaaagcaggacgatcgacaccgcgagcctttgcctaagccgtttagtgtccgcatcttcttcaaaacataaggccattttatcccaaaatgtatgattgtcatggcattccacataattgattgactgtgccggctgcaagaatccgggtgaaccggcaataccgtgctgaagcgccgctttttttccggtgtcccctaaagcatatccgcggtcgctaagctcgaatgtactccctttgactgcgttcctgaaccgatcattaaaaaagccgaccgccggaacttttccggcattttgcaatgttgctttttgcccgctgtcaagcggggtatttaaatcccagccctctccgaacagaggcacgcccggctttacattctcggcaagcgtactgatttggcggacggtttcaatatcaagaatgcccattaaatcaaaacgaatgccgtcgacatcatattcttccagccaatagcggacagaatcgagaatatattttcgcaccatcagccgctcagaagcaatatcatttccgacgcctgttccgtcggatggaaaaccgtattcattatgtctgaaaaaatacccgggaaccgttttttcaaaaggggacgtttccctcttgtacacatgattatatacggcatccataatcacggagaagccgtgtttgtgcagcgactgaatcatcgttttcagctcggtgattctgcatttggggttctgcggatcgagcgaataacttccttccggggcattaaaatggagggggttatagccccaattataagattgatcaggagacagctcatccactccggcaaaatcgtgaaagggcagaacctcgatgtgggtgacgccgagctctttcaaataggcgattcccgttgagaagccgccggatgtttcagttccgtcctcagtaaaagcaacatatttgcctttatggcgcataccgctgtcttcatgaatcgagaaatcgcggatgtgaacctcatatataaccgcatcgcacggactgtgaagtcttggagcgcggtgtttttccaccttgacttcctctggatctaatacaacgcctttttcaccgtttgccgtaacggcttttgcataaggatcgactgtcaataacggcttcccatttacataaagctcatataaataggaccagccgtttagatcgccttcgaccgttacctcaaaaacgcccttttttctgcgcatcatttgaaaagtatttgtttgaagcgaatcagggtcctccagcttgatcgctgccgcactcgcggtcggcgcccataccttaaataaagtacttccttttgaataaaaagcgccgaggcggccgtcataaaaaaaagccttgtcaaacgccgcgcttctcgtaacagagccgatttgcaggtctgtccagacgctttcttcacagcatactttgtgaactcttccgaatggaacggtgcagctgctttcaagaacatacttgaattgttcctcaagctccacctgcgcttttaccgaaagctctatcctctctccttgatcatcttcaagcagaaaaggaggactgcagcttgacgcacggctcttcggaactaaaacagtgatcgttctcatttcatcgagataagcttcaaaagggcggctgatacccggcatttcagtctctccttcattcgaaagatttatgctcttaatcgaagggattcagtccctgttttaatgaaaacgggcgcccagccgatcacctctccatccgcttgaaagagcacccgctcattcgtatgaaaatagatgtctttcgtcttaaatgccgtaacaccgtttttgccgacgtgtttgccgaatatcatcgcaaacaagaggccggcttttttcaagacgggcaggtcttcaataatgatcacgtctaaaagctcatcccgcggattcgcattcggtgcaatcttcattcctccgccatagtaaggatgatttgaaaccgacgcaaaccagatttttttaaacgtacgcttgtcatccccgttttcatacgaaagaacaaacggtttaaacgtaaacgccgtgacaaagaaaatcagcggatgaatcaaatgattcagcctgagagcagccgtccatttcggcaaagctgacatcttcttggcggtgcatgcatcaaatccgaggctgagatgattcgcaaaataaagttcgttttcactgtctttcgtatgaaagcttccgagggcataggtccgggtcagcgattgcccttttcgcttcatttctttgatgacattcgattttttcacgccaaagccgcgtttaaaatcattgcttatgcctgacgggatgacgctcagctgaatgtcccgcaagctgactaaaccattgagcacttcatggacggttccatccccgccgatcaccagaagacgcttcagcctgtcatcctgcatcgttgatatttgccttgccaacacctcagcatgcccgggatgctgagtcataaacgagcggtacgatatatttgccttttggaggtctttctgcaatgatttccatgctctgaaggccgtcgagtttcccgcctttggatttatgatgatataccaatcgctcatgattccattctccattttatagtatgaaaaagccgggataacgttctgtcggtcagctcagccattcctgtctccgcaccgagtcggagacgccgtgcgacaaaagaattttcgccgttttcagctgctggcttttaatcggggcgaagtttttttgctgtttctccagccactctttccagtgtctcttgtcgcaaatgccgattccgtagggaggttccggataatcgatgtacgatgtacggctgacgatgactttgcgcacaggcagttcaatccccgatccctttaacaaaccggaaagaaccttgcctgtcctgaggagctcgacagccggatttaacaatgaccgttccttgccccttaccgttttttctttccaaaaacgatctttggaaccgataaatgcgctgtccctctcaccttcaagaaatgacatacagtagatttcaaggggagtgagaatcaagacgctgagctctaccgcagcctgattcacctgcagcaccggccgatacatgatgaaatatgaatccgggagctgctgtgccaaaatgtgcaggattttatcgctttttatttcccgggaaagcctggatatgtcagagattgtcgagcttgcccatttcagctgaaactcgtacacgtattccttaaaaaacggtacgagttcttcccctgccgcaggaattcttgcgatcaagctttcatccgtttctccgtccagtccgttaaaccattcatcggcttcttttcctttattaatatcggatgcttctttttttctctttaatgtaaatgtattctttctttttccaaacgtttcatcaccggcggctcctttatcgtgatgaaagctttctttctttttttcagccatctctttaattgactgccagcgctgctttttcaagcggataaactggttgatataatgataaggatcttgttcataccttgaaatacagtcctgtattttaataatctgtgccatctgcgttcatctccgaatcttgcttttctgcagccggccgttcgccgaaatggaaaacggcttgatgctcgtatttgggaagcctgtctaaatgggtttgaaagatggtgaaatgccgggccgtaaaagacaccgcgtcttcaagcggctccaggcgtccgttaaaagaggccgatccattccactttctggcgaccgtcacatgtggatgaaaaggccgtttttcaatttcaaagcccgccgcatccgctgcatgcttcacctgttccctcacatgaaagagagcggctgagtattccggttccacatgaagaattctcggctccgacggctttccgaaggttccgaaacgttttatcgcaagctgaaacggagccgtctcatcggagatcagcttgaggctgccagcaagcatcgccagctgctccttttcagcagagccgaggaacacgagggtgatgtggtagtccaaaggatgcacccatctatgaaaagaaaattccggacggctgctgaccgtttgataaagcggatcactaagctccgccggaattggaattccaataaagtaatgcggtttgactgacatatgtatggcttcctcctcattcgtcttctctatattttaacaaaaaatatggacttataacctctctattttccactttccaagggcttatgataggatattgacagaatcatgttttctagaaagggtgcacagttgtgagagccgttcaaaatattgcagaattaatcggggaaacgccccttgtcaagttgaaccgcgttcagcccgaaaacgcggcccaagtttatatcaagcttgaatcttttaatccgagcggaagcgtaaaagaccgcgcggcctaccaaatgatcctggatgccgaagaaaaaggcctgctgaaaccgggttcaaccatcattgaaccgacgagcgggaacaccggcatcggccttgcgatgaacgcggcggcaagaggctacaaagccattcttgtcatgcctgatacgatgacgaaggagcggatcaatcttctgaaagcgtacggagccgaagtcgtcctgacgccgggggatgaaagaatgccgggcagcatcaaaaaagcgcaggagctcgctcggcaaatcccaggcagctttattccgatgcagtttgataatgaagccaatccggaggctcaccggagatcaaccgctctggaaattgcccgggcaatagaagaaatcggcaaacctctcgctgcatttgttgcaacagcagggacagggggaacgattaccggaacaggcgaaaagctgaaagctttatttccgggaataaccgttcacgtggcagaacctgcagggtcgcctgttttatccggcggcaaacccggaaaacacaagcttgtcgggacaagcccgggatttatcccaaacattttaaacgaaaacgtctatgacgaaatcttaaagatcaaggatgaagaagcctatgagatgacgcgcagattggcgcgggaagaaggaatccttgtcggcccttcttcaggagccgcttgcttcgctgctgttgaaacggccaagaagctccctcccgacaaagtggtcgtctgcatgacggccgatacaggggaacgctatttatcaagcgatttatttcaatttgattaagagagaaaagcctggatttctgttttgaaatcaggctcagattgttgaaaaaatcccaaagctaagagacgttttgggattttttcatcctttcagcgtgaacgcaacccttgcagtctaggaaggccgagcattggagctggttttcacaggatgtgatgacggcagtgttcaggcaggacgacgcccgctccgttaagccgccgtttctcttttgttcgtgagcatcgacttagcaggcctggcaacgaatgcgatggtttgccgacacggaaagaagcggataaaacgccccgtaaccgaaaaagaacaaaaataaaatgaataaaaccgtttcaattccttttcctgcttcaaaaagccgctctcctcccggacgcctgtacgcaccttcactatattcgttatccctgaaaacagcaatgtttaacagcaaaaaagccgctctctagagcggccgtctatgttgtgctacacatgcattcctgttctggcatcgttgtgatccgttatatattcaatccgcttgaaaccgcagtcctttgcattttgatatagaagctccaggtttttttgatctttgcagtatatcgtgacaaaactcgaatcggctgtaagcacaatcagctcgcagctgcttttcatatatgattcatatgtgctgacatcttcgggatggccatccttcggaaaagccttcagatcggcgaagatgagatagtaccttgcgtcttccagcctttttttaaatgcttctcctgtcatcacctgcggatcttgaggaaaaagattttcatctgacaattcaccgttttccacgagatagcattcgccatcggcaagcagccaattgaaatcggccggttcaaccggcttcagtatatcgagaagaaagcgcccgtacccgttcgggatttcaaataaaacgcctcgcttatgactcatgccatcactctctttgctacttcgccaattcataaatggcctgtgcataaatcgatacagccttcagcaaatcgtcgatttccatatactcgtctttctgatgggcaacgtcaggacggcctggaaacagcgggccgaatgccacgccggctttcagtgatcgtgcatatgtcgccccgccgatggaaattaattgtgccgtttcccctgtctgctcttcatagacccgctgcagcgttttgatcagttcatggtcttttgctacatgatgtggcttgctgtctttaaagctgatgagccgggcgccttttatttgtgaaagcccggatttcacccggccgctctcttcagtaacaggatagcggatgttaatatgggcctccccgccttttccttgttcatactgcagccggccgacattcagcgtcagctctccgctgatgtcatcgcggcagccgatgccgatctttttccctctcgtatctccggcaaaagccccgctaaccgtttgaacaaaatggagcccggctctgtcaagggattgtgtatgtaaaaactcggccaaaatgagaccggcattgactccgttattaggttccatggcatgagccgatttgccgtgcacggttaatgtcagtctgccgccttcttgaagaatacgcccttctgcgcgtttttcttttacaaaccgggcaaatgactcttcaaattctgacgggacggcccctgccaggacggcttccgcatcatcaggcaccatgttcaggcgccggccggaccggaatgcctccaatactaagtccgcacctgtttccgcctgatcagtttcaatttttaaagctgcgtcaatcaggcctttttctgcatagataatcggaaaatcagcatcaggcgcaaaaccggccgaaggcatttcttcgtgtttaaagtaatgctccacacagcgccagtcgctttcttcatcggttccaataatcattctgatccgttttgataaagggaggcccgagtctttgacaatttttaatgcatgaaacgcggccattgtcggccctttatcatcaagcgctcctcttgcatagattcggccgccccttatttcagctgcaaacgggtcgctcgtccatccatcgccgggaggaacgacatcaatgtggcaaagcacgccgataatctcctcgcctttcccccattcgatatggcctgcataaccgtcaaggttttttaccgtaaacccgctttcctcccctttattcagaagcgctgtcaggcattcttgaatcccttttccaaacggccgtcccggacccgccgtctcttcgtcaaggacgctgttgatttttaaaaaaccctgaatatcctcaacgatctcattccgtctttttaaaacttcctgttcccagttcataatttcgccccttcttttttcagtttagccaaaaacccttgcaaaaacacccgataacgaataatatagatattgttttgctataatgttcgttattggaggaaatgatgtttaacataaaagaaaaccaaaccacagtcaaaaaagaaatcctcgccggtattacaaccttctttacaatggtttatatcgtcgtggtcaacccgagtatcctttccggcacaggcgtcccgtttgatcaagtgttcactgccacaatcatcgctgcagtcgtcggaacgctttggatggcgcttgccgccaactttccgatcgcgattgcacccgggatgggactgaacgtgtattttgcagtgtcagtcgtcggctcatccaacggcgaaatttcttatcagacggcgttcagcacagtcttcgcggccggcattctctttattatcttatcgctaacacctcttagaaaacaactgatcgaagcgattccggctaatttaaaatacggaattaccgccggaatcggattgtttatcgcttttgtcggtctgagaggagccggcatcattaccgcgaacgaagccaatttggtcggactcggcaatctgcactcgcccggagtgatactggcattaatcggcttggctttctctgtcgttttgatggtgatgaatgtgagcggcgctctatttttcggtatgatcttaaccgggctgatcgccttttttaccggccagcttgagtttaccaaagggattatgtcgatgcctcatctgccggaaaaactgatcgtcacaaaccctttcgccgcttttggcgatgtcatccactacggcctttattcggttgtcttttcgtttctgctcgtgacgatttttgatacgacaggaacgatgatcggtgtcgctgagcaagccggactcatgaaaaacaacaaactgccgaatgcaagaaaagccctccttgccgattctacagcgacgacagtcggtgcaatgttcgggacaagtccgacgaccgcctatatcgaatcatccgccggggtggccgcaggcggaagaacggggcttacgtctttaacagtcgctgtgcttttcggcgcggccctgtttttcagcccgcttgtcagtgcggtctccggaatcgcagcgattacgtcgccggcattgatcattgtaggaagcatgatgatcggcgccgtgacgaacatccgctggaaagaacttgacgaagcatttccggcctttctcgtcatcttgacaatgccgctgacatcatctattgcgacaggcatttccctcgggtttatcgcttatccgattgtgaaagccgcgaaaggcaaatggcgcgagattcatccgcttgtcttcgtgtttgctgttctctttttcatacaccttttctttttggaagggcattaatcaactgaaccccgtcttatttaaaaagacggggttttttcaatatgtacttttaacttcatcatcttcaccacctttcttttattacgtatgaagaaagaaaaagtttaaattttttcatcaaaaaaacgtgttcgcactgcatgttctgctcgcgattttcgttttttcaataatttggctccgccttttttctggatatttggcaaagggatcgtgtataatatttattgatcattttcaagaaatggtcgctaaccgtccatgctgcattttggagtcgtaagttgtggtagtcaagtccattcgatcatacgatagggagtggttgtttgaaaccttcaacaaaccgaatgctaaccaggatcaaatcagtctacatgttcattcaagaaaagggactcgttacaacccaggaactggttgatgaatttggcactacaccgagaacaatccagcgtgatctgaatgtgttggcatacaacgatctagtacacagccccagcagaggcaaatgggagactacaagaaaaaaagtgaaaatctcctcatagcaatattctgaaaaattgaactttagcgctgaatatcatataagaaagccatcaaacataaaaagcatcaaacttggttaagttcgatgctccacaaacccatttcaggcactcgatgaatcagagtgtctttttgttttgcaatgcggcaagctcgtgttcagagagctccctgtattcccctggcaatagctcttcatcgagatcgacatcccccattttcagccgctttaaatagatgacgtcatggccgaccgccttcagcattcttttcacctgatgaaattttccttccgttattgtcaaaagcaggcgttctacgccgttttcgcttgccagaagcgatgcttcagcaggtttcgtgacatatccttcaccgatatcgacccctttttcaagctgatcaagtgccgcttgatcaatcggcttattgacatggacttcatacgttttaggtacgtgttttttcggagataaaagctggtgtgccaactgtccgtcattcgtcagaagcagcagtccctcagtatccttgtcaagccttccgacaggaaacggctcaaacctcagcagctccgggtcgagcaaatcgacaaccgtttcctgccggctgtcttctgttgctgacagcactccttgcggcttgttcatcattaagtaaataaattcccggtacatgacgggtgccccgtataccgtgatgtcgtctgattccgggtcaacgtgctttttggcgtctttgactaattgatcattgacgcgcaccgcgccgtttttcagcatttttttgacttcttttctcgaaccatagccgctgtttgacaacagtttatccaatctcatgaagacacccctttttttacataaaaagaaaagccctttttaggaggcctttcttttgaaaaagcgattcaatcgctgaccgaagattttttcgagcagtttcacacggtaagccaagtacagataaactgacccgcccactgcggttgtgatgaaaatgacgacagcagacctgatctgcccgccttcgtatgaaataaaaatacttagaagcgcctggacaagcagcaaaatgatgcccatgaccgccgtcaggatcagcatcagcaaaaaccgtttaaacagtttgcgatacgaatagccggcatggcgtttaatcatgataaatccgtataggagtgaagctgaatagccgagcgccgttgccaaaatcgacccgctgccttgaagcagcttgatgagcggaacgttaagcgcgattttgatcacaatcccgatcatcaagctgacaaccgcaaatttctgcttgttcaccccctgcaaaattgcagcgttgacggtgaagagcgagaataacagcgccacaggcgcgtaccagaacaaaatatctcgtcccatttcagggagcaggctttccgagccgtaaaagaacgtgtaaaccggccccgacaaaagagccataccgactgatgccggaagaacgatgaagagaatgatctgcatcgcctgatcaatctgtttgtttaaagcagggaaatctttgttggtaaagttttcagtcaccgccggaatcaatgtcagcccgaatgccgtcgcgagagataccggaatcatcacaagctttggcacgtacagcgtcacgatcgccatcaaatcctggctgatgttttgatagccggctgcaatcatcgctttattaaacgtattcgtatcaatgtactggtaaagcggtatcgccagcccgacaaagacataaggggcggcatagctgaacagctctttaaacatttgccggtacgtaatatcggctgaaggaacaaggttcggcttcagcgccaggagcgccccttttcttttctgccaggaaaagtaaagagtgaacagtccggcgaacgctccgatcaaagccgcaaaagtcgcatagccgacagcgacgacaagcccgccgtttaatactttgatcaccaagtaagtggccgttaatagaaagacgattctggcaatttgttcaactacctgtgaaacggctgtcggccccatcatctggtgaccttggaaaaagcctctgatcagcgccaagatcggcacaaccagtagcgcgagactgaccatgcgaatgacatacacgacatgttcaagcgtcagcccgttgttttctgttccgccaagggccatctctgcaaaaaacggggcggacaaatatagaatggagaaagcaatgatgcctgtgacgagcatcatcgacattccggcgcgcagcatccttctcgttgtttcataatcacccatcgagttatatttcgaaacaaacttggacacggccgccggaaaccccatggtcgcaatgcttaaaaaaatcgtatattgattataaccgtactggaacagggcaccgccggtggcaccgaccatggctccgaacggaatcagataaatcatcccgaggatccttgaaatataggtaccaagcgttaatacaaatgtgcctcttaacagtttgcttgacatgttcccaatcaccatttttcttcaatagattcaacttttctattttaacatacaggcgctccactcaggtaataataacatggctaaattttaacatggctttgttttatcgttttttcatcatgccgttctttcgttataataagaagatggagcgcggttgttgtctgatgcaatctgccccgcctgcacagaatgcaggctttacaagacaggaaagttgaggatattggtatgaagtattttgatgtcatcgtcatcggcggaggcccctcaggattgatggccgcaatcgcggccggtgaacagggggcggacgttctcttaatcgacaaaggaaacaaactcggacgcaagctggccatttctggaggcggacggtgcaatgtgacgaaccgcttgccggttgatgagatcatccggcatattcccggaaacggacgctttttgtacagcgctttttctgaatttaacaatgaggacatcatcaagttttttgagcgtctgggcgtcaagctgaaagaggaagatcacggaagaatgtttcctgtctccgacaaggcgcaaagcgtagtggatgcacttttaacaaggctcgaacagcttcatgtaagcgtacgtacaaacgaaaaagtgaaaactgtcctatacaatgaagaaaaagcgtgcgggatcgtgacgggcagcggtgaagaaattgcagcgggatctgtcgttattgctgtcggcgggaaaagcgtcccccatacgggatcgaccggagacggctatgaatgggcggaaaaagccggccatacgattacggaactgtttcctacagaggttccggttacgtctgacgagccatttatcaatcagaaaacattgcagggcctatcactgagaaacgtcgccctcagcgtattgaacaaaaaaggaaagccggtcatcacccaccaaatggatatgatttttacccattttggactgtccggacccgcagtcctcagatgcagccaatttgtcgtcaaagagttgaaaaagcaggaaaaagtcaggctgaaaatcgacttgttccctgatattcatgaggaacagctttttcaacgcatgcataaagaattgaaggacgctccgaagaaatcactcaaaaacgtgctgaagccttggatgcaggaaaggtatctgctgtttcttttcgagcgcaacaagattgatccttctgaaaccttctcttccctttccaaagaccgtttcagagctttcgtcaaagactgtaaagagtttactgtcaacgtgaacggcaccctttcgcttgacaaagcctttgtgaccggcggaggggtttccgtaaaagaaatcgatcctaaaaaaatggcgtccaaaaaaaaggaagggctttatttctgcggggaaatcctcgatattcacggctatacgggtgggtataatatcacatccgcgcttgtcacaggcagacttgcaggcttgaatgcaggcgaattttcgctttgccggagaaaaaaataaaattgctccaaacccttgacaaatgtggaatggcagagtttcagcccagtgctgagacttgtgccttttttgaaaagtatgttacggttaaagagttttgtttcacctgattgtggggtaataggggaagctaggtcaaacttcctgagagagaatgatttttatatgtgcaactcatactaaacataatgatgggagtaaggacgaaaaatgattagagggtgaggatgattttgaaaaatatttcaagcgttttttggattgtgattgttatcacagcagcagctgtattatggggaatcgttgctccggataaccttcaggcgttaacgacttcgattcaaggttatgttacaaacacactcggatggtattacttattggtggtttctctgtttgtcgcattcagcatctttttgatcttcagtccgattggaaagatcagattagggaaacctgaagaaaaacctgaattctctcgattatcttggtttgccatgctttttagcgcaggtatgggcattggtctcgtattttatggcgcggctgaaccgatcagccattatgccattagctctccatcaggtgaaacagaaacagcccaggccttcagagattctctgaggtatacatttttccactggggattgcatgcttgggcgatctatgcgatcgttgccctttgcatcgcatactttcaattcagaaaagacgcgcctggcttgatcagcgcgacgctgtttccggtcttcggcgacagagtcaacggaccgcttggaaaagggattgactgcatcgctgtatttgcaaccgtcgtcggtgtagcgactagtctcggaatcggcgccacgcagatcaacggcggactccattatctattcggagtgccgaacagcttccaggtgcagctggcgatcattgcagtcatcaccgttctgtttttaatttccgcttggagcggaatcggaaaaggcatcaagtatttgagcaatacgaacatggtgctggccggcgtcctgatgatctttatgctgtttgtcggaccgacggtgttaattatgaactcgtttacggacacgatcggaacgtatatctccaatgtggtgcaaatgagcttccgccttgcgcctaatgatccggacagccgtgaatggatcaattcatggacgattttctactgggcttggtggatctcctggtcgccgtttgtcggtattttcatcgcccgcgtatcaagggggcgcacaatcagggaatttttgattgccgtcttgtttgcgcctactgtgctggcgtttctatggttttcaattttcggggtttcagcgatggatcttcagcaaaaagggattttcaacgttgcaaaactgtctacagacacgatgctgtttggaatgtttgaccactacccgctggctatgattacatctatcgttgccttgttgctcattgccgtattctttatcacttctgcagactcggcaacatttgttctcggaatgcaaacgacttacggttcactgaatcctgagaattcggtcaagatatcatggggcatcatccagtcagcaatggctggggcgctcctgtattcaggcggactatcggcgctgcaaaacaccgccatcctggccgcactgccgttctcagtcgtcgtgattctcatgattgtatcgttatataaatctctgtcacaagaacgaaaagagattaaacaagccgagaaattccagaagccaagaagcccgagggtgaaaaaagcgtaaatgaaaacagctcttctctctgaagagctgtttttttatgtcctgtataagattaacgctgaaaaacagtaaagctgttcgccttgaggatcgcatgcggctgatacgtcatattttatatcgaccagctggtcttccgacagcttttttaagaattcattgatttcatgctgcaaatctttttcgtgttcttcatcaaatacggccaccttcagcatacgctctctcctttctataatgaaaggtattcgcacacagccgaagttatgcttaaaatccttagcaaaagagccttcaacattggcagcagacgctccgaacgttacctggcatttggtgctccattttaaataaaaaaacttcttacctgtacagataagaagtcaaatccgcttattttgttttcggcttcgtgtttccggtccattcgagcatgccgccgaccatgttggtgacatcaaagcctttatcctgcaaatagaggcagacattttcgcttcgtttgcctgatcggcacacaaaaatataaggctgatctttttgaaagacgtcgagtttttcagggatatcccccattttaatgtggacggcttcagggatcattccttcagccacctcttcatcttctctgacgtcgataatgttcagcgtttctccttttgcaagcctgtctttcagttcatcaggcgaaatctcttttatcgtcatcattactgctcccttcaattgcctttaggtgagactattatagcaaaagtcgggaggccatttctatttcggcatgttttctctatcgtccgctgtcaggaaacaccgactttcccaatggctgaaacgatccgtcctgtgctgcagaatcagctgtgaagcttccccccatcaggcaaacaagcatgacggcgaaaaaacaaatgttttttttcatataatcccctccttcattttatatatttgatttttcgcatgctgcgatttttccaggtaaagcgcgcttttttcatggtcgcctgacttcatgtaatagtcggcaatatcttttgtcagttcagcaacatgcggccatagccgtttatcactcatatattcaagcgaaaattcaatatcgagcggatggccagcgtcatacagggcgaaaatcagcctgaacttcgctgcgtattcatcctctcctaattcggccgatctggtaaatccctctttgcagagacgtctcgcttcttcgggagaaccgtttttgtacatgaggtgagacagctcgaaaagggtgttaatgccaaaaaccgattgctcatggacaccgattgaaagggcttttctaaagtgctcctccgccaaaagcggcatgccgcatttggcatagttcagtcccatattatgatagatcagcccgatgattcgccggttttgaagggcaacggcctgatcaagcgcccgcccgtagtgctcctcagcttgtttgatgcggaacaattcaaactgcaccgatccgagtatcatttcgcatccgatcgttttgtctatgtattctttatgcttgctgaaaagtgagagcgctttttcggagtagttcaacgatctgaaatgatcgtctatttggtagtaggcggtcgcgattttataataaaattccgctttttcaatttcatcggtcagtttatgcagcttcgcttccgctttcttgtaacagctgatcgcctcaaaatagtttttctcataaaactcatacatgcctgaaaaaaagaaaaaatagtactgaatgatgtcatccgcgctcttaaccgtttccttctgccttttaattttccggaaaagctcggctgattctgaaactgctccatcatcaatttgcagcgatagtccaacagctgaaaacaaagctccagatctccgcttttctccattttagaaagcaggttttggatctcgtacctcaaagatacagcctggagcgcttcatggcgcttgatcatggtgtaccactgattcaggagccaggccgctttttcgtatgccgctttcgcttccacttcttcattcatcctttctcctttttaaaagcataaatattacctttattttacataagatgattgttattggcaattatttttatgaataagtgcagggaatggcatcagctccaatatttgagctgactttcgaggtttttggctgaaacaaggcctttttggaattggttcggacaggtgaggttgtattttttaattttttggttgatggcatcaatcagcgtttcgcgctgattcgatttgatcgctttttcaatctcttgtttaatttccttttgcagcttcagccattccggcagatatcgggcgtttttaagggttgacgaaagcgcatccccctcgagcatctctttgctgagcggttttccataaccggggagggacttgaaatcgtctttcttttcgctctccttcacggcttcatcaatccagtaaagatatcgtttttcaaattcttcacccatatgggccagctcctttcacacacctaaaacaaaggattaagtgtgtcttgtcgttatgacggtttccttctgttctgcggcttccgcttttttcaacacttgatatgccagccacataaccgcataactaagcagactggcactgaaaaaaggaacgatcccgggcagaaacgcaaaagcgatataaagcattgcagtgaccgccatcatcgttaatgtatactgcaaatacgatatgcccagaatcagcgaaaacttgaaatacattcgcttcttccaatcgaaatgggcgagcagcgggaacatataaaacagcatgatcaaaaacaaaaatccaaaaaccataatgacgaaccggagaacgtgcaataggagatgatccggataaataaaagcaagatctacataaatgatgatgccggccgccgccagaatgagaccgatggcgttggaacgaaaaaactcgccgcggtacgcctgccagaacgttttgaatatcggaatatcggttttgcccatgatccattttctcgtcactgaaaacaatgcagtcgtcgccggcataaacccgaagacgccaaggccgagcatagtaaaaacaaaccacagcagattggcgtaaaaaaacttcagcacccattcacaaaagctcagcacccttcccatggagacgttttgttccatgaatttctctccccctttatgtatattgccgggtatgcagaagttcactgattcctatcggctttttttctttgatggagcgccacaatgcctcgccggctgcaattgaataggcgcctgcttcggcaccggccagaatgtcgtaattcctcaaagggtctcctccgccaaacagctcctccaaaagcagcgggtctcctccgccatgcccgccgggctgcctgacgacgcgaatcgtttctttcgattcaaacagcggataataatcgatggtctgttcgggaacttcaaatgggactcttgccggagcatgatattcctgtgtttcaagccttccctttgtcccgttgattgcaagccggtagccttcatacggggctgaaaaatgaacggagtaattcagcagcgcccctttgccgtatttcaaaacggctgcatacgtatcctcgatgtcgatttcttcatcgaaaatacacgcgtcaggcctgtaatcggtatagagcagatgctggctttcattggtcttgacatggtcgtcctgcgggtcgcctgcctgccacctcatataatagcggcatttcttcttgacatggcatgttccgcaatagcggttttcccctttttcaggattcatttcgccgcggggtccgtagtagtacagaccgccgtaggcaaaacctcgctggggcgtttgatcaagccaccaattgacaagatcgaaatgatgggttgacttatggacggaaagaccgcctgagaatgctctcatcctgttccagcgtttaaaatagcttgcgccgtgatacgtatcgatgtaccagttcaaatcaaccgacgtaatcgtgccaagctttccgtcaagtatcagctctttgatcttgcggtggtacggattgtagcgatagttaaacgtaacggtcacttttcctttgctctcggcttcggcttttaacacggctgccgcatcccgtgccgttgtcaccatcggcttttcagtgatcacgtcaatatctgcccgtaaagcgcccaatatatagcggacatgcgtatcatcacggcctgctacaataatggcgtccggcttgattttgtcaagcatttcggtaaacgctttctcttcgaaaaacgggacggggcgaagcgccggaaacctttctttgcagacttcctccctcagcggatcgatgtccaagagcgcagcgatgcggttttctttcccgtattttcccaccagaggctcgataaacatgttaaaagcgcggccgctcagaccgcatatcgcatattttttcatcggctcctccccctttcattcattttgcttgaagcgcttcgatgagttccgtcgcttcaggggttttcttcgcataaaccggtatgaaagctgccatatctgtattcaactgaaccgtatagccgttcaaacgtttttctcctttttcgatgacagccgcatacagctgtacttccccgtttttgcccggagcgctgtacggctctttttcttccgaagcagcattcaatggctgaagtccttcaggatcgtaaaaaggtttaaacatgtcttctggaacgataaacagatctccttctttcgccgcaatttcaacaaggagtttttccggggttgccgggaaaacggtgatgttgagctgttctttcccgacagcgcgctgcacgttttcctttacttcagccggtgcatccgaaaaaatcaatacgtctgttccccggctaccatcctttccgcatgaggtaagaagaagcactgctgctattagaaggacggagaaagcgaagtttttcacttcgcttccccgcaggaaaaacggccggtcttttcaagttctacaaaagccataaccaaggcgccgacaccgtgaagatcgttggtgcttttttcccgtccgacataataatcgtatgtccctgcagaagttccgacgcagatatcttttaaaagcaagccttcttttgcgctcatctcgattttttcttcgacgagtcctttgaaagcctttgtcgctctatcaatatatgatgaatcaatatagcccatgcgagcccctttggccatcgcgtacatatacaaacacgagcaggagctttcgagccaattgtccggaagtccgcctttatcgacaacctggtgccatagccctgtgctttcatcttgaaaatcagcaatgcttttgaccatctcttgaagcgtccgggtccactcctgtcttgtgctatgcccctgcgggagcagttcgatcatgtcgctcagtgcaagcgcgtaccagccgattgaccttccccaaaattctggagaacagcctgagacggggtcggcccaaggcatctgcctcttttcatcccacgcgtgataatataatcccgtcctgcagtctttcgtatgctttctcattagtttttcctcgaggatgaccttatcgtaaagttcaggctcattgaacgcccttgcatacttgagtgcgaaaggccctcccatgtacaacccgtcaagccacatttggtaagggtatttatctttatgccaaaaaccgccttcttctgtttgattcagcgtttcaaaaaggcccctcagcttttttgcagctttgcggtagcgttcatcgcccgtctcctcgtacaaaggataaaggagaagtccggcttgtatagcgtccagctcatccctcctgaaataaaaattgccgcagtcatcgatgagatcatcggcatattcttttacatatttgaagtatgcttctttccccgtttcttcccaaaggcgaatcaggccgcacagaaatacgccctgatggtagtgccagcgcccggccggtggcagctctttcggtgtatacgctttcattattgttttggccgcttcttcagcaatgtaaagaggcgattttgtgatgagagattgattcatgtcattcaattcctttcatcaaaaaatattaatatatcccttcttctccaaatttcttcgccatcctgtttgcaaatacgacaagaatgagaccgacagctgctttaaataaaccgacggctgtactgtagctgaactgtccctgctttaacccggccgtgtatacatacgtatcaaagatttcggccacttcgcggttcgttgcattcaaaagcagatacacatgctcaaagccgagttcgagcgtatcgccgattttcaagatcagcaaaacgacgatgacgcttctgatcgcgggaagtgtgacatgccacatcctcctcaggcgattggccccgtccattttcgccgcttcgtaaagctgcggatcgacagctgtaatcgccgccaaatagatgatcgtcgaccagccggcttccctccagatgacctgaagaatgtacatcggcctgaaccagctttcattcagcaaaaaattgatcttttctccgccgaagtaggcgataatctcattgatcaatcctccgtcaacagtcaacaggacgaaagaaagcgataccacaatgacccatgacataaaatgcggaatatagatcagcgtctggacaaactttttgaacaatgcgactctgacttcattcaataaaagcgccaaaataatcggtatcggaaagaatacaacaaggttgagaaaaaacaaaatcaatgtattcttcaacagcataaaaaacgtcggttcggtaaacagcctttcaaaatgcttaaagcccacccattcgctccccgttatgccgagaaacggctggtaatcctgaaacgctatgacaatcccccacatcggcacatacttaaaaagcaaaaaataaatcagtcccggcaaaatcatcaaatataaatatttttgctggagaagcttttcccaaaaacgcgtctttcgtttttttccaacaacaagggccggattttttccggtctggacatcggctgctttcataaacggcctcccttcgtgatgtttgctttcactttatcccaccatgaaaaaataaatctacaatcatatcatcacatcggccgcacctcgcccggcagccggcaaaacctaataaaatgaaacgatggttagaaaatgattattgacaaattcacacaaaagtcggattaattatatatgaacaactcaaacgaagatttgttgggggggaatttatgaagagaaaacaatataagttttactataaactggtgaccttctttctcattctgagcaccattccggtcatcatcgtcggctttttttcctatcagagatcagcggaaacgattgaacaaaacgttacaaacgaaaagctccaaaccgttagccagacacagctaaatattgaacatattttaaaaacggttgaccattccttcaccaattacgtccgttcctatcctttaattcagacgctcagccgcaccattacaccagaacgctttcagctgtataaccaaatcaacaaggaattaaacgaactccagacattcgataccgatctgtcggatatcacgctgatcagccaagaaaaaaagtggtatatcaacaactccggtttataccctttagatcagggaaaacaagccatcacgctctcgctttacaacgctttaaaaagccgttccagctgggtgcttgaaaaaaacaacgaccttgtcgccacaaaagaaggggcttcgggaaactgcctgtacaacgtcaatctggtcaaacagcttcccctgaacagcatggaaaacagaggccttgcgatcgcgagcattccttcttgttcgcttgtcaagcgcatgccggatcattcaaaaacaaacagcatgatggtgcttgatgacaacggacggatcatccttcactcagacccgtcaatgatcgggcaatcgatcaaacaagaaaattacttcaaaacgatccgccggcaccaagaaaaaaacggccagtttgatacaacagtcagcgacaccgcctataacattacataccagaaatcagattataataattggatatacgtttcgttaacgaccattccggaactctatcagcagacggcatcaatcggctggttcacgtttacgatctgcctcattttgttagcgctttcatatttattctcctggtttggttcacgccatttttacaggccgatcaaggttttatacgaatccgtctccggcttttctccaggagccgattccgtccaagagaaaccgaaaaacgaatttgaactgattgaacggaacattaaagaaatgaaaaataaaaaccatgatctgaaggtgcgcgtcgaacagcaggtcacccagctgaagcagtattttttaacaaggctattgctcggcaagctgagcgaagaagaaatcaaagaccgctttactgggctcggcttccctgaagattggagccatctgtcggtattcacactgcaaattgatacattgaaagacacatcatacgaaaaaaaggatcttgatgtcctgctgtttgcgatcaacagccttgtcgaacgatctgtgcccaagaataagcgccttccgccggttgtcattgataaaacgcagaccatcatcatgctgaatcgcggacagccgctggaaaggtttcaggaagacttagagcataccgcatcagccattaaggataaaattcatgaagagcttgggttgttcgtcagcatcggcatcagccagccatttacaagtcttgcaatgtcaaagcgcggttatttggaagggcttgaagcactgacataccgtctgaaatccggaaaacacgcggtgattttctatgaacaccttgaccgcaacaaagcgtttttaacccagtttccgaagcagattcaaaatgaactgtttgaagccattaaaacgtgcaaccgtaaacaagcggccgaacagcttcaccttcttcttgagtcgatttgttctgaaaacatgaatccgcatcactgccagattgcgattgcaaggctgttgaacaacttgattgaatttatgcatttgctcggaatcgagatttttgaaccgaacgaaaatacgatgctgtacgacgacgtctttgagctgacgaccatcgaggaaattgaaagctggctgaacgcgcagattatcgttaaaatgatcgatacactcagcatcagagaagaatcgcaatacaaaaacatctcagaaaaaatcgtccatattatccagcaggaattcgacacggacttgacgctcgaatcgatcgcaggaaggcttcattacaaccccaattatttaagcagcatcttcaggaaggaaatgaaaatatcgttcagcgaatacttgtcatcatacaggcatcatatcgcgaaaaactggctgacggaaacgactatgtccgtaaaagaaatttccgaaaaactgaaatacaaaaatccgcagaatttcatccgttcatttaaaaagctggaaggaatcacacccggcaaataccgcgagctgaaaaaccattcggcataaaaagacaatcccggctcctcgaaattgtctacattgttgacaaaatcccaaaacgacttttagttttgggattttgtcatcctttcagcgtgaatgaaaacccttgcagtctaggaaggccgagcatcggagcgcagcgaatgttggaattcgtgagcaccgacgcgcaggcctgacaacgaatgcgagggtttgtcgacacgctgacaatcccggctccccgggattgtcttctatttttctgcttttttaaatgactcctcatattcttctatgacttgatttccgccgttcgtgcgccatttttcaaccgctttctcgaactggctttcattgattttgccgagaatgaattggtatgtggcatcatcaatgatcttttgcagttcatcgcctctttcagatgcggccggtgagtacaggctttcggccgggtttgagacgatgatttcgttattgtcctctgtcagctcttcatattttgtgcggagcggatcgcccgtatttttcaaatattgcttatcaatgccgacgagagaaacgagcggctgaatttccgcctgccagtctttcagtttctcgtcgatccgtttgaattgtttattcccttcttttttatagtgaacgccttcgatcccgtatgtcatcagactgtaaacatcctcttcggcgatccggtcgaaaaaggccagaatcctcttcagctctttttctgttttgacgctagttttcgggaaggcaaagattccgttatgcccgcctgatgcccagacgcgttcctttccgtccggccctttgatccgattgatgatctcaagttccattttatcatcgacagactggtctcttagattgacggcatcaaccatatttccgacataaatgccggccttcccttgtgaaaacatttcttgctgctgcgttttgctcgtcaccggaaagtctttgttgatcagcccttcatcatacagctttttcatatatttcatcgtatccatgtactcttttgtcatgaagtcaggcgtgaacttgccgtctttttcctcccaatcagtcggcatgcccatataggaccccaatgttttaaaggcgccgtagatcaaatcgtttctgtcggcaaagccgatcgtatcgtttttcccgttttgatcaggatctttttctgtaaatgccttcgctgtttcgtaaagttcatcaactgtcttcggcatatcgagtccaaggttgtcaagccagtctttacggatgacgatcccctgtcttgataacgggcgctccctgtagatgccataaagctttccgtcgattgaagcgtttttattgatcagcttgttcatcttgcttaaattcggataatcctttaaataaggtccgacttcccaaaacatccccgatctgaatgcattcatgacagatgaatttttaatgtcctgaatggtgacgactttcggcaggtttccggcggcgagcgctgagtttaaacggtcctcttttaccgcatcaggcacccacattaaatcgagcttagtattggtgagttcctcgatttttttaatcgccgtgtccttcggcggctgctgatggtaaaggatcaccatccagctcaagtccaaaggcgagttcaaatcgactttctcctccttcgaagaagcctggtctgctccgctgttcgaacagccaagcagtccgccggccaaaagcacgaacgcaaaaatcgggatcagccattttttccccatattgtcccctccgtttttatcctttaattgaccctaaaagagcgccttttgcaaagtgtttttgaataaacggatacacgagcagcacaggtatggttgcaacgacaatgaccgccattttgatcgtttgttccggcggcgccgcggctgctcccatttccgtcatatccccttgcataccgcttgatacgatgacaatctggcgaagcaaaacttgtatcggccattttgtcgcatcgctcaagtacagaatcgcctgcatgtacgtattccaataggtgacggcgtaaaacagcgaaatcgtcgcgatcgccggcaaagacaacggaagaatgatgcggaagaagatgccgatgtcattgcagccgtcgattttggcggattcctcgaggcttgacggtatgttttgaaaaaagttctttaaaataatcaagttaaacgcattgatggcggtcggaagaatcagagaccaataggtatcgagcaatccgagcgattttacgacgagaaaggtcgggatcatccctccgctgaacagcatcgtgaacacgaccaagaacatcaggacgcgccttcccatcagctcctttctcgacagcccgtatgccattaaagaggaaagaaacatgctgaccgccgtccctacggctgtgacaagaatagaaacgattaagctcctgtacacaatgtcagttgaaaaaatatacctgtacgcatccagcgaaaaagtcgtcggtattaaaataaactttttcgaaataacctcctcgactgtcgcaaaagaggctgcaataacgtggatgaacggcagcacacaaaccaatccgaaccctgttaaaaatgaataattcaatatgtcaaacacgcggcttccagcagaatgcctgatcgttattccccctccttgtaagcgctgtcaaaatattacgatatcgtgtctaaaatgtagcagacagaaaggagagcgtctataatcattttttaagcaggagcaggaaagcggagaaaaagatcatcaccttagaagatgatacgtcagtcttcatcaaggatgtcagaggcgctgacttgcggcctgtaccccagttcccgaatggcggaatcgatcgaccacggccgccccttattgtcgctgacagcataatatgtaccatatgttttgccggatttgatagcggctttaaagattccgatgaggtcggggtgggataaaagcgtttttttgcttctcggttttgcgtgcagcgtttctagctcattttcagcagctgtcccgatccgcagattgatgacggaaaccttggcgtctaattggtgcgagaaaaggtagccgagattttcggacgccaattttagcaagccgtacaagcttttggactgcgggtagtcatttgtgttgatctgcctccccaacagagaatcgccgcccttttcatatacatctgtcacatggttgctgctggcaaataccactttcggcacgccgagctccgccgccgcccgcaaaatcgtatatgtcgctttaaaaaagatatccgtcattttcgcaaactcctgccggtcaagcaaatcgcccgacggctttacagccaaaagattgatcagcgcattcgtctgtgcaggaatgcttttgacgacttcgttgtaatctgtcgcatccacccggataaaacggacagcctgtttgtcatccggttcttttaaatccagcactgtcacctcatacccttcgcctgccaatccgcccgctaatacgcggccgaccgtgccgttccctccgacgatcgtcacctttttcacggttatcgcctcctgttttacagccatgtttttaagaaaccgaccgctttatgcctcattccggctgtctcgaggtgccctgaatgagaacgaaacacttcatagcgttcacctgcgcctttttctatatacacatcggacagcttttcttcaataatgtcaatcccttgaaccggcgtcagtttatctgcggttccgaccaggcttaaatgaggccttggagcgatcaagctttcgatttgagcggttgaaaagtgtttgaccagccctggaacataagaatagagattgtggcggtccaaattctgcgtcttgattaatgtttcgctgtccacctgagcgcatatatcaacgcatacgctgacccgctcatccaatgcagcggtccaccaggccatcagacctcccatcgacatgccgagtgaagcgatgcggctttcgtctatgtcctccctcattttcagataatcgatggctctgatgctgtcgaaaaccatcattccccacatcacccgccctgtccaaagcatttctttaaatatctcactctccgttttgccccgcctgtctccgaaagcccaatgatcaatcgcaagcacggagaatcccaaagccgtcaattcctcggcgaacggcggcgcttgcaagtactccgctccttcaaccagctcctcctttcccctttcgtagcgccctccgtgtgaatgacagtaaagcacggccggccgcttgccgttcatctgtttcggttttgcaaaataggccggcaccgcttcaattccgtttaaatcaagcaaaagcgtttcgagaataaaagatgacttttcttcgattttaagagtgctcgcatcaatgctttttttccccggcaaatcgccgagcagtttgaaaagttgactgcgcatcgtattcccctttcttttttcgtttgattcattaatacgatttgaaagggcgttttacctttttccagatgttaagttggcggaagttcacaacaaacaatgcgctggcaagcatgataaacagtaatacccacgatgatgaaaacaaaagaagcagcgtgaagccccccatgagaaagaggcatacttttttgtaaatgcggcctgataacagcttgtaagctgcggcaagaccgcacagcgagttgcagatgaaaaaggcgtttgcgatcagaaccagcgtctcaacattaagaaagtgaaacatcaggcagacgaaaacgatcgtatggatgagaaatataagccccagcgctgcagtcggctgatttccccttgatctgtaggcaaacagcccgccggcctgcgaggccaccagcctggctgctccgcctgtcacctgaaaataagcacacatacagaggacagcggtgagcactgcgatcaccggcaatgcaaaagatccgaacaacggcgtcagcatcatcgccagcttcaattgtccgtttgcggagaatccaggatcaatccactgaacagctgccgcggtcgccaaatatatgaccgttaccgtcaggctgctgatcacgacagcccgtggaatcgttttcccgcggtttttcacttccatgctgtagttgccgacgatttcccatccgaccaatgcccagaacaggagcagcaatccgcggccaaaatcggtaaactgaaatgttccgtctacgagaggcccctcacggaagtaaggcacggaagccgcgctgcttccaaacaggataagcgccgcggcagtggaaaaaatgagtgcaaccatgccgacaaatgaaagattaaagcaaaggataaccatacaaaagatgaaaaaaacaaagccgtacagttcagcagggaatgccgtgcctgccgcaagagaatgaatatattcgccggccgtcattaatacggcggcggggccgaagctcgcagccatgataaaataaaagactgccaactttttaacacgcgacccgaacgctttttcagccgcataagcaatcccggcatcattcggatactcgacgcttaatctggcaaaaacccaggcaaataaaaaaccgattcccagcatcaacagccacgcaaaaatcgcgtagtctccagctgtctgatgaatcatcggaggcagcagaatgattccggatcctaaaatgggccccgtcatcagcccgcttaacaataaaggaccaagctttttttctctcatacgaatacaatcctttcacaaagtcgtttaaaatgattgtaatcatgttcgattcatcagtaaaatagatattatcgatctgcaacttcgaatttttcgatataagataaaaaagggagatggacgagatggagatccgacacttgaaaacatttaaaacaatcgtggatatcggcggttttacccgtgctgccgattatttaggatatgcacagtccactgtgacttcgcacgttcaagcaatcgaacaagaattaagaaagccgctgttctaccggctcgggaaaaaaatgatgctgacagaagcgggaaagcaccttctcccttatgccgcagaaatggtcgagctgtatgaaaaagcgaggcacattccggaaaacgaccaggagccgtcgggaaacttgatcatcggcgcctcggaatctttaacggtatacaggctgcccgccattcttcacgaatttacaagcaaatatccgcaggtcacggtcactttaaagtcttccacgtgctggcagctgagagacgaattgaaacagggaaaaatcgatgtcgcttttcttttggacaacgaccggaaagaaaacgaccttcatgttgaaaagctggtcaatgagccgatggtgttcatctttcccaaagaacacccggcaggacaaaaagctcttgatgatttgacttttaacgcaaatgaaacgtttttatataccgagcacggctgcagctaccgtgatttttttgaggaatatttacgtcaaaggggagtcattgccgaccatacgatggagttttggagtgtcgaagcgattaaacaatgcgtaatgtgcggtttgggcgtctcccttcttcctttgatcacaacgcgcactgatatcgaagaaggaaagcttcagggcacgctggtccgcgacgccctgttttccactcaaatggtttatcataaaaacaaatggctttctcctgctatggcggcttttacggatatcgtccgcaggaaggcaagagaatgggaacagacataacatccctatatgccttcggtattcatcagcacgatccgccagccgtccggatcttccaccgttgcccctttttccttccaatacggattttcaggcggcacttcgtcatagcccatgtcagcgagcctatttaatatgctcctgatttcctccggatcaggaatataaaaaacgagcagattgtctttagtcggtgccggacaagggcttccttcgatatgtgaggtgaattcaaggtggtattggacattcggcaggccgaacatgacgccattatacccgtggtggccggaaaaaccgccaagctttttcagccccagccccttttcgtaaaatgcaacgatttcgtcaaaacggtctgtaggccgggcgattctgacctgtacggcggaaaaatcggaaaaatgcatcatgatcatctccttttttcccattttaagcggtcatggatcatttgaaacgaagcgatcgtctgaaatattatcatcctttcggcggaatgacagaaaaagccccttcggattgaaggggctttcgccattaatttgcaacaatatttacaagctttccaggcacagcgatcacttttctgatcgtttttccttctagctgttcttttactttttcattgtttttcgccagctcttcaagctgttctttgtccgcgtcggctggaacgttcagcttcgctttcacctttccgttcagctgaacgacgatttcaatttcatcatccacgagcttcgcttcatcatagacaggccatgcttcatacgcgatcgtttcctcatgaccgaggcggttccagagctcttcagccaaatgaggcgcgacaggagaaagcaatttcacgaagccttccatgtattctttcggaagctgatcagctttatatgcttcattgatgaagaccatcagctgtgaaatgcctgtattaaagcgcagaccttcgaaatggtccgttactttcatgaccgtttcatggtagacgcgctcaagcgtttcgccggctccttcaacgatcttctcgtttaacccgccattgtcatcgataaacaaacgccatacgcggtcaaggaagcggcgggctccgtcaagccctgtcgttgaccaggcgatcgatgcatccaaaggtcccatgaacatttcgtacagccggagcgtgtccgcgccatgcgtctccacaatttcgtccggattgacgacattgcctttggatttgctcattttttcattgttttcgccaagaatcatcccttggttataaagctgtttgaacggctctttcgtcggaacgaccccgatgtcataaaggaatttatgccagaagcgcgcatacaataagtgaagaacggcgtgctccgcccctccgatatacatatcgacaggaagccattcctttaatttttcaggggaagccagctcgttcgggttcttcggatcaatgtagcgcaggaagtaccagcagcttcccgcccattgcggcatcgtattcgtttcgcgtcttccctttttgcctgtttcaggatctgtcacttccacccattctttaatattcgcaagaggggactcacccgttccgctcggtttgatttccgacgttttcggcaagatcagcggcagctcttcttcaggaaccggagtcgatgtgccgtcttcccaatggatgatcgggatcggctcgccccagtagcgctgacggctgaacagccagtcgcggaggcggtatgttacttttttctcgcccttcccgttttcctcaagccactggatcattttttcgatcgcagccgctttatcaagaccgttcagaaaatctgaatggatatgttcgccgtcgcctgtatatgcttctttctcaacatccccgcctttgacgacttctttgatcggcagcccgaatgctgatgcaaattcatggtcccgctcatcatgggcaggaacggccatgaccgccccggtcccgtatgtagccaagacatagtccgcaatccagaccggaattttttctccgtttgccggattaaccgcatatgcacctgtgaagacgcctgtctttgttttggcaaggtctgtccgctccaagtcgctctttgattgaacttcttcaatataggcgttgactgcgtctttctgttcaggcgttgtgattttttgaaccaaatcatgctccggagccagcacggcatatgtcgcaccgaataatgtgtcaggccgcgtggtgaaaaccgtaaacgtttcattggtgccgtcgaccgcaaaatgaacatgcgccccttcagaacggccgatccagttgcgctgcatttctttaatgctttccggccagtcgagttcttccaggtcttcaagcaggcggtcggcataagcggtaattttcagcatccactgcttcattggacggcgttctacaggatgtccgccgcgttcgcttttgccgtcgatgacttcttcattggcaagaacggttccaagcgcaggacaccagtttacagggacctcatctacataagcgagacctttttcgtaaagctttaagaaaatccactgcgtccatttatagtagtccggatctgttgtgttgacttctctgtcccaatcatacgaaaagccgagcgctctgatctggcggcggaagttgtcaatgttctgctcggtgaagacggcaggatcgtttcccgtatctagcgcatattgctcggcaggaagcccgaatgcatcccagcccatcggatggaggacattgtacccttgcatccgtttcatgcgggacaaaatgtcagttgctgtatagccttcagggtgtccgacgtgaaggcctgcgcccgacggatacggaaacatgtccaatgcataaaatttaggtttggatttatcttcacgagtggcaaacgttttatttttcagccaatagtcctgccactttttctcgattgtttgatggtcaaagctcaattgtaaaaacctcctttgaatatgtgtacggcttctttgtcttcaagtatggacgggactggcagcgttatattcagattattctaaaatcaaaaaaactctcccatccctaagaagggacgagagatttcccgcggtaccacccttgttagtgtgcacgcggcacactcacttgatatctgtaacgcagatacgcggcagcagcttatcactgctgcaactctgaggcgagttcggaagctcatttgattgactttcaccagccgtcaactctctgaaacaaaatgggcttcttactgctcctcttcactgttcttgccgtaaccgtaatcttatctgtattttatagaattctgttcataagtgcaagcaggtttgtatacaatgggaatgtgctgaaaaaagggtaagagtgaggatcttaatcgtgtggagatttgttttgccgttcggagttctgtacatttgcctgctgttctctgacaaagtcaaagcttctcaatacagcttcaccgccgtagccggcaatgatcgataacacgacaagctgaattcccgaatcaggttccgcagataaaacaagcaaaatagaagcaaccattccgacaagaatatcttcaaaaaatccaaggtaaatgaatcgtttcgttgttctcggtttctcgagtcgtcctctttttttaacgtgcccgagaacccccataatccctccaatcaaacaagcaaccaaaacttgatgcagcatcttcatcaccttcctaaagcccttactttagtcaagcgacttcggccatcgagcagcccccctagaccccttgcgatgatattcgatactaccatacagaaaatgtgttctgtctgagaagaaaaaaagcttgtttcttccattatatgtgaagatttggttgataatcttgattccttcgattcattttcgaataattacaattacctattttttctatattactcatgcatctgactgagcggagagctgcttttccttcctgttgtataaaaacgccgttcctattgcaatcagcagcaatgcgagcagaaccgcgagcaaaagctgcatactaaaataatcaaccagcattccgccaaaaagcggtccgatcattcttccgccggtcgccatactgttgacaaacccttgataaaacccttctttccctctcggtgcgagacggtttgcaatcgtcggcacagccggccatacaagcatttcgccaatggtcagcacaaccatcgcagcaagaaaagccggaaaccgttcagcgccaaacaaaattccgtatgccatcataaaaatgacaaatccgatcacgatttggtttttcagcgattcggcaaaccgtttcacaaaaaaaccgatcagcggctgaccgaaaacgatgagcgccccgttcactgtccaaagcacgctgtactgcccaagagatatccccagctcctgggtatgtgaagcgatggtcgaggaccattgcgaataagcgatccagccgagcaggtagcccgtacatatgaccaaaagcgcagaaaatttcgatttcccgctgactgaatcggcatgatccaaaacagatgactgcatggctttttcagaccggatgcgtttaaatccgaaaaacgcaatcatgaagaagacggcgtacagcatcgcattcgcgagaaaaacatacgtaaatgaaaaagaagcgacaattccgccgagcgctgagccaactgccacacctgcattttgggccacgtatacagagttgaacggctttctgccgccttccggccaaactgatccggccattgcatagcatgccggaaaaacgatccctgatccaaaaccggccaacgttaagaaaagaatgtactggaaccaatcgtgaaaaaagacgaggccagaaaggctcgcaaacgtgatcacaattccaagaacaaccgttttaaatccgccgattttatcgaatagatatcccccgaacaggttgcccagcacatttgcccctgagttcagcatcagcacaaatccggccgctgtcagcgactttcccaaatgctgatggatatagatggtattcagcggccataaaaaagatgcccccgtgacattgataaacattccgatgaccaaaagccataatgtgcgcggcatagcgtttccttctttctctttatcattccctctagattctattcgttttgcccatttttttcaattgacacgttttcgattttcaacataaaaaccccctttttaaagggggaatttttttatgattgcgtcatccatttcggctttccgaaaccggcgaattcccgatcgatcgtctcctcgaaagctttggattttaccgcttctttgagatctttggcgaatggcttgtctttgtttttttcatccactaccacttggttgcggtagcggtcgggcatgttctcaagcgctagggcgtcctgcagcttcatattggcggagagagcgaaatttcccgggacggccgcgatatccaggtcatcgacagctcttggaagattggcggattcaagctgtttaaatgtcagctttttcggattttccgcaatgtcctgcacagaggctttcaatgtgtcgacatcgcttttcagccgaatcagcccctgatcctgaagggttaaaaatgccctggcagcattggccggatcgtttggaacagccacttccgctccgcttttgacatcgttcaagtcgttatatttggcagaatagagccccatcggagcagtcggcacagaaatgagagccgcaagatttttattgttttcttgattgtatgatttcataaaaacctcatgctgaaacaaattcgcgtcgagctcgccttcacttaacgcagtattcggctgtacataatcggtgaattcgatcacctccactttgtagccttttttctcaagctcaggttgaatcgcttttttgaccatatcgtaatacggtcctgcagtggcgcctattttgatcgttttgccgtcgcttgcggcattgtttccgcacgcggccagaagcgccaggctcaaggccagtcccagcgcagaagtccattttaataactttttcatgttgatctcctccttcaaaataaaaaaactctttcagccgcctgaaagagttgttcaacttatctttcagaatgcgcctgacattctgctggatttagcaccttgcactgctgcaggttgctgagatttcaccgggccagtccctccatctctctttataagctgcatattcggtttttaaatgatttctttattttacgtttgaatatttagatttgcaagaagttttttcggtataaacatttttttctttttaagctaaaatatagttatcaattaagaaaggagacgaatcatggaatctatcatgctgatcgggtttttatccttccttttttccatctgctatcttgtatttcatttgatcagaaggattttttctccaggcaaaaggttttccaggaaactcttttatccttgttttgccggcggacttctcctcctgatcatctctgcaccttattacgatgaggaaacatatgccgccgatgagaaaaaaacggagaatctgacaaccgagcttcaggaactgaaaactgaacacagcgctttgcaaaaggagcaaaccgcattaaagcagcaggtcaaacaggcaaacaaaaaactgaaggcagtcaaagcggagaatgacacattaaaaaaagaaaacgaaaaactgacaaaagaaaaagattcgcttacgaaaaaaacaaaatcgctgacagaaaaactggccaaggctgaagaaaaaagcggcagtgccgaaacctctgtaaaagaaaagagcgccgccgctcaggccgaagcgtcacacagcacgcccgccgccaagaaaagcagcgctgaaagcaaacaggagtgcaaaatcaaaggaagcgtcaaccatatttatcatacaccgggcagtacatattatgaccgcacgaaaaacgtcgctcgctggttctgcacagaacaggaggcgcgtgatgcggggtacagaccgccaaaacgttaaaaagccggcataccgccggcttttttcctaaagctctcttcttaatgctgtcagcacgttcgttcttgtcgctttaatggccggattcaggccggaaagaatggcgacacccgcactgatcaatgtcgcgatgaggacaagactgaccggaatatgcgagaaggtgatactgagctctgccgcactcgcttctccttctgaaaccgatgataaaatgacaggtataatcttgttcactaaaaagctgacaccgtatgaaatgataatacctaaaacagatcctaagatgccgatataggcgctttccagcaggaacatttttcggatcacattcgggcttgcaccgatcgctttcataatgccgatttcctgcgtccgctctgtaaccgccattgtcatcgtgttgaaaatcccgatcgctgaaataaagacggcaatgactccgacaaagatcagaccgattttaaaagccatgaaaaaaagattgatgctatcgagctttttcgttattgaatcgacgtagtagccttcatcctccaaatctgttgtcagctgtccgacatgttcaaagttatccgcgtaaaccgaaagcgttttttcgatcatgccgctgtctttttccgacttcagaaagccggtgatgtctttttgcatgccgttgctgacatagactgttgaatcgctcgcccattcatacgaaggtttttttgtcactccgacaactttcagatcatatgttttcgcttccccttcttctcctgttttttcatccatttttgagatctttaattcaatcgttttgccgagaatatcttcttcgtatcctttcggctcttttgcttcctcagcattattttccatctgcttttcataatctgcggcttcctttttcgtccagaggttcttcccgaaatggtagccgacgacaatttcattcggtgttttcgctacgcggccgcgatcgagtttgatattggctttttgctcagcggccatgtcggtaattgtaatattcgacatttgattattggtcctgttgcccaattttgcttcagcaggtgcgaacacgtttgtgcgctcgataatcgcggacacatctttgcggttttcaaattctttcaggtctttcttttgaaccttttgatcgctttgcccttcttttccgacaacatttatctcggtcacgatctgctctttcatcagctgttcagtcattgatttttgcagtccgaatccgaccgatgcgagcacgattaaaaacgcgcaggccaccgttgttgcgagaatggtcatgaatacacgcaggcggtttttcctcatatttcttctaatgaacttcaactggtccttaaacttcaacagtctcttcccctttctctaacacgccgtcagataaatgaaatttcgtattggcgatcgatgccacctcgtcatcgtgcgtgatgatgacaaatgtaatgccgcgttccctgttcagctgccgaatgaattcaaggatttcctgctctgtttcggaatccaggcttccggtcggctcgtcggctaaaatgattgaaggattcaaaatcaaagcgcgggcgatgctgacgcgctgctgctgtccgcctgaaagctcattcggatagtggccggcgtggttttcaaggccgacgcggtggaacatctcgttgacgcgctgcttccgctccgacggatgaacaccttttaaagtcaggggaagttcgatattttcgaaagtcgtcaagctcggaatcagctgaaaactttgaaagatgaagccgaaatgttcaagcctgaatgcggcccattctttctcgctgtacttcgtgacatccgtgccgtcaatcatgatcttcccttttgtcggggcgatgtagccggaaatcaagttcagcagtgtcgactttccggagccgctccgtccgacaatacaggcgatttctcctttttcaacggtaagcgagacgtcctttaacaccttaatttcattttcccttccctttttgccgactttaaacgagtggtgaatatgctttacactgatcatttgtaaatctcctctccattaatgattacagctgttttatttttttgaaaatcaagaagtaactgattaaaaatccgactgccgaaccgatcaacataccgaatatatagctgaacagactcgaagcagcggctgtgccgaatccccagatgccgaataaaatcacgagaatctggatcggacgatccatttttctccaaaggaaaaaatgtccgttccgttcaagctgctgtttgataaagcagaaatagccgattatataaaacaagatccccatggcgagcggaataagcgtaaaggccaggctgccgtcttgaatgccgaaactgttgaggtatatgatcggcgttatataatctagtagttctgtttcaccataaaagaaagcagggtcatgcccaaagaaacccaggatgattcgtaagttggccagcggaaggccgatcagcaaatacggcagaatcgacgctgaaaaagcaacgatcatctgggccagcggattgccggtcatcgcgcccgccgccatgacaagcgagtagaccataaagcagaagataaccgccccgataaaatactcatggaaaaagacaacgtcaacgttatacaaaataatcaaagcgtaagataacaagtaagataatagctgggctgttaaaagaattgaaatgccgaagaaatatttagtattgaaaatgacgccgcgcttgtaagggaggccgagtgtaaagtcaagcgttcctctgctccgttcaaacccgatctggctgatcgcaagcgcgactccgccaacccagaacattctcatggccccgcttaccccataatctttatataaaacgcactctatatcgggaaattttttctgttctgcaaggcatccctggtactggaaataatcattcaaaatcgcaagcggttcactcagcaacaccgctgcaaaaacaactaaaaaaatccagaaatgctgtttccattctttatataaaagtccgcggtctaccatcttcgcttacctccatacttcgcgatgaatacttcctcaagactgaccggaagctcgttccaaactttcggagacaaacttttaagaaattgtttgctcacattgtcttctttcggaaccaataccgtataaaagacgccggtgtggtccaaaacagggatttccctttccctgatttttaaattgacatcttcttcaaatgccatttgaattttaataaaatcgcctttcagttcatcaagatccatgatgttcgacaatgtattgtcttcgagaaaaccgattcggttgcacattctttcaatgtcctcaagccggtgagatgtgatgagaatcgtcgtgttgttttcagccacttcatcgaccatcagctgaagaacgtcttgtcttgtgacggcatcaatgccgtctgtcggctcatcaagcaggatgaccgccggccggatcgcaaatgacaggatcagcgacatttgctttttcaatcctgtagacaattccctgtacttttttgtttcgggaatatcgtatcggttcattaattcatttgcatatgtaacatcaaagtccggataaatgttacgcaaaatattgacgagctgtttgtaattgtatttttcgaaataggtgttttgaacgggcatatagacgatgttgcgcttgacgagcggatgatccttcaccttgacgctgccgaaaaagatatctccctcatcaggcagcaggatttgctgaatcaggcgaagaagcgtcgtttttcctgagccgtttcttccgagaagtccgaaaatctctccttcctccagcttaaaggagatgtctttaagtatttgttttccgtcaatcgtttttgaaacagatttgagctcaatcattcacttcgcctcctctcacttcttcgtcgatttccgccatccactcctgcagctttttggtgtcgatccccgcgtaatgcgcatcgatgatcagctgctttaactgctctttaatcatcgcaatcttcccttcatcaagcgtaactttcgcgttttctgaaatatacgttcctcttcccctcaacgtttcaataatcccttcccgttcaagttctttataggctttgctgaccgtattcgggtttgcaatgataatggttgcaagctctctgacagaaggaagtttatctccaggcttgattatcccttttaagcacagctctttcatctgctggatgatctgctcatagattggggttgagcttctcggatcgatttgaatcatctatctcccttctttctcgttcaatctcagcgttattcacttttaaaaaaacacatatcccaaattttcttgaatcataaagcccagcttcgcaagtacaaacaagaacgaacaggcaatgataaacgccacgacaaccattggcgttacttttttatgtttatcactcatgagtattgctcctttacatgtgtgtgttaactgtattactcgatgtagtacacttaatacaatatagacatcgtccttttttgtcaatcgcttttttcaaaaaaatgaaccctttcaaaaagggttcatctttcatacgatctctgcagaatcatattgttttgaagggtttgcagctggagccttttgcggtgaatttcctccctttgctgctcattggcaaacagcgaaagcttgtttaattcattgaccgcgttttcaagcatcagctgcgcatcgctgtactctgtctcattgtaatgttcctgcctgcttgcagtttcaaattgagataaagcataatcataagcatcttcgcttctttggatgtgctctccgacggattgtcttgtagccaaagtaaacccctccttaatggaaaaatccatcgtgattagtttggccatcacagctgtgatcattgaagaaaataattgggaatcggtttgttcttatcgtgtttatttgctacaattttaggatgcgtgatactaaaaggaggtccttttgtttgcatcagaacaacccttttccatatacgaacagtgaaaaacgatatcatacatggaattatcatttaagaaatcatttcggtcataaagtgtttaaagtcgcccttgacggaggctttgactgcccgaaccgcgacggtacggtcgcacacggcggatgcacattttgcagcgccgcagggagcggagactttgcgggaaaccgcgccgacgatctgattacccaatttaatgaagtgcgcgacagaatgcatgaaaaatggaaagacggcaaatacatggcgtactttcaagcatttacgaatacgcacgctcccgtcagcgttcttcgcgaaaaatacgagaccgtcctcggccttgacggcgtagtcggcctttcaatcgctacccggccggattgtctacctgacgatgttgtcgaatatcttgccgagcttaatgaacgcacatacctctgggtggagctcggccttcagaccgttcatgaacggacggctgatttgatcaaccgcgcccatgatttcgactgctacgtggaaggcgtgaacaagctgaggaaacacggcatccgggtctgctcccacatcattaacggactgcctctcgaagaccgcggcatgatgatggaaaccgcaaaagccgtcgccgatttggacgtgcaggggattaaaatccatctgctccacctgttaaaagggacaccaatggtgaagcagtatgaaaaaggaaaattaacgttcctttctcaagatgaatatgtccagcttgtttgcgatcagcttgaaattcttccgccggaaatgatcattcaccggattacgggtgacggaccgatcgaattgatggtcggaccgatgtggagcgtcaataaatgggaagtcttaaacgccatcaacggggaattggaaaggcgcggcagccatcaggggaaatggttcaacaaggcgaaagaaggcatggccacatgaagctcaagaaaatcctcccgtatgcgaaagaactgctgaaaacagccgcaggcgaaggagacatcgtcattgatgcgacaatgggaaacggacatgatactcactttttagctgaacttgtcggtgaaagcgggcatgtctatgcctttgacattcaagaagcagctcttatgaatactgccgaaagacttggaaacgagtataaagaccgggtgacattgattcaaaaaagccatgatgagctcaccacttcgcttcctgacgacatctcaggcaaggtggcagcagccgtgtttaacctcggatatcttccgggaggcgacaaatcggtgacgacaaaaagcgattcgaccatcgccagcatcaagcagcttctcaaaatcctgaaaaatgaggggctgatcgtgcttgtcgtctaccatggccatcccgaaggaaagcgggaaaaagacgccctgctcgaattttgtgcatcgctcgaccaggatacggcccgtgtcctctgttaccaatatttaaaccagcgaaacgatccgccgtttatcattgcgatcgaaaagaaagaagcggtccaaaagtgacatcctgaaatcctccgtttggaggatttttttcattcaaacataatgtaagcgatatcaaaataaaatatgaacactttagatttcggaattttctaaaaaacaccaaataatggaggtggtttcactctttgtcgcgaaattattgaaaactcatggaaaatacggagggatttcgctttgaaaaaatttatcgcttatcaaattttgatcgcactcgccattggagcagttatcggacatttcttccctgatttcggaatggcgctgcgccccgtcggagacggatttatccgtctgattaaaatgatcgtcgttccaatcgttttttctacaattgtcatcggagcggccggaagcggaagcatgaaaaaaatgggcagcctcggcatcaagacgattatttggtttgaagtgattacgacgttcgtgctcggactcgggctgcttttggctaatgtgttaaagcccggcgtcggccttgacctttcccatttggccaaaaaggatatcgacgaactctcgggctacacggaaaaagtggtcgatattaaacaaatgatcctcgatatcattcctaccaacatcgttgacgtcatggccagaaatgatttgctcgccgtgatcttctttgcgatattgttcggcgttgcagctgccgggatcggcaaagcctcggaacctgtcatgaagttttttgaatctgttgccaacatcatgttcaagctgacgcagatggtgatggtcacagcgcctatcggcgtgcttgctcttatggccgcatccgtcgggcaatacggcatcgagctcctgcttcctatgttaaaattagtcggcactgtttttctcggactgtttctcgttctttttgttttatttccgatcgtcggtcttgtttttaaaattaaatacttcgaagtcctgaaaatgatttgggatttgtttctgatcgcgttctccacgacgagcacagaaacagtcttgccgcagctgatggaccgcatggagaaatacggctgcccaaaacgggtcgtttccttcgtggttccttcaggcttatctctgaattgcgacggctccagcctatatttatcggtcgcctgtatctttttggcgcaggctttcaatatagacatgagcatttcccagcaattgctcatgatgctcgtgctagtgatgacaagcaaagggatcgccgccgtgccatctggctcgctcgtcgtccttctggctaccgccaacgcagtcggccttcccgctgaaggagtcgcgattatcgcgggagtggaccgcgtgatggacatggcgcgaacaggcgtgaacgtgccgggtcatgctgtcgcctgcatcgttgtttctaaatgggaaaaaagcttccggtataataagcgctttgtgcttgaaaaacaataccggacggaaagcttataaacggcaaaagctcaagccgataaacggtttgagcttttctttacgagcttttcatccacggcattttttgaattttgcggtatgccctgccgttaatatagaaaaagaaagatgttttgccgctcgctttaatcagctttttcgcaagccggccgatttccttctggcccgctactttgtcatccgacaaataaacgcctaacagtcctctgttgatcaaacggtgaaagttttcgtgcggaatcccgcgcaaatgttcatccgccatttcgatgaaatattcgagcctttccatcatatctgaatgtgatgggtaataagtgcagaaattcaaatccccgccgattaaatcttcctcctggtcaattaaataatcgagcaggatgtgcagtccctgtatgtacggaaaatagctgtcgcggatctttccggccatcgattcagtaaaatcgggacggacggaatacgatacgaggcagaagatgccgagcgttgaacccgcacaggccgagaactcataccattccattttcggcagagccgatttataattctcaaaccacgcttcgagccggggaacacgctcatgctccactacgtgtttatgaacttgcaggtcgcaatagtagctgcaaagctcaatcagatgctccttgatcagatcatagttctcaatttccgcaagcacgccttgacatgttttcactaagtcgtgcaaatagccttgatcatcctgatcttccctgaaccggtaatagtttttcaattcagccccgactgtcagcgcgtctttcatcgactggtgaagcatggtgaaatcatccggatcaagcgaggtgctccggtcgcatagattgtcgaggtagtcgcttatcgtctgatacgccgtaataaaccggatcgactgctcgattttgtctcctgaaagaagggccataatgccgccgccttcacagtgaaaggttttatccctgatgctggctttcgcctgcgttttcagttcgggattttgaatcgtttcagcttttcgtttccacttgtccaattcctgatgaacaaggggaaaaacctctctgtatactttagccattaatccaaaaggatgctccggtactgccaaagaatgcacctccattatgttatatactgctccgcaaacgctctggccgctttaaaaacgtcttcccgttcaggctcattgaaaatttcgtggtacaagccatcccattccctgtacgtcttattgtgggaagcaagctggttaaaccacttgacgaccatttttttgtcgacaagccagtcggtgcccgcctgcatgacaaagagcgggatgttgagaaaggcgtccgtcggctccatcgcgcttttcaacgcttttaacatttcttgataccatctgacagaaacttttgtgatatataatgaatcgttgatgtccatttcgatgacttctttgtttctcgtcgctttatcaggcgtgatcccggattcaaaccgcatagacggcgccaaaacgttgagccccttggaaatcaagtccagaaatttgttcggctttaattgcagcccgagacaaggggatgataaaatgagaccggcaatgccgctttgctgctgcttaaaccattcgatcgcaatcaggccgcccatgctgtgcccgagcataaacacaggcagttcaaatgctttcgccctggcgacccatttgtccacttcatcaatatattcttgaaaagagcgtatatgtcctctttctcttgtcgaagtgccctggccgggcaaatcccccatcacgacattaaagccggatgaacgccacatttcggacagccatttataccgcccgtgatgctcacatgcaccgtgaatgacgacgattgtagcaacaggtctttccgcttccatgcaccacatgctgaccacctcacacaattttataaatgaaaggatgaaacctatgatctacccttataaaaaaacggaacccgttattcatgaaacggcgtttatcgccgacaacgcggtcatcaccggagatgtaacaatcggagagcgatcaagcatctggttctcttctgttatccgcggcgatgtcgccccggtcagaattggaaaaggtgtgaacattcaagacctttcctgtctgcaccaaagccctgaacgccctctcgtgattgaagacggtgtgacggtaggccatcaggttacattgcacagctccgtgattcgaaagcatgcccttatcggaatggggtcgattattcttgacgaagcggagatcggggaaggcgcttttatcggggcgggcagccttgtcccgcctggcaaaaagatcccgtccgggcacctcgcattcggcaggcccgccaaagtcatccgtccgttaaccgacaaagataaacaggaaatggaaagaatacgcaaagaatatattgaaaaaggacaatactacaaatccttgcaaaaaaaagattagctttgctacaactttaccatttttccaccgataatttaagcaaaaaccttttcggccgcacgcgtctgcggcttttttctttttccgaaatctttacaaatacttatcatttgctaaacattcattttttacaataaaaaatgaagcagccatacatgtaaagggggttaggacatttgaataaactgatggttggcatttacaactttgaatgccggattttcctcggtatgaacagattatttcatcaaaaaacactcaaccgttattttcgttcctcaactcatttgggaggggctatgtgcacgatttctgcctgcctgtctctcttgctgttcggctcgggaagtgttcgtacagcggggatggccagcgcccttgcacttttggtcagccaccttcaagtcatgctgatcaaaaagctgtatccgagaaagcggccgtatttaacgctaaaggaaactcaggttttgcaaaatccgctcaaggatcattcttttccatccggacatacgacagctgtattttctgttattacaccgttaatgatattctttccgatactcgcgcttttattaataccggttggcgtcagtgtggggctctccaggatttatctcggtcttcattatccatcggatgttctggcaggcacagccctcgggatttcagtcggaaccttgtcggcgatgatcttctaagccggccgtttcttccaaagcgtcactgatttttcacacacaaacaggaggggaaacgatgaaaattgcgatatttacggacacgttcacaccagatgtgaacggctgcgccagaacgctgaaaaggtatacggattatcttgaaaaaaacgggatgccctataaagtatttgcgccggaaagcacgcatgaaacacaattttcgagccgcatccgccgttttacgagcatgccgttcttcttataccccgagtgcagaatcgctcttcctaatctcatcaaaatgaaatcagaactccgcgaattccatcccgatctcattcacatcgcgactccttttaatatcggcctggcggggctcaagcttgcgaagaaatggaacatccccgtcgtaggctcttaccataccgattttgaccagtacctttcatattatgatcttcaaatgttttccaaactcttatggaaatatatgctctggtttcataaagattttcgaaaagtttttgtgccttcgcgcgaaacatttatgcagcttaaagccaaacaattcaggaacctctccatctggaagcgcggcgtggactgctcgcagttcagtccggcgcatcaaaccgaacacatccgcaggcgatacggcataaaggaaacctatatcctcagctatgtcggaaggcttgcacctgaaaaagacttggagacgctgctcaagatcgcaagtcaccccgctttgaaagatgacgtccactggctgatcgccggagacggcccgttaaaaaaagagcttgagaagcgagctcccctcaacatgacttttgccggctatgtcaaaggagaagagctggcaagcatctatgcgagctcagatttgttcgtctttccttctccgacggaaaccttcggaaattccgcccttgaagcgctcgcctgcgggacgcctgttatcggggcagactccggcggcctgaaagattttatacagaacggaagaaacggttttctttccgaacctagaaatccggaagcattcaccgcaaatatattgcgcgtcctctccaacccatcgttaaaaaaacggatggcatacgaagcgagaagctatgcccttacccagtcgtgggacgtgatctttgacaatctcctctccgaatgtgaaagcgtgcttgcagatttatcagcagaaaaaccggcataaaaaaagaaggttttcggttaatcgaaaaccttctttttttggcttaaacaataatgacctcttttggctgatggttcagctcttccggtacaaagcgtttttcaacgaaaatgctgtgccagatcataaagatgagaaccgtccagattttgcggctgttatccgctttgttggcgcagtggtcttcaagaagctgaagcacgtaatctttatggatatatgcatctgtctcgctctctttaatgatgttcacggcccagtcatgcatttcgtttttcagccagtggcggattggcacagggaaccctagttttttgcggtttagcacgtgttctggaacgatgccttccgccgcttttctaagaagatattttgtcgtgccgtttttcgttttcagctcttcgggaattttggaagccgcttcaaatacgactttgtccaaaaacggaacgcgaagctccagcgaattggccatcgtcattttgtcggccttcagcaaaatatcgccgcgcagccatgtgtggatatcgacatactgcattttattgatttcgctgtaggacctgctttcttcaaaatatggctttgtcacgtcacagtaagacaggttgctgtcatattggcgaagaagttttgatttcatgccttcttcaaaaatctttgcattgccgatatatctatcttcaagaggagtacagcccctcattaaaaagcttttccctttcattccttccggcatcgctgaagctacgcgcagaagcatctttttcagcggggacgggatccgctcaaacggctttaatgaaagcggctctcggtaaatattgtaaccgccgaacagctcatctgccccttctcctgacaaaacaaccgtaacttgcttcttcgcttccttcgcgacaaaatacaaaggaatcgcagcagggtctgccagaggatcatccagatgccagacgatctttggaagctcgttcatatattcctcaggggaaatgatcgcgctgaagttttccacgccgaccttatcagcggtttctttcgcaacgtcaacttcgctgaagccttcatgttcaaagccgacagagaacgtctttaagttgggatggaattgcttcgccactgacacgataaaggacgagtcaatgcccccggaaaggaaggaacctacaggcacatcgcttcgcatatgaacttttacagaatcaaagatcgcgtctcttacttcctgaacaagcttgtcttcttctgtctgaaccggcttgaattgaactttccagtatgttttaaattgaatatcctcacccgggcggacggtaaactgatggcccgactctactttttgcacctttttgtccagcgtctcaggctccggaacgaattggaacgatgtatactgctgaagcgctttttcattcaattccaagtcagcatcgacagccatcaggctctttctttctgacgcaaaataaacgtggccgtccgttttcgtaaaatagagcggcttaatgccgaacggatcgcgcgctccgtatagaagctgctcttttttatcccagattaaaaaagcaaacataccgcgcagctttgaagcggcttcctgtttgtagtggcggtaagtcgcaagcaaaacttccgtatctgaatcggttttgaactcgtatcctttagaaagaagttcgtctttcagttctatatagttatagatttctccattaaaaataatccaataggagtcgtcttcataagacagaggctgtcctccattttccacatcgatgatgctgagccttctaaatccgaagcctacatgctcatcatgatagtacccatcatcgtccggaccgcggtgtacaatcatttcattcatttgtttaatcagttcttcctgtgctgctgtctcggatgatgggcgatgattgaatacccctacaaatccacacatagtattgcctccgattttttaaatttcgtgcagaaatcaaagtctgcttcttgattagacaagtgtttaaagaaaaacgtttcaagaaacttgaaaaatgttcatattaaaatatttgtatctggcaatatcacatcaatattaaatctggatatttttcaagtttcaacatccgcccgcattttgccatcgaaaaacaaagccgcttattaaagcggctatgcggttgttattctcctaatgcatctttcttcagctgatctgctttgtctgtgcgctcccaaggcagatcgagatcgaggcggccgaaatgtccgtaagctgccgtttgtttgtaaatcggacggcgaagatcgagcattttaataatgccggcaggtcttagatcaaagtttttgcgaaccacttcgatcaatgtttcttcactcgctttgcctgtaccgaatgtatcgattgaaatggacaccggctgagcgacaccgatcgcgtaggcaagctgtacttcacaggaatcagcaaggcctgcggcgacgatatttttcgctacatatctcgctgcataagctgcagatctgtcaacctttgtcgcatccttgccggaaaacgctccgcctccgtgacgggcatagccgccataggtgtcaacgatgattttgcgccctgttaaaccggcatccccctgcggtccgccgataacaaaacggcccgtaggattaatgaagtatttcgtgttttcatcgatcagctcttttggaactaccggattgatgacgtgctctttcagattgcgctggatttgttcaagcgaaatctcaggatgatgctgagtcgaaatgacgattgtatcgatgcgaatcggcttgttgttctcatcatactcaacggttacctgtgtctttccgtccggacgcagatacggcagaatttcctctttgcggacttctgtcaaacggcgagacaatttatgggcaagcgaaatcggcagcggcataagttcctttgtttcgttgcaggcaaaaccgaacattaaaccttggtctccggctccgatcgcttcaatttcagcgtcgctcattgctccttcacgcgcttcaagcgcctggtcgactcccattgcaatgtctggagactgttcatctatagacgttaagaccgcgcaagtttcggcatcaaaaccgtattttgcacgtgtgtagccaatttctttaatcgtttcgcggactgttttcggaatatcgacgtatgtggacgtcgtgatttcaccgcttaccagcaccaatccggttgtcacagatgtttcacaggcaacgcgggcattcggatctttctttaaaatttcgtctaatatactatccgaaatctggtcgcaaattttgtccggatgtccctccgtaactgactctgatgtaaataaccgacggtttttgctcatttatgtttcctcctgtatatgaagatcagccgtgatcttaagtatgatacggaactcgtccctcttgattatatgacgatactcgggcttcatacgctctcgttttgaaacaatttccattatgctattcttgacgagattctgagtcgaaattccccttagcagaatttttcctgactggttgcccggctagacctttcacgtcctgtgaaaaacgcccagtaccttcctcctgaaggcagtttttttagcaatttttggatctcgatttatgcaataaaaaaaccttttcctattcggtgaggaaagggtctggtattgcgtgcctttcactcttatcgctcaaggtattgaacaccttgcatcaggttagcaccgtagttgtctcagaaactgtttttttccattaataagagaaaccggttgctgggtttcattgggcctgtccctccaccagctcgggataagagtatccgctcaatgaaatatcttatcttaaaatggcttgttatgtcaatatcggccgaaataaatttgaacttgtcctacgagaaaaaacccgaacgaaaaatgaagaaacggtatagactataagagtaaatgtgttatactaattctacattaatgttatacacattaaaaaacacgcaaaggaaggttttttatgaattctgtagatttaacaactgacttacaaacgctattaacgggcgaaaacgttcagatgaacttatccgttccccatttggttgaaaagatccttgagcgcaaagaaggagtcttgacatcttccggagccgtgcgggcaacaaccggtacatacaccggccgctcgccaaaagacaaattcattgtggaagaagcgagcacaaaggacaaaatcgattggggcgcagtaaaccagccgatttcagaagccgcctttgaccggctgtacgcaaaagtgctcggctatttaaaggaacgcgatgaattgtatgtatttgaagggtttgcaggagcagacgaaaaataccggcttccgattactgttgtcaacgagttcgcctggcacaacctgtttgcaagacagttgttcatcagacctgaagaacatgataaaaaacctgaagaacagccgtttacgattctttcagctccgcatttcaaagccgatccgctcgttgacggaaccagatctgaaacgtttatcatcgtgtcgtttgagaagcggacgatcttaatcggaggcaccgaatatgccggagagatgaaaaaatcgattttttctattatgaattttcttctgcctgaacaaaacattctaccgatgcactgttcggcaaacattggcgaggaaggcggaactgctctcttcttcggattgtcaggtacaggcaaaacgacgctttccgccgatccgaagcggaagctgatcggcgacgacgaacacggctggtccagcacaggcgttttcaacattgaaggaggctgctacgccaaatgcattaacttaagcgaagaaaaagaaccgcagatttacaatgcgatccgcttcggttccgttctcgaaaatgtcgtggttgacagcaaaaccggagagccggactattccgactcattctacacggaaaacactagagcggcttacccgattgacgcgattgacaacatcgtcaagccgagcatcgcagcgcacccgcagaccatcgtatttttgaccgcagatgctttcggcgtgcttcctccgatcagcaagttaacgaaagaacaagccatgtatcatttcctgagcggatatacaagcaagctcgccggcaccgaacgcgggatcaccactcctgaagccacattctcgacctgcttcggttcaccgttcctcccgcttccggcacatgtgtacgctgaaatgctcggaagaaaaatcgatgagcacggggtcggcgtctttctcgtcaatacaggctggaccggcggcggatacggaaccggggaaagaatgagcctcgcatatacgagagcgatggttcaggccgcaatagaaggagaactggataaagccgaaatgaggactgaccgcattttcggacttcattcacctgtccacgttccgggtgtgcctgatcaagtgcttgacccggccaaaacttggacagatgaaaacgaatacgaggaaaaagcgatccacctggcgaaagcattcaaacagaatttcaaaaagttctccaatacggaaaacatcgaaaaagccggaggaccgctcgtttaactcagcctgcttgcatcagcgcagatcttctgcgctgatccagtttatcgaaaacctcttcgcctatcagcggccgatgccatttcctgggcaatgatcaagatgacagtcaagcaccgcctcagataaaacgattccaatttgcaagtattattatttgaaaatacagactttttttatttttaacaaaagaaatctttcatatgttaatattataaaaacatttgtatatttcaggaggacacatctatgaaatttggattactgccaaggatcattacggcaattgttcttggtgttatcgtcggaagctttgctccgctttggttcgtcaaaacggcagctactttcaatgatatttttggaagcttcattaaatttgtcattccttttattattatcgcttttattattcccggcatcggacaaatcggcagcggcgccggaaaaatcctcggcattacggcaggtatcgcctacacgtcaaccatttttgcaggcctcctggcgtaccttgtcggttcaaaccttcttcccgcgatcatttccggccatcagctgcaggagtttaaaaatccggaagaagtactgcaagcaggatttttcaccattgaaatgacgccgtttatgagcgtgatgagcgcactgatttttgctttcatcatggggatcggcatcgcttatctgcccggaaaaacattaaaaaacgcgtttgatgaatttcaaacgatcgttgaaaagctgatatcatatattattattccgttactgcctgttcatattttcggtattttcaccaatatgacgttcggcggtcaggtgcagacgattctatccgtatttgcgaaagttttcgtgatgattatcgtgcttcaccttgtcatactcttgattcagtactccgttgcgggtgctgcaaacggcagaaatccgctgtcgctgttgaaaatcgtagcaccggcatacttcaccgcgctcggcacacaatcgtcagcggcaacgattcccgttacgctgagacaagtcagaaaaacgggggcaagccaaaaagtggctgacttcgccgttccgctcctggccaacattcatttgtcaggaagcacaattacactgacaagctgtgcaatgggcgtgatgattctaaacggtcaaacgccgactttttcggtcatgatgccgttcattttaatgcttggcgtcacaatggtcgcagcgcccggtgcaccaggcggtgccgtcatggccgctgccggattgttgcagtcgatgctcggctttaatgaaactagcgtatcgttgatgatcgctctttaccttgcccaggacagcttgggcacagcaacgaacgtaacaggagacggcgctctcaccatgctgattcacaggctgacttccaaaaaaggaatcggaaaagaggaaaatgtgcctgcataatacagaaaagccaaggacgctatccgcgccttggctttttttaattcgtggaatttaatgatacgagcctgtatgttaaatgagtccgtccgtctgaccattcaaggcgctccgcctgcgcggtgccggtaatgtcgccccgcttggtctttctgacttcaagcggcacatgaagagggtaaacccgataaccttctttctcgagtgtaaacacattttcctcaacccgcgtttcttttccttttgtcacaatcatcgtgttaaattcaactggcattcccacctaaagtccccctccttttctcttttactttagtttaccataacttgtccaaggacggcttttcatccattgggataattctctaacaatccgcctgttttcgcgcggaggaaaatagtgggtatattggctgaaataccacgtatccacagacttgttccttcgcagaagttcacgctcaagacgccgcgcatgctcgatggagacattttcatcgtttgctccgtggatcaaaagcacgggcgcttcaatcttctccagctcgtcaaaaggcgtcctccattcatacgcttcgggaaccttttcaggcgtcccgccgatgacccgcttcatcatccgccgcaaatcttttcgttcgcgataggtcatgaccatgtcgctgacaccgccccaagacacaaacgaagcggccgctgctttcatttcgattgccgttaagatgcccatgattccgccgcgggaaaagccaaaaatgtgaacgcgtccgtcctttaccagttcgtgcttctgaagaagacgaaaagcggcaaaagcatcttcccggtcattacctgcaaaatcctcatcgccttctcctccttgattgcccctgtaaaacggagcaagaacgacaaagccctgtgaagcgaactggacgattcggcccggtctgaccatcccgacgtttttaattccgccgcgcaaatacaaaaacccgtcataatttccgggagcggccggttcggccaaaagccccttaaccttgagtccttgtgaaaggtatgtgacggaaaacagacgcacctctttgttcggcgatggaaaccttcttttttctatccacattcgtcacgtcacctcttttaatccgcagctgtccctcacacctgtttagtatataacataaactattttatgccgaaaataaccgaaatcaaaggagggaaatcggtttgaaacgtttcttttttaccatattatccttcatcatgatgctgtttatcctcgcttcatgcggcggacaaaagaccgaaaagatccgtctggcggaagtgacccgttccgttttctatacgcctttatatatcgccttatctgaaggtttttttaaagaagaaggccttgatgttgaactgaaaacgacctggggcggagataaaacgatgactgcccttctgtcaaacggcgccgatattgcgcttgtcggctcggaaacgtcaatatacgtaaatgcccagggcgcaagcgatccggtgattaattttgcacagcttacccagacggacggaaccttcctcgtctccaggaacgattcggggcatttcagctgggatgatttgaaagacaaaacgttccttggccagcgcaaaggcggaatgccgcagatggcaggcgaatttgtcctcaaacagaaaggcatcgatcctaaaaaggatgtggatctgatccaaacgattgatttcgcgaatatcgcaaacagctttgcatctggtacaggtgattatgttcaattatttgaaccccaggcatccatttttgaaagagaaggcatcggccgcattgtcgcctccttcggaaaagaatcgggccgaatcccatatacaacttttatggccaaacaaagctatttaacgaaaaacaaagaagcggtcgaaaagttcacccgcgcggtttacaaagcgcagcagtgggttgagacgcactctgcaaaagaagcagccgaaagcattcaagattattttaaagataccgagctttcaatcattgcatcttcaatcgaacggtataaacaacaacagtcttttgctcttgatcctgttttggatgaaaaagaatggaaccagcttcaaaccatcatggatgaagccggcgagctgccgaagcgcacccctcatcaaaagctggtcaatacaaagatcgccgaaaaggtcacaaaaaattactaggaggtggccgcagtgtcttttctgcaagttcaggatgtcacacatacttacttttcattgaaggaaaaaacagcggcgctggaaaacgtcagcattgaagtcgaaaaaggcgaatttgtttcgtttctcggcccaagcggatgcggcaaaacaacgcttttatcgatcatcgccggcatcgtttcccccacggaaggacgcgtcttggttgaagggcgcacacctgatggaaaggatcggcacatcggttatatgctccagcaggattatttatttccctggaaaaccattgaggaaaacgtcttaatcggtttgcacatttccaaaaaactaggcccggaaacgaaggaaaccgctctcggcctgctgaaaaaattcgggctttacgaggttgaaaaaaagtatccaaaagagctctcgggcggcatgaggcaaagggcggcgcttgcccgcactctcgctgtcgaccccgatatccttctgcttgatgaacctttttcagcccttgactatcagacaaaattgaacctcgaagatttagtgttcaacacgttaaagacgtatcaaaaaacagcggtgctcgtgacccatgatatcggtgaagcgatagcgatgagcgaccggattctgctattttcaaagcagccgggcactatccataaaacatttgccgttcctgaaccgatcaggaagctgacaccgtttgaagcgaggcaggaaccggaatttcagcccctctttcagaacatatggaaggagctcaatgaccttgaacaacaaacatccgaaaccaaaagttgacttccttcatgaggcttttttaaaggagcagcaggccgaaaaaaggcgggtccgcttttttcaaatcgcgattttcatcgttttcttttcgctgtgggaaaccgcaagccgtctggcatggatcgatccgctgatcttcagctctccttcagccgtctgggcgcttttcctcgaaaaaatgggagacggatcattgccgggacatatcggtgtaaccgtatttgaaaccatcctcggctttctggccggaacattgcttggaacttttctagccgccctcttatggtggttcccgaggctctccaaaatattagatccgtatcttgtcgtcttaaatgcgatgccgaaagtggcgctgggtcccattctcatcgttgcgatcggccccagcttgacgagcattattgcaatgggcgccatcatcagcgttatcattacgactatcgtcgtctatacgtcctttcaagaaattgatgaaaactatttaaaagtgatgaaaacattcggcgctacgaaacgcgagattttcaaagaagtcattttgcccgcttccattccgacgatcatatctacactgaaggtcaatgtcggcttgagctgggtcggtgtcatcgtaggagaatttttagtatcggctcaaggcctcggctatatgatcatctacggctttcaagtctttaatttcaacctcgtcatgctgagcctcctgatcatcgccgtcttcgcaacattgatgtatcaaggtgtcgagctgttggaaagaaagtggatgaaaggcagagtataacatgaaaaaaccctgcaaatgcagggctttttatttgatgatgccggcctttttcagcttttcaagactgatcgtcaggacggaatctttcataataaaactgtaatttttgttttttgcgatatccttcgggaggctcttcagcaaaacaggaccattcgtctcatagtacgtctgctgtttttctatcttttcgatatcggcaaaataaatatttttgacgatcactttctccctgccaagaactttatattgtccgagataggtcagctttcttacgacagcgcccgtttcttccttcacttcccgcaaagccgcttcctcagcgttttcgctcggttcgactttgccgccggggaattcacggcccctgtccttatgatttgtcagcagccattgatcctcgtaacggcagatcacccatacatgctttggttcttttgaaaaaggttccttctcaaaagaaagctgaaccgtattacggtaaaaatctttaaattcgtacatcctaatccctcttatccgtttccttgcttcttccactcatcatatcatatattggttctttcggtagagtttttgtccagttcagttcagtaattttatcgttccctaaagaacttcattgtccattcctgagtgagaaggcggcaaggctggatgactccgcgcctgcgggcgcttttcaaaagcggcattttttaatctgctgaattgagttcggcaaggccgttttcactgataaatgacttggtttcttcattgcccagacggtaaagcatcgagtaaatgtctttgcgcagttcgtccattttatcatttgcactgtcattgtgatattcgaccgcaggcacgtgagctctgaaaaagttgacccagtcttctgaatacagctgatcaaaatattcccttaaaatgatgatgtcatcatctgtcgccgaaatttgaaattcccacggggaagcgtcagagctctgcgaaatcattccatcttgcaccgaaacatagtatgtctttttttccaaagccaatcatcctttttcgtgttagtatgaccagttgttttaaaatgttacggctttccccggagtttttcctttatggtatttaaaatgtccaataacatctgcggcacggggattcctaacgaatgagccgtgctcacgatttgaaacgcttcatataaaatataaaacataatagaaaaatcgcggatcgaactgcctgtttgcagcatttgatcaaaaaggtgggcaacggatatcagaaagagcgtaaccaattttttcgccagccttgtaaacagcctcttaattgtaaatcgatcttccacacattcgttcaagcttttgctgacaaattcaatgcccatcagcgtaattaagatcataaataaatattcgattcggccaaacaaaaatccgatggccgataaaccaattgtaaagagcgaaaagatgcttaagtccttaaacatatgcttcaacatcctttcaaaaaagacttttcatagcttatcctatgaaaaaagactttgaaaggcttggatgaattgtttgacaatttctaaaaaaggctttaaaaagaacgaaaacacaaaaaagctcaggcattgcccgagcttttccttaccctaagtaggctttcagcatccagttgtgtttttcgatcgattgatgaatcgcgagcagcatgtctcccgtcgtttcatcgttgacttcatcggcaagctccattccgcttttcagctcctcagccaccgttaaaaagtcattataaatattttgcaccatttgttcagcagactcgcttccgtccgcttctttaatcgcggacatttccaggcattccttcatcgttccgaccggagagccctgtatggccaataggcgttcagccaaatcatcgatatgctctgccgcttctgtgtaaagctcttcgaatttttcatgcagcgtaaagaaatctttccctttcacataccaatgataattatgtagcttcacatatagaacggtccagttcgcgacttgtttgttgacggttgctttcaatttttcagacattagatcgtcctccttttcgtttacttttgatttacccgtttagcttgtgcaggaaacatttcttttactctttatcatgattttctttgcctgatatggtaaactgttggaaaaagctattcggaggtaagtgatgatcctcttttggattattgtaggaattctgatcaccggcgccgttctggccatatcgcttgtcacaacatcaaaagcttatgacttcaagcatgaagtcgatcccctcccgtcgcgggaagaagaacagccccatcaatgatggtgggcttcttctttttcatcttcatcggtctcatccgtcgctttccctactttaatgtctgcaacaggcattgtatgctgttttttcgccgtgacatggacttggactttgtaatggccgtcttcaggaaacgctttttccatgctgtatacgccttttccctcattcttcgctttgattagctcgctatcttccttgctcccggccttccagcattcaaactccacctcatcggcatctgcaaccggctcttccccgtagaggacggtcgcttttatgacagccttttcatttttggccgccgattcaggcgtcgccagttttgccgtcagcactttgggctcctcatccgatgccgcctgcttgtccccctggctgcaggcggaaagaccgaccgctaaacataagagaatgaaccattttccaaaacgcatcctatcacccttcttctatgatatgtattacaatataaagtgtagcaaagttcagggataaatggcattattttctttgtgaacaaaaaatgaaaaccggctctcttatgagccggtttttttcaatcattttacccaaacaccttgagcaggtcttctttattttgcgaaagccaaaaacgcatcatgcgctttgcgccttcaagatcgtgaagctttgcctggccgcactgtttttcgttagccgccggaatttcagtcacttcaacggcttctttgaacgtatcctcaagcaaatcaacgatttcttccactttcggctcaccgcttaccaccaggtaatagcccgtttggcagcccatcggcgaaatgtcgataatatcaaagtggtcatatttttccgcatatgtgcggattgtaaatgcaagaaggtgctccaaagtatgaatcgtatcaggtttcattgcctgtttattcggctggcaaaaacggatgtcaaacttgttgacgacgccgtccgttcccactttgtggacgccgcagtgtctgacataaggcgcttttaccgcattatggtcaagctcaaaactttcaactgaaggcatggttcctctctcccctctaatcggtctttttgtattatatcatactttaccgataagttttcaggtgaatgcttttcctttttatgcgttttttgcttatattataataagatcaaaacaaaaaaggtgcgaaaaacatgaaaaccgtattcctgctgctcatccgcttttatcaaaaatggatatcaccggctcttccgccgacctgccgtttttatccgacatgctccaattacggtcttgaagcgatcgaaaagcacggcgcatttaaaggcggatggctcaccatcaagcggattctaaaatgccatccgtttcatcccggcggaatagatcccgttccggaaaaaaagcaaaaggattagcgctcttccggatatccgttgacaatgagatccagtctgcctgtttccggatcaatgacaagtccgtgaacaggtacttcctccggcatcagcggatggttccgaataacgcttacactgtccctgacgctgtcctctacagaatcaaagcttttcagccattgttcaaaatcgacgccggagtactcaagcgtttcaatccgttcttttggaatgccgcgcttgacgactttgtccaaaaagctgtcgcagctcagcttgctcatgccgcagtcataatggccgatcacgcatacttcatcagcgttcagttcgtataccgcaacgagaatgctccgcataatacttccgaaaggatgagccacgagtgcgcccgcgctcttaacgatcttcacgtctccgttccgcatattcatggcatgaggaagcagctcgacaagccttgtgtccatgcaagacagaatcaccattcttttatcgggaaacttgcttgtttgatatttttgatagtcctgccgttcaacaaactgttgattgaactgtagaatattatccaaaagtttcatggctcatttcctttctaaacgctttttatatctaaatataacatatttcttgtatttttttcacaagtccagtaagatttcctttgtgcaaatcgaaacaattacgttttaaggaaggtgaaaaacatgaaggaaaacctgattccggtcactgttttaagcggttatctagggtccgggaaaacgacgctgctgcagcatgtcctgcatgaagcgcacggcttgaaaatcgccgtgatcgtcaatgatatgagcgagattaatatcgacggctccctcgtgaaaaaaggtgacctcatccgcacggatgaaaagcttgtcgaaatgcagaacggctgcatttgctgtacgctgagagacgatctgctcatcgaagtcaaaaagctggcggagaacggcggaatcgattatattctcattgaatcttccggtatcagcgagccgattcccgtcgcccaaacctttacgtacaaagatgaggagctgaatattgatttaggcaaatattgcaggcttgatacaatggtcaccgtcgtcgacggcagccgtttttttgaggacttcgcttcgggcgagagcctattggaacggaagcaggcggcagatgaaacggacagccgggaagtggccgaccttttaattgagcaaattgaatttgccgatgtcctcattttgaataaaactgatttactcaatgaagaagagcaggaaaagctgttctggtccctgagaaaactgaatccggactgcagaatcatttctgcggcattcgcaaaagtgccgctttcggccatcatgaatacgaaatcgttcgattttgaaaaagcaagtcaatcagcgggatggatcaaagagctgaatgaagagcacacacctgaaacagaggaattcggaatctcttctttcgtctatcaaaagcaaaggcctttccatcctgaaagactgaagcgctggcttgaaaactggccgccgcaaattatcagagcaaaaggcttcttctggcttgcttctcgaaatgacacagcaggccttctgtcccaggcaggctcttccctgatgatccaaagcgcgggcccctggattgcagcgtctaccgaggaagaacaaaagctcgcgtttgaagaggaccctaatttgaaagcggactgggatgaaacatacggagaccggaaaacggaaatcgtttttatcggcattgacatgaatcaggaagacattatccgctccctggatcagacccttcttacagataaagaaatgaattcagactggtcggccttacttgattcactgcctgagtatatttaactatcatttcctcttttcaaatcgtaattattacgatacaatgatacaggaccattaaatcggaaccatttcagttttacattgagaggagaaataccatgaaaaaaacattcggaatagcatctgcattcattcttgctgccggattaacagcgggttgctcaagcaatggagcttccagtgaacaaaaagaaaataaagacacgctggacatctatacaaccatttatccgcttgaagacttcaccaaaaagatcggcggagaatatgtgaacgttaaaagtgtttacccgccaaacgttgaagcgcacacttacgagccaagctcaaaaacgatggcggaaatttccgactcggatgcctttatatactctggagtcggtgttgaaggattcgcagacaaagctgtaagcacacttaaaaacagcgacgtcaaaatcgtcaaagccggggagggcattgaccttctgtcacgtgaagaagaaggcgaacatgatgagcatgcacatggagaagaacacggtgagcacgatgagcatgcacatgaagaagaacatgaacacggagaagccgaaggtcacgatcatcatcacgaccatggagatcatgacccgcacgcatggcttgatcctgtccttgctgaaaaaatggccgaaaacattaaagaccaactcgtaaaattagaacctgaacacgaaaaaacgtttacgaaaaactatgagtcattaaaaaaagacttggagcagcttgacaaagacttcaaacaaacagtcgacaaagctgataaaaaagaaattctcgtctcacatgccgcctacggctactgggaaaaacgctacggcattaagcagataagcgttctcggcctttcgcctactgaggaaccttcacaaaagcagcttgaaaacattgttaaaacagcgaaagaacataatattaaatatatcatttttgaaagcaatgtcagcagcaaaatctccgagatcatcaaaaaagaaatcggagcggaaagtctgacgatgaaaaaccttgaatctgtaacaaaagaagacattgaaagcggcaaagattataccgccatcatgaaagaaaacctggacgtcttgaaaaaagctttatcaagcaaataacagagaacaagcgcatgagatgtcatgcgcttgttttttaaatggacgaaaaaaaaggccggaaacatccggtctttttaatttattaatccatattaaatcttttcttgaactgttcgacccttccgcctctttcattgaatttctgtcttccggtataaaacggatgggtatcagagctcacctcaacttttataacgggatacgtcttgccgtcttcccactcggccgtctcatcggaagttttagttgagcggcttaaaaaacggtacccgctgtttacatcctgaaagatcacttgataagttttcggatgaatatttggtttcatatgccattcctcccgtcaaaacgtaataattacgttttattatatacctttcaaatccctgtgtcaaaaatgaatgttcatttgccatacttaatccctttatccattttaacctcctacaggaagaataatctaaaaaaggcggtaaacaataaaaagcaaaatggtgtaaatgaaaggtggttttccggatgaatgacttgatttttgcaagaagccttttcggaacaacgatgggattccatattatttttgcctcgctcggtgtcggaattcctttgatgattttgctggccgagctgatctatcaaagaacgaaagatccccactacgccattatggccaaaagatggacgaaggcgcaggccgtgttgctcggggtcgccataccgaccggaaccattgccggcacgcagctagccctgctctggccgggattcatggaagtgatcggaaaagtcatgtcccttccatttcaaattgaaatctacgccttttttattgaggctttatttatgtccatttatgtttacgcagccgatcggctgactccacttatgagaattacagccgtcatttttatcgttatcggagcagccgcatcggccatcttgattacaaatgtgcacgcttttcagggaacgccagaaggcttcaaaattgtaaacggtgaaattacggatgttcagccgtggacggcgttcttcaacaaaagctttgtggccacagcaggacatgttgtcgtctccgcttttatgacaggtgcgtttattattgcgacgatagccgcctacaaaatgctccgaaaccgcggcgatgatagagtctacgcccttcataggaaagcgctgctgctcgggctgattgtcggaggagcgttttctctggtcacggctctgagcgggcacgaatccgcacagctacttcaccgctaccagcctgaaaaactggcgggcgcagaagggctgtttgaaacccagtcccatgctcctcttgcgatcggcggatttactgatgaaaagacgcaatcggtgaaatgggcgattgagattccgtgggctttaagctttttggccgacaaccgctttgacaccgtcgtaaaagggctgaatgactttccaagggatgagtggcctcccctgttcattcataccttatttaacggcatggtttttatcggcagccttttgattgtttatgccgctgtgggttttatttggagaaaagtcatgaaaaaagaccgctttccccgctggatgctggccgtgttcataaccggcggcccgctcgcattgctcgcaatcgaacttggctgggtattcgcttgcaccggaaggcagccttgggtcatttaccatatgcagaaaacgtcggaagtagtgaccacctccggctcgatcggcatattgtttcttttgttctttatcgtctatatcattttaggagcagcggtggtgttcgtattgcaatattactttaaacgccatcctgttgaagaggacttaaaaagcagctgaatgcacaaaaaaaacagaagggaagtcatatgatgcaactggatggaacaacagatgccctgctggctatttcgatcgtctggggatttatatttatatacgccgttatggcgtcgatggattttggagcgggattttggtcgatgatttatatgaacaaaaaacagctgaaagcaaccaatattgcaaaccgctatctttctccgacctgggaagtaaccaatgttttcatcgtcggaatcgtcgtagcccttttcagctttttcccgggcggcacttttgtgctggggactgtgcttttgattcccggcagcatcattttattgcttttggcgattcgaagcggatttttggtcttctcccacgctgcaaaagattatgaaagggcgctgacttacgtttcagggatcagcggctttatcattccggctgttttaatccttgtcttgcctgtgacacacggcaatttcgtataccaggtagacggaagccaccaattggactttgtcaatttgtttttaagccctcatgcctattcttttatgggcttcgccattttcagtacgctgtttctgtcttcactgctgctggctgatttttcaaatgtagccggagaaaaagacgcgtatcaggtctaccgccgaaacgctttaattaccgggccgctcgcactgctcatgtcgttcagcatcatgatgaccatgaggacggaagccagctggctttatacaaaaatgatggacgggcttccatggctgattttatcgtttttgctgtttctcgtcgcatttgcggctctgtttctgccaaacagacataacagcgaccggctgggaaagccgcgcctggctgtcatcgccattacgctgcagtattttacggcgagctatgtgtacgggagggcgcaccttccttacatggtctatcctgatgtcacgattcaatcgggcttcaccgcaccggagacattcagggcgctgttcatctcctacatcgtcggttttattattttattccccggcttttattatttctggaaattgttcatgaaggacaagcggtacatcaaacagcatgaataaggttaagctaaatgtgtacaacttttaaagggggcccaaactaaatggagcaaaaaatactgtgtgaagtcagcaactgcacctattgggaagagggtaacaaatgcacagccgacgccatctatgtcgtcagccatgctgaaggtgaaaaagcttctaatagtgaagaaacggattgcaaaacctttaaacctgaacatcattaaaacggatgaatgaaggagggacagtcgtgaataaagagtcgctgttacaggctttttatcaggaaatccacggggcggatgaaaccgcatttcaaaaagccgcccgctccttcatgaacttatgggattatgaatacggctgtctcgacgggctgccggatcaagcggaccgggtgatcggacagatcgtgcacgaagatttgcttttgggcgattaaaggaaagggctgtcataaaggcagctctttttatgttaaaaaaaccggctagaaagccggtccaaacgagaagggaataatgtacagctttaatatacatgagaggccgcctatttaacaaagcttgaaaatctggaaatcggcgtttaaaacagcctttactgcttaaaaacgtctattttagatgaattctttcttaaaatatgagtatcgacttcaaatcccattcccggtaaggttggaacctgaatatagccgccctcgatccggatttccggttttacgatatcctcttcccaataccttgaggatgaagaaagatccccgggaatcaaaaactgcggaagagaactcagtgcaagattatgggctcttgaaatgccggtttcaaacatgccgccgcaccagacaggcatttgatgttctttgcagatgtcgtggattttcagagcttctgtcaaaccgccgactcgggacggctttatattgataattttgcagctgccgagctcaattgcctttcgcgcatcagcagccgaacggatgctttcgtcaagacaaattgatgttttgatatgtttttgcagatggcggtggtcaacgatatcatcatcagccagcggctgttcgatcatcattaatttaaatgcgtcaagctctttaatccggctgatgtcttttaattcataagaagagttggcatctgccatcagcggcaccttcggaaaatgccggcgtatttcttttaaaagctctatatcctgcccgggctgaattttgatttttattctttgatatccttcttttacatattgttcaatttcctgaagcatatcatccaatggggcaagaccgacgacgactccggcaggaacttctgtttttactccgcccagcgcctctcttaaagagatcccttttttcctggcgtaaatgtcccaaaaggcggcttcaaggccggcctttgccattcggttgcctttgaatccgcgaagcgcctcgggcacttcggaagggtgtgtgaatgattcgcgcagcacagccggaatcaaaaaatctttgagcatgtggtagcatgtctccgttgtttcttcggtgtaccacggagatgaaaaagcggatacttccccccagcctgtcacaccttcttgatcagcagcttcaacgatgataaacttgcgatcctgaaaggtttccaagcttgatttaaaaggctttttcagccgcatgctgagatggtacaatgtcagctgtttgatttgaatcatggcgctctccctctacaatttatgtctcatcagtttatttgaagcatttctcggcagcctatcgacaaaatgaaatgctttaggcactttatatgaagcaagccgttctttgcaaaattcgctcagctcctcttcatcaacggggctgtcggcgacgagataggcgtggggaacctttccccaagttttgtcatcgactcctttcacccccgcttccgcgacattggggtgtgacagaagaacggcctcgacttcagccggatagatgttttctcctcctgatatgattaagtctgaacgcctgtccagcacatataaaaatccgtcatcgtcaaaatacccgatatcaccggttttaaaccagccgtcattgaatgagtctttatttgccgcctcatttttcaagtagcccttcataacggtcggcccttttacggttatttcaccatgttctccgggttggcattccgttccgttcttttcgattttgatgcttgatgcaaacagcggtttgccggctgaaccgagcttttcaatcgagtattccggggcgagggtcgcaatctgtgagcacgtttcagtcattccgtacgactgtacgacgggcagccgctttcttttgcattcctcaaggagagaaagcggtgctggccctccgcccaataacaggcaccttaatgatccggggcatctgtcgacttttgccgcaagcctcgacagcatcgtctgaacgaccgatgcaatcgttacttgctggtctttgatcgaacgaagaacttcttccgcgtcaaacctttgatgcaaaacgacagtcattccgtaaatgaccgatttaaaaagcgccgataagccgctgatatggaaaagcggcaaggcgatcagccagcggtcgtgttcttggagccccaaattcaaggcggatgaaaccgcgctgaaataatggtttgcaaatgtctgcataacccctttcggccgtccggtcgttccagacgtatacatgattgttgccgcatcgtccaaatgaatgctttcgatttctgtaaccggcgggcaagcggcgttttgaacgtcttcaatgtcaacagcgcgagccggctgtccccctctatgctcttctatgaaaggcttctctgtaagcaatagctttgcttcagaatgttcaatttgatatgatcgttcggccattgacagcttcgtattcagcaaaacgatgcgaacgccgagaagaaagcaggcatggacggcgatgaccatctccatccggtttgtgagaagtaaagccgctgtatccccattcttcagaccaaagctcttcagccggccggccgttttttttgcttcatgaaataattgaataaaagtcagcttgtgatctccctgaatcacagccatcctgtcaggtgtcagttctgctcgctgtttaagccaattcggatggtccatcagcatatcatcatctccaaaaaatgtcttgaatgataaaagaaacagctcagtcgcaccaagctgtttctctcttccgatttttaaggaaaacgcgggaactgtccgaagtctggacggcgtttttctttaaacgcatcgcggccttctttcgcttcatctgttgtgtaataaagcagtgtcgcatctccggcaaactgctggatgccggcaagcccgtccgtatcggcgttaaaggccgctttaaggaatctgagtgctgtcgggcttttctcaagcatttcttcacaccatttaatcgtttcttcttcaagcttttcaagcggtacaaccgtattgacaaggcccatttcttttgcttcctgagcgttgtactgacggcacagataccagatttcgcgcgcttttttatgtccgacgatacgcgccagatagcctgatccgtagcccgcatcaaagctgccgactttcggccctgtttgtccgaaaatcgcgttgtccgcagcaatcgtcaaatcgcatacgacgtggagcacatggccgccgccgatcgcatagcctgacaccatcgctacaacaggcttcggaatgacgcggatcagccgctgaagatcaagcacattcaaacgcggaatctcgtcttcaccgacatagcctccgtgtccccttactttctggtctcctcctgaacagaacgctttatccccggcacctgcaaggataatgacaccgatattggcatcatcccgcgcatatgcaaacgcatcgatcagttctgaaaccgtttttggacgaaatgcgttatgtacctcagggcgattgatcgtgattttggcgatgccgttatatgtttcatataatacatcttcgtattgacgttcgcttttccattctacagtcattgatgtgtacctcctactttaaaataaactcacttactattctaccaaaaaaatcgggctcttccacatgaaccgcatgaccggtatgttcaacaatctcgaggcgggcggctggaatccgctttgccatgctttcattgatggcgacaaatttctgatccaggcttcccgcgatgagaagcaccggataattgatcccgctcagtttgttccaccaagacggctgtgatccggtccccattccgattaagctgcctcgaaggccgatcggattgttgttcagacgttcttcgcgcactttttttctttttgaagggtccattgaaagctgggatgcaaacagcggaatgccttcccaataatctacgaaagacttgattccttcttcaagtatccgcctgctgagccggctgtcctgctccctgcgcgcttttctttcttcaggcgaatcaagccccggagaactgctctccagcacaagaccggacacacgctcggggtgaatcatcgccaaggataaggcaagccggccgcccattgaataaccgatgaggtaagcctgttttacatttaaacgatcaaaaatttcgatgagatccgctgcctgcttctctgttgtgtagcgccggctgtccgatggcgagtcggttccgccgtgtccgagcagattcagcttgatcagacgcatcccctgaaaatagccgtctatcccgtcccatgtggccgcgcttcctgtaaagccatgcaaaaacaccgccgttttttctgcagacaggccattgtcttcaattttataggaaacgccgtctttcagtgtcaatttcaaaacggccactcttttcttatttcatgcagcgcggaatcaagcatccggcgatgctgctccacacgatcatcgcgcttcgttttcacctcaatgatatccaagccgcggcggttgacggaggataaatacgcatcggcaaaatgtgcggatgattcagggcatatatagcgtcccccatacagcttggcagcatgctcgaattcgagacccgtcggcgttccgaacaagagctcgaagtacctttcttcagcagattggggaagaaatgagaaaatgccgccgccatcattgttgacgagaacgacagtcagcggaatatcgagcgttttgctgacgaggaggccgtttaagtcgtgataaaatgacagatcgccgatgacaagggttaccggttctttcgttgcggcatatatgcccagcgccgttgagacaacaccgtctatcccgttcgcccctctattggcaaaaatccggaaggtccgttcctgattttcaaaaaatgtgtccgcatcgcggatcggcatgctgtttccgacaaacacggagctgttgtccggaatcaaatgctgaaggttccggtagatatttccttcaaaggtaagatcctcagcttcaagatttcttaaaagagcgcggaagcggctgttggcaaaccgccacttctcaagccagttgcctgtcctattttctgaattgacagcggaatccgcaagaacagcaatctcctcttccgtgcaatgcagcatatgtgcgctgagctgagtcggatcgcgccatcctccatctggatcaacgacgatttgcctaatgctcggattttgcttcagcagctgaaaaagcggcttggaaaccggcatcgcaccgaagcggatgacaagctcaggcatgagctcgcgtttcagctgttcttctttcaataatgagtcgtatgcatcgataatggtttcttttgaatgggtgccgtttctcaagtttgagagcgggtcagccaaaattgggtattctgctgcctgtgaaagagctacaatatgttcttttgcatcatcatcttgcagctctccgcagacgattacgcctttttcggtctctttaatcagagcactcagcgctacaagctcatgccgatcagcacggaagcggccgctttcaaccgtcacatgactgccgcttctcagcctttgaaaaggttcatcctcaaggttcggcatgagcggctctctcagcggaaagttgatatgcacgggcccgcgcggcgcttttttggcttctccggctgcacgtgctgccaaagaccggatgtacgccagcatgtcaggatgactgtcaggcaaagccgagtctgtgaaaaacttaacaaagtttccgaataagaattgctgatcaatcgcctgaggtgctcctacttctctcagttcatgcggccgatcagccgttaagatcataagcggtattctagaataatgagcctcgatcacagccgggtagaaattcgctgcagccgtcccggatgtacagatcaatgcgactggcttccgcattgcctttgccatgcccattgcaaaaaaagcagcggatctttcatccacatggatatgaacattgatgtccggatgactcgcggccaaaatcgcaaggggcgtcgatcttgatcccgggcagatgaccgcttctgtcacgcctgcaagggaaagctcatcaataaaattccctatatattttgtaatcggattttcagtcaacggatatcgcctccaagagcagacagcatcggcttcatcttaatttgtgtttcttcgtattccataagaggatcggaatcagccacaaccccgcagccggcgaaaattctggccgcatttgaatcgataagtcccgacctgatcgccaccgcgaattccccattgccggacatgtcgatccagcccgccggtgccgcataccagccccttgacatcggttccaactccctgataacctcaatcgctttttgctgtggtgctcctccgagcgcaggagttgggtgaagcttctcgattaaatcaaaaatcgaggactccgcattcattttgccgacaatcggcgtatacaaatgctgcacattttttgttttgtaaagtcccggcttggccggctttttgatattgctgcaatttgacaaaagcgcctgatgaatcatattgacgacaatgtcatgttcgattagatttttttcatcgtttaacagctcaagaccgagcatccggtcttcctgctcactttcgcctctcttgattgaaccggcgaggcaggtcgacagaacgttctctccgtcttttttgacaagacgttccggagacgcgcccacaaaacttttgccgttttcttcaatggcgaatatatagctcgttttttgttcagacatcagattgaataatactctgtgaagttcgacaggctgatcgaacgttaaaaggatctctctggcgagcacgactttatcgtacttcccgtttttaatgtcgtctgtcgcccgccggaccgcttcaagccattcaggaacatcaagctcttccttggcggtatattgcgtatgacctttttccggataacgggaatcgtccgccttggtcagctgtgaagcagcgccctttatttcttcaagtactttgcgcacgtcttcttcaggagtcttccatctattgaccgttatgaatgtttcctctccgtcctgtgtcagcatagcggcgggaataaaaaaagcgccttcctggtagccgttccaatgctgcttgcgatcttccagcggatcaaatgaaaaaccgccaaacagcaatggccccaccgctgcctgacctctgctttgatcttcatgaaagtgataggttttctcttttaagcgctcccatttttcatgtacagcctgataacgtccggcatccttcagatctgtggaaaccgatatttcctttcccagcccgacaagcgtcagcccgccgtccggatcagaccagaagaaccgttccccggcaaattgttctttcccgtttatgaaaaaggaaagagcatctatgctctcaatttttctggaatagcttattaaaacagcatggttgacttttttgacgatgtttaatgcttcaggcgcttccttgaggaaagtgcgctgcactgttgtcaccatgatacattcctccaaaatccgtaaaatgcttttataaccatacacctgtgaacggtatgtgtcaacaaaacgacactttattaacaactgccaccacctattataaacgtaatcggccgattgaaaaagacaaggtcatttattattttcgaattgcaggacggccgctttttttctaacaatatcacccattatattgacaccttttttaactttttctaaacttagtatggacgtgtacgtattaaaactaaaggagtcatactttatgcagcatcaatcactttcagggagtgtttctgaaataaagccggaaaaatggcgcgtatggtggatgttaacaagaccccatacactgacagccgcctttgtccctgtaacgctcgggaccgtgatgtcccttgaatcggggaaaattgacatctggctgtttttagctatgctggccgcatcaatattgattcaaatcggaacgaacttattcaatgagtattttgattttgtaagaggacttgataatgaaaactcggtcggcatcggaggcgctatcgtccgctatggaatgaaaccgaagacggttttatacctggcatacggactgtttggagcagccgttttactcggcgtgtacatctgcgcttcttcaagctggtggcttgcgctgatcggattggtttgcatggccgtcggctatctttatacgggcgggccgtttccgatctcctatacgccgtttggtgaaattatgtcaggcgtttttatgggaatggtcatcatcctgatttcatactatattcaaaccggcgggctgacttggaacgtctttctgatctcccttccgattacgattttagtcggaggcatcaatctttccaacaatatccgcgatttggtcggagataaagaaaacggaaggaagacgcttccgattttggccggaagaaaaaacgccgtgcagattttaagctgggtttttgctgtttcctatatattgatcggtatatacatcggctttgagatcgtttctctgtggagctgcctcgttcttttaagcctgcctaaaccgattaaagccatccaggagttcaaggcaaaagaaaagccggcagaactgatggtcgccatgaaatcgactgcgcagacgaacacctttttcggccttctgctcgccatcgccctgcttattcagtacgttttttaaaaaaagagcctatacggctcttttttttgcttttatttacaatgaaagttctgtttgaattcgttcatactaaaaacgcgagcactttaaagaaacgaggcgatgcatgtgctaacaaaagaacagttgacaaaactcgaaaatgaactgaaagccggaaaagaacagatcatcagccgctttaaagaaaacggacattttggcatcgatgcgacgcacccgttcaactcgacgggcgatctttcggcttatgacaatcatccaggagatgaaggtacagaactgtacgaacgcgaaaaagaccttgccctttttgaacatgaaagagagcatttacacgatatcgaacatgctttagccatgatcgaaaaaggaacatacggccgctgtgaagtatgcggaaaggacatcccgtatgaaaggctgtccgtacttccaaccgcaacgacgtgcagtgaacattcgtcaaccgtctccgtttcaaaagatcggccgattgaggaagaagtgctgaacccgccgtttggacattttgaacaagacgaggacgatgaaaatgtcgcatacgattcagaggacgcttaccaggatgtcgaacgctacggcaattcggaaacgcctcaagatctggccgttccgcctctgtcatacagccagatgtacatggagtatgaagagccgctcggatatgtggaagattacgaaaactatgccgcaacagacattaccggaaaagatgttaccgtctatccgacgaaagaacacgaaaaatatgaagacctgcttgatgaagaaggcatcatgacctctttcggcgatctcccggcttatgaaaaggatccttatactgaagacgacgactaagcccctgaccagcggggcttagtgtttttaaattcaatgctggtacggcttaatttcccaaatgtcgtccgcatactcccggatggtgcggtcgcttgaaaaatatccggcatgcgcgatgtttgtgacggctttttcagcccaaagacgcttattcaagtagtctttttgaatccgctcctgcgctacaatataagaagcaaaatcttttaaaacaaagtattcatcattataagcgatcagcgagtcataaatcggctcaaattcgccggcttctccttcgaaaaaaccattgatcagctgatcggccgtttgtctgatccttgcatcatgctgatagtattcccttgacagatagccgcctttttccgcgtagtccagcacttcatccgcctttaaaccgaacgtgtagatacactctgtccccaccctctcaagcatttcaatattggcgccgtcatgcgtgccgatcgtcaaagccccattaatcatgaacttcatgttccctgttccggaggcttctttgctggccgcagatatttgctcgctgacatctgacgccggaaaaatacgctcggcggttgatacccggtaattttccagaaagatcacattgatcgaatgtctgacatccggatcatgattgattttatctgcgactgaatggatcagcttgatgacctttttggcataatgataagtcggcgatgccttcgctccgaaaataaaggtttgcggataaatggcaaagcctttgtcttccttcagcctgttgtacaaatacatgatatggagcacatttaaaagctggcgcttataagcgtggagacgcttgacttgaacatcgaagatgctgtcagggttgacggcgaagccgacgctgcctttcatcatgtctgccaaaagctgctttcgttcccttttaatgcgctgaaacgactcgagaaacgcggaatcgttcgcaaatggacgaagatccagaaggctttccggatctttcagccacctgtctcctatcgcttcagttatcaagttcgcaagcggcggatttgcctttaacagccaccttctatgtgagatgccgttcgttttattattgaatttaaaagggaaaacggaataaaagtcgttcatttcccgctcttttaatatggtcgaatgaatgttggcgacaccgttaacactgtagctgccgacaatcgccaagtgggccattttcacttcgccgtgggcgatgacggcaagcttttcgatcctttcccattcacccgggtatttttcccacagccagccgcaaaaccgctcattgatctcctcaatgatcatataaattctcggcagaagcggtttaattaaatcgatcctccatttttccagcgcttcggcaagcgtcgtatgattcgtatatgagatcgtatgtacggtaacatgccacgcttcatcccacgtcattttttcttcgtcaagcaaaattctcatcaattccggcaccgccaaagcgggatgggtgtcattgatatggatcgcgactttttggtgaaaatcatgcagtgacgggtgagtgttcttatagcgtttcacaatgctttgcaggcttgccgatactaaaaaatactgctgcttcaaacggagaatcttgccttcgtcatgcgtgtcatccggatacaggcattcagatacagcttctgtctcgcgcttatacttcaaaatattcggttcatgatggagcgagcaaggctccgcattccacagccgaagggtgttgaccgtcttggtctcatagccgatgattgggatgtcgtgaggcacggctgtcatcacttccgcatcttcctgccaaaagcggaggcgccctccttcctgcgccatcttgacccgcccgccgaaacgaacacaaacagcctgatcggcgttgcggatctcccatacgtaaccatgtttgagccattgttcaggcaattcgacttgatgaccgtcgacgattttttgttcgaaaaacccatgcttgtagcgaatccccattccatgcccgggaaggtcgagcgaagccagtgaatccaaaaagcacgccgcgagcctgcccaatcccccgttgccaaggcctgcatccatttcggcctcttcgatgtcttcaagacaaatgccaagctcggtaagaccttctttgacaatctcacgaaccccgagattgaggaggttttggccgagcagtctgcccaggagaaactcaatcgataagtaataggtctgtttattttggttggagcggctcctttcattggtctcgatccagtttgcgctgatatgttccctgaccatgatgccgagcgtctgatactggtcaagcgttgaagagtcccgaaagctttttccgcacaaccgttcaacacgtttcaaaaagcattgtttaaagctttctttacttgagaacatgcgcttccccctttatctcccggctgtataaccgctgatactgacgggctgacaaagcccagctgacatcatgtgtcatcgctttttgaacgatcctgccccactcttctttcctgtgataaaatgacagtgctcttttgatcgtatgcttcatatcatgggcgttaaaatgggcgaacgtaaaaccgttgccttcaccggttgtttcccggtaagcggtcaccgtatcatgaagcccgcctgtttccctgacaaccggcaccgcgccgtacctgagggcaatcagctgtccaagaccgcacggctcgaattttgaaggcatcaggaaaagatcgctcgcggcataaatcttgcggctgagcggttcatgaaaaccgatatacgccttgcacctgtccggaaaagcatgctccatatagcggaagtaattttcaaattccgcttctccggttcctaaaacgatcagctgcatgtcttcttcttcaaacagttcatgcaatacccgcttgatcaaatcgaagcctttttgcttcgtcagccttgccaccatgctgatgagcggaatgtcttcattcaccggcagaccgaatgtcttctggatcacggctttatttttccgttttccgtcccggttgacggcatcgtaatgataatcgatgtgcggatcgtttaaagggtcgtacagcacatcgtcaatcccgtttaaaatgcctgtcagtgcatccttcttgtctgacagcaccccttcaagccgctcgccgtagtatggagtcaagatttcatcgcggtacgtcggactgaccgttgtcacctgatcagcggcgataatgccgcctttcatataattaatgttcccataaaactcgagcttttcggtcgtgaaatgggaaatatcaagtccgagcaggtcatgaaccgcttccttcgggaaaatgccctgaaattgaaggttatgaattgtaaatacgcttttcatgtgctgatagaacggcttttttcgatattcttcttttaataaataattgaccatccctgtgtgccaatcgtgggtatggatgacatcagcttcaaaattcagcgcgtatagtgcttccaaaacagcccgcgagaaaaaagcaaaccgctctccatcatcataatggccgtaaagggaatcccgattaaaataatacccatgatcaagaaaataataggaaactccgtcatgttcaaggtgttcaatgccgcaaaactgcctgcgccacccgacgcgaacctcgcattcagccgttttaaccatccgtcttctgacgtcttccgcaatcaaactgtatttcggcatcatgacgaccgtttctatgcctaaaagggcgagctctttcgggagcgccccggcgacatcggcgagcccgcctgatttaacaaacggcacacattcagaaacagcaaataagactttcaagagttcatcagcgctccttgtatggctcctttttttaatatgaaagggaggctcatggtgccggacatttcgatatgatggccgattttgacgtccttgtcgcagatgacgtgctcaagccggcagttttctccgatccttgttttttgcatgacaacgctgtttttgatggttgttccttttcctacgtgaacccctctgaacaagaccgaattctcaacctcaccttcgattacgcacccattagcgataatcgattgctttaccctgctgtttttagcgtattttacaggaggatcgttttttatttttgtgtagacaggctggcccatatgaaagacttgctcccaaaacacaggctgaataaggttcaaactatgaaaaaggtagctttcgggggaatcgatcacggcggtatatcccgagtgctcatagctgttgacggatagagagccgcgctctttccggcagacttcttcaaaagattgggctccttcagggcaatgcccttcaaccatctcccacaacagactcttcttagtgacatacattcctaaaggctttccttcgtgacaaatttcagtcagatcacacccggattcaaggtgttgtttgagcacttcttgaaaaggaatgtgaccgaccgtatagctatttgccacaacagcatattgttgagtgcttctttgaaaataatcgagatgctccgcaaattgccgaaacgatccaagcccaacatgctcatcatggggaagtgaagatggaagaaagaaaaggccctcccttttcctgtttaaatcccactcttttcccgatcctaaatggtccatcaaggagcggtacggggacttggagaatacagcgacactccgaatgcctgcatgaaccatgcctgacaacgcaaaatcgatcagccggtaccttcctgcaaacggaacggctccgatcgagcggccggccgttaagtcctgaagagagtgctggtttacagctgcatcaataattcccaacatttgattattcattgacaccatccgcctctccgcgttgtttaaacaaccttatgttttttgacatactcctctgtgatcagcaggacttcgccatcttccggcttcgcgcaaaaaccgtccggaattcgaattcctgccgatacaatggcattttcgatctcaacatactctccaattgaaacgtcatgcatcacgactgaacgtttgatggcggaatgtctgccgatggcaacgcgctgaaatataaccgaacgggtgaccgacccatacacggtgcatccttcgctgacgagcgattctttgatttccgccagatcggcaacaaactgcggcgggagattcggggagactgaataaatccgccagttccgttcgaacaggtcaagcggaggatgatctccaagcagatccatattggcttcccataaacttctgaccgtaccgacatccttccagtatcctttaaacggataagcgttcagcctcttattttcttcgagaagagccggaatgacatcttttccgaaatcgtggcttgacgcggaatttttttcatcgcgttccaacgcatcttcaagcacgctccatttaaaaacgtagacacccattgatgccaaattgctctttggatatttcggcttttcctcgaagcttgtaatctccatcttgtcattcgtatgaaggatgccgaaacggccggcttctgcccagctgacttcaatgactgcgatggtggcgtcagcttgtttctccgcgtggtattcgagcatttttccgtagtccattttgtagatatgatctcctgataggatgagtacatgttcaggctgaagctcctttaaaaaatggcggttttcataaatcgcgctagccgtccctttgtaccacttcacttccgacgcttcagcataaggggataaaatggagacccctccgtcattgcggtcaagatcccatggctcgccgattccgatatatgagtttaataaaagaggctggtattgagtcagcacaccgacatgatgaattcccgagttggcgcagttgctgagggcaaaatcgatgattctgtacttgccgccaaatggaacggcgggttttgcgaggtttttggttaaggcattcagcctgcttcccttgccgcctgccaaaagcatagccacacattgttctttcatccctttttcgctcctctctttttgactgctctgaaaaccgcagctcccagcggagggactgtcatgctgatgctgtatggtttgccgtgcagaacgccttttcttgcctgaaggcgttttgggttgatttggtgtgaacctccgtattttgcatcatcgctgttaagcacttcgatatattcggtttgaaaagggacgccgacccgatattcgtgatagacggaaggcgtgaaattgcagacgataatcagcgcttcaccgggctgttttccatagcggataaacgatacaatcgactgttccgcattgttaacgtcaatccactcgaatccttgctgccgatgatcattttcatacaggatacggctttttttgtagaggtgtagagcctcctttgtaaacattcgggctttgcggtgcatgtcaaaatcgtccaaaaaccaatcgagctcttcttcgtctttccattcatcaaattgagcaaactcaccgcccataaaaagaagcttttttcccgggtgcatcataaaataactgatcagcaggcggtactgggcgaatttctgccaataatcgccgggcatcttatgaagcagagactttttgcggtacaccacttcatcgtgggagaacggcaggatgtaattttctgagtaggcatacattaaggagaatgaaacaagatgatgcaggtgttttctttgttctggggaagcttccatataggttaatacatcgttcatccaacccatattccacttataattaaacccgagaccgccttcataggtcggatgcgtcacaagcggccagtctgtggagtcctctgcaatcatcaaaaagtggggatcttttgcaaaaacctgttcatttaacgtttgaataaattcgatcgcaaagccgttcgcttcaggctgaggacggtttggccaatacaggaggttcgcaaccgcatcgactcgaaatccatctatatgatacatctcgatccaatacaacgcattcgagattaaaaaactgtgaacttctcgttttccgaggtcaaaattggcggtcccccattcccaattttccctgtcatgctcgtgtttatattcatacagaggcataccgtcaaacaaatacaagccgtggtcatctttgcaaaaatggccggaaacccaatccataatgacgccgatctcatgctgatggcactggtcgatgaaatacatcaagtcatgcggttcgccatatctgctcgtcggactgtagtaccctgttgtctggtagccccatgaacggtcaaacgggtgctctgtcagcggcatcagctcgatatgtgtgaatccgtgttctttgacgtaaggaatgaccgtttcgctcagttcccggtatgtgaaaaaacgtccatccgctttctttttccacgaaccgatatgaagctcgtagatggaaatcggtttttcatacacggctttttgctgctttttcttttgccacttccggtcgccccattggtatccggccaattgataagtgaccgatgccgttttcggcctcacttcagaaaaaaaagcataaggatcagccttcaatttcgtttcatttgcggctgtaatcatttcatatttatacagctccccttctccaataccggggataaacagttcccatatgccttcctgatgacgcttttccattcggtgcaggacaccggaccagccgttaaacgttccggcgattcgaacctccttcgcatgcggggcccaaacacagaaacggaagccttggcggccgtcctgttccgtctgatgagcgccgaagaacctgtagctttcataaagccgaccttcatgaaagagatgcgctttaatatccgaggcactcacaccagccattgatttcatcctttctgccactatatttaaagaatactcttttattcggataatatggcttgatccctttaatgaaagcgcttctttttattgacaaagttcaacaattttccttttaaacattgactgatgtcatatttgaatataaaaaaactccgcatcgaaatgatgcagagtttaacatgatgacccgtacgggattcgaacccgtgttaccgccgtgaaagggcggtgtcttaaccacttgaccaacgggccttattgaaaaaatggcggagaaggagggatttgaaccctcgcgccgcttacgcgacctacacccttagcaggggcgcctcttcagccacttgagtacttctccatggctccgcaggcaggattcgaacctgcgaccgatcggttaacagccgatagctctaccactgagctactgcggaatatcatggtgggcctgaatggactcgaaccatcgacctcacgcttatcaggcgtgcgctctaaccagctgagctacaggcccatgatatgcaaatggagcgggtgatgggaatcgaacccacgacatcagcttggaaggctgaggttttaccactaaactacacccgcatttcgcatggggcggttgatgggaatcgaacccacgaatgccagagccacaatctggtgcgttaaccacttcgccacaaccgccgcaatatatagaattgtaaaatggtggctcgggacggaatcgaaccgccgacacacggattttcagtccgttgctctaccaactgagctaccgagcctttgttaaaatggcggtccggacgggactcgaacccgcgacctcctgcgtgacaggcaggcattctaaccaactgaactaccggaccattttggctgcacctttcgggcaatcctcatttaatgagtgaatttggttgcgggggcaggatttgaacctgcgaccttcgggttatgagcccgacgagctaccgaactgctccaccccgcgatgatcaaaataataaataatatatggcggaggaagagggattcgaacccccgcgggctttgacacccctgtcggttttcaagaccgatcccttcagccagacttgggtattcctccgtaacaatggtggaccttgtaggactcgaacctacgaccggacggttatgagccgtctgctctaaccaactgagctaaaggtcctttaatagcggcggagggaatcgaacccccgacctcacgggtatgaaccgtacgctctagccagctgagctacaccgccatggtgaatattaaagataacaaagtggagcctagcgggatcgaaccgctgacctcctgcgtgcaaagcaggcgctctcccagctgagctaaggccccgaatagtggtcgggaagacaggattcgaacctgcgaccccatggtcccaaaccatgtgctctaccaagctgagctacttcccgttatataatggcgcgcccgagaggagtcgaacccctaaccttttgatccgtagtcaaacgctctatccaattgagctacgggcgctggatgattaagcggaagacgggattcgaacccgcgacccccaccttggcaaggtggtgttctaccactgaactacttccgcaaaatagattggcaatgcggatgaagggacttgaacccccacgtctttaaaagacactagagcctgattctagcgcgtctgccaattccgccacatccgcatgaaatggtgagccatgaaggactcgaaccttcgaccctctgattaaaagtcagatgctctaccaactgagctaatggctccaatactgcaatgaaatctgaagactttttcgaaagctatctgtcttttttcagcaacttttatattgtatcataaaatcgtggtgccggcaagaggacttgaacccccaacctactgattacgattcagttgctctaccaattgagctacaccggcccattccaatatgaatggtggaggatgacgggatcgaaccgccgaccctctgcttgtaaggcagatgctctcccagctgagctaatcctccgcgtcagttgttggagtaactctcgatctgacaaggactattatatacgggaatacacccatttgtaaaggctatattaaaaaaattttattttcagtttattctatcacaacagacgaatatggatacttcgttccgctcaatccgcatgatggcatcaaaagcttaggagcaacatttatccctattgacggcttataataggttctccagacgctccatgaattcctgtctcttccccatggtaaatttgtattcgaattgatttttcaaaacaattttaagcccgtttcgaacgataagcaatatatttcgcttctcgactctctctatcccgactcttaatagcaagcggcgtgttttgaaaatgaacgtcgtactgctcaaaatatacgcattcatttgtcaatcctccagctacctcaatccctcgaaatccatttgccggaacatccagcatccactcttctatttgcatgggttttactccctggcttcactgattttatgcatgccaatgtgcttattggcttcatatttccgctttaaaattcggatttgaacacccagaacacgggccagagaagatgaagacagcttgcctattcttcacaccgtttcgcggggcctgaagggttgaaatcgtctatgcactcctgcccttccggtatatacaatcgaacacccgcaaaaaagaccagcttatataagctggtcttcttaagcgcttggcggcgtcctactctcacagggggaagcccccaactaccatcggcgctgaagagcttaacttccgtgttcggcatgggaacgggtgtgacctcttcgctatcgccaccaaactatgccttcaggacgaaggtactgggcgttcctcacaggatgtgagggcctttagccgagtttccttgcctttggctttctgagagcattctctcaaaactagataacggacagacgattcacaaatatttaggttaagtcctcgatcgattagtatctgtcagctccatgtgtcgccacacttccacctcagacctatcaacctgatcatctttcagggatcttacttccttataggaatgggaaatctcatcttgaggggggcttcatgcttagatgctttcagcacttatcccgtccgcacatagctacccagcgatgcccttggcagaacaactggtacaccagcggtgcgtccatcccggtcctctcgtactaaggacagctcctctcaaatttcctgcgcccgcgacggatagggaccgaactgtctcacgacgttctgaacccagctcgcgtaccgctttaatgggcgaacagcccaacccttgggaccgactacagccccaggatgcgatgagccgacatcgaggtgccaaacctccccgtcgatgtggactcttgggggagataagcctgttatccccggggtagcttttatccgttgagcgatggcccttccatgcggaaccaccggatcactaagcccgactttcgtccctgctcgacttgtaggtctcgcagtcaagctcccttgtgcctttacactctgcgaatgatttccaaccattctgagggaacctttgggcgcctccgttaccttttaggaggcgaccgccccagtcaaactgcccacctgacactgtctccctgcccgataagggcagcgggttagaaggtcaatacagccagggtagtatcccaccgatgcctccaccgaagctggcgctccggtttccaaggctcctacctatcctgtacaagctgtaccaacattcaatatcaggctgcagtaaagctccacggggtctttccgtcctgtcgcgggtaacctgcatcttcacaggtactataatttcaccgagtctctcgttgagacagtgcccagatcgttgcgcctttcgtgcgggtcggaacttacccgacaaggaatttcgctaccttaggaccgttatagttacggccgccgtttactggggcttcaattcgcaccttcgcttacgctaagcgctcctcttaaccttccagcaccgggcaggcgtcagcccctatacttcgccttacggcttcgcagagacctgtgtttttgctaaacagtcgcctgggcctattcactgcggctctctcgggcttgcaccctaacagagcaccccttctcccgaagttacggggtcattttgccgagttccttaacgagagttctctcgatcaccttaggattctctcctcgcctacctgtgtcggtttgcggtacgggcacctctcacctcgctagaggcttttcttggcagtgtggaatcaggaacttcgctactatatttcgctcgccatcacagctcagccttacgggaaacggatttgcctatttcccagcctaactgcttggacgcggatatccaataccgcgcttaccctatcctcctgcgtccccccattgctcaaatggtgaggaggtggtacaggaatatcaacctgttgtccatcgcctacgcctttcggcctcggcttaggtcccgactaaccctgagcggacgagccttcctcaggaaccttaggcattcggtggaggggattctcacccctctttcgctactcataccggcattctcacttctaagcgctccacgagtccttccggtctcgcttcacagcccttagaacgctctcctaccactgttcgcaagaacagtccgcagcttcggtgatacgtttagccccggtacattttcggcgcagagtcactcgaccagtgagctattacgcactctttaaatggtggctgcttctaagccaacatcctggttgtctaagcaactccacatccttttccacttaacgtatactttgggaccttagctggcggtctgggctgtttccctttcgactacggatcttatcactcgcagtctgactcccaaggataagtctttggcattcggagtttgactgaattcggtaacccggtaggggcccctagtccaatcagtgctctacctccaagactcttaccttgaggctagccctaaagctatttcggagagaaccagctatctccaggttcgattggcatttcacccctacccacacctcatccccgcacttttcaacgtgcgtgggttcgggcctccattcagtgttacctgaacttcaccctggacatgggtagatcacctggtttcgggtctacgaccacgtactcatgcgccctattcagactcgctttcgctgcggctccgtcttttcaaacttaaccttgcacgggatcgtaactcgccggttcattctacaaaaggcacgccatcacccgttaacgggctctgactacttgtaggcacacggtttcaggatctctttcactccccttccggggtgcttttcacctttccctcacggtactggttcactatcggtcactagggagtatttagccttgggagatggtcctcccggattccgacggaatttcacgtgttccgccgtactcaggatccactcaggagagaacgaagttttgactacagggctgttaccttcctatggcgggcctttccagacctcttcatctacctcgttcttttgtaactccggtacagagtgtcctacaaccccaagaggcaagcctcttggtttgggctgttccccgtttcgctcgccgctactcaagggaatcgcatttgctttctcttcctccgggtacttagatgtttcagttccccgggtctgccttctcatatcctatgaattcagatatggatactgctccattacgagcagtgggtttccccattcggaaatctccggatcaaagcttgcttacagctccccgaagcatatcggtgttcgtcccgtccttcatcggctcctagtgccaaggcatccaccgtgcgccctttctaacttaaccgttaaaaagaatcactacgtgatatcttgcattactaattgaatgtgatgtctactgttatctagttttcaaagaacacgctttgaaggaatgatccttcaaaactaaacaagatccaaacgcacctgtctataagaccgcaaggtcttatattccgtataatatccttagaaaggaggtgatccagccgcaccttccgatacggctaccttgttacgacttcaccccaatcatctgtcccaccttcggcggctggctccaaaaggttacctcaccgacttcgggtgttacaaactctcgtggtgtgacgggcggtgtgtacaaggcccgggaacgtattcaccgcggcatgctgatccgcgattactagcgattccagcttcacgcagtcgagttgcagactgcgatccgaactgagaacagatttgtgggattggcttagcctcgcggcttcgctgccctttgttctgcccattgtagcacgtgtgtagcccaggtcataaggggcatgatgatttgacgtcatccccaccttcctccggtttgtcaccggcagtcaccttagagtgcccaactgaatgctggcaactaagatcaagggttgcgctcgttgcgggacttaacccaacatctcacgacacgagctgacgacaaccatgcaccacctgtcactctgcccccgaaggggaagccctatctctagggttgtcagaggatgtcaagacctggtaaggttcttcgcgttgcttcgaattaaaccacatgctccaccgcttgtgcgggcccccgtcaattcctttgagtttcagtcttgcgaccgtactccccaggcggagtgcttaatgcgtttgctgcagcactaaagggcggaaaccctctaacacttagcactcatcgtttacggcgtggactaccagggtatctaatcctgttcgctccccacgctttcgcgcctcagcgtcagttacagaccagagagtcgccttcgccactggtgttcctccacatctctacgcatttcaccgctacacgtggaattccactctcctcttctgcactcaagttccccagtttccaatgaccctccccggttgagccgggggctttcacatcagacttaagaaaccgcctgcgcgcgctttacgcccaataattccggacaacgcttgccacctacgtattaccgcggctgctggcacgtagttagccgtggctttctggttaggtaccgtcaaggtgccgccctattcgaacggtacttgttcttccctaacaacagagttttacgatccgaaaaccttcatcactcacgcggcgttgctccgtcagactttcgtccattgcggaagattccctactgctgcctcccgtaggagtctgggccgtgtctcagtcccagtgtggccgatcaccctctcaggtcggctacgcatcgtcgccttggtgagccgttacctcaccaactagctaatgcgccgcgggtccatctgtaagtggtagctgaaagccaccttttatgattggaaccatgcggttcaatcaagcatccggtattagccccggtttcccggagttatcccagtcttacaggcaggttacccacgtgttactcacccgtccgccgctgacctaagggagcaagctcccgtcggtccgctcgacttgcatgtattaggcacgccgccagcgttcgtcctgagccaggatcaaactctccatgaagtaatggagcgcagattaagttcgtcacatcctgtgacaacatctgcatgacctgcatcgtgcaggcccctgactacgcacattcgcatgtacgatttatttaatgaattaacaggtacgttttgtcttgtttagttttcaaagatcatttccgctcctgtccgaagcgactttattaatataacattctatcaatgtgaatgtcaacaactttttttaaaagtttttttgaagttgtatttataaagccttctttttagggcggatactaatataacatctattttcgttttgcacaatagcttttttaaaaaaataataatcaaatgaaattcccgatcatcccggaccagccgacaattgacgcaacttattccttcttacttactgttttcttctatataaaagatgtacagcggccaaaaaaatcgagacgctgtaccattgttcccgaagctgcggaaatgcccttaaactctccgctatcagccttcaatttaataaaagctccgaattcggagctttttaaaggatctatctttgtctcatgacattcacttctgtcgtgctgttggcaacgaaagcagccgaatactcgaatcgcttgtatgggtaaagctgatcagcctacttttcggcttggcggtcgaatgtctgacaacaagttcaggtttatagacggtagaatgctcaagcttatccgtgttccgtccctcaactttggcaatcatccattttgccgcctcaatccccatctgcattttcggatgggtgactgatgtcagcttcacttcagacgcctcgctcaagtgtgagtcgtcatatccgacaattgatatgtcgtccggtactttcaaaccgaattcccttacgacatccaacactataagtgctatctcatcattatagcagaatatggcagtcgggcggtctgctgaggaaagccgcttccttgcctcagcaatcgttttttcttttttgttctctgttgtgtaagtcacgaccatctccggataaaacgacaagccgttttccctgaaagcccggataaatcctttcatccggttgacgccctgcatatcgtcctgtttaaaaaaaccgaacactttttcatggcctagcttaatcaaatgctccgtggcgataaaaccgccgtgctcatcatccaaaatgaaatgaggcgggtttaactcctgatataattggttgatcatcaaatatggtatatggtgctgttcaagggtcagatagtaatttaaattcggattaaagctgccggttttcgtcggctccacaatcaacccatcaatttttttgtcaagcatatttacaagacattgtttttctttttcaatgtcattattcgtgctcgcgacgaccaaggtgtaacctgcactcgacaatgaagattcgattcctcttataatagaaggaaaaatgtaatccgaaaggtaagtcgtaatgaccccaatcatcttatttctttcccttcctttttcagaaagctgcaggcggtgagagcaatacgtccctgagccttgctctctgtataaaagcccttcatgaacaaggtcgccaattgcttgccggatcgtatgcctgctcacatcaaatattttcatcaattcgttttccgaatggattttttcgcccggcttcactttgccttcatatatccacgatttaatttcatttttcaccatgctgtattttgtgagttcactcatcagatcaaccctttactgcatcttgtacgtatgaataagttctattataaggaaaagatgtttgcattgctacatattggagggtttcagcaaaagtttttcgaaaaattagcttgtcgtccgtttctttttttagtatagtagaatataactaaataacttgatgaccacaaggggagcctccgggctgagagtgaacgaccgttctgacccttcgaacctgttagttaatgctggcgtaggaatgtggcaaagtcatttctaattgcatccaaagcagtgcgtggaaaactgtcctactccttccccgcattgctttttttattgggaaagaagtccagtatccctttgttcatcaaaagtgagggttatgatgaatcaatctaaacaacttgtacagctgattgaaattgcgattatgacaggaatagcacttatacttgatatggtgtccggaatgtttttaaaaatgcctcaaggcggttcaatcgccgtcatgatgattccgatcttcctgatctcctttagatgggggctcaaggcagggctggcgaccgggtttttagccggattgcttcaatttgtcactggaggattttacgttgttcatcctctgcagcttcttcttgattactttatcgcgcctacggccgcgggaatcggcggcttttttgccggatcgatccgaaatgcttcatttgagaaacaaaaaggaaagatcatttcctatgttatgctggccgtccttcttggaagcggactgaaatttctcgcacatgtcatcagcggcgctgtcttttttggaaactatgcgcctaaaggcactccggtatggatttattcattggtatataatggaacgtatatgcttccgtctttcattgtctgcacaatcgtcctttgtatactgctgctaaccgcaccaagacttctagaaaacagaacaaacatgagataacataaaaaaacagcggattcgcctgagattccgctgttttttatgttttaatcaaatctgcgaccaatatataccgctccggtgctgaaccgataaagtcaaaaggatagcaggtggaaaccgtcaatgtcgctctcggctttggaactatcaccgtccggtcatccgcatccacgattcggacctttttcactttgtatgtaaaagttccgtaggaagcttcaacaattaactgatcgcctttccccactcggccgagttttcggaaaaccgtatcccggtggcctgataaaaccgagttgtcatcttctccaggcagaacggatcctgcgaaatggcccacgcctttttgcagctcgtcttcatctgttccgtgatatatcggaagccttgcattgattttcggaataacaagatcaccgattttctccccggtttcaaatgtttgatcaattgccgtcttttcttttttcgtcgtctgaatcggaggtttttcaggcttttcctcttctttcatctgctgaaatgaaaatagagcgtagccgtgcatcagcttgaacacattcgttgttgtaaaataagcgccgcacgcaaccatcgcaatggctgcaagccagatgatcttttttcgatgtgccttaatttcctttcactccttataaaaacttcccattctatacagacttagaatgggaagtaaaatgttaagccgcttttcgaagccttctgaccataaacaatccgccaaacatcagaacggcgccaaagatcgaccattctgcgtaatgcccggccgttttcggaagctttgcacctttaaccgtctttttcacatgagatttctttgcgtcgtgtttaacagccgtttgggtttgcttcactttcgaccctgtgtcatgaattaaatcagatccgatcatttcaggcgtcagcaatacatccaaaatgaaattgccctgcagatcgtatacttccactaggaggcttgctcccttcagatcttcagcactgacaagcgtcgtcaaagacacttcttttttctttccgtctttaacaagataatatttcgttttcacttcgagcgtcttctgaagatcgtttaaaatggacagcatttcagcgatatcctgagctgacagctctgatacagactcgaaatcggctaccgcttcaagacgttctccaagagccatcaagtcattttcaaggttcggattgttatcgcgcacttttcggaggtgattcacgagtctttcccactcctgatcatccacacccaattcttgaaacatgtttccgatctgaaaatcgtcttcttcatatgtcacggtgtagagcgcatcgtccaattcgtattcaaacataaacacgtcgagaatgttttggccgctttccatatagccattttcaacaaataggtcagccgcttctttttcgctcaatccgtattctttcaaataggatgccaaaagctttttagtcagtctttgccctaaaaagtctttcaactcttccaccgagtcaaaaccttttaaactctcatcatatgtatcctgcaaataggcttccaattctttttctgtcattcctatttcttcaagataatctttaagctcggcctgtttcggcgcggcaaaagctcctgctgccggcactaaaaccaggatgcagaccaatagtgacatcagcctttttttcattttgtatgaccccctaaatttatctttcattttgattatagtggaaatatttttaaaaacatgtattgtaattgaaaatcttttcgtctataatattttgttctttttcctacttaaacaggcataatctttccctctattgaatgtaatatagtaaagcgaatagaggagggtatacaaatgaatccttactatatgatgctcttatgttatgtcctatcgatcatccactttttaataggctaccgggaagccctgaaaataagcggggctgacgggctggtcaacggaaccgcaatgatctcctgtattccgcttggcgcggttttcgcttttttcgcgcactttttttggaaaatgacgatttaatttcgggaatgaattttttcgccaacaaacatgcatttccgtgttattcacagacggcggcagtttatgctatgattaatagaacttcaatttacaaaaaattcacaaagattggagggaaaagaatggccaaagccgtggcttctcaagaagtcgccaatatgctgaacgactggtacatactgatgaaaaaacgagacatttcaggttcaatcgaaatgaaagatgacatagataaagcaattgaaaagatggaagaagatcatgacgttcttctctattatcaaatgctggattttcgcttaaggcttcttcttgaagatatctcccaatcttccacagaaaaattggaagccatcagttttaaggacaaagatccaaaaagtacggacgataagctgaattattatttttatctgttcaaagggatttatgaagactacaagcaaaaccatacagaagcgcttaattttttcagaatagcggaaaaaaggctgagcgtcattcaaaatgaaattgaaaaagccgaatttcattataaaatcggtgttttgtattacaacttaaaagcgacatggctgtcgattcaccacatcaacattgcctcaggcatcttccaagggtatgacgggtatgccaagcgggtcatcaactgcaaaatgctgatcgggctcaattatattgaccaatttaagtttgccgaaagtgaagtattgttaaaggaagcaattgaaaaaaccgaaaaaatcggcgaccaatatcttttgccttatacctactataatatgggctttttgaagagtaaggaagataaacacgaagaagcgctgaagtattataataaagcttttgcaatcaaagactttgaaacgaaagccaagtatgcttaccttctatgtgtatatgaaaacacaaggtctcttttcaaaaccaacgatcccgaccaagcttttaaatggatcgacacaggctttaaaaaagctcaagaagtgaatagcgaaattttcgaattaaaattcaaaactttatatacattacattccgattgtcagaataaactggaagtaatcaaggactttattcaccaattagaagataaaaaagcatgggttgatctggaggaattgctgatggacgtagcgaattactatagggaaaataagttatacgaagaagccatatatttctacattaaaacagacaaggcaagtaaacttgccggaagaggaggagaataggatgaaaaaagtgttgttagctgtatttgtattaggcactgttttcagcttttcgtttgcaaatcacgctcctgaagcggcttcccaaagcaatgagatacttttggcttctcgtggagcaggcgggtgactacatcctcaaaatacccattcagacatctgctgaatgggtattttgcactttacattcatattcaggagtgatcgatatgggaaagaaagtactgctgacaggatttgacccctttgggggagaaacagtcaatccgtcctgggaagctgtaaaacggctgaacggagaggaagcagaaggcgtctctatcgcagcggagcagattccgaccgtttttcatcattcagcggccgttttgaaaaaagcgatcgaaaagcacaaacccgatgtcgtcatttgcgcagggcaagcaggcggcagggctcatattacgccggaacgcatcgcaatcaacatcgatgatgctcgcattccggataatgaagaccgggaaccgatcgatgaacccatcgcggcagacgggcctgctgcttactggtccgcgcttccgatcaagctcattgtgaaagagttgagaaaaaacggaataccggcctccgtctccaattcagcgggaactttcgtatgcaaccatctcttttaccagttaatgcaccgtatagaccgcacctcggcaaacatccgcggagggttcatccacattccgtttctccccgaacaaacaatcgataaacccgagccgagtctcagccttgaaacgatcgtcgaaggacttagaatagctgcggtcatctccgccctgcacgaaaaagatattcgcgaaacgggcggatcgatcagctgacaccgcagccgcctcaaagcgccctccggcttcaccttccggattcttgtacatcccagtgtgtttttcttaaaaaaagtaaacactataagaaaaacaggtaaaagggtgaatacggatgcagaaatcttacgccgttttcgggctcggccagttcggcggcagccttgtgaaagccttccacgcaaaaggggcggaagtcttaggcatcgacaaatcagaagaaaaagtaaacgaatattctacttatgcaacctacaccatttgcgccaacgccgttgatgaaaagaccttgaaacaaatcgggatacgcaacattgaccacgcatttgtatcatttggcgatgacattgaagcaagcattctgacctcgcttttgctgattgaaatgggcgtccccaaagtatggacgaaagcacaaaatgactatcaccaaaaagttctccataaaatcggcgtccatcgtatcattcatcctgaaaaagatatggccaagcggatagccagccatatcacgtcggaaaagatgatcgattttgtcgagctgtcgccaaactacagcatcgtcgaaattgtggccactaaaaagctggacaaaagaagcctgggggatatcgacgtacgcgccaacttcggctgcaatatcgtcggcataaaaagggacgggcatttcatcatcgcaccgagcgctgatgacatgatatatgaaaacgatattttgattgtgatcgggcaaaataaagatattgagacctttgaaaaaaagggcgattaaccgtgaagtttaaacagatacaattaagcccgtcccaactgctcgtgctagtgtttttatttttcatcatattaggaacccttttattgaagctgccggcagcaacgcccaagcctataggctggattgatacgctttttacatcgacctcggcgatgactgttaccggtctggccgtcgttgatacaggcacggattatacgatgtttggtcagcttattattctcgttctcatccagctcgggggactcggcatcatgtcttttgcggtgctcatttttatcatgctcgggaaaaaaatcggcctgaaagaacggctgttgattcagcagtcgcttaatcagacttctttaggcgggattattaaactgatcaagagtttgtttatttactccttcgcgattgaaatgctggccatgctgatacttgctgtcaaatggattcctgaatacggtctcgcccgcggcatctactacagcctgttccatgcggtttcctcctttaacaatgcgggattttccatatggccggacagtttaatgcggtatgaaggcgatccgctcgtcaacctggtgatcagttttttgttcatcgtcggcgggataggatttactgtattgtccgatttatggcataagcggagctttaaaaagttgagccttcattcgaaattgatgatatacggtacgtttatcgtcaatttggcagccatgatccttatttttctgcttgagtatcaaaatcaaaaaacgctgggaatgcttccgctagctgaaaaactttggggcgcctattttcaggctgtgaccccgagaacagcaggatttaacacgacagacatcggaagcctgcgcgaaagcacgatcacgcttttgctccttcttatgtttgtcggagcggggagcgcatcgaccggcggaggaatcaagctgacgacgtttcttgtcattcttctgtcggttatcacttttttaaagggcaaaaaacatatttcaatagccaaaaaaacgctgaaagaccaattgatcctccggtcgctcgctatttcaacaatcagcgtgctgttgattttaacggccatctttattttaaatatgacagaacctataccgtttttggcgattttgtttgaagtcgtttcagctttcggcacggtcggcctgtcaatggggattacggccgacctgtcccctatcgggaagatgctgattgttttcattatgtttctcggaaaactcgggccgctcacattggcgttttccctggccagacctgaaaaggaaaacatccgctattcaagcgaagatattttgactggataaagcgcggactttaaagcgccttgggcgttttccctttcaccgccgggacgttgtttttccgtatgctttgcgaggccatgaacaggatgatgcctgaaaaaatgaccgctccgccgatcacctgcgtcatcatgacggattcgtctaaaatccaatacgccagcgcaaccgctccgacgggttcaaataaaatcgccacagaaatcatatttgtgctcagccatttcagcacccagttaaagagcgagtggccgagcaaagtcggaatgacggcaagcagaaagaagtaaccccaatctgacgcaggataagaaaaaaaggcggcgcccgaaaacaggcagtatagacataaagtgagggcgctgattccatatacaataaaagtgtaaacggtcaagctgtggcgttttctgacatgctggccaaacagcagatatgccgtcacaagcgcacatgccaaaagcgccaggatatcgccgtagagcgcctggccgcttactttgaaatccccccagctgatgtacacgcttccgccgatcgcgagaagcgcactgatgatcccagcgaacgagactctttctttaaataaaaaatatgtaccgataaaggaaaagatcggctgcagcgtaacaagaacaaccgagctcgccacagacgtgtattcaagcgagcgaaaccataaaataaaatgaaatgctaaaaagaatcccgctgccgcggaaaacagccagtcttttttcgaaaaacccaagacttcttttctttttccccagaaaaaaggaaagatcagcaaagcggaaaaaaagagacgataaaaagcgatgattccagcatcagctgttgacagcctgacgaagatggcggaggaagacacagccaacaccccgaccactaatgctatatacgggtacaatgtggttctcaaaatgaaatccttccttcttttcattttttcttaagcatatccgatggcgatgcgaaaatcgagtgttttttggttattttaccagccttcgatatggtacagttaaaactaggaggggatatgatgagcatttttaatgaagcgagaaaagaactttggagcgagattcaaggcctatcagacgaaatgctgaataaaaggccggcggaagacgaatggagcattcaagaagtgatcgaccacctgaaaaaaatcgatctgatggcacttcaaatcttgaaggaacaaatcaaacatgcaccggttaaatcaatcgaagataaaccggttcatcagttggaagacagaagctccaaacgaaaggcgcctccatatgcggagccggaaagaaaaacagcggatgctttaaccctcaaagctgagctcgacaatgtcagaacacaattaacttcagtcatcgccgcctttcacaatgaagattttcaaagggtgctgccgcatccgattttcgaagagcttacggtcaggcagtggctcgacttcatcggccatcatgaaagaagacatattaaacagatcaaagaagtcaagcagaaactgctgtaataagcggaaagccccggctcttagagactcggggcttttcatccgcctaggcaaacgacctggcgtctttcatggcagcaggcgaatacgcccacacttctgcttggtcgccttgatggatcaggcccgggcgttcaacgatgcagacgattccccttcttcccatcgcatggcgcacaaagcgcgaagcaagcttcggtttgtcgggaaactgctcctgaatgacttctccgggctgaatgcacggctcattctcgccctcgctcaacaaagaggcgccgcttggaaaaacgattctgcttccttctcttaatgaggttaaatcaggcaggccgcttaatgcgatattggccccgagccattccggaaggaccgccggaatgttcagccgtccggcaatttcaaggcactcttctaccgagacgatagaaatctgcctcctgttgaaaatctccgttcctcttttatacatcggctcccttgccccggcttttttcgtcagtccaaaatgcagatcccccggtatgcccccgtaatcgattacgatctttgcctgtttctctgtcacaaatgacgctgtgtccgctatgtatacgtgctccgccacagccgtgcgcttcttccacattcaacccatcccctttttttcaagatgtgatttattttacattgcctccctttttttctcaaattgaaaaagcccgctgtgtgctgcacacaacgggctttttcaattttttcagacagttttcggggttaaattgaagcagcgtttgtaaatccaattgtacgctttttcgttcaggtctctagggttaccgaccgtttgcggatctttcatcgcttcttttgaaaggcggtcgatcatgtcaggtgatacgccttgctcttcaagactaggaatctctaagtcttccacaagctgatacatccagttcaccgcagctttagccgcttcaactgcagacatgccgcttgtgtcaattccgaacgcttttgcaatgcgggcaaatttttcagggtagcctttccagttgtattccattacagggcccatcatcgccgccacacattggccgtgcgcgacagggatgatccctccgagcgtctggctcatcgcgtgagcagcgcctgcggattcgcttccgtaagaaaggcctgcaagcatggccgcctgcgccatgccgtatctcgcttcaagatcttctccatcggcaaacgctctgcggatgtaatgtgcgccgtattcgatcgcaagaagggccaccgcgtcagtaatcggctgggcaaatttcatcgtatagcactcgatggcatgagccaaagcgtcaacgccggtcatcgctgttacgtgcggaggcattgatacatgcaattcaggatcgataattgtcaaatgagcagcaatcagcgggccgcccgtattgaatttaaattcgcgctcttcatctgtgataaccgcccattgtgtaacttctgagccggttccggcagtcgtcgggatcgttgtaagcggaggaatccggttttcaagcggcttttttccttctgccgcttcatagtcaaggactgagccttcatgagtggcttcaactccgatcgctttcgccgtatccattgagcttccgccgccgaccgcgacaaggccgtcgcagttttcttcagcatacagtttggaaccttcagcgacaagacggacaggcggattcggctcgactttattaaagacggcaacttctacgcctgcttcctgaagggatacaacgaccgggtttgttacaccggctttgtagatgccagggtctgtgacaagcagcgcttttgaaacgccaagctttttcacttcttcccccacatgtttaacggctccgattccgtgcttaatgacggtagggatttcaaacgtgtggaatttgttcatcgcttctactttcatatttaaagtcatgaatagtctcctccttcttatgctttaaaccaattgacagccgccggtttcgtattgcggtagacatgcttcacttctgtgtattcttcaaggcccatgcggccaagctcgcggccgatgcctgactgcttgtaacctccccaaggcgcttgtgcgaaataagggtggaagtcattgatccagacggttcccatgcgcagtttggaagcgacgcgctccgctttttcgatgtcttttgaccaaacggcgccggcaaggccgtaaatcgtatcgttcgcaagtgagacaacctcttcttctgttttaaatgtttcaactgttaataccggaccgaatacttcttccttaacgattctcatatctgatgtacagctcgagaagattgtcggcagatagaagaagccatttgcaagttcagggtcctccggacgttttccgcctgtttccagcttggcgccttcttgcaagccgatttccacatatttttcaactttgctgcggtgttcagctgaaataagcggaccgctctgtgtctcctcgtgaaatccgttgccaagcttgatttttttcgcacgcttgacaagctctgcgacaaactcatcttgaatggactcttcaacgagaagacgagcgcccgcagagcaaacctgtcctgcgtggaaaaataccgcattcagcgcctggtcaaccgctacgtcaaaatctgcgtctttaaacacaatattcggatttttcccgccaagctcaagcgcaatttttttcacattcgtacttgcagcctgcatgattttctttccggtttcaattccgccggtgaaggaaattaagtcgacgtctttatttctggcaagttcatcgccgacagtcgccccggggccgagaacaaggttggccaccccttcaggcacaccggcttcttccatcagcttgaagatcttaatggttgtcagcggtgtgatttcacttggtttgacaacgatcgtgttgcccgccgccaaagccggagcgattttccagcttgcctgcaggagcggatagttccacggtgtgatctgcccgcagacaccgaccggctccctgacaattttgcttttagaatcggggatcggtgaagaaatgacttctccgccgtctttatccgcaagccctgcataatattgaaatacgtttgcaatatcatccatatcggctctgctttcttcaatcgtcttgccggtatcaagcgattcaagttctgccagctcttcgtggtcgcgtctgatcagttcggcgatctttaatacgatgttgcctcgttcaagacccggcgtattcgcccactcgccgtcgtcaaatgcgcggcgcgctgcagcaatcgccctaacagcgtcttctctgtctccttcactgacggtttcaatatgctcttgattgtaaggattgataatttggcgagtctcgccttttttggcgcccacccactttccgtcaatgaaaagtgtttgactcataaaagcagcctcctcattacgcaaagtttgttaaataaaaatttaatgttttgaacactttgaatttatcatgcgccattttttgtgtcaaagcaaatcaggctgattattttttttgaattttatgtgaatgcagagctcacatgggctgagaccgtttgaaaaaaatttttgattttgacatttcaatttctttcgttaagataaagaacatacagaaataacttaacaaacttaacgcggattttagaacaatccccgatttttcggggggcattgaatctgcaatgccgatgttccgctcctgtgaaaggaggcaagttatggacaatccccgtgatgtttcagcaaaagaaacgatcgcacaggcaaaagatcttgtcattgattcaatcgcagaaacaatggatctgtacggcattacccggagtgcgggcattttgtacggaacgatgtacctttcggatgaaatgacgctggacgaaatgcgggaagaactgcaaatgagcaagcccagcatgagcacaagcgtaaaaaagctccaagacttaaacgtcgtcaaaaagacattccacagaggaagaagaaaacacagctttgttgctgaaaaggatttcttcaaatttttcacaagctttttccctaaaaaatgggaaagggaagtcaaagtgaatctcatggctattcaagacgctcaaaaagcattggaggacatcatcgaaagcgaagggcttgacgaaagcataaaagaggaagcgagaactctttatgaccagcttgaacattcaaaaccgtattatgactggctgctgagactcgctaaatctgtccaatcgggagagatttttgagtttataccgattgataacaagaaataaaaaggttttatccgctctgaagtcagcaatttgcatacttcccagagtggggcaaaaccttttttcatattttaatttcaagaaaattcaaaaaatattttcggaggcgatgtgcatacatgaattatgctgagaagaaaaaaaactggatcaaattaggtatttttgcgctgtttgcgggaggcatactcgcgtatatcggcatttcgaatgcggacattcattggggcggctttatctccatgatgatattctttgctttcacctattatttaggcgctttttacgcagcaaagaaatcaaattctttttccgatatgatcgtggcaaaaaggagcatgccgtttttcgtcggaatggtgacgatggccgcaacatgggtcggcggcggatatattaacggaacggccgaatcgacttacagcgacggcctcatctgggcccaagcgccttggggctacgcattgagcctgattatcggcggtattttcttcgccagaaaaatgcgccgtcatcaatttatgaccattatcgatcctctcgaacagcgcttcggtaagcggatggccggcgttttatatataccggcgctgttaggagaattgttttggagcgccgcgatcttaacggcattgggcacgactttcggaatgattctgaatatcgatttccaaacgtcgattattctttcggcgatgatcgccatcgcttatacggtggccggaggcatgtgggcagttgctttcacagatgtctttcaaatgattgtcattttgctcgggctgtttttagtcgtcccatttgtattgtcgaatgtcggtgctctcgatagcgtatgggcaaattacaggcacgatttcggcagcagcgccaatctgcttccgccgttggacggctggaaaaacccggattggggaaacctgttttggaactggtgggataatgcgctcctcttaattttcggaggtatcgcatggcaggtgtactttcagcgcgttctttcggcaaaatcggaaagcgccgccatgtggcagtcgataattgccggagtgatctgcatcattgccgccattccgtgcgtaatcatcggagctgccggaaacagtaccgattggagcctgttcggagcgagcgctccggataacccggcgatgattttgccgcaaacgcttgcgtatttgacgccaggaatcatcgcaggcctcggcttgggtgcaatcgcagcagccgtcatgtcaagcatggactcatcgattctatcggcatcatcaatggccgcatggaatatttaccgtccgctcatcaagccgaaggccacccaaaaacagctgcaaaaagtcgtcaaacgctcaatcattttgttcggcgcgggagcagcggtcatcgcgctgaatgtcaaaagcgtttatactttatggtatttggcttcggatttagtttattgcattctttttccccagttaacaatggccctcttttataaaagagcaaatctttacgggtcgattgctggatttgcagttgcagtcattctgaggctcggcggtggtgaacccgcattcggcattccgccgcttctgccgtatccgatgattgaagacggcacggtcctctttcctttccggacgctggctgcagtcacagcatttatgacgatcttcgctgtgtccgaattgacgcagcgcaaatgccctcctaaacagcttgtactcccccaagaaaaacagaaagacgaccgcgcggcttaaataggaaaaacgcccggccccgggcgtttttctagatttatgtttatttttttacggcaagaatgtaatgaatcgtttcaaaggctgacagatcatcttttcgatttttaaaataacgcccttgaatatctgaaggtgataaatgctcgtaaacgagcagtccggattgctgcagcatgtgctgtattttctgatacgaatagcatgatttcatcggttctcctcctgccgctgccatttttaccatattttccaccctgttgaagaagcctttctctttaaacaagttttcatcagcataatcgaaaacgatcgaactgcctgaagggaggtcagccattaattccccgagcagtttttcggtttcttcctttgttaagtagtaagaaacgcctaaaaagctgaagaacgtttttttgttaaaatgaaaacccttatcagccaattcttgataagaaaacgacttggcaaagtccaaaggaataaaatgaaggtggtccgggatgtgaaaaccggctttgtccagcttttcctttttcaatttctgtgtcgctgggtggtcaatttcaaagatatcaattttgtcctttaactctaggttccgaaaacagaaagtatccagccctgccccaagaatcacgtattgttctgtcccaagccgaatctcatgatgcagcactctttcgcaataagcggcacgggcgagcggcgtcggagagagctgaacttgtgtgatccatcttaatatttcttcatcgtctccctcgtatttttccgctatagctttgttgaagaactgtatgccttgaatgaagctgtttttgatatcagcaaattcttgttgggaaatgagcgatttggccagattatcatcaaagatttttggttcatcatactggctgtgataagctctgccaaaagccgaaataagggacgttatactcgattcatcttttttcatgtcggacactccttcataaacgcaaaaaaataggattctcccggccaggagaatcctattatacacaccaatatttaattattaaattatagcataaataaatttttttgtcaagaaattgctcttttttattttgatcaatgatcgagcaaacggcctgtgagtatgggaaaactacacgtataacagcggggtcgactttttaaaaatctcgccgtctcttatataaaaacgagggacgcgccagcttatggtagataccacttcatagttgatcgtatcaagcatttccgcaatttcatcaacagatatctctgctcccttttgccggccgtaaatcacgacttcctctccttgtttaccttcaccctctcccagactgaccattatcatatccattgttactcttcccgccaccggcactcgtcttcctcgatgaagaataaaaccgcggttggaaagttcacgggaatagccgtcagcatagccgaccggaattgtggcaatgacttccccgcgctctgcaacatatgtagcaccataactaaccgtccgcggttcagtcaacatggttttcacataagcgattcgcgccttcaagcttagtgcaggcacaagcttaacgagattaagctgcctgatataatcggaaggatataatccatacattccgatgcctaagcgaatcatatcagcgctgaattccggaaaagcgatcgccgcggccgtattgttcatatgcaccgtaggcagcttaaagccttgttctttcagaaagcgaagaaagctgataaacttttcgtgttgaatcatggttagctcagtatccggttcgtcagctgtggaaaaatgcgtaaaaattccttcccattcgaggttttcacttgccgtcagcgcttccacgattgctaaaagcttttcctttgttcgtacacctaaacgccccatgccggtatccacattgatatgaacagccagccggttaggatctgcttcattttccaatatctcgttcgcttctttaatccagtcaacttgaaaagctgataacgatatattccaagctgccgcttctttcacacagctcagcggggtgaaaccaagcacaaggatcggcgctttaatccccgcttttcgtaaaacgaccgcttcctccaccgaggcaacggcgagctcactcgcaccatgttcaagtgcatggcgtgcaacttccaccgatccgtgaccataagcattcgcttttacgacagccataattttgctctttttcggaatatgccgccgaaacgcgcgcaaattttttttgatcgcatcaagatttacctctacccaaacttcacggcaaagctttttcatcaacgctcccttctttcttgtcccatagtattcatttcatgtagccgttcgaaaattgcccggatgctttctatctcattcttattcagcttcgggcgaaatcattcagccagtaatcgttagcggtggaaggcaaacagcaggagcccgtgccgtgcagactttaaatcgaaggtttccttctgctgccaaaggaaatgcaaatctgtccatctagttttttaaaagtgtcttaataaggctccgatttgatatattttaagcgtccctgtcataaatttcggtatacacgacctgtgaagggagctttccgcatgaaaagaacagccgggactccagcttggtacaatcacgtgccgcatccaataagaaacgatggtgcgggcgcgaccgattttggcccccgcgacgtgatgcgggatttagagaatcccgacatgttcgttcctccaaaaacagatgccggagcaatccctaatttaaagttttctttttcagacacacatatgcagttaaatcatggcggctggtcccgtgaaataacagcccgggaactgccggtatcaacgacgattgccggcgtcaatatgcggctgacgccaggcggggttcgcgagttgcattggcataagcaatcggaatgggcttacatgattttgggccatgcgcgcattaccgccgtcgatcaggaaggccgaaactttatcgccgatgtcggccccggagatttgtggttctttcccgccggaataccgcactcgattcaagggcttgaggatggctgcgaatttctcctcgtttttgatgacgggaacttctctgagttcgataccttcacgattaccgattggttcgcacacacaccgaaagatgttctggccgcgaatttcggtgtacacgaaagcgccttcgcccgcatccctgacaaacagcggtacatcttccaagcaaaagtgccgggaccgcttgaaaaccaaaaagtgccggacccgtatggaaccgtcccaaaaagcttcgcatacaggctgtttgcacaaaagcctatcgtaacgccgggcggaacggtacgaattgttgattcttcaaactttccaatttcgacagcgatcgccgccgcactcgtcgaagtcaagcccggcggaatgagggaaatgcattggcacccgaacaacgatgaatggcagtactatatctcagggaccgggcgaatgacagtattcgccgcaaacgagactgcccggacctttaattaccgggcgggggatgtcggatatgtcccgtttgccatggggcattacattcaaaatacaggcagcgaaagcctgtggtttttagaaatattcaaaagcagccgctttgcagacatttcattaaatcagtggatggcctgactccaagagagctggttgaagagcatttgcatgcaggccctgagctgatgaacgctctgcgaaaagaaaaatggccagtcgtcaaataccgtactgacggataggccataaacctaggaaaatggctcgcgaaaaaaggcaacaaaaaaacccttgaatgatcaagggttttaaagatggagcatagcgggctcgaaccgctgacctctacactgccagtgtagcgctctcccagctgagctaatgccccgtatatttgagacatgatttattatagatggaattttggagaaaagcaagtggtttttgatgtgaaaaagaaaatgctctgtcagccggccattttctttttcacatagacaatctatcgctccgatttttcaaagcagaactgaatgaacctttcagacaaatccagaatgtcttctttccttgccaaggcagcgatccattcttccgggatgcttttcattcaaaagattacatttcacggggcgggaaaaccccacataggtactttaacttcttcaattttttcaacttcactttttcctacccatttttcatattcaaatcgatcaacttgaacaaatccatattttttgataatgtccgggccatgtagcccacttccaattaagagcctattgtcttcctcacgaaaaacaggaaactcaagatcattaataattgcttggtatcttacatcataaactgaagaaatatgttctcttcgaacttgtttacaataatgtccagtttcatctaaaataaaaccaaattgaattgcctcaggatctttggtaaataattcgtagttttcttgatcatgctgaataatctcgtactctttatcattgtatagtgcccaaacgccatttctcatatagttacccccacctattcattaactgaaatgaaccttttttgtttaacactatagatcccaataagtttctcgccttgattagtgatctcataaagttctgcaccttcatgcataggtgttcttgtatcattgcgatattcaggaatagtgtaatctttactctctgtaaatccatttccagtaaacggagattgttgctcagttgcaatataatccattgccaaatcatcgtgggtcattttatttacggcctctgaattcttccctccaaacggaattttataatcgtttggattacctgccttatagcgtaccgctaatgctgatgttccgccactgaaagggttgttttcgtaatctaatctaagtccttcataaatcttatcaaaagtgttcaattccttagtatcagtagctcttgccacatatccacctagctttatttgcccaccatcacttggtgaagaaaatagccaacttttggaatcaggagaaagaaccttctgcataattgtatcttctgaaagactaggaacgtttcgcctaatatctttaataacttccacctctttagatgaaagtttatttatagatttaagcctcaagtcattaaaattattgactgttaatttatgcttttttaatacagttcctaaattatcttcaaaagatttatccaattgttcccacgaaaatttcggattaactggtgaattcctattaacatctacctctttaacaacacttttaacactcttcccagcttcaatctccttctcaacccgctgaatcgaatcctgcatcttcgctttcgaagccttatgggcgtcgttgacgtgggcggagtaattggatccttttcggacgagggtgccgcccgctcctgcttctgcaccgcgggcaatatcgctcaaggcgtcggcgcttttggcgaattgttttttaatggcgaagcctgcgtcgttgagccggtcttgagctttcagcccattcaccttcatgcggttcgcccagatgtttttgctgtctttaagagattgtaccatatgttctgttttgcttgaaatttggccgattgtggctgcgcttttaaatgagcctttcgccgcggcagcgcctgggatgatgtcaagggcgccgaacacgcctctttcaaacctttcgcctgtgtttaactcccgctgcgtcatccagtcttttcctgttgccgcgctcgcgatattggctcctccgtaggcgacggccaccgtgagacctgccggtgcgcaaaagatggtgagcacgataatgcctgctccggccagaagatcccgccataattcctgattcttttggacatcgccgattgattcgtattcaaatccgcgggaagaggcaatcgctttcgtgtattcttcatacgataactcaatgtcggggtggttgatctggaattcttcaaattctttgctcagtacgtgatcaaacgattccgagtctttgaagatatcatttacgctcactttcgctttgtcggtttcaaccgcttgcttggacatgccgtatccgacgtaagtggtttccttggagccgatccggtttacggtggtgtaattatgtatggtcagtccgcgcattttttcggcgaacgcgtctatttttttataaaaagggctgtcaatgtggtctgccaccaaactgccggctttcaggcaaaagtcggccagcttttgataatccttaaacagttcctcgatcttgctttttttgctggtgtgggtaaagctgatcgacctgtcgctgtccttgtctttgattttggattcgatatcttccaagagatcattgagttttataaggccggatttcataccgccgccgtattggccgcccgtcagcgcatcaagaccgtctttcatgccctgccattcttccggtacgtatttcacatccatttagatgatcgcctcatttctatttctgaatcttgtagagtttttggagctctttatctgtttcatacattttctccatcgcataactgacaatgtgggaagctatacagtaattatcaaacagctccatcgtctttccgagaatatccgcgtagctttcaatcgcttttgatgcttgtccggctttataaaaatcggattctgagaggtttttgatttccttctgaaccccttctgtataaatatcgcagatgcttttcagcttattggaaatggtgatcatttcttcaaactcgagatggatgtttgtaccgccgcctcctgctccgccttctgcattcatatcatcgccctccctgctctgaaattgatctgcagtgcatcatagatccggttgttcatgatataaaaggctgatccattcatatcgatcatttaaaggatcaaccgagatgaagtcttcgccttttgtaaagtaaagtgttgtcgtctggaagccggggtctgccggtttttgctgtgaggctagcttgaacgtttccacagcaagaacttctttttcatcaagattcattgccctgacttccgctttttcagcggcgctcatcggttttgtcaaaaaggcgcggtcttgatcgcgcggctcccttactaaaaatgacacctttgaaatgagcgataaataaacttcgcgcttttccacataatctaatgtgtaccctttgcccgggcttatttcagtcagggcgataacgcgctcctcgtcgtccggcagaaatgcgcacatcacgttattaaagcgcacgtattctccgctttcttggtaatgttgcagcagcttaatcagaaaaaaagcggtcttggtcagcttgccttcctttaaaagaatgcctttttcaatcaggctgtcctttgcttttattgcacaatccggctcgaccaaggccagctgttcgcgttccggaagaccgaatatgtaggaaactccggctgctcctgctaaaacatacagttctgccgccgacagcgtatctgctttcacctgcatgtcattctccttccctgttataagtttttgatttcctgcacttcactgagctgcgaaaaaccgtcgatgtgtttttccagcgcatctaatgcagcggtatgctctttcaaggcgtctttcatatcggcattcaattcaataatcagctcaaggtagcttaaaaatgcgtcgcgggttttcccgctccatttgccgctttcgacgtacgctttcaattcctttgcttttttgagcgaatcgccgacatgtttttcgatcgctttcgcatgggaatgcgcttttattgttccattgtgtgaaattttcacagtctctccgcttactttcggattcgccgcttgatagttgtagtatccatatccgtccatgactcggctgttcctcctctacgcctttttctcttcagcttcagcttttgctttataatactcccacttgcttttcgccttcgtcttggcgctttggatgtcatcgaccatatctttaaaatgcttgaccaattccttcagcttggcatccttttcatggcgggtatcctcaaattcgtgtgaagggattttcaagtccgggagattgctgtggtaagccttcaaacttgcatcaatttctgctaatttcgtcttgacatcgctttctttatcagataaatagtcgtataaatttttatactcatcgcgttttcgttcattttccgtgtaggatatgtgtaaaaagttgcctactgaatcccaaaaaccttcgctcaaagcagcttcccctttcgtttatcctagtcaataaaaactattttcctctagtggatgatattgtaataggtttatcttacaggatggtcccagacgaatgaataggttaaaagaattgttttccgcggcacaaaaataaaattaccagtcgataaggatcttttataagcaaaaagacccagtctgattttccttgttttccggccgatcatttcctgagaaatattttcttttgaagaacattccattataatgaacttggttggattttacatcgcgaaaggagaagcgccatgcgtgaacataaaggatgtatcaagtgcggaagcacagatgcggggcaaaaagaaatcgcgacgaccggcaccggcctgtcaaaattgttcgatgtgcagcataaccgttttctcgtcgtttattgcaaaaactgcgggtattcagagctgtacaataaacaatcttcaaccgccggaaacattctcgacctgttctttggaggatgacggctcgaaaggagaaacggttatgggggaaaaatacggttcattgattgccatatttattttggcattatgtgtgcactccaacattgtcgtagaacatgcgctcttacagacaatcataaaggcagtttcactttttgtgatgatcgcttcggcgcttgcagcatttgtcaaaggcatcagacaaccgtcataatggcggggagggggctttagtcattcccccgctccccgtgatttgactaaatcgaggatccattcttttatatcgacaagacgattgtatgccggcattgtatcggttccggtgatgatcatggagacgagggtgtcctgcttatgcagtgcaccgtggctggctcctccgacgtgcgtcggcgacccttcgccgataaattcgtatccgggctttgcattggcgatcaaataatcgccttcatgagaaaaaaatgaagcgtacagtctggccagcgcatcaggaaattttccgtatgtcaggctgttctgctcaaccgtcaaatcgagaatatgtaaatccccttccagcgtccacgtttgtccaaattcgtccgtgcatttgcctcccggccgaaatgtgagcttcccgtgctgctcccccgaaacggcctcaattgaatccgcttcatttttccagcagatgatgtcgatccgttcgtccttttgcagaatgtccgctatcctcttgagcggaagcttcgctttatcgagcgaatagatgaacgccattctttcgttaactgcaagaacgatgtcgtcatcggccgtcacacctttctttaatttcacaatgcgaaaggcgtccaaaaggcttctcaaatcaatcaatgcttcttttttattgccgctgatccaggcctgtccgttgtcccccatcacgatccaaatgtgatcctttaaagcggcttcccatgacgaaaaactgtctaaaatcctttgaacatgccggtcggctttcgccacccccgctgcgtcgttcctcccgtgtttatgcacgtgctggtcgagatcgggaaaatagacgagcgcaagaggcggtactttgtttgtttgaatcagatagaccaattcattggttgaaaatcggtcgttaaaaccgaattttttgaaaagcgagcggttggccggattcactttggaaaaaccgccgtacgaaaacagctgggatgcgttgattttgactgaccggtttaatccggaaatcattgaaaaaagaaagggaatctgcaaatagccgtcccggctccccctgtgcaagagcgcattgatcgagcacgtttcgattcctttttcgtcaagctcttcgtgaagcgtcttcacctgttggcttaaatgaacctgattcagattgtaaaagacgtctctggaggattgtttgatgcctaatttcagaagctctcgaatgtggctgccataattgataatccgtttttccttcgcgttgtaccacacaaggccaggcactttgtgctggtcgctgtacacccctgtaagcaatgtgctgtcgacattgacagacatcgtcggaaaagggctgatcatatcaggcacataacgcccgttttccagtaaatattgcagtccaggagcctgtccgtttttcacggcttctttgagcggttcatccattaatgaatcgatcagcaacatgacgactgatttcttgctgctctcagacatcgttcttcctcctcccttatacgtgagcattccctaaaccgctccggttatgaatgatcccgtctaaaatatcgctgaaatcacggtccgatttttcgcgcaaatattgatcgacgctcatttgatagcgcctgatgtcttcatccgaacggaaaaaggaaagcagctgctgttcaatcggctgctgtttttgctgattcagttcgatgacaaggtttttctttttcagaatatcgagattcatctcttcctgtccgggcagcgcatgatagatgaaaacagggagctgtttttcaatgcactcgctgatcgtgacgccgccgggcttcgtaataatgcccgacgcctccgcgtataagcggttcatttcagtcttgctttcgatataaggcagcgctttaatatatggattgtttaaatcacgaacataccggtagagctttcggttttttccgcatagtatttggtatgcgacattcccgttcggcgacagttcccgcacgagtttaaaaatgccgcccacccccatgcttccgccggttatgaggatgttgcaaaacgcttttttgtccccgtcctgctcaggctttctctccgttttataggaacggtgcacaggtattccggtcagaaaaattttctcttcatcaacgccttctgcgatcagctggtctttgatgtctttgatcggcgcgaaatgataatcaatcttctctcttccccagattcggttgacgaaaaaatcggtatatacattggccactttcatgtcgggaaattggccttttaagcggttcagcaaataggagggcaatgcatgcgtacagaacacgatatcaggctttttttctgcaataatctgctgcatgcctttcaaaaagatcagctcatacaagaggtggcgctttgccgtttcatggcgcccgcacgccaggagatgatagaccgagctgtagactttcggaaaatactgaatccatgacaaatatgccgcagaggaggccttttccagccgccgataagcatgtgaaaaaatgtcgattttttcacagtgatgggatttgaggagcagttctgtctgcagcgaatcggcaacgtgatgatgaccggtggaaatgcttaaaaaagggaaaatcagaatctttgtcatctccatcctccatttcagaagaaaaatgttttccatttatatttttcaaatatccagccaaaatataagtgtattttttcaggaaaggaaagtgacgacttgagaaactgttttttgtcaatttggagtgtaattgacccgttttattattttttttcaagactgacactcattgaccaaacgaaaacgagcatttttcgcgtccgtctaacaaagtacaaagggatcgatgtggtgttaagcgatgggacggttattaagaaaaacgatgttctgatcaaaattcatctgcacaatattaagctgatcaaggagcttcaaaatattgagagcgctgtcggaagaggcattctcatttatcaaaaagcgtatttttcaatgccgatcttggccgaatatatcaaaaatcatcaccggtcagaccaaattaaaggcatcatcggcatcactacgctgcataaaggagttgagaggctcggttttgaagcggttgagcctgcgaaccagttttacagagtgttcaagaagctgacgcagattccgatcttatatttaacaacaaagcaattttctcttcgcaaaatccccccttcccaatatttgtttatttcgaaagaaaaattgttcaagtcctatctgcagaaataaataaaaaagagactgatgcaaaaaaatgcaacagcctcttctttttatgaaatgtgatggaacgtcatttccggacggcttccgattcggatgttcgccccagtctgacccaatccctcgctgatataaaacggtttgtcatgatggtagtgaagaccttttatcatattcattcgcacaagctttcccatcttcacgagatgataaggcttcggccaatgaatctgaccgccgtgaaaatgtcctgaaagaagatagtcaaagtgaaattcctgcatatcaagcacaacgttcggatcatgcgtcaatacaaggttgtagccctctttaagccctttatatgaaccggcaatatcgcttcgcttcgtgctgtaatcatcaatcccgataatgttgagtgtctcgccttccacttcaatggagacatgctggttctgtagggtgatgcatccgttatcttccagtacacgtttcagcttccgaaagtgttcgtctttcaataggtagtcatggttgccgaatacagcgtacatcccgtatgccggcttcagttttttcaaagcttttaagtagtttgcaagctttggaatatttctcttcctatcaagaaaatctcctgttaaagcaatgagatccactcgttttttattggcaagttcaagaatccgttcaggtgaaatcgaaatgttttctaaatgaagatcggacagatgaagaatgttcagctttttctttaaagcgggagcctgcacgcgctcgaccgaaatcgtgttgactttcacatcttttgtattgtggttcgctttatataaaaaaggcatgaggcctaagataatcaataaacatgcgataataaacatttcaatatctcctccctcttactagtatagtaagttggcaggcggttttacagtgggaaataatagaatatcattctttttacccataacaaaaccgatttccagccggaaatcggttcgcattttcactcttacagaaacaaaatgaacagaagcagccctaaaacgattcgatagatggcaaacggaaccagcttgatcttgttgatcagccggaggaaaaaacggacgacaaaaagagcgacaataaaagcgctgataaaccctgcgataaagaaaggcaacaggtctgcactcaaatatgcccagtttttgattaaagagagcaggcttgcacccatcatgatcggaatcgccatgatgaaggtgaaatcagcggccgctctgtggctcaagccgagaataaccccgcctgaaatcgtcgaacccgagcgcgagaagcccggccaaagcgccagacattgaaacagccccatgccaagcgcctgcttatacgtcatcctatcaaccgaatctgtcgtatccttgcgccgattgatccagtcggctgcgagcatcagcaccgcaccggcgatgagaccgaccgcaacggtgcggacggaaaacaagtattgatcaatatagtcttcaaataaaaatccaagcacagcggcgggaacaaggcctacagcgatttgggcgatggaaaggcggtttcccgatttctgctcttccgtaatgtttttcttcatgcctaaaagattgagaatccggtctttaaatacgaaggcgacggcaaggatggagccgagctgaatcacgactttaaaggtattcgccgcctccggcgtaagcagttctttcgatttcagccagacatcgtcaacaataatcatatgccctgttgacgatacaggggcatattcggttaatccttcaacaattccaagtatgatagcgacaataatatcccaaatgttcatatgtcattcctttcgcttccttaaaacttgtcctctaataaactatttatattaaaagccgattatgcaagcgggattcagacttcttcgtttttttcgtaaaggtgtgaacgctgtttaaaccattcaaataaatgcgtgacaaccactttgatgaccgcgtatccggggatggcgagaatgacgccgatcacgccgaacagcttggctgccgtcagcagcacaaagatgattgttaccggatggatgtgcaggttttttcccataatctgcggcgaaataaattttccttcaaacagctgcaccacagtccaaacgatgatcagcttcacaagcataaacggagaagtgaccaaagcgatgatgattgccggcgtaatcgcaatcgtcggtccgagatacggaacgatgctcgtacacgccgccacaagggccaaaagagaagcataatcaagaccgatgatcatatatccgataaacaacaggcagccgatacagaagctgacgatgatctgccccctgatatacgaactcagccggtgattcatctcggacatcatcacatacgtctgctcccgcaggcggaccggtatgagttttagaataaacagcggcagttttttgccgtctttcaacaagtaaaacaggataaacggcacggtcacaatcgaaatcacgacctctgtcacggcgcctatgaacgttcccacaccggtaaacgtactgtttaaaatggtggtagcctgatcggataatttgcttgccaaatcggtcagattgatgttcatcgtctgctggacctgattaaagaactggcttccgatcagctgtttaatttggtcttccacaatgtggacataccttgggaagttatcgacaaggcttgtgatctgttcccttaacagcgggataacagagacgatcgaaatcgtgatcagaccgatgatcacaatgtagagaagaagaatcgaataaattcttttcacgtttttccactctagaaaatcaacgatcggatttaacaaataataaacgacacctgtcagcacgacaggcagagcgatggtttccacaagaacgatgaaaggcgtgaaaataaacgatgcttttgtaaatacaaggatgttcagtccgatcaaaagcagaataagcagaaacaggacgaatttattgtctaaaaaaaactttttaaacctgccgccccacatatgcaaagagtccatggcgatcctccattaacgttggttttataaattaaattgtacactattactcctcatactaaaaataaaaccattgctattggtctttttttccgcttgaaaacgtttattgttatatagatatacgccggcgtttccgtctttttgtatttcgccggcaaaagaaaacactgtataataaacatatcctacagcgaaaggggaaaatagcatgatgcggttcggggtagtcggaacaaattggattaccgaccggtttcttggggcggcccgtttgatcgaagattttcaattaaccgcggtatattcaaggaccggagagcgcggacgtgaattcgcgcagaaatacggagccgaggcggtttttaccgatatcggagaaatggctgagagcgatgttattgatgcggtatatatcgcaagtcccaactctttacataaagatcaggcagttacattcatgaaaagcggaaaacacgtcctgtgcgaaaaaccgcttgcgtcccatgtcaaagaagcggaagaaatggtaaaaacagcgcaggaacaccgcgtaacatttatggaagcgatgaaaacgacgtttcttccgaattttaaaaacatcagtcgcaacctgcacaaaatcggcaaagtccgccgttttacagccagctactgccaatactcttcccgctatgacgcctatcgaaacggaaccgtcttaaacgcatttaatccggctttatcgaacggttccttgatggatatcggcgtctattgcgttcatcccgcgatcgtcctgttcggcaaacccctcgaagtcaaagcgaacgggctgatccttgagtcaggggcggacggtgaaggaacagtgctgttaaaatacaaggagcacgaagccgtactgatgcactcgaaaatctcaaattccttcatcccggctgaaattcaaggagaagaaggctctatcgtcatcgataaaatccaccgccccgaacaagtcgacatccgctatcgggacggtcgggttgaacatcttacgctgcctgatgacaaaccggccatgttttatgaaacagaggaattcatcaatttaattaaacaagggcggatcgagtcttcgcttaacacgtttgaacgttctatagacacattggcggtcatagatgaagcgcgcaaacagatcggtctcgttttccccgctgatcacatgtagcaaatgagccgccccggctcgaatgaacgggcggctcatctgttttaggactgcgccaaaagatcggcaaaggctttgacatagatcggcaggtccggcgggcggcggcttgacacgatatggccgtcgacgaccgctgcttcattcacccatatggctccggcattttccatatcgtctttaatccccggtgtgcttgtaaccttcctgccttccaatattcctgcagaaatcagcacccagccggcatggcagatttgtccgatgggcttcttcctttcgttgaaccaccgaatcatctccaggacctcgggatatcttctgagcttgtcaggcgcccagcctcccggaaccagaacggcgtcgtattcctcaatgttcacgcttttcagctcataatctgagacagcgggcactccgtatttgcccttgtattcatgatccgctttttcaccaatgaaatgtacgatcgctccttcttccttcaacctcaaaactggataccacagttctaaatcttcgaattcatcgctgacaagcgcgatcactttcttgccttccagtcgcatgattgatcctttcctgtacaaccagtgtacgatagatgatagtctgtttaaacctatttatacccttccccgttcctttaaaaagatgcttttcccgggcaaaaggctgccggatcggcggaagcctgatgtttagtcaatcttaaattttttcgttaaatcgcgcagttcttcagccatttgttcaagcgtagccgcagaagaactgatttcctccattgaagcgagctgttcttcagccgaagcggcaatgtcttgaatgcttcctgagctttcacgcgatacgtctgcaatttcttcaaccgctcccgcgacttgctgtgacccttctgacagctcttcaactgccgcattcatcgtctgcagcttgcccgcgatttcgtttgtcatgtcataaatctgcttaaagcttgtatctgtttcatctgtgatggtgagtcccgactgtacttcacggttgacgtcccggaacatgtccagcgactttccgatttcattgacgatttcctgaatgagcgcttcaatttcttttgccgatgacgcggattgctcagccagtttgcgcacttcttcggcaactacagaaaaccctcttccggcttcaccggctcttgctgcttcaattgccgcgttcaacgcgagcaaattcgtctggtctgcgatgccgttgatcacccgcaggatcgccgtaatgtcttttgatttgctctcaagtcctttcacgacggattccgcctgtttaacggaatgatcgatggaattcatctgtccgaccgttttttgaacaagctctccgcctgtaccggcaatgtccgtcgattgaatggatgattctgtaatcgatgctgagactttggacatttcatgcaatcggctgttcatgtcagtcagctgctgcgcactgatttccactttctcattttggctttcatttccgtttgaaaattgttcgatcgcagatgtaatatgttctgtcgccttgcttgtctgatccgcgctcgcggtcagctgctctgacgaagaagcaacgttttcaaccgatgtctgaatgacgctgattaaagagctcagcgattcagccatatcgttgaagcttgttccgagctgtccgatttcatcttttgagcggacagtgattttttgcgtcagatcgccgccgctgatgcttttcgcagaggaaacgagttcgcggagcggccctgtgatcgatctgatgatgagaatcatgagaagcacgccaatgatgatgctggcgcccaacgtaatcagagcggcattcagcacaggctgtgaggcttcttttaattcagtgatatacatggttccgccgattttccagccggtcagcttgttggtcgcgaaagccatctgcttttcgccgtcaagcgtgtatttgaatgttcctttgtcattcgcatataccttttccgcccagctgccttcgacatctgtgcccgcatcatgtttcgggtgggcgacaaactttttatcagcgctcgtgataaaggcaaagccttttttcccgatggttacgcgttctgtcgctttaatgagctcttcgattttcatattgacggcgacaacgccggagccgtcctcatgcatcttggcgatggtgataaccaccgttccggttgacgccgttttgtaggggtctgtgataacgacttcgcccttgtgttcagcggcttttttataccagtcccgctctaccggattatatccgctcggcatcttttgatccgggtagcggatgaacttcccgtcctttgaaccggtaaagatcccttcaacatcgggatgaagcttggcgaactgttcgaatttcacttttaaagcgtcgctttctttccctgtaaaagagttttctttaatgaacccgctgaaataagacatggcgtttgttttctggctgatattctgattgatgatttcattcaactggttaacgttttcgcgcgcattgtccatgatttctccgtcaagcgtactgcttgccgtttgatacgcactataggaaaggacgatgattggaacggttaaaataagcaagaatgaaagaattaatttctttgcaatggagggacgcttcacccaattgacaatctttgacatagaattgttgactcctcttttctgttatatccctaatatcggattcttttaaaagtttttatatgcattttataactttttatagtctaaaataactaaaaaaacatccggaggaaaaccggatgttttaaagctattcaatcttaaatttctgtgtcaaatcacgcagttcttcagccagctccgccaatgtcgtggaggaggcgctgatctcttccatggaggcaagctgctcctcggctgaagcagcgatgtcctgaatgcttgccgaactttctctcgatacatcagcgatttcttcgaccgcgcccgcgacttggcgggaaccttgcgtcaattgctcgacagcggcattcatggtctgcagctttcctgcgatatcattggtcatatcgtaaatcgttttgaagcttgtctctgtttcatcggtgattcgaagtcctgactgtacttcatgattgaccgatttgaacatgttcaaagagttgtcgatctccttgacgatttcctgaattaaatgttcaatttccttcgccgagtcggcggattgtgcggcgagcttcctgacttcttcagccactaccgagaagccgcggcccgattccccggcccttgccgcttcgatcgcggcattgagcgccagcagattcgtttgatcggcgattccgttaatcacgcgcaaaatgcttgtgatatctttggatttggcttcaagtcctttgacgaccgcttccgcttgcttgacagaccgatcgatcgagttcatttggccgaccgtcttttgaacaagctcttctcctttgccggcaatctcagtcgatttcagcgacgcatcggtaatcgcagctgatgtttttgacatgtcatataacccgttgttcatttcattcagctgatgcgagctcgcttccactttttctttctggctttcatttccgtcggaaaattgttcaatggccattgtaatatgctcagtcgctttgcttgtctgcgccgcgctggcatgaagctcttcagatgaagaagctacattgtcaactgatgattggatgacgctgattaaagatctcagcgattcggccatttcattaaagcttgtaccgagctgaccgaattcgtcttttgaacggacttcgattttttgcgtcaaatcgcctccgctgatgctctttgcggatgacacgagctcgcttaacggcttgctgattccgcggataataaagtagatgagaatgccgccgagcacgatcgccgctgccaaaatgattatcgccatgtggaagacgggctgggcggcctctgatatctcatctgtgaacatcgttccgccgattttccagccggtcagcttgttcgtcgtaaaagccattttcttttcttttccttcaaatgtatattgaaaatcgcctttctcactgccgtacatttgtccaacccagtcgcctttgccttcggttccggcttcgattgtcggatgggcaacatattttttgtcattgcttgaaataaacgcaaagccgctttttccgatgttgacgcgctctgtcgctttgataagctcatcgattttcatgttgacggcaacaactcctgagccgtcctccgtctgcttcgcaatcgtaatgaccatcgttccggttgacgctgttttataagggtttgtgatgatcacctttcctttattttcaacggcttgcttataccagtccctgtccgccgggttatagcctttcgccattttctcggcgggatatcggatgaacttgccgtcttttgaacctgtgtagatcgcttccacatcctgattcagcttggcgtactgctcgagtctttctacgagtgatgcgttctctttttcttgataaagcttttcatttaccaagccgctgaaaaaggagacggcctcctctttctctccgatattctggtctatgatctcattcagctgttcgacattatcgcgtgcgcttctcatgatttccgtttcaagagagcttcccgccgtttggtacgcactataggataaggccaaaatcggcaaagttaaaaccaatataaagctgaaaaacagcctttttgagatagacggacgtttaagccagtccaatatctttttcatttagtataactcctttagcttctagattatgaaactaatatcggagctttcatttacttttgcatattaaaaaactttaaaaagtatttctgaaaattcttgaagatagaactgaaaaaagaggctgaccagcagcctcttttcatcaaatcttaaactttttcgttaaatcgcgcagctcttcagccatctgttcgagcgttgcagcggatgagctgatttcttccatggaagccagctgttcttccgctgaagcggcgatgtcctgaatgccggcagagctttcacgcgatacgtcggcgatctcttcgaccgcatcggatatttcgtgagaacctgttgataaatgctctacggcggcattcatcgtttgcagcttgcctgcgatttcgtttgtcatgtcgtaaatgtgtttaaaactagattccgtttcttcggtaatttcgagtcctgactgtacttcctggttgaccgatttgaacatgttgagcgaatgttcgatttccttaacgatatcctgaatcagcgcttcgatttcttttgccgatcccgctgattgagccgcaagctttctgacttcttcagcgacaaccgagaagcctctgcctgattcgccggcccgcgctgcctcgatggcggcgttcagagctaataaattcgtttgatcggcgattccgtttatgacgcgcaggatcgcggtgatatctttcgatttcgcttcaagccctttgacaacctgttcagcctgtttgacagacctgttgatcgagttcatctgcccgacggtttgttggacgagctctccgcctgtttcggcaatttccgtcgatttacccgaggattctgtaatcgattctgacacgcctgcaatttcattcagcttctcattcatttggctgagccgctgtgagctttcttcgactttttcgctttgactttcagcgccgcttgagaaccgctcgatggctaatgtaatgtgctcggtcgctttgcttgtctggtccgcgcttgccgtcagctgctctgaagaagatgccacattgtcgaccgattcttgaatcgtgctgatcagcgagcgcaacgagtcagccatttcgttgaagcttgtgcccagctggccgaattcgtctttggagcggacatcgattttttgtgtcagatctccttcgctgatgctttttgcagaagagacgagttgatttaaaggcttgctgatcgcgcggacgataaagtaaacaaggattccgcccagaataatcgcgcctgccaatgtcatgactgccatgtgaagcacgggctgggcagcgtctttaatctctgctgtattcatctttccgccgattttccaaccggttagtttgtttgtcgtgaagaccgttttcttttctttgcctttttcattaaaggtgaacaagccgctctctttgctgaacatttgctctgtcagatcagcttctgcttctgtgccggctttaattttcggatgggcgacatacgttttcccctcgccgatgatgaatgcatatccggtttttccgatgctgatgctgtttgccgatttgatcagcttgtcaatgttcaagtcaagggcgactacgccagaaccgtctttattctgcttggcgatcgtgacgaccatatgccccgttgatgcagactcataaggttcagttacaatcgttttccctttttcctggacagcctgtttgtaccagtcgcgttctaccgggtcatacccgtcgggcagtggagcattcggatattgtgcgtaaacactatcttccgatccggtgaagacgagttcgacgtcgggattctgttttgcaaactgctcaaaccgttgtttaattgcagtctggcctttctctttgtacgctttttgatcaatccattcgctgaaatacgcaatggaagtctccttgctgccgatatcttgctgaataatgtcgttcagttcatcgatattgtctttcgcacttctcaaaatctcatcctcgagcgtgctgctggccgtaaaatatgaagtaaccgaaagaaccaagatcggaattgttaaaatgaatataaatgagaaaattaattttttagaaatagaaggacgtttcgtccaatttaaaagctttttcatgtgtgattcccctttctctacttttatcggagacggggtctattttttaaataaaaaaagcggaaaattagaccgttttcctgcccaagcatcaggcatacgctaataaaaaaggaaaagggtgtatcctatgataagtgtttcgggctaccggctccgtcctgaggatatcgaaaaactgaatgtcagtcagacgcagagagacatcgcaaaccggatgctggccatgccgtccggatatagatacggttcaatctcagaactgttatttgagctgagattcagagagcataccgtcaaatcggccagagagctgatcaacagcggagcgaagtttgccaccttttcaaagacatacgggaatgaagagttttggagggtgacgcctgagggggctttggagttgaagtacagggcaccggcttcaaaggcgattcgaaatatttttgaaagcggcccttcttatgcttttgagtgcgcgactgcgattgtcatcattttttatatggcgcttctcaaaacgatcggcgaccagacatttgaccggaattatcaaaggatcattttatacgattggcactatgagcggctgccgatctatacggataaaggaaacgactaccttccgggagactgcctgtatttcaagaaccctgaattcgatccctcaagaccgcagtggcgcggagaaaatgctattttacttgaaaataatctctatgcggcacacggcctggggatcttaagcggcgaaacaatcattgaaaaactgaacgggctgagaaagcctcatgcacagacgtccgcctatctgctttcccaagtgacgcgggttgatattccggcattaattcaaatgatcagatagcacatcggccggcacaagctgatccatcagctccttcaccgtcgtttgctcgacggtggcccgcacgctctgtccggcccacaatgacatgttatccgtattcccgtcaagcttcgcctgttttctcatcggttgcgtcagcgtgttttgcagaggataaggcagcgcttcagcttcttcctggcgtctgtcttccatccactgattgacgatgcctcttgccggcttccccgagaacaaacgggtcaggcttgtgtcggtttcaaccgcttcgaacaatttttgtttgtaggcagggtgtgttccgctttcttcgcacgtcaaaaaagcggtaccgatttgaacgccctgtgcgccgagggcaaaagctgcagcaacacctcttttgtcaaaaatgccgcccgctgcgataactggaaccgacacatgatctgccgcttggggaattaaagccatcgagccgacagcaggctctcccttcgttttcaagaaggctcccctgtggccgcccgcttcacttccttgaacaatgatgacatccatccccagttcttcaagcagcacggcttcttcaactgaaacggcggtgcccattaaacagcaatttcggtttttcagttccttgacggcatcagccggcggagggccaaacgtaaatgaaacggcgctgattccttctttgagaatgatttctattttctcgtaaaaatcgtcccaatcttgtttctcatctgtcacgggtgaagccgaccgcgccaaaggtatcttctcttgccacctttcatattcttcccgggtgacggtttcccgtttttccggaatgaagaggttgacttgaaatccggctgatgtcagctttttcgtttccagaatctgttgttgaagcacttccggcgtcaaatagccggatgcaaggctgcctaagccgccgcagtctgatacggcggcggcgagccttggtgttgtcggcccgcccgccatcggcgcctggaccacaggctttgacaaagagaggcgttccatgaactgattcatttttatttcctccttttaatcggctaaaattttaaaatagcacgtccggtgcctcgggccgtcgaactcgcagaaatatatgccctgccaagtcccgaggacaagcctgcccccttcaataatcatatgctgcgatgccccgaccgtgctcgctttcaaatgcgccgctgtattcccttccatatggcggtcaagctcatgttcccacggatacacttcatcgaatcttctcagcatatcgcgtttgacatcggggtcggcattttcattgatcgttatacccgccgtcgtatgcggacagtagacgataacagcgccgctggaaacatcgttttctgagatgaatctttggacgtcatttgtgatatcaagcatttcatcgcgccggtttgtttgaatctgtatttttttcaacatacgaatccgctcctttcttggcaccctttctcaattcgttacaaatcgccgatttcctgtctgatcaaataaacgcgcgcctcatagggtctcatcatgaaagatgtgaggtgcttgtgcgcgttgatatccaagtttgacagcagcagtccgttcgaacataacggatatgcgggatgatggtaaaacgcctggcgtgcgctgaggttcacgatcacgatggcggtttcttcttcaagctttcgcaagtatgcaaaaatctgccgatcctcagccagaagcagtttatatgatccgtcgatgaagacgtcataccgttttctgattgcgattaaccgtttataaaaatgatagaccgaccgggggtcatgctgctgatgaacgacattgatcagcttgtaattttcgttcatgcgcagccacggttcccctttggtaaagccggcatttggccgatcagtccattgcataggcgtgcgcgcgtgatccctgctctttttccataccgccttcatgatgtcttcgtgtgagcggcccttttctttttgaatccggtaataatttttaatcgagacgtcatcataatcgtctatatctaagaaaatcgcgtttgtcattccgatttcctgcccttgataaataaacggggtgcctttcatcaaaaaatacattgcagctaaggccttcgcgctgactgttctgtatttcccgtcatctccccaaactgaaacggcccggggctgatcatgattttcgataaaaagcgcgttccagccttttccttcaagagcagattgccagtttgacaaaatccgcttgagttcggggatatcgggttctccgccttcaatatcccaaagcccgaggtgttcaaattgaaaaatcatgctgaatataccgtttggttctccaacccagtcctccgcttcttcagcgctgacaccgtttgcttcgccgactgtcatgatatgtggatacccggcgaacgtattctcttttacatcctgcaataacgccataatcccttcgacattcatatgataagcaaatgaaggcacgaaagggcgcccttccggattcggcagatccggcagcccttcttttttcttaatgtgcgaaatcgcgtcaaccctgaatccgtcgattcctttttgaagccaccagttgatcatgtcataaagagcgcttcgcatatcactgttttcccaattcagatcaggctgcttttcgtgaaaaaggtgcagataatattgctctgttttttcgtcataagtccaggctgagccgccgaatatgctttcccagttgttcggttcgcttccgtcctttccgtcatgccaaatataccagtcccgtttcccggaattccgctctgctcttgattcgataaaccaaggatgttcatcgctcgtatgattgatgacaagatcgatgatcagtttcattccgagctgatgcgcttcagttaatagttcgtcaaagtcgtccatcgtgccaaattccggcatgatgctttgataatccctgatgtcgtagccgttatctgcattgggagaatcaaagaccggacaaatccaaatggcatctgccccgagctccctgatatacggaagcttctctctgatcccgttgatatctccgacgccatccccgttcgaatccataaaactgcgcggatacacttgataaacgactgcctctttccaccatgcccttgccattcaaacaccccttgttgtgaagacattatgatatatgaataaaatatttttagactccgaacataaacatcctataaactttgatataccaacgattatacgtttctcaatactaaatatgctttgcggactataaatcctttgaagacagcaagggtgacggcaagagtaggtgaaagaagctttaatccttttgaacggagcatctgttaatacagaatatgtaaagcataaattacagttgcttttttacctatcggtaagtaaaataaatatatagattatgctaaggatgatttcaatgaaaaagaaaatgaacacccaagatgcgattgttgaagcagcatttactcttattgcccgacacggcctaaaaggcacgagcctttcaatgattgcatcggaagtcggcatttctaaaccggctatttactattatttcccttctaaagaagagcttatcgattatctatttcacatcgtatttgatgatcacaatttctctgaatatttttcaatcaataagtacacgaaggagaactttaaaaaacgattaataacagacggcgtacgctattttgaagagtataaacataactctcctgctttaaaagtggtacacgagtttgttttaagtgcagcacaaaaaccaagatatgagaaaaagcttaaatctatcatggaacaattcttagaaggttttgaagcattgctttcctacggtgtcgaactcggtgtcatctcttctaaaaacaccaaagtgaatgcacactcccttgccctgatcattgataatttgggtaactttatgattttaggaattgagatggattataaaaaagtatgggaaacagcagtcagtaatgtaatgaaaggcagtgaaagattttgaatcaggaaacgattattggattgtctaaaatagagaaaaccttatattggatcattccaccggttttaggagctgttcttggatggtttttgcctgttatagccgattgggtattgaccattccaatcgttccttttaaagggcctttggaatttatcacatcactaaacagtttctgggtttcaattatcgctgcatttatcggaatcgttgccggcctatttttttcacaatatattttcactgaaattcttcaagtgttcatttctgatcaaaacgtgaagctgttgtttaaagagaaagaagaagtgattgagaaaaaagacatttctgcaatttatcttgagaagaaggatcttgttgttcttggtcataagggcactgaattgtaccgtgaacaacttgaatcaaagagagcgctagcagaaagtgcttttaaacatcacggctataaatgggcagacgaagatccctttaagaatgagtatcaacgctgggttgcggatcaccccgattttccctcgcatatcaatacgctacttttagccagagaacgagctttactggataataaacatgaagaggcaaaaattctgcgcaaagacctggcaaagcttggagtggttattcaggatgaagataaacggcaatacgtaaggatggtatcgtaatatttcagttgcgaacgcctaaaaaagaacatttggaataaattaaacaccgctctttttgcgaaagagcggtgcaaatccatcagcggaccgttacgtcccaattggaaatattaatttgtcctgtgcctccgaaaacttcagtaccgaattccacactgctgacatactttgttttggaaagccactgtttggagtcggcaagataattcgtgaaatcccgaatattcaggttcgcactttgggtgtttgctgttctgataaatgaaaacacgttccaccctttgccgcctccagcatcaatatagcctttatatactttccaactgtgcccgccaatcgatacagtttcgacataggaaccggcaggtccggcgtttgtgttattgagccagatcataatctcatcggttggagccgaatcccagctcgccttgtttgtattgtggagccaaatgtcatatgcggcattgtatgtgccgtttgcgctgatcgaatagctgactttcgtgttgatgtttttttgatctgacaatcgcgtcgggaagccgcttccggcagtatagccttcagtccaatgccagccgctgacgatcgacggataagcttttaccgtgcttgtattgctcggccaattccacacccagcccatatctgaatcactattatgataaatggtctgccaccagccgctgacctggtcggctccccatacattgttgaatatgtagtattttttgtttttaaaatacaatttatccgacgggtttgatgacgaagcggcaaatgctgagagcggccctgccagcactatgatgcatacggcaccccatagcagaatggattttagcaaatggttgtttttcacgtattaaaaacctcctcatatttatacatcatattataaaaaagaacgacaaggtgcacattcgtaaaaagtcatgattttccatagatatatcctcttatctttgaataaatatccattttattgaaataaggaacggccatcgaactaaaaaacagccgcggccaaccgcagctgtttttaaaaatccgtttttttcacttcgatgaaacggatatgatgatcttcagcatcaagaattttaaattcgcacccctcagttttaaggatgtccccgtttttcagctccatcttttgcgtcaaaagccagccggcgatcgtatcgacttcttcgttttctatcgcgatatgaaggaggtcattcacttcgtcgattaaagcttttccgtccataatataatgatgttcgcctttttttataatgtgcggcatttcgtcctgatcaaactcatccctgatttctccgacgatttcctctaatatgtcttctaccgtaaccagccctgccgttccgccgtactcatcaacaagaatggccatatggatccgttccttctgcatgcgaatcaagagctcctggatcggtatgttctcaatcaccctgatgacaggcctcattaagtcagttaaaggaatcgtctcgtcgagaaaatacgatttaaacaagtccttgctgttgacaattccgataatatggtctttatcgtccttaataaccggatatctcgtgtagcgttcattaatgacggtttcaatcgcttcttttatggattgatcggccataagcgtcgccatctccgttctcggcaccatgatttcccgggccagcctgttgtcaaattcaaaaattttgttgacgtatttatactcagactgattgatttccccttttttatagctttcagacagcataagccgcagctcttcctcactgatcgccacttcatgctctttaacagaatggaacccgaacagcttcgttaacagccgggccgagccattcaacagtttgataaacggaaacatgattttataaaacaaaatgagcggcttcgccgtccataagctgacggcttccgctttttgaatcgcaattgtttttggcgcaagctcgccgaccacaacgtgcaaaaatgtaatgatgataaatgcggcaacaaccgaagccactcttaaaacggactcaggcaggccaaataactcaaaaagcgggtgaatgatctgttcgaatgtcgattctccgagccagccgagccctaatgcggtgatggtaatgccgagctggcaggcagacaaatattcatcaagatttgtcaccactcttttggccgcaatcgcccgcttatccccgctttcaacgagctgatcgatttttgtgccgcggattttgacgatcgcaaattcggcgacaacgaaaaaagccgtagctgcaattaaaagtatgacgagtatgagattcaggatattcaaaaaaagcccttaccaaatatggtaaggggccacctccttaaaacgaatggttagtcattacgaccggacaggaaaattgcgacgaagcgcagcagctcaaacagcgaaacaagcgctgctgcgacgtatgtcagagccgcggcatccagcaccttgctgacgcctctttcctccgtgttgcggatcattccttctgaaacgatgatcctttttgcccgggagcttgcgttaaattcaacaggcaatgtcacaagctggaagaatacggccgcagaaaacaatatgatgccgagtccgatcagattcaggcttccgagcagcattccgccgataaacaaaaacggcgccactcccgaagaaaagttcacgaccggaaacatcttatgcctcaaaacaagtgcgccgtatgactcctggtgctgcagggcatgtccgcattcatgggaagcaacggaaaccgctgcgattgaacggccgtagtatacgggttcggacaggcgcacaacgcgtgctgtcgggtcataatggtctgtcaaggttcctcttaccggttcaaccgggacatcgtaaaggccgtttcggtcgagaatctgtctggccacttcggctccagttctcccgcttgacgcctctacttttgaatatttttcaaagttgctctttactttaaattgtgcccaaatcgataaacctaatgcagcaaatgttaacaagtaaaaaatcatgctcatgcaatcatcttccctcttgtgataagttgtttaaaaattgtaattgtaaatatattttagcccgagggatttccttttgtacagaaaagtgcactatttgtttcttcgcggcaaacaaaccccgataaagatcagcaccattcctgaaatcatgaagtataaaggcggcctagtgaacagctccttgaaaaattccctccagaacacctcatcagaggaatgatacacggcgtttaaatcaaaaatgaattgaatggacgacgccgccatcaactggactccgatcagtatgaaaaagagcctcattaaacaggacattccgctcccatccctcattcgtttataaaaagtgtatggaaggacgggaaccgatatgacgccggagcgaaaatcttcagctctaccggttattgtcggttaacgaaggtttattattacctgaaaaatttttgcaaaagagggatatactgattaaaaaggcgaactcgggtggtgacacggtgaaagtaacggatcaggaaaaagaacagttaagcacggcgatcgataaaatgaatgaagggcttgatgcgttcattcttctctataacgaatcggaaaaggacgagcagctgatcgaatttgaagaagaaacggcagagatgatcagacaagcgattgaacagcacgggaaagttagcaccaatcaaaagttaaatgcgatcatcaaagaaattttatcattttccctgcggaaagacggtgaagaagcatgaaatcaaaccgtgtattcatcgcatggctgaggtggcctatatatgtccgcatcgcaatcattatccttttattgatcctccttttcggtcagctgatcaccttcgtcgagccgcagcagttttcaaatgtttttgaaggcatatggtgggccctgatcaccgtgtcctcagtcggatacggcgattttgtccctaaaacagcgctcggcaaaatcgtcggcatgctcctgattttaataggggcagcgtttgtcacggcctattttgcaacgatggcgacggccgctttcagcaagcagcagcgctacgccgaaggcaaggtgaactacagaggcaaggggcatatgatcctgatcggctggaacgagaaatccaacaagctgatgaggacgctccaggccgccgattcaaacaaaacgatcgtcctcattgatgaaacgctaaaggaaggtcccctgatggaaaacattcatttcatcagaggacacgcagcggatgatgccacactgcaaaaagcgaatatcgaagaggctgaaatcgtctttataaccgccgatcagcataaaagcgaaatatctgcagacatgcagtcggtcttaacattgctggccgttaaaggcttgaacccgtcggtgtattgcgttgtagaaatcttgacggaaaagcagaaaaaaaatgccgagcgcgccggagccaaccaaatcatcagtacggcggaccttttaaaaacggcgatgctgcagcattttctcattaaagaccagcttcctgatccgctttttacggaagcggatattcatttcaaagtccatcgggttccgcttccgaagacgatggagggcgcgtcttttcaagaagtgatccgccattttatgaaggaagacattttcatcatcggtgtccaccaaaaagacgggcctgtgctgtctccttctttttcgtacaagctacagccgacggaccagctgctgtccctttaagaaagaagcgcctcttcgagttcttttacatacgattggccaagcttttcatagacgccgggaatatcggcgtctttttctttcggttcggcaaactggtcaaaagatgcgcggaaattcccctgaacgacgtagtcatccagcgcttcctgatagacatggcgaagcaaaaacggcgtgccgagcttgaccgtcgcattttgcgaatcaagctgtccgtcctccgcctcaaacggaatccgcaaaaacaggtatccgtcctcatcatcaatcttatagtcaaaaaagccgcggtcatattcccagccgccgctgatcacatagccgagaggcttcagcgtctgttcgaggtgataaagagaaaacgaccggttttccagttcagaaggtaagcttatcatgaaaaaaactccttttttcgtttttatatgccaggactttagcgcaattgcttatcaggttcgttcagatggccttcggtgatttctttaaacaggttgtcctccggctgctgcaggttgttttgcatgcgcaggaattttttatactctcccatagtgaaaggcttggcatcatccgataactcgtagccgatctggccgtttgattcgagcgttacgtttttcacatccgctaactttgaaatcccctgtgtccggagcctcatttccagctggtcgacggtcaggcggtgcttttttaaattctgctcctggagctccccgttttcgatcaatacaacggctttccccgcaatcaggctttcaaaaaaatcaaatttcattttcaagtactcgatcaacagaaggacgatgataaagatcgatgcagctgccaccgttttaaaaatgctgtcttctataatcggctgaacgatgatcgttccgatggatatcatgacgacggtggtggcaattgtcatctgcgaaattgattttcttcccgaaattctcagcagaacaatgcccgttaagatgagaaacaatgtttccaatacaaatgccatggtgtcactccaaccgttttatttttttagtatggttcagaagcttgcgcggtatgagtatatttgaacaaatagggaaagacaatgttataaggttatttttgggaggaacctctattgaagaaaggaaaaatagtaacggctgtgatagtgtttctcgttatatatgcactgttttcactcgcaggaattttatttcccgtagaccgggaatggtatgagtcattaaacaagccggattggacgccgtcaggccgtttgatcggaaccgtctggagcgtgctgttcgccttcatttcattagcagcggcgctcgtgtatgctgcatatgacatgagaaaagcagctgcgccattttggatcatgctgatcatcaactatgtgtttaaccaggcattcagctattttcaatttacgcaaaaaaacttacttgctgccgcagtcgactcctttttcgtagccattaccgctctttcgctcacctttatcacacggcgaattcacaaaacggcggccattctctttatcccttatgtgctgtggagttttttcgcggcttatctcgcgtttacgatttacgggatgaatcattagcctagagagccccgacggctgtagctgtgttaaaatagggtgaacagcagccttacagggggatcggaatgaaccactttctgcaaactaaacgcatcggcttttctttatggaagaaagagaatttgaatttggcaaagacattgtggggaaatcgagatgtgaccaattatctaacagcagacggaatcatgaccgaaggcgaaataagaaaccgtttgctgctggaaatcgaacaatataaaacacacggggttcttaaaacaagcaacaatgaattcgtcggatgctgcggccttcgcccctatgacccggaaaatgatgtgtacgagcttggttttcatctcgtccgttcagcttggggtaaaggttatgcatctgaagcggctgaagccatgattgagtacgcatttaacaaaatccgggcaaaaaagctgtttgcgggacatcatcctgaaaatacagcttcacgaaaacgattggagaaattaggattcgtctacatacatgacgaattttatccgtccaccggacttcagcatccgtcatacgaattaaaacagcctccgggacaataagtccggaggctgtgttttttcaattattgattcaaacgcttctcaagctctgcttttttctcttcgaagccaggcttgccgagaagggcgaacatgttgactttgtatgcttccactccaggctggtcaaacgggttgacgccgagcaagtatccgctcattgcgcaggctttttcaaagaagtacacgagatagccgaacgtgtaagcgttcatttcaggtacgttcacgatcaggttcggcacgttaccgtccgtgtgcgcgagcattgtgccttggaacgcttttttattaacgaagtcgactgttttgccggcaaggtagttcaagccgtcaagatcattgtccgcttcttcgattgtcagctcgtgtcttggcttttcaacgttcagcaccgtttcgaacatatctcttcttccttcttgtacgtattgtccaagagagtgaagatcagtagagaagttggctgaagaagggtaaatgcctttttcgtcttttccttcactttcaccaaagagctgcttccaccattctgcgaagtactgaaggcccggctcgtagttgatcagcatttcaattgttttgcctttgttataaaggacgtttctgacgaccgcatattgataagccggattgtcttcaagctctgatgtggagaagtctttgctcgcatcgcgggcgcccttcatcatttcatcgatatcggctccgctgactgcgatcggaagcaagccgaccgctgtgagcacagagaagcggcccccgacatcgtcaggaatgatgaatgattcaaaaccttcctcattagcaagcgtttttaatgcgccccgctctttatctgtcgttgcataaatgcggcgtttcgcttcttcttttccatacttttcttcaagaagcttgcggaagatccggaaagcaatcgccggttctgtcgttgtgcctgatttagaaatcacgttgattgaaaaatcagcgtcttcaagaagatccatcacgtctctcatgtaagaagagctgatgttgttgccgatgaaaatcacttgcggcgttttccgcttttctttcggcagcacattgtaaaatgaatgattcagcatttcgatcgctgctcttgcgccgaggtatgaaccgccgattccgacaaccagcaaaacatcggaatcgttttgaattttttcagcgcattttttaatgcgggcgaattcttctttatcatagtcagtcggaagatccacccagcctaaaaagtcgctgcccgcacctgttttttcgtgaatggtatggtgggcgactttaacgaagtcacgcagatatgtaagctcctgttctttaaagaatggcaatgctcttgagtagtcaaaacggacatgcgtcatattattaaacctccagtactagctgttttctttcaaatacccgccagcgctttcatttgcatgagagtgcgggccaaagggttttaaaacatgtcgattttcggcgacagcctcttcccttttcactttatatgaactccttcgttaaatcaagtgacgaaaaaaaggaggatggaggatgcccgccaaaaatgcatgttttttcagcctccacttgcatttttgtcaaaaacataacaataaacaacggctcaaggaatggcggttctccttgagccgtcaagaaatcttataaagaagccttcaaaatagacagaacatcgtctttattcagcgttttaaagcggccgaattcgccgtttgccatcgctttgtcggcaatgagatcaagcttctcatctgtaatgtcataatcggcaagacgatttggcgcgccaaggctggtccagaattcagacagtttctcgattccaacaagcgccacttcgcgatcggtttttcctgtttcatctacgtcaaaaacacggacggcaagctgtttaaagcggccgacgttctcggaaagcgtgtgcttcatccaattcgggaacagaatcgcaagccctcccgcatgcggaatatcgtatacggctgaaacagcgtgctcgatattgtgcgttgcccagtctccgcgtgcgcccattgatagcatgccgttcagcgcaatggtgcctgtatacagaatcgtttcacgcagctcatagttttctaggtcttcaatgagcttaggagctgtttcaattaccgttttaagcagggattcgcacatccggtcctgataaggggtattttcggtatggtgaaaatattgctcaaacacgtgggacatcatgtcgacaatgccgtaaatcgtgtggtctttcgggacggtaaacgtgttgaccggatcaagaattgaaaatttagggaatacgagcgggcttccccagccgtatttttcattggtttcccaatttgtgatcacagatcccgagttcatttcagagcctgttgctgctaacgttaaaactgttccaaacggcagcgcatcagccggaatatgttttttcgtcacaatatcccacgcatcgccgtcgtatttcgctccggcagcaattgctttcgtacaatcaatgacgcttccgccgccgactgccaaaagaaagtcaatatcgttctctttgcagatcgcaactcctttattcacagtggcaacacgcggattcggttcgacgccgggcagttcatggacggtcgcgcccgccttttcaaggattgaaatgacttgatcgtataaaccgtttcgcttaatgctgcctccgccgtatacgagcaggacattgcggccgtattgtttcacctcttctgccagcttttcaacttctccccggccgaatatcagctttgtgggattccaatatgtaaagttatccatctacatctcctcctttatttactattatgggaaatcgccgaacgctctgtaaagcgatctgctcctcaggcgtataatgtttccaaatcggtcgcaatctataaatgtgaaatatatgatttcaaaataggaggaataacaaatgaatgcacttcaacgtattgcattggttttaacgatcatcggagcaatcaattggggactgataggattttttcaatttgacttggttgcagccatttttggcggccaagggtctgctttagcacggaccgtttacgcgcttgtcggaatcgcaggtctgatcaacctcggacttttatttaaacctgctgaagagaccgccggcgaagacgccaaacagccggaaatgcgttaaaaaaactccggcttttgccggagtttaagattgttgacaaaatcccaaaacggcttttgttttgggattttgtcatcctttcagcgtgattgaaaacccttgcagtctaggaaggccgagcatcggagcggagcgaatgttggaattcgtgagcaccgacgcgcaggcctgacaacgaatgcgagggtttgtcgacacgctgaaactccggcttttgccggagttttttcatttacttcttaataagatcttttctgttggactgctcgatccactcttcaagtttgtctttcaaagtgttgaatccttgtggagcagctgtatcttcggcttgaacagccttttgtcttctaggcttgctttcttttcgttcaggagctgcctgtgtagcgcggatagaaaggctgattttgcctttttcctcatctacggaaagaaccttcacttgcacctcatcaccgaccgccaaatgttcattgatatctttaacgaaaccgtgtgttacttcagaaatatgcacgagtccctgtgtttcttcatctaatgcaacaaacgctccgtacgcctgtaatccagtcactttaccagtgtaaacactgcctacttcaaactttgctgtcataactaacaactcctaaatcttatgaatttaatctctttttatacgcaataaaaaattatatcatacaagtctttattaagcaaaaaaactttttttagcattgtatgtttaaaaccgagttgaaaggggaatactaaagaacaactaaggctttctagtattccccccttatgttgatgcggacctttcaggtgcgcatttttttattttactgcaccgaccttctccacaaagcgcttcattctgacgagtgcttcctgaagctgttcaagcgaggaagcataggaacatctgatatagccctcgccgctcggaccgaaaacattgcccgggacgacggcgactttttcgctgatgagcagctcctctgcaaactgctctgagctcatgcccgtttttttaacggatggaaacgcgtaaaaagcgccccccggctgatggcagtcaagcccgatttcgttcagtgaatccacaaacacgtttcttcggcggcggtagctttttttcatcttttcaacgtcttcgaggccgtttttaagggcttcctccgccgcaaattgagccatgcttggcgcgcacatcatcgagtactggtgaattttcagcatagggtcccttaaatatgcaggagctgcgacatatccgaggcgccagcctgtcatggcaaaccctttagaaaaacccgatatcaatatcgtccgctttttcattccggcgatttccgcaaagcttgtatacgcttcatcgtatgtcagctcggcgtaaatttcatccgctattacaatcaggtcgtgtttttcggcaaaagccgcgatctcttccagttctttttttgaataaacagagcctgtcggattagacggggtgcaaagaatgatggccttcgtacgctcagtcagaacggcttcaaaatctgcagcgctcgctttaaatccgcgctctgcgttcgtatgaatgtggaccgcttttccccccgccaaagagacaagcgcttcataagcgacaaaacaaggctcaggaatcagcacttcttctccgggatcaaggatcgccctgaccgcaatatcaagcgcctggcttgctccgactgtaacaatcagctcgtcatcaggagcataatccagatgaaaacgtttattcagataagcgctgatctctttccgcagagaaagaagacccgcgtttgccgtataagacgtgtagccctgctcaagggaaaggatgctcgcttcccttacattccacgccgtcacaaaatctggctctccgactcccaatgaaatcacgccctccattgtggacgcaagatcaaaaaatttgcggatgcctgacggtttgatctgctgggctgcttttgaaatataagttgtcctcatttaaggagacaccacgattcttttgtcatcatcaccggagtcaaaaactttaccgtcatgcttgtatttctttaaaataaagtgggtggttgtcgacacgaccgattcaagcgtcgataatttttcggacacgaaatgcgaaatatccgacatcgttctgccgcggatgacaacagacaggtcatatacgcctgacatcaagtaaacggattcaacttcctgaaaacgataaatccgctcggccacttcgtcaaatccgacgccgcgcttcggcgttactttcacatcgatcatcgctgtcacgccttcatggccgtcgacttttcgccagtcgatcattgcagaataatcgatgatgaccttttctttttcaagcttttcaataatcgcttttgtttcttcctgtgaaatgttcgccattttagcaatcgtttcaggttcgaggcggctgttttcctctaatatttccaatatttctgtttctttttctgttagcttcatctcgttatcacaccttttatatgtcaagaaatcttctgaatattatagcacgtttttatacgaatgtaaggcggtaaaaaaagcgaaatcgcagcgtgaaaaaatttttttcgggaacgataaataacatactcaggacttaggcgacaacatgcagccagattgtttgaacatgaaagaaaaacattcggagtgatttggatcatgctgttaacaaaaccttctatcgagaccattcaaggggtcaatatatattatgaacattacgagaatccaggcaagacatcgctcgttttaatacacggttttctttcttcctcgttttgctacagaaaaatcattcctcttctgaaggatgagtttaatttagtcgccgttgacctgcctcccttcggccaatcagaaaaatccagcacctttgtgtatacctatcaaaacatggccagggtggtcatcgaactgatcgaaaggctgaagattaaagacgccgtgcttgtcggtcattcgatgggcggccagatttcactttatgcgataaaggaaaggcctgaactgttcaaaaaagtcgtcctgctgtgcagctcaggctatttaaagcgttcgccccgctcgcttattttcgggagccatattccttatttttatttgtacatcaagcgctggctgtcaaaacagggcgtcctgaaaaacctcatgaatgttgtctacgacagctccctgatcgatcaggaaatgatcaacggctacctgaaaccgtttctcgatgatcaaattttcagggcgctcgcacgtcttatcagacaccgggaaggcgatttatcaccggatgatttgaagaaaatcgagacgccttccctcttgatctggggcgaagaggaccgcgtcgtcccggtacagatcggaaaaaggcttcatcaggatctgcccaattccattttctactccctgcaagaaaccggacacctcgtccctgaagaaaatccggattatgtatcagacaagattgccaatttcattttgacatgaacataaaaaaaccgccggttggcggtttttaaattctgttcagcacgaactgctgtctttgatcacaaggagccgttcagccagccgtttgcattccgacagaggcagcgtctgatcaaacgatacttcaaaaacggtctggatcgcttcgcccagccgctctgcatcgtcttccgtatagacggcctgaacgatttcggccgcttccgtttcataaaaatcgggtccggcttgaaacggatcccattcctttatgatgtgtatgatttgtgctgctgcctgactttctttcatcatgatcaccgcttcatattaatgtttcaaaggctattgtatcacaacatgccggcttgtcgataaggaaagccgcaggctaacggccggcttttccccgcttctccctccaggcgatcagcagcagcccgatgccgttgacgagaatcaatccaaagacggtatttccgaggggcgcccagccgttttcccccgtcagcatcactgacagcacgacctttccgatcagcgtcacattcaataccgcaagcccccaccctaaggagcgcttccaaaatgccgtgccaatcaacacgagaaaacccatcatgaaagcgagcgtgaccacggctgaaagcgggttggacaaaagcattagctcgtaatccaaaacggcctgcatctccggattgatccgctcggggacgggaaaccaaaccatgctgctcgtcatcagcaaaaaagtaatgatgacacctttccaagaccgcctataacaaaagtacgcgagcgccaccagaaagagcgggcgtatataccagctcattgggttgagatgacgctgaaaagcccactcaaggatgctgctccattccaccagctgccactccctttattttataaaagctttcatggttaaaacattgcaatctatccttttcacagttaatgtataacatatgaaaaagacatgaggtgagatcatggattttaatacagagcataacagacgcgggacccagtctgtaaagtgggacttaacacaggaattattcggcgtaaatgacgcgcttccaatgtgggtggctgatatggattttcgtgcccctcagcctgttattgacgcccttcagcagcgcctggagcacggggttttcggctatacatctgcaaacgcgggcacgaaggaagctgtcaccgattggctcagccgccggcacggatggaatactgaaccggcgtttatcaccttcagcccgggcattgtaacagcgctcgcccaagcggttcaggcgtacacagagcctggcgagcgggtggtcgtacagccgcctgtatatacgccgttctttgatatagttgaaaaaaacgggcgggttgttttacataatccattaatcgaaaaagacggccgctatgaaatggatttttccgaccttgaaaaaaagcttgtggaaccggatgtcaagctgttcattctttgcaatccgcataacccttccggccgttcatggtcgaaagaggaactgacaacgcttggcgaactctgccttaaacacggtgtcacagttgtttccgacgaaatccactcggacctgatgctgaacggactgaaccatacgccgttcgcctctttatctccggaattcgcggatatatccatcacatgcattgcaccgagcaaaacgtttaacttggccgggttgcaggcctcagccatcatcatacccgacaaagcgaagagaaccgcctttgcaaaggtcatgcagcgtcagggactgcattctttaaatacatttgcgattgcagccatcgaggcggcctattcaaaaggcgaaccatggctcgatcagcttatcccatacattgaacgaaatatggaagaagtccgccgctttttggcagaggagctgcccgaggtccgcatgatggagcctgacgcctcttacttggcatggcttgactgccgaaagctcggattgtcggatcaggacatcaaacggcttctccttcataaaggaaagctgattcttgagccgggaccgaagtacggaccgggcggagaaggattcgtcagaatgaatgtcggatgttcgctctctgttgtaaaagacggactccgacgtctgaagaccgctttttcgtaagcgttccggctgaaagccgggcgcttctaagagcgtttatggatggtttcattcaattctctttccagcttttccgctttttcagcttcttttttggaatgcttgataatcagccggaatacagcgatcgcgatgataaagaaaacggccagcgtaataaaagaagggatatattctcttttgtcttcaggaaaatagagcataaactgaatcagaaacggcgccatttttcttcctccctgaaatgatttttttaccatttatttattatgataccattaggaggcagatgcagtgaacaaccaatttcaagtcggagatcgcgtaaagggcttttataaaacaggcgtctacatcggcgaaattacggatgttaaaccgatgcactacctggtcaaaatcctcgccgtgctgacccatccgaagcagggcgaccttcatcatcccaatcgggcagacgtccctttttttcatgaacgaaaagcgctcgcttacggtgaacagacgaatatcccgcaccgcatggtgaagccgttcgatgaagctgtaccggattatgcggattcgctccgctcagctttgagccgcttaaaaacggatctgcaaaacgattcgtccgaatacgcggcaaaatcgcttgagcttattcatgggcttgaaaaagaatatttcctgcacaaataacccaatctgtttgtcagattgggttttttatgtggcgtgcggaaagacttttgagaggtcaacccgttcgccgatcgtcgtcggcttcggattttccaaatacttcttatcccgttctacgagccgaaacaacttatacgttgtcatcgcgtcgtcaagcgctttatgctgttttcccgttcctgaatcgccgtactcttccgctgccttccacaaattcgtcaatgttttgtcgccgaaaaattccttgtactccatggaaaggtccctcatctctcctttaaacggaaacggaacatggttgaacatgcaattttgcttcagcactttcatatccatgtttccccatgtaatgatgacgctgtttcggtcaggatcaagctcccgcagcttttcaatcagcgcgttaaacgtgatgccttggtcaacctgttcctgcgtgatgctgagaaaatttttgcagcgcctcgttaatttagggaacttcttcggcttaatatagcttgaaaacgtctcaaccacctcatcatgaaccgtctttacaatccctgcttctatgatttccgggaaaaaattttgcgggtgatactttccctcaggcattgtaaattcaaaatcaataatcagtaaggtgctcgcttccaactttcacacctgcctttctatctcaatataaaaaacttatggtggtaacgcagcggattgaaattatccaagcctatagtcttctgaatgttttccaaagtacgctcatatttctcttattatatcattatatttctatatttaaggttttattttctgaaaatgttgaaaattccttcaaatgcccatttttcgtcattctatagagcatcaattccatgcagctttcgcatttcatttataatgaaagggaattcaaattttttaagaaggtgattcgcatctctgtttataagaaaaaccttgtgatcatgtggtttgcgaattttttcgtggccgcaagctccacaatggttctgccgtttctttccctctatattgagacgcttggcagctattcggacggatttacggcaaaatggagcggatacgttttcggcgtcacatttttgatggcctttttagtttctcctttttggggaaggttcggcgataaacacggctataaaaaaatcctcttgatcacgggtaccggaatcggcacttccattcttctcatgtcccttgtctcgtccgtatacgagctgttttttttgagaatggcgatggggctcgtcaccgggttcattcccacttcccttgccatgatttcggctcagacgccgaaaaaaacggctggcaaagtgctcggcacgctgcagatgggcacggtctcgggaggattattcggccccttgctcggcggtctgctcgccgatcgcgtcggttttacatatacgtttttcattacgtcatttgcgatttacagcgcggttttcctcgtgtttgccggagtgcgcgaacggcccctgaagcagaagcgcgatgcttccgccgggtacacgagaaagcaggttctgcagacgattctgcatcagcgtccgctgatcacggcgatgatcctcaccgctgtgattcaagtgggaaacttcagtgttcacccgctgctcgctttatacgtcagcgaactgcacggaactcataatctcgcatttttttcagggctggctttttctgcacccggccttggaagcctgctcgctgcgagaaaatggggcgctttgggccaccggttcgggcccggaaaaaatattgatgattcctcgcggctggcttgccgcggttttgcgttatcccgcaaggaacttacatctcagtatgaaacgcttgtgttcttccgctttctgttcggaatcgcacttggcgggatgattccctgcatcaccgctttaatccgggttgaatcaccggggcctatacaaggagaagtgcttggctataatgtaagtttcagatttttaggcaatgtcatcggcccggtgctcggcggcatcctttccagctttttcggtatttcttccgccttttacgcaactgcagtcctctttttcggcggagcatgccttctgatgttccaaaggtcccagcaaaaaaaatcagaggcgaaagcaagctgaaatcggataaaaaaactgccaatctatcaaattatccttctcgatatccaaaaagaatggtacgatatggctagaatttagcgaaaagagagtgacaaagttgcgttcattttttggatggatttttctgttgatgttaatacctatatttgtctttaccttaatggcctccggccgggaagctcagaatatgaagcctctcgatcaggtgctcgatgagaagatcaatataaaggatatcggccttgtacaaaacagctacatgtatgacagggacggcgctctgatttccgaaatcgtttcagatcaccaaaaccgggtattcgtcccctataaagatatccctgaacatgtgaagcagctgtttctgacttcggaggaccgtcatttctttcagcataaaggctttgattttatcgggatggcccgggccgccgcagccaatgtcaaaaaaggcggcattgatcagggggccagcacgattacacagcagctttcgagaaacttgtatttgaaccatgaacgaaccttcgaccgcaagttcactgagctcctgtattcctaccagctggaaaaaaagctttcaaaagaagaaatttttgagaaatacttaaacaccatctattttaatcacggggtctacggaattggatccgcgtcttctttctatttcagcaagcctttgaaatctctcagccttgccgaaacggcgtttatttgcgcgatccctaataaccctacattatatgatcctttgaaacattttgactacacaaaaacccgccaaaagcggctgcttgaagggctgaaaaaagcgggcgtgatcaccgaaaaagaatacagcaaagccgttaagcaaaaaattacgcttaacgtgaaagaaaagaaagacgactatcccgactatacgacctatgtcaacgaggaattcaccaaattggtgtccgctacggaagggtttgacgaacggctgaaaaaggcaaaaacaaaagaagaaaagaaaaaaatcgaaaaagagctgtcaaaccgaatcagctccctcacgacaagcggaatcaaaatttatacggcgctcgataccagcatgcaaaaccgtgtcgtccagcaagtgaagaaccgcctcccttatgaaggcgtacaaggcggagcagtggtgatcaaccaccaaacccatcaaatcgtcgccatgtccggcgggaaaaactataaaaagtacgattataacctggcattccaagcatacaggcagccggggtcatcaattaagccgctccttgactacgggccgtacattgaagaaacgggtgcgacggcaggcagcatgattgacgcaagcaaattttgcagcaaggaatactgtccgaacaacttcaacgaaagaacatacggaaccgtgtcgatcaagacagcctttaaatattcgtataatacaccagccgtacgtatgctgaaccgggtcggcgtgcaaaaaggattcagctatttaaaaccgttcggattcgataaaatcgttcaaaacgactaccgtcttcctgctgcgctgggcggatttacatggggcttctcaccgctggagatggctgatgcctatacgaccttcggcaataacggaagctacacatccagccatgcaatcacaaaggtgacggatttaaaaggaaaaacgctatacaaatggaaagacaagccgcagcaagtattcagcatgcggacaaacagccaaatgcgcgaactcttagcagcggttgttaaagaaggaaccggaaaaaaagcgaatttcagcggcggatatgtaggaggaaaaaccggaacatccaacgggtacagagacctttggtttgtcggattgacggatacatacacaatgagtgtatgggtcggaaaagaggcaaaaggcactgtcgagtacctgcatcacgcgggacctcaacttttaatctggagaggaacgctgcaatacgcatcttaaattaaaaaaaggggtggatgaaagtggcggatatgcccgatcgaatcgttctgtttgacggcgtgtgcaacttttgcgacggagccgtgcaattcattatcaaacatgatcctgaaggcttattttcattcgcttccctgcaatctgacgccggagggaatctgctcaagcaatatcacctcccttccgatcattttaacagctttattttgatcgaaaacggccgggtatatcaaaagtcaacggccgccttgcacgtggtgaaaagcctcccgggcctttggcgggccgcttccgccctcttgatcattccccggccgcttcgggacgccgtctacagtgtcattgcgaaaaaccgctacaaatggttcgggcaaaaaagcgagtgcaccgttcccggtcctgagatcagaaaacgatttttatcataaaaaaaccggagccgccggacaaacgtccgcgctccggttttttgcatggctcaaacgggcaggctcgccatgacgctgttataaagcttgatgatgatatacaccgtcccgatcataaacgtaaaccaaaacagcagctcaaacataataaaaccgattaatgacatgaatgaaagcgtgctgtggatcgtataaacgataaaaataaaatatacgagagttgcgagtaaaaaaagcgctgcaattcccgcggcatattggacaaaaataaaagataaaaggcttgctcctagatacacggcagaaccgatcctgatttttctcagattcgctccttcaggatctttggcaaaaaataaaagggcaagctctgtcactgtattggcaatcagcttcaaagcggaaaataccatgaaaaaaatcagcgtaaacacagcaaacaaagccatccggatgccgctctcagagaaaaattcgagcatccctttgtagatgccgagagaagacagcatctgcatggcatagataacggaagaaatcgcaagagatgaactgaaaagaagaattgcgataaaaggaaaaaagcctgttacatacgtatttttcataaaaaaaagtccctttctgatatgttcctcattcattatgtacgacttatgacctgttgacaagaatattttccatatttttaatttctgctaatgcggcagaaaggtgcaggattcttcacaaattcgccatttacttgtaaagtattatgtgttgactaatcaatagatcgcgaggaatcgccgttgaaaaaaacattaaaactgcagacacggttaacgatatttgtctgcgtcgtcgttttaatttctttattgatcgcgttttttatggtcggctctgagaccgcaaggaacattcgggagcaggagcagcagattgccctgcagacggcggagatggtcgccgaggctccgattacggcacaatcgctggaaagcggcgaatacgaagagctccggaaatacaccgcccgcgttcaaaaaatcacccagactgaattcgtcgttgtcatggatatgaacagcatccgcaaaacccaccccgatccgaataaaatcggaaagaaatttgccggcggggacgaaaaagaagtgctgaagggccgacgccacattagtacggcaaaaggcacgctcggtgaatcactgagggctttcgttcccatctataataaaacgggcacccaggtcggagcggtagcggtcgggatcacccttaacgagattgagcagatcacccagcaaaatctccgccctctatatacggtcatcgtcctcagcatcgtcgccggaatcatcggagctgtcatcgtggcgaggaaagtgaaaacgattatgttcggcatggaaccatatgaaattgcaacgcttttgaacgaacgaagcgcaatgcttgagtcgacaaaagaagggattctcgccgttgatcgaacaggaaaaatcaagctcgccaatgcggaagcgaagcgcctgtttcaaaaaatggggatcgaagagaatccgatcgaccgggatgtactcgacatcttgccaaacagccgactgaaacaagtgatcgaaacacagaagcccgttcaggaccgcgatgtcagaatcaatggccttgaacttgtctttaatgaagttccgattcacttaaaaaagggaaacatcgtcggagcgattgcgacattccgcgacaaaaccgaagtgaagcacttagctgagcagctgtccggtgttaaaatgtacgcaaacgcgctcagggcgcagtcgcacgagtttatgaacaagctccacgtcattctcggtcttgttcaattaaagaactacgacgagcttggaaactatataaaagacattgcgatctatcagcagtctgaagcgagcggaattatcaaccatatcaaaaactcggtactcgccggctttttgctcggcaaacagagctatattcgggaacagggggcctcgttggaggttcattgcagcacgaggattccggatacagccaacacagcggtgattcacgatttgatcaccgttatcgggaaccttctcaacaatgcccttgatgccgtttccgccactgagaagaaaaatatttcgatttcattccgccatcatgacggacagcttgatattgaagtcacggatacgggagtcggcatatccaaggaggaacagcagaaaatgtttgaccaaggcttttcaacaaagggccccaatcgggggttcggtctttatttcgtcgaacaaagccttgaaaatttaaatggacatatcgtcgtgacgagcgaaaagaatgaaggaacgacattcagtctccgcattccgtatgaaccaaaggaggatgaccatgattgatgtattaattgttgaagacgacccgatggtaagagagctgaataaacgttacctcagccaagtagagggatttcagctgaagggcattgccgcttcttttcaagaggctctcaccttcctccgggaagagcatatcgatctgatcctgctcgacatttatatgcctggcaggaacggcgtcgaactgctcactgagatcagacgccaaaatcaagctgtcgacgtgatcgtcatctcagcggccagtgaaatggatgttgttcaaaaaacgctgcggttcggggccgtcgattacttaatcaagccgttcgaatttgagcggtttcaaagcgcgctcactgattacaaacggaagcagcagctctatgctagcaaccggaatatcagccaaaaagagctggattttgaactttttcaaaaaaaacgcgcgcccgaaaaggtacatttgccaaaagggctgaccaaaagcacgctgaagctcatttggtcaagcatcagatcgtttgacagcttgacgttcacaacggaagatttggccaatcacacggaaatctctcaagtttcaatccgcaaatacttaaagtttctggaggaaatcgaagttctcaacgtagaaatggcctacgggacgatcggcaggccggttttccaatataaattaaatacaaatgacttgaatgtgattaaccaatatctataacatgtccccgcccgctgctctctaaagacagcgggcgttttttttgtaacggccacatttgactcgccatcattgccggacaaggatttatcgcgctcgccgcgcttgtgttcggtaaatggcagccgatcggagccctgttcttcagcttcgctcaaagcttaagcatcatcgggttcacgcttcccttcttcaaaagaaataccaaacgtctatatgctgattgcgccttacgtattgacgattctagcgctggccggatttagcggcagagccgaagcgccaaaggcaaacggtatcccttatattaaaggaaaacgataaccgaacgatagaataagagagcggcctgctctcttattctttttttgttaccttaacaaaagataaaattttttgacgccgccattgtctttaccacttttatggtatgatgaaaaagtctggttatcaatcattacaggaattttattgcagacaggaagcaaatcgtatacaatttaatattgtttaatttctatataaaacgtttttatttaaaggatgcgaaaacattgaataaatcagtcataccttctttaattacggttggaaactttgtttcgggcatctcttcaatactgcttgcattcagagggtatttattcttagccattatatttgttctgatcggcgctatcttggacagccttgacggcatggccgcgcgcagattaaatgccgtcagcccgtttggaaaagaattagattctttgtctgatattatcactttcggagtcgccccggccatcatcacctattcaatcgttttttatgatgctccgatcttaggccttccttcgacattgttattccctgtttgcggagcgcttcggctggcgcgatttaatattcaatcagagaaccaggattattttacaggccttccgatcaccgcagccggaacgattctggtatgcttaaaccttttctcagaaatcctgggcaaaaagccgttcattttgatcatgctgttcctgtcctttcttatggtcagcaaaatcaaagtcatcagcctgaaggggaaaaaactattgaagaaagtgagctagtttttaatggagttggcaaaagaattgatttcccaatacgggtatttcgcgatattcgggatgcttgtcctcggaattgtaggcctgccgatacccgatgaagtcatgatgacatttgtcgggtatctgtcttctattcatatattaaactatgagatgtgccttttgatcagtttttcaggtgcgatatcagggatgctcatcagttattttctagggaagaaaatcggtaaaccgctgctcgataagttcgggaaatggatcggtctgacgccgaaaagactggacaccgtgcaccgctggtttgaaaaatacggcccgtggacgattcttttcggctattttgtccccggaatccgccatgtgacatgctatctgtccggcatgaacgagatggacatgaaaaggttcctgatttatgccggatcaggagcttttatttggtgtcttgtttttattacgatcggatacacaatcggcgtgatttaaataccgcttgcatcccggatgatcagtaaaggagtgaacagcttgaaaaagcggctttaccggtttttgattgagttgacgaataaaaagggcgtgtcccggatgctggaaaagtttgctcagtcaaagctaagcaaacctctcatcccctcctatatcaaaacctttcatattaatacagaagagatgctggaagatgtccgctcttttaacagcctgcacgagctgttcatcagaaaattaaagagcggtgcacgcccccttcccgctgatccaaacagcctggtcagccctgtggacggcgtcatcgaagaaatgggcaccatcacgcgcgacaagcaatttaccgtcaaacaaaaactctattctgtagaagaaatgatcggacgatccgagatcgtgaaccgctatgtcggcggaacctatatcattatctatttaagtccgagagactaccacagaattcacagcccggcttacggcacacttgaaacgcagtattcgctgggaagcacgtcttaccctgtgaataaaatcggtttgacatacgggaaatcgccgctgacaaaaaactaccggatgatttccgaatttaagcatcaatatgggtccgccctgcttgtgaaggtcggagcgatgtatattaactcgatcgtgatgctccaggagtcaaaagaatggcgccgaggcgacgaaatcgcatatttctctttcggctcaaccgttattctgctgtttgaaaaggatacctttattcctgatgaacgccttcacccctctcttcaagtcaaaatgggagaggtgttaggatctcttgccaaaagaacatcataatgcaccgcccccgaaatgtgaactgacccgttaaaatgagacttagaaaaaacacctatgctgcctgtcccctgtattccagtggggacaggtagtttaattttgcctgaattcgtacatgattatatcgatacatgtattgatttacaatttgtactactttagaattggatatagatgctctactttgagcgttaaatccttccgactttagcgaggagtgaaaggattcaatgacggcattatcatggcagtttccttttcgagacatgcttgtggtaatgcctttttctttggccaaattctgatatgcatgtgaagtatagacagatccctggtcgctatgaagaagtaaccctactggtttacgtaattctacagcttccctcaatgtgtctaatactaggttaatatcttggctcgtacctattttgtaagccactatttcgttgttatataagtccataatcgttgataaatataacatagtcgagccataaggtaagtaggtaatgtcggttacccatttttcatttaatcggcttgctttaaaattacgattgagagtgttcggcacaataatattactctcaccacaaatgtacttttgtcgcttcttcttaacttgacactgaatctcaaacttttgcataattttttgtacagttttgcggtttacatttatcccatactttctgtttaagatggatttaattttacgatgaccatagtgatagaagtttttcttacacagcttgattactagctcttctaatgaagttagctcaacttttttatacttctttttccaacggtaatatgttgacttaggtatgcctaatactccaagaatatcaattattttaaaagtggctgagagttcttctacaacttggacaatgactcgtggctccaactcctttcgatctcctggtacttttttataattgccaattgagcctctagctgtttattctttagttttaattcttctagctcactcatttcctccgattctttaccgtaggaatattgttttccaacttgttgcgaaaatcgataggtttggcctgttttgtaccatcgcatccatgttttaatttgagtcttattttttatccccagttgttccattatttctttgtttgtcattccagcttgtttcattttaattacttcccattttacttcttctgcgtaatgtactcttgtgcccatagaaaaacaccctcctaagaatcatattgtattaatacgattcagggggtgttttttccttgtctcatttatttgggtctctccaatgcgcttcgggggttttttaattgctgcttaaaaaagcttttctccatggacaggaaatcccctttttccgcctggatatggatccctaataaaccaaaagacctataaaacgatcaaaatcaaggagattccttctctttttccgccctttttcgttttaatttaattatcaatcgattattttaatttaaaaaacgcacagaattgacacttttcttctacaattgaacacatacaaacatgggggtgttttttatggaagcagcaaaagatttgaaaccgattacaaatcacggtcataaagaaaataaaaatattttccataagctgatcaactggaaaatcggcgtgattccgtttccgctatatattgcgcttgcgctgattgtttttctggcagcttactttaatgaattgccgaatgacatgctcggcggtttcgcggtcattatgattctcggcatttttctcggggatgtcggacagcgcattccgattttaaaagatatcggcggacctgccattctatcgctgtttgttccttcgttcttagtctttttcaaagtgcttaaccctgcatctatggaagcggttacaactttgatgaaaacgtcaaatttcttgtatttctacatcgcatgtttagtcgcgggaagtattttaggaatgcatcgcacggttctgattcaaggttttatgagaatgttcgttccgttgttggccgggacgatcgcagcggttgccgccggtattctcgtcggtctgttatttggctacagcccttatgaagctttcttctttattattgtaccgattattgccggaggcatcggcgaaggcatcctgccgctgtcactcgcctactcgcaaattttgggacagtccaccgatgtatttgtttcacagctcattccggccgctattatcggaaacgtcgttgccatcatctcagccggactgatgaaaaagcttggggaaaagcgtcctgaactgaacggtaacggcagactcgttaaatcgaaaaaagacgatgaaattttcaaccaaaaagaagaggagccgaaaatcgacttgaaattaatgggtgccggcgttttaatcgcatgttccttcttcattttcggcggtttggtctccaagttcatcgcgattccgggagcgatcctgatgatcatcgcagcggctgccgtaaaatatgcaaagcttctgcctgcaagcatggaaaaaggcgctcaccagctttacaagttcatgtcatcaagcttcacttggccgctgatggtcgggctcggcattctttatatccctcttgatgatgtggcgtctgttatttccctgcgcttcatcgccgtctgcgcttcagtcgtcattgccatggtgacatcaggctactttgtcggaaaattaatgaacatgtaccctgttgaatcagcgatcgtcacaggctgtcacagcggtctcggcggcacgggggacgtggccattctttcggcttcaggccggatgggtctgatgccgtttgcgcaaatctcaacgcgtctcggcggggcatccaccgtcattatggcgaccgttttactgaggttcttcacctcgtaagggccgcataaaaaaacaaaaaggagtctgatctatacgatcggattccttttttgttttcagcgtttctcaactctgatatattctctcggtttaaagggagctctttctgttcccgttaaggactgatcttccgctcccgtctgtagcggcgtgtaatcaccgcggtattgagggccttcgggtgttccgatccccggagtctgttcacgcgtcatttccctgttgatcataaacgctcccgcaaaaagcgaacaaaataaacttaggctgacaaaagctttccttttcatctttcatcacctcaaattcatcttgttcaaaaaaactttccattatacaaatgccgaattttttgttaaaattgttttcaggttcataagaccgcataaaccgcggttaccatgagatcatgcagccgattaaaatttgagttataatttgtctaggtcaccagttctaaaaaagtacataacgtttgaaaattttagtatggaacagaatgtatttatacatgctaccttaagggaggttaatatgacgtctttacatattgctattttatcgccttttgcactcgccttcttgattccgctattggcgaaaaacgtcagaaagattcatacaggctggtttgtcctgtttcttcctgttctattatttatttattttttccgcatgatcaaaatgacggcggatggcggaacattaaaggctgtactggaatggattccgtcctttgggattaactttaccgcgtacgttgacggactcggattgctattcgcccttctgattacagggatcgggtctttggttgtcctttacagcatctattatctgtctaaagaaagagagcagctcggaccattttacgtttatctgctcatgttcatgggggcaatgctcggcgttgttctcgttgataacgtcattgtactttatttgttttgggaattgaccagcatatcgtcttttctgctcatcggctattggtacaagcgggaaaaatcaagatacggcgcgacaaaatcgatgcttatcaccatattcggcggtctttccatgcttggaggcttcattcttctttacacgatcacaggttcattctcgattagagaaatgatcaaccaggttgatttaatttcggggcacggctttttcatcccggctctcgtgctggtgttaatcggagccttcactaaatctgcgcagttccctttttacatctggcttccggacgcaatggaagcaccaacgcctgtaagtgcttacctgcactccgccacgatggtaaaagcgggaatttatatcgttgcaagattcacccctgtgttcgctttttcaggggaatggttttggatcgtgtctctcacggggattgtcacgcttttctggggttcgttcaacgccgtcaagcagactgatctgaaatcgatacttgcattttctacggtcagccagctcggaatgatcatgtcgatgcttggcgtcggagcggccgcactgcattttcagcattttgaatactacatggttgcagtaatcgccgctatctttcacttgattaaccatgcgactttcaaaggcagcttattcatggcagtcggaatcatcgaccatgaaacaggtacgagagatatccgcaagctcggcggccttatgacgatcatgccgattacgtttacgattacgctcatcggcgcgttttcaatggccggactgcctccgttcaacggctttttgagcaaggaaatgttcttcaccagcatgctcaggattacgaactttaacttgtataacgctgacacatggggttttctctttcctgtgctggcttggatcggaagcgtgtttacattcatttactgcatggttctcttatttaaaaccttcgggggaaaatatcagcctgaaaagcttgaaaaacaagcgcatgaggctccaatcggcatgctgatttcgccgattgtcctcgtatctctcgtggtgatttttttctttttcccgaacattctgtcatacagcatcattgaacctgctgcagcgtcgattatgccgacccttttggacggtgacgaaaaattcaaggttcatatttacatgtggcacggcttttcgactgagctctatatgacgatcggcgtcgttgctctcggagttctcgcctatttgaccttgtcaaaatggcggaaggtctacggcctcttcccggaaacactgacgctgaacaagttgtacgacagctcgctgtcagggcttgaaaaaggctccaacaagattacaagaacgtatatgacagggtttctccgcgactatcttgtttatgtttttgtcttctttatcgtgatcatcggcggatcgctcgctgttaccgggggcttttcatacgatgtgaaaggcaatgcttcaatcggcgtctatgagctcgttctgtcagccgtaatgattgccgcaacctttaccaccgtttttgcaaggtcaagactgacggcgattatcggactcggcgtcatcggctacacgctcgcgctgttctttgtcattttcagggcgccggatctcgcgctgacgcagctgatcatcgaaaccatttcagtcgcattgttcctgctgtgcttctatcatttgccgaagctcagatttaagccgaaatcggctaggttcagggtcacaaatgcgcttgtatcggtcggcgtcggaactgttgtgacgctgctcgcactttcagcaaacagccagcgctcgcttgaaagcattgcatcgtattttattgaaaacagctataaactcgcaggcggccacaatatcgtcaacgtaatattggtcgacttcaggggatttgatacattgtttgaaattaccgtacttgtcattgccgctttaggaatatacggcatgatcaggctcagattggagaaaggaggggaagagcattgaaaaaggttcagacgaatgatgtgatcctgcaaaccgttacaaagattgcatcctttatcattctgctcttttctttccatctgttttttgccggccataataacccgggcggcggttttatcggcggattgatgacggcgtcttcgcttgtccttctgctgctcgcctatgatttaaaaacggtgcagaacatcttgcccgtcaactttatctatgtggcggccgtcggcttattcatttccgtttccaccggaatcggctcatttttgttcggcgctcagtttctttcccacgcgtttgattactttaaccttccgctcttggggaaaacggagcttgccaccgcggtattgtttgatatcggggtttatctcgtagtggtcggcgtgaccatgaccattattcagacgattggggagagagaataatggagattttaatgtcttttattgtaggaattctgttcatggcggcgacttatctgctgctttccaaaagccttttgagggtgattatcggaactgccgttctcagccatggcgtccatctgcttttgctgacgatgggagggttaaaaaaaggagcgccccccattttgaatgaagagtcgacaacctatgtcgatcctctccctcaggcgttgattttaacggcgatcgtcattgctttcggggttacctcgtttctcctggtcatggctttccgcgcctatcaagagctgaaaatggatgatatggatcaaatgaggggaaatgatcaacatgaataatcttgtaattctgccaatactgattcctttaatggccgcaattctgcttatctttatgaacaggtcgatcgtgctgatgcgtgcattcagcgccatatcttccattgcggcgatcgctgcggccgccgttcttgtgcagacagtctatacggacggaatccagaccttgtatctcggcgggtggaagcctccgttcggaatcagccttgtcgctgatcaatttgccagccttctggcgttaacgacagccattatcggatttctgacggttctttattcgtttcgctccatcggcgaaaaacgcgagcgtttcttttattatcccgccgtccagttcctgcttgccggagttagcggcgctttcttgaccggggacttgtttaacctgttcgtattttttgaggtgcttctgatggcttcgtatgtgctgatcgtcatcggcggcacgaagattcagctgcgggagtctctgaagtacatcgtctttaacattatttcttccgccctctttgtcatcggagtcgcttatttatatgcggttacgggcacattaaacatggcggatctgagcgtccggatcagcgaatcagggcaaaccgggctgatcacggtcatcgctgttttatttttgatcgtcttcggtttaaaaggcggcatcttcccgctgtatttctggatgcctggttcctattatgcgccgccagccgctgtttccgcactgtttggcgcacttctgaccaaagtcggcctgtacgcgatcacaagggtgtttacattaattttcacccaagacgccgcttttactcatcaattaatggtctggcttgcggcgcttacgatcatcttcggggtcatcggctcgatcgcctactgggatgttcaaaaaatcatcatctacaatattgtcactgcggtcggcgtcatcttgttcggcatcgccgccaatacgccggcttcaatcgaaggatctgtctactatttgattcatgacatgatcattaaaggagcgctgtttatgcttggcggagcgctttttgccctgacagggacaaacaacctgaaaaaaatgagcggcctgatcaaaaaccatcccgtgctcggctggatgtttatgatttcagccgtttcattggcaggtgttcctcctttcagcggattcatcggcaagctgaaaattgcagaaggcggctttttaagcggcgaattcgtgattacgctgctgatgcttttatccagcctgctcgtcttgtattccgtcatgaaaatatttatcaacggcttctggggggatgaacaggaagatgctccggccaaaaggcagctaaaaggctacatgtatccggcagcggtactgctctttctgtcgcttgccatcggactcggaaccgagcttatcgctccgtattttcaccaggcggctgatacgctcgtcaaccccgaaaaatatattgaagccgttttgaaggagtagatcgcatggcattacaaatattgttgaactttattcttgcgttgtgctggatgtttctgaacaatgactacaccgctgccgggtttgtcatcggttatgtgatcggattattctcgctctttctgatgaggcgttttttccgccgccgcttttacttgattaacatttgggcgatcgtcagactgctgtttatttttattaaagagctcgtgctggcaaacgtcagcgtattaaagacgatcttgtcaccgcggttaaaaaataagcccggcattttcgccttcaagacagatcttaaagcggactgggaaatcacgacgttggcaaacctgattacgctgacaccgggcacattggtcgtcgatatctccgatgaccgttcgattctttatattcatgcggtcgatatcgatgatgccgagaaagccatcagtgatatccgaatttcgtttgaagaggccattaaggaggtaagccgctgatgtttgaatttattttgcaattgtcactcggcattttggcggtctccacttttctgtatgtcctgagggtcattaaagggccgagcatcccggacagagtggtggcgcttgatgcgatcggcatcaacttaatcggaattacggctctcgtgtccatcctgttaaatacgacagcatatttggaagtcatcctcttgatcggcattctggccttcatcggcaccgtcgcattttctaaattccttgagaaaggagagattatcgaaaatgatcgaagccgctaaattgcttatcgccgttttgatccttcttggcgcactgatatcgttagccgcttcctttggaacgcttaggctgcctgacttatactcaagaatccacgccgcttcaaaaggagcgacactggggatcatcagcgtgctgctcggcgtattcttttacttctggtttctgcacggcttcattacggcaaaagtgctgctcggtatcgtctttgtatttctgacgtctcctgtaggcgcgcacctgatcgcaagagccgcgtataatacaggcgttaaaatggaaaagaaaaccgtacaggacgattatgaaggctacagaaattttctgattaaaaagaaggaagattcctatttataaaaagaaaactcgcccctaacaggcgagttttctttatgtttacgatgaaggacggctgatgaccgccatcgtgcacctggacgtgcaaatcaggctgtcctgctcatcgcgtatgtcaatttgaaacaccattgttgatttgcccacatgcagaggcgtagcgaccgctttaaccgttccgtcttttaccgatttaatatggttggcgttgatctcaagcccgaagcatgcctgctcttttggatcgatatgctgatatgccccgatgcttgccaccgtttcagcgagcgcaacggacgcgcctccgtgcagatagccgaaaggctgacgcgttctttcatcgacaggcatgacggcaacacaccgttctttgctgcactccttcaactcgattcccaacgcttcaagaagtgtatgtttcgtttccatcacaatcgtcccctcatcagagtacaccttcagatttcgcgattaaaacagcctctgtccttgatcctacattcagcttgctgaatacggaagtcaagctgtattcgatcgaccgcttgcttaaatgaagcgcatcagcaatttcctgatttgtgtagcctttttcgacttcttttaaaatcaggcattccctttcagtcaagaggtcgtgctgggtctgctggctgtttgacttcgatttttgctgtgtaatcaactgcttgaaataatcataatcgacgacaattttattatccagaacctgatatatgtactctataatcttttccttcgattccgttttgctgatggcgccgtgcatgccggaacgaatcgcctcttcaaaataatcttcgacttcatagcctgtgtaaacgataattttgcatgatgaacatgtctcaaggattttcttagataggtccatgccgttgatttcacccaaatttaaatccattaagatcaggtcatacgcagaaaaatcatgtttcttgagaaattgttcgctggcttcagggctgaggcaatcgacaacaaagtcctggttcgtttcaagaattgccttcgtcccctccatgacagccggatgatcatcgatcacaagtaatcttctcataatttcctcccttttgcgtaaccttgccctatcaccattttatagaaaaaacttggcggatgccaagcaaaaatgttaactaaacattacaatcccatttcaatggcgaccctaaagcctttcccttctgctgtctgtatatccagactgccgttcagtgcgcggacgcgctcgcgaatgcccgacagccccatgcttgcgctgttttgataaagcttgtccgggtcaaccccaatgccgtcatcttcataatgaagaacaactttttcttttatgcagacaagcataatcaaaacctcattagctctcgaatgtttaaccgcattgcttaaaagctcctgcacaattctgtacaaattcaactgcgtgtccaagtcgagcacctttgagaacctttccgtattgaggcggatcttatcgatcgatgaggactcctgatgctgcgccgccagtttcgaaagggctttgacaagtccgagatcgtacaacagctgcggcctcagctcctggcacgtttcccttgtcgtctggatgacggcggacatttgctcattcatattgatgagcctttgccggatttgattcgtacagactttatctttttcaaaatcagccagaaacatctcgctttgatgcttcaaggaaatcatatcctgcaggacagagtcgtggagatcgcgggctaaatcagatctctgcttctcttcaatcgcaaacatcaatttattcagccacgccggattcggcccttcttttttcacattttccagatgctccatcagctcgccgattttcagcacgttttccagggaaacgctcgtataaaacgccagcgtctcaagccatgaaatctcatcgcgcgtcagcctaggcgtatttaaaaccgacaaacacagcatgacataagacgtcccgccccgttcaccgatcttaatcaaaaacccacggtcgacttcgacgattttgccgatgtcggtgatagccctaaaagcttctttttcataaggcttccaaacttgatcgtttgcattattttcaagtaaccctacggttccatcactctttaactccagtacataagcctggctgacaggtaaaacatcaagaatcgtttgagacaattcccttagcacttgcgctaacgatgtcgagctccgtataagttgggtaaacttaaatacactatcttggtaattaaatttttcagaaaacctttttaaacggaaacgaaaatcaagaatttctttgagataaaaaacacctagcataataaaattggagagacccaaataaatgagacaaggaaaaaacaccccctgaatcgtattaatacaatatgattcttaggagggtgtttttctatgggcacaagagtacattacgcagaagaagtaaaatgggaagtaattaaaatgaaacaagctggaatgacaaacaaagaaataatggaacaactggggataaaaaataagactcaaattaaaacatggatgcgatggtacaaaacaggccaaacctatcgattttcgcaacaagttggaaaacaatattcctacggtaaagaatcggaggaaatgagtgagctagaagaattaaaactaaagaataaacagctagaggctcaattggcaattataaaaaagtaccaggagatcgaaaggagttggagccacgagtcattgtccaagttgtagaagaactctcagccacttttaaaataattgatattcttggagtattaggcatacctaagtcaacatattaccgttggaaaaagaagtataaaaaagttgagctaacttcattagaagagctagtaatcaagctgtgtaagaaaaacttctatcactatggtcatcgtaaaattaaatccatcttaaacagaaagtatgggataaatgtaaaccgcaaaactgtacaaaaaattatgcaaaagtttgagattcagtgtcaagttaagaagaagcgacaaaagtacatttgtggtgagagtaatattattgtgccgaacactctcaatcgtaattttaaagcaagccgattaaatgaaaaatgggtaaccgacattacctacttaccttatggctcgactatgttatatttatcaacgattatggacttatataacaacgaaatagtggcttacaaaataggtacgagccaagatattaacctagtattagacacattgagggaagctgtagaattacgtaaaccagtagggttacttcttcatagcgaccagggatctgtctatacttcacatgcatatcagaatttggccaaagaaaaaggcattaccacaagcatgtctcgaaaaggaaactgccatgataatgccgtcattgaatcctttcactcctcgctaaagtcggaaggatttaacgctcaaagtagagcatctatatccaattctaaagtagtacaaattgtaaatcaatacatgtatcgatataatcatgtacgaattcaggcaaaattaaactacctgtccccactggaatacaggggacaggcagcataggtgttttttctaagtctcattttaacgggtcagttcaaatagataaatatagtgtttttaactgtatttagactattacttaattcttgtgttaaagtaaatacacctacagctgtcaagcttggtaaaatggctaacaatccatagtatttaaaacgtcccaataagaattcaatgtcatatattttggtagcaataaattgatacactaatgagaaaggaataatcaacaaaaagggtacaacaaacattgccgggaatatataatcaccgataaatacatatggaatgacatagaaaattaagaacggaataaacgcaacaaaatttgtgataacaagtatccttaaaaaataggcttgctcagaagctttattttttattacaccataaatgataagagcaaaggctataatggtaacaaccaagaaagataccaggttaaagagcttaatggaactataagaaatctgcaaattatcactggaaatttccaatagcaaattcaataaacccacagggtataggaaaagaaatattttattattgaaaaactcttttcctttttccttgaaatattgataaatatagtggagatacaaaacaggaacgaattgaaaagttatcattgttatatagatacttaaactatctccctttgcagatcccacagaacaagaataagctgttgatgtaacaagcagaaaaacaattaaaataaaagctgaagccgaatttaatcttttgtttgattttattatgaaataaacacaaaaaagagaaaggagataaaacatcattggaataataaatagaaatagactttcataactcaccaattcatatccggtctctacaaaccctatctctccatctctttcaacgatcatcgatttaacatcacttaattcatcagctaatttcccatcatcagcccttaatttttctacacttttaccatttatctctagaataacatccccttttttaaatcctagggattgagccagtgaccctttttcaatctcgaatacttggtattcgtttttttcattaaattgcattgtcattccaaggtaactagaatgcagatttacatagataatataaggaaccaaggagaggcttagcaaaataataattaaagatagtttattataattaacacgcattaattttacatccttataatagatagttaaggaagaattttaaatccaaaatcctcctccaccccaactcttacctaataatctaatactgtcaaccactactcctgttttttctggatcaatgcctaataaacaagcatccccatcaacaactttttttaatacttcaggattttcgaccaaaaagttcacaatatcttgcatacatagtctcctctttaattgttattcagcagggtagacatcaaacgttctttctccatatcccccaactcaagctccccgattcccttcttaaatttctgaatagcgagctgattcataacatacatatactgagtgacgcctgctgccttcaatttctctttatagcattttatttctttatcggcaattttatcctcagtttcaaatgtttttaacaaatcaatcgacggctggttaaattttcttgacaaatataaatacgcaagcgtccgctttttcttggcgatatcgctttttgaatcataaaaaagtgctttataatcattttcaatttgtgaagcaatgcccagctggtaggcgtacttttcaaccgtcgggtcaaatttgcccgtagcaagcatagctcccagcacgcatggcaaggctgtcagcgccccggatttacgcttgatcatgtcaaggcactcatcttcagtggcagggcggttgctgagatcgtcatgctgtccctgcatcgattgaagtgtatattccattagcttttcgaaaaacaccggttctttcgacaccgaaccgatcactttaatgcttattgtataaagcgcagtcgccgcattcattgcgactgaacggttgattttcatccaaggttcatcggggctgtcttcatcctctaaatcatcgaatatatcaaacgcaagaatcaagagttcaatgcctgctccaagggtttctgccgcatcggtgtccgtgccgccgaaactttggtaatgataaaaagcaagctcgctgaaatgcaactggtcctttgcatctagaaaagcgtgcagcgtccgatttaagtccgcattgggaatctcaaggtctataaaatgattcattctttgcttgattttactgtgatctagacaaaaaagcttagagatggtgctccctcctttcttaatattttactaaatcaaaatcccgattgacagagcaatttttttatttaacaattatataataatttatcctttttttgggttcgtttgcacacaaaaaaaagacttgtctgaaacaagtctttttacgaggtttttagatatgtgtacttatcgtattgatcaatgcttttgttaatcttgcgcaaggagtcctttgtttctctgatttcattctctagccgccaaagcagttgttttaattcttcaatttgttgcttttccaccggttccacactccttttggaagatcaatcaatttgtgtatagtgaacgagtcataggtatttgatctgttaatacaagtttaaagggatttggtttctttttcaccgaaaagttgcatataaattcatgcgttacaccgcaaactttaaatagaccataacacccattttacacaacttgcgattagttctcaaatcctaatgaaacataaaatttttgtttgtttttcaaggagtcaaataaagatcgcatataaacccctttatcatcgcaagttcagttgtgttttgttcgttttgcaaccttgagtctaaagtagtaactagcggggaatagaaaaacttgagtgttcacggaacgcagatcgggtatgcgccaccgaaaaacacgcaatagaccgacacgcatttcggcccttataaaaaaccatcccttcgccttacaccgcaaaaaccgcaatttgacccgtaaaaattgaaaagaggtgttcatattgcttcctcctcattgcttttggatgcatccatatcaacacgtcagctgccggcaggtctatcccgaagttcaagtcagcgccttattgcgctcggcaaaagaagcggagagcttgatggctgacggacagagaattttaagcaggctttcagcctcgcgtactttggcccagcaaatcatgacggctgcccaaagcaaccaaaaaaataacgtgctggccgcgctcaggcaaaccggcgtccgcagccagcttgatgcctcattcgatcccgacggcattcgcatcatgctcatcagcccccgcagcagactattcctgctattgcgttggtcttagcgcaaaaaaaattccggtccctaagaaggagccggaatttttttataagagcttttgacaccaatcaacagcttcaagatagcactggtacgcttcatctttagttaagccttctgtctccggtgtgttgtcttcccattcgtttcgttcgatcgattttgcaagccgcaagatttttcggtaatcattttcttttccgagcagcgcctggcccacttcgtctgtcagcggcagttcgctgacgacttccgttagttctttgtgcagcagtgtatcgataaatgaaaacatgcctgtcagcatataagaagccggctgagggcggttcgttttttttgccagcaattcgcaaagcttcgcgcggatcagcgaaatcttgacgacttcgttcttgctggagttttgctttttcgttaaatccttaaatgagaggatgaagatccaccttttgatttctttaaatccgagaagcacgatagcctggcggatgcttttaatcttttggatcggccggttggctggagaattcaacagcttcagcagctggtaagaaagcgacaaatcgcgctctataatatttgtgacgttttcaatatcaggctgatcttcgcttaattcatgcagcagctcataataagcgtggaaatgatatgtaatgtcctgaccgtcaatcacgacaggctcgctgaagaaatagccttgaaacagatgaaatccgtcttttacagcctgctcatattcttttcgcgtctccactttttcagcgaggaacgtcaggcggtggttacggcatgatcgaaggatgctctgtctttcctgctgcgtcgttttgaaaaaatcgatcttcaaaatatcaatggatgccaaaagctgatggagcaagtccctcttcacgcgatgctttaaacaaaaatcatcgagtgcaatcgtgtagccgaggcttttcaaatgcctgcacctttcgataagctcaagggtaatcggcacatcttcaaggatttccacaacgagctgatccgggtcaaaatacgtcggcagccctgatgccaaaagaccctcggtaaaattcacgtaataccttttgccttctgtcaatttatcgattccaatgtttaaaaagctgttaatcattaattctgttgtcgcttgatcaccgtcaataccggaaaaaaagtttttctcgctttccctgtataaaagctcgtatgcgacaacttgttcttttctgttgaatattggctgtctggcaacgaataccctcattcttcttccccctagcgactgaggtgccttcgcttttaagtatatcaaataattgggcaaatcccgtctgctgtataaaaattcacccaaatttgaacttaatattgaaaaacagataatccccgaagaaattatctgtttcaatccccagttatgttaaaaactatcgtttacagagtcaaccttgatccagaccttttttcgccttgattttcgcttcgtgaatttgctgcatcttgttgttccagcaagcttcgcttaaatcgacaggatattcttcgggcttgctgatccgcttatactcttcccaaagcaaactgagattttcttgaacataccgcttaatatcctgaatgctcggattctcatagacaagctcgcctttttcaaagatcggctggtgaagatctttcgcatcaaaattcgtcacaaacttgctgataaacgtatgaacggggtgaaacatcttcagccgctcctgttcattgaccttttcatagtccaaagcgatataatcgccttctgaatgatggttcagctgattgatgattctgtacacctttttcaagcctggagtcgtcactttttccggattcgaagaaattttaatcgtgtctgccatctttccgtcttcttcgatcgaaacaagtttgtaaaccgcgccgagagccggctggtcgtaagcggtaatcagctttgtgcccacgccccagacgtcgatttttgcaccctgggctttaaggttcataatcgtgtactcatcaagatcgcttgatgcaacaacttttgtatctgtaaatccggcttcatccagcatggctctcgctttcttcgacaaataggcgaggtctccgctgtccaggcggattcccgaaaattcaatttgatcgccgaattcctttgctactttgatcgcatttggaatgccggaacgcaccgtatcatatgtatcgaccaaaaagacacattttttatgggtttccgcatattttttaaatgccgtgtactcatcgcgataggcctgtacaagcgcatgggcgtgcgtgcctgataccggaatgtcaaaccgcttgccggcgcggacattgcttgtcgcgtcgaatccgccgataatcgcggctcttgctccccacatcgccgcgtccatttcatgcgcgcgccttgttccaaattcaagcgccgtctcttctccgatcacacttttgattctcgccgcttttgtggcaatcaatgtttggtaattcacaatgttgagcagagccgtctcaatcagctgcgcttcagccaaaggcgcttcgatcctcatgatcggttcgttgccaaacacgatttcgccttcctgcatagaataaagcgaaccggtgaatctcatatcttttaaaaagccgagaaagtcatctttaaagcccagctcttcttttaaataaactaaatcgctttcagtaaatctgaaatcccgcaaaaattcaatcgctttttcaagaccggcaaaaacggcaaaaccgctgtcaaaagggagctttctgaaaaacagttcaaatacggctttcttttgatcaatgccgtcgcgccaatacgtttccgccatattaatttgatataggtctgtgtgtagtgctagactgtcgtctgtaaaacggtgttccaaccttcatttctccttcctcaatctgacactgaggctcccagggtgtttgcaaaatgagaaagagcccagtcgtgtccgtccgggttaaagctagccactgcgttttgatgaatgacaagattaaaccctttattataagcatctactgcggtatggagcacgcatatatctgtgcatacgccaacaaggtgcagttcttgaatatccctttcacgaagcttcagctcgaggtttgtcccggcaaaagcagagtaccttgttttttccatgtaatagacattctgatcgtgttcgtgttttcgataaagcttttcaagcttcccgtataaatcctgtcctgatgtaccttttatattatgcggaggaaacaaacgggtttccggatgaagcgtatcgccggcctcgtgtgaatcgactgcaaatacgacataatcgccgttttgaataaacgtatccgcgagacgcgccacggcgtcttcgattttgcggccgggttccccgcacgtcagcttaccgtcagctgcgacaaagtcattcgtataatctatacatataagagcttttttcattgccgccctccccgccttttgtatgataggtaacattataacttatctaaacggacaagtgaatggcgaatcaatcgaatatggctgtcaagccgcgccagcagcggttttttctttttcagaaaaaaacaaaaaccacgggttcgggaccgccttgcggaaggcgcgtgcgaaaacccgcacctcatctcttgtttaaaaccgactgctcaaagatatcgtcctgaacataaatcgattctttctctacggcctcacgcgccgcgagaacaagtccaaggggagtgtccgattgctgatcggacacgatcgaaaaagggacgccttgcttattggactccttgatgtaaggagataaatgagagtagccgatttcgccgttaagcaataatgttgcatccgcttttgagccaagcgcatcgatgacttcccggtatgccttcggacgcagcacttgtcctttagtcaatgcgatgatgaccctttccctcagcgagcctaaaaacagtctgcgttcatccggcttcgtttcgcgtggtccgtacattccctgctgtaaatattgatccaatgattggtcgctcacgtcttagaccctccagttttatcctgctggcagcgttttttaagctgcattttttatcagtatgcccacgaaaacagcgggcatgagcccgtgctacatttcggtcacccattgtacgatctttttggacagctctcggccgcatccgactcagccactttcgacaatgaccggtcaagcttttcggcgagttctgctttttcttcctcataggaaatcagcgtgctccactccagttgcggcacagccacaagcgtatgaaattcctttttattttcatggaggtaaacgtctgtgatcatctgatcttcgtttaagatgtttgccttcctgattttcatctttgtcacctgccttatctatcttttttcccattatactataaaaaagaaacagcctctttaaaagaggctgtcacaggttcaatgactgggaaccgtccatcacatccgcatctgtgaaggtcgttttattgatatcgttatgaatcaatccgtagtcccctgtttgaaatgtgcccgctcctcctccggaggaatccgtgcacttcggggaaatcgcaaacacatctccaaaaaaggctgcgctgtcatcaacgactcgcctgataaaaatcggtccgacaattgccggcattttcacacctccgccatttaatttattagcatcatatgtgaaaatgggcaaaacgttcagacttcaggattttccgccgtttcttttttatacctctgccttaaacggacaaggcggacgatattcaatgtaaaagccttgagcagggcataagccggaacggccaggatcatgccgagaatgcctccgaagcttccggcgccgattaataaaaggatgatcgtcagcggatgcgtattcaagcggcggccgataatcagcggcgacagcagattcccgtctgtctgctgaacggcaacgacgatgatcagcgcgatcaatgctttcgtcggcgagtcgagaaatgcgataatgacggccggcgccgctccaagaaacggtccgacatatggaataatattcgtcacggcaatgatcaacccgagaatcagcgcgtatttcacaccggcgatccaaaaaccgatgaagcacgccgttccgacgaacagacaaacaatgagctgtccttgaatgtaagccgccagcgtctcgtacaaatccttaaaaatcttcagcccttcatttttatacttgtcaggcaggatcttgacagccaaattcgggaaacggtggccgtccttcagcatataaaacaggatgaacggcacggtaacagccgtgagcgcaatgttggtcacaacgccgaatacagaagtcaggctccctgtaatattttcaggcaggctcgtcaaatattcgccgattgagctttcgattttggcaaccgatacgaagtcctgattcattatccaagtgaaccactgcgaattcgacatttgcttaatgaaaatctggatctgtttcacataggaggggatgttgttgaacagatcggtaacctgctttgtaaatacaggaccgactgctgacaatacaaacccgatgaatgccacaaacaccaaatagatcagcagaatggacagcgttctcggcagctttttctcaagaagccgcacgatcggattgaatataaaatacaagattcccgcaattaaaatcggagtaaatagagtcgatgcaaatacgatgatcggttcgaaaagaaaagacacttttgtcgacacataaatgataagaagaaccaataaaatttgcagcgtccaaaaatgggtttttgattttaacaagctttgtttcctcccggcttttttcattaatctaaaaactactattcacactaacgtctgtcaactgttttccttccattcatacgaaaaagctttgacagggtttcatatttcagcgccttttgaataaaaaagattgacagctcctcctgttgtaattatcatgattacaacaggagggtggtttgatgaagatcagcagcagatttacgatagccgtacatatgttatccttgatgcacgtccgaagcgaccatttgacatcagagcaaatcgcagacagcgtcaataccaatccggtcatcatccgccaaatcagcagattgctgaaaaaagcgggcttgattgaagtaaagcgcggcacaggcggagcgcacttattacgggatgccggcgccatttctttgtatgatgtctataaagctgtcgaagttgtcggtgaaggcgaactgtttcacactcacgaaaaccccaatcctgattgctgggttggcgcgaatatccaccaggttcttgagcttgttttattaaaagcgcaaacagccatggagaatatactcaaagaaatgtctataaaggaattgactgatctgatcatccaaaaaaagaatgcttctcagtgaggcatgattttttcaactcgttgtaataactatacttacaacaagcatctggcactgtgtttttttcacctcgttgtaatattgttcattacaacggaataaaaggaggtggttccatgtgatcaacacaggcaaattcggatttccatcacattaagggaggacttaacatgacgaatcatataaaagaaatcaactgggagcaaaacaccaactcttacattcagctcataccgaatattgagtacacaaaagtggaagacacttctttgacattacatttgctggtgtaccgcaatccaatggatgcgttatttaacaggaaaggcaatcaggaaacatacccgctgatcatttatttgcaagggtgcggatggggctggacaaaacaggatacatccgcctttatcccccaactggttccatttgtcgagcaaggatatgtcgtggcaagcgttcaatacagaggcagcggagaggcggtgtttccggctcagcttcatgatgtgaaaacagcagtccgctttttaaaagcaaatgccgcccgctataacatcgatcctgatagagtcggagtctggggggattcttcaggcggccatttggctcttttgcttggattgaccgaaggaattgaagaatttgaaggcccggacgaataccgtcatgtatcgagcaaagtcgatgcggttgcggactggttcggtccggtcgaccttctgtccatgagcaagtatccgtccatcttcgatcatgattcacccaattcaccggaatccaagctgatcggcggagctgttcaagaaaacagagtacaggcgaaacaagcgagtccgataagctatgttcacagggaagcgcctcccattctgattatgcacggggatcaggacgatgtcgtcccttatcaacaaagcgtccaattgtttgaagccttaataaaagaaggccatgatgcccttatgtataaaataaacggggccggacataacggttttacccaggctcataccctggacatcgtcaaatcgttcttccgcaaacatttaaagcctggaaaagcctgaacattgaaggccggatatccggcctatcagtgtatattcctctcttttatgaatattttctaaatttttttcagtatatcggtataaagttcaccttcagaaaataagatgaaaacgcttacaaataaaccatgaggtgaacaacgatgaaaaaactggtgctgctcatgcttgttttgctgctcgtgtatccgcatgtatcgaaagcgggaggatttaaaggaggaggcggcaatccgggctactggttcgcgggagaccctgtagaacatcccgatcccgcaaaaccgccgattgtattcgtccatggattaaacggctcttcaagcgcttggtttgacgaaaacgacatggcggaacaggcctggaaaaacgggtatgacgcggcttttatcgatctccaccccgataaagacatgcaggacaacggagcgatgctggccgccaaactgcgcgaaatctaccagtatttcggccgcaaggtgattctcgtttcctacagcaaaggcggaattgacagtcagtcggctcttattcatcacaacgcataccattatgtcgagcgggtgattacactcggaaccccccatcacggctcacagctggcagaccttgcctacagcaactgggcaggatggctagccgatattttaggccagaaaaatgacgccgtttattcactccagacagggtttatgaaatcgttccgcgaccagaccgacaatcatcccaatcgattgaaaaccaaatattttaccctggcaggcaataaaatcggcgggttcggcagcgctttatttttcgggggcgtctatttaaacatgtttggcgaaaatgacggagccgtcactgaaaaaaatgcgagactcccttacgccacaaacctggatacagggaagtgggatcacttctcaattattaaaggaaacctcacgtttcctgtattcatgcctttactgacgattcaggcaaatgcaaatgaaactgcggccaccaaagaaaacttatcgtaccctttcatcagagggggggaaaatcatggattgagagaagaggagtttgccgttgaaaaaggcgtcaaggagataaccgttcactggctgagcaatcattcctcgggaaatatcaaattgacagatccacgcggcaagccgttcaaagatttttcaatcgcaaagacggcggatgtttttgaaggggggttcgtccattccgctgccatcaaaaatcccgcggcaggcacttggaagatcgcatcatccgtcaaacaaaaagaggcgtttttgttcattgtgactttcgattctcctctaaaccagcaaatcaaaaacgcagtcaccagagaatcgtcaaaccttgcgaatgttaaggcgtccgtccgctcgatccgctacgaaaacggaaaacaagccgagaaaaagtcgctgaaacctgcttctatcaatgcgctgcaaaacagcctgtcattcaaaaaagccggcatgtactcggtgacgatagacctttcaggaaaaacggcagacaactcgccgtttaacaggacgatcatccgctctatttatgtaaatgacaaaggggaaaagtttgaaaacagccctttgtccgattaaaccgttcttttcatgggagataaggattcatcgaccatgcggtcaagcttccggattttttcaagcgccagcttatgatcgattttgcggtaatggtggtttccgcccggctcttcgtccagctcatccgcttttttgacgatttgctgcagcttgtttttatcaaggtccccttctggcaaataggaatccgtatgaagcagaatcgccaaagcaatctctttggccgctttccgatcttcgccgaggcggatgagaagcttgtgggcgcgctcggctccctttattgcgtgaatgtcgttttgcttgtatttttcataatcccattctccgtcggtgtaccattcataatggccgatatcgtgcagcaatgccgcttttgtcgcgatatcgggatctactccagctcgcaccgccaggcggtatgagtgataggcgcaggctacagcatgagctacaccggaacgagttaaatatttttgtgcgattggatgggtgaatacatccattaaagttacgtttctcatgtaaacccctcctttatatatttttagaatcctaacatattttcatgcaaatctcaattgatctggcacatcatattcaaaattgataaataaaaaacaagcacaatcgattcgatgtgcttgtttttttattttttacaaaaactctttaatatcatacactctgccgttttcaaagtcggtctcaagcaggtcgagcagaatgccggccacataagaggtgcttctcagctttccttctgtttgataggttttgaatcgttcaatttcatgaaaatcttttttcgatgatgaacggataacctcttgcatgccggtatccatgatcccgggggagaaagaaatcatcttcaccggatcagactcatcttcctgttcaaagccgaatgttttcgtgaacatatcgagccccgcttttgagctgcagtaggcactccatcctttataagggtttttggccgcgcctgatgatatattgacaatcgattttttgcctttatatggcttgagccatttggtaaacagctggctgagcatcaccggcgctaacaaattcaagtcataatgcagcctcagttcttccggttcagcttcgccggcgcgcttgatcggcgtcaccattcccgcattattgatcaaggtgatcgaagcaaaatcatgggcttggacagaatctgagaattgccgaaaccacttttctgtttcggcgagctgcgccagatcggcctcatgctggatcagcctgtcatgactgatatcagacttggtccttgaaacagcatgaacaatatggcctttttgcaaaagcccttcggccatcgcggcgccaagcccttttgacgctccggtaacaatggataaatgcatacggcgtccctccttatccattattgtactgattcatcagcccgcttctcaagtgctgcggttttctgcgctaagaacagccaaccaaaagacagccgcaccgacagcaccttacagaacctcggacttttcattgctgagcgctcttattttttctgctgcccgctgactttcggaatcaaaaagaacagaccggcgatgcaaagaaggatcagcagaccgtatagaatgggcaggaagatggattgccggttttccgcagagtcatcttcccttcccgataaggacggatttgccgagaatgacaggtcaagctgctttagctttgaagccacggaattgctttcattcgtgaagcttccggacaggcttttcagcttttcgatagcatcttcttttttcgaatctgtaaatgagaattccttcagttcttctggaattgatatttcctctttgtattccgcctcttcttcctgaaggtagtccgtctcgattttaatatcctgcttttcgtactcgtttggctttacatcgactttatcggtttcctccgccttcgcgatcggagtgaaaagaaagaaggagagcatgactgccatgatccccttctttccccatttcgcattacgcatcatggtcagtctcgctttcttctgttcttgattttgcaaaatcgacaataaaaggaacagcaattgcgatgatcgtgattaaaattaatgctccgattccgagtgcaaactggcttccagttccgtactgaatcgacatatatacggttgataccggattgttaaagctgaagttcggcatcgccaggtcaagcagcggcgctacatagaacagcaccatggcggctgtcgcgattccgcctgcgatcgatcccagcataaacgccgtccggataatggctgaacttgcgacaagcagcaagatcgtaaagaccgaccacatgacggcctgatcgtctgcgagtgagtaaatgttcaaaccgaacaggctgatcatcagtccgacaatgatattcaaaatgccgaacagcgcgcccctgactaagagcggagcattttgataatggtggctgaaatatccgatcagcaagctggaaagcatcacaatcacgagaatgacgaccggcggtacgttttgcgcttttgactctggaacatccccgctgattttcaccggacttgccagatgatcgtatacatatccgtcgtttcctccgaacgcatttccgagaatgccgtatacgtctccgcggataagctttgtcgtcgcgacattttgaccccagtttgaattcagggtatccgcttttttctgaacatcgtttacactttcctgaatattgctcgtgtactcgatgacgcctgattgcgtttccgacaaggaaccgagcatgttggacagctgcaaaatgtcatttccaagcgtatcctgcatgctgatgaccatcgttccatctgtcgcatctccctgcatgactgctgttccggcgccttccggattgcgcagctgttcagatacggcatttgctctgtctgaaatcgtgctgagctcattcagcacgtcagtctgcttctcattaatgaaatcgccgtagcttttgacgaaatcggtcatgtcttttgtataattttcaatatcttcatttgtagacagcatgttgttttttaaattgctccatttttccgcttcggtttcaccgattttaaggacggtattcacgctgtcttttttcgcggagatgacattgttcttaattgtataatctactgatccgtatagcgttgtttcatagtttgaaagtaacttatagtatttaagtaactggtctacatctctcgtacgaatcgttgactcaaaagccttgcttaacgtttctcttcgatcactatctttcggaagatactctaatatgccattttcaatttttttaatactatcatagattacatcaaaatttttattgagattctcaatatccaccttcaaatctttgatttcatgctttaaatccttaatgttttctttcagactactaattttcttatttaagttttcaatctgtttttccagctcttcgttatgagtgtcctgtttagcacgaagatcttcttccaatttttcaagccttgctgcggcttcgttcaattgttcttttaacttagcattctcatcttccggttgttcgtttccaggtttcagctgttgatcatcttcacccgtcccttgatcatttatctcatctgaaggagttgccgcgtcgccttgctgaccgttttccccggttccaggggaaggttcttgtccttgattcgggtctccggcagatggttctttatctcctgaattgtcgccttcattccctgaggaatcctttagcccgtccgataattctttaagatcagccgcaatgctcttcaattcatcttgctgttcttgaagatcaatttttagatcttttggttcttcttcatcacctttatcctgatcttctttatcttcattacctgggttatcatttgaatcatcttctgagcctttagccagttctgaccgcattgaaattaaatcaggttgaagccctctgagtctctctagtttcgtttgatcctgataatcatcgatcaactgtttctgaatactttcaatcccaatcgcctgtaaaggcacctgattttcccgcatcgtttgcaggttttgaaaagagttcgcagtcaggctgaattgattttgcaagccgttgaacgaagcggccatgccgctcatttgttcattgaaacggcttgttgcgctggactgcttttccttaatcaccgtaagtccgtcttgaatctggccttcgctgtccgcttgtgcagccatcagcagctccgactgcttctcttgatattgtttgtattgattgacgttgtcgacgaagctgtccaattgttttttggattcttcgacgcttgcgttgcgttcttttgatgtgccttctgtttcattgatcgattctttcagtctgtcgatcatctctttttgtctttctacttcgccagctaaattgttggagctcggcttgtaaaaattgtacatcgcgttttggaactccgactctttgtttacgatgctgtcaaactcttttctgacctttttgactccctgtttgacaaagcgccagtacagggaagacattttcttgctcaccgttttttgcgcgtcctgaagctcgcgctggactttttccttgttgacggcgtcgagctggtcctgaattttgaattccagctccgctttttgcggacgctcatggttgtagcttaaaatgttttgcgaaaagtccgacggaatgtagacaatcgcatcgtattgcttctccgcaagtccgctttctgctgcgctccggttgacgaccgtccatttataatccggacggtcaaccagggaagccgagatttcgtttcccagcagcgcatcttgatcaacggttccgtcatctttcaaaacgccggtatcctcattgacaacggcgatttcccttgtcgcgttcgatacctttttcgtcgggttctcaccgatgaaatgaaaaaacaggacgggcagcaagatgatcgtgacgatggcgctgataattttcagcgtgcttttttgttgttccgtcatttcgctttcttcctttctacagcacataaaggaatttgaattttcctctctttgccgttttcaacgatatagccaaagcccggcagaatttccggctcctggcgttcatatgggagctgaatcaagttctgctcggattttttcatcaatagcatcgcgtgtctgacctgcttgacttcgcttgtcagcgaatcatagccttttgtgaactcgctgtgatttccggcaggtataaagtggaaacctaaatgggcgtaagatttcatgaacatcgccattttgtcctgaatcgatgcgtcgatcgtctgctggaaccgtgaaattccgtcgacaataaagaccatcggtgagaaatcaaggttggcgatttctccttgtttaacggcttccaaatacatcgcttcccttgtccggcaaatttcttccgtctcagcgagccagagcagaatgtcgtcttttgtttctagatagctgatttgatcctctgtcgcatattgagaaagccctctgtctatcgaatcaaacacggcgatttttttcgtgtcatggtcaagcaggtgctcgagcatgatcttgatgacgtttgtttttccgcgctgcgtctgacccataatgaggcagtgcttatttttctcaagattaaagtatacgggttcgacagtttcttcatcgagtcccattggaataaggcctctttcaggctgaagcggataatctctcacaaactgtgtgacggaaagctcgagcggcagcatcggcacaggcgccggctttctcatgccttccgagcgttctgcgatcgcctgaatgtcggctttgatcccttcaaacagctcgatatcgttgtccgcttccacaggcataaacatttgtgcgaagtattggttttctttattgataataacgcgtccagggatcggttcaaggctgaattccggccttccgataatcgaatatgcttcagactgatccatcagatagtggacaaccctcgttttcaggttgttcaagagcgactgtctgattgcattgacccttgtcgcggtcaggattaaataaattccaagcgactggccgtctcgtgaaaactggataaattcgctttcgagttcatgcatttcgtctttaatgatgtcaaagttgtcgaccgttatgaaaataaacggcagcttttcctcattcagcgcattgtacatcttgatatggctgatttcttttgcacggaagagatttttcctgtgctcgatttccgccttgatccggaccataaatttctcgatttttctcgtttggtccatcaggaaataatccgcggtgtgcggaagccttgcaagcggaagcagcgttccgttgccaaagtcgaaaatgtagtaatgcaattcttccggcgtatactgttcggcaaagctcatcatgaacgtcgtggctgtcagggattttccgtagcctgacgagccgacgatgccgatattgccgtcttccatcatgcggtagctgatcggctcctggctttgcttttcaggttcatcgatataggcaaagttaaaggcatcggcttcctccgacggatagcgcgttttcggtatgcgttcttcaagcggcggcagccaagggctcgggagcttctcgattcccatctccgcttgaatccgttcaatttgttcgacgactgccgaaatttccgtcacagcctcttttttcgcagcgcgatcagcatcaacatctgataaaggaattaatccggtatctgtgacgatcgccacttcatcctctgtgccgtagccgtcctccatgtaaggggctccgctccatgcagactggaacagttcatacacctcgttgttgccgacttgcaaatagccgcggcccgttaccgtgatggtagccgcatccccgtttttgaggatctctttactgtcattcgcatcctgcaccttcaaggcgaccttgaatctggagttgctccaaatctggtcatcgatgatgccgcccggtttttgcgtcgccaagattaagtgcaccccgaggcttcgcccgatccttgccgcactgacaagctcgcggataaattccggttcttcgcttttcagctcggcaaattcgtctgaaattaagaaaaggtgcggcatcgccgttttcgcttttttctgtttgtaaagctttgtatagtcgttgatatggttcactttgtactgatcaaagagccgctgccttttcttcagctcgctcttaatggacgcaagcgcccggttgctgaagttcttgctgccttcaatgttagtaatcgttccgagcaaatgcggaatgttccggaacggctgcgccattccgccccctttgtagtcgattagcaaaaatgcgacttcatgcgggtgaaagtgaactgccaaagacaaaatataagtctgcaaaaattcacttttacccgaaccggtcgttccggcaagcagcccgtgggggccgtgcgccttttcgtgaaggtttaaataaacaatgtcgtcttttcctttatagccgatcggcacggccaaagatttggccgattcgcttgtcatccatttttgttcgatgccgatgtcatcgacttccttcacttggaacagttcgagaaacgatacggtatcaggaatcgaattcgtcatgcccgtctggtggtcaagcgttctcagcgtccgggaaaactgttcgttgtcttccctgttgtggtgatccagctgaaacgggatctggacggctttcttttgcttgatcagaatgtcgccttcctgttcagtaatataacgaacaagggtatgaatgttttcggacaggctttcttttgtctctgccgccacgattgtcgacactccgaggtgtttctgcttgccttccaaatattctaaaatgacgtgttctgcgatgagctgctgatttgtgatgataaacacaaagtgcggcttaaacaaagtcttctttttgttttcatctaaatcccgttctctcaaaatctcatatatgcttgaaaggagctgatctctcgtctgttcgttgtaaataaaccctttcgcataaatatgaggcatctgaaaatgcgggagccacttcatccattcccattcttgatactcggcttcgtcaaaaataaagacaaagcgcaagtcatgatagctgtggaaaaatgcgagctggccgacaagctgatgaatttcatttttgacgacggacaattttccgacgacgcccatcgggccttcggcaagattcacagtgatcggcgcatttttcagctctctgtagacctcttccattttttgcgtttgttcaaggagatggtctgtatcgcggttggccaaatctccgccgttcaaattgatttggtacgaagatgcaacatttcccgttccaaggcggatttgcagaaaatcggcgctttcaatcgatttttcccaaattcgtccgctgatctcctttgttaaatatttcattctctcaaatgtaggaaaatggaaatcaagtacgaacttttgtctttctgcaagttcatgcagctctttctttttgttttcaaggtaaagggtatagacccgctctcttttttcttctctttttttacgctgatttttgtcgcggaagtactgcacggttgacgtaatcagcgtcatcataaacatcgcaagggaaacgatgataaagatcccccgcggctgaatgagcgccacgatccccatgacgatcagcatgacgagcggaggcagaatcatcagccataggcctctgttgtctccgtcgctttcctgtgccgggaagctgaaggatactttttcatccggcaggtcgtaaatcattctcggcggcctgcggtattgcggatatttattttttgtctcggagctcggcttaagaatgttctccaaagacgtatcaaacttcccgaatccctcgatttccaagaggtcgtcttcaacgatgcgaagaatattcagtccaaatgcgatttcgtctccattttgcacggagacaggggcggacacttcttctccgttcaaataaattttcgcgtcattcggcaggacattccattgcccgtcgaggcggatgaaagagaacgtacctttttctccaaagaatgaatccgtttcattgaaataaacatccgcttcttgatcgagggaagaaatgacgatttcctgtctctctcccaaatagtaggcaggaacgctgtcggcttcttcggctaaaaagagcgtcagctgttcagcgccgctttggacggacgcctttccgccaagctttaaagaagagaccgtctcccctcccagctgcacgttcaaagcgtctgagtccttctgcttttccagtgtcaccgggcctttttcaaatgaaaaatgcttaatcgtgacagaatgtttcaaatccggcccgatggtgagcgtgcggctgttctgatcatccagttttattttttgatagtttttatgataaaaaatccataacagactcatttctccgcctcctgccaacaacaggtgttttcgcttttatttgtcatcttttttctttttgtcttccttttctttattttcttttttcgcctgttccttctcggccttctccgtttcagcctttgcggcctctacgtccgcctggttttgctcggtgtttgcctgctggttttcttcagttttggctttctgttcatccgctgtccgcttcaattcttcaagttctttttcgagcggatccagctgtttctgccgctcatcactggacaatttatcatcggctttaatgtcatctgtgtatttcataagtgccaacatgatctgtgcattgttttccagcttacgggccgtctcaagcgcttctttattggcgccgcgtccgatctgaatccagtaaaggaaattattcggatcgacttgaagcgtcaggctcttcatggcatcttcctgtaaatcggcttccttcagtacattgtcaacgatgatatacgaataagccagctgatactgaacagaatcaggcatctcatcggcatcatatttatcaagcgtactgatgactttgctgtactgtttatttaagaagtagcggttgctttcgataaacgcctgctgtttcggctgcgcgaagaataatgaatagaaggaaaataaaacagccggtattaagcataaaattagtcctaaccctatgtacctttgaatcttccatttcttcttcggaagatggacaagcattttttctttggcatccagttcatcgatcctcttttgaatgacggctttcaaatcgccgtatgtcccgcttgtgatgatgtcttttacctgatctgaaaatttgatggtttcgctgtattttaaatactcttcaaaagaaaattgcccgtcgacagcaagcgccgcggcggctttcacttcattgaaaagtctttcttcgtcgtgttcatatggcggaatgctttctttcactccataatgtaaaaatttaggcgtcaaccctttgtcaaaaacaatgttttcaggcgcagcgatcaggtgcagccttttaattgaatgttcttcaacggctttcacgagctggtacgcgaatagccacttgctttttttatttttcccttttatataacgaaattctttatattcggaaggaggctgaatcataatttggacttcatcatcggtcatgacggcttctttattaaaggaaggatcgacttctttaatgacgtttgcttccaagccgttcacaagattgatcttctctctttgaaaacgaaagatatatgtaccgtcttctttcgtcatgacggcctctaattggtcttcgagatacgttttctttttctctgccattcatccagatcctttcataatatttccagacggtcacctgtcgtaattccgcattgcgataatgtatattcgcctgaaaaaacggcatctttatttgtcacccttacccagtagccttcccggggaggcaccggtatgcttttggcttgccacgcaatgtcgactacctttttaacagaatggtaatccgacagtctgaggtcaaagacgctgccgtcgtaatgttttaaatcgatggtaatgtcaacatacaccagttcatcacctctcaatagaaaaagcgccgtcatcttcttttgaattaggcgcttctctcattcttctaatctgtaaattagccgcggatttggctagcgatgtcttggtcagtgctttcaagagtgttagcagtctgatgaagctgtttagaaacgtcgcttagaagttcagccattttaataaaagaaggtcttagctcttggtattgctctgagaacgcacggcttgattcaccttcccacatatcttgaagctggttgatcatttgatcaagacgctgattgacctgctcagtcacatctccgctttctttttgatatctgtcagccatttgccgcagttcagccggcgtaacacgaatgattcctgacatattccttatacctcctgcgctattcgccctagatatgggctaaataacttatttttttgaacgcttttattataaaaacaagattgaggcacagtcaaacaaatctgttgttattttacaaaatgagtctaaaggtttatcattcctctatttccacccagcaaaaattatagaaatctagtaaaaatatctcaattttcttctttcggaacattcgcatcaaaaggcatggttcaatgtgactatctgagactaaagcgtttccataggataaaggaaggattgcctatgcgcaaaaaagcccgcctctcttagaggcaggcttgtcttgatcagcccgctttcaagccggctgacttttgtttttccttattatagtggtgcaaaaagaaatcgtcagtttccgcccgaatgactttccataagagcacaagggcgatcaagttcgggatcatcattaatgcgtttgccgcgtcggcaaaagcccatacagtattcaggcttgcgactgcaccgtaatatgcagcaatgacataaacgacacgataaagcggcacccattttaaaccaactaaatattccagacatttttctccatatacataccaaccgacaatggttgagtagccaaagaaaatcaccgaaaacgtgacgatgtatttgcccgcggctcccagcgaagaagcaaacgcggcgtttgtcagcgcgccggcatcaagcgatgcatcgtgggcaacaccagaaagcagaccgcctgaaggatcccagaatcccgtgataatgaggacaagccccgtcatcgtacaaacgatcaatgtaacgatgaaagttcccgtcatcgcaaccaaagcggccttgacggggtgatcggatttcgcgtttcctgcgattaaagcagcggtaccaagaccagcttcatttgaaaagattcctttcgacattccgtttctgatcgcctcagagacgaccacgccagtaaagccccccgcggctgacaccgggttgaaggcgtgataaaaaatcagctggaacgccggaatgatttgatcataatgaaggaaaataatgatcagtgatccgccgatataaagtatcgccatgaccggcacaaaaatgctcgcaaccgtgctgacacgctgaaaaccgccgaagatgatcgcagccgtcaataccgcgagcacaaggccgatgatccagccgggaatcccgaagctctgtgtaacgacttccgaaatcgtgttggactggacggaatccccgattccaaaagaggcaagcacacctgacaatgcaaataaaacggcaagcggcttccacttcttcccgagccctttttcgacatagtacatcggcccgcccgaatattcgccccgctcatttttgacgcggtatttcgtggcgagcaatcgttcgctgtattttgtagccatccctaaaagaccgacgagccacatccaaaacaaagcccccggacctccaaccgtaatcgccgtggctacaccggcaatatttccatttccgatcgttccggcaagcgttgtcatcagcgccttgaaattgctgacatcaccgtctgctccggctgattctttttctttcccgaatgcaagtttgaatgcatatatcaatcttttaaattgaagcccccgcaggatgaacgtcagaaataaaccggttcccgcaagcataacgatgcccgggactccccataaaaagccgttgattttctctagaatcgccaatgttcctactcctcttatttcagaataattaaatttggtttaatacatcgccgtgtttatgaaaaataataaatcaccagcgacttttttgttgattttaacaaacaactatattcataataaaagtaagatgggtatatgtcaaaattttttcatgcaaacataaaaagtaggggttttttatgaacaatcgaaacaatccttttaaatatcaatatgaccgtttagaagatgtggcagatcatatcagcgaggtgctggactgtccgattacgatagaagacatcaaccaccgcctccttgcttacagcacccacagcgactacacggacccggcgagaacgtcaacaatcatcggaaggcgcgttccggaaaaagtcatcaacaagctttggaaggatggaacgattcccgccttgatgaaaaccgacgaaccgatcagggtcgaacaaatcgatgaagtcggcctgtcgagccgcgtggcgatttcaatctggaaaaacagcgaggttatcggttttatctgggcgctggaaagccaaaaaacgctgtcggaagacgagcttcaccttttgaagctggccgcggattccgtaaagaacaagctgctgccttatcaggtccgaaaaagaaaaaatgaacagcgcagccaggaatttttctggaagctattgaccgggcacatttcggaagatcaggaaatctccgacggctttcaccagcttggcatcggagttccttcaacttattcggtcatcatcatccggctgaaagacgaaatcgaagaaaaaaccgaaaagcagctccattacttgctggaaacgacgcagcagctgcaaatccttctggctacaatcgactataatgagctgattgtcctcgcttcgccaaaaacggggcaaaaagggcagccgttcaatgatttaaagcaatttgccgcgaatatacaaaagcaacttgaagagcgctataaactgaataactgcacgatcgcgatcggcggaatgtacagcttgatcacccttgtacaccagtcttatcaggaagcgctctcggcgctgaaggtcaaggagcgttttcccgatgagacaaggcacctcgtcagcttttcagagctcggcatctaccagtatctcgacgtgctcagcgaaaaacggaaacatgcaagctatccaaactattctttaatgcagcttgaagcatatgataaagagcaccactccaatcttgtcgagacgcttgaacaattcatcgaatgcgacagcaacgtcaacaccgccgcaaaaaagctgaacattcacgtcaacacgctgaattacaggctgaaacgcatcagcaaaatcgccgaaatcgatttaaaaaacatcaatgaaaaatttacgatttatcttgaaatcaagcttcgcaacatgcatttgtgaaattccacaaatgcatgtttttttatttttcgattcaaacaaagaaaattctaaaaagtcagtataaactaaagcaacagcatttttacagaaaaaggaggaatgatcggatgattatcggcgtaccgaaagaaatcaaaaacaatgaaaaccgtgttgctttgactcccggtgcggcttctcaattgatcgcggcaggacaccgcgtcatcgtggaaaaagacgcggggactggaagcgggtttgaaaatgaggattacgtctcagtgggagccgagatctcagaacaagcggaagccgtctgggaagcggctgaaatggtgatgaaagtcaaagagccgctccctgaagaatatccgtattttagagaaggtctcatcttgttcacctacctgcatctagccgcagagccttccttggctgaagcattaaagcagaaaggcgtgacagccatcgcctatgaaaccgtcagcaatggccgttcccttcctttgctgacgccgatgtctgaggtagccgggcggatggccgcccaaatcggcgcgcagttcctcgaaaagccgaaaggcggaaaaggcatattattggccggtgtacccggagtcgcgcgcgggaaagtgacgatcatcggcggaggcgttgtcggcacaaatgcggcaaaaatcgcggcgggcctcggagccgacgtgacgatgatcgatttaagcgcggatcgcctgcgccagcttgatgatcaattcggcaatcaaattaaaacattgatgtccaatccggtcaacatcgccgatgccgtagcggaagccgacctcctcatctgcgcggttctgatcccgggtgccaaagcgccgactttagtgacggaagagatggtcaaacagatgaaaccgggctctgtgattgttgacgtcgcaatcgatcaaggcggcatcgtcgagacggtggatcacatcacaacccacgacaatccgacctatgtcaaacacggagtcgtccattacgctgttgccaacatgcctggcgccgttccgcggacatctacagttgcgctgacgaatgtaacagttccgtatgcgcttgaaatcgcgaacaaaggcgcggaaaaagcgattcttgaaaaccctgcgctaaaagccggcgtcaacacagcaaacggccatattacttatgaagccgtagccagggacttaaactatggctacgttcccgcagagcttgcgatcgaaaattcgtcgtcagccgccggcgcatagcatcaaaaaaacagagcctcggaaaatatgcccgaagctctgtcttttttttatgattccgttttccggcgatcctgaatcaattttgccgcaattgcagaaacaggaaccgccccaaacaggacgattctccacagcgtccggtcagaggcatcgccgactgcggcaaacagtgccagaactgccgcagccgtcagcaataataaaacagcaaaagcctttttcttgaatgatgcaatgaaaagccaaaaacaggcgctcagcattaaaaatatgaacagctgtacgaaaaacatattcatcctccccgctaatcaaagctgtatctttcttctttccacggatttcccctaagatggtagccgtttttctcccaaaagcccggatggttttcctttgtaaactgaatgcccctcagccatttggcgcttttccaaaaatacaaatgcggcatcaccgctctgagcggaaagccgtgctccggcgtgagcggggcgccgttatgggaatgagccaaaagagacgaatccttcaaaaagtcttcgagcggaacattcgtcgtccagccttcctctgcatgcaagatgacaaatctggcttccggaagcggctttactctttcagcgatctcctttgtcttgatcccttcccaaacattatcgagcttggaccagcctgttacacaatgaatgtcattggacacttcgctttgcggcatctcatgaagatcatccaacgtcagcaggagcggctgttcgacaagtccgtaaatttgcaaattccattttgacaggtcttcgtattccggaacatgtcctgcatgaagaacaggaaaagatgttgtgacattttggtttggaggcaccctgtcggacttgtgcggttttgttttcccaaaaaacacgaaagaaccccctttgttaactcgaataaaaaagtggttgacaaactattttgtgatctcttacgataaagttgtgtgaatcactgaggaggaacaaagatcatgaataataaaaaacttcgcgccggcgatatggcgcttgtcggaatgtttgccgctctgatggggatcggcgctaatatcacttcgtttgccccgtttctgcaaatcggcggtattccgcttacgatgcagcctttcttctgtttgcttgccggacttttgctcggccgtaaattaggtgcgctgtccatgattgtctatgcgttagtcggctttattggcgctccggtattcgcttctttttcaggcggtatttccgttctttttaaaggaagcgcaggctttattctatcctatattcctgccgcatatgccgcgggctggatcacggacaaactatccgaaccgaaaacaggccactttttcgcagcctcattgatcggtacgctgatcatttatctgatcggcgtcaactatacgtatctcgctttttccacttggctcaatacaccgatgtcatattcagccgtttggaaaatgatggcctggttcttcgtgaaagacttggcattctccgttctgctcgccgcgctcgcctcaaaggttttccgggcggttcaaaaaggcgcaggcttcagaagaaatccgactttttaataaagagagcccgtggtgcggttctcattttattttaacaaacatagaaaaaaattcccctcgttttgaggggaatttttttaaagaacaatcgccgcgatccagccgaacaaaatcagcggaatattatagaagatgaatgtcggaacacaggtgtcccaaatgtggtggtgctgtccgtccgcatttaagccggatgtcggtccaagcgtgctgtcgctcgcaggtgaaccggcgtctccgagagctgcggccgtcccgataatggcgattgtcgccatcgggctgaagccaagctgcatgcaaagcggaacaaatatcgttgcgataatcggaatcgtcgcaaatgaggaaccgatccccattgtgatcaataagccgacaaccagcatcagcaatgcgccgagcacctgattattgctgatgaaacctgttgacgcttcaacaagcgctttgacatcgcccgttttttcaagcacattggcaaaaccggccgcggccagcatcacaaatccgataaacgccatcatgttcatgccgttagtgatcaattcgtccgcttcgccgcgcttcatcgctccgcttaaaaacaagaccgccaaaccgctgagcgcgccgaagatcattccgtcgacgtctaagctctgagacaaatagagctgtacgcttaatgatacagcgatggccaaaacggcaatcgaaaggcttttcttcgtataggacgccgacttttgaccggcgatttccttcatttcatatgtgcggggtttgcggtacacaaaagcagcaacggccaaaccggcaatcatcccgacaatcggaatgatcatggcgattggaatatcagccaatgtgacagaaaggcctgcatctttcatattgtctttcaaaatcccctggaaaatctggccgaagccgacgggaagcaaaatatacggagctgtcaatccgaatgtcatcgcacacgcaatcaggcggcggtccacttgcagctcattcaaaattttcaataacggcggaattaaaacaggaataaatgcgatatgaaccggaacgacattttgagacatacaagaaataattaaaatcacgaagacgatcagcgcttttgaaagggttttgcgccttgtatcgccttctttgccgatcagcttgacagcagcttcaaccatggcatccggaagacccgttttcgtcaaagcgactgcaaaagcgccaaggagcgcgtagctgactgcgacggttgcgttgcctccgagtccttccgtaaatacgctgaccgtctggccgagaccgagaccgcccgtcagaccgccggcaagagcgcccacaatcagggctagaacgacattgacccgcagcaggcttaatataagcatcacaataacagcaatcacaactgcattcatatttgaaacctccgaacaaacactttagtttgctaatgtagtagataattaaagtaatgaacgtatattaccacatgttttatgaatgcgtcaatgagacatctgcgttttttccataaaaaaatccccttctagcaaaggggatgaaagactacaaatttcccgaaaaccgctcgacaaacgtgacaagcgttctcaccatcacgcccgttccgcctttcggtccaaagcatgagttttgagctgtcgttgccgttccggcgatgtcaaggtgaacccatggcgtctgctcggcgaattcgccgaggaacgttccggccataatcgcatggccttccctgcccggtgaattgttaagatcggccatttggctgttttttactctttttttgtctttttcagtaatcggaagctgccaaatcgcttctcccgcttcttcagccgcctgtctcacctgctgataaagcggatcatgatttgtcatcgctcccgtcgtttccgttcccagagctacgacgacgcctccggtcagtgtcgcgacatcgatcagcacggaagctccgtggtgcttcgcatatgtcagtccgtcagcgagcgccagccttccttcggcgtccgtattcaagatctcaatcgtcttgccgctcaaggaaacgatgacgtcgtccggcttcattgcgcttcccgaaatcatgttatcagtcgacggaatcacggcaagcacgttttgttccggcctcaattcgccgatcgcttccatcgctcccaaaacgctggcggctccgcccatatcggacttcatgccgacaatcccgctctttgtcttaatcgaatagcctccggtatcaaacgtaatccctttgccgactaaaccgatgacgtcatcccatgtttcttttccttgatatttcaagacgatcattttcggcggctcttctgatccttggttgaccgcgaggagaccgcccatcccgagctcttccatttcagccttttcaagaatttcacattcaaattcgtatttcgccgccaattcagcggcatatgacgcgagatccgccgctgtcagcatgttccccggcatgttcacgagggttctcgccgaattcgtcgcatttccgtacacctgtccgacatgcagactcgcctgaatctccttcaggtcatggtctgtcaaaacatagacgctttgcagacattgatcaggcacatttgatctgtgcttgtaatcctgcacttcatagcatgacagcatgcacgattcagccaatgcatgtgcggcgtcagcagctgggacttcttcggatacgaagctgtcgagcatgacggttaactcctgctttcgatctttgtgaatcagctgaacagcttcggcaaagcactgcttcgcatcctcgaaggtaaattccgcttcacggcccaatccgacgatataaatgcgtttgactccctgaagcgaaggggtaaatattttagacactttcgcttttttggaagatacatccccgtctttcagcagctgagaaagctggccgttcaaaaggcggtcgatttcttcagccttaccgtacagccggctttttttaaacagtccgattaaaagcgtttcttttttttcgaaatctttaaaggcataaaacatgcgttcacagctccttatcagcaaagtgagtaaaattaaaacaacaatgttataataggaaaaacattttttcccgatggggtttcatatcatatattttagcaaataactgcgtgcttttctgaattcatctctattttctttatagaaaggatgttctgcaaaatggaaatcctcacaaactttcctttgctggcgagctttgccgcgatctttttcgctcagtttatcaaggttcccatttactttgtcgtctcaaaaaaatgggattggcggcttgtcacaagcacgggcggaatgccgagttcacactcagcggccgtcacggcgctctcgaccggtgtagctcttgatcacgggatggattcttctttgttcgccgtttccgcaatatttgccgttattacgatgtttgatgcaaccggagtgagaagacatgccggagaacaagcaacagtgatcaaccggcttgtccgcgattttaaccgctttgtcaacgaagcgaaggatttccctaaaagccatcaggaagaaaaacagaaaaagctgaaggaactgctcggccatcagccgattgaagtgtttttcggcggcctgaccggcattgcactgacgctgcttctcgattatttattgatgtaaagcaaaaaaacgtttaagacgccaggtcttaaacgttttttcttattctttcgccattttatatttttgtctgaatacttgcatcgatttattttcattcagcttcaggagatcctcttcggtaatggtgccgtttccttttttaatgacataaacatcaagtgtttttttgccccattctttataaacatcctcaaccgtctcatagtacaaatcgagccggtttcccttaatggctgatccggtatccgcaacaaccccatagccgtagtccgggatgaacaatatggtgccgatcggaaagaccgacgggtcggctgcaacggttgaatataaatctctttttactttgactcccgaatatgtaatcccgtaatcgggatgatgaggctgttttcccgttgattcagcccctgctgtatatccggtcgcggtgactttttgcttcggatacttgctccagtcaaacgcgtcttcaagcgatttcggtttgtttttaatttgttctgcggcagacagagacgtcttttccgctttttcttcgggaagtgatttaaaggtgagcatcagctgtttcaaggacagatcgcgttcttttgcccagctggatatatcctgtgcctccacgcctgaaacggcaaagaaggtcgtcataaaagcaaggacaaacaaaactgtcatcaagaaacgccggaacatagtcatcacttttctcaattcttccactcctctcaccatctagttgtttccaagtggaaaaagaaatattcagatggcgaaaaagttttgagaaaagtgaaaaaattaaccgcaaaaaaaccctctcccttgaagaagaaggcttaaaacatttgatatcccctttttcgcagcgctttgatcgtaacgcccgacaacagggctccggccattccgctggctaaaatgatgatatcggcagcagccaaagaagccactctgtcaaaaaggccggaaaatgcctctcccggcgcctctacatagcgaatcagcttttctttattcacaatgaaaaggcatacaattggataaatgacagccatgatccatgacattctgagcagcatattcagcagaaaaccgatgccgaaaaacaggacgaaaaataagacaactgaaatgatgacaactggtaaactaatcaaagcctccacccccaattcacctcttttagtgtacattggggaaggaacttgagtcaatcattggaaagctgtgatcaacggtcttttcctgttcccttgcagttgctgcacgtttccgaaccgccgagcagaagctgaaaatagccttttcctgaacagaatgtacaggtagattcaagtcgatgggttgacgttgtcttcatcggatacacacctttttcttaattttctgataatatatcatgaacgttgtcaataataaagtcagaaaatataacagatcatttgatgtaagcgcttaaaagcgaagctttctttctttttctttcgtttttgaagtttttagcctgaaataaaaagcctgcagaggaagctgcaggcttcagcgtgtcgacaaaccctcgttgtcagacctgctaagtcggtgctcatgaatagaggaaggatcggcggctaaccgcccaggcatcctgcctgaacgccgccgtcatcaccttctgtgaaagtctgatcagaaaaatttaaacttgccttttttcagaacaagtcccggcccgccgatcatgaaaagcgagcggttgtcgatgatttttttcatcatggacgccgtcgttcccgtcatctttctgccgaatgcgacgccgattgcatcgtgttcgccgagagaagcgacagagcctttgttatcaaatgagaacgtttccgtttctttgccgtgaatcagtgcggccagattgtttgcgcacgtttcgccttgctgcatggaaatctgcgcagtcggcggataaggcctttcggtttcttcatttatgattaaagagcagtctccgataacaaatatatcatcatggccttcaacgcgcaggtcaggtttaaccttcacacggccgcgcatgttttcaaagccggattcctcaatgatcgggttgccgcggacgcctgcggcccatacgacagtgcctgctttgatttcttcggtctgatcgtcttttccgacgatgattccgtcaggcgtgcattctttcacggccgtgccgattttgaattcaacgccttttccttcgaggtagttgaccgcataatcgacaagctccggttcaaagcccgggagaacagacggcgcggcttccacgcaaattaaacgaacctgctggcggtcgatatcgtattcgcggcacagctcaggaatgcggttggccatttcacctaaaaattcaatgcctgtaaaaccagctcccccgacaacgatcgtcaggcgttccgggcgcttctcggcttctgtgttatacgtcgcgaactgatattcaatgtgctcgcgaagctggcgggacgaattgatgtttgaaatagagaaagcatgctctttcaatcccgaaattccgaaagtttcagggacggagccgagcgccacgacaagatagtcgtaactaagctctcctgtttcaaggacgactttctttccttctttatcgattttctttaccgtatcctgaacgaaattgacacgggatgtattgatgacgtctttaatctgatagcggcatctgtcatgatgaagcgtacctgcgctcgcctcgtgcatccaggtcgtctcataatggtaattgtgcttgttgacaagcgtaatattcgcttcattgatgccgatttttttaacaagtctcgtaacggtcattaatccaccataacctgcacctaatactactacttttggcttattcaacggaatcacatccaccttttctgtattttactgctaagccggattaaaaatagcctttgggttatcttctgccggcttcaggctttttatgaaaaaaagtttgtgaaacccttcactttagtttgccgaacaacggaatgtttttcggctgtgcgacgaaaaatattcacgaatcgttaacaatttgttcacaactacatcatagccgcttgcaattgctttttcaaggttaaatatgctctgacggtattattttccgcgcctaaaaaaacagacgcgctcgtatttattttatgtgatatgatataattaagaacaattttcatttagggggcattattttcatgcgtgaagacacaaaagtatatgatatcacaattatcgggggcggccctgtcggcttgtttaccgcattttacggcggaatgcggcaagcgagcgtcaaaattattgaaagcctgccgcaactcggcggtcagctgtccgctttgtatcccgaaaaatacatatacgatgtagccgggttccctaaaatccgcgctcaggagctggtcgacaatttaaaagagcaaatggcgaaattcgatcagaccgtttgtttggaacaagccgtcgaaagcgttgaaaaacaagcagacggtattttcaaactcgtcaccaacaaagaaatccactattctaaaacggtgattattacagccggaaacggagcattccagccgagaaagctcgagcttgaatctgcggcacaattcgagaatgcaaaccttcattactttatagatgatctgaatcaatttgcgggcaagcgcgttgcggtattgggcggcggcgactccgccgtcgactgggcgctcatgctggaaccgatcgcaaaagaggtgtcaattattcatcgccgcgataaattccgcgcacacgagcacagcgtcgaaaacttgcgcaattctaaagtcaatgtattgacaccgtttgttccgaccgagctgatcggcagcgagcgaatcgaacagatcgtcattgaggaagtgaaaggcgagagaaaagaaatcatcgatgtcgacgatgtgatcgtcaacttcggttttgtttcatctctcggaccaatcaaaaactgggggcttgaaatcgagaaaaattcgatcgtcgtcaagtccacaatggaaacgaacatcgagggattctatgcagccggcgatatctgcacatatgaagggaaagtcaagctgattgcgagcggatttggtgaagcgccgaccgctgtcaacaatgcaaaagcttatatggatcctaaagcgcgtgtgcagccgctgcactctacaagcatgtttgaaaacaaataaaaatgaaaaggagcctgacaccggctccttttcattatatgatattcaaatatgagaagatcgttcccaatatcagcacaattgttaagatgccgacgactcccgccgcagtcaagacaatccggtccgtaattttctgtgattttggaagcggtttttcgcatccgcatgcctcgcagacttttgaatcgtacggcgtaagcccgccgcagcttctgcagttgattttttccatggttgaaccccttttctttactgggcttggacactaaataaacctgtccagtatagaataacaaattgacgaatagaatgtcttaagattcacaaaatattcttaaatgaactccaaaaaacccttgttaggaagtgacgatatgtcttactacaacaatcgcaatcaagagcctctgccaaaggaagatatcagtacgtgggaatgtacggctgaggactgcaacggatggatgagaaaaaatttcacgagcagcgaccgccctttatgccctctgtgcaacaaggaaatgataagcggaagccgctatatcacctctatcaccaacaacacgagcaatctgaatcgcatctttaaccagaaataaacacggttgtgttccggaagcccattgcaaaaaccttgctcaacactttgagcggggtggctgcattgctcctcttcgcgaagaagcagaaaaactatgctaaatctttcaccaatagaatctcatcccgaatcggaatgccgttatcagcgacaaagggaatttccggctttacttttcttgctttgtcaactgcgtttacatacaactcggccaaagtatagcccctcttttgataaaacataagcgcccgcatattatcgttcgtcgtgatcagtttaatcgatttacactgttttcgctttgaaacacgctccacttcttgtaaaaggagtgagccgatccctttgttttcgacaacactgtccaaagagacgacttcacattcgtttccagcgatgaagtacgtaatcaagcctttaatgtcgcttttttcatctgttacagcgaatccttccaattcatcgcagcggaatgttccgtgtgaattgaccatttccggacttccccaatgtgtatgaaaaaacgcggtaacgtccgcttttgacaaggcgtgcgttgatacgagtttcatttctttttcccccagaccataataaaacgccttttcatcacgatgaagcatcgagatgaaaggcgtttttttcattgcatatcgttgaccttatgtcagcactcttcaggcttccccgcattcgctgcggttctgaatgatgatccgcagccgcatgaagcgatggcgtttggattatcgatggtgaagcctccgcccatcatcgattgtttaaaatcaatgaccgtaccgttcatgatatccagactttcttggtctacaagcactgtgattccatgctggacgaattcattgtcgtcttcgtttttttcatgttcaaaacccatgccgtatgacaggccgctgcatccgccgccttttactccgattctcaaaaatgcgttctcctcttcatgctctttcatcatatccttgatatgaagagcagccgcttccgtaaccgtgaccgttttttcgctcatgagattacacctcctaaaagctcatgtgtacctttattataaagtcgcacgtccgatttctcaaacagaccgacttatgatataaaaaactcgccttcacataccgtttcagcgggtcccgtcatcatgacgcgtccgtcgtttttccaattaatgatcaaatcgccgccggcgagatggacggtaatgtccgtgtcccgtttggaatagccgttgagcaccgaactcactgcggctgcgcaggcgcctgttccgcaagcctgggtaattcctgatcccctttcccatacgcggaaatggagttcattttcgttttcaacttcaacaaattctacattaaccccttccggaaacctttcatctttttcaatgagcggtcccatcgtcgtcagcggggctttttcaatatcgtctaaataaaagacgatgtggggattgcccatggatacagcggtacccttcatttcacggccgccgaatatcatcttttcattgatcgtctctgaaccctgttcaccccgcatcggcatatctgatttgagaagtcgcggttcgcccatatcgaccgtagccgatacaacttttccttcatccacctcaacctgagcctttaccaagcctgaaagggtttcaattaaaaaggacgtttcctctaccagtttatgttcatacgcgtattttgcaacgcagcgcaaaccgtttccgcagtttttgccttcagatccgtcgctgttgaaaatccgcattttaaccggcgctcgatctgaaggacagatgagaatcattccgtctgaaccgattccggtgtaaacggaagacactttgacggccaaatccgacaacagctcctcagggagatgttcttcaaactgattgacgtatatatagctgtttcctaagccgtgcattttagtaaaacgaaaagaattcatagccgcctccacatttttttctttcttctagtataaaagctgaaagggatggatacaatatggctatcccccgtttttcatacataaaagctccctgcattcatttgcagggagcttttatcatgttatccgataaacattccggcgatcgccgcgcttaaaaggttggccaatgttccggccgcaacggctttcaagccgagacgggcgatatcggaacggcggttcggcgccattcctccaagtcctccaagcaaaatcgccacagaagacaagtttgcgaaaccgcacagcgcaaagctgataatcgaagctgttttgacggaaagctgatcaaacatcggagcaaaattggaataagcgacaaattcgttcagaacgagcttttgaccgataaagcttccggcctggaccgcttcatcccatggcacgccgatgacaaaggcgagcggggcaaatacatagccgagaatatattcgagtgaaaggtctttaaagccgaaccatccgccgactcctccaagaattccgtttaaaacggcaatcaaagcaacaaaagcaagcagcatcgcgccgacattcaacgcaagagagagacccgttgatgccccttttgccgcggcatcgatgacatttgctgcgtcttcgtcttcagccatttgaatatctttttcttcaattttcggtttttccgtttcgggaatgagcatttttgccataatcaagcccgcaggtgcggccataaagctcgctgcaagcaaatattcgagaggaaccccgagaagggcgtaaccgaacaaaacagaaccggccactgaagcgagtccgcctgtcataacggcaaacagctctgactttgttaagtttgcgataaacggcttaattacaagcggcgcctcagtttgcccgacaaagatattggcagctgcagaaagagattccgttttgcttgttccgagcagttttgccaatccgccgccgatgaagcggatgatcacttgcatgattcttaaatggtaaagaactgcaatcagagatgaaaagaagatgataacaggaagaacgcttaaagcaaaggcagcactgtcgcctacttgtaagagaggcccgaagagaaagctgatgccttcattcgcataattgacgagatgctgaacggcttttgtaaaccaaagaaacgcttccctccccgtttcccatttgagaacgatgaatccgaacaggagctggatcgccaaaccgattaaaatcgttcttatgttaattttgctcttatgctcggaaagcaggaaagcaatcgcgaaaatcgccagaataccaagaagtccccataaaatgttcatgaccacacctcttattattatttaaacttttattaagatatcaattaatgattggcctgtccacaaaaattttcacgaattttttctctttttatgtaaaccctttcatttaaaggctttgcatgaaaaaacgagatcaccaagatgaccccgtttttaaatgagttcattttcatcaatgaacttgtatatattttcgaccaattcagccggattattcgctgtcaccatttctccgtttacaagagcatacatcgtctgcatgcattgtccgcagtaactcaggcagccgtattcaacgacatccaaattcggatctttctccaatatttcctttgcctcctgagaaccttgggcaagattgctgacgcaaaactcaacgattggaaacaccttatttcacctcacatcgcctttttatcgtaccctaaatgcgtttcattagtcaaagtttaaggctggagaataaagcttttgtaacatattaatactttaaagagttttactaattatcgattctaggcgttagtgtaggttattttcccgagaaatattgtgattttacatcaaattagatataattctagagggtatttacatagttttttatttttgcagtgtaaaaggtgagtttcttaatctgaggggaaaaggggaattaccaatgagaaatttagtcttgctcggcggcggatacgggaatatgcgcatcattcatcgtttgctgcctaatcagctgccagatgatgtgatgatcactttaatcgacagaaacccttaccattgtttaaaaacggagtactacgcactggctgcggggacgatttccgatcatcatatcagagtgtccttcccggatcacccgaagttaaagattgaatacgggacgatttcgtctgttgatttggaaggaaaaaaggttttgtttcatgacagggagccggtatcctatgatgacgccgtcatcggactcggctgtgaagataaatatcacaacgttcccggggcgcctgaacatacctacagcattcagacaatcgatcaatcacgcagcacgtaccaggcgctcaacaacttaaatgcggaagccaccgttgcgatcgtcggggcaggactgagcggcgttgagcttgcgagcgagctgagggaaagccgaaaagatttgaacatcatcctttttgaccggggagaattaattttgtcgagcttcccgaagcgtttgagcaaatatgtgcaaagctggtttgaagagcacggcgtcaagattatcaactgcgccaatattacaaaggtggaagaaggcatcgtctacaatcatgacgacccgatccaagccgacgccatcgtctggacagcggggatacagccgaatcaaatcgttcgggatctcgatgtggaaaaagatccgcaagggcgcgtcgtcctgacgccgcaccataacctgccgggagacgaacacgtttatgttgtcggcgactgtgcaagcctgcctcacgcgccgagcgcacagctggccgaagcccaggcggaacaaatcgtccaagtgcttgaactgcgctggaaaggcgaacctcttcctgaaacaatgccgaaattcaagctgaaaggcgtcctcgggtcgctcggcaaaaaagccggtttcggtttagttgctgaacggccgttgatcggcagagtgcctcgcctgctgaaatccggcttgctttggatgtataagcatcataacgggtaggtttgccgcgtacatgcgcgaaaccttggagttttagataaacagcgtttttctttcggggcgctctctcgccttcatgagaggatgccccttatttttgcgcttttttatttccgccaaaaagtcgagcagtccgccttatccgcaatattaaactcgatcattttctcaagcaatgaaaaatccaccggacgatcccagcggaaacggacaagctgcttcgtatgatcatagccggcctgcacaatttcctcagaaaaacgatcgatcccagcgctttcaggggcgacagccaaatgatttttcgcgacgctaaagccgataataaatgtgccgtgatcagtaaacatcggctgattccaagcgattttcggcgttaaatttggaaatgtctccgctacccaacccaatacttcttccatccgggcacgatgttccggatgatcaattcccgctaaatattcttcaaagacttccatgctgctccctcctaaaaatgattacatgctaaattgcgctgttcagtatagaatttcccctgcaatctgtctattggcatgcctcacattggcgttaagaccattataaggatttatagaatgacaagcactataaatcgggcagatttttcaataggattcgaccaaaagccggtgagcgccattcctgtcatgtgtttcatatttttaatcttcgcaagcgatttgcagggacgccggttatatttgctttcataaaaaaagcgccgctggcggcgcttttcgaagagagcttgtccggtgacaagcagggttatgcggtgttttgtcaggcggctggcgaatttccgtcaaagctgtcgagaaagatcgctctgcccgccatcagctgagccggcttatcgtcaagaaaaatggctcggccggcaaactcggcatctcccttcggctgagacgaaaaacttaaaacgacaaggcttgcaaagacggcagtcaacgcaacggcaatcatctttttcactttaactcctccgttcttttaagaatttggtctcttgcatgatgagattcttcaaaatattcggcagctttgtctgcatctccattttctttatagtaaagtgcgatatcaaatgttaattccgctacatccgtccagagattgatcgttttaagatattctaaagcatgttcaaccgtaagtggatcctgttcatcatacagagcatgaataagtttaaatttcgacaaatattccctttctcctgctttttccgcacggaaaaatcctttttcatacaatttgcgtgcttctttgacaacatttgatttgtacagcacatgtgtcagttcaaacatggaatggatgccgtaaaccgattcttcatgctctttgataagcagcgcttctttgaaatgatgttcagccaatgtgaggaggttgcgattgacatagctcaaccctaagttgtggtgagccatgccgaggaggacatgatgtttgatcagtgccgcgtctttaagggcttgcttgtaatgctgttcggcttcatcaaaacgaaataaatcgagtttatttgccccgatcagcatatcgttgctgatcgctttttgaatgtaatcatcatgtgctttgaaggtttttagagctgttttcgcatggtttaaggaaaggaaattttgtttgatttgatagtaggcgatagccagtttgtaatggaattcggcgatttcgatttgatcggggattgtcctgagcttttcctcggctaatttataataattgattgcatttgtataatccttcttatgaaattcgtacatgccagcgaaaaagaaataataatattcaatcatgtcatctgtgctttgcatatcggctttttgctcctgaatatcctcgaacagtttgttggaagcggcaaactcttctgtcagcagcttgtgccgatagtctaaaagattaaaataaagaagcagatcttgattttcttccatattcggcagctggtgctcaatgtcgcatttaatcgagaccgcttgtgatacttcgtgacgcttgatcatgacataccattgattaagcattcccgcaacttcctcatacgcaatttttgtcttcaatcgtttatccttcctttcttcccatgtcatttcctttttatgggttgtttttcattttacagaatcgcttattttttgacaatcacttttctaaatattggcataatttcctaagataactcaaaattctgacattaatcgtaacaatcttctttatttgtgcaaatctctcaggaagtattttcgtttgacatcttttttgacggcattttataattatatatgtaaatatcaacatgtttcgatttacaataaacaaataaaggagcggttcatatgaatcaagatgtaaaagagtttgtaggaagccatatgatctatacgtatgaaaacggatgggaatatgaaatctacattaaaaatgaccataccatcgattaccgcattcacagcggaatggttgggggacgctgggttcgcgatcaaaaagccgatatcgtcaagctgactgaaggcgtctataaagtatcctggacagaaccgacagggactgacgtttccttgaacttcatgccgaatgaaaagcggatgcacggcatcatcttcttccctaaatgggttcatgaacgccctgatattacagtctgctatcaaaatgaccatatcgacttaatggaggaatcgcgcgaaaaatatgagacgtatccaaaatatgtcgtaccggaattcgccgatatcacatttattgaaaatgccggaatcgataatgaagatctgatttcaaaagccccttatcccggaatgacggatgacatcagggcaggaaagcgggtataaaagggaaagttaatgatataatgactggacttttgttaagtcatccagcagcgcttttatatcatcttgcgacaaaggtacaagcatttggtcgtagagggtgatgatctgtccgtcctcatcgtgctcatgctgccttaaatagtgctgtaaagccttgagctggttttctttcagactggtctgcgtttgaaactgcttgattttctttaatgaaaaaacattcatttcgtcatcaaaatcgcctgacatgatttgtccttcaatgcttgacatgcttgctgtccctcctaattgatctggctgatagttagtctgtccggtttaagaaaggtgcaatcataaaaaataaaacagcaaggggcatgtctgccccttgctgtttatcatgcaggcttatatccttgcttttccatttctttatacacgtctttcagcttcggatttccttcgccgaccacttgatcaccgaccatgacgagcggataaaaatattcgtcgttcaggattttttcggagatttcctgtttttcagggtcgttttccggcggctgatggatatcaatgtacgtgattgagaaaggctggtcgggatattttcttttcagggcggcttctagccactcatacgtttcttttgatgacggaaggttcacacagcttggacaaagaacgtcggcaccgtaaacaaaaagctcggcttgttttttcatcagcggcagctcctttctctttatctttattttattctattttgtccatctgctccatattgaaatgaaaatcgttttttgtctttgccggcaaatatgatataatatgtgggaaaacgattgaaaccaaacaatagctttttattgttcgactgaatataatggttgtatgatttgaaaggagcgatacgaatgacgacagaggtcgaaatgaaagaacaagtacaggaagtgctggacaaacttcgtccgtttttactccgtgacggcggtgactgtgaactcgtcgatgttgaagacggcatcgtcaagcttcgcctgctcggcgcatgcggaagctgcccaagttccaccatcacccttaaagctggaattgagcgcgcccttttagaagaagttccgggcgtcattgaagtagagcaagtattttaatttgagaaggctgccgtaacggcagcctaaattgttgacaaaatcctaaaacggttttcagtttaggattttgtcatcctctcagcgtgattgaaaacccttgcagtctaggaaggtcgagcatcggagcggagcgaatgttggaattcgtgagcaccgacgcgcagccctgacaacgaatgcgagggtttgtcgacacgctgaggctgccgtagtgtacggcagccttttcttttttatagataagcttcaaaccagcctgcaatatactcaagccgcctgatccgctgcttcggatgcccgcttcttgataaatcgtgtgacgcgttcggaaatctgacgagttttacttctttccccatttttttcagcgccgtgaacagctgttccgcctgttcaatcgggcacctgtcgtcccgttcgccatgcagaatgagaagaggggtctccaccttgtccgcgtatttgagcggcgaatgctcccacagtttgcctggatcttcaaaaaggtctgcaccgagctgccagtctgtgaaaaaatagccgatgtcgcttaccccgtaaaaactgatccagttggaaatggacctctgtgtcactgcggccttgaagcgcttcgtgtggccgacagcccagtttgtcataaagcccccgtagcttcctccggtgatgccgagcctttcttgatcgacgaaatcataatgttcaagcacgtggtcaacagccgccattacatccttaaaatctccaccgccgtagtcgcccctcacccggttgacaaaatcctgtccgtagccgtggcttccccgcgggttaacatatacgacggcgcttccctttgcggccagcacttgaaattcatgaaaataagcattcgcatacatggcgtgaggtccgccgtgcacttccagaatgagcggatacgtgtttcctttttcatattgggcgggctttatcagccatccgtgaattgtcagaccgtccgctgcctgaaattgaagctcctccggttccgatatgatatgttcttccgtaaacgcttggttggcatctgttagtcgctccgctttttcttcacccaattggagatggtaaagttcgctcggccggacgggcagggctatggatgccgcaaagccactttcgtccggatgcaggctgaatccgttcacatgctctttttccaaccggaccggataagcaagaccttcgattgatatgtagtaaatgcctgtagaaccctggtcagatccgatgacataaaagccgtttccgtctttggtccaggccggtttcggaagaacgcctccgacaaggctgtctcctgccaccgcatcgctgagatggacgtcaagcatttccgtcagacacgttagttttcctgtttcaatatcatacagccatgctttatcgagcgtggcgttttgatattctttctcgtttccgataaatgcaaggtgtttgccgtcaggagaaaacgatagtgaagaaaaaatgccgttttgacctgtgaggcgcttcaaatcacctgtcgaaaggttcatcaagtagacatcgttcacacgcatatccgtttgattggcgcaaaatgcaatctgatctccgcacggtgaaaatgcatggctgaaatggtcgcgttcaagatcggtcagctgtttcatttccccggtttccacttgaacgaggacaagctgcgtatactttccccttttaaacccttggccgtctgctttatatgacaaagaatcgacttccagcggttcgtggtcttcaatctcggttttcttctcatcgtcgacgctttcctcttttgtcagcttcactgaacaaagcaatgacttgccgtccggcgaccattcaggctgtgatacatcatagggaatatcggtcacttttctcgcttctcccccggcggcgcttatcacgtaaatttgtgcggtttcctcgcgattggacgtaaatgcaaggtatttgccgtccggcgaccagcggggatgctggtttctgcctttcccaaacgtccattgcaccgaagcttgtttttcgcggtcgtagatcatgatatgcgaatcatatgagtcctgtttttcgtttacttttgtttggacgtaggcgatttttgcaccatcgggcgaatactggggatcggtaatggatacaagcttgatgaggtctttttcggttatcagctgcttcatgtcgtttctcctcctcatgtctgtttgccatactacttcgacttcctaaataaaaatccttgttttgaaggcaaacaaaaaaagagccgaaaaagctcttttttcgttaaacactgtttactgattttctttcaacgataatgcctgtatccgggacataaaggcagtcgacctcacagtgcggaaacttggacgcaagctggtttctcagcgcctctccttttcctttttcaataaaggaaaggatcgtcgggccggctccgcttaaagccgtcccgaacgcgccgttttggcctgcttcatgctccactttcgaaagctcagggacgagcgcccttcggtatggctggtgaaagaggtctttttgcatcatgcggccgacaagcttccaatctttcgccatcagtccggcgacgagcatattgctgaccgcgcttgcttccacggctttcggataagagaggctttcgggaagaacatcccgcgcatcttttgtcagcacttcataaaaaggaatgacgacgacgacatccaaatcgatgtctttcatagaaaccatctctgtttcatcttcctcatgaagtccgatgacaagcccgccgaaaagcgatgctccggcattgtcaggatggccttcttcaaggctcgcaaaatgaagtttctcgcggtctgaaagcttcaaatcggcaagttcgttcgccagctcaaccgcagcggcaattgcggctgcgctgctgccgagaccgcgcgcaagcggaatatcgctccacactttgacaaggcttggcggaagttcttttccgaagtgtgcggcggtccgtttggccacctggtaaattaaattgtccgttccttcaggtattcccgctacgacttctgtttcagcttcaaaacgccactcatcatgaggaaaaacagacagtcttaaatagcgggacagcgccatgccgactgaatcaaagcccgggccaagattggccgtgcttccgggaaccgtaacggaaaacagcatgtcagcctcagtcatacacgagcggctccttttaagtgttcgagaatagcttcttcgtctgtcggcagtgtgacaggtttgatctgcgacacatcaacggctgtgttcggatctttcaggccgtttccggttaagacggcaaccactttcgcacccggctgaatctctttcgtttgcagctgtttcagcacgcccgcaatggatgcgcatgatcccggttctgcaaatacgccttcttctcttgccaggagctgataagcgtggagaatctcctcgtctgacactgcatcgattttaccgttcgattcttttgcagcgttgaccgctttatcccagctagccggatttccgattctgatcgctgtcgcaacggtttccggcttttcaattactttgtttttgacaatcggggccgcgccttccgcctgaaaacccttcatgaccggcaggcctgtgccgtttttctcatgatactctttaaagcctttccagtaagccgttatattaccggcatttccgacaggaatcgctaggatatcaggcgcttcgcccagctgttcacaaatttcaaaggaagcggttttctgtccttcaatccggtatggattcacagagttgaccagcgcaatcggctctttctcgcaaatgctgcgcaccattttcagggcatcgtcgaagtttccgtcgatcgcaatgatttctgcgccgtacatgacggcttgggccaattttccgaaggcgattttgccgtctggaataatgacgatgcacttcatgttggcgcgggccgcataagccgccgcagcagccgacgtattgccggtcgaagcgcacatgatcgtgtcattgccttcttctttcgccttggcgaccgccatgaccatcccgcggtctttaaaggagcctgtagggttgacaccctccgtcttgacataaagctcgattccgagctttttcgaaaggttttgcagataaataagcggggtatttccctcgttcagcgtcaattccggtgttttgtccgttactggcaaatattctttatattgatggatgagtcctttccacattagctccaaccgttcccttctactcgataagtgcttttcacctgatgaacaacctcaagatcgttcagcttttgcaggatatccgtaaaatcctcttctgacgtatgatgtgtcacaatgacaatctcagccaggtcgtcatggcctttaatcggaagctgaaggatcttttcaaagctgacgcctctttctgaaaaaatcgatgtgattttcgaaaacgaaccaacctggtctttgacatgaattcttaaaaactgctgggcaaagatttcagacggcgcctttatcttcttttcaaactgcggatcgacaaagctgctgccgttcacgccaagacgcatgtttttcatgacggagaccaaatctgacacgacggcggttgcagtcggcatgcttccggcgccaggtccgtaaaacatcgtttcccctacggcttcgccgtatacgtaaaccgcattgaattcattatggacggaagacagcggatgatgctccggcagcaatgtcggctggacgctcacttcgactttttgtccgtcgcgctgagcgatgccgatcagcttcatcgtatagccgagccgtttgctgaaattgatgtcttcatcagacacttgggaaatgcctttcactttgacatcgtcaaggtcgacattcattgagaaaccgagcctggccaaaatcgccatctttctcgcggcatcaagaccttcaacatcagctgtcgggtctgcttctgcgaagccgagctcctgcgcttctttcagcacctcgtcataaggcgcgttttctttgttcatcttcgttaaaataaagttggtcgttccattgacgatgcccatcatcttcgtaatccggtctgaagccagcccgtcttcaaggcttcgcaaaatcggaattccgccggcgacgctcgcttcaaaataaaggtcgcagccgttttctttcgcggcagccgtcagttccgatccatagagggcgatcaaatctttattcgctgtcacgacgtgtttcttcgcctgaagcgcgtcaagcaaatagcgtctcgtctcctcgatccccccgatgacctcgataatgacatctacttctggatcttgaatgacatcataggcttcagtcgtcagaacgtctttggaaagctcgacatccctcttcttatctttatcttttacaagaactttttgaatcgtaacagggcatccgacttggtgtgtcagcttatcctggtgatcctgaataatcttcaccacaccgctcccgactgttcctaatcctagcagccccactcgtatcgccttcaatgaaattccacctttctctctcttgtccgtcctctctgaaaggacatttgtaaacacaacgcagacatttaagttacaaacattataatgggggattctttttttgacaagatgacatttgctgaaaacaaaacgtgaaaacgctttagtcgttgatataataagattctatatattcagaaatatttttgtaagaaaatcttccgagccgctcagggcagccggaagaaacgtcaaatctcggtctttgcctgctttcctctcaggacaagcgcaatattttccgcacaaagcctcatcatggcttctctcgtttcgacggcggcgctgccgatgtgaggcagcgcggtgacttgcggcaggctgacgagcgggtgatccttttgcacaggttcttccgcaaagacgtcgagtcctgcgccggcaatatctttttcgaccagcgcttcatataaatcgtcttcattgacaacctgtcctcttgagacattgataaaaatagcggagcgcttcatctttttaaaagcgctgcggttaaacagatgcttcgtttcatgagtcagaggtgtcaggcagacaacaaaatccgcctgttcaagcagttcatcgaagggcagataggatgcgcccagttctgcttctgcatctggattgcgggtgcggttatgatataaaattttcatgccgaagcctttcgcacgccgggcgacggcttgtccgatgctccccatcccgacaatgccgatcgttttatgatggacatccgcaccggccaaaagcagaggaccccagcccgtccacttcccttgtctaatccagtcgctcgcttcgacgattctgcgggcggatgccatcagcagagcaaacgtcaaatctgccgttgactctgtcagcacgccaggcgtgttgcagcagatgacgcgatgcttttgcgcagcctccacatcgatgttgtcatagcctaccgccaagttggccacgacttttaaatgcggcgcgccttttaaaagctcctcatcaatcgtgtcggaaagcatcgtcaacagtccgtgcgccttttttgctttttctttcagaatggcgcgcggacacggttcttcttccttttcccacatttcaatatgggcttcttcttttaacgcagaaagctgttcttcaggtaattttctcgtcacatatacaaacggtttgtccatgctgcctcgttcctttctaagagtagcttccactctaagcatatcgaaaaaatccgaaaatgttaacagaagaaaagaacaccgcgaagctatggtgtccttttcagccaattgacaggcggcatgcttatcaatcctgcggatctcatgcccgccatttcttgaaagccgttcaggaattgctcatatgccggcgcctgagacaataaatagtcgagtctgctttcaaaataatggtgctctgattcaggagaaatatagtacccttcaagcgtctcaaaatagtggagcggaaacagcagcctgctgtacatcagccgcttagaaaatgaggatagcggcgcggcttgttcgtattgctgaagaaacaacatgatttcattgaagtttttcctttcgtgaaacaagcttctggcatattccgcaagatccctggccgcatgatcaaacacccattccatcgggattttaataagcggctcgcgccttaaagcctcgcaggtgagccgctgctggcaaatcgttcccgagtcagcggcctgcggctgatcatccaattcggtatctgccaaatattgaatcgcattttcggttaaaccgagataataaggaaacgattcgataaattgtttttcaaagggctgcagctgccttgcctgcgttttttgaatccagaattgttccagctggtcgagccgtttcccccaaagttctttccactgcccgatccgcgaggtttcttttacctcgtaagggtatccccttcccttgtgatgaaattcggcgagctccgcaccaaatgaaacggacctgtttgtcatgcggggagcagcttgaagaagcacatatgagacgccattctcctcaaacgtcatctccccgtcctttgtcaatataaaagatgaaacgtatgggtcgcgctgttcttgcaaatactgactcatactaaacaattccgccagctcatcctgactcaagtgggaaacagggacgatcaaaaacatcgaattcggggtatgaaaagcctgataagacaagtacgatgtaagatcgcgaatgtagattccgaatttttctttgatcagctccttcacggacatcacttcctgcaaaatttttctccttctacacatcgtaatcatgaagggattcgattatgaatcgatctggaaaaagagttctaaaatcgttacatttttaaagttgtttgtatacactaagtaaaaaaagattgggtgaaaatgatgccggaaaacaacagcatgcatcagatcgaaacagcagcaaaagaatggcttgagaaacggggcgtcaagatttcggaaattgccgatcttgtctacgtattgcagaagaaatatcatccaaacttaacaaaagaagaatgtgaagagaatgtcaaccgggtcatgaaaaaacgtgaagttcaaaacgccgtgatcacagggattcaattggatatgctgggcgagcaaagaaagctcatggaaccgctccaaaccttaatcgagacagatgaaagcctgtacggcgtcgatgaaatcttatccttctccattgtgaacttgtatggatcgattggttatacaaattatggatatattgataaaatcaaaccgggagtgctcgcacgtttaaacgataaatcaacaggcgaatgccacacgttcttggatgatatcgtcggagcgattgcggcagccgcatccagcagactggcgcatcgagcaaaagatgcggaataagccattaaaaaaacacttgtctttaaaagacaagtgttttttgcgttagacgcgatccagccattctgtcagtgaatcaatgacatatgtcggcttttcctgataggcttcaaggtgttcttttttggtcacgcccgtatgaacgagaagcgtgtccatcccggaattcattcccgccataatatccgtatcataattgtcaccgaccatcagcgtttcactgatgtctgtgccgagcaccttcatcgcctgctccatgatgatcggctccggcttgccgataaaaataggctctgtctgcgtagaaacagttaatactgacgtgagagaaccattgcctggcaagagtcctctttctgtaggaatggcgatatcgccgttagtcgagatgaatgtagcgccgttgcggatggcaagacaaccgacggctagcttttcgtatgtaatgccgcggtcgatgccgacgacgacaaagtcggcgtcttccccgccgaatgccagccctttttcctcaatggcctgacggatcccttcttcgccgatcacatatacggaagcatcgggtttttgttcggcgatgaaattggcggttgccatgctggttgtgaatacctggctctcttcggccggaatatcaaatgaaacaagcttgtccgccacttgcttcggcgtgcgcgacgagttgttcgtgacaaacagatacgggatgttccggtctttcagcttcctcacgaattcgcatgcttcttcgattttttccgtccctttgtacattgttccatcaagatcaattaagtatcctttgtatgttttcatgttgtacactccagttcgtttagtgcggtttgaatgcggataccggaccgagttcatggtttaaataatcgcggatccgcgccggaaatttctcgagcgtttccgcatgcctgctgagcagctcttccaattcttcatggttgacgttcaggtagtcttggaccaatgtcttccgataggcgatcaaatgtttcaaactgtcgccttccgcttggctgacaaccttttcatcggtcagtatatccataatgtcgtcatagcttcccggatctctcataataaagccgtcaatcatatcgttccctatatccaatatacattcgatcagcgtgtggccgattcgttcaagcgcttttttttcgacgtcggaagtccattcttcctgcatttgataaagccgcagctcctcttccaggaagttgagcgtgttttcgattttgtgtcgatcgacaaaatacatcatcagtgcatccccttttatgatcgcttattttcgcagacgttttaaaacaaagtaggcacatccgaaattgcagtactcgtaaatatattcatcaagcgtgctgatcttcgtatcaaatgtggccttttgattttgatcgtcaaaaaagcctttcagcctcagctggctgtatccccaatccccgacgatgtagtcgtatttatttaaaatgtcggagtatctggctttaaacgcttcttcgttaaaaccgtttttcacatctttgacgacttcaaatgcagcgttctgaacgacaatcattcttttcacctcttttatatgataattcaaacccgggccgccatcaattgctaagaataaatcctcccctttggaaaagctataaatgaggaggaaaagcagatgaataaaaaaattcttttagcagggctggtggcgctgcctttagcaggctgccagacggccttaaacgataccgaacacaatatatatgacgaagacggaaataccgttcacgttgcagacaagaaccctcaatatcaggaaaagttcagaaatgacaaccgaaaaggcagattcggatatgcgcgccatcaggcaacaccagtcgcaaacaaggaagaaatgcaggcgccccaaatcgaccgggaagaaatggcgcatattatatctagtttaacggttcagcttcccaatattcaagatgcgtcggcgcttgtgacagacgaagaggcgctagtcgtgtacaaaacggactccgggcagcgcaaacagacggctgatcaagtcaaaaagacggcggcatccgtcgttccgagatattaccatatctatatttccgatgatccggacatgatgcaatccgtcgctaatttcagccggcttggagccaattcaagaaacgtcgatcagctgatggccgatacaattaaggaaatgcaaaaatcgccgcaaggcaaaaccacgacaggtacagatgaaaacggaaacgaccttgacggaaaaggaaaggcgaccgaatcttgacctgaaaataagaaaaacgccagcgcatatggctggcgttttttcatccaatgttatgcctgcgcctggcgttttttagacgcttcattcacctgttcgtcggcatggtatgaagaacggacgagcggtcctgcttcacagtggctgaagcccttttccatggcgatttctttcagttcggcaaactcgtcaggatggtaatatttctgtactttaatgtgttttttggacggctgcagatactggccgattgccatgatgtcgacgttgttcgcaagaaggtcgtccattgtttcgatgatttcttcttttgtttcgccaagaccgatcatgatgctggatttcgtcgggatgtccggctgcatctctttggcgcggcgcaaaaattccaatgatctttcatatgtagctctcgcacggactctcggcgtcaggcggcggaccgtttcaatattatggtttaaaatgtccggacgcgtatccatcagcgttttcaaattattatagtctccgcccatatcggacggcagaacttcgattgttgtaaatgggctttttctccggacggcgcgtacggtttcggcgaatacccccgctcctccgtcttttaaatcgtcacgggcaacggctgtaatgaccgcgtgtttcaggttcatgatgctcacagaatctgcgactctttccggctcattcaagtcaagctctgtcggcagccccgtcttcaccgcacagaagcggcaggctctcgtacagacagatccgagaatcataaaggtcgcggtacgtctgacggcccagcattcgtggatgttcgggcattttgcctcttcgcagaccgtatggaggttgttttcccgcattaatttttttaagcccgtatagttttcattcgtgttcagcttgattttaagccattcgggctttcttaggtgctcgtctttctttgccaattccatcatctccattgtggatagtagtcatgttcaatacgaaatttgtgacatagcgccggatgagtccctctgctttggaaccgcttaaataaaaaatgctaaatcttcatctttagtcactttaacatagtacagatttgtgaacaagagcttgattagacaagatggaatttctaacattttcttattattgatttctgcagatgtcacaaactaaccgtattcaaactgaaaggagctaaggacactgtgaaagctgtattatccgttctcatcctccttttgctcatcttgcagccgtgcgctcttgcaaaggagaaaaaagagcccgatctgcaaaagagaatggccctttatcataagacagaagccgcaacccatattccttggtatgttttcgcggcagtcgaccaatacgaaatcaatatccgcaaaaaccgcaaagacttgccgaagcaaaaagggcacaccgggatatatattccgcaaagcgtgtggagcggacctgaaaaccccaatcctaaagatacatcgccgctcagcatcaaggtttttgacggaattggaatggacggaaacggagacggactcgcagaaccggatcaggatgaagacgtcctttatacgtttggacaatacttgttgacatacggaagggacattgaaaatatccgcatcggtctgtgggagttttacgaaagggatcagacggtcggcatcatatcaggctttatcaggctttttcaaaaatacggccacattgatttgggcaagcacgcctttccccttcccgtaagatcagattacagctatagaagcacatggggagatgcccgcggattcgggggcagacgcattcacgaagggacggatttgttcgcccattacggcctccccgtccggtcgacatgctacggcattgtggaaatgaaaggctggaaccgtttcggcggatggcggatcggaatcagagacatcaacaatacgtaccattatttcgctcatttgaacggtttcacaaaaggcttgaaagtgggagaaatcgtcgagcccggccaggtgatcggctcagttggagcgacgggatacgggccgccgggaacatcgggaaaattcccgccccaccttcactacggcatgtataaagacaatggaagaacagagtggtcttttgacccttatcctcatttaaaggcatgggaacggaaggaacttcgaaagaaaaaataaaagacatccctatttcaaaagaatagggatgtcttgcactttaagaggttagccggcctggcttttcttgcttttcacaaccgcattgataatgcttgcggccaatcctccccaaataatgacgatgccgatcaccatcattgctatagatgcgccgttcatgaggaaacctccttgtcatgttgaaatggcgtatatgccagcccattcttccattttgaaagcgaaaggataaatccggctgcgatcgctccaaaagcgacgcaccatccccatttcaggaggaattcaaccggcaggtcgccataggctgttgtgatattcgtcttgatattatcaaacatcatataccccagaacaatcggggtgacgacgctcaggcagattctccaccaagcgccgagctgaatgtcggaaaccgaattggcgtgagcctgcagagctttcagctctttcgcaaaccatgcaatcgcaacgacttcgatcaatccggcaagcgccactccgaaattgttgataaagtaatcggccgcatcgaggaagaacagtccgcctttcgtcgcaaatacgagcgaacacaatgcagcagcccctccgccgaacaggacggctttccgccgcggaacgttgaatttatcctgaatcgcggcaacatatgtttcagagatagaaatgagagatgtcagacctgccaaaacgagcgagccaaagaataaaaatccgaaaaacgcattaaacgccggaaactcattgatgatttgcgggaagacgacgaacgccaaaccgattcccgaagagacgacttctttgactggaacgccttgctgcgcagccataaagcccagcgcactgaataccccgattccggccagcagttcaaatgacgagttcccaaagccggtgataaacgcattgtttgtaatatcggattttttcggcaaatagctggaatacgtaatcatgatggcaaacgcaatcgacagactgaagaaaatttggccgtaggccgccacccacacttttccgtttgtaatctggctccaatcaggcgtgaaaaaggcattcagtccttgtgcagccccatcaagtgttatcgaataaatgacaatgataaaaaataagaccacaagcagcggaatgaaaatgcggttcgcgatttcgattccttttttgactccggcaaataaaatccccaatgaaacaatccatacaatcgcgagcggaatcaggacgcccggcacgaagccgccgaattggccgatggctcctcccccgatatcaattctgtttaaatatttattcattaggaaattttctgtatttttaccccaacctaaattgaatgaaaagacagtgtaagaaatggcccatgccacgataacggcataatacgtcgagatgacaaatgagatggcgacctgccaccagccgatccattccttccctttccccatcctggcataggacagcggggctgagcctctgtatttatgaccgattgtaaattccatgatgagaagaggaattcctgctgtcaagagcgcgaacaaatatggcagaaagaacgcgcctcccccgttttcataagctactgccgggaatctccaaatattccccaaaccgatcgcagaaccgacggctgctaaaataaaacccgctcttgttccccattgcggacgattatccataagcttcctcctttacctttttgaaacatctgaaaacagtgaattttctaataattattattgaatagtatatacagtctttttgcctaagtcaaagtatttttttaagaaaatagacgcatgtcatttctaggccgcgcgaaaaaaagcattctgcctgatgtttgcagaatgcctggaaatcattactctttttgttcctttttttgctctgttttttcatcctttgaagggatctgaatcgatggcgccgtttggctgccgttgccgctgtagaagtcgggtacttctccgtgcacagcttgaatcgttgccggaatcgtatttttgacaaccgccgtttttgtcgcaaacggtatgacgacacggaccttgacttcgacaagcacaccgacatttattaatgcattattaataccatatggctcgacactttgcttaaaatctgtaaagacatcccccacaacattaaaccgtacaggtattttcggccccaggtttccaagaagcgagtttcccgttgcctgacccagaggaatattatagattacaccatcattcttaccttcgggagttttcgcagaagaattaaattcttctgtttctgtttccttcagcttttcgtgaagttgtttcgtaattttcgaatgcataccactaagaccatgagagttgaaatcaattgttgttacttttccattttcattcgtcttcatttctactagatttttcacattttcatcttggctcatataatcctcgacggcttcctggatgacgtgggtcgcaatccggttcgtttccatttcagcgatgttcagaagggtcggtttgatggatgagttgataatcaacaggctgacggccgttgaaaaaataaaaaatataaacgaaagcagcatgacatatcgcaaaggcaaaggtcctctttttgacagagggccgcgaagtcttcgcaagcaaaatccccccttacatcacaagtgtatgcttgtaagaggggatatacgattcaatcagacaactttatttcaccatttttaaaagggcttcttttccgctcattccgggatgaatgccgagctctccggccgcatcggttacagattcgagcggggcttcgagaagctgatcgatcgtccgcacgccgacggctctggcggcgacgattttccgttcttttaatttatcattcagcagggcgacatcaagcgctccgcacataatatatccatggtcattggttaccgccataaagttcgttttcggcagtttgaccgttacagccgtaaacggctgatcttctatcatgatcggagttaaatttaccatcgctatccctcctttaccattaatgtatgataaagcgagagacatgttccggtttgccccgaatcttagagatctgtttaggaccggtttgcttttttcagcttccaggcgagcagatcgcgcaggaattcaggcataaagtagtcaatatcttccgcatcgcggataacaggaaacagcgttccgagtgtaaacatatcaatcgtggcgagcgtgtagaacgcatcatcttcaatgtccgctccgttgacggagagcttttccgggtcaaggccggcatacagcatcttccccatcacttcgccgcgaaaaccgagccctttaatgcgcagcttctcggtttgttctgatgatgcatggaggatgacctctttcagctctcgtcccgtcagcttcagtttgaccggattaatcggatgcggacagatgcggtgaacatcggctttcgtcaccggaccttgtgaaagagactccagcacaatgcctgagttgaccatcccgatttccgcctcacaccattcctttaaggcatctgccagcatttgcggaagggcgcttctgcggaaccaggcggtttcaagggtgttgtccaatgtcgcaatttcctcttcaaggagatgtccggcttctctctctttttccttcagaaaacgaatcgtctcctctgattcttcattccaatctgccgtcttcatgacggttgctgtgatgttctcaagcgctccgttatatgtcagttcaacatgaccgacatagttcccgtacttttccgcgcaggccagcataacgccgtctttcatcatcccttcttcaagcaggtgatgggtgtgggagccgaggatcaggtcgatttcgggaaaagcctccgcgacgcgctgatcgtccaaaatgccaaggtgtgaaagaaggatgacagtgtcggctttttctttgatttcacttagcatctctccgatgctttcaaatgcgtctgtaaccgtccagccaagctggcgatagatcggatagtacgggactgtcacaccgagaatggcaagagttgcgccgctcttcacctttttgagcaaatacggcgctgcccagccgggcctcttcccttctccgtcaaacaaattggagacaacgacaggaaactgagcgttgtcataaagtgtatccaactcctgatgcggcagtgtaattccttcattgttcccgatcgttgcagcatcatactgcagacggttcaacagctccacattcgcttttccgaaggtagcctcagatatcggatggaatctgtcgacatgatcgccgaggtcgaacaaaagcacttcttccccctgctcttcatgtttctgtctttgtgtctgaatgtaatcgacgattttcggccagttttcaaaatggctgtgcaaatcgttcgtatggtagatatggagcttttccgtcatgcaaatctctccctaacgtttaactaaacacgccttgatagattaatctgattccgatgagaatcaatacgaaccgcatgatcaatacgatcgtctttgtctgcatctttttgttaatgtaggcgccgagctgtccgccaaaccaggcgcccgggatcaatgcaagcgcataaagccagttgacatgtcccgagatgacatggccggcagagcccgcgacagatgaaaggaaaatgataaacatcgatgtcgcaacggcgacccttgtcggaaataaaaacagaagaatcatcgccggcaccatcagcgagccgcctccgatgccgaaaagcccgccgagaaagcccacaaaaaaggcgatcgcgattccggctaaaggatggtatgaatacgtatattcctgtccttcatcacctgtgaacgttctgataacgcccgtatgctttttctcggcaggtttcacccttttctttatcattaaggaaagggaaatgaggatcataaaaatcccgaaccatagagaaaacgagtctgagctaaaatatgtcgatacatgggcaccgacgatgctgcccggccccgagccgatgaaaaaaataaggccgcttttatagtcaacggttttatacttcatatacgcaatcgttgaagaaagccctgtgaatatgatgacgaccagcgatgtgccgaccgccatctgcggtgtcacatggtcaaacagcgtcggcagccccgccagaaaaaggagcgagggaacgatgacgatccctccgccgagcccgacaagactgccgatggttcccgcgataaacccgagtatgatcaagataagatattccataaaataagtcctcttttctagctgaataaatcgagctgccttggcgtaagccctttgtattcaatgttgagcagctccatcatttgcttaccgttttgagccgcatcaccgcccgaattgttattaaacagcacgtaaacgtttttcgactgctgttcaagcagctcaaggtttcttttccagtcttttaattcttgttcattatataaatacaaatatctgacctcacgccaattttgaccggaagatggccttaaccagccttccttgttgcggccgtgaaaacggacgagcgttttccggctgtcagtcgcgtgaagaacagtcgggatgctgccttcgcccgcctggggttcatcgcaaatgctgtgaatccattgctgctcctccataaaagcgagcgttttgtcgtaaaactggggcataaaccatgacctatgcctgaattcaagcgcacacgggatatctcccattttctcttttacccatcttaagtaattgacgttttctttcttgcaatcaaaccatggcggaaactgaaagaggaccatcgccagcttacccgcttttatgtatggcgttaatgagagcttaaaagcagcaaacatgtcgtctttcgtttcaaaggggatttccccgcgctgatgccctgtcattccctgatatgccttaacgataaactgaaaggtttccggcgtctcctttacccacttttcattgttccgctcgggctgtatcgcgtaaaagctcgcatcaagctcgacgatcggaaaatgcgatgaatagtggatcagcttgttttgactgcttgtcttgggcggatacaggctgtcatgatccccccatcctgttaatccaatataaatcaatgcagttcacctcttcttttagtttatcacaggtttttttcgaaaatcttgatccaggtctgcttgtagcatttcctttttcagcggcgggatacttgaacatgaaaaagaagccggacatccggcttcttttaacgggctttcctcggaaaaagggtaaagctgaaactgtacaaaaaatcgatgacaaggatgatcgaccataaagaagcgatgcggattaatggttccgttctttccgggtcgccgatgaacaggtgcatcccggccagcagagccgctccgatcagccatgcgatgaaatggcgaaaccagccttcacgctcttttttggcgtgttccctgccgtactgcgggcctttgtcaggcttcggacctccggcaaagcgataggcaaacctttcatccgcccatttgatcatgcggctcccgaacgcgatgctgacgccgatataaacggcggcgatgccgtgcaaaacatccgcttgcgccccattgtgcagatcaagcgacgttgcagccaaaagcagtaaatccaaaaccggtgtgcatgcaaacatgatcaaaccagcctttttccagcctgccatatagcgaaaaataagtccaagcagaataaaaatccaaaagccgatttcacaagctaaaatcaataaaccaatcaccttttatccgcctctctttttttaacacattcgtactaaaaaattataacacagatgtattaaataatacacccgtgttataatgtgtgtatgccaaaaatagttgatcacgaaaaacaaaaagaaaaaattgccgaagcggtgtggaatgtgattcacagagatggacttgaacaatgcaccgtcagaaatgtcgctaaggaagccggactttcggccgggtcgatgcgccattattttcctcatcagtctgagcttttcatttattcaatgaggcttgtggcaaaccgggtcaaaacgcgtatcgaaaacatgacatttaacggtacaccggctgaaaacgtcaaacagcttctttttcagcttatgcctcttgatgaagagcgaaaactggaaatggaggcatggtatgcatttacagccaaatcgctcagcgatccggagctcaaaccgttgagaaaggagatgaatgaaggcatttattcagcctgcaaatcggctgttgaaatactggtaaaaaccgaaaaaaagaccgggatcgatgttcttaaggaaaccgagcatctatacgcccttgtcgacgggctggcgcttcatttgatcatggcccctgaaaggctgacggctgaaaggatcgatactgtattggcgggttatttaagatcgttggaataggaacagatctatcgcattgcaccagaaggaactcacacaaccacagaaaagcaggcctctcagcctgcttttctggatttaatgctcttgttttaaattctcacggatttccttcttcatttcttcgacatttcttttaataatttcaatttcgtatttctcttttgcatctggaggtaagttctcatctaagtattctcggagtttttcttcgctgcgagtatcatctgggccgattgatataactggtctgtttttccaatcacagaactaactaaaccaaacttatcaaaggcgttcagaagtacttcttcagttgttttttgatttggatcagccgcttgtgaagctgtattaaacagtaacaagaaaagaaccaagaacaagattccgaaccgttttttcttcattattctctccttaaaataatttttcctaagcacagcattgagtttctatttttatgtatttcagctttccgggacaccgtttattcatattttaggagccggtcctgaaagcgttaacgagagaggtgatctttattttctggggaagtaggctcatgaggtggatcagtgtaagtttatcttctctgaatggagatatttgactgttttgcaacttcttcttttgctagcgattggaggcgttgtcattatttccgcctcttctaccttgatacctcctttatttattcacaagtctaatatagcataaacctctgcaaaatttttcaaattacaaattgatttcacaaattattttgctggtcatcacaaaaaaaacagcctgatcgcaggctgtttttctgcactagtgaaccgctttttgtatctctttcgttcagccatgttccacctgttgccccgcgcgtgccggagccgtcaaacacgagccttcctctatctcagaagcctactcatgatagaaatccagtgccgcctgaagcgcatttcccggcgatactgaagcacctgtgcgaatgagaacagcttcgagagcagccaatgtaaaaagaacattttctttccggcagctgtatcccatcgttccgattctccatatctttccggccagcggcccgaaagagctggcgatttcgacgccgaagtcgtcaagcatcatcttcctgacaagatctgcgtcaacccgatcaggaactttcacacaagtgacggtcggcagctttttccggccttccgtaaacaattcgagtcccatcgctttgatgcccttgattagtgctgtttcatggagccggtgtcttgagaatcgctcgcggagcccttcctcaagaacgacccgcgctccttcgcgcaagccgtacagcatcgaagtcgcttctgtatgatgattaaggcgcctcgggctccaataatccatcagcatgccgaggtcaaaataattgctggaaatcggcaagcgtcccgtttcaagcacgatatcttctcttgtggcaatgccccgttctacctttttcctttcattgatgcgcttttcaacccggctgttaaatgtgatcggcgccatacctgaaggaacggataaacacttttgcgtaccgccgacgaccgcgtcaagacaccattcatccgtattgacatccgtgccgccgattgtagccaccgcatcgactacacaaagcacatcaagctcccggcaggcccggccaatttcttcgagcggctgaatgcatcccgtcgatgtctcgccgtgcacaaccgcaacaatctccggtttcgtccgtttgatttcggagatgacctctttcggttcaaaaacgtctccccacgggcattccattgtataaacatcagcctggtaccgttcgcaaatctcggcaagcagatagccgaaccgtccgaaaatgggaatgagcaccctgtcccccggtttgatgagactggcaaggacggcttcaagcccggcccgcgatgtcccgtctatcgggaatgcccatttatttgtcgttcggaaaatctgccgaagcagcgccatgacgtcgttcatcatgtctgtaaatgcaggatcgaactgtcccagtacaggtgaggaaagcgccctcagcactctcggatgaacctcgacaggaccgggagtcataattgtccgtttcggaatattcatttcgccaattgtcatgatctttttctcctttcattcatatgccagcctgtataatacatgagtcaagagctcaacgccggctgcaagatcagccggttttgtccattcttccggcgaatggctgatgcccttccggctcggaacgaacagcagtgacgtcgggcaatgcgggccgaaaacctgggcatcgtgccccgccccgctgaccatctcctgataggatacgtcaagatcctcggccgactgttttgagagttgaatcaaatcccggtccatcctcacaggcttcgcatccgtcgtctgttcaactgtgatctgaacgttccattcgccggccagctctgtgaaataagcaaaaatatcgtcgcaataccggtccaacaccgcatcatgatgatggcggagatcaagagaaaaaacagcttctcctgatatgacattcggcacattcggctttgcttcaatcctcccgaccgttgctgttaaaagcggataagcagctttagccttgttcgtcaaataggaaatgcacaatgccgagacggccaccgcatcttttctggcgttcatcggcgtcgtcccggcatggttgctttctcccttgaccataaccgtaaaccgtctttgtccgacgatgtccgtgacaatgccgatttgacggccgctctcctcaagaatgctcccctgttcaatatgaagctcgataaagcacttcacatcacgcctgaacgggcgcctgtaccgccgttttccgaaaccgcaatctttcatcgcctgctcaatcgatactccgtcccgatcgtgcacagccggcgtcttttgacagtcaaacaagcccgttaaattccccgatccccaaaaagtcaaagggaaacggcttccctcttcctcgcacagagacacgacttcgattgacgttttcggcctgccgtacgtgtccagaaggtgtttggcagacaaaaggctcgctaaaatcccgtacgctccgtcgaatttccctccgttgatgaccgtatcaatgtgtgaaccggtcaagatcgctttcgtacggttctctgtaccttctattctcccaaacagatttccggcatcatcgaagtacggctctattccccagtcctccatcttttccttcaacgactgctgggcgctgagccacggctttgaatagagaagccttgtcacccctccttctccgctttcaccgaatgatgccagccaattgatcatgtcttcgatattgcgggctgtactttctccggtcttatgaataccaatggtcatgtaaagaaacttcctttctattttcttgttatatttctttacaactctctatataaatacaattttactggtaacatgaaaaataaacatcggcataaatgtcacaaatccgctcattttttgttgaaaatgactaaaatgacaaaggaggcctgtacagatcaatgaatatctatgacatgatgaaactccctgtatttaaaggcgcaacgcttgccgctggaaaggcgggcgtaacccggaacattgaacacatcaatatgatggatgcgccagatattgccgattatctgcatcatggcgaactcctcgtcacgaccgcataccatttaaaagaccggccttttttattgaaggaattgattgaaaggatgatcaggcggggctgcgccggactcggtatcaaaacccgctttttgcaggaaatacccgacgaggtgatcaagcttgccgacgagcggacatttccgatcatcgagctaaatgaagatgtccgcctcggtgatattgtcaatcatacactgagccatattctagacaaacggacggcagaactcgaacaggccatcgccgctcaaaaaaagttcacaagccatattatgagcggaaaaagcattcaatcgctcttgcataacgtctctgctgttttaaagcttcccgttcttctattcaatcagcacctcaagccgattgcctcctcaaaagcagatgccgccgggacgctgtcggattatgaaggaatatttcaaaaaggaaacagaacggggctcacctgtttttcaacgattcccgacaaacaaacctattcggtatttccgatctatactcatgaaaaaaaatgcggcttcctcgttgtctgcgggatgatttccccttcagacaaaggcttgctgttaaccctcgaacaagccgccaatgtcatcgcctttgagctgctgaaggaaaatgcgctcaaacaatatttgcgaagagcgcggaacgagtttttcagaaattttttggacggcgccttttcctctgctgaagaaattaaaaaccgagcaaaagaatttcagctcaagtgggatcaaaaatatgtgtgcatcgccggcaaattggaccgccgcgaaaaatcgctcagcttcacggaaaatcagcttgaatcagattccgtgttcgaacgcctggaagaagagctggttgacttcccgtttcctccgcaccttttcacaaaaggaaacatatgcttcctgctggccgaggcgacggacagctgggctgaaatgaatgcagccgtgggcggatttttaaaggcgtttcagcgccatgcatctgagcattttcagcggacgatttcttttggaatcagcaacctcagccatcagctgagagacgttccgcacatttgcaaagaagccgtcgatgcgctccactccggccatttgtcaggcagcaccgagttcatccagacgtaccatatgaaagacgtgtcagagcttttgcgcatgattccggctgatgatttgaagacattttacacgcatgcgctgcatcagcttgccagcctgccgaaggatgacccagggctcctgcaaacattgtccgtctatctggaaacgcactgtcagatttctgaaacggccaagcgcctgtacatccacagaaacaccgtcatctacaggcttgaaaaatgcgaggaactgctcgggaaaagcctgaaagatgcggacacgaccttgcgcttgagactcgcgctcagaattcaaatgctgcttgggttgtgagaaatcccttccccgcggcaatcggaggatgtaaagccgcgccggcatatttgatgatttgagcatttcaccataaaaaagccggcatatgtgccggctcccttatactttttcaggaattgtgcgcgcctgctgcttccgcccccagctgactgccgccaaaaagctgagcacgagaacgaccacaccaaaaatatatggaatttctacgttcacatcgaataacagaccggccactgtcggtccgacaatgttggcaaggctcataaacgcattgttcatgcctgcggcaaatccctgttcatctccggccatttttgaaatcagcgtattaatcgccggtcgaagaatggacgtcagcatgaagaaaacaattgttgccccgaaaaccagccagtacgaaccggcaatcgagcagacggcaagcgctccggcagaaccgatcagcgtcatgttcatcagctttttttcgccgaagcggttcgtcagcatcccgagagccaccgcctggacgaacacgccgatcagacttgccgctgttatgacaaaggcaatgtctcccggtgtaaagccgtgcttatgatcgacataaaggctgaataccgcctcgaaattcatgatcccgaagttcaagatgaacacgaggataaacagaaatgcatacggcgaccgcagcgcgcgcgccatttgcttagcgagcggttcgcgcttttgaacggagcggcgcttttcaagcatcttttcttgactgagcgtttccgggaggacaagaagcgataaaaccgtcgccaagccggctaatccggctgacacgtaaaacgggaaggtgagcccgaacgccgccaaatatccgcctgctcccggaccgatgacaaagccgagagacatcgcggcgctgatcagccccatccctttgcttcgatccttttccgatgtgatgtcagcgatgtaggcaaacatggccggcaccaaaaacgcagctcccgctccgccgagaaggcgggaaacaaacagcagccacatctggctcgccaaggcgaaaagcagctgggaaaccgcaaacgcaccgattcctaaaatgatcattttccgccttccgtatttatcagtcatttccccggcaacgggcgaaaacagcagctgggtaatccccgaagccgcgatcagcaatccgagcgtgctgcctgacgcgccgaattcttctataaacgtaggcatgagtggaataatcaagcctataccaagcatcacgataaacacgttaagcatgagcatatacaatctggccatctttttcatctgcggataccttccttcagcccgaaaataccggacaatcttaaattcgaacaattactaaattagtatatccacagataggtttaaagtctagttttttcatatttttgcatattttttcttctcaaggaatgatgggtaaataaaaaagcggagattcccccgcctttttatccatttacgaccagccgacagcgttagcaaacatcaggaaaagcacggccgctcccatccagaggcaaaacagcggaaggatgaatcgcagccatttgttccaggcaatccggctgatcgcaagcgtcgccataaaatatcccgatgtcggaaagacgatgtttgaaaaaccgtctccgaattggaaggccagaatcgccgtctgccgcgtaattccgacgatatcagccaaaggcgccataatcggcatcattattaaagcctgtccgcttccgcttggaacaaaaaagttaaacagcatctgtgtaaagagcatcgccgtaaccgttaaatacgaaggaagctgtgagacagcatgagacaagccgtaaacaatcgtatccatgatctgcccgtcggccataacgactgctgcagctcttgcaatgccgcaaatcatcgcaccgacgagcacttctttaaaaccctcattaaaggactcggcaatgtctctcgaattcatgccggcgatgtaagcaggaatgatgccgagcgccaggaaatagcccgccattgtcagcatatcccacctgaaataaattacacacccaatcaagccggcaaacaacccaagcgccgcgatcccggcccatttcacccgtccgcctgctttaaaagccggcacgggttcgactgcttccttgcccgtcaggcttttttcaggatgcgctctgatcttttccgcatatttgagcacataaacagcggcaatcgccgtaacgacaacaaagatgaccgccctgtaccccatcccggaataaagcgggagaccggaaatcatttgtgaggttcccacggtaaatgggtttgtcaaagcgctcgtaaagccggcgatcgtcccgcacaatgcgattgctgctgctgtcatccggtcatatccgagggacagcagcaaaggaagaatgacagggacataaacgatcgaaagctcaggcgtcccgataaaacaggaaatgccggagaaaacgaatattaagacaggcgtaacgaaaacaggcttgttcctgaactgatcggccaacagacggacgccgagctcaatgacagatgctttcctcagaacggcaaaagctccgccaatcacaaacgtaaacacaataatcggagccgcttctgtcatccctttcggaaccgccgtaagcaagccaagaatatcaaccggcgtctgttcgacccgtttgtaggacgctggatcaatcatttccctgccgtccggactttccacccgttcatattcgcctgccggaatgatatatgtcgcaagcgccataagaccaatcatgacagccagaatgacataaatatgcggaaattcctttttgcgtttttcgttctttttcacctcttctgttttgtaagccggcattcccattttttaatctccccttcttccatgttaaattttttaacatattaaatgatcgcagcgctgatagcattgaaaaatcctctaaatttcagcgtgttttcagttaaaatacataaatcaacacgagcaatccagaaaatcgtcacattttctatcaatcattaagctgatcatctcgactgttccttttctgcattttcatgtaaagtcataagaaagatcagcatgtaaaggagagagttgacattgcagcagtggattaaagaagtggccagaggaaaaaggggcgcccgggatttaacttatgaagaggccagacaggctgctgaagcgattgttacgggaaatgcaagccccgctcagacagccgcgttgttaatagcggagaggatcaaaacggagtcccctgaagaattgttcgcgtttaccgaagcattgcggaacagctcggaatcattgagcctttccagagctgtaaaagaggcggtcatcgattttgcaggaccttatacaggaagacattcttttttagcaaccattcccgtctccctccttctcgcaggaaacggcgttcctgcgtttctccacggcagcgatgcattgccgcccaaatatggaacgagcgtaaaagatgtcctggacaaactcggaatcccctctgagactgccccagcgcaaacggcacgctcactcgaaaaggctttaatcggattcgccgccgccgaaacattttgcaaaccgtttgttcgcatgaggaaaatccgcgaggaaatcggcgtccgcaccgtgttgaatacagcagaaaaactggtcaacttctctgatgccgacaagcttatgatgggcgcatttcaccggacggccatacagaaaatgcatcccgtatttcagcgcttgacgtacaaagaagtgttcattgtccaggggcggagggctcggaagatgtgccggtccacagaggcagctttgtgtttacaataaaaaacggcgagatcgattcttttatattaaaacctgaagaatacggactttacgcagaggaagcaaagctcaacaaaccgctgtctgctgaagagcaggcggaaaaaataacagccgttctcgccggagatgaatcggcggatacggaatacgaaagaaaacaagtcatcatgaatgccgcattgcgctattatttgttcggatactgcgcggccattgaagaaggtgtccaagcggcggaaaaacagctgaaagaaaaagccggtctggaagctcttgaaaggtggaaagcttcatttacaagaccgtaagaaaaccgtaatcaaaatgatatttccttttcatgaaaagattggataatgaaagaaatgaaaaggaggggatcgatagatgaaccgaaagtgtgtcattccgtttattttgatgttgtcggcgatgtgcgcgcccgcccaaaacgcagaggccttccagctgttttccttacccgtacaatcctcggctccggcagattactacgaacaggcgcagggcaaaacaggtgaagctttaaaacgagcgcttcacgacacaatcgacgatcatcgagagctgtcttacagcgaggtatgggaagcgctgaaagcaacggatgaagatccggccaatcgaaacaacgtgatactgttatattccagagagtcgcgctctaaacaggcgaacggggggcaaacgggcgattggaaccgcgagcacgtatgggcaaaatcgcacggtgatttcgggacaagcaaaggacccgggacagatttgcatcacctcaggcccagcgatgtgcaagttaacgccgcccgcggaaaccttgattttgacgaaggcggcagcccctatcccggagctcccggaaactactatgacggcgattcctgggaacctgacaaaagcatcaaaggcgatgtcgccagaatgattttctatatggcggtccgctatgaaggggacgacggtcatccggatcttgaaatgaacaatacaacgaacaacgggtctaaaccgtaccacggaaaaatgtcggttttattgaaatggcatcatgaagaccctgtcgatgccctcgaaagaaagcggaacgatatcatctatcagcaataccagcataaccgcaatccgttcattgatcaccctgaatgggcggaggatatttggggctcgggcgttttgaattgaacaaaaaaagcgcctgctcagcgctcttttttcaaacctctgtttttttgttcagcaccgattttttatccataaaacgaaagaaatctgctgtgcagcagccgcgaggcacggcttcatgggccgattatctacactgacagcccagatcccgcagtctccgttcaaacagccgagctcaatccgagccttcctccacgcacatctaaaagcgtgtcggccggcttgatggaagccggccttttttctccgttcatctcaagggttacttccatccttttagcgctttgtcataaggtttcctttttcagcatgccgagaatgtcaaacagagtatgtttgatgacaaacgtgcggtactctgcggaaccttgcgcatcgtccaatacaggaccgggcaggcggttgatcgcctcttccaccctttgaccaacagggagtgcctcgtcattcaacgcagattccacttcagcggagcgaaacggataagagcagacaccgctgaatgcacagcggacgcgtccgtctatttcgagagccgaaatcgttgccaaaggatatcccgtatcccatcgctgcctcacttttatgcttgcaaaaggctgatgaagatagcgttcttcaatcaaaagcgaaatgaggatttctcccttgctcagcttcagctgctgatcaaatacgtcgtgaatcagatagcgctttttccccttgtctccaactgtcaccactttgctgtcggttaataaaaaaggcagcaccgcttcgcggtaaaagatctgcccgcaaatattgccgccaagcgtaatcttattgcgcgccgtatggtcggccacctctctcgccgctttgctcaacagcggaaagccgccgttttccgtgatctccgtcagtgttagcgccgagcctaaagcaaggtgatgccgttcaaattgcaaagtcctgcactcaggtatatctttaatatcgatgacggcatttgtatggatcacattcatccgtccgagcatcaactgttctgttccgccggaacaatacgccggctttttcccctcccgctccaggctttgaaagagctttaccgcttcctgcgcagattgggggctgtaatactcaaagtcaaactggatcatggcggtcctccttcattttccaaatttgtttggaatcagaggcagccgattcaaaaaaccggcatgcacttcaaataaagccagctcattcacccaaaattttactccatgaatttatattgaacaatattctattttaaaactgtaaacaagaaaaaagttcactcgaagctagagtgaacttttttctgcacgttgattcaactttcaagcgcgccggccggatcatataaagcgatatcaagctcaggctcttctcccaaagcgagccttgccaattcagcgccaaggtacggacctgacgtaagccctgaagcgccgagaccgttggcaacgaggagcccgcaaatgttcggcaatgagccgatcacggggagaaagcccggtgtaaacggcctgaagcctacgcgcgcctcaagcagctcgctcaattccaaccccggcgcaacggcgagcgcctttgagaaaatttcgtgaaggccgccggccgttacccgaagatcgtccagttccgcttcattttcgtgagtagcgccggcaacgatccggccgtcttcaaatgccagtatgtattggtcattcggaggcatcacaacaggccagctgccggtatcggcatcaggaagacaaaggtggacgatctgcgctttttggtagctgactgaaaaacgaacgccgagcggcttcaagagctcgtccgcccaagctcccgctgtgacaagcacctgatcagcgtatattttcttgccccctgtggagatccctgttacccggtttccttcatagagcaatgaagcgtttcctgaaacaacagaagctccgtatttttttgcggcattcacaagtgagcggcgcagcaattttccattcacgcgcgcggctccgctgatatgaaccgagctgtacccctctgccaaaggcggaaataaacgcttcgtttcctcatgggataaccgggtgatctcgccgatttcgggcgcatccttgcgccttagatgcgcccgttcttccattttctccagctttcgctcgtctgtatgcaagctgatagcgcctgtccgtttataccccgtatccgattctccgtcagcttcaagctgcttgattaaatcggcatagtacgccgcaccgccttttgcaagcttgtaccatgcctggttcctgcgctgcgaaagccaggggcagacgattccagccgcggcatctgtagcccttccccgctctccgcggtcaatcaatgtcacatccgcgcccttttttgcaatatgataagcggctgaagcgccgaggatgccgctccgactacaataaaagatttcatgactaacacctttttcatttctgtttattctacaaatataacggatcacaccgatggagcacaacctaaccagcggctaccgatatcacgccaagcaccattaaggcagccgcgatgatcctcagtcgtccgaaaccttcggacaaaagaaccgcccccatcacggttccgattaaaatgctgatttcccgaacaggcgccacatagctgaccggggcaaataccatgacactcagcgccaaaatataagccaaagaattaaaaaccccgaccccgacagcttccatccggtgatgcttccactcaaaccggacttcactccagcttttcgcggcataaggagtcaatatgaccaggcggccgagcgtattgcaataatccagcagcaatggcggaatgagaaaccggctgaccgctgctttatcaaggagagtatatgcggcaataatgccgccgaccgccagcccgtaaagaaccggtgtgaacgagcctgattcttttaaccgcttcactccccctgtaaaaaaaagaatgctgatcacaatcaatagaatccctataatagcgggcagcgtcaacgtctcgccaaaaaaggcgaccgccagcatgcaggtgagcagcgggcctgtccccctcgcgatcggatagacaagggagagatcgccctttttgtatcctttttgaagaacaagaaaaaagcccaagtgagcaaggatgctcgccatgatgatgacaagctgccagatgccgatctcaggcttttcatatatgacgacacctatggccaacggcgtgtagatgacggctgcaatcgctgtgaacagccagataaacggaacgcctccatcggcttttttagaaagatagttccacgatgcatggataaatgcagaacataataatacgcaaaaacccacgacagtcattacacagccctccgtccatcataaaagagatcaatgcttgatgacaatgtagcgcttcaattccccgtgccacttctttcctttgacggcatccacccagacgtcatacttgcccggtttcagctttttcgtcggaaagctcacccgaaaatgaggctttccgcgcgttaaatgaacatctcgatagatcaggacagtcccttttttattgatcagcctgacggcaatcatcgttcccgtaacagggctttttccagtgacaacgatcgaagtggctgatttcgtatatgtattggcatccgtcctgaatttcaccgcgcctttggaaggcatagcaaaggcttctgtactcccggcaaatgcggccagcaagaaaacagcggctatcaacacagcctttttcaacattttcactggtcatatcctttcttatacagtatgaatgtcacatgctatacccttcattatacatgacaatatgatctaataaagatatttgacaagaagatcctgttcttctttaatggacaaatactgtataaaggaggtgatttaatgtattaagcaaagatgaaaaaatgaaacccgcatatagaagaagttactgttgaaatacaaggctatgaatttaccggcttttcaactgtctgtcccacttttatagaagagggtaaagagtatcccgtcatgatcaaaatttaccattttctaatcatgaagcattccccaatcgtaaaacctatgataaagaccgcgcaagctgaggagtaattcggattttccattgacacctcgcaaattgcgaatccggtccccacttccaaaagaataaacagataagatacgattctggattttaaatagcttgccatagaccgacctttctttctgcgattacttaaaataataatcaagtaatcaaaatttgaggttttaataatgctgggggaaattcttttttatagtaagaaatcctgctgctttaactacccctagaacgatttagtttacatgtagaaaagcactcctttgaatttgtcttctcgcattaactgttatccggtagaattccactgcatctcgaattttttcttttttctctaatagttcagccgctataagaccgtattcctccatgtctgcatacttgcctttactttcgaaaaacttgaacgattcgcgaaccatatccagatcaaatgaaagataaagcccttttattaaatcaaactttgcaagcatatctaaattcttgttcttttcagccaactctttgccttcatagtataggtcatcagttattgacaacttcccttgctttgccctgacatgtgcgaggttgaataatgtttttggcaaaaaactatgcttctcctctttataaaggttcagagctctttgaaaattgtaggttgctttatcgacatcttccaatttattgtagcatattccgatatttaaatgtgatgaacccataagatgaagaattccttgtgtctctgactctttaagctctttatttaaattatgtagagctttttcgggatacatatgatctagccagttacctgcaataataaactgactttgtactcgacgctcaccgtaagtatcatactttttgaataagttatacgcacgacttgcataattcatcgaaaagatggtttgtttcatatggtaatacacttcagatgccttgaaataaaattcagccttttccagttcatcacaatcaaaagaatcgagttttttctcggcatccctataaaaattcagcgcaaggattaattctttttgtctgaaatgatacattccagcgaaaaaatgataataataatccaacattccttccagattattctgatcgcgaatctttttgaactcatcaaaacgactatttaaatttacaccgggtttagaatacatataatcaagttgaagattatgccggaagagcagtaagttgtaatagacaatcacatcctgattttgttccatttgttctaattctcgttcaacttctttcttagtatcctcagccttgcctgtccaattgttttttaaggctgtataccaaaaattcattttcgtcgcaaccaaatcatatggtatcacgctcacatatcctcttcctttctcgcaagattataatttttctaaaaacccaaaatagcaattccctttttattcatagtcatcattttacataaaagtaataatttttcacaacaacattctcagaaatctttataagttagaggttttttggcctaatcaatatgattcgttttccgtgtttgggtgaattttagaagtataggaaggaaggcagaacagatgaaggattatattttcctgttgatatgtaatttggcataactaatcgttaggaagcaaaattcaaacctcttttatgaaataaaaagctaaagaaaaaaccgcagatacatttctacgccttttagaaaatcgataggcaatagattatatctgcggtacacaaacataaagtttattcgggtgcaatcaaatcgaagtctgatcaccccctttagtatcaagggttaaccaatagacccttccatctcgaacttgataagacggttcatttcgactgcgtattccatcggcagttctttcgtgaacggctcgatgaagcccatgacgatcatttctgttgcttcttcttcagaaataccgcggctcatcaagtagaagagctgctcttcagatacttttgatactttcgcttcgtgctccaatgaaatgttgtcgttcaaaatttcattgtatgggattgtatcagaagttgatttgttgtccatgataagcgtgtcgcactcgatgtttgagcgggcgccttcggctttgcgtccgaagtgtacgattccgcggtatgtgacttttccgccttgttttgagattgattttgaaacgattgtggatgacgtattcggtgcaaggtgaatcattttcgcaccggcatcctgatgctgtccttttcctgccagggcgatagaaagcgtcatgccgcgcgcgccttcgcctttcaggataacggcaggatatttcattgtcagcttggagccgatgtttccgtcgatccattccatcgtcgcgttttcttcacaaaccgcacgctttgtcacaaggttgaagacgttgttcgcccagttttgaatcgttgtataacggcagtagccgccttttttaacgatgatctcaacaaccgcgctgtgaagggagttcgtcgtataaacaggtgctgtacatccctctacatagtggacgtgagcgccttcgtctacgatgatcagcgtccgttcgaactgtcccatgttttctgagttgatgcggaagtatgcttgcagcggagtatccacttttacgccttttggcacgtagatgaatgatccgcctgaccataccgctgagttcaaggccgcaaacttgttgtcagtcggcgggatgacttttgcccaatgctcgcggaaaatgtcttcattttctttgagggcgctgtctgtgtctttgaagacgatcccttgagactcaaggtcttctttcatgttatggtaaacgacttctgactcatattgcgcggatacaccggccaaatatttttgctcagcttctgggattccgagcttgtcaaatgtctgtttgatttcctcaggcacttcgtcccatgatctttctgaacgctcagaaggctttacatagtatgtgatttcatcaaagtttaatgagtttaaatctccgccccattgcggcattggcatattgtagaagtgttcaagagatttcaagcgaaagtcgagcatccactgtggctcttctttcatgcgtgaaatttcttcaacgatttcttttgtcaatccccgctctgaacggaaaatggaaacgtctttgtcggcaaaaccgtatttatattcgccgatatccggcattttcttagccatccattttcactccaatctttattcgttatcgctgttttctttggaaacgcctttttcgagggctttccatgacaatgttgcgcatttaattcgggccggaaattttgaaacgccttgcagagcttcaatatctcctaaatcaatcgaatcgtcgtagtctttgccctgcatcatatctgaaaagatccgtgacatttgaagggcggtctccacgtctttccctttgatcgcctgtgtcatcatagacgcagaagccattgagattgagcatccttcgccttcaaattttgcatcttctactttaccgtccgttatcttcatcgtcagcctgatccggtcaccgcatgtcgggttgttcatgtcaacgacgatgctgtcattcaaaacccctttatttctcgggtttttatagtgatccataatcacctggcgatacagtgtatccaagttcacattaaaagacatttgtgaaatactcctttgtcttctgaagagcttcaatcagtttgtcgatgtcttcttccgtattatacagataaaagctcgctcttgcagtggcggagacgttcagccatttcattaaaggctgcgcgcagtgatggccggctctgacggcgaccccttctgcatccagcacggttgccacatcgtgcggatgaacgtcttcaaggttgaacgtcacgagtcctgcacgttcggccggaccatagacaacagcgccttcaagctctttaaagcgctccagcgcgtatgccgccaaacggtgttcatgcgctaatatttcatcaagtccgatgtcttcaaggaagtcaatcgccgctcccaatccgatcgcgccggcaatgatcggtgtgccggcttcgaatttccaaggcagctccttccaagtcgattcgtaaagaccgacaaaatcgatcatttctccgccgaattctgcaggttccatgttttcaagcaatgctttttttccatacaataccccgattccggtcggaccacacattttgtgggctgaaaacgtatagaaatcgcagtccaaatcctggacgtcaattttcatgtgcggcgtgctttgcgcaccgtctacgaccatgaccgcgccgtgttcgtgggcgattttggccatttccttaatcgggttgatcgtaccgagaacgtttgaaacatgcgctgcagagacgatttttgtattttccgtcaccgtttccctgacatcgtccaaggaaatggtgccgtcttcctgaagcggaatgtacttcagcgtggcgccggttgctttgacagcctgctgccacggaataatattcgcatggtgctccatcggtgtaatgacgatttcatcaccgggcttaaggtttgcgcgggcatagctgagcgcaaccgtgttcagggccgttgtcgtaccccttgtgaaaataatttcctgcatcgatttcgcgtttataaacttcctgaccttctcacgtgctccttcatatccatccgttgcttttgttcctaatgtatggacgccgcgatggacattggaattgtaagagttgtaatactcatcaagcgtctcaatgacgacgcgcggcttttgcgaggtggccgcgctgtccaaataaacgagatcgtgtccgttgacctgttggctgagaatcggaaactgttcgcgaatatctttagcattcattattttactttcctttcaatcacagagaccagctgcttcttcacgccttcaatcggaagttcattgacaaccggtgcgaggaagccgtaaatgacgaggcgctctgcttcttctttaggaattccgcggctcatcaaatagtagagctgaaccggatcgacgcggccgacagatgcagcgtgtcctgccgttacatcgtcttcatcgattaataggatcgggtttgcgtcgccgcgcgctttttcactcagcataagaacgcgtgactcctgctctgcatttgattttgacgcgccgtgctcgatctttccgataccgttgaagatcgaagacgcggaatctttcataacgccgtgttttaaaatatagccttctgaatgctttccgtggtgaatgatttgcgttgtaaagttttgagtctgttctcctctgccgacgacaaccgttttcgtatcgccgaatgtgccgtctccatgcagattcgtcgtgttttcagaaatggtgtctccgtcattcatcaaaccgagcgcccattcaattttgctgtcgcgtccgagtgcagttccgcggcggctgacataagccgttacccctgcggaaaggttgtcgacggctccgtattgcacgcgggcattcgcgcctgtgatcacttctgacacgatgttaaagaccgcttccttaggattcaccgtgctgatgtagttttctacatatgtgacggcactgttgtcatctgcaacgacaagtacatggttgaaaagcgttgtatcgttgctttcatggacataaacagcctgcaccggagcttccagctcgacgtttttcggtacgtaaaggaaggctccgccgttcaggagggctgcatgcaatgcagttaatttatgctcatcggcttttacgccgtctttcataaagtactttttgacaagctcgccgtgttcgcggaacgcagtatgaatatctgtaaagatgacgcctttatcctgcagctcttttgaaagagaaaggtaagccggcgtctggtctctctggacataaagcgttttgtcttcatttccaagatcgatcagcgatttgacctcatctgaaagatcatccaaagaatcaagcggtttattttctacagtatgcttatcaaaccgtgtaaaattccaatttgtaatttttgttttatcaggtttcggcagcggcagatcttctgctttttcaagcgcttctaagcgtagatcttgcagccatgccggttcctggtgcttctcagagaagcttttgacatattcccgatctacagatagttttgtttccaatgtcatgtttatccccctaacgcttacgcttcttgaccgacagtttcgtcttcgattccaagctcatgcttaatccagtcatatccttcagcctcaaggcgctgtgcaagttcaggtccgccggatttcacgacgcggccctgcatcatgacgtgcacatggtcaggcgtaatgtagttcaagaggcgctgatagtgcgtgatgatcaggcagccaaagttctcgccgcgcattttgttgattccttttgaaacgactttaagggcgtcgatatccaaacctgaatcgatttcgtcaagaatcgcgattttcggttcgatcatcatcagctgaaggatctcgttgcgctttttctcaccgcctgaaaaaccttcgttcaggtagcgctgcgccatatcagggtccatttcaagaaattccatgttttcgtccattttgcggatgaatttcattaaagaaatctcgtcgccttcttctctgcgcgcgttgatcgctgaacggagaaaatcggcatttgtaacaccgctgatttcactcggatactgcatagccaaaaacagaccggcttgagcgcgctcgtccacttccatttccagaacgtccttgccgtccagcgtgatgcttcctttcgtcacttcgtatttagggtgtcccatgatcgccgcggataaagttgatttacccgttccgttcggtcccattacagcgtggaattccccgccttttatttcaaggtttacaccttttaaaatctctttcccttcaatctcaacgtgaagatctttgattgttaatgtcgaagcagccatgaaatatacctccaattatagataatcatcattctcaatttattctcattctaattttataacaaatgaaaattgaatacaacaatagtcttcctatcttttcgtgtacatgttctcaagtttaacaaaaaacgatttgttcttaaagagattgggacaagaaaacttcccggggcagaaaagcggaatttattaccaagctgtcgaaaacaatcggtacatccgtcattaagagcggggatggtttgctcccaggctgcacgattcatgaggggaacagcgctccccttctatttgaaccgtcacatgctccacgttgcattctttccttagatattttgatacttgttttaaaattctatccctgtcactgttttcatccgctacgatatggcagcttaatgacggcatatcggatgagatcgaccaaatgtggaggtcgtgaacctccctgaccgacgggatggaaagcaggccgtttttaagcgcctccgcatcaatgtctttcggttttccttccattaatatatgcaccgagtctttcgtcacccgccagccgctgacgagaaccaaagcagcgacgacggcgctggcgattggatcggcgatgttccaattgaagaaaagcataaggaggcccgcgatgatcgccccgaaagagcccagcatatcgccgatgatgtgcaaaaaagcgctccgcatatttaaattcccgcttgtgtcgcctttcattattacccaggccgcagcaatgttgacgaacagaccaaccgtcgcaatcgcaagcataccccttcccgcgacttccggcgggctgaaaaagcgattgtatgcttcccaaaaaatataaagtgaaatcaaaagcagggtgatgccattgataaacgcagccaaaatctcaaagcgcctgtagccgaatgttttgctcgcgcttgcggccttttccccaattttaaacgccaagaggctgaagccaagcgccgcagcgtcgctgagcatatgtcccgcatctgacagcaaagcgaggctgttcgtcaatattccgcctatcacttcaatcatcataaaagtaaaaattaaaccgaagctgatgaacagcgctttttgatttgctgatcggctgccatggtggctgtgtcctgtatgtccgtgagaatgagccattttaaatcctcctcttaaattgatatatgatcatgtattcatatttaaattttaccttttcctttaattaaggtcaagcggcttctaagaacatggagaaggacggatcggcatccgtccccctcgcgttttatccgattatgggcaagtctgatacgatctgcttgcttttttgatactgcttttctcgtcttttctcaacttcaagccgattcacatggcttctgctgtactcctcgtaccccattccatgcgacttgtgcatcgctttttccatttcggccgtgaattcaaggtcaagctgatcttggcttgaacaaataatgaatcatcctttcagagattttcttacatagtaccagttatatacaaactctgcaaagatgtgtgtgctttcaatatgctttcacggtcgaaaaatcaatgcttcatctgctggaattcttccatcgcctgcaaaacgagcgtgacggcttggctcatggctgcgcctccgccaaatgcagcagttacaccgactgcctcaagaatttcttcctccgatgctccgcaatccaggcagcccttgatgtgataaataatgcaatattcatcctgcgtattgacactgatgcccagtgcgatcagctgcttatccttttcgctgagcacgccttttttaaagcactcttcggtaaattcgttgtatttggcggcaattccgggcattttttcggaaaagatgccgatccccgccttatattcgtgcagtgcggattcgataatgccttctgattcatgctgattcacgttttgttcctccattttcagtaggtagtcttttttattatgagcctcttttcaaaaaatacgcgaaaaaaccccggttttctccgaaaccggggtgttctttcatttactcagatacagaaatgacagagcctttatattttttgtcgatgaactttttgatgtcgtcagagcgcaatacttccatcagagcttttactttgtcagaatcttcgtcgcctttgcggacggcgatgatgttagcgtaaggattgtcttttggagactcaagttcgattgaatcagttttcggattcagcttgttttggatcgcatagttcacattgatgaacactgcgtctgcttcattagcttcgtatgcttttgccgtcatttcaggcgccacatcatttttgattttcaggtttttcttgttttctgtaatatcttttactgtcgcatctactttttcaatgcctgatttcagcttgatcagtcccgcattttcaagcattgcaagcatgcggccctgttcagcggcattgttgctcataataatttttgcaccgtcaggaaggtcttttaaagatttatactttttagagtaaatgccgaatggctcaaggtgtaccgcaccgacgttgactagatcgtaatctttgttttctttcatttcctgttcaaggtaagggacgtgctggaagtagttcgcatcaagatcttttgtagcgagcgctttgttgatcagtttgtagtccgtgaaatttttgattttaagctcatagcctttttctttcaaaagcggttttgcttcttcaaggatttcggcgtgaggcgtcggcgtcgctccgactgtaatgactttgctgtctttatctccttcgctgctggaagatccgcaagcggccaaaacgcctgcaaaaatgatgaataaagctgttaataaaccttttttcatgttggtgtcctccctaacgtttgtctaatttatttgttataaaatccccgataaattggatgatgaacacaatagctaagatgaaaatagtggcgatcagtataatatcgggattgttcatctgaaagccgtttacataggcaaggttcccgagtccgcctgaaccgattgctccggccatcgctgtcgaaccgatcagtgcaatggctgtaaccgtaatgcctgagatcagcgccggcatcgattcgggcaggagcactttaaatatgatcgtcgatgtttttgcccccatcgatttcgctgcttcaatcacgcctttgtcgacctcgcgcaaagcaatttcaaccaggcgggcatagaacggagcggatgcgataatcaaagccggaagagcggcattcggccccagaatcgtattcattaaaaactttgtgaaaccgagcagcaaaataatcaatatgataaaaggaatagacctgaacacattgacgattgccgagattacaccgttaacgactcggttctgccaaatgttgccttttgaagtcaaatagagcagcatgccgagaatcactccgatgataaaagcaaacaatagggaaattcctgtcatatatatcgtttcatacgttgcttcccacagctgctccatatctacgtttggaaacagtttttcaaacattcgtgatcacctctgcttctacctggcggctcttgatgaaatcgaccacgtcattgacctcgttttcacgtccgtcgacatgtatgaacaatgaaccgtatgcaccgtcctgagtctgcgagattttgccttgaaggatgttgacttcaacatcgaacttccgaatgatctgcgtgatcagcggcgattcggccgcttcgccgacgaaagtgagcttgatcgtccgcccggatgtcgtttcttcgaggaaatgcttcagcgtttcctttgtttccaccggttctgttacctgctgaacaaagcgctttgtcatttcttccttcggcttgatgaagacgttcagtacatcgccttcttctacgacctttccgttttccatgacggccactctgtggcagattttcctgatgacatgcatttcatgagtgatcaggacaatggtcagtccgagcctttcattgatatcggacagaagacccagaatcgaatcagtcgtctgcggatcaagcgctgatgtcgcttcatcgcataacagaactttcggattgtttgcgagcgcccgtgcgatgccgacgcgctgcttttggcctccgctcagctgtgaagggtaggcgttttccttgccttcaagaccgacaagcttaatcagttcagcgactctttccagacgttttgctttgctgacaccggcgatctccagcggaaacgcaatattgtcgcgcaccgttctcgaccataacaggttgaaatgctggaaaatcatgctgatttcctgccttgctttcctcagcttcttccctttgatctcgctgatttttctgccggctacttcaaccgtgcctgaagtcggctgttcaagtccgttcaagagacggatcaaggagctttttccggctccgctatatccaataattccgaagatttcaccttttttaatcgtaagggtgacatcttggacagcattgacatctccatgctttgaccgataaatctttgaaacattttgaagatttatcaaaagccatcacctgctttcttgctcaattctcatagttgtctaaattcctgatcaatcaacgaaaaaagcctttctgcacacatgagcagaaaggctttggaaaagtctgggcctttctctcatctttcaaagcataacgcttcgcgtgaattggcaccatttcaacacgtgttgatggttgccgggtttcatagggcacttccctccacctctctggataagagaaacatatatttattttttgattattatgatcggaattcttaaagtaggatatcatgcgaaaaaatagttgtcaactatttttcgtaagacaatcgtcctacggcgaaaagagacgagcgtaaacgcccgtccctgtctgactaatacacggaatgtgccgattttttgaatttttaaaaagtctatgaataaagatcgctgtttttaaagaagccgtccgtcagccataaaatcgcttcaagcttcaataaagctctaaaagagccttttactttaacagtgccgcgctgtacgagatgctgcaatgaaatgtcgccatgaagaaggtcaataatctcgctttgctctccaaaaaaggtcaaatgagctttttctacaggagaatatttttccatttcccctttttcgttgattgctaacgtaaaagcttctttctctccttgaaacgtaatcagcaaagccgttgtagataatagaggttttaaaaaaagagccttgccctctctttctatcaatcccattttctccaactgtataacctcctgtaaattggtcatacttacagattctctgtctgctgcaggagttcctttaggaattgctcgacaagtttttgctggttatttcccgagaaatatgtcaaaaccgcccttaatccacaagattttgtttaatcgtatcatataagtaggaaacggagtgaaaagcgtattcttttttgacgactcgcccttttttgtaaaggataaaacacgggacgctttcaatttcctgctgtttggcaaatgacggggagtaattgagattgtttttataaaaaggaatgtccttcatcatttcatcaacgacctccagcattcttccggccagctgacacgttccgcagaacggcgtgtatacatatagaagacaagtttcatgctctagccgttttagctctttttcttgaagttcttgcatctgttgaaccgcacctcaatacgttttataatagatattttgtatgtacccggatgtttgaacgaaataatacttctgcaacatgctgactcggggcggaagcgacttctttgtatactctatcaatgtatagatgcgaagcttggggaagctccctcttcagctgccggcggagcttttcgcctgattcatcggcatccaccaggatataaacgtctttatcgaacagcgtctcagcgaattcatcgagttttgcctggctgatcgttccgtttgtgcatatgatgtccacgggctcttcgatgacatgcttcactttttgcttatctgatttcccttcgacgatcatgactttttcattttccggcatatggatcacctttaaagatttacttgtaaaaaaaggcagtgaatattcaccgcctgacttgattaacaccagccttggtggtcatcacagtctacatatttagcatccggtccgcttacggtatccgccattttgtaaaacttttcatcttggaatgaatatccagatttcaactcgtattgatccttgccggtcattcggccgatcagctcattttcatgatacagctgcgttccgccgttttttaatcggctttccacatgttctgtaatatcaatacgttcttttttcagcgtcaatttggacaccccctcctgatatagagtatccaaacgacgaatgtctatcctgtttagtcttcttttatcatgtcctcatattgcccggctgtcatcaggttttcgatttcagaagcgtctgacggctcgacgacaatcatccaagccttttcatacggagactcgttgacgaattcagggctgtcttccagatcttcgttcacttcgaccacttttccgttgatcggggcatacagctcagaaacggtctttacggattcaacgctgccaaaaggctcgtccgctttgatttcgtctcccacttcaggaagctcgacaaatacgatgtctccaagctcagattgtgcaaagtctgtaatgccgattctgactttatctccttcggttttcacccattcgtgttcttctgaataacgcaactctttcggtgtgctcatgctaacccctccataaagtgttttaatcgatcctacattgaagatatcatattttgatgtgttataaccagtatgtcttaaactgatcttctttaaaaccgaccgttactttactgccgtctgtcgtaattgggcgtttgatcagcataccgtctgatgcaagcagttccagctgctcatcttcagacatgctttgcagcttgtctttcaggccgagttcgcggtatttttggccgctcgtgttgaaaaacttcttcaattcaagcccgcttttctcgtagagctctttcagtttttccttgctcggcggctgttctgcgatatgtatcccattgatttcttttccgtggtcttcgagccattttttcgctttgcggcatgtcccgcatttcggataccagtaaaaatccaaagccatacatacacccctctcatttaatcgaggtaattttaacatagatcgaatgaaaaacctaaaacagtgctcgggttctattaacagctcagaaagccctgcattaaagcagggcttctcgtttaaacgatatatttctcagcttcaaagactcccttggctgcctggcgctttttctcaatcacgttgacaggcgtaaagcgcgtcaatttgcgcagcgcggacagcatcatgcgcagcgaatcgcctgattccatcgcaatgagcgattctttggcatggctttcaatttcctgaaaggcttcctgcgcaaaaatttgcgtataaagaattttctgtgcgtttttgtcttcgccggttgcccggatggctttttcagtacgtaaaatagctgcttccattgcgtagatctggctgacaatgtcggcgatgttgacgaggatttcctgctcctggtcgagcgcttttccgtatttttgcgcggcgagtcccgcgatcatgagcgcggtctttttggcgtttctcagcagatacttttcctgttcgagaacgccgtcacctggttcttcaggcatgagcatcatcagttcttcctgaagagcctttgctttctcaaacagaggaagctcgcctttcatcgcttttttcatgtaggtgcccgggacgatgagccggttgatttcgtttgtgccttcaaaaatccggttaatccgtgaatcgcggtaagcccgctccacttcgtattcctgcatgaatccgtaaccgccgtggatttgaacgccttcatcaacgatataatcaagcgtttcagatccgaatactttgttaagggagcattcgattgcatattctgcgatcgatttcgcaacctggcgcccgtctttttgctcttcttcgctcaaggtgcccattttgtcttcaaacagcccgaccgtacgataaacagagctttccatcgcataaagtttgactgacatgttggcgattttttccccaattaagctgaactttgaaatcggtgtcttaaactgctggcgctgattggcgtatgaagcggacagctcgatgacccgtttcgaagcgccgattgtcccgacagcgagcttatagcgtccgatatttaaaatattgaaggcgatgacatgcccttttcccggttcacctaataggttttcttttggaacttgaacctggtctaagatgagcgtgcgggtcgaagagcctttgatgcccatttttttctcttcaggccctgtggagacgcctgagtagtctttttccacaatgaaggccgagaaatgttcgccgtctattttcgcatagacgatgaaaatatcagcaaaggctgagtttgtaatccattgcttttcgccgtttaatatatagtgggttcccgcctcattcaaaacggccgttgtttttgcccctaatgcatcagacccggagcccggctctgttaaagcataggctgcaaacttttcccccgttgcaagggacggcagatactttttcttttgctcctcggttccgaaaaatacgatcggaagcgtgccgatccctacgtgcgccccgtacgataacgaaaagctccccgctcttgaaaatttttcggtgattaacgccgagctgattttatcaagtccgagtccgccatactcctcaggaacgtcagctccgagaagcccgagttcgccggcttttttcagaagcctgacagaatgatcgaaattgtgctcttcaatttcgtcgatgtacggtagcacatctccgagaatataatcctcagtcgttttggcgatcattttatgttcatctgtgaaatcttccggtgtgaacatctgatcagccgttacctcttcgatcagaaaggcgccgccttttttcatatgatcttttgtttgttccattgttccatcccccttgtgattaaactaattcgaatacccctgctgctcccatgcctccgccgatacacatcgtcacaatgccgaattgctcgcttctccggcgcatttcgtggatcaatgtcagcgtcagctttgtacccgtgcagccgagcggatgtccgagcgcaatcgctccgccgttgacattgactttttcttcatcaatgccaagcgacctgatgacctggatcgcttgcgatgcaaacgcctcatttaattcgaataaaccgatatccgacagctcaagtcccgccatcttcagcgcccttgggactgcttccacagggccgatgcccatcacttccggcggaacgccgccgactgcgaacgaacgaaattttgcgaggggctttaacccgagtgcgtccgctttttctctgtccatgatcatcactgcggcagccccgtcgctcgtctgcgaggaattccctgccgtaaccgagccgtttgccgaaaacgccggtttcaacgttgacagaacgtctttggttgtccccgggcgtacaccttcatcggcagagaaagtaaacgtccgctccttcaggttatgatgttcatccacttctctgacggtgacgtccaccgggacgatttcatcttcgaactttccttccgcgatcgccttggctgctttttgatggctgttgacggcaaatgcatcttggtcctccctggaaacgccgtatttgacggcaacctgttcagccgtatggcccattcccatataatattcaggagccgtttccgccagagccgcgttcggtctgacgatatgacccatcatcggcacgatgctcatcgattcggcgccgcctgcaatgatcgtgtcagcagctccaagcatgattttttcggccccgtaagcgattgattgaagtcctgatgaacaatatctgttgatcgtaacggccggaactgtgtgcggcagaccggcaagcgcgccgatattgcgcgccatattcaagccttgttcggcttccggcgtagcgcagccgatgatcaaatcatcgatattcccttcataaccgcccgctcttttcagcgtctctctcaccgcatatgcgcctaaatcatcgggacggacagtcctcaatgagcctttttttgcttttccgatcggggttctcgcccccgatacaataactgcctctttcattattttccctcctaattacgcaaaggtttgcctttcacaagcatatgctgcattctcgcctgcgatttcggttcgctcacaaggctcagaaacgcttctctttccaaattgagcaagtattcttccgttacttcggcgccgaatggaactcggccgcccgcgatgacaaacgccagttttttcgcaatcttcatgtcgtgttcagagatggcgccggaaagttttaacgattcagcaccgagcaggagcgccgcatagccggtttcgcccgtcaccggaactttctctttcaccggcggacggtagccgctttcggaaagtgtcaggacgagttttttggcatcgtataacaagtgatcctgattgatgctgatttgatcctctgcggttaagatgttcagttctttcgcttcttgagccgaagtcgacgtttttgcaagggcaattgtctcaaacgtcttgatggcggcctcctggatatccggtttaacgccttcaggcagccctttcaagtaatttaaataaagctctttattgcctccgccgcccggaatcagaccgacgcctgtttcaacgaggcccatgtatgattcgcttgaggcttgaacacgggcagcaggcaggcatagctcagtccccccgccaagcgtcatgccgaacggagcagcgacgaccggcttggaactgtatttcactttcatcatcgtctcttggaactgacggatgatcatgtcaatttccatatagttgtcgtcttgagcttccatcagcatcatcgcgagattggctccgacgcagaaatttttgccctggttgccgatcacaagccctttatagttggcgtctacttcctcgagagcaaatttcagcatttgaatgatgtccaggccgattgcgttgcttttcgagtgaaattcgagcagtgcgacatcatcgcctaaatcgatcaaacttgccccgctgtttttcttgatgacgccttttgtttctttgagtgacgacaaatggatcgttttcttgttttcttgaagcgccctgtattcgccgctttcaaaacagtagtagaacgtctttccgttttccttaaggtagaaggtttcatgtccttttgcgagcatttccttcacccagtccgcgaccttccagccctctgcttcaagcttttgcaccgagcttttcacaccgatgctgtcccacatttcaaacggcccttccgaccagccgaatccccatttcatcgcctgatcaaccgccgttatgctgtcggcgatttcccctgtcagctccgccgaatatacaagcgtcggagctgtaatcttccaaaggaggcttcccgccctgtcatcggaataaacaagcgctttcaatctcgctcctgcgcctttcatttgcttggccgcttccagtcccgatgtttttaatgtttgacgcgcgctgtaggtcatcgtcatcggatcgagctcaaggatgtcttttccttcttttttgtaaaaaccttgtttcgctttgctcccgatccagcctttttcgagcatttgttcaataaattcagggagccggaaaacgtttttttcttcgcccgtgacttggttatagacatttttggcaacgtgtgaaaatgtatcaaggccgacgacatcgagcgttctgaaggtcgcgcttttcgggcgtccgatcagcggacctgtaatcgaatcgacttcgcctatcgtgtagccgcctttcagcatttcctgaaccgtcacaagcaagccgtaggttccgatgcggttggcgataaagtttggcgtgtctttcgcttcaacaacccctttgccaagaacgtcttcgccgaatttcttcataaaggacagcacttcgggctccgtttcgtcaatcggaatcacctcaaggagctttaaatagcgggccggattgaagaagtgcgttcctaaaaagtgctttttaaaatcagcggaccttccctcagccatctgcctgacggagatgcctgatgtgttgctgctgacgatgcttccttgttttctgtattgatcgacctttgaaaacacttgctttttgatctccaggttttcgacaacaacttcaataatccagtcggcatctttaatcttttcaaaatcgtcttccatgttccctgtgctgatacggctgatattcttctttgaagtcagcggagccggtttttgctttagcagcttttgtacggctgtccgtgccagccgattgcgcacatccgggtcttcaagggtgcggccttttttcctttcctcatctgttaattcatgcggcaccatatcgagcagtaatacaggaatcccgatattggctaagtgagccgcgatgccggaacccataacaccggaaccgataacggcggcttttcgaatatgcttgaccatgaaagatcctcccccacctttgaatgaatactcattcatttttactccaaaaaaataaactctcctgtcttctttcatcttaaaagattttggaagcgagttcaataacttggtgcaaaatttctgaatttttttcatcgggtatgatcttgccgtgtttacatgtttccccgcttttgggacaaaccaatagagaggaggtgaaggccttggtacgtgaaagaaaaaatccatcttctgccgcagtcagcgccgcaagcataaaaggcaatgcaggtccggattataaaaagacggatgcgggcggtaaacggacaagccaaaaccagcaatataaaaagcataatatggatgttcctgaagatcactaagcccctttaagcatccggtataaatttccgctgtgttaggaaatctaaaaataaacgctaaaaggaggcagacgcatgcagcagcaaggaatgacaacaccgccgccggtcatttcaacgaaggaccatctgtatttgcaggatatgctgaactggaacctgctcgcgatgaaaaaagcgcattttatggcggatcaatgccaggatcagtctcttaaacagaactcgacagggtcggccaatgcaccatcaccattacaatatgatattggagcagcttcgtcaaaatcaaacgcaaaacccgtcagcatacatgcaataggaggtcaatgatgaatcagcaaaaccaacagaaaatcggcaatcaggaaacccctgtcccaaagacgagcgcgatgaacgacagggattttgtcaacgaactgctgacaaccgaaaaatatatgacgtcagcatactcgacggcgcttaatgaactaagccatgaatcgctttaccaggccgtacagccgctgtttaacgaggcgcaaaacgctcagcgcagattgtaccaggtaatgtttcaaaacggatggtacaaggtggaggcagaagatgcccaaaaaatccagcagtcctatcagcagttccattctacactgcaagaccagtcgccttatcagcaaaatcaataaacaaaaaataagcagaggaatctctctgcttattttttctgattagccgcccggtgcgcttcattacgttctttaatctggcggattacttcttttatcccctgcttcgcatccggataagctccgttccaatgcttggcgaggggcggcatgcttttggcgatatggctgtagatgatccacatcttcacctgttctttcagttcttcgtccgtttcgcccaaaagcagttccgtatatttctcgaccagtccgtccagctgctccctgagtttttccactcacgacaccctttctttatgtttatttctcgggcatgttctgcatttgacgccgttttcgtctgttgcataatacagacagcaagtcgtgcgtgtccgatcctccgcatgctgtccgggataaaaccttttgagagggttttcgtcctcaccttcatcaaaaaggcctggctctgcttcgtaaagaagaaaacggaaatctcgcgccgcccgtgccttgagcttcggatcttcctgaagcatgtcgtacatccaatacagataaaccgcaatattttcccaaagaatgtgctttgaaatcgagaatgtctgtcgacaggcctcgatcatgccgcccaaatggcgcctgaagatatcttcggtcaattttttcagttcttcggtgcggtccccttcgataagctcagcacctttgtgaaaataaaacgacggcgtccatccttgatcatccgcttctatctcccacgatacggaagccgggtcggctgggagccgttttccgcaaaccgtaaacagatagaaatgcagcgcagcaagcatgccgccgcgcttaacgagcattgaagccgcaactttttgattcggagcgttcagcctgtcttttatagcttctgcataacggcctaaaaaatcctcatcaaggagcatgtttcctttaacagagaataaggagccggtctgcttcgttccaaggcggaaacgaagcaatgactcaagctcctcttttgttaaattaagcatgggactgaaccacctgctggacgatgcatcttccttttccgtacggaatgcagtgcggcgtgccgaaaagcggatctttcgtcacttcgcagtccatttcaaaaacgtcctgtacaagcttgcagttgataatggattcaggccggccttcggcatatatctttttatctttaatcgcgacgaggtgatgggcgtagcggcaggcgaggttcaaatcgtgcagcaccatcacgatcgtgcgcttttcgtgttcatttaattcaaacaataggtccagaatttcgatttgatgcgtcatatccaagtatgtcgtcggttcatccagtaaaatgatatccgtttcctgggcgagcgtcatcgcgatccaagcgcgctgccgctggcctcctgacaaggaatcgactgtacgctcagccagttcttccattcttgtcgctttcaaagccctttgcacggcctcttcatcttctgctgaccattgcttcagccagttttggtaaggataccgcccctgcttaacgagctggagaacggtcaagccttccggagccgaagggccttgaggaagaatggccagctcctttgccacttctttcgtcggaagcttggcgatggagctgccttcgaggagcaccgaaccgccctttggcttcatcaaacgtgcgagagaccgaaggagagtcgacttaccgcagccgttgctgccgataaatacggtgatttcaccttttgggatcgttaagtttaactcatcaataatgattgtttctccataacctaagcttaacgtttctgttgaaatggcactcataaatgaaatctctccttttattggtttctgcttttatacagcaagtagataaagtaagggggcgccgatcgcggcggtaaacacaccggcaggcacttcaacgggagaaaaaagcgtgcggccgatgatgtcggcaatcagcacgagcaatcctccgatcagcgcggcaaccggcaagagggcgccgaatgacgatccgacaagccttcttgcgatatgcggggccatcaaaccgacaaaaccgacagttccggcaaaagcaacggcgattccggcaaaagcagtgctcagaagcaggagcaaaaagcggtttcgctgaaccgagctgcccgctcctgtcgccagttcttcgccgagcgtctggatattgacgtttctggcggcggctgccgatatcagcaaaaggacaagcgcagccggcaataaaacgttcacatcctgccagttggagccatatactgatccggtaatccagacgttcgcctgggacattctgtatatcggtccttttatcataaacaatgtcgtcagcgactgggcaagcatcgaaaatccgattccgatcaaaacgagcctgaaagttgaagagccgtttttatatgaaagaaaataaacgagcattccggcgagagccgcgccgataaaagcggcgaccgggagccagctgatgctgaccgtaagcgcattatttttattggaaaacagcattaaaaacaagacaacggcgactgaagccccgccggtcacaccgataatatccggcgaagcgagcggattgcggatcagaccctggaggatcgatccggctgccgccagacagattccggcaaacagagcaaccaaaatccgcggcatcctgaaggacatgatgatcaggtcatcgcccggatcccccatgcccaaaaacgttttcgcgacggcgcccggagaaataaaacgttcgccgatgccggcgctgaggatgactgcacaagccgtcaacaccaataggatcacgaatgaaaacagcgcttttctgccgatcaacaatgaaatgccgccttttccgattctcagcgtgcggtaatttttcatttttggaacccccttctcgcgatatagacaaaaatgggtgtcccaatgatggctgtcatgacgccgacaggtacttcttcaggcatgatcaggtaccttgcgccaatgtctgcggtaacgagcaggatggctccaagcacggcgcagtacggaagaacccagcgatggtcgtgcccgacgataaatttagcaaaatgcgggatgacaatgccgataaagccgatcggcccggccacggcgacagatcccccggctagcaggacaatcgaaaccgccatcagcgctttaatcagccacgttttttggccgaggctttttgccacttcctcccccattgttaagacattgattttggatcctagcaaaaagctgatgatgaatgccggcacgatatatggaagaacggagaccaagaggctgaggtcgcgcccctggacagagcccgcaagccaaaacagcgcctgctcaagggctgcttcattaacggaaagcatcccttgcgtcaatgatgagaacagcgctgacatcgccgcccctgcaagcgtcagcttgaccggcgtcagcccttcccttccgagagagccgacaaaatagacgacaagcgcggcaaacgctgcaccgaaaaaagagatccatgcaatcgtctgaagcgaaccgacgtgaaagaaaaacagcgctccaacaacaaagaaaccggcacccgcgttcacgccgaaaattcccggggaagcaagcgggttttttgtcatcgcctgcattaaagcgccggcaaccccgagggaagcaccgacagttgcagcaatcagcgcgcgcggcaaacgcacgtttttgatgacaagatgttcattagagccgctgaagccggtaaaagccttgtaggccatcgaccatgacgtattcgtataaccgtatacgatactggcgcaaacggcggcagccagcaccaaaataaaagacagtagtgcgatcgttctatatttattcgttcttaagagcataaattaaaattctcctagtttgactgaaacatctactggtaattgtatcagataacattgatcttgaaaatcattttcaattaacaattgacaaaattctgatcaaaaattatgatcaggatgaatgacttacatacctaaggaggacacacatgaagagatggtcaattgttggatttatcgctttgttagcgatttcaattcttgcagcctgcggcggaggcaaggatgactctgcaaagggcggagaaaataaagatacgatcaccgttaaacacgcaatgggtacggaagaccaagtgcctgcagacccaaaaagagtcgtcgtcctgacaaatgaaggaaccgaagcgcttttggaactcggaatcaaacctgtgggtgcagtcaaatcctggacaggcgatccttggtataagcatattcaagccgatatgaaaggcgttaagcaaatcggactcgaaggcgaaccgaatatcgaagcgattgccgagctgaagcctgatttaatcatcgggaataaaatgagacatgaaaaaatctacgacaagcttgaaaaaattgctccgactgtcttctctgaaacgctgcgcggcgaatggaaagacaacttctccctctacgcgaaagcggtaaacaaagaggaaaagggcaaagaagttttagaagatttcgataaaaaagtcagcgaattaagcgacaagctcggcgaccagaaaaagaaacgggtgtcggtaatcagatttatggccggccaatcaaggatttactataaagattctttcccgggaattatcctggatcagctcggattcaagtatccggaaaaacaggaaaaactgtttgagaaacaagacgacaaatttgtttttatgacggaaaataaagaatcgatccctgatatggacggagatgtcctgttctatttcacatataaacctgccgaaagcaaaaaagaagctgaaacatggcaaaacgattggacaagcgatccgctgtggaaaaaattgaacgctgtaaaaaccggaaacgcccatgaagtcgacgatgcgatctggacgacggccggcggcgtaaaagcagcgtatctgttccttgatgacatcgaaaaatactttttaaaatcttaagcaaaaaagagcatttccagtttggaaatgctcttttgtttattttccgttatagattctggacgtgccatcaggccatttcacccgcagctgaaaccggtcatattgttcgtcaagattgaaggcctcgagcacattgctgatcacgtcctgctctggatcggatttggcgatcgaaagctcgcttaaaaccattttcatttcgtttaaagcttcctccccttcgcggtccgctccgttcagatagtctttaatcgatgcttcttcccgctcctgtttgtcgtatacggcttcaaacgtattgtgctttccatggccatagttcacttccaatgcaaatgcagcgtaaggcacgcttttcacatctgaaacaggggcgttatcgggaacggcctccttgccttccgcatgttcttccgctatggagccgcagccggtcatcaggatcaggacgagagcgataacggccatccgaaattgattcatcccgttcatctcctctatgcacattatccttagctatgtccactttgcggaaactcattcaatctaagcggaagcatttatgtcatcgctaaaaatgcttctgcatctcggacagccggctgaatggccgcttcccagaaatcccgcttcgtcagatcggcgccgagatgcttcatggccagttcttcaacagacatggaggctgtatcttttaagagagcaatatatttttcttcaaatgccgcaccctctttcagcgcttgcgcgtaaatgccaagcgaaaacaagtagccgaacgtataaggaaaattgtaaaacggaacagacgtaatataaaaatgaagctttgatgcccaaaaatacggatgatactcgccaagcgcaccgcaaaacgcttctttctgagcttcttccatcagttcgttcagccttccggcggatacgacgccgttttttcgttcatcgtagaagcgggtttcaaataggaaccttgcgtgaatgttcataaaaaaggcgacgctccgctgaaccttatcttccagaaggacgattttttcttcgtctgaaccggcttgttttaacgccgcatcggccacgatcatttctgcaaaggtggacgccgtttccgccacattcatcgcatacgccctgttcagcggcctgacgtccagcatggattcctgatgaaaggcatggccaagctcatgcgccaaggtggaaacgtttgactggcttcctgcaaatgtcataaatattcttgattccccgctgtcaggaaaattggcgcaaaagccgcccggacgttttcctcccctgtcttcagcttcaacccatctgtctctgagcgccttttcagcaaaggaggagagcttttttccaaacgttttaaactgcccggtaataaaagcggctgcctcttgatacgaatattcctttgctgctgaaccgatcggcgcttcgacgtcataccagctcagtttatccagtccgagcaaagacgccttccgggaaagatagtctgcaaacggctttttatgatcaataatgacctgccacatgacatcaagggtttcctgcttcatgcggttgatgtccagcggttctttcaatacattgtcccagcctctcgcctcatagacgttcagtctgaaaccggcgaggtgattcagcgtgctgctgagcaaatcagcgtgctgttcccagccgtggtccaaattttccgatacggagcggcggatctttctgtcaggtttagatgtcaggttctgcgcctgtccgacagacagaattttcgtctcgccatcttcttcatacggaatttgaatttggtcgacgatgctgtcgtacatatcgccccaggcatgatatccgtcaacagacaagccttgaatcaatgtttcctgttcggaactaagcttttccgttacccgctctcttctctcattcaaaatataagcgatatcggaaatgctttcatcttgaaggatcgcttcccattctacatttgggacaacggcaaatttgctgtcaagcacgaccagcgccttctgcgcatcggcagcgagccgggtgacctcaaaattaagggcattcgcctttaaatccgcggtgtcctgggcttggagacatccgacaaaagcgtctgcttcgcggattttaacatcaattgtttcaaaaagcgccagcgtttctttcaattcatcaaggccgctttttgagacggtaagagcctcggccgaacgtttaaaagttgaaagcagtgttttaatctcatttaaatattggcggaattcggcggagccgctcccgcctttaaagaaaacctcgagatcccacgtatccttaagttgatgaaatgtcattgttcccgtcccctttcattggcttgtttccattataagataaatttgccttttcagggcaaataaaaaaacggccggcttgtgagccggctcgcctcttcccttatcatattacagctgcctcatccgcttgaccgcatagctggccgtcaataaaccgattaggccgaacacaaataaaaacaatccgcctttactttgcggttgaccctgaatagcatctgtaccgtttgtcatttccgcgctgaatggttctgcgatttgcagggcttgaagcagcctgccatcctcccctttaatgttaaggattccgtccgtgtctacattttcactcagaacttcgcctttctttttcgtaacgtataaagggtccttcagttcatggctcgtcccgttctggtccgtaaacgcttctccctttttgagttcttgtgtttcgaaattgtgaaatccctcatccagaagagcttttgtatcgctgtacatcattttcttgctatctgccttcatgacgaccgcaattaaatcaaggctgccccgcgttgccgtcgtgacaagggtatgctttgattcatccacaaatcctgttttgccgccggttatacctttgtaaggaatctcacccgtcagcattcgatgatggtttttaagcgtcgtgtcccatgtctgtccgtgccaatccgtttgcttttccgaaaaaagcgctcggaacgttttgtttttcattgcgtactcagtaattctcgccatgtcggcagacgtcgtataatgatttttgtcaaacagcccgtgaggattcataaaatgagtgtcatgcactccggcatgttcggcaataaacgcgttcaaatcatccgcaaactgtttcacgcttccgctgagatgttcggcgatcgccgtaccggcgtcatttcccgaattcatcagcagcccttggagcagccgttttaatggaaccgactccccctcttccagatatacgcttgatccttccgtttgagcggcatttttgctgactttcacacgatcttccaaatttccgttttctattgcataaatcgccgtggcaattttggttatgctggctggatacatttttttgcggctgtttttttcatagaggacctggcccgatttcccatcgatcaatatagcggaaacgcttttgatttccggtttgtttttttctcctgcttgagccgagctatgaaaaaacagcgtcagacatagtacaataatgaacaggagggatcgtttaacattcatcgtgtcaccctgccttctttctcttttgcaatttttataaaaataggtcttttagcactttttaaattttaccaatgatgaactgtcgctgacaagccttttcttgtcaacaagccaaaattttgaatggaggaaactcattgaacaataaaatcgcaattgtaacgggcgcgacgagcggatttggtttattgaccgctttaaaactcgcaagcactcatttcgtaatcgcaacggcgcgccatccagaaaaagcggaagctctgcggaaccgtatagcggagctgtcgatcgagtcatcgattgccgtcgctgaacttgatgtcacaaacgaacaatcgatttcctcattttccgaagagctgaagcagtacggacagatagacgttctcatcaataatgcaggaacggcatacggcggattcgctgaagagctttctcttggcgactacagaaaacagtatgacaccaatgttttcggcctggtggcagtcacaaaagcggtccttccttatatgaagaaacacagcggcgccaaaatcatcaatctgagcagcatcagcgggcggatcgctttccccgctttctcggcatatgcttcatcaaagcatgcagttgaaggcttttcagaaagcctccgcctcgaactccgtccattcggcatcaatgtggccgtcgtccagccgggatcgtaccagacggcgatttgggagacatcgtttgccgcccaagtcactgcacctgatgccgaatcacagtacaaaacatatttcgagcggatctccgcctacattgcagcgagccgcaaacattacggaaacccggatgatgtggctgaattgatctgccgactcgctgcaaaaaagcggctgaacaggctgcgctatccgatcggcaggggcgtccgtctctcgatccttctccaccaaatcctgccatggcggatttgggaacgtgcggtcataaaaaaattgcttaaatgaggtaatttaaaataattataatttagtattgattttaattttgtatttgttataatataattaacaaatgaaaaacacgaggaggaaatatcatatgatctctcaacaattaaaacagcaaaatcctgtacttgaaaactcaatgaatacgaatttgtcaaactggttcatcctttacacgaagcttcaccgttttcactggtacgtaaaagggccgcagttctttaccctacatgaaaaatttgaagagctatacaaccatgcgtcagaaacagcagatgtgatcgcggaacgcttgctggccatcggcggacagccgctcgccacaatgaaagaatacattgaccacggcacaattgaggaaaacggagccgaaaaaacggccgaagaaatggtttccgcactggtaagcgattaccgtcaaatccgcgatgaaattcagcataccatcgaacttgcggaagataaatcagatcattctaccgctgacctttatatcgccctgacagaggaaattgataagcagatttggatgctttcttcatttttggacaagtaatatgaaaaagccatggcgtttgccatggcttttatttatgatttgcttttcgcaagttttgctttcattgttgtttgctttccgtttctcagcacctcaaatgtgacagtatctcctgcttttgcttctgtataaagaatttttctgaggtctgaggtggtttcgacgtttttgccgttcattttggtgatgacgtcgccggctttcatacccgcgtctgccgcaggcgatttcggcgatactttatcgatgtacacgcctttattaagctggtctccgaataggccgagcgtattttgctggtactgttcaggcacctgctgcatatcgatcatttgcacgccgaggaaaggccgttccactttccctttttccaaaagctcgtcaacgatcggctgaacatcgttgctcggaatcgcgaagccaagcgattcaacaccgctttggctgatcttcaggctgttgatgccgatgacctgcccgctgctgttaatcagaggcccgccgctgtttccagggttgatcgccgcatctgtctgaaggacgttcatatcccaattcccttcagatgttgagacttcaatcgtccggttgacaccgctgatgatgccttctgtaaccgttcttgaaaattgaaggccgagagggttcccgatcgcaattactttttcgccggcgcgcagttttgcggagtctccgaaacttgcaaccttatcaacgcctttgctgctgatctctaaaacagccagatcagtcaaagcgtcgctgccgataatcttggcatccgcggtctttccgttgtataaggagatggtcaccttcgaggcgccttcaacgacatggttgtttgtgataatgtaggccttgccgccgtctttcttaaagatgacgcctgatcccgtgccgctctcctccacgtcgtcttcagagaagccgaagctcgtttgaatatttgaaactccgacgatcgcaggctccaaatcttccaccatatcaggtacgttatctgcgttcgtgacaggttttgtggtgaaattctgcgactgctttggctctgtctgtccggttccggcagtttcgctcggatgatcgcccggcagatacggggagattccaagcaccaagccgcctccgatgatcccgcccaaaatcgggctcagccacgaagccttgcgccgcttttcttttgccgctctcgtttccctggcatcttccagggctgcagcggtttctttattcgtaagatctgactgatcgtctgtatccttctttaaaatcagctcgggctcctttgccggctgttctgactgctgctcctcagaacctgccgtttgcggcgtctgcgcttcttcgtgaaactgctcttcatttgcatgtttttgttcgtcatcgcgtctaaaatccataagcgtacacttcctttatttttcttgtcttcaactatcgcaaatggcattaaagctttaacatccacaaaaaaagagacccggccatcgttcactctgttttcattccctttcttccctgatgaatatgttacgaaaacattgtgggataaaaatgaaaagaatatgtgaaattatgaaaattgaccagacttatgttaaaactagtataatgacgtagaaaggatgtgaaccgcccttgtcatactccatttatctagttgaagatgaagagaatttaaatgaattgctgacaaaatacttagagagtgaaggctggcacgtcacttcttttctaaacggtgaaagcgccaggcaaaaaataggccagtcacctcatttatggattctcgatatcatgttaccagatatcgacgggtatacgctaataaaagaaataaaaaatcaagatccggaagtccccgtcatttttatttctgcgcgcgatgccgacattgacagagtgctggggcttgaactgggcagcagcgactatatatctaagccgtttctccccagggagctgatcatccgcgtgcaaaagctgctcaagctgatttataaagaagaaccgcctgagaagaaaaaaggaacgccggtttcctgctatgaagtctatgaagacttgagagaagtctatgaaaatggcagcatgatcaatttgacgtcaaaggaatttgatcttctgcttctatttataaacaaccagggccgcgccttttcaagggaggatattctcaccagcgtctggggagtcgattacttcggaaccgaccgcgtcgtcgacgatcttgtcagaaggctgcgcaagaaaatgcccgaactgaaagtggaaaccatctacgggtttggctacaggatgttgaaatcatgaagaacaggtcgctcgcctttcaaatttggagtgtcatttgcggcatcctgttaacggtctcgattttgctgacgtttctattctcgacgacactgcagaactttttcactgatgaaatttatacaaacattgaaaatgagcagcatgttctgacggaatacggattttccgattcaccggaaagaggcttcggcggaagcagcggctcgcgaagcacaaaccgccacgttcagcacgtcctgctgcctgagaaaggaaccgtctatcagagcccgcagattctccccgattcatttatcgagaaggtgcagaagctcgggaaaaggcaggacgagtcatcgaaaaggtattcggagaatgtcaacggagagcacgttttctttgtgctcaaaaaaatccagacccaggaccagacgtttctgttgttatcctatgcgcttgattcatacagggacgatttgtctcatacgctgtttaagcagctgctgtttattttgatcgtcgtcattttgctgagctggattccttctatttggctggcgaaatatttatcaagaccgctcgtcacgcttgaaaagcacgtcaaacaaatctctaaacaggattgggatgatcccgtgattgtcgacagggaagacgaaatcggcaagctggggcacaccattgaagacatgcggcaaaagctcatccagaaagatgagacagaacgcacgctcctgcaaaacatctcccacgacctgaaaacgccggtcatggtcatccgcgggtatacccagtcgatcaaagacggcatctaccctaaaggagatttggaaaacacgattgaagtcattgaaggcgaagctgaaaaacttgaaaagaaaatcaaggatcttctttatctgacaaagcttgattatttgctgagacaagaaagacagtacggaacttttgatatacaagaggtcattaaagaagttgttgaacgcttgagatggtccaaaaaagaattgaactggaagattgatcttgaagaggaaacaatgttgacgggcgatcaagaacaatggagcaagctgttggaaaacgttcttgaaaaccagatccgctatgcggagacattcattgacatcagcgtcaggtcgacgaaagaacatacgttgatcaccattaaaaatgacggaccgcacattgaagaagagatgctttccagcctgtatgagccttttaataaagggaagaaaggcgaattcggcattggactcagcatcgttaaacgaatcttaacgctccaccatgctgacatgaccattcggaatgatcaaaccggtgtgtgctactcaatatccgttccgagaaattagactgtagacgctgcagtcttttttcatataaacgaatagccgttgaaatcccggtagctcggcttcactgtgttttttggctttttcatccatttcttttcgcacaggacgtgctttggatatttaactttgtccaccttaattcccctgctgcgcaggcgcctgatcatgtcatcgatttctttcatcaaccttcaccctttctccgcaaattttgaccactcggtcaccttactttataatataaataatatcaaacaaaaaaacaagttacaatctagttaaaaatataacggagcaaaaaaagtgacccgccagtcaccccggtccgccgaaagccgcttttgggttcgatctttcaggaaggtgaaagctatgaaacaaaaagagaaagtcattattgaaacagccatcaaacttttcgctaaaaaaggatacagttctacttcagttcaagagattgcaaaagagtgccaaatgtcaaaaggcgctttctacatttattttaaatcaaaagaagcgctcctcctttcagtccttcactactactatgaaagaatctttacccgaatccagaaaatcaaaacggagcatgacaatccgcgcgatgtgtaccggatgcagctcgtcgtttttttcgaaaacattttggagcataaagagtttatcacgatgcagtttaatgagcggtcgatgccgatcaatgaagaaattgaggcgtttgcgaaaaaaatgcggagaaccacgctcaggctgcacatcgaaaacatccagaacatttacggcaaagacattgaaccgtacagcgccgaactgtgctttatgatcaacggaatgagcgatgtctaccttgagctgatgattttgctgcaccattcgttcgacctgcagtctctcgccgaccacatgctgaaccgcctcgacgatttggcgaaggggatgatcaagcgcaatgaccagccgctgatcccattcgaaaaagcagacgagtggttcggcccattttacacatttgatccgctgaaggacgccctgctcaatgaaatgcgcgtcaaagcgaacaagcagtacaacggcgctcctcctgcagaccttgccgaaagcctggatattctggagaaagagctgagaaaagaaaaacgcaaaaacgccattatcaaaggcatgatagccaacttgaaggaatatcccgcgattcgaaaagaaacggacaaactcgccgaattgctcaaaaaagacatgcaccatccgcacggatgatccgcaaaacaaaaccggctgcaatgcatgcagccggtttgttgattatgctttcggtttcaccatttcttcaggtttaacaacttcgtcgaactgctcctctgtcaaaaggttcagcttgagagccgcttctttcagcgtcagcccctctttatgagccagcttcgcgattttcgcagcattttcgtatccgatatgcgggtttagagccgtaaccagcatgagagagttggtcaggttcttctcaattgtttcccgattaggttcgattcctacagcacacttgtcatggaatgaattcatgccgtcggcaagaagctgaacggattggaggaagttgtaaataatcacaggtttaaagacgttcagttcaaagttcccctggctcgcggcaaagccgatcgttgcgtcattccccatgatctgggatgcgaccattgtcagcgcttcgctttgcgtagggtttacttttccaggcatgatcgagcttcccggctcattttccgggataagcagctcgccgattccgcagcgaggtccgctcgcaagccatctgacatcattggcgattttcatgagatctgccgcaagcgctttaagcgccccatgcacgtgtgtcagttcatcatggcttgtcagcgcatgaaacttattaggcgagcttttgaatgtctgcccggtcagagcgctgatctcttcggcaacggtgctgccgaattcagggtgggcattaatgcctgttccgacggcagttccgccgatggcaagatcgcggattttttcagcagcttcaagaatcatctctttagagcggtccagcatgtatacccagccgctgatttcctgtcccaatgtcagcggtgtcgcatcctgcaaatgagtgcggccgattttgacaatgtctttgaaagcttcagctttttcatgcagcgtgcttctcaaccggtcaatcgccggaatcagtttatcgtgaatcgcgaggacagctgccacgtgcatagctgtcgggaatgtgtcgttagagctttggctgcggttgacatcatcattcgggtggattttcaggcttgatcctttttcctgcaaataagccgttcccctgtttgccacaacttcattcatattcatgttgctctgtgttccgctgccggtctgccagacgaccagcggaaaatggctgtcatactttccttctaaaatatcatcgcatacggaaacaatcgcttcctttttttccgcctcaagatttccaagcttttcattggcaatcgcagcgcttcttttcaagattgcaaacgcatacacaatttcctgcggcattttctcggaaccgattttaaagttctccttgcttctttgggtttgggctccccaaaacttatccgcgggaaccttgacttcacccatcgtatctttttcaattctgtagtccactttcttatcccttccttctctaattctgcaatattctatatttcgataaaaatcgataaaacccttccatttaaattttatctttattttaattttagctcaatataaacccgggtatcttttgcatatttatatttcggatttgttttaccgtattctttcgatacatatgaaacctcataatgcttagaaaaagattgaataatgcgttcaatctcctccggtttccccgtaagcctgatttgcgccaactttctcactccgtctctgttcaatgaaaatttcgccaaacactactgtaacacagtatattgtttttttaacaggaaaagataacctatacaactccagaaacaccagggcaggtgacgatcatgactcaatcggaattcaaggaacacatccatgaaaatctcgcaatgctccttccccatctcgagcataacgatgatctgattcaaaataaaaaaatgctgaaaaacggaatcattttttactttttgtactttaaagatttgaatgatgacaagaaaatccagaaggctgcgaaattgcttgtctccgatgacagctcctattcattggaggatgtccggctccgcttaaacaagctgaatgcggaacccgttacagcaaaaaaggacgcgattaacgcaatcttcaaaggaaaatgtctgctgttgatcaacggtttgaatactgtatttgcactgccgacagctgagaaaaagaaaagaagccttggagaagtgaatacagaaaacgtcgtcagaggcccgaaagtcggttttatcgaggatgtcgatacaaatgtggctctagtcaggcagcgtgtcccggataaagaactgaccgtggaaaaaatcccgctcggcaagagcaagtttaaagacgcgaccattctctatatccagggcaaagcggacgattcgatcatcaaagatcttaaaaagcgcctgaaaaaagttcagctggatgatattcaagataccggcgttcttgaagaattaatcgaagataataagtactcgccgtttccgcagatccagaataccgaaagacctgacaaggtttcttcagcgctgtttaatggacggatcgcaatttttgttgattactcgccatttgccctgatcgtgccggcttctttcggaatggtgatgcagtccccggacgatttttacgaaagatggatcgccacgaccttgatcagatttcttcggttcagttcgattttcatcaccctgttcctatcggcgttttatatttcgcttgtatcttttcatcaaggcatgctgccgacggctctcgctgttacgattgcgagcacgcgcgaaaatgtgccgtttccgccgctccttgaagcgctgattatggaagtgacgatcgagctcttacgggaagcgggactgcggcttcccaatccgctaggccagacgatcggcctcgtgggaggcgtcgtcatcggccaggcggcggtcgaagcaaatatcgtcagctctgtgatggtgatcatcgtcagcattatcgcccttgcttcatttactgtgccgcagtacggcatgggcctgtcgtttcgcgtgcttcgttttatttccatggtggctgcagccgtgttcgggctttacgggatcatattgtgcatgctcgccatcttcacccatttggctaggcaaagaagcttcggcatcccgtattttaacccgaaccattttttcagcttaaaacatacggatgaagccattattcgtctgccaacaaaagctcgggaggtgaaccgtaaaaatggatccaaaaaatcagcacgatcggattagcacgtatgaagccgcttcgatcataaccagcacaatgctcggcgcaggcctgctgacgctgcccagggcgctgacgcaaaaaacgctgtcgccggacggatggatcgtattaatctttgaggggcttgtcttttttctcattatctacatcaatgcaaaaatcgttaaaaaacacaacgtcctgtctttttttgattacacaagagaaggctgcggctttataatcgggaatattctcaacctgttaatcgttttatacttcatgggcgtggccagctttgaagccagggcgatggctgaaatggcaaagtttttccttcttcagttcacgccgatgagcgtgacgattttcgcttttatcgtctgtgcaatttatttggttgtcgggggtatcagcgatatgtcaaagatattcccgttcttcctgtccgttaccattgtcattcttctgatcgtctgcggactgagcctgaatatgtttcagctgaaccatttgcggccggttctcggccttggtttggagccggtcagcagagctttgacggtcgtttccatttcatttttaggggtggagctgatgatgtttctgccgaaatacgtcaaaaacaaagaaaagctttttaaggcatcggcgattggatttgggataccgctcttcttatatatcctcacctttgcggtcgttgtcggggcgctgaccgcgactgaggtcatgacgttgacatggccgacgatctcgttgtttcagtcttttgagataagagggattttcatcgaaaggttcgaatcgtttttgctcgtcatttggacgatccagtttttcacaacgtttgtcgtctatacgtactttgccgcttcaggacttgaaaacgtattcggatggcctgtgaaaaaaaacgtcctcttcatcggcgttgtcatctatctagcatcccttgtcccgcgggacgccaaccaggtcagcgccttcagcgactaccttggatatatctttatcgttgtcttctgtgcacttccgcttatgatctttttgctcgtgtccatcaaaaggaggtttacttcttcatgaaaaaaaagggaatgttagcagccctttctctgcttctccttttaacaggctgctgggacagcaggcagatcgaaaagcttagcatcgccatcggccttgccctcgataaaggcgaggacgataaaaacgtgaaattgacgtatcagtttcttgttcctaaaaagatcggacaagacggcagcgctcaggatccgtctaaagtggtgtccacctccggaaacacggtccatcaaaccatccgttccaccgctttgaaaaatttcccggtattctcgcagcatctgcaagtcctgattttctcagaggagcttgtatccgatatttctctggaagcattgatcaatcaatttattagggacaacagcatcagaaggagcagcgaggtctatatgacgcccggagctgccgacagcatactgaaggttgatggtgcaagtgaccctgcgtccgacgtgatccacagcatctctgaaaacagagcttcgacgatcaagctgctcaagcccgtcacattgaacgatatttcgattaaaatgcagtctgatttatcttatatcatgccgaaggttgtgatcgaaaaaggacagcttcagcttgaaggcggcgccgtgatcaaaaacaacaaataccatgcaaacctttcgccgtctcagatcgaagcgctgaatttattaactggcaatgtcatcggcggagtgatcgactcaaggcatgatggacatttgttctcgtatgaagtgttttcgatgacccaccgcgtgcgggcgatgaggcagaacggaaagtacaaattcgtcgtaaatgccaatattaaaggaaggctgtcagaggactggtatcttggagaggattcttttaatgaccaatatataaaaaacatagagaaatcggttcaaaaagacatcaaaaagcgggttgagcagctgatccatgtcctgcagcacgatatcaaaacggacgtcaccgatttttccgacaatgcgcggatcaattttccgaaggagtgggaaaaagacagattcaattgggacaaacacttcagcgaagcctatatcgactatcatattaaagcgacgattcaggactttggaacaaaaggtgcgacaaaaagcagatagcgccccgtttttctgatagaatgtgtttgaaagggtgatgagcttgaagcggatattgcacatgacaggcatttttttgattgcagcggcagtcattctgtccggattcattatcagtgatgtcgcctatgatccgtttatggaggattcgcagtcgatgcttttcttcacgatcggcacatacctcaccactccgtttttttgcttcatcggcggattcattttgctaggcatcggcaagttgatcgacttgcaggagaaacacaatgccatagtggccgagcggctcgacatcatttgccaaaacggtacagcgggcgaacatgcacgcgaagaaaacgaggccgcccaacttaccgcccgcacggttgaaacagattcattcactcttcctgcagccgaggatcgaaaatattggaacggctgaaaaacggctttcttgagaaagctgttttttgtttgatcagtcgacaagtttgtttcggtgggcgtagattgcggcttgtgtccggtcgtcgacttcaagcttggaaaggatgttcgtcacatgcgttttaactgttttaatggtgatatataattcttcggcaatacctttgtttgtcttgccctctgctacaagtttgaggatttccaattctcttgccgtcagcgattgatgaaggggctgttcgccggctgaatgtctcagcttggacaacacttttcctgcgactttggcttcaagctttggttctccgacgctcgcagccctgatcgcatcggcgatttcactcgctttcgacgttttcagcaaatagctgagcgctccggcttcgatgaccggatagaccttgtcatcatcaacgaagctcgtcagaacgatgattttcggatcggcaagctgccggcatatttgtttcgtggcctcaattccgtccatcccttccatcacaagatccatcaaaatcacgtcgggtttggtttcaagcgccaattcaacgccgcgctttccgtctgatgcctccccaatcacttcaatatcaggctgggattccaggaaagcggccagccccattctcaccatttcatgatcatcaattaacaatactcgaatcaccttttaagcctctcctttttgttgttcaaaaatcggaacctttacatcaacctgtgttccttttcccgtaaatgaaatgatttctgccactccgccgacttcgctggctctttccttgatcgagttcagcccgtacgaagatgttttgacggcatccatcttaaatccttcgccattgtcaatgactttcaactggagctgtttgttcctgagcagcagtctgacggtgacttttgtcgcttttgaatgccggaacacgtttgagagcgcttcttgaacgatcctgaacaggtggtcttccacacctttcggaagtttgcccgcatcctcaatctcccaatcgatgtcgatcgactgtttcgctttaaattctttcaaaaggtctgcaagcccttcttgtagacctttcccttcaagcgtaacaggtcgcaaatgcaaaaggagcgccctcatttcattctgggcatcggccgccattttttcgaccattttcagcctttgagcgagcttttcatcagccgcagcatcgattccctccaaaacagctgaagtcatcatggaaatcgcaaacagctgctggctcaccgcatcatgcaattcgcgcgcgagacgctgccgctcttcggagatcaccgattttttcatttgatcctgccattccgctctctcattggacagcttttgcaaagaggcaacctgtctttcgatccgttcggccatctcattgagctggtcggcggccagcccgatctcatcgtctccaagcgatggaatccggtaggcaaagttgccgttttcgtactttagaatagactcgatcagcttttcaagccgttttttcagctgattgccgaacatatagcctgagccgaacccgacagctgtgctgatcaatgcgagaagcgcgataaacggaatcccgaaccacctggaaacgatgagcaccctcggatccagctggtaataaaacagcataaagcccaatacagcaagaaaaatcgtaaagctgacaccaagggataagcggacggcgcgccattgaatgtttgcaagtctgttcgttctcatatgaaccgcacatccacatcgccgataaacagcgaaatcgaaattttgacccgtcgtgccgactgctcgtaattctctgtctcggaatagatttgattgccgatgccgctttttcggccgccgatgacgtcaatgtctccaacgaatgcagaagagctgatggacacctcaagatcggacggaatgtaaatatcgacatctccgatcaaccccgtaatgacgatggtgttttcgccctctgaaataatcgcctttgacaaatcgattttcacgtcaccgataaacccggagatattcaagtcatttaagtcaaaaggtgttttcatcaattttacatcaccgaaaaagaagctgcgctggccagggctgttcttctcctgaagcggcttgaaatccgccttttcctttcccctgtctttcggcttatggcggtcaaataccggctgatttgtcaccagccggtaccccgcataaattaagaaagcggcaaagaaaaagccgaacaggctgaatgtaatgctgaagatgtctttcagcagcagaaagcctgcaaaaatatacatgacagacccgagccagcggcgggaatatttgtggagaaaatacccggcaaaaagaaaagcgagcggccagaataacgcgtctccaagcccgctgttttgcaaaaatatgctgattccgaagagtacgatgatcagtccgatcagctggttttttgtaagacgcatgctgactcgagccccctttcttcttgtcgattactcaattgagacattcccgctcgtaattgagatgtcgattttattttttccatttcctttttttccagtcagcgtccgcttctcattggcgacttggtcaaatgaataggaatgactgatgtttccgcttgtcgactcggcttcaagactgatgtcggcatcatcgggcaggctgagcttggtgtttccggatgtctgtttgatgctcagagaatcgttgatctctgtaaaggaagcgcgcaaattgcccgaagtctgtttgatgctgagtttgccggtgacattttcaagttttgtattaccggatgtggagcggatatcagcagctgccgtttgaacgttttccagcctgaccgatcctgacgtcccttttacagaaaggtcttccgcctgaaggtcatcggccttgaggctgccgcttcccgactttaaggctacatttcgcaaatgcagaccgccgccggacagtttgacatttccgcttccagaagaaatcgacagatcatctttatattcagaagggatcttgacaatcagctcatttttcttccagaaaaacggccaaaagcctttcgaatgagcggaaagctgaagagtacgcccctgttcggacgaatcaagccggacgttttttcctgaaatctcggcttttatatcatcgcggttttcagcttgaatgttgactgttatactctttgcatcaatgtcaattttatcgatgtcttccgcctgtgcatgatatgtgcgggctgactcttcatcgaagccgaagaaagaaaagccttcacgcccattaaacatcatgcctgcaaggatgagaatgccggcgatgatcagcagttttccaaccgtttttttcatttagaaaaccctttcggctagtaagtgtatgctccttattataaggaaaatggtctttgaaagaaatcaaaaattgcataaggggctgtgagagcccctattcgtttatgcatttcccgcaggtgtctgcttttccaagcctgtctttttagccctcattttttccagctcttcttccacttcttttgcatattcaaggcggccgaatgggctgcttgatgaagctgataattcagcatagctgttcacccttgtttccatctcttcaatccggttttccattctcataaattcccggtaggcgctttcgctgtcgattttattaaatgatgcattcatatgttctttcgctttcaccgcgtttgccctggcgatcagcgcatgctttcggtctttgatatcgcgcagtttaacctcaagtgtctccagctgttcctttaattcagcaagctgctttttcgcgtgctggtgagcgtccttgtattcagcagctttttcttcaaaatacttcatttctgagagcgcctttttagcaagttcttcttcacccgcatcaaaagcgagctgagcctggtttcttcgcttgacagcaagcttttcggcttcttccacttttcctttaaaactatgttcaattgtctgctgcttgacgatggtatgcttcgccttggcgatatcgctttccatgtcgcgtacgtattgattcagcatcacccgtgggttctccagtttatccaatccttcatttactgatgcgacaaacatgtctctgattctttttaaagccatgatctcgtcctcctaaaatattatttattctttttcaaaaagtcttcccactctgcatcaaagcctgtgtcatatgaagctgcggaaggctccgttttctctgaataaaggatgtcatcctgtttgtcatcttgcttcatcattttccatccgaaataaaccatcgctgcagcaaccgcgatgccgatcagaaacggcaatgaccctcccaaaaacatgatgccgaagatcgcggccagtaccgcggcaaactggcgtccttccttccattttttcacggaatagaatagaagcaatgctccaatagcacctgtaaccaatccgccgaaatggcctccgccgaagaacagggagacgccaaaaaggattagaaaaaagccgatgatggacttcccatttatattcatatttgctcctcctttctcgttcatgtctttactatagtcaatttcaggcttcgacaaaacgagtcacagattgattttgccgtacgaccagggtcgtatggcacatcggacccgctcgcataaaaagaccgctcatctcagcgagagagcggtctttctgcaggttgccttgctatgattcaactttaggattccagccgtccaatacgttttcaattgtccatttctcagcctcatgatcggcaagctgccttcgggcctcatgcgaaatcgcacccggacccgtattcccgtattcgtacaatctggcatcggccgcagaaaagcccgacatatccgtccatccttcaggcttgatgtgtgcgcctaaatcgcagcggtgatatagcacactggcgatggcgtcggggtctcctcccggatgccatgggcgcccgaggtataccgttccatctgcggcatcgcttgtcactctgcagtttgttatcaataaaccgaacggctttgcgatatgcgtgctcgcagctgtcacataaccgttgtttgtagcggacccgcggtcagcgctatggatctggcactcttcaaacacagctcttgctcctccgaaaatgaaatcgacatcgccttctatatagcattgataaaaatattgtgtaccgtcattgacaaacagtgtatcttgtctgcctataaacctgacatatttgaacgtcatcctgtttcctttcgcataaaccgccaccgcttgcgtatcggtcgtgtcgactttcgtgcggtcgaacgagttttcaaacgtcaaattttcggcttcaacatgatccgcataaataaacacgcttgaacttccggtcgtgccgtatttccctcctccttccttttcttttccggcatagttgtcatacgtaatcacagtctcgtaacgattttcgccgatcagcttcacaaacggctttgtagccggaatatgaacgacttctttgtaaactccttttttaatgaatatcactttctgttcccgactgtactcaggcaaagcatcgatcgcctcttgaacggtttgaaattcgccgtctccatccttcgaaaccgtcagccgtatagcagctgcctcccgattaaccacttgaacactccctctctttgaaaacgcttacttaaagtttacgacaaaaagccgttttcccctgccggaaaacggcttgatttgatcaatcggcccgtttctgttagataacgattggcggatggctcattcatgattttttctttgtccggaatacatcagcgcttcgttcatattcgacatccacttccccgagacggtgattgacaatgcgcgccgccgcaaataaataatcggacagccggttgacgtatggcagcgcaagcggcggaatgtcttcttctttggccaaagcgacaatctttcgttcagctcttctgatgaccgttctcgccgcatgcaaaaatgatgccgcttctgttccgcccggaagaataaacttggtcagctgcggcgcttcctcgacataggcatcaattcgttcttcaagcatggtgattgattcagccttgagcttgccttcttcctgaacattgacatgcgccaaatcactgccgcagtcgaacagctcatgctggatggcggtcaactctgacaaaatatcatgaaagagcgcctcttctgcttttaaataagactgagccagcccgatgaaactgtttgcttcatccagtgtgccgtacgcttccactctaagatgatctttatcggcccttccgccaattaaactcgtttttccccgatcgcctgtttttgtatagagtttcatttcatactcctctctttaccacttgtctctatagtataccctgtttataacggctgcatagatcgtttcattatgaaacacaaatttccggaacaatcattgaaacaaagtatcgttgaataaagaaacactcgcttttataatagaattgtaaacggttttattcaaagacaggtgggatgaggatggaatttaatcagcaaacggccattatcacaggtgcaagccgcggcatcggcagagccattgcggagttgcttgcggataaaggggcaaatgtcgttatcaatgggacaaacgaagaattgctcaagtccctgtgtacacaattgaatactgagagaaagtgcgcttcttatgttgccggtgatgcaagtttgccagaaacagcctcgcttctcatcgctgaggcaaaacagcggtttgggcggatcgatattttggtcaacaatgccggcgttaatttgcgcaaaacgaccgttgatacgtcgcttgaagaatggaaaagagtgatagatttgaatttaaccggcacctttctcatgtgtcaggctgtcatcccggaaatgatcacgcagggcggcggaaaaatcgtgaacatgagctctacgacgagcaaaacaccgcatcacaatgcctctcctgcttacggtgcatcgaaagcaggcatcaactatttaacgatgcatttggcaaaggagcttgctgaacaccgcattcatgtcaacggcgtctgcccgggaccgattgaaacggatatgagcaagcagtggagcgaggagtaccgcgcagcagtcgtcgaacggattccgctgaaaatgctcggctcaccagagcatgtcgcaaacgttgtcgcctttcttgcctctgacaaatctgactttatgacaggcgaaaccattaatattaacggcggcacctatatgaactaaaaagaagagcctccttaatcggaaggctcttctttttttatgcatgccgctcacgcgtaccggacagcatgatcgcctgtctcaccgcttcttctatactcgcaggatcggctttgccggttcccgcaatatcaaaggctgttccgtggtcaacactcgtacggataatcggcaggccgactgcaatgttcacaccggcttcaaggccaagcaccttaatcgggccgtgtccttggtcatgatacatagccaccactatatcaaagtcgcctctcactgctctgaagaaaagcgtgtcagcgggcagcggaccgaatgcctgtataccttcactttgtgcgcgttcaacggcaaggacaattttctcttcctcttctccatgtccatctcaccggcgtgagggttcatgcacacggcgattttaggctgcggaatgccttcgcgaatgagcgtgtcatgcgccaattgaattgtcgttacacccgtttcgcattacgagagagtccgttcaaacgattgggacagcccctccaacttaaatcataaatgatgcaatatagggataccattcatttcatcaagtgccgcgcgcgctcgttcaaacggctttattcttgaccggcagcggcccacgtttccggaacacgtacatagtcaatcactgccaaaataaacgttatgatcgaaccgcttaagacatccacccaaactccccctttgtttgtgagcctcttacaggctcatggtgaaaaacatgtacagatccgggcagcctacatatccagcaatttcaaatagacagcttcaatctccgcaacagacatcggctttggattgttatccatgagccttttgacgtcggcagccgcctcagcaagcgatggcacatcctcttttgataccccgaatgtctttaaattttgcggaatatttaaatcggcggtccactattcaatttttcgtataacccgctctgcttggctggacttcgaaccttttggctcgattccaattacgccggccacgtccgaaaggcggtcagttacatgatccgcgttgaaggccgttacatgcggaagcagcattgaattggccacaccgtgcgaaatcttgtattttccccctagagggtaagccatcgcatgaaccgccgctgttcctgcgcttgtcaaggccattccgccatacatggcgccaatgagcattttttctctcgcctccaggttatctccatgatggtaggcctgctgaatgctggaggaaatcagtctcatagattcaagcgcaaacatgtcgctgaatggatttgctttgttggaaatataggattcgagtgcgtgtgtaaatgcatccattccggttgcagctgtgattgcctttggaagtccggtcgtcaaaactggatctaaaatcacaagcgacggcagcagatagggactgactataccaatctttaattctttctcagggaacgttacaatcgcattcggcgtcacttctgaccctgttccggatgttgtcggaatcagcacaagcggaacgccgggcttttcaacgagattcgtgccaatcaaagcagaaatcggtttttcatttgttttcagaacagagaggattttagccgcatcaagcacactgcctccgccaattcccaaaatcgcgtcatggcctccttcagaaaaaagctgaaaaacctgttcgatattttgctccgtcggctcaggctgtatatccgtgttgacttcacttgagatgcctttctttgcaagcccttctttaatttggtctgcatagccgagagagacgatcgacggctgagttaaaataaacaccgaacgaatctgattcaatccaatttgatctaagtaatcgccgagcaaattgagtgaatgtggaccagcctcaattcgggcggccgttcgaaaatgataaagcgttttcataatcttactgctcctttgccagttttgcttcaattccgtagccttccagcatctttttcacttttagcagcggctctcccgacagttctgcaatcggacgtttaggcggtccgacgtcgatgccggcaagctccgctgctttttttagcggcgccggcagtgaaccgagtgaaaacgtatcacggagcggctgcagctgctgttgatagtgctcgctctcttcaatgtttccttgtttaaaagattcatagattgaaacaacggtgtgcggaaacacattggctgtggcagccacagctcctgtccctcccgccttcaatgtgtctaagatcagcgaatcagttcctgccagaacggaaaaggactgttcttttgtacgctcaagatacgccttaatattggcgaagcttccgctgctgtccttaatgccgatgatgttcggcaatgccgccagcctttcaactgtttcgggctccaatgatacgcctgttctcgacggaatgttgtagagcaggacaggaagcgcgacattttcggaaatcgtgcggaaatgctgatacaattcctcctgcgaaggtgcaacaaagtatggcgtaataatcgaaagaacatccgctccaagatccgccatttgattgaataaagaaatggtcgcctcagtactgttttcacctgctccgatgaaaacaggcactcgtttattaaccgcttttacaactgtttcggcaatttgaagcttttcctcttgcgagaataaatgaaattcgccatttgtccctaaagcaaaaatgccatggacgcctgaatcaattagacgattcaccagcttttcggctgcgcccggatgaaaggcctgttcttttgtaagcggtgtcagtatggcagggataattccctctactttcaagtgacttcgctcccttctgttgcatttttaaacaatcaaatagtaaaacgctttctcaaatttcattataaaggtgttttgattaattaagcaacattttttaggttcggaacaaaagagtaaaatctcaccttcagctgatgcgttttaaaacaataaaaaaacctgtcaaaagacaggtcaatttaatcttttaaagctttcacacaagcggctgttttattttgaatttgtgtcaaaaaagcggtttgatccgctgaccggccggattgagtggccgctacaaggacatcactacacggaacatgatgctgggctgcggcaaatgccgcagcgcttatcgccttcacaaattgaccatcctgcaaacagccgtcaactaacacccacatgatcaaacgccccatcgtgtctttcataccgacgatgcaaagatcaccgctttccgacacaatatggcagtcagccaattcagcatcatgttggataaacagcgtttcctgttcaaaagctgacgagccatgcggccatccagagttatttccgctgtcgaaaataagttttcgtctccaagcaaagcccctttctgaggacagaagccgcagcgggcggtctgccaaaaatgcgatgccgtgcggcaaatattgttcaattcgctcttttaaaaagaggggctcggttttccgcgggatgtttttcgccataattgtaaactgcggatttgaacgctgaggatggtccagtccagtgatgtccgtatcatacactcgtccgatgcgcccagcagaaagagctgcttccgggcggtcaagaacttctgcttttccatcttttaataggagcagacggtcacagtataaactcgcaatattcacatcatgaaacaccccgaccactgcgagtttggatgcagccgtttcttgtttcattaaatcaagcagactcttttgaaatgacaaatcgagaaaactcgtcggttcatcaagcagcaaatattcgggttcctgggcaagtgcctgcgctaaatacacccgctgctgctctccgccgctcagctcatggatggatttttgggcgaagcgaagcgtgtctgtctgcttcatcaccctcttcacgatatcatggtcttccgccgtcagctgccgaaaaaggcctgcttgatacgcgtagcggccaaactgtaccgtttcctccaccgtaaaggaaaaggcctgctccgttttttgaggaaggaccgccattttgcgagcgagctccttcgttttgtactccccgactgaacggcattcaagcagcacctcgccgcttcggggggcaattgttcccgacaacattttcagcaaagtggtttttccgctgccgttcggaccaagaattcctaaaaattcacccggctttacagcaaaactgatatcctgtaagacatccgtttttccatatccgccggacacccggatgacatcaatcatgaactcgccctccccggtagcgccgaattaatataaagccgaaaacaggtgcccctatcaatgcggtaataatgccgatcggcagctcggacggctcgataatggttctcgacaaaagatctgacagcacgaggaacgaagcgccgttcagcatcgagagcggcagaagatgacggtgatccgtaatcgacagaagccggataaaatgcggaatgacgaggccgacaaaaccaatggttccagacacagcaaccgcactgccggttaaaatagctcccgccaacagaacgatatatttactccgcttcacattcacgccgagcagcctcgctttttcctcgccataagtcatcacattcagttccctcccgctgatcaaaagcgcggcagcgcccgcagcaaaaaagggcagaaacaacgcgacatagccccagcccctcatcgatacgctcccgagcagccagtggacgatcggttttaaatcatcgccggtcaaagcgatcatgagagaaataagcgcacccaaaaacgaactgaagatgatccctgttaaaatcaaagcggacagggtcaacgaagggtgtacgagccgcgcaaaaaacaaaaccaaaaaaatcacgataacagccgcagcaacgcttaaaaacggcagtgtaaaacttccgatcaccggcagctgaatcccaaaaaacagcgtgaccacggcaccgacggccgcgccagacgaaatgccaagcgtatatggatccgcgagcgggtttttcaagagcccctgaaacccggctcccgcggcagccagacccgcgccgacaagagcggccaaaaccaccctcgggagcctgattttcatgatgatgttcgcctctgtcggatcgggatttaacccttgaatgccaaaccattcttccaaaaaaaccttcataatagaaggaatgggaatctccaaagatccgatagagattcccataagaacggatgccgacaaaaacagcaggctgaaggcatatgccgcaaaacggttatttcttaaaaacgtcagggtaaatatgttcagcaagctcttcgacccctttgatcaatcgcggccccggacgggtcacgaggtcagggtccacgtcgtatacttcattatttttgacggctttgacaccgctccagccgctccgttttttaatttcgctgacagcggattcgccgtttgtcgtcacgatcgcatcgggattcagcttgacgatcgcttcttccgttatcttggcccagcctttctgcgcggaagcagcattttccgcatggatcgcttcaagcatttcattcataaaggtgccttttccggtcgtataaatgtccggagccggagacacttcgacaaatactttcttttgatctgctttagatatggctgccgctttttcttttatgccagccaggtcagatttcatgctcttgaccaggctcgctgcttgatcctctgcgcctgcagcctttccgatcatttcgatcgaccggtacgtctcttcaaaagaggccgcatcatttacagtcaccaccgtaattcctgcatctttcagctgcttcagcccttcttcggcactctgcatgctggaagcgtgggccaggaccaagtcggggtttaacgaaatgattttttccgtattaaattccatgcccccgattttttcaacgtttttcacttcttttggatatgtatcaaaatccgtcacgccgacgacttttttccccaggccgagggcgtatgtaatttcggtattgctcggcatcagagagacgattttcttcggttctttttcaattttgacctcttgtcctgaggcatcttttatggtgaccggaaacgcttcagccgccttctcctgtttttgctcgtctgccggtttttgcgcttggccgcagccgctaaggacgccggcagccaacagcagcgacagcaataaaagcccaaacttcttcatcctgcttcctcctcgggataaaataaaaacatctctactcagtaaagatgcagcaaaccaagaacgtacaaataagtgcacatcacttatacgcatctgtcctcgcagattacgcggtcatcatccaggcggttattccggctattggttcatcgctcccggcctgtccgaactactaagcggagctctcgccggcttcccctcttaagctgccgatcagcagcgcctttctgactcattcgtatcctaatttcggaattattatactataatcgacacaggtctgtatatgagattctgaaaaggagattttcagctgaaaaacgttgtttttgctaaaacaattacgatatattgcatatagagaaagggtgattttatgccgataccgaaaaactatacgcctcaggtcagactttcagcaaaggaaaaagcgtttcaccaattgcagcgctggattgtagacggaacccttgaacccggcgaaaaagtcacggatgtcgatctggccgaagcgctcggcgtcagccgcacaccggtcagagaagcgcttcagctccttgaatcccaagggtttgtggaaatgaagccgggaaaagaaacaaagatcacgctcattcatcccgatgatgcgctggccgtctatcctccgctcgcacatctccaggctttggcggcagaactggctgcgccgcttttgacggaagaagagatcgccgagctcaaaaaactcgctgctcaatacgaaaccgcgtttaaagaggaaaggaaccacgatgcagctgaactggacgaacagttccaccatttgattacagaagcggctaaaaacccgtatgttcttcagttttctgccgttctgcagcttcatgtcagacggatgaagtatgtgtttttcaatcggcctgctgctccgaaaatgcagtccgccgccgagcattggaaaatcatcgccgcttttgaaaaaaacgatccgaaattggcggctgaagtgatgaaaaggaattggctccgtccgatggaagatattcataaagttttaaaaggcagggaacaataaagcgccaagcacgattttcgaccgcggtatccagctgcgatatactgtttattagatgttttctttcatcttaactctgaaacaaggattgatggcatatggatttaaagctgaaaaacaaactcgtgctcgtaacgggttctactgctggtattggaaaagcaacggcggaagcctttttggcggaaggcgccgaggtcatcgtaaacggacggacagaagaaaaggtccagtcggtcgttgatgagctttcccggcacggaaatgttcacggaattgccactgatttatccgatcctgaagaaagcagggcactggtcgaaaaaaccgctgaaatcggggagcttgatgtcctcgtcaataatatgggcttctttgaagtgaaggattttacagacgtgacagacgaagagtggctcaaatattttgaagtaaatgttttaagcgccgttaggctttgccgcgcgtttttgccggccatgctgaagcggaataagggaagggttctcaatttggcaagcgaggccggcattaaaccgcttccgcagatgatcccttattccatgacaaaaaccgctttgatcagtttgtcaagaggtttggccgaaatgacaaaagggacaaatgtgaccgtcaactctgttcttccgggacctacctggacggaaggcgtcgccaattatatggaaggtgccgccgctcaggagaaaaccgatttagacacctttgtcaaagattatttcaaagtgaatgagccgacttctttgattcagcgctatgcaaaaccggaagaagtggcgagtacgatcgtctacctcgcttccgaaaaagctgcggctatcaacggttcagctcaaagagtggagggcggaatcatccgctcgatttaaccgaaatcctctgccggtcggcagaggattttttccttttggttaagaaccctgcttcagacctcccgtcagcctttcgcggtcatccggctcaaagccgttcagccgttttaaacatgatgcacgccaatttgccgacagttcctccacctcgagaagttttttgatgccctcaatatcgttcttttcatgatgcttgatgcgatttgcgtatgaaatcgtaatgcctttagggtggcgtgagattcgtttcagaccatgctccttacagacgaacccttctttcagcacgcgaaagtaaaaacccgtaaatccggtatcttgtaccttcagtatcatgtccggcataccgtaccttacggttagtttatagcagggctgcctcggctggctcacctgtacaacagctgcacccagctgaaagatgtcgccgatatgaacgtcatcctccagcagacccttgatcgttaaattttcgccaaatgctccgtattccagctttctttgcagttccttttcccaaaagagataatgttcatacggatagacgcacactgctttttccgcgccgccgtgatgaatgagatccccctgtccgtcccccgtgaaattagtagatgacaggaagatggggccgcttgccggcttcttgtatattccggtagacacagctttattttgaaactgaatttcctctggcttccctacattgatcgaaaggatatcggcatattccattcatatcacctcttacattcaaatgtcctgcaaaccccttttgagatttaagtataatcgacctcttaccataaaactattcaatcgttattataaaaacaataggttaaacctatcattggaattcggctgtttttcagatggagaggaggaaagagcattggagctaaagcaattggaatactttatggcattgtgccgggagcttcattttacccgcgccgccgaaaaactgaatatcgctcagccctcgctgagccagcaaatccgtttgcttgaacacgaaatcggaatgcctttgtttaaccgttcaggcaaacgcaccgtgatgacggaagcgggaaatattctgctccagcactgttacaatatctttcatgaactgtcacaggcgcgagacgcgatcagcgagcttcaaggtttaaaacggggaacgcttaaaatcggggcgcttttgaccgtggttaattatttgcttccccggaccgtggtcgaatttcaccgcagctaccccaatattgaattgtctgttttagggctgagaaccggggatatttacgaccggctgctgcaaaatgagctcgacttgggcattgtagcccagcgggtggaacatcgtgacttagaagccgtcccattccttacccagcatctcgccctcgcggcgcctgttgacaatccggttgcaaagcggcagtttgtcacgcttgacgtgttaagggagattccatccattttgctgcctgagacgtattttttgcggcagctgatcaacgaaaagtgccgcacgcttggattcgagccccggccggtcatggaaatgacaacgatggaatcgatcatgaacatggtcggtaaaggcatcggcgccaccattttgccgaaaggctatcttaatgctattggaaataaatccattcagacgattccgatacaaaagccggatttgacgacggagatcagcatcgtttaccgtaaaaacaagcatatgtgcgctgcaagccgggtgtttatgaaactgctgatttcctcggtcaaaagcgaaaccgctgatgcgccgccgcgttaaaagaaaaatcctctgcatgtctgcagaggatttatgtttaggctttgtgtgagtcatagcgttttccgttaatatacagattcgaaaaaacggggtctttcacatgtttcagttccatcggaacatcgacgccgtcgatctcggaatcagccactttcagcccggtgaccggagagtggtcgtatgccagcaccctgatcccgtattgtccgcccatgcttttcagctgcttaacatcaaccgtgcggacgacaggtttgaaatctccggcatctccttcttcatattccatatcgatggcgatcacttcgcgcttcaagcttttgaccgtatttttgtgaaagtagatgttttcaagaacgccgccacgcaccgaattcgttttaatgcggagggctctgtccaagttcgggctgtccataagattgccctctgcgatgacgttcttcacgccgccggaaatttcgcttccgatcgtgacccctccatgcccgtctttcatttcgttatgttcaatgacgatgttttccgacggaatgttgatccttcggccgtccgcatttcttcccgatttgacggcgatgcagtcgtctccattatcaaaatggcagcccttgatcaccacgtttttacacgattccgggttgactccgtcggtattggggccgtgtccgatgactttgatgccgtccactgtcacattctcgcaaagcacgggatgaacttgccacatcggcgaattcagcacagtgacgccttgaatcaatatatgtttgcagcgatacggctgaatgaaattcggccgcaaataatgcccttttccaaactgccgctcagtgaccgggataccgcgctcagccatttcaaacaaagcgttccgatctttttcctgtgaaggctggccgttcgttcctcttttccacggccaccaatgctcgtcatctccttgaccgtcaagcgtgccctttccggttatcgcaatattatcggcttcgtaagcgtagatgagcggtgaataattatagagctcgactccttcaaacctcgtcagcacaacagggagataatcttcagggttctgactgaatttgatcaccgctccctttgcaatatgaagatccacattgcttttcaatctgagcgcaccggaaagaaacacgccttcaggaaccgttactcttccgccgccggcttggtgggcttgatcaatcgccttctgtatcgcttcggtcgaatcgttttttccgttttcgtcagccccaaacgatgtgacatcaaatgagcgattcggaaataccggaaccttcagcttctttacaatctcttcttttattttctgcagactcacgttaccgccccctttataatgtgacgcctgttttaaatatcgcaagctccctgaaatcgtttatctcattgttcagctgcctgccgcttgcgacttcgatcaaatacgctgtcagctccttcaaaacgtcatcttctgatcggtcttcgagcacctttcccgcattaaaatcgatccaatggcgctttgcctcataaatcgccgtatttgtcgaaattttcatcgtcggcacaaaggtgccaaaaggagttccccgtcctgtcgtaaataaaacgatttgacaccctgcagcggccagtgcggatgaagcaacaaggtcatttcccggagcactcagcaggttcagccctttctttttcaaaacgtccccgtattcaaggacatccgccacctttgaagtgccggctttttgcgtacagccgagcgatttatcttccaatgtcgtaatgccgcccgctttgtttcccggagacgggttttcatagacgggctgcctgtgatcgataaagtactgtttaaaatcgttgattaagcggacaattttatgaaacacttcctcattttcagcccgctccatcaatagcgtttctgccccaaacatttcaggcacttctgtcaacaccgccgttcccccttgggcgatcagaaaatcggagagccggccgagcagcgggttcgcggtaatgccggaaaatccatcagatccgccgcacttcaaaccgattttcagttcagaaagcggaacatcttcgcggtggtcaccttttgcatgcttataaatttcctttaacagtttgacgccttccgtgacttcgtttgatacctcttgggaaagcagaaacttgacccggctgtgatcgtaatcgccgagcgcttcgcggaattcgtgaatgctgttgttttcacagccgagccccagcacaaggacaccgcctgcattcgggtggttgacggcattcgccaaaatcgttctcgtgttgatatgatcgtcgccaagctgtgaacagccgtactgatgctttaatacgtgaacgctttcaaaaggggcgatggagccgacctcagccttaaattctttgatgatcagctctgcaatgccatttacacagccgacagtcgggacgatccatagctcgtttctgatcccggtttttccgtcttttcgtttaaagcctttaaatgtaagcggttctttttgatagcggttttccgtaaacttcggcttgtagctgtattcttcgacaccgcccaaattcgttttcacatttttcgtgtgcacccactctcccgtctgaatcatttcagtggcgtgcccgatcggaaagccgtatttgatgacgttttcattttcagcgatgtcttttaaagcaaacttatggcctttcaaaatcggttccttgatcacgatggttcgttctccgacagtgaccgtttcaccggtctgcaattctcttaacgcaatgccgacattatcttgaggattgatcatcaagcagtctttcattacatgtcccccagctcagccatttggcttttcatcattttttccagcgccttcctcattcccgtttgtttcatgtcccttaaatattcagccgtcttgtccgtcaatccgggcatgtcgttcagattttgcccccacactttttcaaacccaagaacatggaatgcgatgttcgaaacgtctgtctcttccgtccagagccgtttgaggaaagccagcacctcatcgtcgtcagacagcggaatggccccatcatccccatcccgttggcctcggtaaaaataaattaaggcgcttaaagcaaatacggttcgagccggaagtttgcctgttcgttccgcatattccattaagacgggcaaatttctgactttgaattttgcaaaggaatttaaggaaatatcgatcagcttgtgacggataaacgggtttttaaagcggtcgagaatctcttccacgtagttgtcaagctcgctatcgggcatatcgatcgtctcgagcacctcccgctggatcagctctttcacaaatgagccgataagctcgtcttcagccgcttcgcgaaccgtctcaaggcctgccaaataagcgaccggcgtcatcgcggtatgggcgccgtttaaaattctcacttttcttatcctgtacggcgtcacatcctggacaaactcgacattcagaccggcctcatgaagcggaagctcgtctcgaagccatttcggcccttcaatcacgaacaaatgatacggctccgccttcaccatcaaggaatcgtgatagccggccgcctcttcaagccggtgtgcattttctttcgggaatcccggtacgatcctgtccacaagcgtattgcagaacacgtttgcctcttcaagccaatcgatgaacccttgttcaagcgcccacgcgtttgtatagcgcagcacaatgtctttcagtattttcccgttatcctcaagcagctcacacgggaggatcaccagacctttttccctgcttccttgaaaagtcatgtatcgtctgtataaaagtgcagtcagcttccctggatagcttttctgcggacggtcggacagacggtcttcctcgatataaatgatgccggcctctgtcgtatttgaaaatacaaaccgcaaatccggcagatcggccagctccataaattcatcataatgctcatagctgctgacgactctgctgattgatgtaatgacagcagaatcgcgaacctcccgtccttcccggaaaccttcaagataaagcgtgtaaagcccatcctgttcttgaaaggccgttactgaaccgcggcgcggaggcacgacgacggcactgccgttaaaatcggtttcttcattcaatctatgaatctgccagtcaataaaccccctcataaagttaccttccccgatttgcaaaatccgttcggggcggctcggcttagaccttatccgtttggacagcctctccatttcaatcccctcctcatttctgcacacgttcacattttacagcgcatcaaaaaaatgatgctatagatgcttaactgaattgcgaatgatcagctccgtgctgatgagcgtctgcccgccttctgcctgcgggttttcgatcaatgacagcaggctttccgcaccaagcatgctgattttttcagtcggtttttttaccgtcgtcaatgacggtgtcgtatacgccgaaaatccgctatcgtcaaagccgataatcgacatattgtcaggacagcgtttcccgtttgcatagagggcgttcatcgcgccgatcgccatatcatcattggcgcaaaacagggctgtcggaggattcttcagctttagcagcgtttcagccgcgcgaaagccgctttgcatcgtataatcgccttgaacgaggtattcgccgggcatatcaaggtttgagtcgcgaagcgcgcgaagaaagcctcctttcctttcttgagacgatttaaagccttctttcccctgcaccatggcgatctgtttgtggccgtttttgatcaagtatgaagcagcgaggaaagcgccctcgtgttcattcgccagtatattgacaacggagtgcccttcgatttttctgttcagcacgacgaccggaatattctgtttgaggacatgctcaataaaagcctgatcctgttcgctttggctgattaaaatcatgccgtcatagcggttgcggtgaatggatgacaaatcatgataatcgtcgattcccctgacaaccatattatagttttcatcgatcaccttgttgacgccgcgcaggatgtctgcaaagaaacttgaagacgtcccgtctgtcaggcttgttaaaaacaggccgatcgtaaaagacttttgcgtgacaaggcttttcgcattaaaattcggtttataattcatttcggctgcgatgtcgagtattttctttttcgtgttctcttttatcagcggactgttgttcagcgctctggatactgtggtgtgcgatacattcgccagcctggcgatatctttaatcgttactgacattgttttttacccgccttttcttgctgttgttaccatcagtttaccatatcaaaagcgctttttagaaagtgaatttccgctatgttctcgctttgatttccgcgaccatttcggcgtgcttctgatccgtcaaacggtacaggtagccgagaacgagaatggccgccgtcagcgctgctgccggatacaaaaggagaatcgctttaatgccgagcagcgtccccgctttttgggccgcattcggcacatagccgatgatgctgagaccgatccctgacaggaagccggagagcgactgagccagctttctcgaaaaattaaacagcgagtataccgttccttctttccgttcccctgttctccactcgccgtaatcgatcgcatctgatacgaatgcccaggtgattccgttcggaatgctgatgccgatgaaggcgatgcttgcgagaatcgtaaaaacaaagacattgcccggtgcgaaaaaattgatcagatcggcacagacagaaaccgcgagccccaaaatggcggtatgctttttcccaaaaagcttcacgagcttcggcagcatgatgacgccgataaaggatgagccgatgatgatgaaattcatgtaggccatcagttcggcgttcccgaggttatactgcgcgaaataaatcagcatcgcggatttaaggttataggctgaaatcgtaaaaattgtcatgaatattagcgtaaggagcggcttgttcgtaaaaaacgtctttgaaatcgctttgaatgtcactttttcctgtttgtacttctcatcttttacgacgatccgttcctgacagttcctgtagcaaatgtagaaaaacaacacacccagaaaagacatcagccccatgacgaccggataggcaaccgcagggttgtcaaacctgacaatcatcgggatgacaacaatgctcgtcacaaacagggcgcccagcgagccggcttggcgaaaggaagcaagcgaagtccgttccaccgagttttgcgtcatggcagccccgagcgagccgtaagggatgttgacaaaggaatagccgagaccccaaagcatgtatgaggcataagcgtagatgagtttgcccgtcggtgacagattcggcgagatgaaggtcaatatcgtcaaaatcgcaagcacaaagcttccgtatagcagatacggcctgaatttgcctttcgggccgatattcttcctgtagtcgatcgatgttcccacaatcggatcgacaaaagcggcgaaaagtttgctcacaagaaaaatgcctccggctgccgccgccggaatgccggcaacatccgtaaaaaacttcagaagatagagctgtccaaggtcaaacataaatccgttcccaaaatctccaaaaccgtaagaaaccttttcttttaaacttaatttctcttgagtgacggcgactgtttcggtttgtttgttcgtcgatatttccatgaaaaagcagctcctctgctagccaatttgtgaatctaagctttcaaacgatctttcacttcaaactggaaatagtgttttgcattttcgtagcagatcccttttacgatccggcccagcagttcgatatcatccggcgcttcgccgttctcaacccatgtgccgataacatcgcagagcaggcgcctgaaatattcgtgtcttgtgtaggaaagaaagctgcgcgaatcagtcagcataccgataaaacggctcaatagaccgatgttggcaagcgatttcatttgttcgagcatgccgtctttcgtatcgttgaaccaccaggcggtaccgtgctggattttccccggtatccggccgtcctggaagcttccgcaaaggcttgaaatcacgacattgtcccgcgggtttaaagaatacaagatcgtttttggcagcgcatcttttcgatcaagagaatcgagaaagctgcacaaaggctttgcgatatcctgatcattaatcgcatcatatcccgtatcaggcccgagcttccggtacattttgctgctgttgttgcggagggcgttaatgtggagctgcatcgcccagcccttctccgcatagcatgttcccaaaaagtgcaaggtcaaggatttgaatttgcactcttcctcaggcgaggcgctttccccgttcatcacctttgcaaaaatcgggcgcacttcgctctcatctgtttccgtgtacatcatttgattgatggcatgatccgatatccgtccgcctgcttcatggaaaaagtcaattctgtttttaagcgctttcaaaaaatcgtcataattcgctatcttcataccgctagctgtttcaagctttctcacccaggcggcaaaaccctcttgattgatttccatcgccttgtctggcctaaatccaggtaaaacgcttacattaaagtcttcatctttcagctttacatgatattcaagactgtctgtggggtcatctgtcgtgacaaccgtttcaacgtttgatttttcaatcaagtctctggcgccgaaccctcctccggccagctgttcgttaacccgctcccaaatatgcggcgcgctcttttcatcaagccggtcatcgatgccgaaaaacctcctcagctccaaatgggtccaatgatagagcgggtttccaatcgtcatcggaaccgttcttgcccaggcgctgaatttctcctcgtctgacgcatctcctgtaataaactcttcggatattccattggccctcattgctctccacttgtagtgatcaccgtagagccatacttcggtcaggtttttaaacgttttgttttcgtaaatctccttcgggctcaagtggcagtggtagtcgatgatcggcattccttttgcatactgatggtacaacactttcgacgtttcattcgttaaaagaaaatcgtcattcaaaaacggcttcacagaatctccacctttctttatttataaatgttaacgttaacaaaaccatctgcagcataatgtgaacgttaacatttaatcttattttatactaaccgcgccttcttttccattattttctcaacataaaagaagcctaaaggcaataacctttggcttcttctttttcataccgcttatttggcggctttagggtttttcttaaattccatcgtaatttccgtccctcggcctgtccggctgtcaactgcgatgcagccgtcgtgcaggtggacaagttccaaagaaatagcaaggccgagaccgcttccttctgtcgcatcttttgtatgcgttcccctgtagtagcggttgaataaatttgagacggtttcagagtccatgcctcttccgttgtcttgaattttaagaataatatattgcttggattcttcaaggatcaccttgatgtcagtgccttttttgttatgcttgacggcgttggcgaggaggttttccaagactcttcggaaccagcccctgtctatcgcaaactcggtatctacttgcttgtattcaaaagacacgttgtacccttctgaaaatgaatggcgcttaaactcctcaacgaagctctttaaaaacggcacgagcctcactgtctggcgtttaatcggcaaagcgtcgtttttcagcctgtacgtcaagttcaagtcttcgattagctgtgacatgtagtccgacttttctttcatcgcctggccgatttcgcggatttcctcttttgaccactcatagtttggagactccagcatcatgctgtagccgtaaatcgtgctgagcggcgtttttaagtcatgggagagccctgcgatccattcctcccgggtcgtttggattttcttgcggttttgctcgtcttttttcagcgtttccgtcagctgctccatcgattcaaacacttctgtgaacagccggtacggctgttttcgcttcccttttttgttccggcttcgcgggcggcctttccggtttctcggttcttcaaatcgcccttttgaaaggttgacgatccatttaatcgtatggatgatcggcatgccgaatctgaaagaataccaaatggtcatagaagacatcaataagatcagaacgccgatcacgatgagaacgatttttaaagcgagcccgatcatcgtcctgttgaactcatgatccggattaaaaatcgggttcggcgtagcggcgatcagccattctgtcgcgcttaatcgcctgtatgaaaactcgtgctcgtagttccatggctttgatccgtattttaaaagctccagctcattgattccctggctgtaatctatgtcctggtagatcgagtccagcattttccctttttcgctgaacaaatagacggaccctttgtttttcttaatgaaatcaagcgtgctttttttataggaagaaaggtctgccatatccttctcttctttttccaaataggacaggatcgtatcgcttttcgactcccatccgaataaaatcacgtagtcttcaccattgaaattggcagaccagaagttgacttgatattttttaattctttttttatcaaaaacggataccaggtcttccctgtggtactgcctctgaatttccgcaggaagacggtaggaataaacggttttctccttgccgtctaatatttgaagccagcctccctgtttgtcgatagccgatttcaagatatcttcgatctgccaattgttattgtcatccacgctgacccagctttcaaacgtgtctgaagtggcttttgccaagcctgtatccgcttcgctctcgcttaatcggagagcgaaaaaaatgaaggataacagcaaggtcgcgagaacaagaccgagaatcaaaaaaatctgactgacaaagtggagaacgagctttcctctgagcttcatccttcgctctcttttcgtgcaggattgggaacgaacttatatccaaggccgcgaatcgtgacaatatattcggggctgctcgggtctttttcgattttctccctcagctttctgatatgtaccatgacggtgttgctgtctccataagatggaacgccccacactttttcataaatttgatccttggaaagcaccctgttcggatgatcgcaaaaatattgcaggagctggagcagctgcgccgagcagctgaccgtttcgccgtccacgatcagctccgcaaagtcgggatgaaatataaagcgttcatattcgtaggctgaagatactgaagcagctgcaacttctttatgtatatacgttctttttaaatgggctttaatcctggcgattaattccagaggattaaaaggttttgtaatataatcatcagccccgtaggcaaaacccgacagtttatcgagatcggatgttttcgccgtcaagaagaagatcggagcgttggtgtgccgcctgatttcaggagatacatcaaatcctgtctgtcccggcatcatgacatcgagaagtattaagtgcacggtgtcctttttcacgatgtcgagcgcttcttctgcgctgcttgcggtcagaacttctgaaaatccttccttcgtgaggacgcgcttgaccatttgaacaatggcgtcttcgtcgtccacaatcaaaattgtcgcattttccaaaatccttctttcctttctgtctatatcatgtattttatatcctcatcttaccatctattatatctatatcggcacacattttctgattttaaagtaaaaataaacttttttagaaatgattttttactttacgaaatcatggaataaaaaaacagacatctgtccgatgtctgtccagattgttgacaaaatcccaaaaaggtcttttgttattgggattttgtcatccggttgccagcctctgatcctcttcttttttcaatagatcgtaagtcaggcacaccggttttcctgtgcgcgggtctaatataatttcagcatcaatctgaaacaccttttttaatacttctgatgtcatgacttcatgaggggcgccctctttgacaatcgcaccccggttcagcgccaccatatgatgagcgaagcgggcggcatggttgaggtcgtgaatgaccatcaaaatcgttcggccttcttcttgattgagcttttccagcagttgcagaatttcaagctggtgcgccaagtccaaataggttgtcggttcgtcaaggagcaagagctccgtttcttgggcaagggccatcgcaatccagacgcgctggcgctgtcctccagaaagggcttcgatcggccggtcataaaaaggcaacattcctgtcacttggagagaccattcaaccatgcggcggtcatcggccgaaagcctgcccattcccttttgatgaggaaaacggccgtaagaaacgagctcatatacggtcaaaccgcctggcgcctcaggcgtctgcggaagaatcgccatctgtttggctacatccttcgtcgacatttggtggatcgctttgccgtttaaataaacggcgcccgttcgcgaacgctgtatgcgcgccatcgtttttaatatggttgatttgccgcacccgttcggaccgatcatggtcgtcacttttccttttggtatgtggaggtttaagttttcgacaatcatctgttcgccgtagccgatccccaggttgtttgttgaaagagacacgttgcacccttcccttctttaatttgttttcataagcaaatagataaaatacggtgcgcctaaagcggcaatgacaagccctacgggaatttccgaaggcgccagtatcattcttccaattaagtccgccagcaaaaagagcaatgctccggtcaacgcggaagccgggattaaaagctgatgcttcggcccgacaagtcttctggcaatatgcggagccacgagaccgagaaacgtaatgtttcctccagccgctacacacgcgccgctcagcgcggctgccgacagaagcagtgtgcgccgctctttttcaactgccgttccgagccctgttgcgagctgatcaccgagattcagcacgtttaaatagcgcgctttatagaggataaaaggaatcagcacgacaatccagggcagcacggccgagacaaagctccagttcgaactccatatattccctgacagccaaacagccgcctgcataaagtcatttgggtccattttaagctgcagcattaagatggccgccgaaaacgccgcattcactccgatgccgaccaaaacgaggcgaatgggattcaagccttttttccacgccagcaaatagatggaaacgactgcaaagcaggctcccaaaaatgcgaatatcggcagggaaaaaacgaatcctttttgcaggttgccaacgtctccctgaaaatagaagatgaacagcacaacggcaaaacccgctcccgtattgatgcccaatatccccggatcggccaggtcattccgggatatcccctgccagacggctccggagacagcaacccctgcaccgatcagcatggcgaggatcatgcgcggcagacggaattcaaataatacaagttcatcctgcggcgttccaaagccgaacagtgttctcaatgtagcaagcgggtcgatgcggatttctcccatgttcatgcttaataaaaacacggcggccgtcagcacggccatgacgagcatcaccgcacccgcccgtctgttgtttttcttgagcattacagtccactcctttccctgcgggccagatagagaaagaatggtacgccgacaagcgcagttactgctccgacaggtgtttcaaacggcgggttgaccagccttgccgcaatatccgcatagatcagaagaacagcgccaagcacagctgagcatggaatgatccagcggtaatcaaccccgaccagaaagcgggtaatatgcggaatgatcaatccgataaaaccgatcgcaccggcaacggatacagtggcacccgtcagcagaacaacggacacgatgccgatcgcttttaccgtcttcgtatattgaccgagccctttcgccagctcctcacccaggcttagaaccgtgatggaacgggcgatgacaaaaacgaccgccaaaccgagcgctgccgccggaatcaacaactgaatgctgagccatttcgtgccggcgacacctccggcataccaaaaactgacgtcgcgcgccacatcaaagtggatcgcgatgctcgtagaaagagcgctcaggaacgtgccgacagccgtaccggccaaagccagctttacaggcgtaagaccgccttttgaaaacattccgattccaaaaacaagccccgctccaagagcggcaccggcaaatgaccagatcatcagcccgatcgatgaggttcctggaaaaaaagcaaacgcaacagcaattgcgaaagctgacccgtgcgtgacgctcataatttccggcgacgcaagaggatttcgcgtcatcccctgcatcacggctccggaaaccgccaggcaggcgcccacaagagccgcacttaccgtccttggcagtctgagttcctgaataatttgatgggccgtatttttcgcgtcaaaatgaaaaatggcgtcccaaaccgttccaagctttatatcagccgcaccgagcgcaatcgataatgcggcgccaaaaagcagcagcatgattccgccggccaggacaaatacagctccgagcggacggctgatcggtctctgttcttcatcagtgccatccgcgccgttgatatgatgtatgtttttgtaagagctcactcgatgccattcctttcgatctttttaaccgataacgattatcattttcatgtttagtataacaggcctaagcaaaaattttaatcaaaattttcggcaggaatcaaaaagccagccgatcttccgctaaaagacccggctggcaaagagctttatcacacttgattatttttgaactttttgtagacgaacgggtagatcgcaagaccgacgaaaaacagcccgattcccaagataaaggtggtcaagtcagacgtgcctgaaacgatgacccataaagagtacgcaagagcggccaaggcaatgatgccgtctcctgttcttgaacctttcagctcgccgtatgtctcccctttgaggatgagcttcaagctgaaaagagccgctatgagataagggacaaggtaagcgagcgtcgccgacgttgttaaaaacgtaaaggcttcgctgatcgttcccgaaatcgttgagaaaataaagatctgcgacatcacgtttgtgacgatcaatgaattgaccggacttccctttttattcgttttcgcaaagaaagcaggaaaatcaccggcttttgccgcctgatacggaacctctgcgccgattaaaatccagccgagcatcgatccgaacaaagaaacgattgccaagaccgccataatcacgctgccgaagctgccgataatcacgtgcagcacatcaacgaacggtttatctgatgcctggagctgatcgtgcgggatgacgcccatcgtaattaaagtgatgatcatataaatgccgagcgcaattaacaggccggtaatggtcgcgcgtttgacatcacgctgggatgatgcgcgccctgataagattaccgcagactcgatgccgacaaacgcccacagcgttgaaatcgccgcattgtgaacctgtccgcccagccctatgcttttgccttctgattcgattggaaaataaaatgattcgaataatgccgtttgaaaaacgaacaaacctgcaacaataaacaggacaaacccaagcactttggaaaaagtcgccaaaaagttcagcttgcccgctccatttatgctggagactaggataaaatgcgtcccccataacaaaatcgtacacacgatgaatgtcaagagctggccaagtgtaacggggtgtccgccgaattcaaccagctcgcgtccgtcggttaagatcggcaagaaagtcgtcaaatagcctgcaaggcttgtaatgatggccacgttgctgatccagctagccacccaatacccccataccattgtaaaacctgccgcattcccttttttagggtctgagaataaagctcttgcatagctttgcggacctgctttgagatccgggcggcgaatggataaatggccgaatacaagggcgatcatcagcacccccgcacccgtcaccagccatgccgccgttacgccgagcgggctagccgtctgggcgagtgtgctggggagcataaaaatccctgagccgaccatattgccgacaacaaaagccgtaagaagccagaagccccatttttttgtctgttccataagatataacctccgagcattttataaaaaatatgccggaccagaccgtgagatcattcaaaataaaaaaagcatgaacaaaagtccatgctttggttaaacatacactcttgatctccggatagccctccgcgggaatacccgcggcagtcctgcacttattcaatgcagacccagcataaagaatgaatggcttccttatgcttcggcgctgatgccttttgcatatgatcatcggccccatcagcctcacacatgcgactcatcatccgcgcaacctctacctcactaagagttaagagtgaggatttatcacatattctgaaaagaggttaccagagaaattttgatctgtcaaagggaagtgatggaaaaaacggacagccgcgccaaaaggccgccttttttggcagccttctgaagaatggaagacgggctctctccatctgtcatttatcggttatttttctttttgttgaccgcctcttgcagagggtctcctttcagcgcttgtcctgcgtcttcaagcgccccccgaacggcgttttggtccttttccttatttcctctatctttattgaagaaaatacccaaatgaatcacctctttaaaaatgtggtacaattttaatttggcttatcaaatttaaattatgcagaaccttggaatgtgttttttatctgaaaacgccatattttagatgtaaacgcgccgattgtttaggaaaatgtttttttcagctgacaagttgttaccatctgtcttgaaggccgtcagaactcttgatatagttttcattaggaaattgttataggtcttaaaggagaagcgatatgacaggaaaaacacacatcatgggaggggtcgcttcttgtacggctgctgcttatttttacggatatgatccggtgttcatgacagcctcgggcgttatcggagcattgattccggatatatgccatacaaaaagcaagataggcagaaggcttccgattttatcagcagtggtcagttctgtcttcgggcacaggacgtttacacacagcctgctctttttgctcatcacggcattcgcggcacatttatattttgcagatcagagcatacttgtcggattgatggccggaatggcaagccatctgctcctcgatgccgggactgtaaacggcatcaaacttttctttccgtccgccattaaggttcgtctgcccctttacattaaaaccggcgggaaggcggaacaagtcgttcttgctgtgctcaccgttgtttcgtgctattttattgcgaacttgatcgcctgacgaaagggacggtttgaccgattgctatatgatgctttttttagtcattttatcttggtgttctttacctgcggggattatatgtgaggagctatttatatgaaagaacaattttttaaaaagcagtggtttttatgcctatccatatttttcatatggatgaagacgtacttcatctacaagctgggctttaatttacaaatcgacaacgcacttcaggaactgatcctgtttatcaacccgcttagctttctcatccctgtactcggcatcagcctcttttttcgcgaaaaatcgcagcgcatctatttaatcggggctaatgtcgtcctgacgggcatcttgattgcaaacagcattttttatggtttctacatcgatttcatcaccattcccgtcctgttccaggcaaaaaacctcggggggcttggaagcagttttcaggagctgtttaatccggttttcatcgcgcttttcctggacctggctctcatggtctggctggcaaaaacgcgcgaaagaaccggcaaaaagctttccgctaaagccgttaagatctactatgcggcagccgccggaacggtgctgtttaatctcgccctgtcggagctggatcagccgaagtttttaagctactcttacgacagggaagtgcttgtaaaaaatatcggcttgtatcagtttcatctgttggacggcatttcacagacctttaatttgacacaaaaagcggtcgctgatgaaaacagcctggcaacgatcgaaaactacacaaatgccgactacagcaaaccgaaccaagatatgttcggaattgccaaaggacgaaacgtcatctttgtaacgcttgaatccacccagacatttgtcatcaatgaaaaggtgaacggccaggaaatcacgccgttcatgaacaagttcattcaaaaaagctattatttcgaccatttttatcagcagaccgaacaggggaaaacgtccgattcggaattcattgtcgctaattcgctctatccgtctctgagcggttcggtgttttttacgaagagcgagaatgcgtacaattcgatgtataaaacactggcgaaccacaattacagaacatcggttttccacgccaaccataaaaaattctggaacagggacgtcatgtacaaagccctcggcatcgacagcttttatgacgtctcccattttcatgtgacacctgaaaattcaacgggctgggggctgaaggataaggagtttttaacgcaatcggccgacttgatgaaagacttgccgcagcccttttacagcaacctgatcacattgacgaatcattttccatttcaaattgatgacgaggataagctgatcgatgagtacgattcagagagtgacattttaaaccggtatgtcacgactgtacgctatgaagacgaagcattgaagcatttcatcgcaaaactgaagaaaaacggcctttacgacaattctgtgatcgtgttcatgggagatcactacggcatatcagaagcgcacaacgatgcgctggctcaatttttgggcaaagacgaaatcaccccctacgataccgttcagctgcagcgggtgccgctgattatccacattccgggggtaacggatcaagacccgaaaacgatatccgaaacaggcggccaaattgatgtcaaaccgacattgctccatttgctcggaattgatacaaaaggcatgattcaattcggcaatgacctgttttcgaaagaaagaatgcctttcgctgtgttgagaaacggcagctttattacagatgattatatctacacgaaaaatacgtgctacagcaaaaaaaccggggacatgatcaacgatggagaggacaaatgcggccctctcatcgagaaggcgaatgaagaactttccctttccgataagattattaacggtgatttgctgagattttacaaaaaataatccgtcccctttaaaccggcattctcgccggcttaaaggggctgtttaaattgagggacagctgggtattatataccgaatgttaaaaatgaacttgcggttttgcagttccttcgttaccctaaatgaaaagagaagttatttcgagtgccgattatttcataaagtgttataaaaaatgataaataagaaggttttaatatgagtgaaacacagcacaagacaaatcaattgccgattgttgccgtcttgattatggggacatttatcgccattttgaatcagacgcttttgacgacggctctgcctccgattatgagggacttaaacattacgccggggcttgcccaatggctgacgaccgtttttatgctcgtgaatgggatcatgattccagttacggcttttttaattgaaaaattcacaacgagaaagctgttcatggcggcaatgtctttatttacggccggcacgctgatctgcgccttgtcattcagctttccggcgctgattgcggggcgcgtcgtgcaggcggctggcgccggcattatgatgccattgatgcagacggtgcttttattgattttcccaaaggaaaaacgcggatcagcaatgggaatggtcgggcttgtgattgcctttgctcccgctgtcggaccgaccctgtcaggctggatcgtcgatcgctatccttgggaagtattgttttacctgctgcttccgttcgccgtgatcgacatgattgccgcgcactttattttaaaaaatgtcaccgaacagacatcgcctaagatggatgttacttcaatcatactgtcttcgcttggcttcggcggcattttgtacggcttcagcagcgccggtgttgccggctggacgggtgcggacgtgctggccggcttcgcggtcggcagcgttgcgctgttttggttcatttggaggcagctccatttggaagagccgattttggagttcagggtatttaaatatccgatgtttaccttggcgacgattatcgggatggttgtctttatgtcgatgatcggagctgcgacgatcgtgccgatgtatatgcaggatatgcgccatttcacggcgatggagtcgggaatgatgctgtttccgggagctgttgtgatggggctgatgtctccgattaccggaagaatttttgacaaaatcggcgcgcggattttgagcatcaccggtttgacggcgatcttcgtgaccacattgctcttgacccatctgacaaagacgacgccttttgcatatttgtctatcgtctatgcgattcggatggtcggcatggggatggtgctcatgcctgttacgacagccggcttgaaccagctcccgcgccatttgattcctcacggaacggccatgaacaatacaatgagacagatgtcaggatcgatcgggacggctgttctcatcaccatcatgacacagcgtgcgcttcttgaccctgccggtccgtcttcggatacagcgatgattcacggcgtcaatctggcatttatgaccgctgctgcattgtcgggaatcggattggttctctcattctttattaagcagcaccgccgcggacggctcgacggcagcaaaagaaaacaagcgaaaggccgcttggccattcatgagaaatgaaaaatcccgggtttataaaaacccgggatttttttatgattattcgaatccgttaaccattgtgtccggatccggaccgacgcgctcatctttattaagagcgttgattttttcgacatcttccgccgataattcaaaatcaaaaatgtcggcattttcaataatgcggtgttctttgatggacttcggaatggtgacgacttcattttgcaaatcccagcgcaggatgacttgagcaacggatttgttgtattttttagcgatgtcagtcagcacctgatcatcgaggagttttccctgcatgagcggagaccatgcttccacctgaatgccttgcttcttgcagtagtccctaagctcagtctgagtgaggcgcggatggaattcaacctgattgaccatcggtttaatttccgcatcttccaataagctttccaaatggtggacattgaaattgctgactccgatcgctttcactctgccgtctttgtacagcttttcaagtgcgcgccacgtatctttatatttgtcttttcctggccaatgaatcaaatataaatcaaggtagtcaaggccgagttttcgaaggctttcatcaaaagccgccaatgttttttcatatccctggtcactgttccaaacctttgacgtgatgaaaagctcttcgcggggaacgcctgattccttaatccctttgccgacgccttcttcattttgatagatagcggctgtgtcaatgctccggtatccgtttttaatggctgcttttacagattcaacgacttggctgccttcttccactttgaaaactccaagtccaaaccatggcattttcacaccgttatgtaatgtcacagtgtcctttaaactgcttaccattttgaacgaccacctttctttttttcagatgcttttaaacgcaccgcttttattatctcacactgggtggattttacaaaacaacttgctcaaccgatggaatgagccaaagcaagcgctccggtgattccctgatcgtcgccaaggcccggcggcacgatgtattcttcaagatcaggcaggtcgacatatccgttcaaatattcggccagctttttgcgaatcagcgggaacagctgctgctgcttcatgacaccgccgcccatgatgattttttcagggcacagaatcaagatatattgcatgagggcctgtgctaaatagtcggcttcaagctcccaaacttcctcgttttcagccaaatccttgccctttttcccccatcgcttttcaagcgccgggcccgatgccatcccttcaaggcagtccttgtgatacggacagattccttcaaacgtatcctgcggatgccgtctaatgagtaggtgacccatttcaggatggagcgtgctctgtacgagccggccgccgacaatcgctcctgctccgattcctgtgccgactgtgatatacaagcagctctccaggccttgcgcctctcctttcgtcagctctccaagcgcggcagcgtttacatcagtcgtaaacgaaaccggaatgccaagccttttttccaattcgggaataaacgggtaccccttccaggctaatttcggggtattggttatgtatccgtaatcctctttattttttgcaacggatataggtccaaaagagcccactcccattgatgtgagctgatacttgctgaagaaatcggtcagctttccaatggtctcttcaggcgtctccgtcgggatcgtcagcctgtctatgatttctcccttttctgttccgactgcacaaacaaactttgtgcctcctgcttctattgcaccgtaatgtttcatcctctcggctccttttcatctgtttgaattgctctaattgaatcataaatcagacgatgaaagaaagcaatcgcactgaacaatggttcaccagagcatgggagcttttgatgctgacggaagaaagcttcccgaaaatgtggcagttttttaaacaactgccgcgttcgctttttcgcttaaataggcttctgaccgcttgatcgtaaccgtgaaaaagaggattttttcaagccccgctcgaagctttaataaggagggatatcatgaagcatccattcgacaatttccgttctttattcccgaaattgtctgatcatgttcatcttgccgcatgttccggaagcgcattggctctgcctgttgccaaagcggtcgatgagtatcagaacggccttttaacagccggtgcagactggaaagcacatctcgacaagatggatgagaccaaggaaaaattcgcccggctgatcggtgctgaaaaagaagagatagccgttttgccgtcagtatctgacgcagtggccgctgtggccgccgcaatgccgcagccaccccgtcgaaggcagatcgccttcacggatatcgattttcctgctgtcggccaaatttggcttgcgcaagaccgcttcaaagatcacctcatcatcattcaaagcgaagatgggatgattgacttggaacaatacgaaaaagacgttaccgatcagacgctcttgacgtgtgtgccccatgccggctatcggaacgggtttaagcaagacataaagcagattgccgagattgttcatcagaaagggtcgcttttattcgtcgacgcctatcagactgccggccacattccgattcatgtcaaagacatggatatcgacatccttgcggcggggacgcgcaaatacatgctcggcattcccggaacagcttttttatatatgaaacgcgaactttgcgaacaatttgagccaaaaacggccggctggttcggaaggagcgcgccatttgccttagattcaggctttgcggaaggtgcgaaacgcttcgagtcggggacaccgtcatttatcagcatatatgcggcagacgcggcattgaagctgctgcttgaagcggagcccgacaggatcgagccctatctgcggcagcttgcggcattctctttgcaatacggtgcggaaaaaggcctgaagatcacaggacccaacaccgtacataacagaacaagcctgatctcggtgtatgccgaagaagccgcccgtgttgaatccctcttgcgtgaaaagcatatcatcgtctcaaagcgaaacaacgtcataagaatagccccgcatttttacaatacaaaggaggaaatcggatttgtgatggatgagatcgcggcaatcgtaggctaagcccccggctttaaaatggacagaatgcgattttttccttaaactataaaaaacaattttcatcaaggaatgagacaaaatggagctttatatcgaaggtgaattagaagagcataggaagctgccgcaccgaaaagttttgtttgccattttggctgttttgctagggtccgggattaccatcggatatatcgtgtatacgcatttttattcgatgaatcatctgccgaaaggaaattggtttcagtcttccggttcgccgaatcaagcatacaacctgaatttgtatagagtgaacaaaggcgggggaacgaactccccttccgtcagaggggaattgacaacggttgccaccggtgaacgaaagaatatctattggggatacgaagaagaacatgccaaaatcgaatggcaggacaaataccatgtgtccatcaacaacaatgtgctggacgtcagaactgatatatatgatggaagaagagagtgacggcgtcactctcttctcgtgtacatatcatttgggacgccgtttaaaaaatgcgtttcttttccaatggaaaagaggtgcagctcatgcatcgccctcgtgcacgccgtataaaataaagtccgctctctttcctttttgtattgcttttcagaagcgtcataaatgatgacggcatcaaattcgatccctttcgccaaatagacgggaatgacgaccacgcctttttgaaacgttctcgtttctttatcgatcagtttaagctctgcatgctgctgaagatgctggaacgcatccctgcattcccggactgttttacagatgactgcaatcgtctcaagtccttctttttgaagggcggtcataagggaagccatctctttatggtgtgcatgaggatcggctgatattgtcaaagtcggttttttgccgttcctattaaaagcttcgatctcttcgcccccttcgatgatgcgctttgtcaattcaacaatttctttcgtcgacctgtagctgcgcttcaaggtgatgatctccgttttttcgccttcaaacacgcctcccgacagaagcgtcttatcgtgataggcatgggcaagaatcgcctggtttaagtctcccagcatcgtgatgctgcacgcgggaaacaagctctccaaaaaagcaagttgaaaaggcgtgtaatcctgggcttcatcaatgaataaatggcggattgccgtgtttttccccccgcctttcagcttgtttttcatatataaaaaagggacggcatcttcataaagcagcttctcaaaacgaaagcttttctgagtgaatgtgcaaatgctctgccagtcatcagggcgcgtttgcggggtatagcgtccggaaaaaagctgaaggtatgttcctttaaaatcaataaagccgaacgcttttaccacttgcttgagcggcttgaactccctttcggcaacgatggaggcaaggaggtttcgctccctttcataatcgtcaaacgtattctccgtaaagcgctgttcctcctgaagacgtttataagcctttaagtattcctctttatccagcagctcgctttcttcgatgacccagtctttttttctttcctggcgttcatatttattcaggagctgcaacagccattttcccgtttgttcaatccggttggacagcgtgtctgaatgatcaagggccgcgaaaaatttccgcatctgaccgcttgtgatgatcctttttccgcgaaaggtgatatgtttaaacaccaggtgcccttttgccaaatatttgacgtaatcatcgatgatgcctttgaaagccagactggatttcaattcaatcgatttcatccggatgcgctgctcctcaccgtctgaagcggttaaacaatattcaagctgatcgaacggagtctcgcatggtacctgctttccaaggcggcgcgctacaaattcctggaacgtcgtctgctggatgttttcctctccgagctcaggcagaacattggcgacatagctgttaaaaagcaggtttggagagaatagcagcatctggctcgactcgatctgcccgcggccgcggtacagcaaatatgcggcccgctgcaatgccgccgacgtttttccgctgccagccgctccccgaacaattaaaaagcggctcttttcgttccgaatgatctgattctgttctttttgaatcgtcgcgacgatgcttttcatctggatatcggcctgctgccccagcacttcctgaaggacttcatccccaatcgccatatccgtattaaacatcgctttcagctgtccgtttttgaagagaaattgccttttcagctcaatcgttcccctgaccgtctcgtccggaacttcgtattgagccgcgccgggtccatagttatagaacagactggaaatcggcgctctccaatcatagatcaaaaaccgctcttctttttcatacattaaagaggcgagtccgatgtagacggactcagcgttttcttcgccgtcctccaaaaaatctacgcggccgaaataaggcgattctttcacttttaacaggtttttcagctggctgtaaaactgcttatggctcctttccctctcagccaaaacctcagcctgctgtttaatgctaaaaaatgtttcaaccgcttcattttcatcggctatgtttacggtgacatcgctccaaaaatgtttccgtaaatcgatgatatcctccttcaatccgccggtttttccctttagagaatgaagcttttgatccaattcctttaaaacaagccggattcgtttttcctcttccagccattcctgaccgttttcctgcacgctgaccactccctaaaaagatttgacatcgaaaaagattcatgataaaataaaaatggataaaattataattattgaaattttatgttaaaatacacttcatcttatcatataacctttggtcaaatcaatataaaaagccgatttttcaatcaacgaaaaatcggcttttttctattcagctgtgggaccgcagcgaacggttcggcagcttccagttgaacatgtacgaacatacacggcacgcgaccagcaaagcaaacaggatatacaacgtgagcggcttctccgcccagcccatgccgataatgaatccgcccaaagcggcccaaacggcgtaaatctccgttttcagcacaagcggctttcttccggccagaaggtcccggatcattccgccgccgcttcctgttaagaccgccgcaacgatcactgcgctgaccggatggttcatgtgaacggcataaagggctccttgtatcgcaaatgcggcaagaccgatcgcgtctgaaaagctgccccagatgctccagtgctttaacaggagcttcggaaacaaaaaaacgatcgtgatcgagacaagagcgattagaaacagactcccctgctcccacaaggcggacactggaactccgatgagcaggtttctgatcgcccctccgccgaacgctgtcacaatccccaatatataaactcctaaaatatcatactcttcttccattgcaacgatcgctccgctgatcgcaaaagcgacggttccgatgatgctcaacacttcccaagccatctaagatgtcctccatactaaacttcaatctttttgattttataacttctccaacctttaaatcaaccctctctgaatcaaaatatcttataatatagaaagatgtttttaaaggggtggaaacatgggacaggaggtcatcatcgaaaaagcgaaagccgagtgggcgcacgaatttgaagctgaaaaacaacagctcgcagatgtcctcggaaaaaaagttctcgctatcgaacaaatcggcagtacctctgttcccggccttgcagcaaaaccggtactcgatttgatggccggcgtgagcagtctcagcgaagcttcagttggatcgaaccgcttcaggagctcggctatgagcacgtatttcacgaagccttcccagccaggcgtttttttcgaaagggaaagcggagggcgggcacacgccatctgcacgtatacatttttcaaagcgaagaatggaaaaatcagctgagattccgaaattatttaagaaagcattcagtcgagcggcaagcctatgaaacattgaaaaaaacttggcgcggcgttttccatattaccggactcctatacaaaaggaaaagaatcggttcatcacagccgtgattgaaaaagcaaaacattcggaaaggagcggcacggcatgctgaaaaagacaaaacataaactgcttactatagccatcgccttcattatggcggttttgttgtactactatgtccaagttacgaagtgaaagcgggattatacgtgcaaggccattctgactgttttgaggatatgcccttcgaaatcttcatcatattcggcgacatcctcaaaacccttcgccttgtaaaagttttttccggtgcggttttctttttcaacctctacaaagatctttttcactccctttaaatggttcatcccctcttccaataatgcggttccgatgccttttccctggtattccggagctaaataaacggctgcgagataggctacccctccttctctgacaaaggagtagttggcaaagccgacgatttttccgtccgcttccgaaacgagcattaacgagtgttccaaacgctgctgcattctttcgtcattgtacgctttctgcaagaacttctcttgaatatcgaaaggaatgatcccttcatacgtatgattccagcttgttttggcaatctgctgtacttgagggatgtctttctttttcattttgcgaatcttacactccatcctcatcatccttcacatctatttgataatttccaaatattataacatcctttctattgaacatgtataagaaataaaaaaagagcattgtcagacaatgctctttttactcgtctttccccttgagaaagcacataaaaatgataatcaaaataaatgcaataagggcgagaaacggaatcgtgatgaaaccgaaccaattgatatactgccctgagcaaggcactcctgtgacacacggtttaatgccgttgaatccgggaattttttgttccatgtagtgcatcagggaaatgcctgcgccgatcaccgccatcggcagcacgtattttttcacgcgggcatcgccctgaaatgtcgcaattccgagaatcagcacgagcggatacatcataatccgctgataccagcacagttcgcaaggaataaatttgcggatttcgctgaagtacaagctgcctagcgtcgccgttaatgagacgatccaggcgccgtacagaaaaagcagtttatttttcatcagactggcctttcagctctttctcgatcgtttctttgattttgtcataatcaaacggtttgtcgatttttacgccgttgacaaagatcgtcggcgtcgagtctacaccgtatttgttgatgagcgaattgtccgtttttaattgctcagcgaacgttttgtcatttaagctgctgacaagcttatcgcgtttgattttcgtattggcttccgtgatgtccgccaattttgccggcgtcgcccactcgttttccatcgtgtcattgtcaggctgcgccttgtacaacgcctcatggaacttccagaatgaatccggatcttccttccatacctgctcggaagcgagggcgctcaattcagagcctctgccgtgctgttcattgacgaagttaatatatgaaaaattaacttgatctttatcgatgtaatcctttttcaaatccggaaagacggtctcagtccactgtttgcagctgggacatttgtaatctccgaattccgtgatcgttacagccgcatctttgttgcctagaagcggctgtccttcagttgaaggcttgtcatcaaaggtttgcgaagcattttgggtttgattgttgattacgacaagtgcgccgatcagaaaaacgaccacgactgtcataatcactgcaaatttcatcggtgactgctgtttcttcttcacttagacacctcattattcttattttttagtatgccagtttgataacctctttcattttaacaagacaagccgcattcgtgaagatgctaaaaaaggaatttccagttcattaggtggtaaaaaagttacatttctttcacttttaataccctcatcgcatttaaaacagccagaagggtaacaccgacgtctgaaaagacggcttcccacatcgtcgcgatgccaaaagcacccaggatgagaaaaactcctttaacgccgagtgcaaaaataatattctgccagacaatcgtcctcgtccgcttggcaatgctgatggcttccgcaatttttgaaggctgatccgtcatgatcacaatatcagccgcttcgactgccgcatcagaaccgaggcctcccatggcaaccccgatatccgctctcgccaagaccggcgtatcgttgatgccgtctcctgcaaaaagcagcttttcttttggaagtttttgcttatctaatgtttcaatacggtccaccttgtgctgcggaagtagctccgcatgcacttcatcaatggacagctgttcgccgaccgcctcaccggtgtctttcgcgtcgcccgtcagcatcaccgtttttttaatacccgcttttttcaaagcggagatcgcacgcttggcatcctctttgatttcgtcagcgatgacaatcgagccgataaacgtatcgccggcggctacataaacaacagttccgatttcactttccttttgatactgtatgccggctttcttcataagcttggcattcccggctaaaatgacggctccgtctacaaccgctctgacgccgaagccggccgtctcgctgtaatctttgatgcggtccgcttgtacttccttcccgtatgcttcacggatcgactcggcgatcggatggccggagaaatgttcggcaagcgccgcatattcaagcagttcatcttctttgacatggcttgcaggcgacagcttgacaacggcaaattccccttttgttaaagtgcctgttttgtcaaaaacggcgtatttgacatcattcagcgcttctaaataattgccgcctttcacgagtatacctgcttttgacgccgctccgatgccgccgaaaaagccgagcggaatggaaacgacgagcgcgcacggacaagaaatgaccaaaaagacaagggcgcggtacacccaatctgacagcagggcgcctgaaataatcagcggcgggacaaaagcgagaagaagcgcgattatcacaacgaaaggcgtgtaatacttggcgaatttggtgataaaattctctgttttcgcttttctgctgctggcattctgaacgaggtcaagaatctttgaaacggttgattcactgtattctttgtccacttccacttcaagcacgccgtttttgttgacaaatccgctcagcacctctgttccgggagcggcttctctcggaacggattctccggttaatgcggacgtatcgacaagcgatttgcctgcccgcactttgccgtcaagcggcactttctctcccggcttgacgatgatgatatcgccggctttgacctcatcgggagacactttgaccgttccgccttcggtttgaagattggcatagtcgggacggatgtccatcaaatcgctgatcgacttccgggagcgggtgaccgcggctccctggaacagctcgcctatttgatagaacagcataaccgccacaccctcgggatactgctgaataataaatgcccccagagtggcgatcgtcattaaaaagtgctcatcaaaaacccggccgcgaaagatgtttttgacggcccttaatacgacatcgccgccgatgatgaggtaagctaggaaaaaaagaagccactcggctgcggtgccgccgggaagcagaaagcccgccgcaccgagaacggttcctgcagcaagccttgcaaccgtttttttaaaccgtccgtcgctttctggtggggcctgttttgtcccttccttcagcgtcgcgttgacgtgcggttcgatctcggttacttttttctttattattaaagaaatgtcttcgccgctgttttggtcgacttggacagtcagcgtgcttgttgcaaaattgaccgaacacgcttcaatccccttcataccggctatctcatgctcaattttttgtgcgcaattgctgcagtcaaggccgtttagcgtgtactcctgtttcaccttttccatctctctcacctttctttttcagcgccgggctttattttatatatgagcatatacgcatatattatctacccttattatatgcttcatccgaaaaatgtgtcaatcgatctttgttatcatacgcaccggctgtttccgtgtttaccctgatccgcgtctgcgaaaactctgctggcatattggaagcaatgcccaaatatacttagtttagctattaaactaacaagcttttttcataaggagtgagcgcttttgaaaaaatcgtgtctgatgatcgtctgcctcgcctttcttcttgctttttccgcaggctgcaaaagcagcaccggcacaaagcatacggaagaaataaaagtctgggattactttaccggcaagcagcaggatctttatcatgagcttgtcgaacagtacaatcggtcccaggaccggtacaaggtcgtaacggagtacattccttttaatgaagtgaaaaagcagctgtctgtcggtacagccggcaatgccatgcctgacgccgtattccttgacaatgtcgacaatgcttcattcgccgctatgggcgtgctcgaagatttgacggagaaaatcgaacaatgggggcaggctgaccagttttatgaggggcctctatcatcagccggatatgaagagaagtactacggcatccctttcgcaagcaatgcgcttgccttgttttacaacaaagacctcttgaagaatgcagggatctccaaaccgcctgaaacgtggagcgatctgaaaaaagcggcggaaaaaacgagcaaaggccaaacgaaaagatttgccctgtcagccgtaaaatcagaggaaagcgcttttcaattttatccgtttcttttgtcttccggagcagatctaaaacagctgaattcaaaagaagcagcctcttctcttcagtttttaacagatctgatcaagaaaggcgcaatgagcaaggaagtgttaaacgccacccaggatgatctggccagacagtttgcagcaggtcagctcgccatgatgatcaacggctcctggaatattgaacggctggaagaagccgaagacttaaattacgggattacctatatcccgaaagatcaaacattcgcttctgccctcggcggcgaaaatattgccgtcgttaaaggaaaaaacaccgccggcgcctgggattttatcagttggctgatcgatccggagcggctcgaaacgctgacagcagaaacaggcgtgtttccgccgcgcaaagatttgctcgaatcatcgagccattggaaaacagatgataatttaaaagccttcattccaatcatagagatcgcatcagcccgcggcccttcgaaagactggccgaagatttcggaagctttgcagactgccctgcaggaagcattgagcgaaagcaaaacgccgaaagaagcgctggatgaggccgcgcaaaaaatcagcgccttaaactagctttaagcgcacgaaggagttttgtcatgatcagagccattgtccgtaaatgggaagggtacttttatttgtttccggcagttctttttatgcttgctcttatcggttatcctctcatctacaacatgattctcagctttcaaaacgtatcgcttgcaaatatagcctcacacgatatcagctttatcggaatcgaaaattatcagcggcttgcccaggataaaatattttgggcatctttaaaaaacacgctgctttacacggccggaagcgttgtatttcagtttgcaatcggctttttgctcgctttgtttttcagcatgaagttcaggcttgccccgtttctcaggggattgatgatggtgagctggctcatcccgctgacggttacggcgcttttattcaagtttatgatggcttcaaacgaaggagtgttcaatcagctgctcctatcatggggaatgatcgacaccccgatcccctggctgtcagacccgaatatggccatctggtccgttatcatcgccaacatctgggtcggcattccttttaatatgctgctcatatccgctggactcagctcccttccggaagacgtctatgaaagcgcaagccttgacggcgccaatgcttttcagaaattcatccatctgacactgcctttattgcggccggtgatcactgtcgtcatgatgctcggcttcatttatacgttcaaagtgttcgatcttgtgtttgtgatgactggaggcggtcccgtggacgcaactgaagtcctgtcaaccgtcagctaccgctactcctttgacgaatttcaattcagcatgggcgcggcaagcgccaatgtcctgtttcttattcttcttttggtcagtctcgtctatttgcggctgatcaaaaaagatgaggtgatgtcgtgaaaacgaaccaaaaggaatggctctttaacattattggcgtcctcgttacagccggctttttattccccgtttactggatgattgctacggctttcaaaagcgatgccgaattgtttaaaacaccgcctttattgtggcccgagacattccgcacggccggctttgaagctgtgttcacttctggcgtcgccggatactttttgaacagcctcctgatttccggggcggctgccgtcatcgttctcatattggccgttccttccgcctacggcttggcgcgctttcggatcaagggcaaaaaaatgttcattttactgtttctcatcacgcaaatgctgcctgccaccgttgttttgactccgctgtttatcgcctttaatcaactgaacatattaaatacgtatatcggaccgattttgacgggggcaacgctcggcgttcctttttctgttttaatgctcagaaccttttttcttgggattcccaaggaccttgaggatgcggccaaaatcgacggctgcagccgttttaccgcgttcatccgcatcattttgcctatcagcgtacccgggattgccgtcagcggagcggtttctttctttttcacatggggagatttgatttacagcatgacattcaaccgaaatcaggagctgtggccgctgacggccggcatttacaatgtgatcagccaatacggaatccagtggaatgatctgatggcatttgccgttttatcggttctgcctgtcatcatcatttttatgctgcttcaaaagcagcttgttaaaggacttatcaatggatctatcaagtaaaaagaaagggtgttttcgatcatgaaattttcagacggctactggctgacgcgcgaaggatatcacatcaacacgccgaaagaagcctacgaccgaatgattgatcagcaatcattgaccgtgtacgggcctgtcaaagcggttcaaaagcgcggggacacgctcgacacccgcatgctcaccgtcagattttcgagtccccttgaagacatgatccgtgtgcaagtgttccattttcaaggggaaacgcctcggaaacccgactttcaactgcatacggcagatgttgaaccggtcatcaccgaacacgatgatgcgttgaccttccaaagcggcagcctgtgcgtcgaagtgagcaaaaacggttggggctaccaattttcacgtgatggacagagcctgaccgcaagcgaatcgaacagcctcgcctatatcacaagcgatgacgggcgcacctttatgagggaacagctcaacatcggcgtcggcgaattgctctacggccttggcgagcgttttacggcattcgtgaaaaacggccaaaccgtcgacatctggaatcaggacggcggaacaagcacagagcaggcatataaaaatgtgccgttctatttgtcaaacaaagggtacggtgtttttgtcaatcatcccgagctcgtctcgtatgaaatcggttctgaagtcgtatccaaagcgcagttttcggtcgaaggagaatcgctcgactattttgtcatcagcggcgccgaaccaaaggatgttttgaaacgctatgccgcgttaacgggaaaaccggcgcttcccccggcctggtctttcggcctctggttgtcaacatcgttcacaaccgactattccgaggagaccgtgacccgcttcatcgacgggatgaccgaacgcggcatcccgctcagcgtgtttcattttgactgcttctggatgaaagaatttgaatggtgcaatttcgaatgggatgaacgatattttaagcagcctgaagccatgctcagccgcctgaaagaaaagggcctgaaaatatgcgtctggatcaacccttacatcgcgcaaaaatcaaagctttttcaggaaggaaaggaaaacggctacttcttgaaaaacagccggggggatgtatggcagtgggaccggtggcaggccggaatggccatcgtcgacttcacaaatgaaaaagcgcgtgactggtattgttcaaagcttgaaagcctgctcgacatgggggtcgactgctttaagaccgatttcggagaacggattccgagtgacgctgtttactttgacggatcagatcccgaaagaatgcacaattattattcttatttatacaacaagaccgtatttgacttgttgaggcaaaagcgcggcgaacgggaagcggtcgtgtttgcaaggtctgcgacggccggcggccagcaatttcccgtacactggggcggggattgttttgccagctatgattcaatggctgaaagcctgcgcggcggcctgtcgctttctctttcaggcttcggcttctggagccatgatatcggcggatttgaaagcacggcaacagccgatttgtataagcgctggaccgcattcggcctcttgtcgacgcacagccgcctgcacgggagcgagtcataccgcgttccgtggctgtttgacgaagaagcggccgatgtcatgcggtattttgtcaaactgaagcacaggctgatgccttatttgtacgccgctgcacatgaagcgcacgctgaaggcattccgatgatgcgggcgatgctcctcgaatttcccggagacaacacctgccactggcttgacagacagtacatgctcggcggaaggctgctcgtcgctcccgtttttcaggaagacggcgctgtccgttattatttgccaaaaggcacgtggacacaccttttgacgggaaaagagacggaaggcggagaatggaaagaagaacggtacggctatatgaggcttcccctgttcgtcagggaaaacacactgctgccgctggggcaggaatccgggcgacctgattatgattatctcgacgatgtgacgttctgcctctatcatttaaaagacggctgtacagccgaacagacgatttacaatgaaaagggcgaagcaatgacactcagagcttcacggcatcaaaatacgattgccgtgaaaacaacgggcgtccaaaagaactggaagctgctcctccgcggtctttctgtcacctctgttattaacggagctgcggaagcgcttcaggagggaacagcggttcagccaaaagaaaaagaacgggatgtcttcatttatttctaaaaaggagtgatcaggatgctgaaaacggtccgcatcatcatattgggcgcaatgtgcacgatcctttccgccgccggtttcgatccgccgcagcccgcagccgctaaaagccaggctgatgaatatgagtatccctttcaagatcccagtctccctgtacaaaaaagagtcagcgacttgctttcacggctgacccttgaggaaaaagtgtcactgatgcatcaatatcagcccgccgttccccggctgggcattcccgcttttaaaacgggcacagaagcgcttcacggcgtcgcctggctcggggaagcaaccgttttcccgcaggctttcgggctcgcgcacacatgggaccgctatttaatcaaacaaatcggctcggcggtcggtgatgaagtccgcggcttccaccaccttgatcccgcggcaaacggagtcaacgtctgggcgccggtcgtcgatctgctgcgtgatccaaggtggggaagaaatgaagaaggctattccgaagacccctttttaaccggggaaatagcaaccgcctatgcctccgggttaaggggcgatcatcccttctatttgaaaacagttccaaccttaaagcattttcttgcctataacaacgaaacagaccggggattcagctcctcaagcatcgatcccaggaacatgcacgagtattatttgaagcccttcgaaacagcaatttccaaaaaagccgcgtatggactgatgccggcctacaattctgtcaacgataaaccggccattttgagcccgctgctcgacagtacagtcaaacgtagatgggccggagacgatttcttcatcgtcagcgatgcctttgatccttccggaatcgtcaatgaccacaagtattatgacagccacgaaaaagcccatgcccacgccgtaaaagccggcattgacaactttacggatcagggggaaaatcccgagctgacgagaaacgccttaaccggtgccttaaagcaaggccttatttctgaaaaagacctcgatcaagccttggccaatacgttcagcatccgttttcgcacgggcgaatttgatccggacgaactcaatccgtacagccgcctgacagatgacgtcatcaacagtccaaagcatcagctgctggcgaaaaaagcggctgaaaaagccattgttttactgaaaaacgaccaggatctgcttcctttcaatgcccggaagaatgaaagcattgcagtcatcggcccgttcggaaatgcgctttacgaagattggtacagcggaacgatgccgtatcggaaaaccccgcttgacgaaatcgcggacaaaatcggcaaagaccgcgtctcctttgctgaaggtctggaacaaagcggcttcaaatccgcgctgaccggaaagtttgtaactgcaggccgggacggcaaacaaccgctcacagcagcggctgataagcttgagaaaagcgcggcattcgatgcggcggattggggagaaagcatcttcaccctccgcgcccaagcgaacggcctctatgtctcgcttcaggatgacggccggctgatcgctgatcagaaacagccgaacggccggaccgttaaagaaacatttcagttcgaacagcagtctgacgggacatttgccatcaaaaatacggcaaacggcaaatatctcaccgccggtaaagacggcacattaacagccgccgccgaaaagccggcaacagcagcggaaaagttttcaaagacgatcatcaagagcggtacggatgaagcggttcagctggcaaaatccgcggacaaagccatcgtgtttgtcggcaacaatccttacatcaacggccgggaaaccgaagaccggaaagatattacactccctccggcccaggaaaatctgctgaaagctgtttctaaagccaataccaatacggtgcttgtcgtaacgagcagctatccgtttgctctcaactgggcaaaagcgcacattcctgcgatcatatattccgctcacggaggccaggaggcgggaagcgcattggcggacattctctatggagatgtaaatccgggcggacggctgacgcaaacttggcacacctcagtcaaagaactgccggatatgatgaattacgatatcatcaaagggaaaagaacctataaatatttcgtaggcaagccgctgtttccgttcggccacgggttatcctatacagcgtttcgctacagcgatttaagcctttcctctgacagcatcaaaaaagacggatctgtcacgattcgcgtcaacgtcaccaatacaggcggaagaaaaggagatgaagtcgttcagctctatacctctcccctgtttaaaacacgggttaaacagccgaacctggacctgaaagattttcagcgggttgaactggcaccgaaagaaacgaaaaccgtgacattcaagctgaaacagacagaccttgccttttgggatgtgacgagagaaacatttgccgttgaaagaggcccttacagaatatccgtcggcagctcggcggcggacatccgcaagacaaagcggatcttcgtccaaggcgaaacaattcgggaacggaacttgcgccgaaagacaaacgctgaagactacgacgactacaaaggcgtgctcatcaccgaagaatccaaatacggcggcgatgcggtaaaaagcagtacaacaaacgcgtggatcgcctaccatgatgtccgcttcaaaggcgaaaaaaggatagaagcaaaggttgcaagcagcggcgccggcgaaatcggcatcttcctcgaccatcctcaaaaaggaaagcaaatcggttcgttaaaagtgcctgacacatccggattgcaaaactggaaaacggtaaaagcttccgtccgaaaatcgacaggcacccaccgcgtcttttttgtcttcaaagggaaagttgcaatcgattcgtttcaatttgaaagataaaccggcaaacaagaaattttttaaagccatgcagcttgatctgcatggcttttaccgtttttcagcaattttagcgctttacaatttaggaatgatatattagaattcaatcaaaagttgcattaggtaaaaaaaatgtctttaggcaataaaaaattgccgaaacaaaaatattgtatgcaggttaactttcatatagacatagaaaggggttaatgaacgctatgaaacccgcaattaccgtaaaagatttatatgtttcttatcacggcgcagaagcgctccgcaatattaatttctcactcgatcaaggaatgatggcgggcattatcggaccgaacggcgcaggaaaatcaacgctgttaaaatccatgctccaattgattccaaaagataaaggcgacgtccgtctgctgggaaaaccgctcaaagatgtacgcaagcaaatcgcctatgttccgcagcgaaatgatatggattggacgttcccgatcaatgtcctcgacaccgtcatcctcggcacgtatcctgaactcggccttttcagacgtccgaaaaaacgcgataaagactgggcgtatcactgtcttgagaaagtcgggatggctgcatatgccaagcgtcagatcggcgaactgtcaggcggacagcagcagcgcgtttttctcgccagggcgctcgcccaaaaagcagagctgttctgtcttgacgaaccgttcgtcggtattgatgtgacaagtgaagaaatgatcgtcagcatcttaaaagaacttcgtgatgaaggaaagaccgttcttgtcgtccatcacgatttgagcaaagcggacagctacttcaatgaattaattttgctgaacaaagagctgattcaaaaaggccctgtctccgacatcctcaatcccgacgtgatgatgaaagcctacgaatctcagcttccgttcctgcaatcgaaaagaggtgcgatctgatggagtttatccatggtttgatggaatattcgtttctgcaaaaatcgctgttcacctcgattatggtgggcatcatttgcggcgtcatcggctgctttatcattctcaggggaatggcgctgatgggagatgcgatttcacacgcggttcttcccggcgtcgccatctcttatatgctcggcgtcaattttttcttcggcgccgtctttacgggcatcctgacggctctcggaatcggctatgtcagccaaaacagccggattaaaaacgattcggccatcggcatcgtatttacggcctttttcgccgtcggaatcatattgatcacgcttgtcaaaagctcaagcgatctgtaccatatcttattcggaaatgtgctggccgttcgttcatcagacatgtggatcacgctcgtcatcggagtcattattcttaccgctgtctttttattttacaaagagctgctcatcacctctttcgacccgacgatggcggctgtctacggcttgccgaaccggctgatccactactttttaatgacgcttttaacaatggtcacggtcgcatcgcttcagaccgtcggcatcatcctcgtcgtcgcgatgctgatcacgcctgccgcaaccgcttatctattgacggaccggctgtgggtgatgatctatttgtccgctttcctcggcgctttgtcagcggtcatcggccttggattaagctatacgtacaacctctcctcaggagcggcaatcgtgctcgtggctacgattttgttcggactttcctttacgttttcaccgaaacaaggcgtgctttggagagctgtgaaatcaagaagaaaacgggcagcgcttcaacaataaccgcaaaataaagggggaaaacaaaacatgaaatggaagcaaacattagcaattgcggcggcattgattctgattctcgccgccggctgctcctcgaaaagcagcagcgaagaaaacggaaagctgaaggtcgtcaccacctactccattctttatgacatcgtcaaacaagtcggaggggatcacatcgatttatacagcattgtacctgtcggaacagacccgcatgaatacgatccgcttcctaaagacgtgcaaaaaacgacggacgccgatgtcgtcttttacaacggattgaatttggagacagggaacggctggtttaacaagctgctggaaacagctgaaaaagacggtgatgacgcccctgtctacaagctgagcaaaggggtcaagccaaagcatctcaccgctaagggaaaagaaacggaagaagatccccatgcatggctcgacattgaaaacgggattcaatatgcaaagaacgcaagagacgcgctgatcaaaaacgatcccgaccataaagaagactacgagaaaaacgcggaagcctatatcggcaagctgcaaaagcttcatgatgaagcggtgaaccgctttaaagatataccgaaagagcgccgcgtccttgtgacaagcgaaggggcttttaaatatttcgcttcggcctacggcgtcgacgcgcagtatatttgggaaatcaacaccgaaaatgaaggaactcccggtcagatgaaaaaaatcgtcgacacagtgaagaaaaaggacgtcccggccttattcgtggagacaagcgttgacccgcggagcatggaaagcctttcagccgaaacgggcgtgccgattaaagcaaaagtcttcaccgattcgatcggaaagcccggtgaagcgggagattcctattataagatgatgaaagaaaaccttgaccggatccatcaaggcctcgccgaataaccaatgaactgctgtacaggatgtacagcagtttttttcttatgtttttccgattttaaagcagggtacaacgaagggaaaacgaggaaaaaggagtgtgtttcgtgaaatctggatatgaggaatgcatcaaagcctgccgagaatgtcttgaagcctgcaaccactgctttgacaaatgtctgatggaagaagaggctgggatgatggccgaatgcatccgtcttgaccgggaatgcgcggagatgtgcggttacgcaattcaagccatgacgcgcaacagcccgtatgccgaagatatttgccagctttgcgcaaaggtttgcgaagcttgcggcaatgaatgcagccagcacaagcatgaccactgccaattttgcgctgaaagctgctttgcatgcgcggaagcgtgcagaaaaatggcttcttaacttgaaacatccggccctcgagccggatattcttatgtaggaaatgtttatttttttctccttccccctttctaaactgatacaatatgactataaaagggggttttatcatgaaagacagcgtgtttcaaatgacttctgacacatatcaatctctcagcgattcagaacggcatttgctcgagtacatttatcagcacttagacgtcatcgccactttatcgattgtaaaattaagcgaggatgcaaatgtttcaacagccacgattgtcaggttaatgaaaaaactcggatatgacggctacacttcttttaagtatgcattaaaagaaaaacaccacctcggacacgctccgctgatggatgatatcgacagccaaattaaacaggccgtgctaaagaatgaaagagaagttctggatacgattaagatgcttgatatcgggttgatcgaagatgccattcaaaaaatcagcaatgccgaaaaagtttacatcttcgcaagaggattgtctgaaatgattggaaccgagatgacgatcaagcttcagctgctcggcaaaaactgcgagatgcacagcgacccgaatattatcagaggaaagtcaaaaacactggccaaaaaagacctcggcctttttgtttccttgaacggcgagacagaagagcttgttgaagccgctcaaaatttcaaattgcaagccatttccaccattacattaacgacaaggatcgattcgcgtcttgcgaaattatcagagatcgtactggtcgggtttaaaggggaacaatcattttttcccgattatgaagtccgctctcgcctccctctgcaagtcctctcccgcatcatgctggactcatatgtcatccgcaccgctcatagctgaaaacctttacacaacctgtaaacatcccccctttcatctgtgacataatgtctgtgaagccacatataaaggggggatacagcatgatctatacatgcacgatgaacaccgcagtcgacttattcgttgaaaccgacgagctgcttcccgatgttgtcaaccgtactaaagatgaagattatcagccaaacggaaaaggcgtcaatatttcatttatgctcaagcgccttggtcttgacaataccgcgcttggctttacaggcggattcaccgggcgttttattgaaaatgaactgctgaatgaaaaaatcgtcacagactttgtcgaagtggaaggcatctcacggatcaatatttttatcaattcaacccgggaattcaagattgtaaacaaaggaccgctcatatctgaagcccgaaaacaggagctgatcaacaaaatccgtcaaatcccgccgggccgcttcttatttatttcaggcagtcttccgagaggagtccctgatgacatgtacctttcgctttccgagattgccgccgaaaacaaactgaaattgatcttggatatcagttctcccgtcctattagattgtctttcataccatccttacctgattaagccgaatgaacaggagcttgccgcatttttcagccggaagaaagcgctgtccgaagaagaaatcatccattgcggaaaggaacttctcgaccgcggcgctgaaagggttctcatctcccgcggcaaagacggagccctttatttggaccgccaaagaacattaaaagcgaccgccgctaaaggcaaagttgtcaatacagcatgtgccggcgatgccatgcttgccgtattcgtcggaaaacaggagctcggctgttccgttcctgaagcactcaggcacgcctctgccgccggttccttgacggcattctcgaaaggactcggtgatgtgtccaaactcgatcaaacagcttcacaaattcaaatcactcatttataaagggggttttcttatgaaaaagttcaaaatcatcgcggcaaccggctgtccaacagggattgcccatacatttatggctgaagaggccttaaaacaggctgccgccaaactgggtgtggaaatcaaagtcgaaacacacgggcaaatcggcgttcaaaacgaactatcgccagaggacattaaacaagccgacggggtcattgtcgcggcagacaaagatgtaggcgcagagcgttttgcaggcaaacgtgtccttgacgtcccggttgcgcggggcatccgggatgcggaatctttaattcggacgctgatgaacggcgaagcgccgatttaccgcggacaaactgcggcaaaaacagaggatgaaccaaaaacaggcgaatccgcttccatcggccgtaaaatatataaacatttgatgaacggggtttcccacatgctcccatttgtcgtcggcggaggggttttgattgcactttcctttttattcggcatccattcagcggatcctgaacatccaagctacaacgcttttgccgaattgctgaataaaacgggcgcattcggattccagctgatggttccgattttatccgcctatatcgccgattcaatggcaaaacgccccggcctgattgtcggttttatcggcggcatgatcgccagcacgggcggagcgggttttctgggcggcatcgtatccggttttttggcgggactgatcatttacggcctctcgcatgcacttaaaaaaatgcctcagtcacttgaaggactaaaagcaatttttctttatccggttatcggcatttttctgatcggtgcggtcatgtttttcctcgtcgaaccgatgacggccattaatgaggggatgaagggctttttagccgactttcaaggggcgaacccaatcattctcggcttgatcatcggctgtatgagcgcatttgacatgggcggcccggtcaataaagccgcttatgtcaccggtactgctcttctcgctgaagggaaccaatatttcatggcaggcgtctccgccgcgtgcatcacaccgccgctcgttattgcgtttgccacattgcttttccgcaaatatttcagccagcaggaccgaaatgcaggacttgtcaattttattctcggcgccactcatattactgaaggcgctatcccgttcgccgcaaagaaaccaatccctgtcattccgattttgatgatcggctcttcggtttcggcaatattaacatattcattcgcagttcaagtacctgccccgcacggcggattccttgtacttcccgttgtaacaggagcctttcaatgggtgctgtcgattatcatcggatcgcttatcggtgccttcttatacggcttttaccaaaaacggacatatgaaaaagagaaaggctgatcaaacatgaaaacagcagctttaatcaaaaaagagcacatctatctacaagaaacgctatcttcccaagcggaagcttttgaccggctggctcagatcgcatatgaatcaggagcagccaaaacaaaacaagcggtcattgacggattggcgcaaagagaggctgaaagcacgaccggctttatcgacggcttcgccattccccatgcaaaactgaaggacatcacagaagcaactgtcatcatcattcaaaacaaggcaggaatcgaatggaacgcgcttgatcagacgcctgtcacgttcatcattgcattattgatacccgatgccgaggcaggcagcacacatctcaatctattatcatcggtgtctcgcatgcttgttcacgaagatgcgaggcagcagctgcttgaagcctcgagtcctgacgacattctgagcaccttctcaagctatttatcttaactttgatcagaaagaaggaatcgatatgctgacaaatacgaaaaaaatgctgctggacgcacaggcaaacggctatgcggtgccggcctttaacattcataaccttgaaaccgtgcaggccgtgacagaagcggctgaagccttaaggtcccccgtgattcttgcggctactccaggaaccttcagctatgcagggcgcgactatattcaagccattgcagaaacggccgcggcgcgctgctcgatcccggtcgccctccatctagatcatcatgaagaaattgatgatattcgcgagtctttatcattggggacgaaatctgtcatgattgatgcttcgcaccatccatttgccgagaataccgcaattacggcgagtgtcgttcaatatgcccggcaaaaagatgccactgtagaagccgagcttggaaggctcggcggacaggaagacgatttgatcgtggatgaagccgacgcttattataccgatccggatgcagcaaaagagttcgtcgagaaaaccggaatcgattcgctggcggtggcaatcggtacagcccacggtctttactcaaaagagcccaatatcgattttgagaggctggccgcgattcaaaaacgggtttcagtcccgctcgtcctgcacggcgcctcaggaatttcagagcaagatgttagaaagtgcatcaagctaggctgtgcaaaagtaaatatcgcgactgaattaaaaattcctttttcagataaactgcgccgatatttgcatgaacacgccgatgcaagcgatccaagaaaatatatggcccccgccaaagaagccatgaaaaaaatcgtccaagaaaagattttgatgtgcatgagcaatgacagatactaatacaaaaagccggatgttctttaacatccggctttctcagcaattcatttgacatgctcttctaaagcatgaccgtcatggggcttttcatcgggtatcggttcccgaccggccaatatgctgtatacaagcatgacaattcctacataaacaaccgctgaaaccgtccaaacgagcactgtcttatccttcaagacggattcctccaatcaagcttcaccttttgcagcctgagtgcattcagaacgactgagaccgaactgaacgccatcgcggcacctgcgatccacggagccaaaagcccgacagccgcgaacggaatgccgatgctgttgtaggcaaacgcccagaaaagattttgtttaatgtttttgatggtcaatctgctcatgaggatcgcatcggcgatgctgtttaaatcgccgcggatcaaggtgacgtcggcggcttccatggcgacgtcagtccctgttccgatcgccatacctgtatcggccgccgccaatgccggcgcatcgttgatgccgtcgccgaccatcgcgacttttttgccttttgcctggattttcttcacctcatccgcttttccttccggcagaacttcggcgatgacgtggtgaatgccggcttcagcagcaatcgcttctgccgtccgccgattgtccccggtgatcatgacgacttccagccccatatcatgcagccttttcaccgctgccttcgacgtgtctttaatcgtatcggcgacggcgatcagcccggcaaaccgaccgtcgacggcggcaagcatcgccgtctttccttgtgtttcgagctcttccatttcgccgttcgcatcttgaatgtcaatatcacggttttccatcagacgtcttgtaccgatcaaaatccgcttttcattgactgcggcttcgataccatagccgggtatcgcttcaaagctgtctgctgaggcgggttctatccctttctctttgatgccttcgacaatggcttcagcaagcgggtgttcagagcttttttctgcagcaccgataagcttgagaaacgatgtttcatcgatccatggttcagggcgcacatctgtcagctgaggcttcccatttgtgaccgtccccgtcttgtcaagcacgatcgtctccaagcggtgagccgtctccaaatgttcgccgcctttgaataagattccgaattcagccgcgcggccagatccggccatgatcgatgtcggcgttgccaagccgagcgcacacggacatgcgatcacaagcaccgcaatcagcttctccagcgccgtgccgaattcgccggggctgaccgccaaataccagatgaaaaatgtgatggccgcgatcgccacgacaatcggcacaaaaaccccggaaatccggtctgcgagccgttgaatcggcgcctttgaaccttgcgcctcttccacaacttttataatctgcgccagcgcagtatctttgcctactttttctgctctgacttttaaaaatccatttttattgattgtagcgccgataaccggatctccaaccgttttgtcaacagggatgctttcaccggtgatcatcgattcatccagcgctgaacgaccttcgacaatctccccgtctgccggtactttttcaccgggcttcacatacatgatgtcgcctgccaaaacgttttcaatcggcacggtcatctcttcgccgttcctgacgacggtcgctgtctttgcctgcagccccatcagctttttgatcgcttcggatgaacgccctttcgctttcgcttcaaacagctttcctaaaatgatcaaagttaagaggatggcgcttgtttcatagtaaaggccgtccggatgccggtttgtaccgaggctttcaatgcttaaatacaagctgtagaaataggcggcagacgtgccgagagcgaccagcacatccatgttggcacttttgttccgcagcgctttataagccccagtgtaaaactgcttcccgacgataaactgaaccggtgtggccaacgcgaactgaacccagggatccatgaacatccccggcagccatataaatgacgtgaatttgaaatggctgaccattgcccagagcagcggaaaagacaaaatggctgaaaaaataaatttgccggtttgacgctgaatatctttttctctttgttccgcccgaccgtccgcagttcggtcttttttcagctcgagcttgtagccgagcttttcaacggcttcgatcatctcctccggcgaaaccgcgccagcatgatagtcgactgtcgcagtctcaatggcaaagttgacggcggcgcttttgacgccagacagcttgttgaggcgcttttcaacccggttggcgcaagccgcacacgtcatgccggaaaccgcaaattcggctttttccgcaggaacttgatagccgagcgattcgactttctcagccagctgtccgacttcgatttgccccggatcataaacgatttttgatttttccagcgccaagttcacatttgcgtcctgaacgccgtcaagccttttcaaccctttctcgatccgcgccgcacaggcggcgcaggtcatgccagagatttggagggtggcttctttttgtccgtccatatccttcactccttatataccccttgtaggtatacatcagcctgcaacatcatacccctggtcttcgatcgtatcgatgatctccttcagcgagactttgcctgaatcaaacgatacttcgactttgccctcgtttaaattcactttgacagactccactccgccaagctttccgacgtttccttctactgcctgaacacagtggttgcaagacatgccttcgactttcagtgttttttgttccatattgaaaacctcctgtggtttgatgatattgatcggttttatattaccatacccctgtagggtatttcaagaaaacgattttctcttttttcgttcatgattttgaaaaccgtttaaacacatcaagcagttcctcgatggcttcttctccctcaccgcttttaatcgcgtttgcgacgcaatggtgggtatgatcctcaagcaggctgaaagcaaccttttgcatcgcggcttgcacagctgagatttgaacgagaatatcgacgcagtagcggtcattttcaatcatcttttgaatgcctctgacctgtccttcaatccgctttaagcggtttgtgatttgttcttttcctttagagcttttgggatttaacgcgtgttcatgatgatctgccatcggaacacctctctttcctttatattttgtccaagatccccattggtaccattataaaatgcgaagcggaacatgtctaaaaaagagacaaccccgaactgctgcggggtcatccctgcatattatttgtttaacgctttaaaaaattctctcataaactccggcagattggaccagtcatgacctgagaccaggttggcgtccacatgaagcttctcctcgacataagtcgcgcccgcggcttcgacttccggtttgcaggcgatgtaagccgtcagctcccggcctttcagatgttctctcaggcttgtgaaaatcaggctcgcatgacaaatcgcgccgaccggtttattttcctcaaagaaatgagcaacgattttcagcagggaatcgtacatccggataaattccggtgcgcgtccgccaggaatgatgatgccgtcgtattcggacgggtcaatctcatcaaatgaagcatgcgcgtcaattaaatagcccggcttttcggtgtatgtatcccaatccaggaagtcatgaacaaccgtatgaatctttttctttttcggtgcggcaatcgtcgtttcatagccctcttcaagacagcggtaataagggtaatacacttccagcgcttcaactgcatcgcccgttacgattaaaatctttttcgccatcaaaaacatctcctttccttttttactcttctattttatcccatttgcgcctgtttttaaaatcaagtgcttgagaagttttgtttcagccgacgatcgtgatgttctctgttatgtctttcaagcgggcaagatttgctttgtcaattcctgaatctgtgatgaccctgtatcggtcatgaaggcggtcgatttgcgagaaagcacgggttccgaatttgctgctgtccgccatcaaaatcgtttcgtccgcaatttcgatcattcgttttttcaacagcgcctgcatttcgtttgaatcgctcaagccgctcgcagggtcgacgcctttgcaagacagaaatgttttgttgacgtgatacatgtcaagggagcgctcagccaaagggccgacatatgacatcgattgcggcagcagcatcccgccggttgaaatgaccgtcaccttttcttttttgctgagttcaatcgcgactctgactgaattcgtaatgacggtcagcgggatgttttcaagcgcttttgccatgtaccatgccgtcgtgcttgcatcaagaataatccgttccccgcttttcacatgcttgacggcttcaaatgcaatcatctttttttcgtttacgtttgtaatttcgcgctcgcgaaaatgcacctctctttcttcagtctgcacgctgactgcgccgccatggcttcttttcagcttattttccttctcaagcttttccaaatcgcgcctgatcgtttcttccgtgacggaaaaaagctcgctcagttctgtgacgcgtacgctcgagcgcagattgacaagctcgacgattttttggtgtctttcagctacaagcatccgtttacttccttccttttttggtaaaagtcactgttacattcatgatagcgcatcggctccgatacaggaaaggttttcagcgggaagcggcgccgagaatctgacttgtatagcggcggtatgcccgctcccacgcttctgtatcttccggtacatacgttttttgaggaaaggaagccttgatcgctttccgggcgctctgaatatcccaaaacatgtcgagcgcgacggcctgtacggcaatgttgccgatggcgcttgcctctgacggtccagcccatacatttctggacagtacattcgccgtgtattggcagagcagttcatttcgaatccctccgcccgccatgtgaagtccgtcatattcttttcctgtcaaggtttcaatccgttcaaaggtgaaccggtatttaaacgcaaggctttccagcacgcagcggatgatctgtccgggcgtttccggcacgtgctgccctgctgcacggcagtactctctgatcgcctcaggcatatggacgggattgagaaacaccgggtcatccgggtcaaccgccgacctgaatgcttctgactgtccggcaagtttgacaagctcggcgctcgaatagctgatcccatctttttcccaatccgcctgacagcgctggaacagccacaatcccataatgttttttaaaaaacggaatgtgccgccggcaccgccctcatttgtaaaattccaatcgagcgcctgttttgtcatcagcggagcgtcaagttcggttccgatcagcgaccaggtgccgcaaatcaaatatgcaaagtcatccgtttcagcggggatgccgacaactgcagaagccgtgtcatgttcgccgacggcaatcaccggtacggcgggcacagacaattcgccgcacactgattgcgacagcctccccgcttcgcttccgggctttgctatatcttttggaaaaatcttggccgggatccccagaaggctgatgagctcccaatcccagtcagacgttttcgggttgaacagctgggttgtcgtcgcatttgtaaattcgctttttttctcgcccgttaaaaaatagcgcagcaaatcaggaatcattaatagtgtgtccgcgtaatccaacagcggagaattcgcttttttcagcgcccggagctgaaagatggtgttgaacggcaaaagctgaataccggttctggaaaacagctcttcttttccgatttcattcaacacctccgtcattattccgtccgtgtaagggtcgcggtaatgataagggttccccatcagctctccgttccgatcgagaaaaccgacgtcaaccgcccatgaatcgattccgatgcagctgattcgtccacagccgtttttcgcctttaaaatgccctgtttaatttcatgataaagcctgagaatgtcccaataaaggtgttttcccgcctgaacgggctgatttggaaaacggtgaatttcctccgctttgatcagaccgccgtccacatgacctgcataagctctgccgctcgacgcaccaagatcaaaggcgagaatcgtcaccagcttgcaccgcctttcccgcgtgccaggattttttccgcatatccgctttccgcataagccttgagcggatcaggcggaacgttcatttcctcccgcacggcgcagaggagcggcttgacgtcgatttcaaatgcctcgcggatcgcagcctctgcggcaagcacgtcatgatcttcctgcgctttcttcacttcatcgaagttgatcaaaagcgcttttgcaaattgagtctgcacattcatgaccgagcgcagcacagcgggtattttcggttcaagattatggcattgatcaagcatatacgaaatatgttcggccgtcttccggacgttcgggtcagaatcacggcaggcgtccaaaatttgagaaaaaatgagaaacagttcgtacgggttgtgagcgcccgcgatcaaatcgtcatcagcgtatttgcggctgttgaaatgaaagcctccgagacgtttttcgtcaagcaaataagcgacaatgtgctcgatgttcgtcccctgggcatggtggccggtgtcgacgagcacctcagccttcgggccgagcttttgcgccaaattgtaagccatgccccaatccgccagatcggtatgataaaaagccggctcaaaaaatttgtattcaatcaagagccgcatatcatcgtcaagagcttcgtaaacttcagccagacactcatacatccagtttttccgttttctgatgtcgccctgaccgggatagttggttccgtcggcaagccagaggctgatttccttggagcctgtttgttttgcaatatcgacgcattcgagcaattgctcagtcgctttttggcgaatggccgctttcacgtttgtgacgctgccgaatttgtagtcatcgtcctggaacaagttcggattcacggcgccgatagcaaggccaagctgctcggcgtgcgctttcagctttccgtaatcatcaactcgatcccaaggaatatggatggcgacggaaggacaaattccggttaatttgtgaacgactgatgcatcttccattttttcaaacggatctcttggcacaccctcttgctgaaacactttgaagcgcgtgcccgagtccccgtatccccatgaaggcgtctcgattttaagcgctttcaatttttcctttgcttcagaaaggctgattcccctgtctttctgctgttcttcaaataaagcgtaggcccggtcattcatcatgtacgcccatcccccttgtttttaacggatatgccatggttgacattaacgcaagttccggctgggtcgtgtccagccggctgtactggacgatcacaggtacatcgcttgcgatctcgatcgcataaggaacattttcaggaatgcgttctcctgatcggtgcaaagaacttgtgcggatatgcttcgttctcttgccatgaaccgtctcggaaatgccttcgagcggcggacggtcttcgaagtatacggtgatcgcaaggtttgcgttttcttcatggcaatttaaaacacaaatggcttcatggctcgtcaagcttccggaactttccggaggaataaaaccgtccggtatgatccaatgggtctcgcccttcatctcccttttccccctttgtattctgaaagggcggccgaagccgctccttatcaattaccttgaaaatgcggccggcactcccccgtcaaccgtcagcatgcatcccgtcgtttttgccgttttttctgaagcgaaataagcgatcgcctcggcaatgtcggcgggataaatgttgacggaaagagccgtacgtttgcggtaatgctcttcaagccggtcgggttcaatcccgtaggcggcggctctttcttcgcgccatttggagtcccagatggccgacccttgaagcaccgcatccggaagaactgaattcgcacggattccgtacggtccgccttcagccgcgatgcatctcgccaaatgaacctcaagcgcttttgcagagctgtatgctgatgcgtttttgcctgcataaacggaatttttcgaaccgacaaacaccatgctgccgcctgaaccttgttttttcatttgcttaaaagcttctctggccacgaggaaatatcctgttccgagtacattcatattcaggttccattcttcgagcgtcgtttcatcaagcgggcttgatgtcgcaaggcccgcattgttgacaaggatgtcaatcccgccgtatttgagggcgatttcctcgaaggccgtctgaacctcctcttctttcgtcacatccatgcggacggcgtaagctcgttctgcaccgtattgatcattaatctcggccgctgttttttctgcgccttcaatattaatgtcagcgaccacaacatgcgcgccttctagagcaaggcggcggcaggcctcgctgccgattccgcccgctccccccgtcacaaatgcgatcttgcgcgaaaattcggcttccggcggagcaagcgttaatttataaagctcaagcggccaatattcaacattgtaggattcttcctcattgagagatacaaagtttccaaggacttccgttcccttcatgacggcaatcgcccggcggtataaatctcggctgaccttcgccatcgccaggcttttccctgctgtcaccatgccgattcccgggatcagcatcacgcgaggcgccggttcaaacatctcgtctccttcgtgccggtttcgttgaaaataggcggcatacgactctttaaatccagcaatctcggttttgatccggtcgaccagcgcttctgtgtcctgttcagcgggattccacggaatataggcaggcacccgctttgtatgaacgaggtgatccggacaagcggcgccgacctgtgaaagcgacggtgcgcgcctgctgttcgcgaattcgagcacatcgtcagcatcgcaccaggtgacgagcatgcgtttttccccgctgacagcgccgcggatgaccggcaagatatcggctaaaatccgtttccgctcctccggtgcaagcggctcgaccatctgtccgccaaacggctgatgatcttccgaacggcttttaatatatgcttccgcttcgcgaatcacggcaatcgtctgatcatagctttctttcgacgtttccccccaagtgacgagcccgtgcttctccattaaaacaagctctgcattcgggttgtttttcacaccttctgctatcatcttcgataaagcaaagcccggtctgacataaggcacccatacaaatcggctgccgtatatctcctctgcgatctcttttccattatcgcagcagcagatgctgatgattgcatcggggtgggtgtgatcgacatgcggaaacggcaaaaaagcatgaagaagcgtttcgatcgacggccgcggatgctttccgtccatcatgcaatgggacaaatatgccgtcatttcttcatcggtcatgctgctccgttccatcagcggacgaatatcatccagcctcagtccggtaaattggcccgctgacatcgtcgccaagtccgagccgctgcctttcacccacatcacctcgatgtccctgcctctgaaatccttttctgtcgttttcatcgatgtgtttcccccgccccagttgcagaccgaacggtcagcgccgatcagattggaacggtagacgagctcggcaagacccggacgcagcgatgcagcctcagactctgaccataaatatttcaccatgcgtatcactccgtttttgtttgtttatttttgaatatgtttgttttaagagtaacatattttgattttctttgtaagcgcttttttccgaaaccattttaggacagaatctcttcaatcagtcgataaataaaaaacgccaacagcaggcggccgtcggggttaagaatgtaggaatgtttaatctttgattttaaaataaaatgtcaggttttaagaaagcgctggcatcttgttgccggcgctttttgtgccgctgacataccgtttgggggaacatattgatgcgcaaaaaacggttgaaattcgtcttttgatcttttaatatataaactcatgttttttaaaaggaggggtcaggatgaaaaaaacactgcacgctccagtcaaactgatcatcgcaatttttatgatttgtacattttccatcggctttacagagtacgtcgttatgggtatattgacttccatttcaaaggatctctctgttccgatttcgtctaccggcctattggtaacggcatatgcgggaagcgtctgtctgacggggccgatcgtcaccatattttcggtaaaaatgccgcgcaaaccggtattgatcggcttgatgagtgtgtttgtactgtcgaatgcgctcagtttcctggcgccgaacttcaccattttgttggtctcaagaatcctatccgcatccattcatggtgcattttttgcaacgacaatggtgttcgtcagcgaaatggcaccgcccgaaaaacgggccgccgctgccgcttcaatgaacggcggcttgaccatcgccctgatgctcggcgtcccgtttggttcttatttaggcgatcttttcaactggcggatcgtttttctgatgatcgcatgcctcggattgatcggcctcgccggcatttggctgacggtgccgcacagaaaaccgaaagttgtccctaaattgatccatgaatgggatgtgtttaaaaataaacaagtccttttttcttttgctatcacgatctttggctattcgggcgtattcatcgcctacacgtttattgaaccgatgctgcggcattctgccggtttcgacagtctcggcattacagccgcccttttcgcctacgggtttggcggggtcgtcggcaatttctacgccggaaaggtgccgtttcacctgttaacccgctccatgatcggggtgatgatcgcgctcatggcgatccttgcggcctttccttttgtcagcggacatcctgccggcgccatcatcgtgacgtttttattcggagccggcgcgttcgcgttcggaacggtgccccttttgcaaacaaaggtcgtggctgcgtctgaacacggaacaacgatcgccacctccgtcagcatcgctgcatttaacttggccaacgcgctcggggcttggatcggcggactcattcttaatgcatcagagtctacacataccttgccacaggcggtgcgcttatgaccatgtgcgggctgacgcttacgatgttcgcctatatgtctgagaaaagacaagtgaaagaagacatgtggggaacggacctgtaatcaaaaagctgcccggcttaagacctggcagcttttttgtttggttcttgcagcgtctttgtgtgagctgctttccgcatgaccgcggtcatcaaaagggcggctgcggcataaacgataccgaaacagccgaaaacgaaaacagaagatgacatccccaataacatgcctgatataacaggaccgcaggccattcccgtatacctgataaaattaaacatgcccatcgcactgccgcggttctcctcaaattcattcgccatcatcgtagagaagagcggcggaatcagccccatcgtaacgccgaaaagaaccagagccgccgacatggcgaaaagcgaaaacaaatgggaaaaggcaaaacagacgacgctccctgcggcggtcagattgccgatcaaaaacaggcgtctgagcgataatctcttttgtatccacttaaacagcacgctgccggcaatcgtgctgaccgctatcggcaaatacagcaagccgacgatctgcagatcaaggtgatagtgatcggtcagcaaaatcggcaaatacacgatcattgaaaaataaataaagaaaataaggtagcttaatattaaaacggcattgcccgccctgtttttgaatatgtccttataatgcgacagcaggctgcccgcgctgagattggtctttttctccgaatggctgcgcggaaagcaaaacaaattgccgaaaagcaaaagaacagacaatactgtcaaaaaccaaaaaatacccggataattatagcgctccccgataaaaccgccgagaataggcgccgctgccggtgcaagggaaagcagcatttgataagttcccatcgcactgccccgcttcgttcccttaaacagagatccgattgtggttgccgcaattaatggaagcgcagcagtccccaaagcctgcagcaccctgaaaaaaagaaacaggccaaagtcccgggaggctgcgcagccgattgtggcgatgaccgttacgatcatgctcgccatcattacaaatctcgctcctttaaaatcaacaatcgagccgacaatgatctgcatcgcagctgtaatgaagatgaacagcgagacggacaggtttaccatcgaaacagaaacgtgaaacgagtctctgattaaaggaatgataggtgaataaatattttgattcaacgatgcgaaaaaagcgctgatacacacaaaatacataatgaaagaagcatttgatttcattggtctcatttcaaaccgcctgccttgtttttgtttattcgttaacaatttacctaatatcgtttactggttaacaatattaattgtagatgacccctttatcattgtcaacgaacatttcttattgagatttgaagttttttacatattttttacttatcgagttccttgactcaaaaaacgccttaaataaaggtttttatcctttccattctgattacaattcctcagattcacaaaaaaagttacgaatattttcatattttgaatttgaattgtgttgacagttggaaaagatagggataaaatgactattgtttactagtaaacttttatgctgtaacttgcctgattttgagtacaaacccttgccctgctttaacaattgaacaaatgccacacctcttcatcatgacccgcatcatcgctgtattcttctcgattcatcacgaagtgagaccagcctattcccagctcgataagccgcacgtatccatcattgattgcaaatgaagtcactctatgtccgttaaggaggaaatcaatgacagagcttataatggagagcaaacaccagctattcaaaaccgaaactcttacccaaaactgcaatgaaatattaaaacgcagacgccatgttctcgtcggcatcagcccgtttaacagccgattttccgaagattatattcatcggcttatcgcctgggccgtccgtgagtttcagagtgtatccgtgcttttggcgggaaaggaagctgccaaccttctcgaagcgctcggcaccccacatgggaaggccgaacggaaagtcaggaaagaagtctcgcggaaccggagattcgctgaaaaggcgttggaagcgcatggcggaaatcccgaggacatccatacattttccgatttcgcgaaccagaccgcataccggaatttgcggatggaagtcgaagctgcctttttcgaccagacgcattttcgcaatgcctgcctggagatgtcgcatgcggctatcctcggacgggcccggggcactcggatggatgtcgtggaagtcagcgcagacatgctggagctggctgttgaatacgtcatcgctgaacttccgtttttcatcgccgcccctgatattttaggcgtcgaagagacgcttcttgcttatcaccggccatggaagctcggcgaacagatctcccgtaatgaatttgccgtcaaaatgcggccgaatcaaggatatctcatggtttccgaagcggacgaaagggtggaatctaaaagcatgcaggaggaacgagtatgaatcaatcgctaaaaacattcagcgtgttgtcagaacaatatcacgaaaatccgtatcagtatttctcataccttcgggaatctgatcccgtccattatgaagaatcgctggacagctattttatcagccgctaccaggatgtgcgccgcgtgctccagaatcaggacgtctttacaacgaaatcgcttgccaaacgggccgagcccgtcatgcgcggacctgtgctcgcccaaatgaaaggcaaagagcacacggcaaaaaggagaatcgttctgcgccgctttatcggggaatcccttgatcacctcacaccgctcatcaaagaaaatgcacaaaggcttttggccccgcacgtggagaaagggcggatcgaccttgtcaatgatttcggcaaaacattcgccgtttgcgtgacgatggacattttaggtttggacaagaacgaccaccaaacggtgagaaactggcacagcggcgtcgccgatttcattaccagtttgaatcaggcgcctgaggaccgggagcattccctcaaatgcagtgaacagctcgctgagtatttgaatccgattatcgaggaaaggcgcaaaaatcccggacatgatttaatatccatcctttgcacttccgaatacgagggagtggcgatgtctgaccgggacatacgcgcgctgattctcaatatattgcttgccgccacagaaccggcggacaagacgctcgcattaatgatttatcatttgcttcatcatcccgatcagatgaatgatgtgctggaagaccgcacgcttctccctcaggcaatcgcagagacgctgcgctacaagccgccggtgcagctcatcccgcgccagctttcacaagacgcggagattggcggagtcgagctaaaagaagggacgactgtattttgcatgataggcgcggcaaatcgcgatcctgaagcgttcgaggatcccgacaagttcaacattcaccgcagcgacctggaagtcaaaagcgcattcagcggcgcagccaggcatctcgcattcggttcaggcgtccacaactgtgtaggagcggggtttgcgaagaccgaaatcgagcttgtcgcaaatatcgtccttgatcagctgaaaaatatccggctggaggaagacttcatttaccgcgagacagggctttacacacgcggacccgtctcgctcaacatccggtttgatgccaaacattaatcttgtgaaaaagccttctcctcccgggaggaggctttttcaattgctgcctcactgatcttcgccagctcttcaatacccttcgtaccttcgctcgcgtgtgaaagctcgtgacattgaacgattttaaaaccgttcattttaaaaatcgcgatgatatcaattctcccccggtctccattctttttgacaaccttgaccgtatatctgactgctgcgctttcgaggcgctcgtcaaacaaaaattcatgaaagggcgacaccgttatggtgcgtgcaacgtttttcagcgtccgtatgtgatctttaaactgcacaaggtcaatgtgactgccgtccgtgacttgaacataatcctcgctgaaataatcggcaattttttcagtattcatttccgacacgatgtcctgatacatgttgcttaaaaactgttgggcttcacttttattcattcgctgctcctcttgattaaatgtgttttgaccattcgtttaaaaagcggatgacggtttgcagctcggattcggaaaaccgatcaaacagctcgatgtagcgctgttttgcaatttcatgcatcctgtcatgaatgtcggccagttttttcccctcatcggttaatgtgtaatacaattctttgttgttgttcggttttttgtgcgattcgatcattccgtgctttgtgagcacattgaccgcttttgtcactgccgcttttgaaatttggagttttgctgccaggaaagcgttgttgacgtctgcttcgctttcgctgataagcgagataatgtgaagctgggtcagggtccaatgcttacgcatgctttcttcttcttgaaaggcttcctctgcgaacgcctgctgttcatgctgagcccgcttttctcttttgagaataaaatcctgaacggcttgaaatgcctgctcatacgtcttgttttccactgtcatcattccttttcacaatcattaaccggttaactattaaatagtttaccagttaacaataattaaagcaagcaaaaaaaagcatatgatgcagaaagatccgcagcatatgcttgccctcatacttgaggagatagcacgtgcttttcagtccaagccagaagcttcagatcctgtttgcagccggcgataaatgaaagccccaaaggctcgccgttttttgccggcaacgggacggtgatctgcggaagcccgccgagcccggcaatacacgtcagtttcatcgtgcgcgcccttctctcatttaattcgttttccggcagaccacggagcggcggcgggccgggggcagtcggaataacgagcaagccgtcttctccgagccattccgacagtctttttctcaccgcctctcttttcataaacgcttgcacatgatcgcttatcacaaggcttgacgcccattcaaacctttctgcgattccagggccgaacaccggatttgtgcgctcgatcctagctccgtgctcctcccaaatctccagtccctgcagcaccctgaacgtctccgcccattccgcgaggccgccgtcagcggcaacgcaccagtcgaattcgccgtcaatcaggcctaatgcataagcgtatacttgtgtccggtcgctttcttcaagcaggctccacgcctctttttcaaaataaacccggttgaacatgcccctgcctcctcctgcccgctaagcaggacgcggcccgccgcatgaaggactccaatatcttttgacatccatccgacggtgtcaaaactctttgccagcggtatgacaccatcaaccgacacctcgccgtgcgtcggccgaaacccgaaaattccgcagtatgaagaagggattctgacagatcccccggtgtctgtcccgagagcgaaatcggtcatcccagaggctgccgccacagccgatccgcttgaagaccctcccggaattttgtccatggcacaaggattgacgggtgtaccataatggacattttctccgtcgaggctgtacatcagctcatctgtgtgcgcagcacccttaagccttgcaccttcccgcagcagcaagtcaacggcttccgcgtttttttcggcaggttcgtgcgtcctcagccaatcagggtttcccgccgcattagcatggccctctacagcaaacacatcctttaccgcaaacgaaagttttttcaagcttccttcagccgatggcggatcgaccatcagatcccggtttataaaagcgctccaatcatgctccattttcaaaatccctccatcaacttttgcttctaacgataaccggacgcctcttcaaaatgaacaaagttgtgacaaaatcttccgttccctaatttaaaaaggcctttaggtttgttcctataggcaaacagggtaaaataaaggggtgttgattacatattaaaaacaaacatgggagaggagaatgaaatggtggacaaggttcgcacagggatattaggatacggtttgtccggttcggtgtttcatgcgcctttattatcagtgttagaagattatgagattcgaaaggttatgacttcaaggaaagaacaagtcaaacaggacctccccgaagcagaagcggtcagtacgatcgaagacatcacaaaagatccggacattgatctcgtcatcgtgaccacgccgagcggccttcattacgaaatggcgaaagagtgcatccgcgccggaaagcatgtcgttcttgaaaagccgatgacagcaacagcggaagaagcggaagagctcattaatgccgcgaaagaaaaaggcgtgcttctcagcgtgtatcacaaccgaagatgggataacgactttttgacgatcaaacagctcatcaaagaggggcgccttggagaggtcaacacattccacgcctcctacgaccggttccggccgaatgtcagacagcgctggagagaacagaaaggaccggggtcaggtgcactgtacgatttaggttcacacttgatcgatcaggcgcttcatttattcggcatgccgaacggcgtcaccgctcaagtgaccgctcagagagccaatgcggaaacagacgattacttccatgtcatccttcactatgatcagcgccaagtgattctccactcgggctcgattgttccggccaacggcccccgctaccaaatccacggctcaaaaggaagctttattaaatacggaatcgacggccaggaggatgcactcagagcgggtcataaacctgcaggcgatgagtggggagccgatcaacccgaatattacggggaactggccacagtcgaaggcgacgagatcaggaaggaaaccgtggaaacgctcccgggttcatacttaacttattacaagcagcttgcttcaagtattctagaaggcggcagcttgcctgtcacggcggaagaaggacgcgacgtcatccgaatcatcgaagctgcgcaaaaaagcagcgaaacgaatcaaacggtgttcttaaacaaataaaacaaaaccgcggatatgatccgcggttttttcaaaaagtcctgcccaattctttggctcggacaatcgcattttgttttatttcttcagctttatcaggctcagcattatgcccttctataaataaaccttcaaattccggaaccccgaaaaactgcatcatgatgctgatatagcggtgccccatctcaagttccgcagcctgcccttctgaatagtagccgcctctcgcctggatgtgcagcgcttttttatcggttaacagcccgatcggtccctgttcggtatatttaaacgtctttcccgctacagcgaccgcatcgaagtacgctttcatcaccggcggaaaagagaaattccaaagcggcgtgacaaacacgtatttgtctcccgcgataaattgctcgctcagctcattcaaacggccgactttagctttttcgtgttcagaaagctgttcaaagcccgaccccgactgcaattttccccagccgctgaaaacatccgcatcaatctgcggaatgttttcccgataaagatcaaggtgtatgacttcgtcatccggatgagcttctttgtaagattcgataaacgcttttcctgccgccatgctgtaggatgccctttcgtcatgcgggtgagcggtaatgtaaagggtttttgtcatttcttttgctacctgcctttttgtattgatattgcttagtatgggacgttttcaggcaaatattctggaaaagccggagctttcgcataaagtgcagatgctttttaatctgatgtccgataaggcttttgttcggcatcatgatcacctgctatattttcactctgctttcatttcagaataaaaaaggaacgccccgatttttcaggtcaaggcgttcctccattcaatccgaaagccgactcccttgcaggagcaaatgcaacttcgatttttatatgttacttttgtttacagcttttatgactgcgctgcatgttcctcttctttcagcttttcgagtctctcttgcacctcttcttctgaaaggccgtgctctttgacatacaggttgcgcggatgaacccggcactcgtgcgtgcagccccgcaaatagcggtgctcattttcttcagagcagatgatctgcttgttgcattccgggtttgcgcagttgacatagcgctcgcaaggctcgccggtgaaataatcttttccgacaatgacgtgctctttctgattgaccggaacgctgattctttcatcgaaaacatagcatttcccgtcccacagttcaccttgaacttcagggtcttttccgtacgttacaataccgccgtgaagctgggacacgtcttcaaatccttcttttttcagccatcctgaaaatttttcgcagcggattccgcccgtgcagtaagtcaatattttcttgccttcgagcttttctttgttatcgcggatccactcaggtaattcgcggaacgctttaatgtccggtctgatcgctccgcggaaatgccccaaatcgtactcatagtcgttccgtgcgtcgacgacaatcgtatcttcctgctgcatcgcctcataaaattcttttggctccaggtattttcctgttaattcgttcggatcgatatcatcttccaggcggagcgtcaccagctcatcgcgatggcggacatgcatttttttgaaagcgtgcccttctgattcatcgattttaaataccatgtcttcaaagcggggatcgcttttcatttcactcatatagcggtctgtctgctctacggttcctgacacggttccgtttattccttcacccgccacaaggatgcgccccttcagccccaaatctttgcagaacttgaggtgatcttcggcaaattgctcagggttatcgatatgaacatatttataatacaacaatactcggtattgattcttcatgatactttaccacctatctgatgcatgtttttataagataaaaaatggaatatccgtccatttatataatcaaaccttcattcatattaaaacaaaccatcaccatgatttcaatgaagcagcttgaacattccattaatcaaatgttagaaattttaacacttccggcggctttacgcaagcaaaacagctcagattaaaggactttcagcaattctgttataaactcccaaaaaccaggcacttcttgacataaaagcatctccgctttttcgcaaatcttcatcttcagctcctgttcaagatcctccctctctaatttgcttttgatcatcggtgtgaaattttccagcaatttctcaatctctttttcatcgtgcagactcactgttatcattcccctctgctttagaattcagcagctctcttatcttttcgagtgcccttttatgaatttttgaaatattttgccttgattctcccaaagagtcagcaatttcctgcatggataccccatgaatataaatttgtgcaagcacttttttctgcttgtccgtcaattgcaaaaacgcttcataaagcatcgggtcttgcaggtgttcgcttaattcctcttcctgttccaagacatcgtctaacagatcccctcggggcggctcgggcagattcggactgtcgtcgatcatcaatggaaaacgctctcggtttttccggactcttttatcaaagtcgacggagaaaatccggatcatcgagttgatgtatttgatcatgcggatttttttgtaaaatcgcttaaattcacgatcgagacactctgcctcttcagaatccggatgttccaacacgtggttgaaaagccgctcataccttgggttgctcaaaaaatgcttcacaagcggatgccttgtgatctccttgattttcgcacgcagtaacgtttgatcaatcataaaaaccgcctcctatttatttagatgaaagaaatgaaaaaaaagtaaacacatctcttctattaacatgcaaacataagttcccattcagagaaaatagttctttgcttacatttttcaaactttcgtcacttcttaacataggaggtggtaagaatggacagcgcattcattgaggaagcagcgaaacaaatcggcaatgtcggctttccagctgtattggcaatttacttgctcactcgttttgaaaagaaaatcgatgaactgatcgagctgatcaaagaaaaaaatgaaaccgatgattgacatcggcctcacttttttcacttaacatgacagaaggggaaaacgaaaggcctttcagctctcctttacatttttagaaagaggggatatcacatggaaaaaaacaaacaaattccacagccgatcagaggagaaaaaggagcggaaacgaaaattccgcacaacgttgagcgcgaccgccaaaacccggacatgctcgtaccgcctgaaaccgaccacggaacggtgccaaacatgaaattttcattttccgatgtccataaccgtcttgaaaaaggcggatatgcacgggaagtcacagttcgcgagctgccgatttcagacaagcttgcttctgtcaacatgaggctgaaacctggggccatcagggagctgcactggcataaggaagccgaatgggcgtatatgctgtacggaaaagcacggattacgtctgttgaccaagacggcagaaactttattgaagatgtgaaagaaggagatctctggtacttcccgtcaggtctgccgcattcaattcaagcacttgaagacggatgcgaattcctgcttgtcttcgatgacggctccttctctgaaaacagcaccttccaggtgacagattggctggcccatacgcctgatgaggtgattgccgcaaacttcggcatttcaaaagacgtcgtcgcctctcttccagttgaagaaaagtatattttccaagaagcgatccctggctgtcttgagaaagacaaagttgaaagcccgaacggaacggtacctctatctttcagctacaatttgcttgaacaggaaccgattatatccatcggaggaaaagtatggattgccgattccacgaacttcaaagcatcgaaaacgatcgcttctgcgttagtggaagtcgaacctggaggcatccgggagctgcactggcatccgaatacagacgaatggcagtattacatttccggacaagcgaaaatgacggttttcgctgccgacgggcatgccagaacatttaattaccaggccggagatgtcggctatgtgccgttcgcaatgggacactacgtccaaaatacaggagatgagccgcttcggttcctcgaaattttcaaagacgaccactatgctgacgtttcgttaaaccaatggctcgcgcttgttccggaagagcttgtccgccagcaccttgacgtcggcagcgaatttacaaaaatgctctctaaagaaaagcatccggtcgtcaaatttgataagaaataaccagccaggcttgcaggagacatatcctgcaggcctttggcgcttgtgtacatattttaaaggagttgtgtcatgaaacatttcattatttgctgcatatcggttatattcgtttttttcgcccactttctcggcatttcgatcctgtttcatctgtcgggcgcgttttaccaaacagtcggatcattgctgctgtttacgctttgttataccggactgacctttgtcctggaaccggctgaaaaggtgctcatccacagtatgaaactgctgggcatcaatcggcggatcacggtttttgccgctgaaatgatcacgatcggatgtttatgggccgccatttataccgcggacgaattgctggacgacgttctgctgacaacctcggcggaaatcatgattgccgtttcgttttttacaattgataaaatcctttatccgcggcagaggtccggttcgctcttatattgacgatccattttaaaccgaattttttcattgcaggactcaatgattcgcaacaatgttatatactggatttgcagtgattaaaaggaggttttgttcatgaataaggttcttttcagacccggcatgtcgatcaaagaaattggcgaacagttgcaaggctatatcgccgcaaattggaaacaaacgcttgacgatcatcgcgaagctcttttaaaggtgtttcccgaattggaagacgcgacttacggggtctacctggaccacctgctgcctcctgtatttgaaagtctcgaacagtccggctttacaacgattcaaaatgcgggaaaaggcgatttttttatcggaaagggcttgaactttagacagtccatggaaaaatggggagctgacaactgccgctcacgtgtgttttgggttgtcatctccgatcagcaaaaacagccggccgggacgctgctctttgacttttatcactctcacgccggatttgatgtccccctctccccgcggatttacacgttggaagaaacggagagagaccgaattgttgctcacataaaacagataaaggagaactagcttatttcgacccacaaagtcataagctgcagccgctgggtattccagcggtttttttatttacactaaatgcagccaaggaatttttgcaaccaatcaaaccacacattcgtttatgtataagaccaatatcttacataagggagaaactcatgagaactttcgaagtgttgacactcctgtcttttgtcatgctgtttcagcaaaaaatgccgggaaagcttgcggcggcagccggatttgtgagtattggcgtgttggcggacttgcagctttattcaaaacttttgaagcagctcggcatgacgggcgacatcgacggcgaacgaagcgcggatatcgtgaaccggtacgttttggatttttcaacaagcatttaaaagaaaccggtggtaatcttgtacctgccaacaaaactggtatgtaccaaggtcgtcaggttactgtaacagagcacgtccttggaggatatagaaaaggcgggaaatccaacagcccatatacaagttttacaataaatcaaaaggttgcaaagggctacggtaaaaatacaatagaactcgacatatctgctctccgtaaagccatcaggtctggtgaagtgaaggatattgtaattttatctcctaaacaaatcgaaaggtttaatcaaaaatgatactcgccagtctgaacactggaaaaacaaagctttaaaatggactcaaagagacactgaatactttgtaaaaggtgaggttccaaaacaatttatcaaactacatccgaaggagtgatagatatgcttctatattataaaaatgaatgcttgggtgaaataaaaggcgctactgttgaaggtgtctggatgtatggaacaatcattcctaatgaaaacatggaaaagttcaaagatttctttaaggctgtagtaaacgaggatgacccttttgccattgaacagtatagtgaagaatggttagatgatgaaaattggtttattattgatgaaaagcaaaaaaaggtaggtatatcccttccagggatttacgaaaatgataatgaaataaattggagatggagataagaaggcccctttttagaggcctttttttattacttcagtaaggattcgagttttgctttcgttttcggtccgtaaataccgtcggcagaaagcctgtgcatatgctggaaccgtttgaccgcgttcgccgttttcggcccgtaatagccacctatgccgttattcttcgcccctttgtctggatagaaatagagggcagctaaagcctcctgaatctgccggacggccgtccctttcatcagtgggctttttaccttatagatgccagaccgcagcgtgcaggatgattttttgccgcttgaagaaggctttttctattccgctgcaagagcttgcaatatgggaacgtccttgaattattatgccagtaaccaaacgtttttctcatgatatgaggaccgatgacccgacatattccgcagtatcattcatatgttcattaagcgattccccgctcttgcacaaacaacaaaaactccccaaaaaacaaaaaaaccaccatcatatgtatggtggagacggtgggagtcggatagataagttttacatcggtttagtaataagcgaaaaggctttgcatcaagggttttatgtttatcagttttccttggataagtataaaattataatgcgatcttgccattttcttgccacgaaaaagtagtgataagaggatgacctaacagaccatgaggtcatccacttttaataaaaagaaaaaaggacgagggaaaatgagtatcaacaaaatcagatcagcactgtataagtcagctaaaattttaggagatgttaacgcggcgaaaaatggaacgctagggaaacgaatggcccgccgagctgcaggaaaaacagccggcaaaatattgggcaagctgttcaagtaaaactatgtagaaaatccccctcatttgttttaaaatgtaaatgttcattataaaacaatgagggcttttttcacatgaaagcttggacatggaggggatatttcttagaatgtattgagaatttgttgttattattgagattaaaattaaggagagaataaagttgaaacgaacagcagagtttaccttatcattaattgcaacaatctttttaacaattggttggtttttcacagctattttcacatttttttatggttttacaccagcagatgaagctgacatgggatttttctattacttattaatttatacttatttatcaattccacttcttgtgcttatttgggttgcaacatttaaagtcaaagcaaacagcaaaggctggggaattttcattctaattatgggtgtcctttataccttttctatttactttgtgtcaggcattctcttgttaattgccggtattatgatggtcgcaaaacaaaataataatagtagtaatgttatgtctgcctaaattacataaaaacaacaaagccaccaatctgaactgacccgttaaaatgagacttagaaaaaacacctatgctgcctgtcccctgtattccagtggggacaggtagtttaattttgcctgaattcgtacatgattatatcgatacatgtattgatttacaatttgtactactttagaattggatatagatgctctactttgagcgttaaatccttccgactttagcgaggagtgaaaggattcaatgacggcattatcatggcagtttccttttcgagacatgcttgtggtaatgcctttttctttggccaaattctgatatgcatgtgaagtatagacagatccctggtcgctatgaagaagtaaccctactggtttacgtaattctacagcttccctcaatgtgtctaatactaggttaatatcttggctcgtacctattttgtaagccactatttcgttgttatataagtccataatcgttgataaatataacatagtcgagccataaggtaagtaggtaatgtcggttacccatttttcatttaatcggcttgctttaaaattacgattgagagtgttcggcacaataatattactctcaccacaaatgtacttttgtcgcttcttcttaacttgacactgaatctcaaacttttgcataattttttgtacagttttgcggtttacatttatcccatactttctgtttaagatggatttaattttacgatgaccatagtgatagaagtttttcttacacagcttgattactagctcttctaatgaagttagctcaacttttttatacttctttttccaacggtaatatgttgacttaggtatgcctaatactccaagaatatcaattattttaaaagtggctgagagttcttctacaacttggacaatgactcgtggctccaactcctttcgatctcctggtacttttttataattgccaattgagcctctagctgtttattctttagttttaattcttctagctcactcatttcctccgattctttaccgtaggaatattgttttccaacttgttgcgaaaatcgataggtttggcctgttttgtaccatcgcatccatgttttaatttgagtcttattttttatccccagttgttccattatttctttgtttgtcattccagcttgtttcattttaattacttcccattttacttcttctgcgtaatgtactcttgtgcccatagaaaaacaccctcctaagaatcatattgtattaatacgattcagggggtgttttttccttgtctcatttatttgggtctctccaaatcgttaaatggtggctttttctttatacaaaatatgcaatgttctcggcttaccttcttcccaatcaacaagcccctttttacgcaaccggtcaagatgaccttttgttgtacttgaagattttaaaccaaccctttcacctatttccctaacagatggcgggaaacctttttctttagttagttcgtctatggcttctaatatttgttcggattttttcatagtatccccctccattggtttgttttacctatgacaattataccaaacattcgttctttttcctacaggaagagaacgtatttttgcatgcagagcattattgaccagcttcaagttcctgtttttaaaatgtatcttttttactatttttcaatattcagaggcattaccactcattttatggtaatctatacaataccaaatacattataagggagagagaaaagtggagacgatagctaaaagagtctgtaaaccatttatcctattgctaacagctgtcttattagtaacctttgttgtacctcaaatttcacaggcaagcgaattttcgaattcccaggtgaaaagctattccgattctggtgattattcagaaaaggaattagaggaaatattaaagttttacttcgaagaagttggggaactaactaatgagggatatgttattaaaaacaaggaattgtttgataaaaaagttttggagggcgaccctgctgccttgaaactaaaagaattaatggcgtcagactcttcttttcagaagtctagttttcaggttgctagtgcaacatcttttggtaaatgtgttgtaaacaaaatgattggtagttatggaaatatagcgcgtcaatttttaaatggtgctatctttacatatatcaaaactaagcagtatgatttagccgcaagattaatgttcaaaactttgattaaatctgggatgaaagttaatgcagcgtctcttgcaatagagttgggatactatggatggaaatgtcgagggaagtggtaaaaatgtctccattaacaatagttgaagtcatcttagcgttaaccgttttaggtttatttgcatggacatttaaaagtaaaaaaagtgctgatgacgatgatgtgtatagatatgcaaggtacatgatttatttacttgtagctgaagttgcgatatacgtcatattcagtttcatttaaaaaacccccatttgggggtttttattgtgcataaaagaattttgaatatcgccaaaaaattttctttactttaacagagattcaagtttcgcctttgtcttcggtccgtaaattccgtcagcaggcagcccgtgtatgagctggaaccgtttgaccgcaataaagtcgcggaccggaaaccggagagatcgttcaaatagagggcaaatccactacataaaccagctgcagaaaactttccatgtcatggattctaaaggagacacgaatctttttaaatttgaggatattgttggcgtggaaatgaaataagcccttctcacaactggaagggctttactcatcatatgggcggtattttttccggccagcttcaagttctttcttttgagtctccacatgatcacggagaaacaagctaactgtaccgaccttcttcacaggctttagcttcccggaagtcaccaatgcacttaaacgctgccttgtaaccccgaggagctcgcctgcttctgcagctgtcaaaacttcatcttggataaatttaattttttcgttttccttcatgccttttttcgctccaaatcataattaatccttttaacagtgtaactatcacagccaggtataaaatgatgcctgtgattttccccagagtaccaactttttcaaaatcaattgcaaaaatgcccgctattaggatgagcatagttgccatgtctaatgagctgtaatgcttaaaatattgtttcataatttgtggacgtgatataatgaattggagagcaaggggatttctccccttctctcgctcactatgtttagcgcttcttgcttacccggcgggagcgctttttctttttcttgcctctttttttgctttcgttttgccatatatcataaatgtgtttgaatatggtcaccactccagcagtggcaagaatccagtttcttacctcgtccactttagcacctcctttctatattttaattataacaaagctatttacaacagtcaatagcattgccaaaaaaagttccttttcaaataaaaagaactttttttggagctcaattatcctctgtggttgtgagcattcttgagactttagaagctgttaaatttgagttatgagaattaactttagctctttcctccccctcacgtacaatactatctataagaaatgtattgaatttgttaagattagaagtgttaagagtcattttgattgccgtacctgttagatcagtatcatagaggtaatgtcctttgcctttaatagaaagagcatttttacctgaacatatcaggaaatcccctccgtgttgacagattttacttgtaacaaacagtccatatccagaattatcccaatcagaatttgattgtcctcgcatgacaccattatactcaaaagccttgcccgaaattccaggctctatagacaaataaagagcatctttatcgttttttatgttaagatttgggttgacacccaaagcttgtgcgattccgacaccttcatccagcaatgcaatttcaactttatctttagatggccaatattgtcctgcaaaccagaaagattcagaagtgctatgttcaacaatgttcctcattaattctcgaatagagtaaccaagcacatctttaagattattattgccctgtgacagtacttttgcgagttcataagatttacgttcaatagttgtttgcactacttcattgcgattgtatgattctattcttaaatctctaacttttagttcagttataggaatatatgtattgcttccccatgcttctcctggtttctttccataatcaattctccaactttgaaaaaaccccatgtgtcctgcatattctttatcatgatgattatcgcaccaaataatacctgggtatctttccacgagtcttctgagcttcgatgcaaccataagcatgccaaaaggctctaccgtatttgaatatttaaaatcaaaaattactttctttatgccgtcaaagtcaaatgaattattacaaaagtctattgcatttcgagctgtcaaatccggcatatgaatttgtttttcatccataaactcagctcctttattaatcatgataggtttattttaccacatctcgcattgaatggctttttttgataggaattcttcttttttacccataattgaagcatgggagaatctatatagctagaacctgttaaattctcagtcaatagtaagaataacctgaaccaaatgattcattttcagtgatccacaggatttattccccaattggtttccgtatagtggtaaactttatactgattgtaaccaaaaggattagaggagaatgccatgaagacgctggatgttcaagcgctgcacaatgcaattgatcaaacgctggaacaattaaaacaacaatcagatgaattctctaaagtcaaaaaagcagttgagggcatcacatcacttgatgatgctttaaaaggaaaaggcggcgacgcgatccgcgccttttacgaggaatgtcacaccccttttcttcagttttatgatactttcatagaggaatacagttccacgctgaagaaaatgaaaagcgcgctgaattccctggaaccaaaccataacggatttatttcacagtcctttctcgaacacgagttggagaatggcttaaatgccgctgatcgcacaacaaaacatttggtttctaaggccaacgccacgatcgcaaaagtcagccatatcgtcgacttaccggatttgaatgacagcggttttcatgaacaaaatcagaaagcgttaaaggaaatcagcacgactcttgaaaagctgcatgcgtttgaccgcgagcaaaccaacgccctcaaaacggctgaaaacgatcttgagacgatgcagagatacatggcgcggctcgaaaagatgtataccggccctaaaattgaaatcacaggttaccaaaaaggcgcgattttaaagccggatgagatggataccctgagtggaaatcaagaaacagcgatgggtgccatgttgaaaaaagtcggagacaaagaagatgtggacactaacactatcgccgatccagaccgattaaaaaaattggcgacacaaaaggtttccaagaaagagtacacccaagaggaattgaatgaactgaaaaaagattatagagtatttaacgatacgctttaccgggcatacatagacggcgatacaatcgtcaagatagaacccgcctacacccttccagagaatgtggaaaaaagcgattttaataaaaatttcgatacggcgatggaatttacaggtgtgtatgatgcagtaagagcagcgtttggatatgaccttgcgacaggcgaaatcgttaaaggtaatggggatcgtttgatggccggattgagtgtcacaccttttggaaaggcatttaaatacggaaagcgcggcttcaagttatttaaaggtgaagaagcgggaaagaaacttgcgaaggtagataaaacaccttcctacggcaaacaatccgtaccaaaaggtccgtatcgcgaagtgcatggtttccctgcaaaagtaaaaccaggagctcaagaaaaacatattcctggaacaccaaactacaaacaagaaatagctaatggtcgtaaaaacaaaagcatcttctacggagataataaaacggcacaagaattgctagataagtttgcaggaaaaggcactctgttaaaaaatggggtcaaagagagagtagactttggcaaagtaataggaaaattctatgataaagatactggtaagtatgtggagactactagaggtttgatacattacagcaaaaacggcgctcatatagtaccttcagagcctttaaaaccttaactgaggaggatataaatgggatatgatcctttaatttcagcattaagaaagtataaaaataacgatttgataatagaatggaaaagtggattaaaggttattggagaacctgacacactctatgaaacagacaacggattggacgatgatgatgtcaattatatagaatatgacgcagtcgcatttcaagtaaataatattttatcccaacccactaataaagattgtggtgtatatgattggttaagacaaggagaaagttccttaattgaaatttcactttatgaagatacaccaagtgcagtatatttaacagacggtcagaaaatatgggagatggatagtgatgaataacaattgacaagttagaatttataaaatctaagccctcttgaaagagggccttttgattacttcaataaagcttcaattttcgcctttgtcttcggcccgtaaatgccgtcggcagacagcccgtgcatcagttggaaccgtttgactgcgtttgccgttttcggcccgtaatagccatctatgccgttattcttcgcctctttgtctggatagaaatagagggcagctaaagcctcctgaatctgccagacggccgttcctttcatcatcgggcttttcactttatagatgccggacggcagcgtgtaggatgattttttgccgcttgatgatgattttttctttttcgcttcaatggccgcgagcgccttttcggttgccggtccataaattccatccaccgcaataccggctttcttttgcagagctttgactgcctgcaccgtttcatttccgtaagacccatcagccccgtatttcggcagtgagaagccagcggcaatcaaacgtttttgaagcgccttgacctgggaaccggacgccccttttttcagaatggtccctgtggatttgcttgactggctcgtggatgatgttgtctttgacacagtgttatttccgagcaaggcatcaacttttttcctgaatgtcgtcagctggcttgcatccctcacccagggagtcggacagcttttatttgtcacatcgtaatggcggacaattttgtttgtagaaaggccgtaacgcttgcacagatcggcaaccagttcagcagcattttgaatcgtttggctgtgaatcttgccatctttttcgacgcacatttcaacaccgattgccgttgtgttagcgtttggttttaaaaagctgacataacagcgattttgatcatgggcatgatatgcgacttcgttttcagggatgatgtgctgcgcctctttacggtccacaaaataatgggctgaagcgtaacgtttatcagcgatacatgtgccgttgaaataatttcgctcattcagtgcggacgcgccaggagtagccgtccagtgcatgacaatccctttcactcctgccaacttcaaccctggccgagtatattgattgactttcacataattcttcacaactttaaccatctgaaccactcctattttgttttaaataaaaaaggctgccagccggcaacctcatttcgttaaccctttttgttttagaacttctttttgctgctttcctttgccagtgacatagttatttttgaaccaagcgaccacagacgtaatgatggtgaatgccgcagagccggccaaatacaaagcgtctgcgagcgtgttgatctgatcttcactgattggaagaactggcttcccgaatacgatcaaagtctggtttaccaacgcaataaaaagaagcaccgtccgaacgaccgtgcctttgtcgaatgttgtcatattgtgtcttcctccttatttttgaataaaattaatgaaaagcgccgcaatcccggagatcaccagtgtacaaaccgctgtgatgatcgcgcccgttatgctgcgcttaatccatgttgtgttctcttcaatcttgttgagcttgtcattgatggacataatctgttgatcgtgtcgatcagacgccctttccagtgtgatgacacgctgttcaagcgttttgtgatcggccttcaattcggtaatctcctgcttgaagacgtcccattcatttgtttgatgcatgtcctgaaatcctcctgttctcacatcgttttcacctccctcgaggcaaaataaaaacacccttattgggcgcttggcattcctaaatccacactagtgtcaggcttatcatagctccggcctgttatgtcttcatattcggccggggtgatccacttaatttttacgtactcccgcatttcttcatctgtgtaacacccccaatcatagaattgttttatatcggcaagagtgggatacttcatgatgccccgcccccttttaacgcttcaacatcagcctgcaggcgcgcaacttgcaatgagagtaaagcattttgttttttcaatagatcagttatgcccggttcaggctccggaggctgcaagctttcaatatattctttggtggccgattcaaaccattcccctttcgcaggatcaaatttggctaggtataggccgtcaggcggttttacttcgcaataaaattccggtagctcagcgtcgtcttcgacttgaatttcttctcccggcatgtaattgaatttctcatcatatttgtaaagccatttcactgtcatccctcctaagccgccttaaatttaaaaccgaaagtaataaattcgtttgggtttaccgtatttgaacaactctgaatgtaaacagttccatcagtggcgatctgggttctatggtactgaggagtggtgccagtgccttgactagaagctacacctataaaatgaagcatttgtatagggcgatatccagccggcagcataaaagccggcacatcaaaaccaattgttccaccggttattgagccgataatttcaacctctccaagggcatttttactaaactgaaccttatgggttccatactgcttccacccgtttaacaaagtaggtgattgccaggtaacttccgcgtcggcatccgttataaatctctgccaacctttaaatgatccgtcagtgtggattgtcccaaaccaccttttaggattggccgtagcagttaccacgatcgttttgcgtgcattattagttgaaacatcgtaatgaaaccactcgaccgccttcggttctggagaattcacaactttgttactgacaccataataaagtcctgatggtaaggttaataagtcagtgtcatcaggaattagcgttctcccgccgttgtcatcggttaatttataaagctgtccggcattccatttcgttcgctcagctttatttatgtgtcgagtattatcgctgtggtgctcatcaaactctgcttttgtcgcctgcttcacattgtctactttagataagccgatctgatcttttgtgacaccgtgcggattgtcttttttagatgcgtgcttatccatgtaagcttttgcattggtttcggcagcgtcagctcttgcttgggctccctctttggtttcgatattatcaagcatttcaaattttgcctgcaagtcatcaatcatttcttccgcttcagctttgaacgtttcaaaatcttcaaagtagtattcggcaacgggcacgatatccgcatcaatgagagctttatcaatctcaaaagaaaatttatggacactcattttctgaccattatcatatttgacataaagctccgcgtgaacggtaccggcatgtttgatttgttccggcgttaagacataaaaaatagcgcccttcagcgcgtcttcgacttctgtattgacatagacctggctgccgtcagtaaatttcatgaatagcttggcatgggttgccttactaatcggcaaaggcacaccgtcctttgtcaggttaaacgacaattttgcggtcccgatatcttgtgtactgaactgaatatttgctgatacacttcgcttcacttgtgcattgacatcaaagtgcacagccgtatttttataaatcattggttcacctcccctttcaattagctgctgctttttgtaatgatttttctaatatagtcatcttttgttgtcccataatacccgttaaaattggaatctccttgaacgatgacgcggccagtcccttttgtgttggtgacattcacctctgttgcagcgtcttttactaaaatcgcaaacgccttctcgacgcctcgtatccggctattttcaattcgtccgtcgtatccgttttccacataaatgccgccgcgccctctcgtactgctttgctctttattggtattcatcacattattatctctcacatcaaagtgatcgcagttttgaatgaaaataccgttgcggccagtagtgttaatttcgtttcgatcaatagaaaggtgatatgatttcggcacggtagaagttttgtctctgcttttttcgacgtagattgcttctgtatcaacacaggaaacataatttcgatcaataaaggtgttgtaacagccttctatccacatccctcttcttcccccaaaaatccggttatcagagatgaaagcatttcttgcaaagactaattttatggcttgctcatcgtcatattcaccaatctcttttgcctttaatttaaagtagttcccaaaaatacgaatgccatcgctccaggcgacttcgttgttatatatttgcccaaacgataagattccgtatgacttgtaatcataaaaatcatttccctgaatcaagacgttttgtgcattttgggggcgattcatttggactccttcaacatttttagaactttcaattcctccggctgcttgggaaattcgaatacattcattattgcgcttaaatcgattgtttaaaatcttaacttcgccccatttaaacgttcttactcctgcaaaaccacagtcctcaatcgtattgtcaaagattgtgatgtttttttggaaaatatcataaacagcatagtgatttcctatcgcagaaccccagccgcccaacagctcagatttaccaaaatgattatgggcgatataaacgttttgattaggggtgccgtcaaactctccgaattgattgacgcccatttcaacaaattccccaagctgtatggcttctgagaaagggcgttttccgctcaagtctatgaatccaaaaaaattgctccttgtgatctggagattgttgatcccattggcatcaatggcatgggcggtaatcgtgtctttgaaagttacgcggtcaatccaaatattatttgcatgacctaaaatgattgagtccatcgcagtagacgggtatttgtctatattggcatagttaccgtctaaaataccgccttcaataatgatgttgcttcttccggaaaagccgctgaagctatcatccggccttccgttgacaaagaatccgccggcccatcctctaagaagtacacaatccgcggccatagtgacacgggtattttcatacacaatcattcttttttcgattaaataaataccgcctggtatcacaagctgcccgccgccttctcgacgaatttcatccagcgccttttgtatggcccaggcagatgggctttttccggtcgggtccgcaccatagttaagcgcatttttaaagttaaatctcgtttcaatatactgcccatctgcagccagacggtcccataaagtcgggtaaattgttcccctacgatcaacacgcgcgtcaacaacttcctttatgttcgttccgtcggcatttaacactaaatttctggcccttgctttggcagtttcgatttcttgggatactgtaagcccgctgctgtgagcaatctgatcagacgtatgagctttttttgatgtttgatgcgattgaatctgtctttcttgctcattcaagctgttttctatgctttgcatatctgctcttagttgtgcttgataacgggaattccgggtttgatcatagtcttttatcagccgttgcatctctttcactccttttttggcaaaataaaaaaacgcctacctgagcgttttgaaaagctggtcaatatatcgtttttgatctctaagccttttcgcttgatccacatttatgctttggatatctttgcggaagttcgcaaacgtcaatttcggactgctgtatgggttcagagggttgtactggatggacacaagtctcacattatcttcaaatgtgataccatcagccgtatcagccaagacatggatggtgtcgcctttccagaaatcttgctcgatctctaaaagcttcggctcatagattttttggaaatcagcttctaccgtcatttccggatatggattcacatgcctttttaatgcagaaatcatactgctggcttttttatagcgctcatccctgatcggttcagcccagcgtggcttcccttcaatcaagaatttcttttcgtctggatgaatgtataaaataggctcaaactcgtactgagggtttttgtcatcagtactgctccccttttttaaggccccgtatccccaggcacgtgttgtactgttttgcgagtttgttgtaattgaaatgccgggcatattatagcgcgaatctagggtgaaattaatccgtttccccatctttttgtagatataaattttgtaattatccacgtctatttcaatcccataatcctcaatgatttcatccattagctctgtcgagtttttatcaccgaaattttcttgatctgctgattcaaattcactctcaggcgtcttaaaaatatatttgaagtctgtattcttcagcgcaaaatcaagcgcatctctcaatcttaatttctttgatacagtttcatgaatcctgttgttaataagcagcacagtgaatatgtggcttgctgtaacggttttactaataacatttttctcttgatgaagttcgacacccgtaatgaatatttttggggtttaaattttttctcatccagataaagtatgttatcgtccaccaataaatcaaattctgtgccgttctcctgcgtttttgtgatagtgaaggtaaaactcttcttacctgtcgtatcgtctgtcagatcaactgacacacccgttatttccacaaccttttttccgtcttttgttgacacatgaagctgtgggaaatcggtatctgacggcagattctgattgagtgtaatgtctttcccgtcatattccttgcttggtatttctggatcaggtatcggtgtttccggttcgtcaggtccttctggcaccccacccacagtgtcatattgtgttagcttgtaggtttgaatgagattattcaactttgtcgcataattggggtcagtcgcataaccagcttttacaagtgcagcactcgccttcttgtaatctttttcgccgactacagctttatagtgattcggatcccagctcgttccgttcacatacaacttggctaaatcctgaatcgattcataccaagatggatattttcgaaagcgagcttgtactttggttgcatttccgctcttatcatattcagtcgtccacatgagaacatattgaccgttataagtacccttgatgccgaataagtttttccctttctgcaccagcccgcttgtcccccatgcgctctctaaacaggcttgagcaataatgagagacgcgagaatatcatactttttatagactctttgggcgtctggtgcaatttcctttataaaatctgtgtttgccatattgcatgctccttacgcgtagtagaaacgggtatcaaatatgatttcaaaatcattggtattcaagatttcaaacttattcattcctatatcgagtcccgggagtctgccggatgttttaataggtgttttattgatcactgtgtattgcttaataaaagaaacacgctgcgttttttttaattcctgttcaattttcagcttttcaccatttgtatggttgatgatcgtcacattttttccggccgcccataaggccacattgtagtcatgttccaaaggattgatataggcatcaccagtgttataaacctgaaacctctttcgatttttgaacctgtattccagatcgtcacgcatttgaatgttcatgcctgggctccaatgctcaacgtcaaaattttgctttgtcagagaagtgaatttcgattctgccagtcccgtgatgttgttaaattcaactgtgaacgttacaaagtttttctccttttcttttgggatactaaaatttccatcacaagttacccgaaaacggagattcggcaataaatcggtcgagatataatagggaaacggcttaactaaaagcgcgtaaagctcccgtctaaattgataaaagttttcagcgatgattgaatttaaataaaattcaacggttatttttcgttctgtatatgtgacatcccgaggatgttgcggaaggacaactccgtttattctcgggatgctaaccgtttcacgatcaatccccggtgcttcaggtgtgaagcttaaaggttcaaaaaaaggaagcaggctatttaagctctgctccccaagaccattatcgtaatcaaggaataatttcactatctcaccccgtttatgaatgaagttcgagtaaaccgatccccggctgattggtcaatttttctgccatcaagatatgtgttgttgtcttttagtaaaagtcgctgcaagagctgcacatttttatttagaaaatcaatttgctttgccatcatactgatttgtttttcttgattctttacaacacggctgatgtctacagaaaaatcattaggtggtagctgctgtttgggcttttccgaaactttttgaagcaggagtagtgcttttgaaatcatcccatcctgtaaatccggaagtacgccaagtttgctaccaatccgagcccatagcccaatattacgctccctgtatgaaggatcttccgtgatcgttgtttcatcataccctcgttcatttaagatggcccattttgagccaccccgtccaggtgagataccaccttttgcataaccaacatagccgccacctcgggccattgattttaagcctggatgattgctaatgtctccatatctgcgcttgatatagttaattgcagccaacgtattatctatcggattcaaaatgttattatgtccaggaaacttattggcgttaaaagtgctcgggatcgtctgcatcaacccctgtgaaggatggcctgctttcgcattggaatcccataagttgatagcatttggatttccgccgctttccttcatggcgatggtcacaagccctggaatccatgaaagtggcacccctgctataccaacagcctctgtaacccattggtttacggctttcgttcctccggtccctttaaatgtggacggctctggcatgactcctttcaaaaattgagctgcaccattttttaaagtcttgagtatgccggttccaaacgaatcaataccttttcccgatttatacgggatcaggccgctaaacagttttttaattaattttcctgggccgttgattatcaagtccatagcgcttgaactaacatccccgactttgtccacaacaccttttccgaaagaaatagctccattgaccattttcttagagccttcagcggcttttttaaaaaagtcgccgaccccgcctgcatatccaggaagccccgaagctgcaagctcttttgactgatcatgaggaagtacagatgtgccgcgcggtaggtcccaaatttgcgggccgcccataccgactacatacattccgatgcctggtgtatgggccagttcccatcctttttcaccaacaagcgcctttcctccagggtgaaagtctgtacctttcgcatatgcagctcctggcgcaatttgcattttttcagaccggccattgtaacctttaggcttccactctggaatggttgggatatgcataaattcaagaaccgtgttaattccaccggtaatcttattaacaacaccagctaagtcgagaacaaaaatatcccatttaccaaggacttcacctgtctcaaaatcaacttgatcaatatgtccataagcttgaagctttgcctccttgactacacctttatgcgtcttttctgcttgcttaattgtttttttggcttggctttttgcttttccaactgtgtcatcgtgctctttctttgaaattgtgccttttacataatactgatcatcggcagcagcaataacggaatcacgctgcttttcggccgcctttattgttttttcttttgctttattactatttttcacaacagcagcagcctgtttagcagataagttagaggattcttccttcagcttccttgaaattttaatttgctcgtccttgcttcgagtaagagccgtctccatttgagccaacattttcccctgtatctctgctatttctctgttttccttcgctgttgtttttcgattttcttcagccgcggttctgtaaatttcatttacccgatccacataaccttgtatttccttctgtttcttatcatttccatttttgattttattgaggattttagctgcttctttatctgacgttttatcatttgaagcataaaattcctgtaacaccttggtggcggaatcagcacttgtttgaaatccctttttcagcgagtttcccatttcagtgaactgctttgtcacatcatcggcaatatccttggtgatctttgtatttgttgctcgaagggtattgagctttgccgtaactttaatattcatatcttcatatgcattcacagcttttgcagtagccttcgatactccctcaccaaagtcaatagtcgatggaagaacccttttcttcagattgtcataatactttgtaccagcttcggttaaaagtgtcactcctgtcacagcaagaccaactggaccgcctaacaagctcaatccgccacgtaaaaggccgacaactcctgctccttttttgagaatgttgaataggccaaaaccgctttttgctaatttcataaagccgccagcgcctttaattgcattggctccaacctttaaaatattcccaccgaattttaagagctcaggagcaaatgaaagtattagcccggcaattgaaccaactggcccgccaaacaatccaaggccaacgccggcaacacgtgaagcaccgcctaggcctcgcatggctttagcacttctgctggatgattgttcaagcctcccgactctggttgttgccagattggctgactgatgaaaacgccccattcgtgtggatgctgctgccgctgccgcagatgttgttgtcatacctgcagccgctgtcctggaagctgcgcccgctgcaatggcttccgtagaataaacgccaagactgcccgatgcttgatttacattccgcgttaaatagccgcccgcggtccgaagcatattccagcctgctgctacttttggcaaagagccaagcaacagtaagaacgcgccgcctaagagggaaaatacagtgactgcaccgccagtaatcgcaatggtactcgccacagaagggggcaatgaatcaaaccaggttacaagctttgttagtccgtcagctgtagcccggataacaggcaagaactgatttccaaaagtgataacagcattgtttgtagcagatttcagatactcaatagagccagccaggttgtccatttgctttttggctactctttcagctgtgccgccgcttccttcgatttcctttgtgaattcttgaattttatcttttcccgcgtgcattaaagtaataaatccagaaagagcatgctgcccagccaactgttttgcaattcgaattttttcagtttcggtataatcttttgttttctcattgatctggccgataatatccgcaagtggtcgcagtttccctgtcgaatcggttaccttcaaacctaattcatcgatcgcatttccggcttgttttggtggagatgataaacgggtcagtgtagctcgcaaagctgttcctgccatatcagccttgatcccgctatttgccataatgcctgtcgctgctgctaattcttccatgctgagtcctgccgtttttgctgccggagccgcatatttcatcgtttggccgatctcttgcagggtggcgtttgaattcgtaaaagtatatgtcattgcatccgcaacgcggtttgtgtcttcggccttgatatgaaattcagtcaaaatgtcagaaacgatatctgccgtaacaccgaggtctgtttgaccggctgcagcagttgcgagaaggccaggcatagccccgattatttggatttgttttaatatccggccatcgcaagatactgcataccttctgcaacttggccatcagtatattgagttgtcgcccctaaatgacgggctgtttttgtaagatcagccatctggtcgtttgtagcatttgctaaagcaccgacacggctcatcgctttttcaaaatcagcagcagctttaacagtcattccaatcccaaacgatcccgctgcaccgagagcagaaagagcctttccagcggttgaggctgcttgatacaccgcgtttaactctttagatacttctcctgaattgcgcttaaacacagaaaaaacactcgctgctcgccgggtgctgtttgtggtattttcaaattgttttgttactcgttgcagttcatttccaaggctttgatgaacggcaattgcatcattcagccgacggccttgtatctgtgtttctcgattatccagccctttttctctgaccagcttattgtattttgcccgatgctcatcaactaaacggccttgtatgcggtatttattattgagtccttctatttgcgattgaagaaacttagactgattgcccgcagctttataaactgcaccggatgctttcatttccgaattcgctaaacgcatttgccgctttaaaccttcgattccacgattaaagccagtatcatcaaggcctactttaacaatcatatttccgataggttgcgccatatgtatccaccccgcttccctggcataaactcaacgaaaaaagaccggcgataaagccagtcttagaaaaatatttgatcaattggaacaacttttggtttattttcatgagccaggacttctaagtaatggtaaatatccatctcgtcaatttcagtcatggtccatccctgttttaaaagggtcgcatatatatcattgagctgttctattccgttttcaactgtaagtcctccgtttccgctgctggcaaaaaatcttcttcctcatctggttcttcatagcccatgatttctcccataattcgtcttacttcatcggaaacttcaaaggactgtaatccttcttgaaaatcctctaaagtaaattgattgtgaaatacccgtacaatgaatttcatacgatcctcaaggcttttgagtacttctttaagattttttgctttagaagctgtctcatctaactttaaggcttcaaacaacgtctttgtgtttgtacggggagcaataaacgttttatattttccttcttcttcaaaccataatttaatagaaatatgtttttgagccatgttgactcctcctttattttgttagatttaaaaaagaagcatagagcttccctttatactgtctttccaatgtctacgctggatttattatcagagcctgagtccggatttttataagcattgccaaacactttttcataaaacttgtccaaattgaaattcggtgcgtcctcatcagccaatactttataggcgttgtcttgttcgcgctccataaattcagcagaaagtttgaccgtctgaaaatcagtcttttcttcttttgttttccattcatcatccggaagagaaaaacgccctttcactaagcctacatggcgattcttgccgttcgcttttggcccatagaaagacatcgcaacccatggcgcgataacattctttttgaacatatagatcccgtctgtttcttctatcccaaacaattcctccaaaatttccattggcagatcccgcatttcaagctccaattttgtggaaccagtcgtgacagccatatccaccagtttgttgtctgcatactgcttttctgttgatgtttccgtattgaccttcgcgttaattgcgtaagggtaatcaataatttttgtagccacataaaagccattttccttttttaaaggcgcaaatttaacgccttccaatccggtaactgaactgtattcaggcattctaaaacctccaattatattaaaatattggcctcaaatcggcgtcccttccgaataagaccctcatcttttaaaaaatcattgattaaaattcctgtttgaaaatccattctattcatgacccctataacggcagccaaaatctgatcgcaggatgaatcgttgtatacatcaatttgatagacagcgctgtccttgatcggctttccatcagcccacttggtagttctgtagtccaattcctgtacgacgatataagctggtttgcttttgatgccaatcggcaccgcaagttcaaaaatgtttgcaggatcagccaataataaaagcgccggatcagtttccagcgcttcaaatactttattttttaattgcaaagctctttccgctacattcatagcttgtaccctctttttataacgcttgccatcgcctgaagcatcctctcattggcacttagcatactccgctgaatagacgggttagccggctgatgaatggttccgaattcaggcaagtggacacggaacttcgtatcttttgtaggaccaaccactgcatatatctcaccatcggggtcctttctcgtacgattaccaacgataatatcttcatcaatgtggggatggctccccccaatattggaacggggagcattctttttaatttccttcgcaagaacagcgcccccagcttttacagtagctttatttattttttcatccttccttgcgagtgaggataaatatgaatctaattctttaaagccctgcatttctatttcaaatttcattattccaccgcctttgccctaattgtggtgaaatttttccgggaatagttcggtatgatagattctatttcatatgattggttttgaaaaagaatccgcatatgtttaccaataccttcacggtgtcggatcgtaaattttactgtttcttccttcttgacggcagcggccgcataatattcccggccttttaatccttcagcttttgcccagcattcaacgaccgtttcatagtcaccttccacagggagacggccgccttcttttttcttttgaaacttgattcgatatcgcatgtcattcagcatcggcatcagtctccgaaactgtgtattttaattgattgatcaacgttgtcagaactccatcaaggtttgaagttgtgccagctatttcacggttttcataccagtgagttacaaaagcctttacacacaaatctgcgcgagctgaattattaggaaatttcaggcccgttgcggatgtaatgtattcttttgctgaagcgataaacccaagaattaaatcatcctccagatcaccatcgacccggaggaattttttcgcctcttcaagctctttttgttgggtttcagtcatagggcatcacctatctttcgttaactagatgttccgccttttaattcatcaatttgcttttgtaggtcttcaaaaatggcctttacttcgctgtttaagttgtccatcatgatgctaccagttcctacgttgttgcttcttactaccttttcaccaagcatttcatgggtaatgcttttttcttcaatgacagcaggatcacctttgtcaccttttggtccctggggtcctggttctccttgtgggccttgtgggccagtatctcccttgtccccttttggtccttgtggcccctgcggaccaggttccccttgcattcctttgatgtataaaggattttcttcgctgttgtccttcaaataaacgggcgttaccggtttgcccgtgccatcgtcctccgcagaagtgaatacgccgttactttggtttaaaaattgatctgccatatctcatcatcctttcaattttttattttccaacgtcaactgatttatcttctgtgtcgccggtacttggagtttcattgtcgggaacagcgtctttaatagatgcaaattccgcgtaaacaacagcatccgtgtcccaaagtacaacgtcctcacgttcaatgattcgcatatctgtagagttacggtagaatgctttaccaccgacatttgtcgttaaaatggaatattgctgacgatcaaagagtttgacagcttctttaaggtctccaatgattaatggatattttggagtcgtttttgtaccgccgtttggcaaatacttatcagaaatgacggataccggcttaccgaacaataattttttagttggatcagtagggttcggctgaagcaggtaacggccgaaagcgtctttcagtttatctaacacgttaaatcctgattggttcgtgacaactttagtcgtggcattaatagccggatcaagtttgacattgagaatgtctttaatgtcgtcctgcttcgatactgtggtttttgcaagtgttcctaattgattaagaatcaacgtattgcgggtcacggccgactttttggcaagccaattagaaaggtactgcaaaagtgcttcttgtgtatctgcaagcaaatcattagaaagaaccaaaatcccggcatagtctttaatgctatactttatgttttcaaatttagggttctctaattcttcaatatctgctaattcctcaagatttactaacggggtgatatccgctagtttttcaagaacccttgaccctttgtttgttgataccggaatgacatcgacgagatttgccaacgtatcaaattgacgtcgtttttcatttattttcgtggagatatcctgcggtacaataagcccgccgtcctcatccacaccttctttcatcgcggcaagaggctgtggtactttgcctgttctaagggcagatgcaaaaagctgagcatgatttttcgcatctgttttggcgatatcatccgttggctgttgcgggttctttgcctctggatcttgctgcggctcttcttgtgcatatgaaacctgcatgtttcgtaaatcctcatatgtttgaatttgatctttaatttgttgagcctcagcaagcagttttttggcttcgtccattttcccttcatcggtcagtgcttcaattcttgtacgtttttccgccaaggtctggcgcaattctcgttcttttttggacattccgcccccggcaaaaaattgaatatcaagtctcaataactttttctgtttcaaatgcttgtcctccttaatagtggcataaaaaaagaacccttaaagatttaagagttcaagtttcatattgatcttttgttttagtaattcatccggcttagtttcttcagccggactttcagcagtagattgagcaacaattttgcctggaacatgtttaaaatgtgccagtacctgatgatcaatgcaggctgctacatcctttgactctgaaacctcatcgatcaagccataatttaaagcttcatcggcggtgagccaggtttcctcatccagcagctggcgtaaagtcccgtcgtccagtttgtctcctgctttcgcaagatatgtggaaacgatactttcagtaatcttatccagatcatcggctgccttccggaattccgcggcattcccgaccatccccatgtatgggttgtgaatcatcatcatggcgttacttggcatcgtaattttatcgccggccattgcaatgacagaagcaatacttccagccagtgcatccacatagacattgatttttgccttgtgacgctgaagcatcgaatgaatagcctgcccctcgaaaacatccccaccgggcgaattaatgtacaaatcaatagagctcacgtcacctaaacttttcaactcagcctgaaaggccttggacgagctctcgctaaaccatccttcgccagtaatagaaccgtaaagcgtgatttcagcagtcgaatcattcagaaccttcatgttccaatacttgtttttcttcttctgttccgttgccatcaccccctttcaggcgatttgaagaccgtttgaccttgctaagttgatactctttcataattgaaaggggaacaaggtttaagtttccataatgctcatcgccgatctccccgatacctgtcatgtcctctttttgaagaatagtattgacgctaaaggcgcctacgctttgcatcgttttataaaattcagcacgtgatttactatccccgcgaagctctgattccaggttaaatttaaagtaatagccagctccctgctgcttctctgtcaaaaccttatcgtttaactcttgttcaatatttgtgacgattggctgtaaagtggttttgacataatctaaggattgttgctcaatatttgaaaatgttgccctgtccagctcacctattttatgcggaggcaccttataaatcgatgcaatctgttggcgattccatttcatcgattcaataaattgggcatctttcataggcatggttacctgtgaataatcaagcccggcgtctaaaactgcaatagactgccccgcattcacccgctcccagtcttctctaagaatttgtttactttttcgatctaaaagggtcggcgctttaacaacaccgaacggtgcaccgccattcttgtaaaatttcgcgttgaattttgtggcagctctatttgaccctatattgtcccgaataactgaaatcggagtttgccccacaattccgtcaagagacaggtttttaaaatgcagcacctcttcataaaaaaactcacggtatctgccgtcaatcgttgtggagtaccaaacacgcccgttatcgggatcaatatttgtgttggttgcttccggatccaatggtctgatacccgtcacatttccgtctttatcaaaaagtaaaaggttgtagctgtttccccaagtgcaaagccttgtaaccaaaagccgcttccacacaaagcttgtcatatagtcattgactttgttcagaatgatatcgctgactttattttgaacctgttgtatgtttccattttgattctgaaaaagtttaatcggcagtttcgcaatatcatccgccaaaacaatcacacaggcatatacatccggatgaagaacggccgtttttgttgataccctttcaccagatgcgctttcagatccagcaaaaatatttttgaaccaatcaaccggatggagaagggaaccgctatcctcttcagcaatttcattttttattccgctctttaaacggcttaatagcatctatttccctccctcatccttatttttttgacgaacaaatcctgccaagctggcaagagaaaataaaaaaacaccggttgcgattaaacccgcgtttacgtttattcgatatatggctattgaaatgaataccatgcccgcaataagcaagatatcctctaaaaatagctgtaaggtttttaaaattttcaagtgctcaccccctacagactgaaagatccagactgaatataagcgtttaagtcgatcgccgtatcaatttgtgaagcccgaacatgtgcattaataagcgcggctgccgggtcaatccgttgtgtggacttggacttatccagcattatattttcctgggcatccacttttgtaacggcgttccccatagcccaagtcagcagatcgtttttattatggatgatctttttcgccttcactttttcgcggaagtctttcgtaggctctgaaagtgtggcaacaccctgccgaatttcaatcatcacatatccgtctgcctccatctgttgggcaaactgtgtagcattatacgggtcataggcaatttctttgatccgccagcctttctctttctccatttttttaatgtaagccctgatatagtcataatcgacaacagcgccgtcggtgacggttaaccagttcttttccttccacaaatcatacggcacgttatctgtcttcatgcgctcatagaaggtatcttcaggcataaaaccgtgactatccacagcaaagctcccattatccaatgggaaaataaacgagacagctgtcaggtcaattcgttttgacaagtcaatccctacatagcactcacggccggataaatcagggaactgatcagatccgcaatccttccaagcctgcatatccatgtatccaccgtcgcgcatattaacccaaacattcatattcttggtcaggaaatccctcatcttttcaggaacagccagagccatttcaagacgatctcgcaaatattttttcccaacttcatgagaagctaatatcggattagcctttatccaattcctttcatcctttatgtcatcgtctttatctatttcgttcaccatgacaaaatactgttcatttgtctctactttgtttggatcgagaagacgtgaaacataatcatactccacacgataggccggattgtttaactcgtgccccgctgtcgtgataataaccatgatcggctgcgttcttgcgcccatccccgactccaggatatcgtaaatctctgacgttttatgagcatgatattcatcgattatgccgcattgcgggttaaatccgtcaccggtcttccctgcatctttagataaagctttgatggttgaatttgtttttgggtgttcaatggtgctgtatgcaatcctgtatttttgctcaggtttgtttagaagttcgcacccttctatttgggcttttatctccttccaacatatttgagcctgctccgtctttgttgcccctatataaacttcagacattttctcattgtttgccattgcttcataggatgcaacacatgctagactctgagtctttgcatttttacggccaacctgccaatacacttttgtaaaacggcggtatcctgtatctttatgaatccagccataaacattaccgaaaataaagatttgaatacgatctggaactatgttttcaccagctaatggcccttttgtatgtttgaattgcgtcatccagtaaagaaagcgacgggctttttcatcgtcaaacacgtaaggaaactctcttgttccttctcttttaatatcatttaaaaaccgctgacaagcccatatatgcttttcgcacgcaacaatctcgcccgatatcacatcgcgcgagtaatcaatcataaactgtttaattgtattcatacattactaaactccttttctgctaaagtcttctcccgttcttcctgggttttcgtgatcgcgagcttggcacgtgcagacggtgtgagtccgaaatcattagcagccgatttcatttgatcatagaagtttttctgtcgtttcagtaggggatgctcttctccaatcaacttgaccggcttcccgttttcaccttgaccctctgtatgaatcatgatgccgtcttcctcaataatttttgtaatagaaatgtactgagaataggcattacaataggcggctaacatgctgatatccgcctccgtcataatttccacctcagataataaagcagcaatccgcttaaattcttttttagccaccttatccagccaggtaggcggtttgatattttcagagcgcattttcaactttttttcatgtttggccctggctgcaagctctttcgtattctttttatttggattgccctgtattaattgaagggctgcggattttgcaggtctcggcatgtttttcacctcatttctattaaaaaaattgcaatttttcgcttgtttttttcaccaagcatgctatgatgaaggtgacaacaaaaccagtcatatcaagccctctcggcaaatgtgccgggagggttctttgcgtttttggaaactttgaaaagcggtgtttgtttgcagaagatggggcgccgttcccggggcggttgcttcccaaggattttcataggggggtatccctacttgaccgacttgcttcggtcgccgtgaaccttgttatggcaagcattgcagagactttcaaggtttgaaaagtctaaacgcttggaccagtcctgcttcacctccacaatatgatggaccatgtcggcaggagtgaatcgatgttctctcaagcatcgctggcaaagacgattgtctcgaagcaaaacaagttctcttgttcgtttccaatctgttgatttataaaaacttgttaatgttttgtttcttgaatgtttgttgtaatgtttcgtttcctcctgctggacgtgcttatggtcagggcagtagccctctcgggtaagggccttacacccataggccttgcactcccttaatggtttaggcggcattgtaatcctccttcagtttcaaacacttattgattcagatcttcatttgcttgctcgactaaaggctgcataagtaggccaatacgctcctttaaattgaaatactctgtcaaaaggcgctcggctttctttagcctcttggctttcgcatattggttctttacacctctaatacgcttttggaggactctaatttgtggggtagtcacagaaaacacggccctatgctggcaggcggggcattgaatatacccaatttcaacgccattctcccttttctcctctcgcaataaaactccatgaacctcaccgcaatgcttgcatttcgattccatttggatcatctccctcaaataaaaaacgccctctcgtttgggaaagcgcctggtatattctttctaaaccgggcccacactcagaggctctcattggccgccaatcgtttattctgagatttactggacccggtttacagagaacataaaaaagcacccagttgggtgctatatatgatgatgcactgtaaaccatacagtcattgtttaatcccactagttacaacatggtttaccacaatgagtatgagagtgtgtaacaggatcgtaactagaataagtgtgtggatattgatgcacatgctggaaatgcttatgatgcacatttgttatatgctgcggatgaatatgcggcacaattgttttagaaaaagtatgagtttgacaacaattagtcgggtgtacaattggcggcatcacatttggtttgcaatgaaacatgactaagctctcctttcattcattgatcatattcattattaaactatgataaacagtgtatacatgtaccattacaatcacccatatttgtccgatcgagtactatccacagcctaaatcaaaaaaagcatcctcaaaaattttttaaggatacttaaactgaaaggagagaagttattatgatttcgatccatatttgcagcttgtctattcgaattcattcaaaaaaacaagaagcatccttcaggatacctcttgaaaaaaggggtaattctcgatgtattttattttatgcaataaattttaaaaaataaacttgtctactcgcttaataccataatactcgatagtccagtcttggactgtcctcttatcttagttgtacaattcctccttacgctaaacgcttattcaaatttgcgccttacacatacttcgggaggaagccaagcattgtaaggcagcatgtccaaaaaacatacttcatataatctcccgataccaaagccgcaagactagcgcgatccggctcagaatgctcctcccgtttggcttcattcttcatcgccttaatttgagtatccgaattcaccttgataagggaatggtgcgtatcccgttatttcttgataagtaaatcttatcgataaattacgcataaaaattccccctctttatccccccgattatcggaaaaatgtcgggattttgtcgggtttttctcgatgaaaaaagcactcagataattccgagtgctgttgcaatacggcagattgcccgctgctttatttcataataggtatcctttttcatgccgagttccatataaatattgatgtctttcaccctggcagccgtcaggtatttcttttcgataatcaaacgttcttcatcgtccaagctgttttgtaaagcccgttccatctgtttgactttgagttcattaacggtaaatgaatcccggagggaagggaaaatgttaaagccggcagatgaacattcttttttattctctaattggactttgagcgcgcggtaatttttcaattctttgatgactattttccggacggctttttcgtccacatcatcgagaaaagatagctgttcctttgacatcctttccctccattcgttcatttttctttttcccattcctgaatccgtctttctgcaatctccatccagatgaatgaagcggcaagaatgaggatccctataatcacatatatcatgattgcccccctagttttcctccacaatcacaactgcattgctgatcatgattcgttttccgtccaggtcgaatttcaccttattcccatagtcattgacttcaacatcaaatttgcctttgtatgttttgatcttatttccgttctgatcgtagacagttgccgtccgttctaatccattattggatgcgttaaaatccttcaccattctatcccatgactcacaacctgccgccaacgcgacaagcagcagaattacgattgtggcaatagcttttttcattctcatgctccttccactggtcagcccccaatattgggttttgattgattacggctccgccgcctcccatcatttcaccctttgaagtcttttcacatcatcaatattcatttgatagtcagcctctcggacggcagcagcaaatgattcaatccctttttcccaaagaccgtgacgctcaatgatttccgaaaactcttcaacgtcatgctcgcggatcccccagctgtcgggatcttctgcgggcccgtacatagtaacccatttgcttgagtcattcggatccggttcctcccattccgcgcgggtaaaatgacaaagctcatgatcgaccagggcggcgcgctgctctgggttcatcgtcttccaggcttccttattgatgaatacaaaaagcatgtaatcggtcatatggcgctcaaaggccgtgcatttttttgccttcccggcccatttgttgttaccttcccggatgtaaaaaccaatgtgtttcttcatcttttaaatgtgggtgatgcttatcgattaaactttcggccaactgccgcacctcttgtgattcttcaaaacctacaaatgccatggtcattttcccctttcaatcaatttctttttgaatattgcgtctaattcagccaatgaaagctcgtacagctgccggccgtcaggcgttttaaaataccccattttaagcagccgcgctttaagctcgtcctttttcctttcacaataaagggccttcattaattcattcacacaaggcccccctttaacagctcccgggccatataatgaaaatggtgatagatatagtttccggtcgcgctcggattaataaaaacggttgagaaattgtaacggacttcaaacgtttttaagctgccaagcaaagattgcggcttatattgtgagcgatattttccgttcaatattttttggtagccttccagatcctccacaagaagagtgaaggggtgtttggctgcacggatcaattcattttcaaaccgagaacggtccttaatggattgaaccagctcatcaactccatttttccgttcgatagcagcgttcaaatacatgtcccggctaatcccgtattcctcgtttttcgggatcatggcagaatagtcgcccgtcttcatccctttgaatttgatagatacgttctttttgcggagatagtcaagaacatgctggttcttctgctccctcgtatccacaataatgatcatgctgtcgagaatattttttaattctgtatccgaatagttatagtgaataatcgtcatgctttcttccccttaaagtacgacatggccctttcatagatttctaaagagagtttgtccgtttcttcatcctcaaaattcgcaacggagctgttcagatctctccagccgttctcccaaaatagaacaagcaatctcgcggctttgattgccgcatcccactcatgattgaaccagtcgtctatttttggattcatttcttgatctatgcccataaaataattgatgattttatcaatggtctgtttgactttatgatcctgcactgagtattcaccttttaaatactggatgatccgttttttatgtgactgaacaaattccacaagttctggatagacgttctccggatgctcaatataaaggtcatccccatccagaactaaaggtgaacctaaaaaggcaaggtcttcacaaatttgttttgggtgcatttccctcacctttgacaaagagcttatttcctttacctcgtttgaattcataaccataggtagctacaacattataaaaatttcttttgcctagtaataagcttttgacccacttttcatattcttgataaagttgtttagcctcaatctgttgtttggaaattttagaggaatactttttcaaaaatgttgatattaatgattgttcatcattttcattccgaacacttagttgtttttctaagtcttcaatgactttgttcaacctatcaatttctcttttttgattgatatacaatttatttttttccgttaaggtcatttcatctattttcattattgaattcacgtttgaaatctcctttcatcaatttctcacagtcgtttccagataatgtcgttacttttgttgctttttcaaaaaacacgcctcactcctactctcccaagggattgaacgtttttttgttacttttgatactcaaatatttattaacgccctataaataattaatatatatatttattttttatttattttttcagtagagggaacatagcagaaaagtatcaaaagtaacaccagtttttaacaaaaggcctaaaccccttattgtatcaacgtttatagccgattccataaattgtatagtgttacttttttgttactttttaatcgagaagcaaaaccgtaatttaaatagacaccttctataattaatttttataatttttttctttgaatacttgtgacattactttttaattccgatggattctgcctctgtttcaaaggatttaattgcttatgcaaatctcggttttcttttattaaaccgatcccatcaaaataatttttgttatagttgccgcgatattttttaaatccacgaatttcgagttgccgataaaaagcccggttcttcagttcaatttcgtcattttcaaaacaccagtctttgtaatctttatagagctccttggcctctaccttggccttcggatgttggatgcatctttcttccatgaatggaccgagaatgtccatatcctcccgatagccatctgttgccttcttgatcgcttccggttctcccaggccttccttctgccacttcaaacagccctcaacagcccagcgaaggatcccaggcatttctgcagccagtttctgcggcagcttcttgtctactttttcttttggaatcgtgacagtaaacggaatcagccggatccggcgccaaataccttcatcgctgcctttcacgatcggtttatggtttgtggtaaagaagactttaaattccggtgtaaactcaaagtattcctggcgaagaaaacgcgctgacatcttttctccgccagtgatctgcttcaccaacgattcagacagctgctgtccctcttcactctcgacagccgacacaaaccgggcgccgtccaacctggcaatgtcattgtttatggcgctgtcatttttcttctttatgaaggtgtcgctgtttgtctgccgcccatagtccccgaacaggtgctgaacagtattgataaaagttgatttaccattccgaccatttccaaatagaaagaacatgacctgttctgtggtgtccccggtcagcgaatagccaattgccttttgcatgaaatcaataatttcatagtttggcgtgccctggtcatctataaaaatactttccaagaaagttttccagttcgggcagtcggcatcagtttgataagagataggagatattttcgtgaaaagcagatcccgatcatgcggcagaagttcgcctgtttttagatcgatcacaccgttatcgcaattaaaaagatatttgtgggaatccagttcctgcttcctcactgaaaccattggccgaacatctaaaattgtgttcatccgtatgttgcggcgctcgcatttcttcgcccaatcgttcagctgcttttttcggaatttgtcttctgtggccttagcctcgccgtacaacgcccgtaatgtcttggcggtgatagcttcaattttccgtttgctgtcttcttcccatcgcttgccgttccagatcagccagtcaagctcgttacaatatcgaatattctttccgtggtagtagacaattcgttcagcgttgccgagctccgtcaaatgaaacgccggcggagtgtcaatgatctcttcggtatcctcaacttgagaattttcgggatgggaaatatatatttcatacggctgttcctgctgctcttccagcaaatcagaaattgtcgtatgagtagaataaacggccgcggcaatggtcatttctccatatgtagcgccatcggatgaatgctgccgatcccatttctcccggaacaaacctgattcgcgaaacattgaatccatttttgcgggatccttatccgtccagaatgccaaatgattacacaaagccatatctgtggccgagtgatcatcatttatcagatgaccgttaaacagatcctgaatgctcttcccgttcttgctgttgaacatcctttcccatatctccttattagagaggttgctcatatcacgggatgaagcagcagggagtttggaaggtttcgattcttcttttttatccttcaaatatttctcgaaaagctctttgagctcgtccgttcgttcttcaacggccccgatcccgagactattgccggtaaaggtgaaataacggccatggcggtatacttccagcccaagttcaggatttttcctacctgtgcccggcccccgcaatgggatcttaccttttgtgatgatgtggactcctttgccgctgggtgaatattcggtgtaactgctaatggcctgaacgatttcctcagcgaatggggacaagacaccgtcctccacacaatgatctatgtctatgccgatgaacggatcatcttttgaaaacatgaagccgatcccgtcataatctcgatcgttatagaatttcaaaacggtcgggaatgtcgaccaggttcttttattactggattgagccatgctgccgtcaatctggtacggcacttttgttttcttaccgtcacgttcttcggaacgccataaaatccactgaggggcgttttttagctcttgcggtatgtttttaaattcgtacatgtgataattcccctttaaaaacgagggagctatacactccctcatatgtgttttttatgatcaaaacggtatatcatcgtcactgatattaattggttcggtttccggtgctggcgcttctgacggcttaaacgctttgacttctggatatttcttgccgttatgttctctttccccgacaagcaggcgaaccggtttattcagaaacgccttggcccattcgatatgatccttaaattgcattccgtttggaaaacccgcggcctttgatgcttggtgaaatctccacattgcattttccgtaacggtgaaattgtcgtatagaattttctggccctggcatggctgctcaacgtcagaacgaatttcataatctacgacaaggcgctcatttccggatgcagccgttttggcttcaaagttgataactgtcgcttcgtattctcctggtttaatcggttcaaaagcttcacctttgctgtggtctactgtaaacattatttttcctccttagtctttaaagcttgtaatctatcaagtgcggcagatgccaacttaatagtccattgatcaagttttttatttgctttgatctgaaattcttcaatcatctgggcggctgtttcgttgccggcgacgattgttttaatttcatcaatcaatcgaatccgttcggcttcttcctctgctttcacgtcaataccgagctcaagccattggtaaagcttgcggccgacttctggattgagcttaaaagaagatccttcaaacatgcgggtattatcttttgatgtttccgccaaatgatcaataccaatattgaaattgagcatgaattcatactccatttcgtctttttgcacaggcttggtcccgaccttacgcggcgccattttcccctcactgttcggctcaacaacgtactcagttttggtccgaagcgtcgccagaatgtgaacgtcattttgcgttaacgtttttattaatttcgtagtttcgggcgcaagtttaccccagttttgaaatgagttaccttgcatttccccatgtttttcaacgatgccaccttcccccgcccaattgtgggaaagcgagtcaattatgacaacttctgcaccggcttccttaattgcttcaagagccatttgataccgttctgtggtataaggcggtgtaaaatcgatgtgcttgaagctgccaatccgtacatcatcaaattgcaagtttgcatacagtttggcgcgacggtgctcagtatccacaacaccaatctttgaccagacttccttatcacttgcatccgggtatgcttcccgcatcattccgtaagcaactagcagggcgccggcagtctttccggatccactcggcccgataaagccgacaattgccttttctttttcacgctgtgcgtttgtgacttgaaacatctattacacctccactttgaagcttgtggaggcaggttctatttctacgcccggaacaacttgtccattttcatcaacgacaacctttttgccgtccacctctttaatggacagagattttttaaggtcgccccatttgacatcttctttgataaattcagtgagaccggcctctttcacatgcttgagaagctgatccttatcggttggcttaggctgctctttaattgtgcggctttttgacttaccgtaaggtgtggaaagtgtttttgcttttggatcctgaacgagctgctttgagtgataaacgctgaccagtttttcaaagaacgccagattgtccgcgagaggttttagctcctgagtttcccattcatcgatacgctgcctttccgttgccgccagagccttgatttctttttcctgtgtctttaaagcagctattttccgaaacgcccaatttagactattcatgtccgtaatctcaaactgtggacggctctcctgctgcaggctattatttgaaatctcgtttagttcaaacgcctgtaaaggattcatgtatattgcctcctaattgattttgtaataaactccatttaaaataaggttgttaagtgttgtttttagtcgcctctgccaaggcggcttttttattcataagctgacggataaaatgcagtcatttgaattttcctgttaatttcagtctcgtaccaaaagctattatcataggaacgctgattaatctctgtgttcaaattttcagcggcatctttcacgttttgaagagctgccttttcatttttacagtgatagacaatgtcaatcctcccaccatttctcaatgcatattcgacaaggtgcaatactgagtcaatctgtttttgatccattttcatcctccttttctacctcgtctttcaaatattccaaaggatatccgtaacggttgatctccgtgatcattggatgttcgatattcattgaaacgatctccttacagttgaaacgtttaatcccctgttcgcaaatttggacgcgatttcgtgaagccgaacaacctgttccgggtgctccatccgtttaagatccttgcaatttaaaatgattgttgcagcaatttctacacatccttcaaaatcatgttcctcgatcgcggcaggcaattccgaaataagatctcgcgttgaaatgaacagcctttccgccttttcacggtcagcttttagaaatcggtttaggttcatacccgtaccacctttcttttttcggtataatgttcctgtataagacaggaggtgaaactatgaaactaaattatgattgtgtccgctcaattcttctagaattagaggaaaatttaactcttaacgatggcgtcactttatatcagctcaaagattttgagacattcaaagagtatggctatgaaacttccgtttacgctttaaccaagttaatcgaagctgactttttaaacggttcggtttcgcgcgcagacaataagattgactatattggtgttggctctattacttgggatggacatcaatttttagacaacattcgtgacaatgctgtttggtctaaaacgaaagatgccgttaagtcgttatcaagcgtttccttgtccatactttcaaatgtcggagaaagcatcacgaaaaagcttatcggtttagaataatttaatttctacaccttgcactaaggcgtagataaaatctttctctttcggataatgatcttcaatgaattttgtcaaagaaatcaaatcgttggtgtcgatagataataatctgttgacgccatctttttttgaataaacaataatatttttatttgtcattctttttactcctttcacagattaaatgattgttaagtattcctgattttataagttttcaacaataacattaaatcttggcggtcaatctgtttcgatcaaagattcagcttccgccaaggtttcttgatctgttacttcaaaacgtctgtacaaccaatctttctttttgttctgttgtttgccacacattaccctcaccacctttcaagaaattcacgaagtactcacaatcaggacatcaatttcgctttcacaaatgcttgataaatcttcatgaaacgctccgcctcgcttaatgcaagccattcttttgttttgatcttcattttctcacctcccttcaatgggtcataacatctatagcaatgtcgtttttatcagcgaattcttcaaacagacttttttgtcctgaggctcttcctaaatcactaactgtcgatactaaggtaaccatgaataaagtgatatccggattctgataatcccaaaggaaatcgaatacctcttcttccgttcctatgcaattgtctattcctttttctttgacagcatgcatggtactgaaatagtctttcattccaaacttttcaccatcatactgcttacggatggggaacatctgcatcaattctccgggtgtaagctttcctattacggtttgaatgaactcaattaaacgcagctttacttctaggaaacggcgtgatctagccttctccaggttgatcatcttgattccagcaaacgcgattttcttgaaatcgtctgtgtcaatttgattagttctttgtatttttctcgcactctcaattaccgctttttgaaacatcctgtggtagattgagtagtggtctggctttcgagtaccctcgatcactttgagttgtgttttcatgaaaatcctcctcatttgcttagtccgcaggggcatcttcctcttttactaggaatgctagtcatcttcccctacaatcacaatgtgatctaatgcgaagcggagacaggaatcaattaatttatgtaacttgatacctgtttctgcacttaaatcttttaactgttgatgtgtatctgtactaatcacaacaactttttgcgctttttcgggctgttcacgttttagttctagtgtgcatgtcatgataaaccctcctcattttttaggtctgcatgatatttaattgccattggtattttgatgtgatggtcagtgtatgtcgtttcattcccttgagctgttgctttttttgagtaacagctatccacacttcttcaatcttgaaatagatcattcagagtgcagccaaacaatttggtaagcgcctttgcttctcttaaagtaaattcctttttcccacgttccttttcatggtaggtctgtggatgaataccgatttttcgagcgacatctttttgatacaatccacgttctcgacgagcaacgtagagtttatgtatcatgacgcctcacccacaccgtacttaatggccatttccttcacgatcgctagataaatttcagtcaagcgagcatcatcgccaataacgtccattttgtttaccttgtctatttttgacttaggcacaccgtttaaggccatttcggatttcttattcgtaagcctaatggataaacgacacctcgctctatcttccaacaattgataactttctttcctaacatctgcataggcttggaaaccgccttttgatagcgcaatagcattgatgatcttgttcactttctttttccattcagtaggattaagcgaaagaacttctttaatgttgtcttgcttcttttcaacagcatcaaggcgtttgtcttgttcctgctgctttagttgtgtacgggctactgaatcaaaaatttgcttgaacatttgtagttcagggcttaactgggatgtatcaatttgagtttgcttgacgttgtaatactcatccacaagcatttcataagcgtcccaggcttgatcggtatttagtgacttcgcatgaagccatgcacctttttccgtccaaaggtagagcgtttgggcgttttttgaaccatcctcaatttgcgtatggttgataaaatcccgtttttccttcccttgcaaagagtaaaaatgtttcccttctttaaagcgatttatgttacgtttaaaattctcggagatccgacggttattcgtcccatagctttctgccaactgggttgttgttaaaacacgttggttattcttttcaataattgatagattcatggtttctctccttttttcgcatttcatgcgacatactgattaaaaaaaataactgttgcttccttactcgttaaacctagaacagtacatattagatttgcttctttaattgagaaagtttctccgttactattgagttttctatagaatgtacttctatctacgccaatttttttttgcaagctcgccgatagtcattccattttcgacaatcttccctcttaacttatttacattgaccacgctatcacccccttttctattttcgcatatagtgcgatttcgattttcattataggctcttattttcttaaagtcaacactaatttcgcaaatatcaataaataaacgataaaaaaattatcttttgttgcatatatgcgaaataagtgttattctaacattgggaggtgaagagaatgacagtaggagaaagaataagaagtagaagaaaacaactaaatatgtcagttgaccagcttgcccaaaaactgaaaaaaaacagggcaacggtttacaggtatgaaagtaatgaaattgacaacatgcccttgacagtactagaacccttagcaaaggcattgaatgttactcctgcatacctaatgggatgggaaagcacagaacctgttcagctatcaaccaaatacccatactacccgataggcatatccgccggccttcctttatgcatagacagcatagatgagaacaatgtggagtacatcttaataccggacaaccttatgggcaaatgggcaggtaggaaagacatctttatgatgcggattaatggcgatagcatgaataggattatgccccacgactcactgattgcagtaaggcctgtaccattatccaatctacgcgatggagatatagtggtttacagtgacggcggggattatgctgtcaagagattttaccgcagggaagataaagttatatttaggcctgattcttccgatttaaattttacggattacgtaacatctgctgataacatcgatttaagaattcacggaaaagtagttctatatatcgcagaattagattaagttgttagcgctaaaaatttaatcacaggcgggacgatcacccgcctttttttaaaggagtgaatttagtatgcctgtctataaagacaaggaaaggggaacatattattttatcatatcctatacaaacagaaatggagaatacaaacagataaaaagaagaggatttaaatcaagcggagaagcgaagagggctgaagcagaaacccttttacgactagaaactgacgacggagaaaatgaagataatccaacttttgaatttgtcgcaaaagaatacttgaaatggtacaaaaaaagaagaaaggcatcatcatatttaaaaacaagtagcattataaatactcacttgataccaaggttcgggagcaagaaaattaacaacattcgttcaagggacataatgcgttttcagaatgatttgcttgatagatatgccgttgcgcacgtcaaaaagatacatcaagttttatcggctgtatttaactttgcgattaaacaagagtacacaaaagataatccagcacgtttagcaggaaatgtggatatagaagaagataaacacatcaattattggacgttagacgagtttaaagcgtttattcaacacgtagatgatcagttatattatgcactttttatgacactctattatagcggtatgcgaaagggagagttattagctctcacatggggagatattgattttgacagtaacactataaatatcgataagaccgtttataaccgaatagtgactaaaccaaaaacaacatcgtctatacgaaaaatcatgatgcctaaacacgtaatgaggttattagctcaattaaaagcaaaaaccaagacaaaaatgacatatgtagtatttggggaatttcatgaccacatttcaactacaacactagatagaaaatacgctgaatacgttaaggcggcaaaggttaaaaaaattcgtctacatgatttccgccattcacatgctagctatttaattaacaggaacacaatcccatctgtcgtggcaaaaaggctcggtcacaaggatgtgggcacaacactcaacatatacagccatttatatccgagcacagaaaaagaagccgtcctcaaaatggaagacgacttcaagactgctgaaattattcaccttaaagaagcttgatactctagcgcgtaaaaattcttaccacaattcttaccacggtttcataaaccctatcaaatcaaccttaaaactcaaaagatggagacggtgggagtcgaacccacgtccagaaacgtcgattgcttcagcgtctacgagcgtagccctgcatatttagtttcgctcatcttcgtgcctgcgggcgggccctaggagagctagtctgatgagtctcttcctgcgccctcagacgggggcgcaagcgtagcctacttcgttatgggctcttaaccggcacataggcgatgcgggcaagagctcgctgcgctaattaggcagctagtgctaagttctggttagatttgccagttatatttaggtgcgtttttacgagatcgcctctcggctcgcagctcaagctcgatccgtccctgtcgaatccgtaacgtccccttggatgaaaaggaagccggatcactggctgcatcactattataacaagatcacgcgtcaattccaaatggtaatgtctgtgatcacgttcatataggataacatgagttctggctttagatcaagcctttttgcctgtcgcggaacgctctttcgatttcgcgtttggcgtctttgcgcttcaagtcttcgcgtttgtcgaacttcttcttcccttttccgagaccgagcagcacttttgcgaagccgttcttcaaataaatcttgagcggtacgagcgaatatccctgctctttcgtcaaaccgatcaatttgttgatctgcttgcggtgcatcaaaagctttctcgttcgcaacggatcatggttgtagcggttcccctgctcatacgggctgatgtgcatattgtggaggaacacttctccgcgttcaattttggcaaacgcgtcctttaaattcacccgaccggcgcgaatggacttgatttccgttccttgaagcacgatgcctgtttcgtatgtttcttctatgaaataatcgtgatttgcttttttattttgggaaacaaccttcccttctccctttggcatacggcaacctcctcccgccttcaatctcactaaagggcggcgaatacgtattattctatcaaatgaacgttcgtcttacaatttcgccgccctttttttgacgtgtgccgtctattttttctttttcttgcgtttttgtttcggcgcgttttgaaaaccgcgttttttctttacttttttctttttcggcttggtgaaccattcccctttgtcagccgatggagcctctctttttgaagcctttttctgctttggctccggcttctgccggcggcgggagcctttcatgccgacgatttcaaaatcgatgttccgctcgtctttattgacgtcaacgacgcggaccgtaatctcatcgccgatccggtacacgttgcccgtgcgctcgccgatcatcgcgtagtgctgttcatcataacggtagaaatcatccgtcataaagctgacgtggacaagcccttcgatcgtgttcggcagctcgacgaacatgccgaagttcgtgacggagctgatgacgccgtcaaattcttcaccgatcttatccagcataaattcggtttttttcagatcgtccgtttcccgctccgcatctacggcattgcgttccatatttgacgtatgctcggcgatctcaggcagtttctcggcccatttttcccttgtcgcttcgtctgtcttgccctgaatcaaataggtcctgatcagtctgtggacgattaagtcaggatagcggcgaatcggagacgtgaaatgcgtgtagaattcagtcgacaagccgaagtgccccaggctttgcggatcgtatttcgcctgtttcatcgacctgagcataaccgttgaaattacggcttcttcaggacgatccctgacttcttcaagcacgctttgcagcgctttcggatggatacttcccgccgttcctttgacgacatagccgaatgtcgtaacgaactccaaaaatctctgcagcttttcctgatctggatcttcgtgaatccggtaaataaacggaacattcatccaatgaaagtgctcagcgaccgtttcattggcgacaagcataaattcttcaatcagcttttcagcagtcgaccgttctctcaagacgacgtccttcgcttttccttcttcgtcgacgagaaccttcgcttccttaaagtcaaagtcgacggctccgcgttccatccgcttgccgcgcagaatcgcagccaagtcttccatgtctttaaacatcgggacaagggcctcatacttctgtttcagctcttcatcatcatcgactaaaattttgttcacatcagaataagtcatccgctcggtcgttttaatgacgctttgaaaaatttcgtgctcgacgacttgcccttgaggattaatgagcatttcgcatgacattgtcagcctgtcgaccttcggattcaaggagcagattccatttgacagcctgtgcgggatcatcggaatcacccggtcgacaaggtagacgctcgtgccgcgttcatacgcttcctggtcaatcggagatccttccgttacataatggctgacgtcggcaatgtggacgccgagtttataatggccgtttttgagttttgtgacggtaacggcatcgtccaagtctttggcatctgcgccgtcgatcgtgacgatcgtttgatcgcgcagatcccgtctgccttcaagatctttctcatcgattgtatcaggcgtattgccggcctgttccatcgcctcagccggaaagtctcccgggaggccgtgcttatgaataatcgaaagaatgtcgatgccgggatcgtttttatgaccgagaatctcgatgacttccccttctgcactcatccggccttcaggatagcttgtcaggcggacgacgactttatgaccctcgacggcgccgtttttggcgtgcttcggaataaagatgtcattcgtgatttttttatcgtcgggaatgacgaagccgaagtttttcgtctctgtgtatgtgccgacaatcttctgaatgttgcgctcgatgatgcggatgatggccccttctttttttgtaccgccggattctgtgctcaggcggacgagcacggtatctccgttcattgctgtgttcagctcagacggcggaatgaagacatcgtcaagcgaggagtcttcgggaaggacaaacgcgaagcctttcgcgtgcgccgacaccttccctttgatcagattcattttttcgggcaaaccgtagcggttgcttctcgttctgacgacaagccctttttcttcaagggttacaagagctttgacgagctctttgtattcgtccgaatcggtgatttccagcatctcttccagttcctgaactgtaagaggtttatatgcttcttctttcataaaggagagaagcttatccataaattcttctttttccactaatcagacctccttatgtctgccaatccaacgtttctaaaaattgatacacatccttgtgcagtgtttcgcgttctttatccaatgtgatggcatgacctgattcttcataccatttcagctgcttatcatccgtttcaacttcattgtagatgatgtttgcgctatccgtattaatcatatgatcgtggcgcgcctgcacgacaaatgtaggcgaatagatcatgtccacatgctctctgacatcggcaatcaaatcctgcagtgctttcaacgtgttcatcggcgtttttttgaattcttccatctcagcgttaatctgctccgctgtcttgccttcaaatttcttataattgcgggcataatcaagcacaccctcgtacatcgtctcttcgcttttgatgtacatcggcgcgcacattggaacaattccctttatgggtacagtgtaacccaatttcaatgaaaaaacccctccgagagacagtccgcaagcggcgatttgttcatatccttccgatttcagatattcatatccgtccatgacgtctttccaccagtcttccggtcctgtggagagaagttcttctggaggcacgccgtggcctttatattggggcgcatggcatgtgtagcctttttcattcaaatatcttccgagcattctaacgtccgccgtgttgcccgtaaatccgtgcagcagcaggacggctttttttccgcctttaaatgtgaaaggttgtggtttgacaattttcatgattcactgtctccttttcatatgtattcttccacgtttagtcttgaaacaaactttatcaatcggccggccccttcagacaaagaccggcaaataggaaaaaggcctgacttgaacatcagacctcatgcttcattgtcttatacaaagtaagcaagcgcaatcgttaagaaaaagaaaagcacggttaaaacgaccgtcatccggtgaagaatcaaatcaagtcctcttgctttctgctttccgaaaagctgctcggctccgccggaaatcgcgcctgataatccggcgcttttgccggattgcagtaaaacgacaacgattaatacgatacttacaatcactaataagaccgttaaaaatgcggccataacctacacctccagacaaactggctgacaatagttttattttacatgaaaagcaagcgcatgtcacgagcgtttcgaacagctttttttattttttcccagcgccggaataaggtatacaaaaaaagagagcggctctgctccctttcctgcggaatatgtaatcacatttatttcttttctgacagtgccgccatcatatcttccaggagcatttccgctccgcgcgggctgagtacgattttgccgcccgcatacgttttatttttcgtggtgatgtcgccggtcatcaaacatgccatgtttgcggcgtattttgtcaaaatgatgttttcgccgtcggtatatatttcgagcgggtccttttcattgatattcagcaccctgcgcatttcgaccgggagaacgactctgccgagctcatcgattctccggacaatcccggtatttttcacgtttgaaaagcctccttttctcctttctttattgacttttgtcaacatctttataataaaagagatcttcaaattttttgttgaaatactgaatcatctttccgatcacaagttgtccgggcctcctttcgccatttaaaactctgctgagtgtcgccggggatacgccgatttcaatggcaagctgatttaaggagagattgtgttcaatcatgtactggagaacaaaatctcttttgatatgaatcttttttaccatgattactcccctttctaatctcttatgtttctttttatctacattgaacatatacgatttgttaacttttgtcaatacttttaccatccatatgtttcctataggcaatattcgtactaaaatattttataataagagattgcgaggttttggccatgacgaactttggacaccatttacgacaattaagggaacggaaaaaactgaccgtcaatcaactggcgatgtattccggcgtcagttcggcaggcatttcgcgaatcgaaaacggaaagcgcggcgtgccgaagccggcgacgatcagaaaactggcggacgctttgaaagtcccgtatgaggaactgatggcatctgcaggctatatcagcgcgtctacagtccaggaagcaagaagcagctatgattccatttacgacatcgtgtcacagtacgatttagaggacctttctctgtttgacagcgaaaagtggaaggtgctttcaaaaaaagacatcgaaaacctggacaaatatttcgactttctcgtgcaggaagcaagcagccgaaacaaaaactgaatacttctccgcggcacactctcctctctatcattttcgtctgtttacgatcctgctgttattttatcccttatgttaacttttgtcaatatttttcctgtctaagtatttcctatagtcaacatttgtattaaaatgttcatatcatgaatttgcgggggggggatggcgatgacaaggttcggcgagcggctcaaagagctgagggaacaaagaagcctgtcggttaatcagcttgccatgtatgccggtgtgagcgccgcagccatttccagaatcgaaaacggccaccgcggcgttcccaagcccgcgacgatcagaaaattggccgaggctctgaaaatgccgtacgagcagctcatggatattgccggttatatgagagctgacgagattcgcgaacagccgcgcggctatgtcacgatgcaggagatcgcggccaagcacggcgtcgaagacctgtggctgtttaaacccgagaaatgggactgtttgtcccgcgaagacctgctcaacctcgaacagtattttcattttttggttaatgaagcgaagaagcgccaatcataaaaagccgaatttcccttttaggagaagttcggcttttttcggctgccttaagcggcatccggattcggcgtcttgcctttatgatgcttaacggggctcagcgcacgctcgagccatcccatgaacagatcggcgatgatcgccatcagcgccgtcgggatcgcgcctgctagaatgatcgctgttccgttggtcgcgtttgatcccctgacaatgatatccccgaggccgcctgcgccgacaaacgtgccgatggccgtaatgccgatcgcgatgacgagcgcggttctgagccccgccataatgaccgacaaggcgaggggaagctccaccatccggagcacttgaaatttcgtcatgcccatcgccttccctgattcaagataggcatgctcgatgctggcgattcccgtatatgtgtttcgaatgatcggcaacagcgaatacaaaaacaatgaaagaatcaccgtgtttgcgccgagccccatgacaagcatcaagacggcgagcatcgccagcgccggaaccgtttgaatgacattagtgatggaaaagacccatttgctgattttacggtatctggcgatgaaaatgccggccgggatgccgacgacggcggcgaacaatacgccgtatgccgacattaaaaagtggcggtaaaattcccccagcacatagccgccgttttgcgcgtaatacgtccaaagctgctgcagcacttccatttgtcatcccctccttttactcaaaataattgtgcttctttaaaaactcggccgcgacgacagaaggctctttcagctttccatcgacttcgtaattgagctcctgcatcgtttcggtgtcgatttttccaatcagtttattgatggtctcttcaagctccggatgctccttcagcactttttccggcacgaccggcgaacagtcatacggcgggaaaaagcgtttatcgtcttttaacagctttaaatcataggctttgatcctgccgtctgttgaataggcaagaacgatatccattttgccgtttttgacggcgtcataaacgagtccgatctgcattggaaaggtcgagccaaatgaaaacccgtattcctgtttaaatcccggatatccgtcgccttttcgtttcagccatgcattgtcaacgccaagcttcagttgatccgcgtcttttttcagatcggatatggtttcatagttccctttttcagcgagttctttcgtgactgtaaaagcgtacgtattgtcaaatccgtaagaatcgaaccatttgtagttgaatttcttttgaaagtcctgctgtacgatgcggagcgcttttttcgggtctttctccgcttcccttccaagcgtgcttgtcaggtcagttcccgaatagcgcgtcgcagaaatgtcgatgtctccgccgagcatggcctggtgctgcacatagtttgagccgaggtttttgaccagcaccgtattgagatccgtatcatgctcgatcaaaagcgagatcatattggcaagaatttcggattcggtcaggttttgcgctccgattttgatcgttttatcggaagccccgccaaggcccggcagcgcacagccgctgatcaaaagcgagaggaccagcatgacggcgccgagccgtctcagtttttttgtttgcataagagccaactccttatgatacttccttcatcccttttaatccttgaggcgtgactttgtcttcggttttcgacagaatatagtcgatcacgatggccagtatcgtaaccggcaccgctccggcgataatgtactcaggctggtacaggttgagcccgataaaaatatagtcgccgagaccgccgccgccgataaaagccgaaagcgtcgcccagccgattaagtaaacggtggacgtccggatgcctgccatgatcaccggcaccgatagcggcagctcgaccaggcggatttgttcccatgcagtcataccgattccctttcctgactcaagcaaattttgattgacgccttttacgcccgtgtaagtgtttctcagaatcggtaggactgaatagaaaaacagcgcgacaatcgccggaatctttcccactccgagaagcgggataaaaaacgccaggatcgccaaactcggcagcgtctgaatgatgttgacaacgccgatcacgacgccggctccttttttcattctcgttaaaacgacaccgagcggaaccgcgaaaatgatgccgagcagaaccgcgaaaatggatatatataagtgctcccatgttttataaagcatttccccgccgttgtgctgaagaaattggacaagctgattcatgattgatgcacctccctgcatttaacgttgaacaagggtttcttcatctccccaaatcgagtcgtacacgatatcgacaaggtttgcccttgtgacaatcccgacaaggcggccctcttcatcaagaacgggaacatatttgaatccccttttcaaaattttccggacggtatccctgatgagcgttcctttttgaacggagtaaacattctcattgacaacctccccgactgtgacggattttttccggttctgatcgatgatttcaacatcgatatatccttttaagacattgtgttcgtccacgacgagcagtgaatcgacgcggcgttccctcatcacttgaattgcttcagtcaggtttttttcgctcgtaatcgtgaccggattcgggttcattacttgttcgacatgctcgatgtcaggacgggactgaagaagcctctcttttccgataaattcctcaacgaattcatccgccggtttccgcaaaatgtcgtcaggcgatccgacttgcacgatctcgccggcgcgaaggatgacgattctgtcagcaagcttaatcgcttcatccatatcgtgggttacaaagacaatcgttttgtccagcgatttctgaagctttttgaactcttcctgaagcgaatcacgggtaatcgggtccagcgctccgaacggttcatccattaaaatgaggggcggctctgccgcaagcgcccgcagcacgccgattctctgctgctgtccgccgcttagttcatgagggtagcggttcaaatattccggccccatatcaacgagctgcagcagttcctccgcccgcttctttcgcttttcttccggccatttcaaaagcctcggaacgagcgtgatattctgctgaatcgtcatatggggaaagagtccgatttgctgaatgacatagccgattttccggcgcagctccaccgggtcctgatccattatgttttctccgtcgatgtaaatgcttcctgaagtcggttcaatcaagcggttgatcattttcatcgtcgttgttttcccgcagccgctcggtccgataaagacgataaattcaccttttgctatatcaaggttaatgtttttgaccgctttttttccgcctttataaacctttgatacattctctagcttcagcaaaacgcacacctccaactgttttttaaaaatttcaacatctcattcattataagatacactttgtaaaataaaaagtttacaaagtgttcaaattatatatataagacataaaaaaatatattcatggcatcaatttgccggttattcttaaaattgcggctgatttctttgtttttctgtcgttttagtgttttcaaccgctaacaaaattatgatatattgacaataaaattggctgcccgaagggatgatgagctttggaggaaaacgctttaaaagtgattgaacaagcggaagaacatttcatagaaaaaatcgccgaaaatatgaatacatacggtctatcatcaactgtcggccgcgtgctcgggatcatctatatgaacagaaagccgatgaccttaaatgaactgtcagaagaaacgggcatgagcaaaacgagaatgagccaggtcgtccgcgaaatgatcgatttaaatatagctgaaaaagtttttgaaaaaggcgtccgcaaagatctgtacgatgtcgaacaagactattatcaaacgtttatttcattgtttacggccaactggagcaaagtcgccaaaaagaacaggatgattgggaaaaaaatcagaaaagagctgttggaggcgctcgaggaagaaggccttacgcctgaaaccgaagctaaaatcaacgagctgctggctgaaacaaaacaatggatcgattactgcgagtggcttgacaatctgatcgcgtttttggaaagcgaagagatcttcaagcatgtgccaaaaccttcataaacaaaaaaagctgcgaagactaagcagcttttttgcatttcctcaattatcccgccaacaccggaaacatccctttcaatcccgttccgatcatgccgaccgccacgacagccaaaatcaggcccatcagccgggtgatcacgttcatctccgtctggcccaatttgttgctgatcagcgtagaataatgaaaggccgcaaacgtcagcaggaggacggcggcgatgccgatgatcattccgccaaaatgcaccagactgcggcttccggccgaaaggctcatcaccgtcgcaatcgttcctggccccgaaatgatcggaatgctgagcggcgtcaccgatatatcctccttttccttgctctcgcgatgctcagcatgatgcagcgactgaacatgggactgctttgcattcagcaggttgtaggcaattccgaatataaatatgccgccggcaattcgcagcgcatggatgttgatgtcaaaaagcctgaagataaactctccgaatatgagaaacgcgatcaggatcagaaacgataaaaccgcggcctttctcgccaatgcggtgcgttctttcgcttcgtagccttctgtgagcgctaaaaagatcggaacattgccgatcggatttgtgacggcgaacaatgatacaaaaacgtggatgataaaagcaaacacggttaaagccactccttcctctgtataaaaatacgggtaatcgatttttacctccgacgctgaccgcttaaactttcaaaaaacaatgacaccttcctgcactttcatttataatgaacctttataggccaaaataactattttaaaggagattttattttcatgacatgttcaaagtgcggccatcaaacagatggcggaaaattttgcgagcagtgcgggtcaagtttggccggcggcagtgatggcggaaaaggagcagctgaaacgccgcaggcagctagatatgcggaggcggcgaaacaagcgtcttccatgtatttttcctattgtttaaaggtgctgaaacgaccgtttatcgaaatgaaaaacgccggagaacagcacgtcctcaacagcatcaccacaatggtgatatttgcgctttcggtgccgctgatgttttatttcggcctcaaaggcttctttgacgccatgggggactattccggagtattcggccgctcctacgcaatgccgacattttttgatatcgtcgtaaagcccgctgttacctttgctatttatattttcttattatttgtttttacatacgcaggcgtgcgcattcggggtgtgcaagcggcatttaaggaagtgctcgggcggttcggagcggtgcttattcctttcgtcgcccttctgctcgccgctttgcttttatcattcatgcaaacgggtttgtttatatatgttcttttctttgccctttgcggcatcgcctttttaattccgccggctgtcatctcgagctatcacgaaaaagcggaaggcgctgttgatacgatttacgcgacgctgatcgtctatttgctgacatttatgtcggtgcggatcatgggagatttgtttcttgaatatatcggaaggatcggaggctctatattagggcggctgttttagtgaattgaaaagcctttttccattgaggaaaagggctttttttttattctattgacgttaagagcaatctgccgtcctcgatggcggcgtgatatgtccaatgatacgtttttaactgttcttttccgcctttgataatattaattttctccgttgtcttaatcgttgcctcccgcccgttttgcttccagctgtttacgctgaattggacgacttcctcctctgtcccgctgttgtacagtttagcgaccagtttcttttgatcgttgtacagcggacttccttctttcaagctgtcgcggacgaggccgaaatcgtttgtgttgatggcgtcttgtagcctgtataaatacgcttcaatggcgaaagcaaccttttggtcggtgagctcttcgcctgctgatgcattgttcatggcccctttcgctgaggcccatgccgatgtgtattccttcggattgtcatttttgatttctttttgatgctcgatatcgataacggcttcaggatcgcttttttcgatgagccactttttcttgccttcggaatagaccaatgtgtacgtatatccgctatcgttttctttcagtttaggcgcaatgtagtcgtcataataggccgatttgtgcttttcaatccctttgagctctgttttccattgcccgtcttctttgtatagccggaacgaatcaagatcaaatacagtagataagtaggtgcctttatagtaggtgctgctgcttttcagcccgtccgtgacctctttcaggcggttttgataagacggggcggccattgtcatgccgctgacattgccgcttgcaaaggcctttgctgcttcctttgtatggttgacgacagcggtcatcatgtcatccataaaccctttgtctgatgcaagattgacttcgatttcttcaccttcaatcggcgttttttcgcttttcagcttcccccacggaaattgcgcctcaacctgagcagacattgaaccgtcagtcagcacaggtccgaattcagttcctttgaatggattgatcttcatctcctgatcattgatccagagcgttcctttcaagttttcatagccttcttcaaagacaagctttgccatgtgcccgttaaggtccgcattaaccttcacatcaccttggagggcggtgaccttcaagatcggcgattccgcttttcagctttgccttcacctcgtaagtaccggggacaaacgggccgatttttttctcgaagttttctttttctgttgtgatgacctttttgccgttaacaaacaggccggtatctttatagtttgtcttaaccgttaagtagacaggctccgtgttcaagacatagcggtcatagatccaaaaacgcctgccctttttttcgatcgtcatcaatggatggccggcaccgctttttaaggatgtgatcaattctttttcttcatccgggtgttctttcaagtaatccaagagcggcttgacgtttttctccgtgacagccagatccacgtctgatgattgaagcagttttgctgctttcttggcatctttctgatcgagggcggcttcaaaatcggaaatcagtttttcctttgatgtgagtgcttcaccggttttatagccggcaaacaataaaatcaagcaggccgcgattgccgccatgatgatgattctttttcgtgtcatcgcacgctgataccttgccgccgggtcggaagctcgttcctcgtccgcccgcgcgccgcaatgcttgcaatacagcgcattttttgttcgttcccttccacattccttgcaaaaatccatgactttcctcccatcaaacaaaaacacaattagtcattttatactatatttatcgtaagaagggatttaatattaaggccgcatcaaaaaaagccaaacgaatgcgctgatccgtttggcttttttgatcattttaaaaagtatttttcaatatcatcaagcatcaggtttgctgcaaggacgccccctgctgtattccagatggcatcgctcactttatggacgtttccttttttggagacgtttaagtttttaaagagcggatcattgacatagtctttctcaatggcgcttgctttgtcatcgcctgtctcatacgtgtaataaaaaagcacgtccccgtccatatcaggaatttgttcctttgtcacttccatttgtccgagatcgttggcttcctggcctttaggccttgcaaaaccgagctgatccaaaatcgttccggcaaatgatcctttgtgatagatgcgggtatcagcatctgtaaagcggacgagagagactttttgtttcactttatcgcctagtttttcatgaatgtcttcaacgcgcttgtcaaagtcagcgatgactttttcgccttcagcttttttattgagcgcttcggcagtaagcttaaagttgtttttccattcccctgacaatgtctcggcaaatacggtcggcgcgattgctttcagcttgtcgtatacttcttcttggcggattttgttgccgatgattaagtcaggcttcaggctcgcgattttttcaatattcggcgcagcctccgttccgacgttctctacgcctttcattttatctttaatatggtcataccatggatctcccagccaggattgaacggcgccgacaggttttacgccaagtgcgagcactgcttctgtcgcttcattcgtgagtacgacgacttttttcggagtgccgtcaattgtcgctgttcccattgcgtgctttacagtataggaatctttgctgccgttcttctccgcagattgatctttatcttgatttccgcaggcggctaataaaaggataagcgcagcgaacagtgcaaaccatttaaaacgtttcatgatatgtaggatccccttttctcaagtgattttcattatcaattagattatataatgaatcaacctaaagtcaatatgaaattcctatatatctgttttggattgtgctaaaaaccgcttttgagctgcatccggataaagaaaaccctgctcggcagacactgtacaatgagcatatcgtcttcttacgaaaaccgggatgatcctccttctagacactttgaattcattaggttaacataatcttgtatgaatatgttttttttaccatagtaaggaggggtgatttgactaagtttttattgagtggtttctaccttttcggacttgtcatgctgagcaattggtcgatttcttttggtgaaatatttggagccggcaattcagccgtttttcaattatcggaagcggtgctttttacgtttatcatcgggtgctatacaggtcttcctttgatttatgccaaattcactagatctgaaacgttgttttttacaaatcaaaaggtcttcctcatcaccttaggattaggcgtgctgctttcctgttcggcttacagccttcagcaagccctctctcccatcgcgattgcgctgttgtcgatcattggttttttgatcgttggcatcagcggttttcttcccgcctggtttctgaagcctgcgaaaaatctgcgataaacgggtgggtttttcttaggctgacggggtgttggagccaaggtcgaactcagtggtttctataaacggcgctggtcaatatggtgctctgagaaaatcacttgccaatgcgtaatctgacgattgattttttaaaaaacaacatttgctttcgccatttacaaattaatgaaaattctttatgatatagatatctaagtaaacatgttgcatatactaaaaagaccgaagtgctccaacacttcggcttgtacaaaaagccggcccttcgaaggggcttgctcagattgacctaaaatagaccactccctatcactttccaggctcaaggggcggtctatttttctttgttctctgacaacatggcaatcagcatgccaaaagcaatcattaaagagattgtttcatatgctgtcatttttatcaccccctttcagaaggggatgagcaagacttcccttgagtgagcaaagctttttatacgaggtagattataccatatcaaggagaacataaaattagggaaaaaacctttttcactcatgaaatctagcttttccgccgaattgcttcgacatcgactaaattcttggtctttcagctcatttattgattgaattcattagcttgaagaagtattcacgttgaccggtcttattgagttgataccatgaatccaatgtatccggtgcaaacacgtctaattttttcagcacttcccttgcgaattcgagaggagccgctcctgatgcagtaaccagattcccatttgataccgcgggtcccatctcataaaacggttctcctttataatgaggacagaccattttcatataggccaagtcattgcttgtatgctttcttgaatccagatatccgctattcgccagtcccgcagttgcacctcatattgcggcaaccatcgcgccaagctctaaagcttcgccggcctttttcaagatcggctgatgaatcttttctccccaagtattccctccgggtaaaatgattagatccgcactctcgggcgtccactcatcaagggagatatccggttttatgcgcagtccacccatcgtcgtcaccatttctttattcactcctattgtcatgacttttaaaggtgccgcatcttttttgaaatatcttcccgagttcagttcggccattaaatatccatattcccaatctgacattgtatggaatgcataaagatatactgttttcgactgcatccagtaacactccaatcgcaattgatacagcctattataatcaaaaaccctgacagcttttgtcagggtaaaggaaattcagctttcacatttaaaagaggttggccgcatctgcagccaacctcttttttatgcttacttattcaagttgtagaaagattgaataccgtggtattgcgcagtttcagccaattgatcttcgatgcgaagaagctggttgtatttcgcaacacggtccgtacgagacggagcacctgttttgatttgtcctgcgtttgttgccacagcgatgtcagcgattgtgctgtcttcagtttcaccggagcggtgagagataacggcagtgtagcctgcgcgtttcgccatttcgatcgcatcgaaagtttcagtcaatgtaccgatttggtttactttgatcaggatagagttgccgacgccgtttttgattccttcagcaagctttttcgtgtttgttacgaaaaggtcgtcaccgacaagctgaacttttgagccaagacgctcagtcagaagtttgtggccttcccagtcgttttcgtcaaggccgtcttcgattgagatgattgggtacttagaagtcagctcctcgtaccagtcaaccatttcagctgacgtttttacaacgccttcgcctgcaagatggtatttgccgtcttctttgttgtagaactcagaagatgcagcatccattgccaatttcacttcttcgccaggtttgaatcctgctttttcgatcgcttcaacgattgtttgaagcgcttcttcgttagatccaaggtttggagcgaatccgccttcatcacctacagctgtgttcaagcctttttctttcaagactgatttcaggctgtggaaaatttgtgctcccatgcgaagtgcttcgcggaagttttccgcaccgacaggcatgatcatgaattcttgaatgtcaacgttgttgtccgcatgctctccgccgtttacgatgttcatcatcggtacaggaagcgttttagagttgaatcctccaaggtattggtatagaggaatctgcaagaaatccgcagctgcgcgggcaacggccattgatacaccaaggatggcgttggcgccgagcttgcctttattttcagttccgtcaagttcgatcagcaatttgtcgattgatacttgctcagtcacatcaaagccgataagctcgggtgcgatgatttcgttcacgttgttaacggctgttaaaacgccttttccaaggtagcggtctttgtcgccgtcgcgaagctcaacagcttcgtattcgccagtggaagctccgcttggaaccagcgcgcgtccaaaagctcctgattcagtgtatacttcaacttcaaccgtcgggttaccgcgggagtctaatacttcacgtgcataaacatcaacaatgtatggcatgtttgtttctctcctttaatgcttatttttgaattaatgacgatcctgtcatttctttcggtttttcaacacccagcaagtctaaaagagttggcgccagatccccgaggattccgccttctcttaatgtcacgccttcttttgtgacgatgacaggaaccgggtttgtcgtatgtgcggtgtgcggcttgccttcttcggtaatcagcacgtctgcgttaccgtggtcggccgtaataatcgcgtagccgccttttgcaagaatcgcatcaacgacttcgccgaggcactcgtcaaccgcttcgattgctttgaccgtcggctcgacttttcctgaatgtccaaccatgtcagggttggcaaagttgaggatgatcgcgttatgcttttcagcctcaatttctttgacaagcgcatcttttacttcatatgcgctcatttcaggtttcaagtcatatgttgcgactttaggcgagtcgattaagattcgctcttcgcccgggaacttttcttcgcgtccgccgctcataaagaatgtgacgtgcggatatttttcagtttcagcgatgcgaagctgcttcagcccgttttgggataaaacttcgccgactgtgttgtcgagattgaccggtttgaatgccacgtatccgtcaaccgtttcactgaaatgtgtcaagcaaacgaaatgaaggtttttcggatgcttgtctccgcggtcgaagtcgcggaagtcgtcattggtgaacgtgttggaaatctggatcgcacggtcgggtctgaagttgtagaaaatgaccgcatcgttgtccttgattgtcgcaacaggttcgccgttttctttcgtaatgacggaaggaatcacgaattcatcgtaaattccgttttcataagaatctttcacgacatcgagcggattttgatatttcggtccctctccgtatgccatggcgcggtacgctttttcgacgcggtcccagcgcttgtctcggtccattgaatagtagcggcctgacaatgttgcgatctcgccgacgccgatttcttcgatttgatcctgaagctctttgatgtacttctcagctgtttgcgggcctacatcgcggccgtcaaggaagccgtgaatatagacgttttcaacgccttcttttttggcaagtttcaagagtgcatataaatggtgaatgtggctgtgcactccgccgtcagacagcagtccgaacaagtggaggtttgtgcctttttctttcacgtgcttcatcgctgcaaggaatgtttcgttctgttcgaattctccctcgcgaatcgcaacgttcacgcgcgtcagactttggtaaacgatccggcctgcgccgatattcagatggccgacttccgagttgcccatctggccgtctggaagacctaccgcttctcctgaagctgtcagcgtctggtgcggatacttgttccaatagcggtcaaagttcggttttttcgcttgggctacggcgtttccgacggtttcgtcccttagtccaaacccatctaaaatgatgagcgcggctaacttgttactcatattgacctgcctccaataattgcacgaaagactgcggctcaaggcttgctccgccaacaagagcgccgtcgatatcggattcggccatatattctttaatgttcgcaggttttacgcttccgccgtactgaatgcggacgctgtctgctgcagtttgtccgaactctgatgccacggttttgcggatgtgcgcgcatacttcgtttgcatcttgtgcagttgaagacttgccggttccaatcgcccagatcggctcataagcgatcacggaagcagctacctgttcagttgttaaacctgcaagtgcttttttcacttggtctgcaacaagctcgtttgttttgtttgcttcgcgctcttcaagcgtttcacctacgcagatgatcggaacgatgccgtatttaaatgcagcatgcgcttttttgttgaccgtttcatccgtttcagcaaacatttcgcggcgctcggagtggccgatgacgcagtattcaactccaaggtctttcaaagccgcagggctgatttcacccgtgaaagctccgctttcttcaaaatgcatgttttgcgcgccgactttcagatctgtgccttttacagctgatgtgagcttttcaaggaacagtgcaggcgcacagacaacagcttctgctttatctgctgcgggaatggaagatttcacttcttcaacgaagctgacagcttctgaaagcactttattcatcttccagttaccggctataattggttttctcatgtgctccactccttatgctgtatattttgcttacttgtcgttcaatgctttgacgccaggaagttcttttccttccataaactcaagggaagctccgccgcctgttgaaatgtggctcattttgtcagccaagccgaacttttctacagcagctgcagagtctccgccgccgatgacagagtatgtatcatttgcctctgctaatgcttcagcgacagctcttgttcctttagcgaacgcgtcgatttcgaatacgcccatcggtccgttccaaacgacaagcttgctgtttttgatgacgtcggcatatgtttttcttgtttcctcgccgatgtcaagcgcttcccagtcgctagggatttcgcttaccggcacgattttcgtgttggcgtcgtttgagaaatcgtcagcaacaagcacgtctgtaggcatgtagaagttcacgcctttttctttggcgcggtccatgaaagatttagccaattcaattttatcttcttccagcagggattttcccacttcatggccgagcgctttgacgaacgtgtaagcaagaccgccgccgatgatcaggttgtctactttctcaagaagactttcaatcacgccgattttgtcttttacttttgcgccgccgatgatcgctgtaaacggacgttcagggtttgacagcgctttgcccagcacttcaagctctttttccatgaggaagcctgcaacagccggaaggtgttcagcgatgcctgctgttgaagcatgggcgcggtgagccgctccgaatgcatcattgacataaacgtcagccaggtcggcaaacgctttagaaagctcaggatcattcttttcttctcccggatagaagcggacattttccaatacgagaatatctccgtctttcatttcggaaatttgcgctttgacggcgtcgccgtaagcttcatccgcttttttcacttctttgccgatcagttcgccgaggcgtgcggctaccggcgttaagcgaagctcttctgacacctggcctttcggacggcccaagtggcttgcaagaagaactttcgctccctgctctgttaagtattgaatcgtcggaagtgcggcgcggattctcgtatcatccgtcacttttccgtccttcatcggaacgttaaagtcaacacggcagaaaacaacgcggccttttacatcaatgtcttttactgattttttgttcatggcttttaggagatcctccttttaatgttttacaagcctgaaaacggaaatccccgggcggcttaaaggcgccgatatggaaaaagggaaagggagtgtgtgtccccttcccttgtccgctttcattatagcgcttctctcatcaagaaccaagtctgattctggtttccggattaaagaccttgttttgcgatgtaagcggcaaggtcaacaacacggtgagaatatccgctttcgttgtcataccaagaaataactttaaccatgctgccttccataaccattgtagaaagagcatcgattgtagaagagtttgtattgccgttgtagtctttagatacaagcggctcttcgctgtagccaagaacgccttgaagttcgccttctgctgcttctttaagcgctgcgtttacttcttctgctgttacttctttgtcaagttcagcaaccaggtcaacaagtgatacgtttggtgttggaacacgcattgctccgccgttcagttttcctttcagttcaggaagtacaagggaaacggctttcgcagcaccagttgttgtaggaatgatgctctcagctgccgcacgcgcacgacggtagtctttgtgcggaagatccaggatttgctgatcgtttgtgtaagagtgaacagttgtcatcataccgcgtttgatgccgaatttgtcgttcagaacttttgcaaacggcgcaaggcagtttgttgtgcaagatgcgttagagataacatggtggttagccgcatcgtatttatcttcgttaacacccataacgattgtaatatcttcttcactcgcaggagctgagatgataacttttttcgcgccggcttccaaatgtttcgccgcatctgcgcgttttgtgaagaaaccagttgattcaacaacgatttcaacaccttgctctccccagcttagtttagaaggatcgcgctctgctgtaacttggattgtttgaccgttaacaacaaggttgcttccgtcaacagaaacctctgcgtccaattttccatgtactgaatcatattgtaataggtgagcaagcatgttagcgtctgtcaaatcgttaactgccacaacctcaacttcaggattatttaatgctgcgcggaatacattgcgtccaatacgaccaaaaccattaataccgacttttactgccatgatgatttcctcctttaagtaaataagagatatttaatttatattgagggaagaagcttcccttaataactgttttgcggctccttcatcagtgatcaaaaccgtattgcgcggctttttgaagtatgcctctatggcgtcagcttttgacgagcctcccgccaccgcaatgatgttcgggatcgaatcgagatcctcaagctggatgcctacgctgtgcactttgtgaatgacttccccgtggcggtcgaaatagtagccgaacgcttctgcaactgcctcattttcttctattttcttcaaatcttcctttggcgtatttcttcgttctgccattgttttagcatccccgattccatgaatcaccatactggatgattgaatcgtctgaagcacttctttaatagaaggttcctcaatgatagaagaatatgcttctttgctcagctgccccggcacaaataacagtttgtatgtaccggaagctttctcggccatatgggcgcaaatcgtattggcctgattcctgacgttttcgcccagtccgcctcttgccggaacaaaaagcagcttgcggtttttcgagtcaggcgtcatcatttctgccacggcctcaagtgtcgtacctccggttacggcgacgatattttcccccgtaaacctatttttcatgcatgcgacggccgctctccccatctcttttttgacccatggggactggtcgctgtctcccgatacaatgatgacttcgtcgaggttcaacctctcttttaatgtattttccaaatgagttaaacctaaaacgtccttcatcgtatcttcgagaactttcagcaggtcggatccttcaggtgtcaatatcatgccggttgttttaatctctagtagattttgttcttttaaaaactgaacctccgcccttaaaatccgctcgctgatgccgaggctggcagcaaggcttcttctgccgatcggttcagtcagccttatgtactgcaaaattttgtaccttttctgcatgacatcgagaagatccggcaataattttttctgagcctgtattagttgattcatgccaaaacgttcctttcatctcatcctggacgaataatgtcccgcagtgactgaaaacgtcccacctcagccaaaaaaaattactcctgcttacattccttattgtaacagggttaaaatgtttattcaactgttaagaaacaattcatcgacaacattcgcgcgaacgttcacacttctgttttaattattgttcctgataatttctatattatacatatttcataaaaacgtgcctcaatgaaaattagcccttttatttcatgcaaagctgttcgatttcttccaggcatttttctagattatattgtagctatttcaaaaataaatatattgctaaaatacgtacttaccagcaaaaaagcaacgggcggtttttccgttccgttgcttttttgcgtttatccgtttttccatacatctgcaatgatttcgaacgagcgaagtctgtcagcatggtcaaatgtttctgaattgatcatgatctcgttcgcctgagtcgtccggatgaactcttcaagcttttctttcacactgtccggcccgccgatgatcgttgagctgagctgctcgttcaccatcgctttttcgcgcggcgtccaaatctgttccatatcatctacaggcggcttaagctgtgtcggagcgccgcggacaagatccaaaaacttctgatagtgcgacgttgccaggcgctgcgctttcgcatccgtatcggctgcgataacggtaaccccgaccatcgcataaggctccttcaagacgccgggcttaaacgaactccgatacagttccaaggcaggcagcgtattggcgggcgaaaaatgagccgcaaatgcaaacggcaaaccgagctccccggcaagccgggcgctgaatccgcttgaaccgagaagccaaatcggcacatcaagcccttctcccggtatggcgcgcacatgatttcttacattgcccgacggcttaaaatattgccgcagttcttcaagctgctcgggaaaatcctccccgctgcttatgtttcttcttaatgcgcgcgctgttaattgatcagtgcccggagcgcgtccaagtcctaaatcgattctgccgggataaagggattcaagcgttccgaactgttcggcgatgacgagcggggaatggttcggcagcataatccctcccgagccgatgcgcattttcttagtacctccggcgatatagccgatcaaaacagaggtggccgagcttgcaacaccttcgatattatggtgctcagccagccagaacctgtggtacccccatttttcggcatgctgcgccaaatccatagattgtttaaaagattgttccgcatttccgccttgtacgataggagacagatttaatacggaatacttcgtatttttgaaatgctgttctgacattgtctttccttcttcctgaagtgtagtggtcatgtaattagacgataacataatcgtcccggtgaataaaagaaattagttcgaaaaaaatcgaactaatgtataaaaagcttgcctccgctgggaggcaagcccttttttaagaagcggccgtttggccggctgtctggtttcttcctttaaagaaataagcagcgctaatgagcaaatagatccccgccgtcaccaatgtaatgacaatcgacgtggtcaggatgacaccgatcagtatggctgtcagcgaaatgattgccacccaagtcgtataagggaaccatttgacatagtagccgtttccagctgtttgattccgtttcctcgattttaaatgggcggcggcaatcagcatccagatcacaaggacggtatagccgagagaccccatcaaatattcaaacgtttggctgccggcaaatagtgaaaacaatacgcccaagtataagaacgaagtgcataatagaatcgaataaaccggcacctttctcgcagaaagcctcgaaaagattttcggcattcttccgtctgacgcctgtgtatacaaaatacgggaggcgccgtaaagccctgagttcatagaagaaatgaccgccagtaaaatgaccgcattcatcaaatgatccgctccgggaacgccgatcatcttaaagaccatgacaaagggactctccgacaccccgttcacttgattccatggaatcaagctgacgatcacgaaaaacggcagaagataaaaagcaataatgcgcgttaacgttccccgcacggctttaggcacaaccttctcaggatttttggtttccgccagggtcaccccgataatttccgttccgccgtaggaatagatcacgacaagcatggctgtaatcagccctccggcgccattcgggaagaagccgccatggtctgtcaaatgagtaaagccgacagccgaatgttgtccaaaagagaaaaataacaagataaatccggatataataaagacgacaatcactgtgattttaatgagagcaagccagtattccgtctcggcaaagcttttgacagaaagcaaattcacgctcgtaatgacgagtgaaacgaacagcgccagcacccaaatcggcagccccggcagccagtactgcaaaaacatcgcggcgacaacagcctcagccgcaatattgagaacccacattttccagtatatccagtccaaaaaataagcggcatacggccctaatatcgattgaaccagatccctgaatgttctggcttcgctgtttcggacagccatctcggccagcccctgcataataaacagcaaaatcacgccgccgatcaagtaggggatcatgaccgaaggccccgccaaatcgatcgctttgctgcttcctttaaataatcctgccccaatcgctccgcccaatgccatcatcataatatgccgcgatgtcatcgtgcgctcgagcttctgcatgtctttctccatctatgttcacttcctctattaaaataaaaaagctcaccgtctccctcttcaatttgaagataaagagacgatgagctttgaagcttaccgcggtaccactctttttgatcctataccaagaatccagctttgcgaagcacagccatgctgtgcaaacctgttaacgaaggttaatcgtaaagtcctcaggaattgatgtccgtcctttagccagtccactcccgggcgagttcaaaggttcattggtctgcgtctcacctacccgcagctctctttgccaatgccgatcttttactgctcccgttcattgtgttttcttctgcctgaaatatattcatataatatacgtgccgatcttcactttgtcaacatcaaatccgatgccaaaaaataaaaattaaaatttttctcttttttcaaggaagatcgccttttctattggaaaatgcaagggcagatatgcacaactttcataatgatagagcatgaaccaaaaaaggaaaatgtaaaaatcggcagatatcccccgaaaaaaatagttaaattgaaatattattcaaactttacaaaatattttaacgatgatagagtgtgaaccgaatcataacatcagctaaaggaggaagagaacatgaaaaaactcttgtttatggtgatcttgtccgtattgacgctcgtctttggttcatcgtccgtaagctttgcgaaggacattcctgaagacaggtatacaacacctacagatgctgaatttagccagattaaagagattttaaacgaggctgatgtcgaaaccggcaatttgcagaaggattacggtgtgatcgtcaatgatcctgctgaaaaggtcggcgtcatatcggacattcctgccgaaaaagatgactggagccatgtcagcttccattcttactatgtcgacctcaacagcggcacactcattgctgatgttcaatttgaattcacgcaaaacgatgacggtacatcagaaaccgagtacaaaaacgtaacaaacggaggcaggtacttcgtcaaaatggatcaagacggaaatgtcattgatgaagcaacaaccggcgacatgtcgattttgtggaaatactagaaaccgagccgccccttatggaaaacgcctttattcaaaggcgttttttttggtcgtatatttaatggatctatccggtggcgccatacgggtcagcaagattaaagacatgaggcccgaacaatgccgaactcatgcctgtcaaaatctttctggaatattagcccaccatagtgtcaagacacaacgcgttcctccgagctgtcgataaagatgtcttcaagcgacggttcatcgacgtggattctgtagattcccaccttgcagttcgttaatactctgacgatggcaggaattttttcttctgaattgacgatgatcgaaatctcatggtgcttaaattgaacgttttcaccagctgactcaagaaatcggtcgatcaggccgaaatgctgctcgggaatattcgaatggcggatgtgaacgcttatgttcgacatgaaatgccttcttaactcatcgagcgtgccttccattaaaatgcggccgtttttcatgatcgcgattcgtgtacagattttctcgatttcatgcaggttgtgtgacgtcataaataccgtcttaccttctttttgcaaatccataatcagcttttgaatgtggagtgccgattcggcatcaacacctgatgtcggttcatccaaaaagatgagctcgggatcatggatgatcgcttgggcgatgccgagcttttttttcataccgaatgaatacgcgcccgcttttttttcagtatgctcagtgaaccctaccctctctaagacttcttcgcaacgctcagtcgatacggtccgtccgttcagctttgcaaaatacttcaaatgcccgaccgctgtcattgaatcatagagggtcaaataatcgggtaaaacgccgatgcggtgcttgacgctttcaatcgaagcttcatttaacagcagaaaactgccggctgtcggctggataatgcctgtgatcatattcataaacgtagatttccccgcaccgttgcggccgaggaatccgtaaatctctcctttttcaacttgaaggtcgacatggttgacgacggttttggcgccgtagcttttcatcagcccttttgcctcgatcaccacattcattataaatctctccttttaaacaaaacgatcgcaccgcaaagaacgatggcggcgtagacaaagttgatgaaaataaaagaaccgcccagtacggagtaatagtacggcgttatatatttaaaccaggtgatcatgccgttctctgaataaacagcccataaactgaccgctggaaaaacgagagcaaacacgattccgaaaaacattgacacggcgggccttgaaatcacgatcgaaaataaaaggttcaaagagatcgcagctgtaagaaaagccatgctgtctgcataactcagccataaaaactcttttgaggcgatcatcaccaaggcataagaaacgagcatgcagaaaaaccaaaacagccagacgccaagaaactttcccagaatgatcttgatccgcgacgttttcgtcacgagaaatctgaccgtccgggtatggacttcgcggttgatcatgtcatgggaaagccccgcgataaacaggaaaccgagagcaaacacgataacggccgttccgatcgcgcctgcatcgcttcctaaatccaattcccgcacgacatccgcaggcgcctgttcaatcaatcccgcagtcttatagctcacccaaaacataataataatgacaataatcgacttgatgcttttaaaaagactgataaattcgttcagacacactgcccgcatatgagtcactccttcactattctccattatagtgagtgaacattatcgggaaataatcttatccttaacattaccttaaattttaatagactctttctatcaggggtgcttctgtggattataaatgagataaaaaatctcgcaagcggcttggacctgcggcagaaatgtgtatgcagagccggcgatccgataaaaataccattttaatatactatttataatcggcaaaaaaagcagaacgatgcgttcaatctgtatgcgccggaattgtcatatcgcataataaaaaagattagctcagtatgaagctaatctttttgctatcgataattaccggtcctccacgactatatatgccgcctttacggggccgtggacgccgactacaaggtccatttcgatatcggctgaattgctcggtccagtgacatagttgatgcaggacgggatgacgtcgccgtctgcaatcttttgtttgatgattgcgcttgcttgtgtcatccgcgggacgatggtgcttttcgggacgatcgcgatatatgtcgtcggcagcaagctgacggaacgtcctttgtcttttgagctgaagaggacgaccgttccggattcagcaagcgtgatctcgctgaatgtcacgccgatgttagcctgttcggctcgctggatgttctcatctccggccgctgcatcccattcccacactttcgtcccttcattcggccacttgtccgttaacaggcctgacagtccgtactctttaaaacggtcatctttcgggatcatgacaggcccgcctccaaatcgcgctgcttgttcatacaaggcatcatgcaagccgatgacatctgtttcaatcagctccgtgtgaattttccggcagtggtcctttaagacgccgacaagctcatcctgtgtatagccttgatataccctgtgctgcggctggtggatataatcgggaacggtgacgcctgcagaacgcctgttgcggccgagcctttcagcaatccggtttaaaaagccgtctttgttgtggattgttccgtttgtcatttgtcttcccccttctctttccgtctgtcctcaaaccagtcgcggaaccttgacttgttcggcgcggggaagtcgcgtatctgggtccactgttttaacggacccggtcccttcgtaatcttgccgtcttctttaaacggcttcatggctgccggcgcccatttggagcccattttgtaaagggatggcgcagaagttcccaagccgaacgctttcatcgccagcttttcggatatcggcgcgcgcccttctttttcaacgatgcgctgcctgtgctttagaagcagctcatgaagcgggattttcaccggacatgcttcagagcaagccgcacataacgaagatgcgtacggcagttctttataatcgtcatatccgccgagcagcggcgacaatacagccccgatcggacctgaatagatcgaaccgtaagaatgcccgccgacatgacggtaaacggggcagacattgatgcaggccgcacagcggatgcattgaaggacggactgaaactccgttccgagaatgttggaacgcccgttgtcaacgatgacgaggtgaaactcctccgggccgtccgcttcaccgggcagcctcggccctgtcagcgccgtgatatagctcgtcagccgctgtccgaccgcgcttcttgtgagcatgccgacgagaacttcaaactcgtcgaatgatgggacgatccgctccatccccatcacggtaatctgcgtcttcggaatagtcgtgacgagacgtccgtttccctcgtttgtgacaaggctgacagatcccgtatcggcaattgcaaaattgcagcccgtaatgccgatatcagcttcgagaaatttctttctaagcacggcgcgcgcgtgcatgacaagctcttccggcttttcggtgttgcggtagccgatccgctctttgaagacgtcgcggatttgctctttgtttttatgcaaagcaggtgcgacgatatgtgacggcggatcatgatcatcgatttggaggatgtattcgcccaaatcggtttcgaccacttcgcagccgtcgctttcaagtgcctcgttcatgttgatttcttcggtcaccattgattttgatttgacgatttttttgccgtttttctttttcacgacatcgcggatgtagcctgtcgcttcttcagccgtctgcgcaaagaaaacgtgcccgccttttttggcgacattttcggcaagctgttctagatagtaatccagattttccagcacgtgctgcctgatttcttcggccagagaccgccattcttcccagttcccgagctcttttgccgcctcaagacggcgcgctctcaagcgctcctgcgcgcttgaaacggcccccctcataaactcgttgtcgagcccgtctgacacgcgctctttaaatttctgcgttccgatcttcattgccataacgaatgtccccctctatctgtgaaatgaccggattgtctgtttatctgctgttcagcacttctgcgatatgcatgacttcaatcggcttgttctttctcccgatccgcccgccgatattcatcaagcagccgcagtccgccccgattaacacgtcggcggctgtttcttcgacacacgccactttctcatcgaccatctgttcggatatttgcgacatcttcaccgagaaagtgcccccgaatccgcagcagtcgtgtttgcgcggcagcggcgtgaactccagtcccttcacatgccgaagcagcttcatcggcgcgtccgtgactcccaaaagccttgtcatatggcatgacgtatgataagtcgcctttttctcgagtgtcgccccgacgtcctcaatcttcaatacgttgacgataaaatcggtcagctcatacgttttgtcagccagccgctgcgctttttccgcccaggccggttcatcccggaaaaggtgcgggtactctttgaacataaaagcgcacgatcctgaagggctgacgacgtattcagctgattcaaacgtctcaatcatccgtctcatcgcttttttggaatctttgacatagccgctgttgtacgcaggctggccgcagcagatctgcccttcgggaaaatccacttcacatccgagccgctccagcagttcaacagtcgcttttccgacatttgactgaaacatgtcaaccaaacacgtgataaacagtgatactttcatcttgatcccctctccaacccgattaatcaggtcatctgatgacttggttagaaaaccctctttctccatcttacaccttggcaaaattttttgaaaggggtttctttttcgttttcactcaggccgtgcagctgactgctgcttaaatagccggctcgtcggcttgtttcgtttcttcaaaatatgaggccagcacattttccacatttgtcagatgattgtgcatcgcttgctccgctttttggccgtctttttccttcacagcctgatagatggcttcgtgttcctcataaaggcgcttaacagttgtattcttcgagaacagccaaattttgcgcgtctccctcatcgtctcaattaagagagatgacacatgattcatcaagcctttcagcagatcgttctgcgaagcgccggcaagcgcaaggtgaaacgcgaggtcggctttttcgccaagttcgccgttcccgtccgccagcttcatatcctcaagtgcttcctgcatgcgtccgagatcatcctccgtgcgtttttgagccgcactggaaactgccccgatttcaagtattttacggacttcgagcagttcagcgacatctttctttttcatcaaaagtgcagccgaaagggggatggaaatttgctcaggctcaaaccttttcacatacgtcccttccccctgcttcatttcgaccatccccatcgcttttaacgcggacagcgcttcccttacggccgaacggctgacctgaaagctgtcggcgagcgcttggacggagtcaagcttgtcgccgggctcaagctctccgcttttaatcgattcaagaagcgcttccgcgacttcttcatatatttttttcgtcttgatttgtttgtatttcaacttttttcacctcgtaaccagactgggcatgatgcgctattttttattataccgttctttccgtctggaacatatagacttcggctccatgcaaaaaaagattgtaatttatgacattgagaaatataatgctaaatgatcagtcttatcatcatgtcatcagatgactagatgaggcttttttgacgaacaaagggggaattggagatgggatggacgcaagattatactccgctggggaacagtttgctgctctcttcgcttgcagcgcttataccgattttgtattttttctgggctctggcaatcaaaagaatgaaagggcatacagcaggcttgacgactttgctgatcgcactcgtgctggccgttttcgtatacggcatgcccgctcagcaggctgtgatgtcggcttcgcaaggcgcggtttacgggctgctgccgatcggctggattatcgtgacttcagtttttttgtacaagcttacggtgaaaaccggccaatttgaaatcatcaggagttcggtattgtcgatcacagatgaccgccgtttgcaagcacttttgatagcgttttcattcggggcatttttggaaggtgcggcaggcttcggcgcccctgtcgcgatatcggctgcattgcttgtcggcctcggctttaatccgttgtatgcggcgggcatatgcctgatcgccaacacggcgcctgtcgctttcggagcgatcggcatcccgattatcgcggttgaagggccgactgggattcctgcgatggacatttcaaaaatggtcggacgccagctgccgtttttatctgtatttattccgttttatttgatcatcatcatgagcggtttcaaaagggctttggaagtgctgccggccattctcgtgtcgggcgtctcttttgccgttacacagtatgtaagctcaaacttcctggggcctgagctcccggatattttgtcagctatcgtatcgcttatcgctctcgctgtattcttaaaattttggaaaccgaaaacgacattcagattctcacaagaaaaggaaatggccgctgcagcggaggcgcagcagcttgaacatcaaaaggcctcatactcggcggggcagattttcaaggcatggacaccgtttttgctgctcacggcaatggtctccatctggggaattccatctgtcaaacaggccttgacgggccattatgaaggttcaaatccattgctgctgttcataaatgatatcggcggcaggctgacgtttgcacccggcgtgccttttttgcacaatcaaattctcgatggttccggaaaaccgcttgaggctctttacaaacttgatctcgctggatcggcaggtacggcgatcctgattgccgccgtactgacaaagtttgtcacaggcatgccttggaaagaatggggcgccgtatttacagattcgctgaaggaactcggcaagccgatattaacgatcgcttccgtcgtcggttttgcctatgtcaccaattcttcgggcatgagcacaacactgggcatgtcccttgcgatgaccggttcaatgttcgcattcttttctcccgttctcggctggctcggtgtgtttataaccggttcagatacgtcggccaatttgctgttcggaagcctgcaaaaaatgacggcacagtcagtcggaatggagccggtgctgtctgtggcggccaactcttcaggcggcgtcacaggaaaaatgatctctccgcagtcgattgcggtcgcctgcgcagccgtcggactggcaggaaaggaatccgacttgcttcgctttacactgaaacacagtctgtttcttcttttcctcgtttgcatgatcactttcctgcagcatcatctgttttcgtggatgatcccgtaaaaaagccgccggcgctcgtgccggacggcttctttattgatatctctttcttacagacgaaggcagtatattgagctgatcacggtatttggcgacggtccgcctcgatatgacaacgccgtgcttttcgtttaaaaggtcggccagtttctgatctgaaagcggtttcattttatcttcttcatcgatcagccggcgcagatgcgctttgactgtgtgacttgacgcatgcccgtcagcggcgtcctttaccttcgccgaaaaaaaccgtttaagctcgcaaagctcaaaaggcgtctgcacgattttccctttgactgcgcggcttaccgttgattcgtgaacgccgagggcatcagcgatctcttttaatgtgagcggcttcagttcgtctttcccttttaaaaaataatctttttgccgcaccatgatttccgccatcaccctccgcatcgtttcccgtctttgcctgagggcattgtcgagccatttccactgcttgaacttatcagagatataagcggtcgcctcgtcttttgactgacgctctaaaaacggctcgtaaaacgcgttaagctggatgtcgggaaaagaacggctgctgagctcaagcaccaattttccatcctctgctgaaatgattaaatcaggctcgacatagacttcgccatcatctgtgccatatatcaatccgggacgcggcgacagttctgcgacaaggtcttgaatgtcctgaagctctgaaagcgaaagccccgctctctctgacagctctttccatccctttttggcaaacaggtcaaagtatgaggaaatgactttttccgcttttgccgtctccttgggcagacgctttaattggatcaggatgcattcctgtagcgaccgcgccccgatgcctgccggatcaagagtctgcagcttgcccaagacttcttcagcttcttctctggtgacagccagctcggaagcgataaaggcgatgtcttctgtcacatatccgtttggatcaagtgattcgaccaaatagctgaaaacccgcttttcgcggcttgacagctggagatcgagcgcctgccgtttcaaagcgcttttaacatcttcacgggaatgggccgtctcagagcggcttattccttcattttgcaaatgacgattcgttttatggtaaaatgatcggggaatatcggagtcttttcgttcgatcagggggttttccaatgagagttcatcaatccggctgttcagctcggccgacgaatactgaagcatatgaatggcttgggcaagcccttgcgtcaagtgaagttttgccgtttgctgctgctgtacatgcaagttcatcatatctcccctcccactattagtttacacgatcggttccgaaccgtatagacttaaaaaaggagtgttaccattgacagagcttttctccgtgccctatttcatagaaaattttaaaacccatattgaaatgcatccaaatgaggataaaatccacgcgatgaacagctactaccgttcagtcgtttcaacgcttgtgcaagaccagctgacaaaaaacgccgtcgttttaaaacggattcagcatttggatgaagcctacaacaaagtaaagcgtgaagaagcatagcaaaaaaaccgcctgtcatacgtgaacaggcggtttttctgcttctgtctgatggttttgaatcagtttcgtattcgggatgtctttcatccatgtattgtagtaattcgcgttttttccgtaggagttgtcaatcactacgttttcttttccgagcaggcacgataagatgtggccgtgcagccttgaagtaacgactgattcatagcggctgaagaaacggattgatttgtcgacgaggctgtccgaaaagcgtttccaataagaagcgatcggcagcggattgcccgcttttttgttgaggacattgatcgtctgcaggcgtttgattccgcgtttgtcgccttctgataagatgacgttccaatcgtacgtgtccggctcccctgctttctgcaggctgctgttggcttctttgtcggtcctgatcaaccgcagaacggactcggacggcttttcggcaggtgccgcgatcggccagagctggtgagccatatcgggcatcattttgatgtttttcacctcttcgaaacgcttgacggcaaaatcgaatgatgccttttcccgcgtgaataagtgcagatccgggtgagccgccaaaatgccgcgcgtttttattatattttcttcatgctcataataaatcgactgcggcagaatgacgatccggttgtccgggtaatgttcgaccacccgttctctgaactgctggaagtgagggtacaagtcgccgaaattgccgcccccctgacaaacaatgatggcgtcctttggaatgcggcggcccggaatgaaattctccgcattccatctttcgcgcaccttgatgccgtatgcttcaaaaaaagcttccgttcctttcatgatcaatagatccccgacgtttccgtatagcgggtagtccaagtaaacgactgatgaatgccttggaatgacatccaaaatttctgccagcttatgctttaagctgtccatggaatatgtaatcgccatgtttagcacctcatttatatttaatccggtcggcaacgatttgaattacccggtcctgctcttttcgcgtcatacttgatcctgacggcaggcagagcccgcgctgaaataagtcgcagcagacagagccctggtcatcgtgcggataaaaggccgcgcctttaaaaaggggctgtctgtgcaaaggcttccataacgggcgggcctcaatgttttcatttgcgagctgttcgatgatgtccgccggtgttgtttgaatctttgctgtgtctaacgttaatgtcgtgagccagcggtttgacatgccggcctcaggcatgaattctataccttcgataccggaaagcgcctccttatagcgctcgaaaaccgcccgtctggcatgtacccggtcatccagaacggcgagctgtgcgatgccgattccggccagaacattgctcatccggtaattgtagcccgctttttcgtgctgataatgaatggctggctcgcgcgcctgagtggctaaaaagcgcgccttcttcaacgcgtcttcatcatcgctgaccagcattcctccgcccgatgtggtgatgattttgttaccgttgaacgaataaatgccgaagcgtccgaaggtcccgctttttctgcctttataaacagaaccgagcgattcggctgcatcttcaatgacaggcacggcaaatcgatcgcaaatggccataatctcgtccattttcgcgctttggccgtacaagttgacgacgatgacggctttcgggagattcctggcccgctccgcttcgtcaagcgcccgttcaagcgcctcgggcgacatgttccatgtatcccgttcagaatcaatgaaaaccggttcagcctgctcatatatgatcggattggcgctcgctacaaacgtaaaagaagagcagaagaccgtatcgcctttgccgacgccgagcaatttcaaggccaggtggatcgcagctgttcctgagctgactgccgcggctccggacgtccccgcataggcggcaagcttttcttcaaatgtgtcgacaaggggaccgaggggcgcgatccagtttgtccgaaacgcttcggctacatagcgctcctcgtctccgctcatgtgcggcggtgataaataaattcgcttattctgactcatgtttttcaccctttttactgctgttatttgatcattcttgcagggactccgactgcggtgcaattatcaggaatgtcgtgaatcacggctgcccccgctcccgtcacgctccagcgtccgactgtctttccgggaatgaccgccgttcccgcgccgagatgagcgccttccataactgtcacgccgccggttaacaccgttccgggcgaaagatgaacgtaatcgccgatccgattgtcgtgttcgacgatcgcacctgtgttgacaatcgcgtggatgccgacgtctgcatccgcttggatgacgctcgatgccataacaacggcgccgttttgaatccgggccgaaccgctgacaacagcagagggatgaatcaaaaccgcataccggtcaagcggaagaccaatgcgttcatacagctgctgtctgatgctgttttggccgacagccaggacgaacttcgcgtccggatgaagccgcgcaagttcttctgcggcagctgaaggccctcgatacagaccgttctcaacatgaagctccgcataccggtcatcaagaataccggcaagctccgtatccggccgctcttttacaagttcccgaacgactttcccatggccgccggctccgatgatcaccacgttttgcatcaggcattccttctccctgtaaatttttctgctgtcacatgccggtcctggctgacgccttccgacttcaaaacctttacgacagtcaacaaaaggattttgagatcaagcaaaaaagaacgatgatccacataccagacatcgagttcaaatttttcctcccatgtcactttatttctcccgttgatctgcgcccagcccgtgatgcccggcttgacttcgtggcgtctccactgccgcttcgtataaagggggatatactccatcaaaagcgggcgcggcccgacgaggctgaggtctcctttgataacgttgatcagctgcggcaattcgtcaaggctcgtttttctgatcagccgccccgtctttgtcagccgcttttcatcgcttagcagattgcctgctgcatctctttcatcagtcatcgttctgaatttatataatgtaaaaggctcgccattcagccccggacgggtttggcgaaataaaacaggcgagccgattttccatctgatgagacaagccgtcagaatcatggccggactgagcgcgaccagcaaaataactgacaatgcaagatcgaaaaaccgtttcgctagcacgaaaaacgcacccctttcttttatttaaaaaatcccttttgaaacgggaaggatagagaacaccggtatgcttgcagcttcgttgtgacaatgcgccgttccgctttcgtcaacatgacgaaataggcaaacaggccgtaagccaacgtcgcagccagtgccgtgacaaacaaagacagcaggctgacgatcgaaaataagtattgaagagcgtaacagacagccaaagtaaatgaagcgccggcaaccggcccgtatatgcctttataaaagaccctttttctttcacccgtaatctttgatgcataaatcggagtgaagacgacgtttttcagcgttaaagctgccgcaccggccagcgcaattccgtaaaggccgagtcccgccgggccgctcagcacgatggcaagcagcaaattgacaacgccgaaggcaaccgtggtcagcgccggtgttctcagcttgttataggcggtaaagatgtaaaacagcggcgccgggcttaatgaaacaaccaaatagcccgcatgtatcagtaagagccatttcaaatgttcgaatgaagggccgagccaaagcgacagaaacgggccggcaagcccccccagaagcgccgccggcaaagcgagcaggatgccgttaaacctgacggcctgattggcataacggacgagcccttctttgtcgccttttgaataatagagtgtaatcgtaggtgaaaatacggccgctagcgttcccgaaagcgtccgcaacaacagcggaaactgaatgatcgccgcgtacatgccggattcggaaacccccagcatcacattcgccaccattaaatcgatttgcagaaacagcaggatgccgacttggctgacggagctccatcctcccgcctgaagcagttttttgcactttgcaaacgacatatccctcacccggaacgtaaaccatggaatcaatctcttaaagaaaaagatcgacaggatgcacgccgaagcggttgcgatgagagcggcgagctgaatgtgccagatcttcggtgcaaaccacgcgaaaatcaacaatacgctcagaacgcgaatcagcatttggatggcttggatcgtgctcgtaatatagattttattggcgaaaaacggaccggcggcaaaccccgacatcacaaaggtcaataaaaacagcaggctgccgatcaaaagcgcgacctgcacatcccccaaaagagaccggcgggaacgcgaatgatctgatcgataaaaaacaccgtgccgccgagcggaaaaaacaagatgactgaaagcaccagtgatgaaacgatataggtattcatatagcctctcgcttcatcaagcgctcccctgtgggcggaaacagaaaaaaaccggacaacgaccgcgctcagggcgaccgtaattatcgaaaagtaattgatcatattctgtgtaagatggacaaatccaaacgcctcaacaccgagggtcttgatgacgtaaggcgtcagccacatcgaaaacagcaccgataataaaaaagacgccatattggcgccgagattcaaaacaaatgtcttattcaaaaggctcatcccttactgggcagatttcgtttaaaaaacaattcgagcagaatcggaatattcagcttgcatagcaataaaacgagccgctggccgattaacaggttgcggttgcggagagacgtggctttgacgcacgactgcaccatccggtaagacaaaatgtctttaatgtgccgcctcacctgctttgaaggcttcggttccgcacaggcattggctaaaagcatcggaatttgatgtttgcatgtgtacgtttccaaatcgtccgcacattcatccaaaagctgaaacgtctcatagaatctccttttcgcccggtactgccttttcaggctttcatccatgtacggtttaaacggcgcctctgtcaggctgtccgggttgcacctgtacatgtagtagccttcatcgatcgctctcactcgtttcgctgcataaaaggcgtacaaattaaacggcgaatcctctgcaaaacgaatgtcttcaaaaaagtacagctggtttttcttcagcaggtcgcgcctgtacaaattccgccacacataccagatgaagcgggtttcgtgcgcctttttgagctcgcgtttaatatcccagctcaacaagaggcgatcggtcggcagcggcggcgggaagtaggcgtcttccgtatcggaatgtttatgatacccgcacatgacgatatcgaggtcgtcttttttggcagcggcgtacatgttttcaaacatggcaggcaatacaaaatcatcaccgtcgacaaacccgacataatctcctgtcgcggcttgaagaccggcatttctcgccgagctcagcccgccgttttttttatgaatcactttcactctggcatccaggctgcagtacgttctggctatctccccggatctgtcgggagagccgtcatcaacaaggatgatttcaatatttttcagcgtctgcctgcgcagcgaatcgacgcattcttctatataatcttcgacattgtacatcggaacaatgatactgataaatggcttcattggacatcacccataattttccgtcttaaatctgcgaaataatgatcccttgccggggtctcacgatgcgagtcaccggtcttgaccagctcttcgattgcgccgagaacctctgccgcatcgggattttccacaagcttcatcgaaggaacgtctttcagccagcgaaagccttcaagcaccttatgatcaaaagagcggatcacgacgcacggcgttcctgttatcgcacaaaaaatcatgccgtgcagcctgtctgtcacgacgacctccgcgcctctcagctgatcccaaagccggttcagctccttctcgcgggacacgcggctgaccctcctgccgatcgtcgttgtaaaagtttttgcaccgccatactcgtcgccgacagccttcagcagctttttacgctcttccggcctgagaaagctttctttatcctcccttaaacaaaccaacacaccttctctttcagactgctgttctttctttaaataaagcaccatatcaggctgctttacaatcgtttggtttgagaagtgctgtttcataaattgataggttgtatcatcgcgcgccatcatgaacagccggcgatgggagttgtagatttttttcgcccttttcagctcttttttgccgcggagcgtctcggaaaagtgcgcagttgccgggagctggacgattttataatgcttgaatgttttgataatgaagcgcctcgtccattcctcattgcggtacaaatcccccatgtttcctccgccgatgatgaataccatatcctcggggtggcggatgcgcatgagcgcttttgcatgtttgtaaatatcgttaatgccgatttcaattaactcaaaatcgggaaactcgttttctatgaatgtgcggcttgccagggcaatcgcatgatctcccaaattatcatgggacggaattaaagtcagaatgatttttttcttgcctttatattgttcaaagcgccttaaacccggcgttcccatcacatattcagaaggatatttcaccttgagcaaaagccattctgcaagattgatcttcagttcctgaaaggtcatttcctcaccgcctatttcttcattctgtgctcgatcattttctggtaaatggccgcaaatccatacactgccggcatcaaccgcaagcgaatcagcataagcaaaagcttcttcttggaatcgaatgccgacatgtccactgcggagattttccccctgaattccggacaggcgcatatgctgcggatatttttatatttttctattgaagggtttttgtttcggctcttgcattcatttaaaatactgatgcagccgtggttgacgataaagacgtgcagcgcctcctttaaagccgggagctctccgtgctttgtcaggcagtccaggtttgcttcataaagagcgagaccgtcttcaaacagccctgcctgatacttttggacgatggacgccaggtggaccctgtaatgataaagcggcttagtcacgaacgccgcggtattcgcatatagaaggcatctgaagctgaaatattgatcttcgatgttttccagctcgtcgcggagcgggaaaacgagcttatgccgctcaatcagactccgcctgtagagcttgttccaggaaaagccgcttactttaccctttaacaaatccttcataaatgcctctttcggctttccttcatagttcttcccgatgtccgggcagaccgttttttcggtatcctgaatttcaacggcataatcacagatgacaagatcggcatcctcatccttcgctttttcatacatagactggcaatagtccggctcaatccagtcgtcggagtcgatgaatgccaagtactcgcctgacgccgcttcgatgcctttattgcggacagcgccgaggccctgattgtcctgctgaatcgttttaatgcgcccgtcctttcgggcgtaatgatcaatgatcttctggcttccgtctgttgaaccgtcattgacgataatgatttcaatatttttcaaggtctggctgatcagcgactgcaaacaattcggcaaaaaagcttctgtattataaacagcgaccagtagactaactgctggattttccaatgtgatgactcctttgacgaaatttttacaagacctaaaatgtccggtctttccgctattcaacgttcaaaaatcgttctgtacggcaataccgacgagtcgaacggcatgagcataaagctgtataagaagtaacagatcaaaatcaaaacataaagaagcgcgtttgatttcggttcaaaaatccgtacaaaataaggaacgagaatcagctgatagagcccgaaataaatgttgaacctcgcaaaaatgacatcctttgtcgccaaaattccgaacaggaaaccgatcagacaaaggtttacgatataatcgacttcgggccagcgctttctgagctgctccctgaagcaaaaggcaagtgcgagcgggagaagaagaacgatgattttaataacgttcatgccgtttgtattcttcatcagccattcttcataatgtccgtattgactgttttcaagcacgactaggaatacggacagaaatttttgatacagaaaagtccccgccaaaaagacgagcatcaggcaccagaggacaggcgaccacgcttttcttctgacgatgaaataaaccggaatcatgatcaatgccgaagaatgaaaaagcgaacagatcagtacaacgatcatatagcgcaccagcttcccatcgatcagataccgcaccgcccaaaacagaatggccgccgccatgtattggcgaatgccgttaaacgaagcataatagtgaaacatgccgataaacagaaacatgctcaattcaaacggccttccatacacataaagcgtcttgacaatatagatataggtaatcgcggcaacgacggcaaacatgagcgccggatcggctgaaatctgatttaaaatccataagagtgcggtaaatcccgggtccgtcgacgacttgcctgttccgaaaccgaatatctcccaaatgctgttgtattttccggctaattcgtaaagcagcatatatgtgtggtaatccgttccgaccttgtatcttaagccggcaacgataatcaaagacgcgagcggaacgacggtgaggatcgcattcggacggtagcccgtcggcagcctgtgatcttccctgccgtacattttcgcaaaccatgaccagacgaaaacaatccccatattcaacatgtagacagccatacactcactgtccttctgctgcggagattgaatagatgtccatcagtctcgccaaatttgcttttgcatcatagcctctctcagcaaggcttctctctatttccggccatgcaggctttttcggctgagcagcacggctgatatcctcagcccaccgttcaaaaccggcatttaagctgagacgttgcagcaggccgagtcccaaatcggtttcttccgtaatgttgtctgatacaatgcaggggagccctgacgcttgcgcttcgaccagtacgaggggtagcccttcaaacaaagacggcatgacaaatacatcaaatgcctgcatgagagccgggatatcttcgacgacgccgagaaacagaatgtcgtcttttacaccgagagcagcggctttttcttccatctgtctgcgcagcggaccgtcacctgcgaacaccgcttgaaaaggtatgcccgatttcttgcaataagcggcaagcccgagcagaaacgcgtggtttttctgttcaaaaaaacggccgacatgcccgatcaccagtgcgtcttctttgataccgaagctctttttcgcattcgtttttgaaacgccgttcgcttctttgaaccggtcaagttcaatcccgttttgcaaaagatggaccgcgttttcacccatcttctttgcgccgaataaaaaacgcccggcatctttgccgcaagcgcacagagccgtagcactggagaaaatcaagcggcggaatgcaagaagctgccatgtatcccaaaaccgggggttaggcttccaggccgtgttgtgggaatggcagaccctgaccggaacgccggcgagcctggccgccaatgcggcaaagcccgtctgaaaatccgtatgagcgtgtacggcggcataaggccctttctcaaccaaaatccttctgatgtttttgatgtaggcgacaggacccgaccgaccgatgctcggtacataaaacacccggccgccgcgcgtgatgatctccgggtcgtaatcgcacgtttcttcccggtgggaaataaaatcaaattgaatatgccgcctgtctgtgtggcggtatatattcataatcatcgtctccgcgccgccgcggttcattccgcttacgatgtgaagcacccgttttggtctcacgcttccgtcattcatgttttacgacccctccgccttcattcatcaatcttcttttatgatatctgttcatgataaaaggaggcataagccccctgatgatgggtttcattgtataaatatagtccgatagcggcagcttcagccgtctgcaggcggcaaagacgataaacgcattatcaatcgagtagctgagctttctccttttaaacgccgattcgtcttcccttactttgtataaggcttcctgaaggttgtagcccgtgaagcccgcctcaaaaaaacgaagccacaaatcgacatcttccatccttcttgttctccggccgacccgatagccgtccagcgcctcgtagacgtcggctctcatcatgatcgtcgcatggcaaaacggcgtccctttcgccatgattctcggttctggagaggaaggaagcattctgacgcctctaatcccgttttcgtcgaaggccatcatgccgcttccgacgacatgataatgagattgcgattccaaaaacgcgacctgcttttcaaaccgcctcggcaaagagatgtcatctccgtcctggcgcgcgatatatttcccgccggcgtattggagacagtggtttaacgaggcagccagccgctgattcttctcgtttttgatcagcttaatcttatctgcgtaatgatcggcataccgcctggcaacagcatatgtcccgtctgtcgaagcatcgtcgcatataatcagttcccaatttttataggtttgatttaaaattgactcgatgctctctgcgatcgtgttctcacaattgtagactcccataatgacagaaactttcggcttttgaccccctatcatcctttcagcctcctttcaactgtttcgttatccataaaggaagagtaaatgcccgccatttctttgacggtgcgctgctgggaaaaagcggcggctgttcgtctccccgcgtctcccatcttttttcgcaaagaaggcagacggtacagctgcaatatccggtcgctgaacgttccggcgtctccctgcggaaccaaaaatccgttcacgccctcttgaatgacttcccggtgtccgcggttgtccgctgcaacggcgggctttcctgacgccattccttcaaggaggttcatgccgagcccttccctgatgcttgaggcgacagacacgtctgcaagctgaatccattcgtggatgtttttttgaaaaccggcaaacatgacgagcgaagaaacgcctttttgttcagcgtgatttcggtatttttgctccatctgcccttttcctgcaaacacgacctttaagttcggggctctgtcttttaaagcagccgccgtttcgatgagcaaggcctggtttttattcgcgttcagctccgcgggatatatgaggataaagtcgtcttctttgaaaccgtatgttttcctgagcagcattttctctgtttcactgacaggatgaaaccgctccgtatcgacgccgatcccgtggattttttccgtgcgcagcgcttttcgcaagccttttgcaaggacgaaatcttcttcattgatcgtaatcaggcaatcggtcaaagcggacagccctttttcaatcggataatacagcagccaattttttaaaggagcaccttggcaaaagtggaaaccgtgagcggtatagatcactttcgtcccctcttttctctgtttccgggccgcaagccttgccagcacgcctcccatcggcgtgtggcaatgaatgatgctgtaccggtgttcgtcaatgattcgcgccagctcccgataggcagcgatattgcttgcattcaaaggagaacgcctgatatcgatatcaaattttttatctgtatagggcagtgtcatatctccttttgcggcgatatgaacattccacccctgctctttaaaccattttaaatacgggaggtggaaggccttgaaatggtaatccacagtagcgcaaaacaaaaccgttcttgtcatgttcttccccctagtgcgctgtcaccagctttttctcgtgctggccgatcgctttgaacaagcgttctctcagctcgcggtctgacaaatacataaattcatccataaatgacttcagcaccgtccattcgacgtcgaccgccttgccgatatgaatcttcggaaaaacctgctctgccagcacttcattttgattcagcagctcttcgtacattttttctcccggccggatgcctgtaaattcgattttgatctgttctgtcgtatagccggaaagctggataagatttttggcgaggtcgacgattttgaccggttcgcccatatcgagcacgaatatctgtcttcctttggcaagcgcccccgcttgaataacgagccttgaagcttccggaatcgtcatgaagtacctcgtcatgtcctggtgtgtgacagtgaccgggccgcctttagcgatttgttttttgaaaatcggaatgacgcttcccctgctgccgagaacatttccgaagcggacggcgacaaatttggttttgctcgttttgccgagattcatgatcagcatttccgcgaaccgcttcgttgcccccatgatattggcagggttgaccgctttgtctgacgatatcaggacaaatgtctccacttcggtttcgtcggcggcctcagcgacgtttttcgtgccgaggatattgtttttgacagcttctttcgggcatttttccatcagcggtacatgcttgtgggcagctgcatgataaatgacattcggtttgtagcgttccatcagcaaaaacattttttctctgtcctgtatgtccgcgatttcgggataataggcgacatgctttccgaatttctccttcagttcaagcaggatcgaatggatgctgttttctccgtgcccgactaaaatgatcgatttcggtttaaatttgctgatttgccggcagatttccgagccgattgaacctccggccccagtcacaagtacgacgcggtccttgaccgtattggagatttcgctcgtatcgagctggacaggctcccttccaagcaaatcttctgctttgacatcgcgaagctggccgacaggatgtctgccaagcaaaatttcgtctattttcggcatgatttgcgttttgacacctgtttgcgcacacgccttgtacatttcctgcatctgagtgacgctcaaagatggaatggcgatgatgatccggtcgatattccattgccggaccgcctgcataatctgctctttcccgcctaagacgggcagacccatgatttcaagccggtatttcgttttgtcatcgtcgataaaggcgacgggcttaatgttcaattccggcttctgcacaagctgttttgcaatcaaactgccggcagagcccgctccgatgataagcgcccttagagatcctttgctttctttgttcacctgttccctgatgatgcgccacatcatccgcgatccgccgatcaaaatgagctggaacagccagcttaaacataaaagacgaaccggaacgttttgaaagaaaaacagctcgagggccgccgtcacaagatgggacaatgtaatcgatttaagcagcacatacaattcaccgatgcttgcatactcccatacttttttataaaggtggaagcaatgggcgaataaatgctgagcgccaagcagtatcagtgaagtcatcagcagcatttccgaagggtataaatcatatgatggcaaaatcagctgatatccgataaagatggacagcaaaaccaagtacgaatcgagtgcggtaataatggaaagccttctccgatatgtcaatttcctacctcctaatgtatctttctagctgataggatctttcagggcaaaatcccatgagctaaaaagatacgggcgattttcaaatttaaaccgagcacgtaaattaaataaagatgggcatttaacccgtcctcacgccccgccatcgacgacttgcgtctaaggcagacaggtagtctgcccacggtagagccgagtgcctccatcggtaaaggcaaggagacatcacctaaagcggctgcagccgcttcataagattacatggttgcgtaattatattggcgcgctttcttcactttccgcccgttcagcacggcgccgagcagttcgcttttggaagaattcagcgcgtcccgagacttgatcgcgttatcaagctttgtttttccgctgaggatgacaagaatgcttccatccacctgattcgccaatatttgcgcgtctgcgaccggcaaaagcggcggcgaatcaaggatgactaaatcgtattggtcgtacgcttccgcaagcaggtcctccatcgcctgcgacgacaaaagctcggacggattcggaggaatcggaccgcttgtcagcacatggagattttccgcctggctttgctggacgacattttccagcgtcgattttttcattaatacatttgtgacacctgaatggttatcgagctcaaaaattttatggatcgtcggctttcttaaatctgcgtcgatcaaaaggacctttttttcctgttgcgaaaatacgatcgccaagtttgaagccgagaatgatttgccttctcccggcaggcccgatgtaatgagcaatgacttgaacggcttctcaaatgatgaaaactcaatgttcgtcctgatcgtccgatactgttcgacgatcggcgtgttcggctgatgcaatgcgacaagcgccgattgatatttgcgagagcgtttttttctaatacccaagcggctcactccttcctgcttttacgcggatattcatatcggggtccccgcgaaacagactttttttatgcttcatttgctcaatacttcccaaataaatgaatcccgcttccttttcgacttgagacggtcttgcaaccgtatcatcgataaagtccaaaaagaacgccaaagcgattccggtcattaatgcggcgccgaatgccagcaaaatattcattttgtaattcggtctgacaggtgtcggcgaatcgactatttcggcttttgacaggacggttacccgatcggtgttcataatttgcttaatctcttttttgagcaccgcagttaaagtgttcgctatatcggccgcccgtttctgattttcatcttggaccgaaatatttataatctcagattcgctttcactgctcgttgcaattttttcacccaaccggccggcagagtaaggtaaatcaagctctctcttgacttgctccaaaatcaccgggtttttcaaaagcgcttggaatgtccgtgtgtattgaagattgatttgaatatcgctgtatgtggcgctcccctttttctcccctacttgatgcaccaagatctgcgtcgatgcctgatagacaggtgtcagcacatagaactgaatgattccggtcgtcaatgttacacctattgtcaaaacgagaataagaaccgttctttttcgcaagattgcaatcagttctctaaaatcaatattttctttcatgcttgactgcctcctcaggaatgccgtttgttaatgattggattataaaagaaaaaatttgaattgaaaaatgctgaatttagctatatagttctttttagagaacaaattcgttcgttttcttttattttctgtcgatatcttaaatttttgaattttataaagaacaaattatttcttataatgaacaagaaagcgttttatatgaatggcaaggggaaggggaggattcagtatgatcggaagagtcatccgaatgtacagaaagagaaaaggctactccattaaccagcttgctgatatagcaggcgtatcaaaatcatatttaagcaaaattgaacgcggcgttcacagaaatccgtcagtcgaattcctgaaaaaaatctcccgggcgctgaaagtcgaattaaaggaattgtttgataccgaagtgatcctttatcgccggactgagcaggaagatgagtggagaacccatcttgtacaggccgtgcaggccgggatgaaccaggaagaactgtttcaattcacacatcgcctcaagcagaaaaagaaagaacgggcgctttatcgaaacagagagctgacccgggcgaatatcgacgaatggagagcccttatgctggaggccaaagaaatgggactgaccgtcaaagaagtagaagcgtttttgatgaggacaaaaaatcattaatttatcctgcattcatattttttttagaagaaaacgggtgcttttgacttgaaccattcatccggatataaatccacatttccatttaaacttgccgaaaattcggaataatcgcattaatagatatcgcccgatcatgatgatccatgtctatagctccgttttcacctgtttgccttattttttcatggcagtctttaagagactttttgcttatgtttatatataaatgaagaaactcggattttgacctttcgcatcatcctccaatgcatgcaaagtctgtgtcttgcggcttatatcaagacctttgtcacggcccgattccttgaatggggacggagcgtttttgttgaatccgcgctggctgttcgttaagatgaataaaatggaagaaggagatgaaatcatgaaagtattagtgctcgcatttcatccgaatatggagcagtcagttgtgaacagagcatttgcagacacattgaaagacgcaccgggcattacattgcgcgacctttatcaggaatatcctgacgaggccattgatgtggaaaaagaacaaaaactttgtgaagaacacgatcggatcgtcttccagtttccgctttattggtacagctcgccgcctctcttaaaaaaatggctggaccacgttcttctctacggctgggcatacggaacaaacggcacagcgcttcgcggcaaagaattcatggtcgctgtatcggcgggcgctcccgaagaagcctatcaggccggcgggtcaaatcattatgcgatcagcgaactgttacgcccttttcaggcgacaagcaacttcatcggtactacataccttccgccttacgtcttctatcaagcgggcacggccggaaaaagcgagcttgctgaaggtgcgacacaatacagggagcatgtgctgaagtcattttaaatgagaaaagcccggcttatgagccgggcttgttccttatacttgaatctgtttcacttttcccaataggaatagataatttaaaatggcaatgatgatcaaagcagccgaaaaaaggagcgccggcacgaaagaacccgttgcgccaacgatgaagccggtaatgatgggtccgaccactccgcccatattagagactgtattttgaataccggcaaccatcgacgtcatatttttcggagccacatcccccggaagcgcccagacttgggacgcggcgacagtcgttcccgatttcgctacacaaagaaggatgacagccaggatagcggaatctgcaaaagcggcaaaaccgatgcacgaagccatgacaagcccgataattaaaaacagtttccggacggctgtcagcgacagttttccctttgcatatatccggtcggacatccatccggctccgacttcgacgaccattgcagtcaaaagcgggagagacgccataatccccatctcgattaaatccatgcccctttctttaacaaggtatgtcggcagccatgtgataaagaagtaagaattataattgatcatgaaaaatccaatgcacatcgcccatatgttgcgatatttgaatagctgataccacttcagcggctggccgccgcccgtttcttccatgtgagcctgcccttcccgaatatgggccagttccgcctcattgacgcgcttatgatctgcgggattctccttaaagaaaatcatccagacaattccccacgcgacaccgacaagtccgatcaaaagaaacgtcagtttccagtcaaagaccgctatcatccaggcgatcaaaggcattgcaacagctccgccaaactttgacccgctgtcaaaaattccggctactgtcgccctttcttttttcggaaaccatttggcggcaatccccgcattgctcggatatgcagcagcctctccgactcccagtgcgacccgcagcccgagcagggatttgaagcctgtcgcaagacccgtcagcgccgtagcaacagaccaccaaacaaccgcaaaaccgagcgtttttttctgaccgtacttgtcggccgcccagcctgaaggcagctgcagcaaagcgtacgaccagaagaaaccggacatgatgattcccatttggccgggtgtcaagttgaactcctcggtaatatagggagcggcagccgaaagaactgtccggtcaatataattgatggcaatcgcagcccacatcataaacgcgacaacccagcgtacatttgactttttttgaatcgggtgattcaacatgttatccacctcatcccatttgtagaaaacgctttcaaatcatgatgcagggcatgaatgaaaacacattcacaacccgttgacgacaaactccggtttttgtttgtcgatcagtacactagcgatgtttttgacgcatatcatgccaaggttctgtacggcatctcgggtataccccgcgatatgcggcacggcgataaaacggtccagctcaaagagagggtgctgcttcagcggttcggtttgatacacgtcaagcgcagctccagcgatgcccccgctcgccaaggcatcatataacgcacactcggacacgatgcctccccttgaagcattgatcagataagccgtttctttcatagcggctaattctttttcaccgatcatgttttccgtttcggctgtgagcggcatatgaagagtgataaagtcgcattctttcaagagctgatcaagctctgtaaaatggatgtgatgatcggctgcgaatgcacgatcaggaaacacatcataggctaaaacagtcatattgaagccttgcgcccgtttggcgacttcttttccgatcatgccaagtccgacgatgccgagtgttttgccgtaaacgtcagatccaaaaatcctcggccattttcccagctttgtctccctgtcggctgcaggaatctgtcttgcagccgacagcatgagaccgaatacaaaatcggcgactgcatgcttgttggcgttgggggcattcgtcacccagacgttgcgctctttcgcagcgtgcagatcgatattgtcgacaccgacgccatgtttgcagacaatttttaaagaagggagacgatccaggacatacggcgtaatctggttaaacgccacgatcgcggcatccgctccttctgctgcttcaataaactgctcctcggttatatctgcaggaaggcgttccagcgacatgccctttttttccaaaaacaagacgggatcgtctgagtatttcgcaaatgacggtgatgtacatacgactttcataagatgcaccaaccttctttcatttttctacgatttgggcgccagctcagcggctgaccgcaaagcagcgagcatgcttctttcatcggctttgttctgccccgcaatgtcaaatgcggttccgtggtcgacagaggtgcgtatgatcccgccgtttaatccgactgtaatgttgacgccctcttccaacccgaggactttgaccggtatatgcccctggtcgtggtagcaggctacgacaaggtcaacatctcctctgacagctttgtaaaacagcgtgtctgcggggtatgggccgccggcatcgattccctcagctgccgcctgctcaatccccggaagcaattgccgttcttcctcgccgcttccaaacaggccgttttcccctgcatgggggttgattccgcaaacagcaattttcggctgttcgaatccggctcttgtcaatgtatcatgtgcgagacggatgactttataggtccgctccggcgtaatcgactgaatcgcctcgatcagcccttgatgcgttgtcaggtgaatcaccttcagctttggcgaagccagcatcatgctgtagtctgttgtattcgttaaatgagcgagaatttccgtatgccccgggtatcggtgtccgcctttatgcagcgcctccttatttaacggcgctgtgcaaatcgcttgaatacagccttttttagcgagctcaaccgcttttttcacgaaatggaaagcggcgtttccagcttcagccgacacctttccgacaggcaggttttcaggcagcagttcaatatcgagacaatcgatctttccatgtacaaaaccgccctcgtccggatgcccgaccttgttaataacaacctctgatccgatttggaaggcggcttttttcagcattttcatatcgccgatgacgagcggcctgcacatatcatacacttcgcgggacgtgagggcttttacgataatttccggaccgacgcctgccgcgtcgcccattgtaatgccgataaccggtttcttcattgtttatcctccttgtagcttgattgccgcacttgccatcaccgaacgcgagccaaaatttccggcctttgtcacaatgtacaattcttcaccggctgctcccagcggaatgccgggctctacttcgtccagcaatcgtatctcatgaatccgaagctgatgcagcacttgatatgccgtgtcacctccggttaagaacagccgtttcacatgaaaagcttgaatcagctcgcccgcaaattcgccaagtgcaccggacaccgcattgctcgtttgaactggggtgagtccgcggctttcaccaatcttctgtgtctctgccgcattgtctgaggtgcagaggacgatgtgtttcgaacggcgctggacgtccgccgccctttccttcagccgttcgaactcgtttcttttctcagctccgccgcacagcacgcgctctgatctcatttcaattttttcagccgcacgtccggcgaatagttcgtgaagctgttccctccccgtccgactcatgcttccgacgacaaacatgatcggctggtcggaagacggaacggtttgaccgagctccctttctttcagattgaacgctttgggcagacagctcatcaagcctgccgaaccggccaaaatgatagaatacggcaaactctccagaataagcgccagcccctgcagatcggattcgtgaaccgaatcggccgtcacatatgaaatcccctccgcccgaaagcgttccagcttgttgcggacatgcccgtgtccgcggcggatgtcttcatatgataaatgcccgctcttatttcgagtctgcttttctattaatctttgaatattcgactcggctacaggcgttttcggatcgtttgccgcttcggtttcttcaagctttacgccgttcacataatggatgccgccgataacctggcgtccgttttgagggtagccgggagcgatcagcacaaagtccggctgaaacacttcgtacatcgcttgaagctcggctccgatatttcctctcatcgtgctgtcgatttttttgtagacgatatcaaacgattgccgggagatgtgttcactgatgtttttcacagtcgccttcgcctctgcggctggcagcgatctgctgtccgtattgaaaataacgacgccttccgtttcccgtctggtgaattcggcgtcgagtttgacggaaacatccatcccgtaatgaacaagctgaccgccgcagtcgttcgctcccgtcaaatcatccgcgatgattgcaattttcaaatgtcttcatcctttagttgattagttttcgatagatgtcttttatattttccagactgagcggtttcggattgttatgaagcaggcgcgtcacttttgaagctgagtcggctaaatcgtccacgtcgcttgcggttacgccgaacgcttttaaatcctgaggaatattcagccgctccgtccactctcttattttctgcacaacggcctcagccgcttgttcggcggtcaaatcagatgcaacgattcccattgtttctgccgcaagagacagccgttctgtaatggcatccatattaaactccatcacatgcggaaggagcatcgaattggcgacaccgtgggaaattcggtatttccccccaagcggataggcgagggcgtgaacggcagcagtaccggcagccgtcagcgccattccgccatacgtcgaaccgagcagcatgttttctctcgcttgtatcgatgaaccgttttcatatgcttccacaatacttgccgaaatcaatctgatggattctaaagcgaacatatcgctgatcgggtttgctttcgtcgaaatgaacgattcaagcgaatgagtgaatgcatccattccggtagccgccgtaatcggttttggcaatccaagggtgatgaccgggtcaagaatgacaagtttcggcaaaagaagcggactgacgatgccgactttcaattcctcttctggaagcgtaacgatcgcgttcggcgtcacctctgcgcccgtccccgaagtactcggaatcagcacggtcgggattcccggcttttcgaccaaatctgtcccgagcagctcctcgaccttttttgaattcgtttgcagcacggacaatattttcgttccgtccaaaacgctgcctccgccgattccgatgagaatgtcgtatcgtttctcacggatgcctctaaatacgtcttcaatattttgtacggtcggttccggcaatatggctgtgcaaacatctgactgaatgccgatctctgtaagctgagcctgtacctctccgatcgcgccgagcttgacgatcgacggctgggtaataatcagcgccctgtccgccttcggtacaatcgttcgcacatgatctttcagccggcggatggaatgttcacctgcaacgatatgaccggctgtccgaaattgataattcgctggcattcttgaaacctccctattttgattgataggaagcaaccattttttcgacctccaaaagcgccggaccggtcagttctttgacgggcgctttcggcgggcctacagggatcgaataaagctcaaccgcttttttcagtgccgccgggatcgtacctaaacgaaacgtatcgcgaagcggctgaagctccatctgggcagcctccgccttttcagtctcaccctctgcccaatggtggtaaatagacgttacgatatccggaagcatatttgctgttgctgcgactgctcccgctcctcccgcttgaagcgttttcaatatgagcgaatcggtgcctgcaaaaacggaaaagtcgtcatttttcgtctgctcgatatactgttgtatgttttcaaagtttccgctgctgtccttaattccaacgatattgtccacttttgcaagctctgccactgtttctggttctaaatggaaacctgtttttgaagggatattgtacaaaaggatcggaagtgaaacggatgccgcgattgttttataatgcaccgccgcttcttcctgtgtcggtggaataaagaatggcgtgatgaccgacagcgcatctgctccaagcctctctatttccttagaaagccagatcgcttcttctgtgctgtttcctccgctccctaccatgacgggaacgcgttcggccgtttcttgaatgatgatttctgcaactttcagcttgtcttcgatgttgaacatatgaaattccccgttggtacccaacgcaaaaagcccgtgtacatgagcatcgatcaaatggtttgtcagctgtttcaatgccgattcatcaatgctttgatcttttgtgagcggtgtcagcatagcaggataaatcccctttggtacgaatcccattattgcctccccttcctataaagcgttttcaaaaatgattatatacataaatgtttcaataatcaacggtatttatctaaatatttttatttgttgttgcatattaaaacaaaaaataagacaccggtttagccggtgtcttatcaatctgacgatttcaattttctccaaagcgtcgttctgttgatgccgagcctttccgctgttcttgtttgattgttcccttcttcggcatagatcttttgaatgatccttttttcgatctcttcaagcgttccggataaatcgatgtcttctctttcttcctcgttcaagcggctcaggacccgttcggcgtcagtcttctcgatatatacgccctgcgcttcaaggacacagttttggaccgtttttctcaattggctgaggttgcccggccatttcgcttcttcaagcagaacaccagcttcgtttcgaaagccgacgatttgtttgccgaatgcctcattgctttccgcaataaacagataagccagatgcaaaatatcctcttttctttcggaaagagggggaacgtccagttccaaatgacaaagcgcatcatataaatcgcttgaaaattcctcggcgcgcctgcgggaagaagaaacgatcagcctcggcccatcatacggttcgctgatccgcctgagtaaaagccgttgcgaggacggcggcatgcgatcgacttgtttgatgtatagcgttcctctccctgaaaagaattcttcgctttcacaagcctgttcccattctgcttcagacagcaaaccggcatcgatttttcgaaacggctcatgcttgtcctcccccttcatatggatcagcccggccaagctctctttccctgagccgggcgctccattgatccatacgggttcccgccttgccgagaacaactctgcttttttcagcaccttctgcatcgtttcgttccttgatgtttccatataactcatccgcaaaggagaaagaatcgttgccccgggcaaagaagaaacgcgaacatcttttgcattttccgcggtaaatacggtcaatgcctcgtctgatacgaaaaacctgcgccccgtgatattccatgtccgcccatgctttcggagtctaaaatggatgactcccttcttttccgcttccccgatcagctcttccagattatccagcaagccgatatgttcggcaaatacgccgttttgaaaaaccggccgcaatgtcttgttgtatactgcataaccggtctcggccttttgtaaaatgtgatacggcacagcgtacttctgcttgatgctctctaaaaaggaatacagttttttagcgtatgcaaaagctttggcaatgctttcttttccggatgtcaaaagcagtccgtttaaaccgagctgctctgctttctcaattgtgatcacatcgccgataatgatctgatagccctgttctttgagctgaagaagcaccggttcaacatcgcgttcgtctgatacggtgcaggcgtcgatccgaatatccaaaatttcgcacaccgccgatgcgccgtcggcaatcatcggaaatccgacaattgccgccttgccgggatagcccttggcaagcgtaagcacacgcagcatatcgtatcccgacacttcgatatccacaaccggaatggaaacttcttgctggatcagctcagcggttccacctctgctgataatcaaatcagtcccgtttgcttccgcttgtttcgccagctccacgcccttctctaaatctccagaagccgcctcgaattcaaaattctcgccgcctgccacttgaaccatcagctctttcagtccttcatatggagcaattgccatcactttcatattcgatcaccttttgttgcaaatttaaacacattatcactataccaaaagtcagaaatatttggaaccgcaaaacgaaggcaaaataaaaaggctccattacggaagccatttccccccccatgcggccatctctttaaaaatgctgtggaactctttacctttttctgttaatttatattctacagtaacaggaaccgttgggaacaccttccgggaaatcatgccgctttcttcaagatgtcttaatgtgtcagttaatcctttcgtgttgacgtttcccaagttccttctgagctcgttgaatcgccgcttgccctgaatgagttcggcgagaactaaaaatgaccatttaccagagaaaattttcaatacatcctgaattaaagaagagcattctttatgatcgacagctgaattcatagcaattcctccattgcctcatagccaattttgacttgatcctaccatatggacatcagagcattcaagaaaacgatcttacggtttatttttataaagcatgtataaaaaaattgcgttcttgtggagccttccggcggttgctatggttatatcaaaaggaggaaaaacatgaaaaaacaatacgagtctttattcaccccgtttacttttaaaaacggaatccaattgaaaaataggatcatcatgccgccaatggggcattcatcctcattgccgggaggattcatttctgacgacgaactggtctattatgccgcgcgggcgacagaagtcgggatggtcatcacatctgcgacaaccgtacagcccggaaccggatttccaggcatccccggagctgagaacgatgatcaaatccctggactaacccggcttgcagccactttaaagaaacacggagcaaaagcaatcctccagctcttccatcctggagccaaaggtatagagcggacggtcagcgccagcgccgtcgctccgaatcaaccgaatgcaccggtgccgagggcgctgtctgagcaagaaattcaagaccttatccattctttcggccagacggcgcgaagagcgatagaagccgggtttgacggagtcgaaattcacggcgcaaacgggtttctcatccatcagttcttctctccttattacaaccggcgcaatgacggctggggcggcactttagagaaacggatgagatttccgcttcagattatagaagaaatcagacgcgtagcggatagctgccataagccgtcctttatcatcggctacaagttttcgcccgaagagccggaaacacctggaatcacaatggatgaaacgttgtctttcgtcaatgtactgcgggagcaaggattggattacctgcacgtatcactggttgatttccggtccttgccgcgcaggggtgcagacagatcccgcgcaaggatggaactgatcaaagaagccgtccaagaccgtctcccactgatcggagccgggcaagtacacacaccggaagacgcccttcaagcgctggaaacaggagccgatctcatcggaatcgggcggggtctcctgatggatccggagtggctacaaaaagttcgagccggaaaagaggacgatattcaaacaaccctgtcaagacatgatcagcggaagctcgcaattccagatgccttttgggaaagtataccgatgtatattgatttcagcgattgacgattcccgcttatacagactatagattcatataaaaaaggtgtctttccgcttaaaatcggtgtcatttgcataaaaatgtataggaaaagaggaacttagaccagttgagtcccagagatgagtatattagaatgatggtaattcaatatcgtcgggattgttactgtctaagcaggcaagacctaaaatgtgtgaagggcgaaatctatcttttgcctatatgaacttgcacattttaggtcttttttctgttcttcaggacaatgccgcagttaggagggatgattgggaacgttcatgttgtcagaagcaatctattacatattgaaaaagggaggaaatattgatgaacatcaaaaacattgctaaaaaagcgtcagccttaaccgttgctgcggcactgctggccggaggtgcgccgcaaacctttgcaaaagaaacgcaggattacaagaaaagctacggattttctcatatcacaagacatgacatgctgaaaattcccgagcagcaaaagagcgaacaatttaaagttcctcaattcgatccgaaaacaatcaaaaacatcccttctgcaaaagggtataacaaaaatggagagctgatcgatttagacgtatgggacagctggccgctgcaaaatgccgacgggacggttgctacataccacggctacaatcttgttttcgcgctggcgggcgatccgaaagacgtcgatgacacatccatctatttgttctatcaaaagaaaggcgaaacttctatcgacagctggaaaaacgccggcagagtgtttaaagacagcgacaaatttgttccagacgatccgtacctcaaacatcaaacacaggaatggtcaggttctgccacgctgacaaaagacggaaaagtccgactgttttacacagctttttccggcacgcaatacggcaagcagacgctgacaacagctcaggtcaatttctctcagccggattcggacacgctcaaaattgacggtgtagaagatcataaatcggtctttgacggcgccgacggcacggtataccaaaacgttcagcaattcattgacgaaggaaactacagctccggcgacaaccatacgatgagagacccgcattatgtggaagaccgcggccataaatatctcgtatttgaagccaatacgggaacaaaaaccggctaccaaggagaagactccctattcaacagagcctactacgggggcagcaagaagttctttaaagaagaaagcagcaagctgctgcaaggtgcgaacaaaaagaacgcttcgctggctaacggcgctctcggaatcatcgaattaaataacgattatacactgaaaaaagtcatgaagcctttgatcgcctccaatacggtgacagatgaaatcgaacgggccaacctcttcaaaatgaatggaaaatggtatctgttcacagattcaagaggatcaaaaatgacaattgacggcatcggttcaaaagacatttatatgctcggctatgtatcaggttcattaaccggaccattcaagcctttaaacaaatccggacttgttttgcatatggaccaggattacaatgacatcacgtttacttattcacactttgccgtaccgcagaaaaaaggcgacgaagtcgtcattacaagctacatcacaaacagagggatttcgaacgagcatcacgccacgtttgcaccaagctttttgctgaagatcaaaggatcaaaaacatccgttgtcaaaaacagcatccttgaacagggacaactaacggtaaacaaataaaacgaacgaaggaaaatgccggtgaacatcggcattttctttcgtatgtcatcttagaataaagcggggaattttcttgaagaaggcagtatataagcggatcagcattttaactgtttgtcttggaatcttcatcatgatatttctttcagtccgggaaacagaaaaaaagggagaatctccggatacaccggaatatcgtgcagctttccatttgacaacccctgacaaatggaaaaacgaccctcaaaaacccgtctatttcaatggagaatatcattactactacctctataaccgagactatccggacggcaatggaacagagtggcgccacgcagtatcagatgatctcgtccactggcaggataaaggggttgccattccgaaatatacgaataaaaatggcgatccctggtccggttctgtcgttgtcgactcaaaaaacacagccggcttcggcaaagggacgatcgtggcggttatgacgcagccgtcggccaatgacgggaaggaagagcaatttttatggtacagccaaaatggaggaaaaacatttaaaccttacggtgaagagccggtcttgcctaatccgggcaccgtcgatttcagagatccgaaagtgatctgggatgaacaggatgataaatgggtgatggcgctggctgaaggaacgaaagtcggcttttacgaatcgcaaaaccttaaggaatggcgttatacaggtagttttcaaacagaaaatatcggcatcatcgaatgtccggatctgtataagatgcgggcggatgacggaacatataaatgggttcttggagcaagcgccaacgggaaagggaccggcaagccgaatacttatgcatactggacaggcagcttcaacggcaacgaatttacggcagacgaagcagaaccccagtggcttgattacggatttgactggtatgcgggcgtgacatttgaggacggcgaaacgaacgatccgtacgagaaacgctatgctttggcgtggatgaataactgggattatgcaaaccggacgccaacatggaaagacggttttaacggaaccgattcgatcgtccggcaaattcggcttaaacataaaggcggagatcgatacagcctcgcctctcatccaatcgatcaattggatgaattaaccgaatctgccgatgaattggatcgcatcgaagtgaacggatcaaaaacgctgcagattaaggggaatacctatcagcttgaggcagatatctcttgggacgaccttaaaaatgcgggtttcaggctcagagaatccgcggaccgaaaacgccatatcgatgttggaatttcggctgaaggcggatattcttatgtgaacagaggatttacgggacagcctgacagcacccgcacctatttggaaagcaaagcaccgtttgatccggaaaaaaaacgggtccatttcacaattatcgtagatcaaaacactgtcgaagcatttattgatgacggcgaaacgacgcattcaaaccttgcatttcccgacatgaatgatacaggcatcacactctttagcgaaaatggaacggccgtctttgaaaatcttaagatcaaacatttgcgttcaatccgcgattaaacaacacgggcggccaagcggccgcctttttttgtgaaagcgaatcattacgctcactctccgaatacgactaaagtgttcacaaaaaaacaagggcggcaaatgccaaacccttgtcttgaaaacgcgctcggagggattcgaacccccggcagacgtggtaccggaaaccaccgctctatccagctgagctacgagcgcacaatatgattttttaacgtcagcaattcatattataagggctgttctttaaaaagtcaatcacaatctcctgctcgaaacaaaaaacccgcatcatcatgatgcaggtttagataatacggaagctataatcttttgttcgatttcttcatttacttcgtccgttgttttgacaaggcagataatgccgtcaataaaaggccaaatgaataatgtaatccagccgagaagcaacatggctacagcgtagccttttctctcgtccagataaaatctgtgagcggcaacgcctccgagaaaccaccataaaagaaatacaatcagcttcgatttcttcttattttgcagctctgaagccacgacaagcctctgctgatctgtcaggttactcttgtccaagttcacataacccataattgatttccttctttcctataaaataaaatgaagaccaatggactaatcttagactattggacctaaattttctatacttttctctataaagttgatattttgtttgagtttccttcaaaatgggaaaaataaacccagtatgtcttttggatgaaggcggctttttgtttgacctttattgaccaaaaatgtatgattaaactacatacttaccttttaaggtgaaggaggagcattatgaatttaatacctacagtcattgaacagacgaaccgcggggaaagagcgtatgacatttactcacgcttgttgaaagaccgtatcattatgctgggatcagcaatcgatgacaatgttgcgaactccatcgtatctcagcttctattccttgaagccgaagatccagaaaaagatatcagcatctatatcaacagccctggcggctccatcacagccggtatggcgatttatgacaccatgcagtttattaaaccgcaagtctccacgatttgtacgggaatggcggcatccatgggtgcgttccttcttgcagccggcgagaaagggaagcgctacgctcttccaaacagtgaagtcatgatccaccagccgcttggcggagcgcagggtcaggcgactgaaattgaaattgccgcgaaacgcattctttcattgcgcgacaagctgaacaaaatccttgcagagcgcactgggcagccgcttgaagtaatcgagcgcgatacagaccgcgacaacttcaaaacggctgaagaagcaaaagaatacggcctgattgataaagtgcttacacgcaatatcgacgcacagaagtaaacagccaaaaagctgccggagtcaccggcagcttttttttactccaaatgggttgtcccattcgctatatgtaaagcttctataaatccttccactttttctcgaggacagggtagcgataatcattcatgttcccgatcaactccgcagggcttgccgaagcatgaatcagctcaaggtgcgatttgttcgaaaagccttcttgaacgctgtattcgagcattttaagaaggggttcaaaatagccgttcacattgtaaagtccgatcggcttttgatggatgccgatctgcgcccagcagagcacttcaaacagctcttcaaacgtgccgaagcctccgggcatcgcgataaagccgtcagctaattcactcattttcgctttgcgctcatgcatgccgctcacttcgatcagctccgtcaactgctgatgaacgatttcccctgtaaaaaggcctttcggcataacgccgacgacttccccgccgttttccaatacggtatccgcaatcacgcccatcaatcccattctcgatcctccgtaaacaaggcgaagccccttctcggcaatataaacgccaagctctgcagctttcttcttgtactccgggtccgcccccatatttgatcctgaatatacgcataccgttttcactttcgctcactccaactccatatattgataaaagcaattaacattgtactatatattgtttgttccgtgtgcgacaatataattgaatttctaaacgggagtgtataacttatgacaatcacagacgcggagcaatggacaaaggcattttacagggaaagaggatggagcgaatacggacctttcatcaggatgggatttttaatggaagaggctggcgaactggcgagagcggttagagcatacgaaatcggaagggaccgtcctgacgaagcaaaacggccggctgctgaactgaaaaaagaactgatcgaagaaatgggcgatgtaatgggggaatttgatcatgcttgccggcatatacggtgtttcattggaagacatgatggatgcccatcgctgcaaactgacggaacgatttgcaggagagcatcatcaagatcaatgaccgcctttacggggaggcagatttggagcctgtgctgacagacctcattcgttcaaaagccgttcagcgtctgaaagggattcatcagggcggggcctcttttctcgtcaatcccgcatggaacatcagccgctgtgagcacagcatcggagttatgcttttgatccgcaggcttggcggaagcctggaagagcaaattgcaggtttgctccacgatgtttcccatacggcattttcccatgtggctgatgatgtatttaacatggaaaacgaagattaccatgaacagatgtttcggcaatgggtcaagcaatctgatatctccgggattctgcatacatacggattccatgatgaagacatcttatatgacgagcaaaaatggacgctgctggagcagccggctccttcattatgtgcggatcgcatcgattacacgcttcgcgactctttagcctatggatttggcgatccggtagagattggacgatttttagaaactggattgaccgttgctgaaggcgaaatctgctgcacttcggcagagcatgccgaatggttcgcccgcctttactatcaagaagtgattgacttctttatgaatcccctcaatatatatgcgctctgtaccctcagccaaatgctgaaagaggcgcttgacatgcgtgttattgcggggcgcgattttttcaaaaccgacacggaactgcttgcgatgctaaagcaaaaagcgcgcttccgggaaacgctggtaaagctcagcacagcgagcaagcgcgttaaacaaggcgacgaaggcgattttacttttcatcaaacattaaaggtgagatggatcgatccaaaagtcgctgttaacggaagaaaaatccccgcctccacactttcaaagaacgtccttctgatgaaagaaacggcaatagccgccatgaaaaaaggcgcatatgtaaaagcagcccaataaaagaaaccgcctgcttcagtccggccgaaacaggcggttttcttggttatgtcacgtcaaatatttgttcaggcctgtcgacaaaatgctttttgccgatcttatgaaacagccctgttttatgaagaagctcacgcggctgctgctgaagacccacgatcatcactttcccgttttgctggtggacacggttgacgatcgtcatcaggctgccttctgcggaagagtccatgtagtctactttattcatcagcaggatgaggagttttggcgggtggcctttgtccaaaattgaatcctccaatgaattcgatgagccgaaaaacagcgggccttcaaccgaatagatgctgacagagcgttgaaaatgcttttcttccgctgcagctgccgactggacgatcgattcagacacatcttttttaatgcggaacgacttgctcattctggcgataaaggtgatgatcgccagcaggatcccggccgccaccccaaacacaagatcctgccaaacggttaaaagaaatgtgacgacaagcacggcagagtctgaatttctaattttcaaaatatttataaactctttccgctcactcatattccaagcaaccaccatcaaaatcggcgacatgcttgcaagcgggataagggaagcgtatggcgcaaacaaaagcagaaccaataaaacgaacacaccgtgtacgatacctgaaatcggagaagcagcgcccgttttaatattggtcgccgtacgggcaatcgcacctgtcgccggaataccgccgaacagcggtgcggcgatgttcgcaattccttggccgacaagttctttattgctgtcatgccttgtccccttcatattgtctgccaccatcgcggaaagcagcgattcgattcctccgagcattgcaatcgcaagagcgggaggcatcaggtaaatgattttttccaatgacaactcaggaaattgaaagctcggcaagctgcgcggaatttcgccgtaagctgatccgatcgtcaccacctgttcgggaaacagcatcgtggccatgaccgttgatacaagcaagcctgcgagcgctcccggcactttcggcagaacctttggcgtaaacagcacaaagaagagcgatacgacagccgtcaaaatgctgtaaaagctgagcgtattcaggttgatgacaacctctctcatattcatataaaaactctcatgcttctcgacatttctcaagcctaaaaacttggcgatttctccggtgaaaataatcaccgcgattccggccgtaaatccgatgatcaccggccgcggaataaatttgatgatcttgccgagttttagcagccctaatatgaccagaatcactccggccataaaaccggcaatcagcagattctcaaatccgtattggagcacaatagcgaacaggatcgggacaaaggcccctgtcggtccgccaatctggtatttcgacccgccgagaagcgaaatcaaaataccggcgacaatcactgtgtaaagaccgtgttccggtttcacccccgaggctatagcaaaagccatgccaagcggaatcgcgacgactccaacgaccattcctgctacaatatctttttgaaaccgcttaaggctgtatccttcaaatctgcctgaaaatcgtaacattcaatctatccccccatttgatcatcgcacttccgaaagcgaaacgtcttcacgtgaataaccatcttcaacaacatccaaacggccggtctttggatcaatcaccaatccgtgcaccggaacgtctgaagacaagagcggatgtttccggatcatgttcacactgtggctgacgctgtcttcaacgctgtcaaagcccgtcatccatgtgtccaaatcgatgcccgaatgctgcaggagttcgagacagccatcatcgacaccccgctgtttggccttttgaaggatagatgaagcgttcaggcttgccattccgcactcatggtggccgatcacgcagacttcttcagcctgcagctcatagacagccacaagaatgctgcgcatgacgcttccaaaagggtgagaaacaacggctcccgcattcttaatgatttttgcgtctccattttttaaacccattgcatgatggagcagttctaataaacgcgtgtccatgcatgtcaaaatcacaagttttttctcaggaaatttcgtcgtttcgtaaaactcgtaccccttttcctctacaaaagactgattgtgcttcaaaatggaagttaaaatcgccatttttctctcactccttttcatagtcatatgaccttgatattgttacagccgaattatagcacatggatttccgctttggattcgaatcaaaaaattcactaaaaatgtactgaatatttttaaaaatctaattttatatctttctaaaataataaaatgtacgctgttcttcacctataaaaaaataactggaagcaaaatggaatatcaaatatttggatttatagttataaaaatgcattaaaataaattaaaaaactgaaataagattctatgattttctaaataacgataattgagctgatagtcctgcgctagctggaacaatctttgatttttacagaaaccgtttttcctctataatggaagcagatgatacgcggaaggagaatgcagatgaaaccgtttgtatatgtcacaaaaccggtcccaaaagaaatcgaagagatgctcgctgaacattgcgaatatgaaatttggacttcgcgcgagcgtattcccagaacgaccctgctcgagaaaatcaaggaagcggacggccttttgacctcaggaacaaaaattgaccgtgaattattatccaatgcactgaagttaaaaatcgtcagcaacaattccgtcggctatgacaactttgatattgaagcaatgaaagaaaaatcggtcatcggcacccatacgccatatattcttgacgacacagtcgcagaccttgctttcggtctgatcctttcctcagctcggcgaatcgccgagctcgaccgctacgtccgcgagggaaaatggaccaaatcagaggacgatgaaagcttgttcggatctgatgtccatcaccggacgctcggcatcatcggaatgggacgaatcggcgaacaagtcgccaaacgggcggccttgggttttgatatggaagtgctctattacagccgcagccgcaaacccgatacagagaaaaaaaccggcgcggtttatacgggctttcatgagctgttggagcgctcggatttcattgttctggtcacaccgctcacggatgagacataccgcctcatcggcgaagcagaattcaaaaaaatgaaaccgtcgtccattttcatcaacatctcccgcggtaaaacagttgacgaacaagcgttgattcaagcgctgaaagaaggatggattaaaggagccggacttgatgtatttgaaaaagagccgattgaaaaagacaatccgctcctaagcctttccaatgtaacccttgttccccacattggatcatccacccatgtcacacacgtcaacatgctgaaaagcgccgttcaaaacctgattgacggtcttcagggcaaacggccaaaagatatagtcaaagaactgagataacgcgcatctttcaggcgcggaacgttttgccaagctctcctcctaagccaaaatagtgtctgaaaagataaatcaaaggttcccatttttgaggatcgatgtggtgttccccttttaaaatcgcttcatgtgcgtgcacatgaagcacttttgtttcaatgacggcaaaatacggggaatgttccggaatgcgaatgttgacagcttccgcttcaatttgaagcgggcaatcggcgactctttcaggtttcactgccaaggaatccgcggccgtaaatccgccggcttcaaatttctccttaaggtaagtaaagccgagccgctttttttcttccggaacgaatcgtttgccggtataggaagccagccgttctacatttctccataaagatgaatccggcacattgataacgcatccagcatgcctctctaaattttccaatgctttaccttcggttccaataccgagtacgatcgaatccccgagcgcccaagaagatgacagcgggctgagattcgtggaaccgtcttcgttcattgtgctgagtaaaatgactggtgttccgtaatataaaatgcttggctgaataattttgctgttttgttccatatgcgtctcctccttttatgcttttattgtaattcttcaatatttcaattaacatcgaagtatcgattgcattttaggaggaagtgtaatgaacgtgaatccaaatatcgccgaggtcgccaagcttgtcaccgatccgtcgcgggcggcgattttaaccgcattgcttgatgaccggtattatacggctaccgagctggccggatatgcgggaatcaagcagcagacagcaagctttcacctttccaagctgcttgacgccgagatgctgacatgcaggaagcaaggacgccaccgctattacaggctcaaaaacggaaagattgcacaatcgctggagaccctgcttaacatagcgccccctgcggaaattcgctctttccggcagtcagctgaagatcgggcggtcagaaaagcgcgcacatgctatgatcacctggctggatcgctcggcgtcacacttgcggatcggctcgtggagatgggcgtattgaaagaagaagagacggcttttacagtgactgaagaaggggaagcatttttgaaagagcttggcatcgatgtcagggaagtcaaaaagaaacggcgctctttttgccataaatgcctggattggagtgaaagacggcatcacattgccggcgccttaggctccgcattgctcgatgccttcatccgcatgggctggatcgagcggcgcccgcatacacgggccgttgcagtcacgcccgccggcgcaaaggaactttaccgcctatttcatatttccattgaaaagaactgaagaaatagttctcgatcgttttccggcattccgggagaccaaatagcatgcggttaggaacctgcggcaagccgttcacgtcctcggctttcatggaaaatttacaataatataatgatttttgggcatgttttaaggtacaattcaagatgattgcagacggaatatggaaatgaagaaatgcggctgttcaaccccatgaaggcacattcttcatgtttatgttataaagtctaaagacagggaggactttatccgtgaaaaaaatattatcaactcttgcgcttgggtttgttctcgcgctgggctttctggcggggaacctttttacaagctcagctgaagggccgcaggcagaaaaaggcggcaccgttcagtcaaatgaagtcatcaatacatttgaaggtgttgccgactatattgtgaaatacggcaggctgcctgacaacttcatcacaaaagccgaggcgtcaaaattaggctgggatccgcaaaaaggcaatctggcagaagtagcgcctggaaaaagcatcggcggcgatatctttcaaaacagggaaaagctgcttccagatgcatccggacgcgtatggagagaagccgacatcaactatacatcgggattccgggggtcagaccggatcgtctattctaacgacagactggtttataaaacgactgaccactataaaacgtttacgagaatgagatgatcatatgaaacaagtcactttaaaaggagaaaagatcagaagtgtatcagatcttcacaaagaattaaaagaacagctggagcttcctgactactatggcgaaaatcttgatgcgctgtgggattgtctgaccggctgggtcggcatgcctttgctgatagagtggaagaatgtcgagaaaagccggatttacttgggcgatcaagccgaggcatatttgcagctttttcgcgaagccgaagaaacactggacggctttcagctgaaaacagaaggatgaaacagaaaacgagcgggcgcttcagacaggcgtccgcttatattaattgatgcagaaaatcggttcttcagtcaaaaaatgaatgaacgaaaatggtttggaaatctcctgcattcacatcctctttcgtcaaaccgccccctgtctgctttgtgaagtgatccttcgtcaaaattaactttccgtcctttatcagcttggaagcgagcgggtttttattaaaaggcgacgccttctcatcgaaaattgcatcccgcacgcatgtaagcacagcttcatcgattggcgtcagcgaaaatgcatagccgatctgccacccatctcccttatccatttcaagaaggtaatcccctttatccgtctttgtttccctgatacggtaagctcctgtttttgaggggacaggttcacctgagaacggaacgggtgcaagcggcaggttgatgccgaatccagtgtccagcagataggtttcatcaccttcccgcagaattacggcgacatgcgttcccgtcagcgcccacgcctgctcttttgcattaaataccgttccgcggaccatgtgaacggaaaagccgagctctgtcagcacatagtaaagaaaagcgttcaaatcatagcataaaccgccccttttattgttcagcaaggcttccgtcagctctgttttcgtcatcgaaatccgttcgtttcttaaaaccgcgccattttcaaatggaaactgcaaagccagcagcgataaaaactcgggcaagtcggcaaatgtcacctgctgacctggcttgtatccaatcctcttaaacagcgaatcgagcatcgtcgtcatcggtaattctccttccgcttatcaatgagaaaaagccaaacctcataaaggtttagcttctttctcttgaacatatgcagtcagtgcatcaagggcatcttgttcatcggatccgtcagcgatcagcgtgacttccgatccggagctgacagcaaggctcatcagccccatgatgcttttggcattcacttttttatctcccttttccagaaaaatatctgattgaaaacggttggcttcttgaacaaacaatgccgctgggcgcgcttgaagccctgtttttaaaagaacttccactttttgttgaaccatacgatctcccccattccctattttaaagagacagattgtcctgaacgcagctgctcagctatttcatccagtttcctaagtcggtggttgatgcccgatttgctgatttttccgctcgacaccatttccccgagttcctttaatgttacttcctgataatcaatgcggagctgagcgatttccctcagcttttccggcagcgcatcaagcccgattctttcgtcgatcagcttgatgttttccacctgccgcagagaagcgccgatcgttttgtttaaattggcggtctcgcaattgacgagccggttgaccgagtttctcatatcgcgcacgatccggacgtcttcaaagcggagcagcgaattatgcgcgccgatcacattcaaaaactcggtgattttttcggcttccttcagatacgtgatgtatccctttttccgctcaagcgttttgctgtttaaatggaactgattcatgagcctgcacaatgaatcattatgctctttgtacagcgaaaaaatctcgaggtggtaagaagatgtctcgggattgttgacagaacccccggctaaaaatgcccctctcatataagaccgtttgcagcatcgttttttgactaagtcttcggagatgtttctggcaatgacaaagttgtctccgagtattttcaagtcctcgagaatcggcttggcattttcgatcaggcgtacgatgtagacattgttttttttcagtctcattttctttcgaacgagcagttcaacggaaacatcgtattgtttcttcagcaatgtgtaaattcttctggcgatggccgcgttctcggtctggacgtcgagaaccacttttcggtttgagaaagacaatgaaccgttcatccgaatgagggcagagagctctgctttcgcgcagcaatcctttacttcaaggtttgtaagttcttttttcgtttccgatgcaaatgacatattatagacacccccattccaaggcctgctattcttttaacaaatcaacaagtagcgaagcgactttatgtgtatcatgacggatcacgccattctcgtatgtcacaatctgatctttgatgacctcaagccccatcgcagacagatcatcaatattaaactggacgggctgtgcctgctccttcgcatagcgttcccgaatgtcgtccgggatttcctcattgttgacgaggatcgtatcgataaacggaccgcccatatgctggttaagcgcttttacatggtctgccgcactgtagtacagcgtttctcccggctgggtcattacattgcaaatataaactttttttgccggggcgtttaatatctcttcccttatcttcggaacgagaaggttcggcaagatgctcgtatacaggcttccggggccgagaataatcaggtcggcgccgcggatcacgtcaatcgtttccggaacgggttcgattttttcaggggttaaaaacacccgtttaatccgcttcccgtaagacggaatcgtcgattcccctgatatgatctgtccgtcatccatttccgcatgaaggacaacgctggtattggccgcgggcagaacccttcctctcacatttaagactttgctcatttcagtgacggcgtgaaagaaatcaccggttatattcgtcatcgccgccaaaatcaaatttcccaatgaatggccgattaaatcgccgcctttagagaagcggtgctggaacaggtcttcaacaagcggttcgacatcagacagtgcagcgaggacatttctgacgtcccccggcgggggaattttcagctcgtcgcgcagcctccccgagcttccgccgtcatctgcgactgtcacaatcgccgtgatgtctaccggctgctgcttcaatcctctgagcagtaccgaaaggccagttcctccgccaaagattgcgatttttttctgatctgccatgctattttctgcttttcttctcgatgtcccggtgagtaacatgagtatagtagtcctttttaaaataatcggcaaggtattcagccagcgtcacagaacgatgctgtccgccggtgcagccaatcgcgatgacaagctggctttttccttctcgcttgtatgacggaagcataaagctcagcagctcggtcaatttttcaagaaacttttgcgtttcgttccatttcatcacatatgaagatacttcctggtctttccccgtcagcggcctcatgctgtcgatatagtacggattgggaaggaatcttacgtcgaacactagatcagcgtcgatcggcaatccgtatttaaacccgaatgacatcacattcacagtaaaggtatgtccgtgatctgccgcaaaatgctggacgattttttcgcgcaggtctttcggcttcatatcggatgtatcatagatgatttgagaacggcctttcagctcttcgagaagctcccgctccgtttggatgccctcaagcggcaggcccgttgtcgcaaggggatgggatcttcttgtctctttatatcttgaaacgagaaccgaatccttggcatctaaaaataaaattcgcggggtaatccaggatgtttccccaatttcatcaagcgcttcaatcaggctgtcaaaaaactcgcggccgcgcaaatccataacaagggcgactttgctcatttttgaacttgattccttcatcagctccaaaaatttcggcagcaaagatggcggcagattatcgacacagaaaaaaccgagatcttcaaagctttgaatcgccactgtttttcctgcccctgacattccggttatgatcacaagctgtatatcatggcctccattcgcgttcatgcttctctccccctcttatgtttattcgccttgcgggtcgaggcgataggacagcaattcaaagtcaggcgtatacgtaaaggtgccgtgaagcagtcctttgcctttcagcataaaatcaagaatatggacgtcgcccggcgccatcggcaagctaccgacgtcccccgcctgatgccacctgatgatgccttcttctgattcttctacatgcttgcctgtataatgatcggcgacgaatgtgaacatcatccattcagatacaacctgatcattttcctttatgataaaggtgaatattcctttcagctgcgggttcagcacatacaggcccgtctcttcgcggtattccctgataacggcgtccctgacggtttccccgctttccattttgccgccgggggccacccaccagcctcgtctgggcttttgcagcaacaggactttatcacctgaagtcagcacacaattcgtcactctttgcaaagtctgtcacccatccttttattccttcaattcttttttctattataccgtttcctgtccccgctcacaatgaacatgcagttccgccgcgaaaatcgccttttcccgggctgttttaggctttttccgggtaaaaacttaatgaaacggctttttcagcaaatggaagcgcttgcgaaaaccgttcttttattctattttacagcaaaaacgactgtttcaatattgaaatttgaacaacttgtgaaatttgtaaaaaattctctttgcgggaaaataagacaaaaaaaggacacggataagatcatccgtgccaataaaattcattataaaagggggtcaattactataccaatcataacgaataattgtttcactggtgttacaggccggttaaatcatgatgacgattaaaatgcgttattttacagccttttctttctctttcagctcttcgatatagtgctgaacgctctgtgcggcaatgcttccgtcccctgttgccgttacgatttggcgaagggttttctcgcgaatgtctcccgcagcaaaaatgccttcgacttttgtttccatctgttcatttgtcacgatgtagccctcttcatttgtaatgccgaggtttttgaaaggctctgaaagcgggagcataccgatgtagataaagacgccgtcagtccggaactcttcttcttcgcctgtgaccgtatcgaccagtgtcactttgccgacttttccgtcttgttcatgaatttccttgaccgtcttattccagagaaagtcgactttttcgttgtcaaacgcgcgcgcctgaagaatgctttgcgctctcagcttatcgcggcgatggacgattgttactttcgaagcgaaacgggttaagtacacgccttcttcaacagcggagtctcctcctccgacaacgaccagctctttgtttttaaagaaggcgccgtcacaaaccgcacaataagaaacgccgcggccgccaagctctttttcgccaggtacgccgagcttcttatattcggcgcctgctgtgatgatgaccgcgcgcgctttaaattcttttgatcccgctttgacgatcttatagtctccttcatcgacgacttctttaatatcgccgtacgcatactcagcgccgaactttttcgcatgttcaaacattttatttgaaagctcgggtcccagaatgctttcaaatcccggatagttttcaacatcctccgtattggccatctgtccgcccggaacgcctctttcaaccatcaaagtcgacaggttcgcccttgacgtataaacggctgccgtcattcccgcaggacctgctcctataataatgacgtcatacattttttcttctgacacaatgttcactccttcatgaatcttatgcttgcaagcagtgcattcctgttaaataagattcccttcttataacttccttacccatatcctataaaatatcatgaataatcgctatttttttgctcacataataaaacaggctgaacaatgaagttcacacctgtttctatagatgctcttttaatgtacgttcatactttgaaagcgtcccgggcgatatttggaaaattttagcggtttcggcttttgtcaaacgctcctgatgctccgtcttccaaatgtaatagatcgctgccgcaagcccgccggcatttttcagctgaagcccgtaagccctgatctgctgaatgacatggaaaatccaaaagcacatggcctcctgctccatcgccgactgatccgcttgttcaatcgcttttgcagtcctgtaagcaagtagcgcgtcttttgaatcaacggctgcaccgctttccccgtaaagcacaagtctgacaaactgatcttcaaacggcgtttttgccatctgtgaatcaagcaccgctttcagctgggctttttccccttttcttccgctgatataatatgcggcaaggcgctcctcgagcggtcgctggacaggtctcttttccttccgttctttccacggctccatgcgggcgtcatccggatactcttcctgcatctttttccatacagaccgggcaaattgaacgcggcccgtgtaataagccgagcaggcaagccagtaataaaaggtctcatccccttcaaatcccatgcggtagagtgatttcagccatttaaacccgagatcgtatcggccgacaagggctagcgtggcaccgagcttatacctttgctcaaaaagcatcggataaatatttgaaagctgttcggaaagcgcctcgaccttatcgtcccgtcgttcatagtgataaaaaataagaagattgcaaagcgcatgcaggtttccatgacttttttccaagaccgtaaaaaccgtcgttttggctttctgaacgtccccggcataaaagtatgcgagtgcaagattgttataagccgaccaaaactcagggtaatcggaaataatttcttcaagcatcgcgatcgattcctgaagctgtccattttccagcagtgatttggcccgatcctgtttcagaatcaggtcgtcctgatcgaactgcgaatagccctgatcttcctctcccatatccaataaatcaagcagctccgcattttcctcgctgaactcgccgtccggatcttcctttaaataagtctccgccgctttataggcctcttgaaaaagaccgaggtgcgcatagttgttcgctttaaaatagtagcattcagtcattttttcgttgatgttcttcaggataaagtccaaaagttcgtttgattgctgataaaagcccatttccgtataaataaccgcaagttgggacagcattcccgtgttttcaggttcaagaaaaatcgctctctgtatgagcttgctcgcgcgggataaatttcgctctctgtatgctttgagccctttatgataaaaatattgcccatcttggaacagctggacaattctcgaatctttatgatgttcagaagtgtactttcccacagataccctccatttcaaactatataccgtgagtagtataacatagtttccagcaggcttaacaggccaaaaacaagtttcgagaaaattctcttcattttccacatatggttttttcaccattttatttcggacgtttggagcaccaggacggatagggctttcagaaggatgaaggtacgttttatatcggaagtacgcttttcatcttaacccgggcaaaatctttttttagcacttaatgatgacgaatgtacgttcccattgtatgataatagaaagggggttcacaaagtgaaaaaaggcggatcaatagaattgacgcattactcagaagaacattcagctgcgcttctcgaatttgagcttcctgaagaacagcatcgatttaccgctcttccgaaagaggctttaaaacggacggacggccagtttccaatcgtaattttaagcgaaggcgagcctgtcggattttttatcctccatgcgaccgagagggtaaaagactattcggacaacctggacgccatgctgttaacggcgctatccggcgacagaaagcaccagggaaaaggttttgcaaaagaaggaatgctcaaacttccagagtttgtctccaaggagttcacccattgtcatgaagtcgtgctggttgtgaacgtgaaaaacaccgcggcccagcacctgtatgttaaagccgggtttgccggcacaggggaaagaaaaacagggccgatcggagagcaaatcgtgatgaaattgaacatcaaatagctcccctaccgggaaaacaaccaaaaggccaaccgccttttggttgtatgcagtgtgcttatgattcagatccttcatggcgctctttcaagacgccaagcacatcatcaagcggaagggactgctccctcagcaaaacgagcagatggtaaagaaggtcagccgcctcccatttcagttcttcaggatcacggttttttgcagcgatgatgacttccgccgcttcttcgccaactttcttcaaaatcttatcaacgccttcacggaacaaatatgttgtatatgcgccttcaggcatttcagcctgccgtttggcaatgacggtttcaagttcattgatgatgtcaaagcggccgccatcagtctgtctgatatgttcgccgggcgagaaacagctgtagcttcctttatgacaggccggccccgccggttcaacaagcacgatgagcgcatcttgatcacagtcaagcctgatgtctttcacacgctgaatgttacccgacgtcgctcccttatgccagagctctccgcgcgatctgctgaaaaaccatgtctccttcgtttccagcgttttttcaaacgattctttattcatataagcaagtgtcagcacttctttgctcgctgcatcctggacaatcgccgggatcaagccggcttcattaaatgtcaactcgtctgccttgatcatcttacattcaccccgcgctcttttaaataagcttttacttcttttacagatgtttctttgtaatgaaagatagatgcggcaagagccgcgtccgcccggccttctgcaaacgcatcatacatgtggtccgcacgccctgcgcctccggatgcaatgaccgggactgaaacggcttctgacacaagctttgtcagcctgcagtcaaatccgttcttttctccgtctgaatccatgcttgtcagcaggatttcacctgctccccgccgaacggcttccttcgcccaggaaacggcctcaaggttcgtttttttccgaccgccgtgtgtataaacatagtacagatcagcttctggatcgtattttgcatcaatcgcgacgacaatgcattgagagccgaaaaagtcggcgccttccgttatcagttccggccggagaacggcagccgtattgacggaaactttgtcggctccggcccgcagtatcgttttcatatcatccaaacgattgatgccgccgccgacggtaaacgggatcgccagcttggccgccactctttcaacgacatcaaccatcgtttttctcccctcgtgggaagccgagatatcgagaaaaacaagctcatctgcgccttcatgatcatatacttcagccagttcaaccgggtcgccggcatctttcaattcaacaaattgtacacctttgacaacgcgtccatcttttacgtccaaacacgggatgattcgttttgtgatcactttgccgccaccctttcaagcgcttcagccacggtaaattggttggtataaagagcttttccgacaatagcgccagagacgccttccgaagcgcgggaagcgagcgcctcaagatcggcgagagaactgacgccgccggaggcaatgacttgtttgccggttgccctggcaagctccactgtactgttgatattaggtcctgacagcattccgtcagtcgcaatgtcagtgaagataaaaacttctgcaccttcatttgcaagctcgcggccaagctcttccgctctaacggaagaggtctcaagccacccttcagtcgaaacaaatccgtcccttgcgtcaagaccgattgcgatgtgccctccgtaggccttcagcatttttttgacaaactcggtatttgatacggcagagctgcctaggatcaccctctcaacgccttgcgacaagtagtcatacacgtctttttcggtcctgatgccgccgccgacttgcactttaacgtcaagcttatcagcaatgcttatgacgtggccgccgttcacttttttgccttctcttgcgccgtccaaatcgacaagatgaatccagcttgccccctcttcagcaaaccgtgaggccatctccagaggggaatgaccgtaaatcgtttctttttcgtaatctccctggatgagcctgacgcacttgccgtttcttatgtcaatggcaggatatacagtaaactcgctcattttttcaccttctgttcttgtgtaaactgcttgaaccgctctaagatcaacatgccgaccgtactgctcttttccggatggaactgggccccgtatacattgccaagaccgacgacagcgggtacacacacaccgtattcggcgcttgcaagcaaagcttcctcttcgattccgctgacataatacgaatgaacgaaatacgcgaatccttctttcgcttttggcaaaagcggcgagtcgcggtggactttgagaagattccagcccatgtgaggcacttttaagcgatttcccgcttgatcacagtctttcagtttaacgacttttcctttcaacaggccgagcccttctgacgccccgtgttcttcgctttcttcaaacaaaagctgcatgccgaggcatatgccgagaagaggttttccttcgtttgcggcagcttgaataaatgttttcaggccgttctcggttaaaatctccattgcatcccgaaaagcgccgactcccggaaggatatagctgtccgctctcttcagttcatccggatgctcggacacaaaataaggggcatcaatccgttcaagcgctttagaaacgctgtacaggtttcccattccgtaatctatgacaccgatcatttacagcattcctttcgttgatggaattcccttgacccgcggatcgatcaatgccgcttcatcaagcgcacgtcccagcgctttaaaaatggcctcgatcatatggtgtgtgttcgtaccgtaatgaacgatgacatgcagattcattcgcgcttccagtgcaaacttccacaaaaattcatggacaagctctgtatcaaatgttccgattttcctgcttgggaattcagctctgaactcgaggtgcggcctgttgctcagatcaatcgcaacctgggcgagcgcttcatccatcggcaccatgctcgaaccgtagcgtttgattccttgtttatctccgagcgcttccaaaagcgcctgtccgagacaaattccgatatcttccgtcgtatggtggtcgtctatttcaacatcgcctttcgcttcaattgaaaggtcaaactgcccgtgttttgtaaataaatcaagcatatgtgtcataaacgggacatccgtttgaatatccgcttttccttctccgtcaatatgaaaggataatttaatatcagtttcattggtttttcttgcccgttcggcttttctcatcagtcttcctcccggtttctggattcaattgctcttgcatgggcttcaagcccttccaatctggcaaaggccgcaattttctcagcattcgcgcggaaagcttccctgctgtaggaaatgatgctggagcgcttttggaagtctgtcacatttagcgggcttgaaaatctggctgtaccgttagtcggcaggacatgattagggcctgcaaaataatcgcccaccggctctgaactgtagcggcccaggaaaatggcgcccgcatgtttgatctgtcccagcagcgcatcgggttgaactgttaaaatttccaaatgttcaggagcgagctcattgatgacggaaactgcttcattcatcgtctctgtaacatagatcaggccatagttgtcaatcgactgccgtgcaatctcttttctcggaagatgttcgagctgtctgtaaacctcttttaaaacggattcggcaagcgtctctgaatcggtgacaagaatgctcgatgccatcgcatcgtgttcagcctgtgaaagtagatctgcggcgatttcccggtagtttgccgtactgtcagcgagtatggcgatttcacttggacccgcgatcatatcgatatcaacctggccgaatacttcccgtttagccaaggcgacgtaaatatttccgggtcccgtaattttatcgacgggggtaatcgtttccgttccgtaagccaatgcggcaatcgcttgggcaccgcccattttgtaaatctctgtgacgccaagctccgcagcagcagccagcactcccgccgacaatttaccgtcttttcccggaggtgaggcaaggacaatgcggtcgacgcctgcaacaagcgccggaatgacattcatcagaacggatgatgggtaagcagccgttccgccgggcacatacacccccgctgaatcaagcggcgtaattttttggccgagcatcgttccgtccttgcggtggtaaaaccaagatgttgcgagctgacgctcatgatattctttaatgttgaaaatcgccgcctgaataatctcgagatcacgttcttcgagcgcgctgtatgcttccttgatttcctcttcggaaacgcgaaagccggccacatccgctccgtcaaattgtcttgtgaatgcggaaacagctgcatttccgttctttttcacttcttcgataatgccgcggactgcttttctttgttcctccgttccggcgtcaatagagcgttttagtgaaaccgacgtatttccgctgatggatttgatcttcattttgctttttctccttccacaataagagaaagtcttgaagccatttcatcgatgactgcgtctttcattcgatagctgacaggatttacgattaagcgggatgtgatgtcgcaaattttttcagtttcaactagcccgttttcacgcaaagtctgccctgttgatacgatatcaacgattcggccggcaagcccgatcagcggagcgagttcaatcgacccgttgagcttgatgatttccacttgttctccctgttctctgaagtagcttgatgcgacattcgggtacttggtcgcaacccggggcgcaacggtgtctgccgccgtctcgggcaggccggctacggcaagacggcatttgctgatgtttaaatcaagaacctcatagacatctcgttcttcttctagcaagacatctttgcctgcgattccgacatcggccaccccgtgctcgacatatgttgtgacatccatcggcttagcgaggataaagcgaaggttttcttcaggcacttgaatgatcagctttctcgaatcgtcgaattcttccgggagctgatagcctgcttttcgaagcatatcggccgcttcctcaaatatccgccctttcggcatcgcaatcgtcaattccttacccatgcttctcttcctttctggctccgataaaataggtcacgttttgaaaagactttgtcatttgatcaatatctccgattcccgctaagtcctgcatgacgacttttttgccttttcttcgttcttcttcggcaaatctgattgcctcttttctctgttctgtgctgaagatgacgacatcgatcttttcttgttcttccgccggcttcaatgcttccagcagcctgtcagtcctgatgccgaaaccggttgccggtgcgggtgagtcgaagcggccgagaagctgatcatatctgccgccgtttccgatcggaaagccgacgttttcagcatagatttcaaacaaaacaccggtatagtagctcatatggctgaccatgcctaaatcgagcttaatgtcgtctgtgcaaccataatcgccgagcgtctcccatagcgtttcaagttctaaaaccgcacgttttcctttttcagaatcgacgatggatgccgccctgctgcacgtttcaataccgcccctcagctccaaaagctccagcagcctgcttttatcaattgaggataaattgagggattttacatgctcccgatagccgacatagttcttttcgtataaatagcgccgcaggacatgagccctttcttcattccctaaaacttccacaaacaaggcgtctaaaataccgacatggccgatcgagattttaaatgaagtcaggccggcatttttaagcgaaaaaatgacgagcgcaatcacttctgcgtcagcgcttgtcgatccatcgccgatcagttcaacgccgacttgctcaaattcggcggggcgtcctccttcacgctcctgtgcccggaacacatttgcagcatagcctactctgagcggatgatcgtctttatgaagctttgaggccgccaccctggcgattggagccgtcatatcaggccttaacacgagcgtctgcccctcctgatcaaggagtttaaccgtctgctgatccaatgtggccgactgcgcaccgcccgtgtcattaaattcaagggcaggcgtctccatgaactgatacccccacaaagccatcacctctgttaatgaagagcgcacctttttctttgtttcgtgaagcataggcagcgtatcccgcatgccatgcggtttttcaaacataaacttttacacttgcacccccataaccgtttgaaggaaaattccgaatactttagttcgctaatatgatgatatgctgccagataaaagaatcaaaatcaacagccgctcataaaatagacgcctgcaccgtgtgggaaatgataacttttatgtaatgaacatcttgatgttataatatatatacgatcgcaaatctttgccttaaccaaaccagcaacgggaagacaggagactcagaatgaaatttttcaaaactcttttttttatttttttcgtagcagttcttatgaccgccgttcttatactgttttctaaagatgcgttaagcccgttagccgaaatgttgcacagcagccataaaactgctgctgacaatgcgaataataaaggagagcgtcagccgcttgacgttccgctgatcaaccaaatggacccgccgaagctttataacggctgtgaagtcgccagcctggcgatgatcttaaactacagcggatatagtgtcacaaaaactgaacttgccaatgaggtgaaaagagtgcctctgcaatatgaaaacggcttaaagggaaatcctaacgacggctttgtcggcgatatggaaaacggacccggactgagtgtctaccatggcccgatttacgatttggcccattcatacgcaggtaataaagcggtcgatctgacgggaagtgagccgggaaaaatttatgaacagctgaatcagggcagaccggtttgggtcatcaccactgtacatttcaccccagtcaacgatatggaaacatggaatacaccgtcaggcaaagtcgatgtgacgtacagcgttcacagtgttgccgtgacaggctatgatgaggattacgtttatgtgaatgatccgtacggatataaaaacagaaaaacagacagagaaaattttgaaaaatcatggaaacagatgggcagtcaggcgatcgtgatcgccgcctaaaaaggcagattaatccctgcctttttttagttctttcagcccttattaaattaagccgctttacccttttgataaatccaaaatacagaaaacaacctttctgcacatgtttaatttactgttttttcataatattcaaaatactcgtttacattcagcaagctcgcatatatgatagtaccgaaataggtgtctcattttattacataatgaccagaaatcactttcatttaagggagacacacacctgtttcaaaaatatttcttgaggaggatggaaatgatgaagagattagcaggtacggttattttgtcaggtttgctcgtatgcgggtttggacaggctctgcctgaaaaagctttggccgccgaggtcgttcacaaaacgatcgtagtcgagaaaggccaaacgtatgacggaaaaggcaagcggctgattgcaggtccggagctcggggacggcagccaacgcgaggatcaaaaaccgattttcaaagtggaggatggtgcaacgctcaaaaatgtcgtgcttggcgctcctgctgctgatggtgttcacacatatggaaacgcttccataaacaacgttgtttgggaagatgtcggcgaagatgccttgactgtcaaaagcgaaggaagtgtcacgataaacggaggatcggcccggcttgccgcggacaaaatctttcagattaataaagcgagcacatttaccgtgaaaaattttactgccgatcaaggaggcaaattcattcgccagctcggaggctcgacatttaaagccgtggtcaatattgataactgtacgattacaaacatgaaagaggcgatcttccgaaccgacagcagtacaagttccgttacaatgacaaatacaagatactcaaaagtcggtcagaaatggatcggtgtgaagcatgctacggaaagaaacaatcatgaattttaacactgattgcaaataaaggcccccgctctttattcagcgggggtctccaatcttttttccatttcttcttttgtatagatcagccgcatcggattgccgccgacaaaagcgcccgggggcacatctttatgaacgagcgtaccggcggaaatgacggcgccgtctccgatctcgacgcccgggaggatcgtcgtattggctccgatcatgacttcatcgccgatgatcacctcaccgagccgatattcttttattaaatactcgtgcgccaaaatggtcgtattatagccgattacggtgtttcgcccgactgagattttttcgggaaacatgatatccggcatgaccattaaagcaaacgagcatttctctccgattttcatccgcaaaaacgtccggtacatccagtttttcattccaagaatcggcgtatagcgcgccgcctgaatgacaataaagtttttgactactttaaaaaacggaaccgtctgatagatgtgccataaggaattggcgccggacaccgggtagcgcttcgtttttctcaaactttctccaccccaagaatgtgaaggaggtcgctcatttgctgaagcataaaatcaggctcgtgtttggccaggctttcttctcccttaatcgtccatgcaacgcctgctgttttcgttccagcattcttcccggctaaaatatcgtggtaattatcaccgatcataatggcttcttccggacggctgccaagcttggaaagggcgagcaaaacaggctcggggtcaggcttcggccgctcgacgtcatccagcgtcacaaccgtctcgaaaaaggcatcaagcccagtcagtttaagccccatgatgacggtgtcccgcagctttgtcgtgacgatgccgagcttatagccttcttccgcaaggcgttcaagcgtctcgtaaaccgtctcatactcggttaccagttcatcatgcatctgatgattaaatgtccggtacatggtgatcatttcttcagccttatccttttgaatgcttgagaacgtttcataaagggaaggtccgatgaaagcaagaacatcctcccgtttatagcgtcccggtgcataatgatcgagcgtatgcaaaaatgaggcgataatcagctcatttgtattgatgagcgttccatccaaatcaaataaaaccgtattaactttcatacaaagcttcctttctgcgaacggaataacccggctttctccagaagcgcgaaatcgcgatcgtcagcagaaccgcggtcgcaagcctgatcaacaaaagaggccagaccggaatgccgagcgggataaataccaatgtatcttcaacaaccgcgtggcaggcgacgagaaaaataaaagcaagcgtgacatcccttttgctgacgccgtcttcttcgaccgctttgatcataacgccggccccgtatgcaaggccgatcgtcagcccggcaaccattgtcattgaggtgttctctttcattccaagcattctcgttatcggtgcaaaccactttgaaaaagcattcagccagccgaggtctctcatatattgaatgatgatcatcagcggtattacgatggctgcaagctgaaggacaccaagacccgccttggtcacggcttctagcgcaatgtcaaaccagccggaaggagcggcgcttttcgctgagattaagccgtatttggccgcatcctgcccgccatgccagacaaggttgatgataatggccgaaaaaacagcgagaccgatgcgcacgagcaaaatcagccatattttgattccgacccttgaagcaacagtcgactcgataatcaagttgtggcaaaacgacagcataaccgctaaaataaacacttctttaacggtcaaatcaagcgttaaaattcccgcaattccggcatacaagttcagcatgttgccgagcacaagcggtatcgccgcttcccctgacaacccgaaaatccccatcgccggcgtgatcagtttgatcaaccagtccatcaccggtgtatgctgaagaaggctgacaatcagcgtgacaggaaaaatcacttttccaagcgtccacgttgttttcagccccgccacagcgccggcttttaaagttcccttcattgttgtcctccccttagtaaagtcgctacatctcctgataccgtttaatctctctgcctttgaaacgtctgtaggctatcagcgcagctgcacagaggatcagtacgatcgaaataacctgtgcgatgcgaagattctccgtcagcatcagactgtccgttctaaggccttcgataaagtagcgtcccatcgaataccaaataacgtagattaagaacagttcgcctctctttaaattcgcttttcttaaaagaagcagaacaacgactcccgtaaagctccacagcgattcatacaaaaaggtaggctggtagtattgtccgtcaatatacatttgattgatgataaaatcaggcaggtggaggttttctaaaaacgctcttgagaccgcctcaccgtgcgcttcctggttcataaagtttccccagcgtccgatcgcctgaccaagcagaatgcttggagcagcgatatcagccagcttccaaaacgaaagccccttgactttcgcataaatgattcccgtcagcacggcgccgatcagtccgccatgaatcgcaaggccgccgttccatatttgaataatctggtcaggatgttcactgtaataaccccattgaaaaatgacataatatgctcttgcacataaaatggcaatcggaatcgcaaaaagcaccaaatcgacaaaggtgtctttatgcagtcccctccgttcgccttccctgactgccagccacaaaccgagcaaagcgccaaggccgatgataataccgtaccaatggacagcgatcggccccagttgaaaagcaatcggatttaatggttcaatcgtttcattcatattgtcagctcctattcttcaagctcaccatcttcaattacatccgcaagcttatgggtaaattgctccgcggcattcagccccattctcttcagtctgaagttcattgcggccacttcgatgatgacggcaaggtttcttcccggacgaaccggaattgtcagctttggaacgtctgtatcaataattttcattgtttcttcttcaagccctaagcggtcgtactgctttccttgctcccaaagctccaggctcatgacaagggtaattcgtttaaagcttctgaccgcccccgcgccaaataacgtcatgacattgataatgccaagacctctgatttccaggagatgctcaattaattcaggcgcgcttccgatcaatgtatcctggtcttcctgtctgatctcaacgcagtcatccgccacaaggcgatggcctcttttgacaagctccaaagccgtttcgctttttccaaccccgctctttccgataatgagcaccccgacgccgtaaacgtcgacgaggacgccgtgaatcgcagttgtcggagccagctggctttcaagaaaattcgtcagacggctcgtcaggcgcgtcgtctttaatggggaacgaagcacaggcacgccgttttcttcggatgcctccacgagttcaggcggaatcggcaaatcacgggaaaggatgatagccggtgtaatttccgtgcataacgacagcatccgctgctttttttcctcctctggaagcttttcaaaaaaggtaatctcagtcttccccagcagctgaaccctctcttttggatagtatgtaaaataaccagccatttcaaggcccggtcttgataaatcgctcatcgtaatcgggcggttgatcccttcttctccgctgatgagctcaagcttaaatttatccatcacatcttttgttcgaactttcggcacgattgatgcaccctcctcttctcagatgaagaactagacattcagctttattctatcactttcaaaatgaacctaaaacattttttgaaaatggcccccttgacacttcgatgaagtgctttctttcaaagcgaaaaatcagtagtatgtaaagaggaacgcgaaaaggaagtgaagaaccgttgaaatacaatattcatgatacaaccgtgctgaacgaagacattttgacaccggaagaaaaagagacatgggttctttatatgaaagtactgactgctgccggcttgggggatgtctccgaatggatgaagctcgatctcagcatgccgcaaatgaaggttttaatgcttctgaacaaccacggcacactgaaagtctcagaaatcgccgaaaaaatgggagcttccctttcgaatatgaccggactgctcagccgccttgaacaggcgaactttatcaaaagaacacattccgagcaagaccggcgaacgattgtggttgaattaaccgaagatgcgaaggggatttttcggagcctttacaaaaaagggcatgaaaagctcaaaagagcgcttcagaagctgaatgaacaggaaaaaaacaaagtgaatgaaggccttacaattcttgaaaaagcgttaaaagccgatgatgaatagacaagctgcccggaaaccggtgcagctttttttgttgaaaaatttcttttgacaaaacgtgcttttttaaggatgataaaaataattcattcaaagtgaattattcattcgaagttaatgaaaaaggaggatacgtggcgtgaaccaaaagtgggctgtattattgtttacgatcggcgtgtttatggctgctttagacaacggcatcatttcagcggcactgacgacaatcaatgattcttttcaagtatccccctcatggggagcatggggcatcacgctttatacgctcggtttggcagtcagcgttccgatcgtcggaaagctgtctgaccggtatggacgcaaaaagctgtttatcatcgaagtcttgctgtttggcgccggttcgctgctcgttgcattgagccaaaacttcccgatgttcttgttggcgaggctgattcaatcgcttggcggaggcggaatctttattatcgggagctcgcatattctcactgcgctgcctaaagaaaaacagggaaccgccttggggcttttaggtgcgatgaacggaatcgcggcagtgctcggtccgaatatcggcagctttattttggatatgaccggaagctggcactggctgtttttgatcaaccttccgattgccgcagcactgatcatcctcagcgttccattgatgaaggagacaaaaggcggaacacgaaaacccctagatctggccggaactgtgatattgtctcttgcgattttagctgtgatgtacggaataacgaatataaacggacagcgcctgtctgccgtcttgtccgatccaaaggtttacttttttctcctgatcggctgcgcgctgtttgcgggactcattttttacgaaaagcgcgtagagctgaagggaggcgacccgatccttgcctacagtttattaaaaaacaaggtgtttcaatggacgctttttatcggatttttatccggcggactcttggcagccgttatttttattcctgcatatgcggaacaatatttgcacgtcgctcctgaaaaagcggggtattggatgacgcctcttgcgctggcttcagggataggagccgggctcggcggaatgctcgccgatcgaaaaggaccggtaaaggcggcccggctctctggcgtcatttcgttcgccgggtttttgctcttgtcctcctgggtgacagagaagtgggaatttgttttggcaagcatcatcgcaggggtcggttttggctttctgttaggcgcgccgttaaatatgcttgtatccgaggcggcaaaacaggattacgggacagcgctcggtacattatcgctcgtcaggcagatggggatgaccttggcgcccgcgctgtatgcaggatatataacggccggctacgaaaatatcggcacacatatcaaacataagctgaatgatgcagggatcactctgaaggggtttgcaggcggtgagacggacgtatcaaggctgagcgaatccctcagccaaatttccgacccaaaagtaaaagacatcataagcgaagcgatccatgaaagtgtgggagcggggttttttaacctctacttcacagccgccgtcctttcacttgcagtcattgcttctgtcagcgttttatcgctttataggaaaaaacaaaccgacacggcaagccgtctaaaaaaagacgtgacaaactaaaaagcatttgctccctcttaggaaaacaaatgctttttgcgttcgcaaaggaaaaccgccgccagccacaagctgatttcagcaattgggaggtttgtccctttctttaaaatcatcccggccggcggggggctccccgacaattgcctcagggccgagcccgccccggctgtttgatctattaaaaaggatttcatgccatcgtcttttgtcgtcaatctccacatttgagacctgctgttgccgccgtattgatctgaagctgcggcgtaccagaaataggttgtattcggctgcaaatctttccacgtcacggaagccgtctttccgcttttcaccgtttttgctttcccaatttccttgttcgaaaagacattcagctcaaaataatcggttttaacctttttcttcctcggtttcagatccgttttaatgttgaactcgtccttcgggccaaattggtgcggatcataaaagttatagtcatcaagatatggcgaatacgttttgacatggatcgtgtcatgcttcggatccacatggagaattcttaaataaccttggcctccttcaggaccgccctgatagtcggcaagcatttgataaaccttgcgatccggcttgccgtccccgttatcatcaagcttgtcgacttttaagttggagctgtgatagtgaccgctcaatacggcaatcacattcggattccgcttgatgatctgttcaaatattttctccccgattggacttctgcttccgctgacaagcaaaaactcgtgaaatgccaaaatcgcttttcgatcgggatggcgtttcagaacatcatctatccactgcagttctttttttccgattccccaccccatcgacaccatgatatagtcgttgcccccgctggaaatgaggtcgtaatgccctttgttattctgataagacccgccgtaatgcggtttttgtttaaaacgcctctccccgaagtacctgccgaatttcaaatatgaccggtctttatggctgacatcgtgattgcccgccagcacgccgtatggaacttgattgtcgtcgagaactttcatgaactggtcggcgcgcttccattgcagcggctgatccgcttcatccacaagatcccccgtatgaaagacgtactgaatgttcagcttgtccttttgttccgcgatccacttgacctgacgttcaaaaatgtgcggatagctttccgaataatattgcgtatcagacatccacacaaatgtatagtcattttgcgaaagctgaatttgatcctgaatgatgatgctcgccttggattggcggatataatcggcggcttttatgcttcctttgagggtaaaaggtttgccatcctttgcaacatggaatgcaagcgtctcccacctcttgctggcccagttccaggcgaacatggagacttttctgccgggaagcgaactcccgcgccacagcacttccaccttgtcgttcggccccgtattttcatccacttttacatcaaagcgatggtacggaaactttgttgttgatgaggtttcaaaaccttttccgtcaagtgcggacatgccgctgcgctcttcttttgtcagcgccttttcccccctgaccgcaaagctttgcggaggttccgtcccgctttcgttcgctgacacatcaacatgctcttcgtcttttactgtgtactgaaatccctgatggaatgacactttcatcttatcttttgtcgggtccttgacgcggacggcgagcttagcatgtgtgctgccgggtgtatttttgacccgagcgggcttgtccggcttttcctctttaatgtaaaatgccttttttacgattgacaggttgccggcgctgtcctccgcttttattttcaactcgtgctttcccgcatccaggcgggcagaagatacgagatagggaagcgcaatctttttgccgtcaagaaaggcttttatgcttttcatcccgctccatttatcgtgtgcggccgcattgatctcaaacgaccctttatacgtcctgccgtcttttaatgacgttttgatctcaggacctgtgttatcgaccgttaccctgcggatgagcctttcttcgccattctccgcttcaacgatgtgctgcccttcgttccaggcgcgtgtatgccattgactcgcaagcgatgcaaacttggcttccggaatcgtaaaacggaattcataccattcatgcgccccagggccgtcaccggccggaagctcggctttcggatcgtcgtatcgctcatcgcggatgatggtcccatccgcgagtatgaggcgggggttcttgaggacaaaatcatccctgttttcttctgcagtttgttcaaatggtgttgatttcgtgcctgaacgaactttaatcgaaaacggctttccttttttaaattcatccggagaaaccgggaccgtaattgtcgcataccggcggcgcgaatcgtcaaaaactttttgaactctcctgccgatcgttacagcatttttaaaatacagattcgtttgattgacatcgaaagcaaagtaggcttttttttcaagcgccggttcaccttctttttgttcaatcccgtcaatacgaattgtcgtttcagaaggcggcttttctgatgtggctttcaacagcatttttccggaaacggttccgccttcgcttacattcagcctgagtcccttcaaaatgcgctgttcgagcggtatcgttttcttttcagtcgacgaaacatttgatccatcaccggcccgcatatagtactccactttttctttgccaatgagttcggcaaaatagatattgtggcggtacaggccgtcattgcggcttttttcaacacggacttcggtaaaccgctcatcatcattcatgcggtagaaaaactgcgcctgcttcacttgccgattgtctttcatatcagctaagagctggatcgtttcacccggttttacagcttgatgatccgtcatatcatggatctccggcttttctctgtccggcataaccgtcaccgtctgtgaaggtgcctgcgtcttcagaagcgaaccaggcgacggtttttcttccccggccgatatgattttcatatgcttcgttccgtccagcggatatcgatacagaagcgctttatttttggcgacatcggttttatccggctcgctttgataacgggcggatgcgacctcttctccgctgtttgtgcagatgatcacctctctcggcgccgtattctccatgccgccccctttgagagcagtaagcgttttgccttcacgaaggtgaacaccgtaataccgattgaaatcactttccgtcagatgaccgtttgagcggtttttcacccaaaacacgtgtgtttgaccggaaggaatcgccacatcatcgtgctcaaaaggccagatgacgtctgattccttgcccttttcaggatgtctgtacttgattttgtagctgttcagatgaacagctttattggtattgttataaacttcaataaattcatagccgtcctttccaccggtgtttgacgtgtcgactaccatttccgtgatcaacagctccggaagcttttgtgtatctgtacgcatgcctttcagggcgacagtatacacatccgtcttcacagaggagtcgccgacttgagcttcaatgtagtactggactttgccggatgctatggattcgctttccaatttggcaatataggcgttctgtctgcccggctcaacttccatcggaatcgcccgatacggcaattcgtcatgctgcttgtaatataaaatgaccgtgtcggcggccgcctgcgcggaaaaatatatgtcatctcctttttgaacttgttcaacaggagtatgcctgataaccggtgaaccaggctgaatatgctcttcacccgatgcggacgaaatcgggatctgcaaggcaaaaagtaaaactgcggccaacaataaaagggtttggcgatttctgtactttttcatcgtctacctccctttcgtattttgcctttacagatcatttttatgaaagagacatccgggcaaaaaaaagaagcctgatgattcatcagacttcaacttattttctggacatcggttcgataattgctttttgaatgagcaagtgaaaaaccgacaggacgatcgacgcaaaaatggctgtcccaaagccgtccaggtcaaaactgtcccccataatggacgcggtcatataaagagtgatcgcattgatgataaacaaaaataaacctagcgtaattactgtgacgggcagcgtcaaaatcaccagcacgggcttcacaaacatatttaagatggataaaatcaagcttgccgtaatggctgctccgatgcttctgacgtgaaccgcatcaaagtaaccggcaatgacaattaataataaggcattgacaagaacgtttataatccatctcatcatctgttgacgtctccttcattcggcacaaggaatacccagacaatataaatcagcaggacgggaactccggtcgaaaatataaataatagaaccgtaatgattctcagcaatgacgcatccatatttaaatattcagcaagacctccgacgaccccggcaatctttctgtctgtttcggatcgaaatagccttttcattgtatcactcctgtgtatggtttaaatggatcgatcctgtcttcgattccaaaaacacggtcatgctatgatcatgattttgatttgcttttaggtacatttccttctggattgtctcgtttttttcctttaaaatttctgcatctgaaagatcatgagacagagaaccgagattgcttttcagctccgctgtaacagcgcagtcccggggaacattcaactctacgcttccagtcgttgttttcacatatgccgtccggcagtgcggatttttgactgttgccgcgatattgccgttaaagctctgcaggtcaagcgcctcgcatgaacctttaaggtcgatcaatccattgatggtttccgcttcaatctctccgcaagtatggtcggctagtttgatttgtccatttgcagtttccaatgaagcttttcctgccgtgagagcagagaacgacagcacgccgttcgtcgttttggcggacagctcttttacgtttaaatgttcccctctgaccgggccgttaaacagtttaaagcggattttgccgtactctttgtccggtatatagacggtaaggttggtcttcatcgtttttttctcggtacggatcatgaacttatcgccttccacaccgcagtcgatatgctggagaaaagcctgccttgcttcatcctgattttcagcccggtacacttttgcctggcattcgactctgatgtcggaatcgctccatggtacaaggttgacgctgccgttggcaagctgaatatccagagtcgaaaaatcagtgtctttaaactggaatatatgctggacatcgtacgagtgcccgaaattcaaatccaagtctgcttcttttactttttttacagcggtatcaatccattcgaacagttttgaaccgatcgaaggcttcggttcttttttcttttcgctgtagaagtcctccgaatcaatgacatcctcagacagggctgtcaccttgctctcggtttccttgtagtcttcttcaagtttttcgatcaggatcagcgcctcttttgcagacagctttccttcctcgaccaattttaaaattcgttctttctcatgcttcatgaaaagctcccccgttctccttcttttaggcctgagtcagcattttaatcccttgaactacgttccagaccacaataatcaaactgatgatcccgaaaaaaacgaaacctccgatcatgaaaatgaccgccaaataaccgccgtcaccaaagataagcgtaccgcttatcgcgcctgctgccaatatgactacgcttataaacggaataatatgcgaaataagcgaacgcatcgcatgctttttcgtttcttgatcatctgttataaaatacgctgcgattggcaaaataagcggggcaaaaaaaacactaaaataacaaattgaagaaatcagcgcgttgtttctcgtcatacataacactccttatgatgtaaaccgttctttgtgagtctaatgtacagtgaccttatacttagtttacgtgtatcatggcctttaggtttcattttcattcgatcggcgtgcgtcaaacttcgcaaatttatttttttagattttatgaatagattctttttttataaccctttaaaatatgtggcaaagccaatgaaaaggagcgagcgttatgaaacagaaatcggaagtatacgcctcatccgcctcccagcttcttagtctgattcaggaacaaaaaaggatgaatcaggagatcgtgaaccgattggaatcgatcaattccgctcctccgctttccagcgaaatccgctatttaaaggttctgctgaacagcagcagcacccatattttaaacagtatgagtgaagcgaccaaacacatcagccggactgaacgttaaccgttttcatgatatttcaaccagatttccgtcgggatctctgatataaaccgaaacgaccggcccttcagcgcccattcgctctgcggggccttcttcaattttaatggacagcccctccagatgacgaatcacatcatcaatgccggcatttgtatgaaacacaggtctgcggagccgggcatcgggtgctgtgccttcggctcaaactattttccggcttcgtggaggtttattttttgcctgccgaatgtcgcgcttttcttccttctcgaaaagtgaccgcattcaaccccggcacacggctgtaaaaatcacatgtcgcatcaatgtcttttacagtcagtaccaaatgatccatgcgatcgatcttcatcaccccatccccctttattgtttgtttttttacgttataacagctattgaataaaagagcaatgaaaatctttttgaacaaagcttgccgcggatcattcggccattgaaaaagctgccgacgtgacatcggcagctttttctttacggtctgacagcttctttttcttgaagccgcttcttcattctgtttttgtcgcgttcaatgatcggttttaaataacggccggtatatgacccttcgactttcacgacttcttcgggaggtccggcagccacgatcattcccccgccgtctccgccttcaggacccaagtcgatcaaataatcagccgcttttataatatctagattgtgttcgattacaagcactgtatctccattgtcgaccaggcgctgcagaacggccaaaagccttgcgatatcatcgacgtgcagtcctgtcgtcggctcgtccaaaatataaagggatcttcccgttgaacggcggtgaagttcagatgccaatttgacccgctgcgcttctcccccggaaagcgttgtagccggctgtccgagcgtaatatagccaagaccgacatcatagagggtctgcagcttgcgcttgattttcgggatgttctcaaaaaattgaacggcattctcgaccgtcatctcaagcacgtcagagatatttttgcctttgtacgtaacctgaagcgtttcacggttgtatctctttccgtggcaaacctcacaaggaacgtatacatcgggcaggaagtgcatctcgattttaatgattccgtcgcctttgcaggcctcacagcgtccgcctttgacgttaaagctgaagcgccctttcttgtatcctctgactttcgcttcattcgtctgggcaaacacgtcgcggatgtcatcgaacacgccggtatatgtggccggatttgacctcggcgtccggccgatcggagactggtcaatatcgatcactttatcgaggtgctcgattccttttatttctttgtattctcccggtttcgtcttagcccgatgcagcttctgagccagcgttttgtggagaatttcattaacgagcgtgcttttccctgatcccgataccccggtaacagctgtgaacacgccgagcggaaatttcacggaaacatttttcaagttgttttcctttgccccttttacctcgataaagcggttgtcaggctttcttctctcggcaggaagaggaatgaattttttccctgaaagatattgccctgtcagagattgatcatcgttcatcacttcttccggcgttccggcggagattacttctcccccgtgtacacccgcgccgggcccgatatcgattaaataatcggcggcaagcattgtatcctcgtcatgctcgacgacgatcaatgtgtttccgatatccctcatgtttttgagcgtctcaatcaggcggtcgttatcgcgttgatgaagaccgattgacggctcatcaaggatgtaaaggacaccggtcagccttgagccgatttgcgttgcaagcctgatccgctgcgcttctccccccgacagagtgccggctgcgcggctgagcgtcaaatagtcaagcccgacattgttcaagaatccgagcctttcttcaatctcccgcaaaatgaggttggcgatcttcatgtctttttctgaaagatcaagttcacggaaaaattgaagggcgttagctaccgacatttcggttatcttaccgatgtgaaggccgttaatcagcacggcgagggattcctttttcagacggtagcctttgcatgaagggcacggctgattagccatatatttttccatcagttcacgaacataatccgagctggtttctttatagcgcctttcgatattgcggatgacgccttcgaactcaatgtagttttcccggacttgtccgaagtcgttttcatatctgaaataaatctgctcgcctccgctgccgtagaggattttctcaaggtggtgcttcggcaggtctctgaccggaatatccatatcgattccatagtggctgcataccgcttcaagcagcttcggataatattgggagctctgcggttcccaaggtgcaatcgcattctcctttagagacagctcatcgtttggaatgacgagctctacatcgacttccagcttggacccgaggccgtcgcagctcggacatgcgccgaacgggctgttgaaagaaaacatcctcggctccagttccccaattgaaaaaccgcagtgcggacaggcatggtgctcgctgaacagcagctcttcctgcccgatcacgtcgatgatcacacggccttcgccgaggcggagcgccgtttcgagcgagtctgtgagacgggcggttacgccttcttttatgacgatgcggtcgacgacgacttcgatcgaatgctttttattcttttcgagctcgatgtcctctgagaggtcgttcatttcgccgtcgatccggactctcacatagccttgttttctgatttgttcgagcactttcacgtgcgatccttttcttcccgagacgatcggcgcaagcacctggatcttcgtccgctcgggataatccaaaattctgtccgtcatctgttcgatcgtttgcgaggtaatttcaatgccgtgaacagggcaaaccggctttccgattctggcaaacagcagccggagataatcgtagatttccgtcaccgttccgactgtcgaccgggggttccggctcgttgttttctgatcgatgctgatcgccggcgacaggccttcaatcgcatcgacgtcgggtttgtccatctgtcctaaaaactggcgggcatatgcggagagagactcgacatagcgccgctgcccctctgcatatatcgtatcgaacgcaagggatgatttccctgatcccgaaagacctgtcaaaacgacaagctgatccctcggaatagagacatcgatatttttcaggttatgggcccttgcacctttcacctcaattcgtttcgttgccattttctattcatccttccgattttaactctaggagcaagtcgcgaagctcggcggcgcgttcaaagtcaagcgcttttgccgcttccttcatgtcgctttccatttgagcgatcactttttcccgctctttcttcgtcatcttcgaaagcttcggctcctctttcacttgatattcttcctggtcttcagcagcatgagttgcccggatgacgtccctgatctttttgttgatcgttttcggcgtaatgccgtgtttctcattataagcctcctgctgttcgcggcggcgcttcgtttcattgattgcgatttccatcgagttggtgattttgtcggcatacatgattacgcggccttcggcatttctggcggcgcggccgatcgtttggatgagcgagcgttcggaccgcaaaaagccttctttgtctgcgtcaagaatggcgacgagtgaaacctcaggaatatcgagtccttccctcagcaggttgatgccgacgagaacgtcatgcttgccgaggcgaaggtcgcgtatgatctcgatccgctccagcgttttaatctctgaatgcaggtacgtgaccttgataccgatttccttcagataatccgtcaaatcctcggacatttttttcgtcagcgtcgtgacgaggacgcgttcattccgctcgattctctgctggatttcaccgatcagatcatcgatctgcccttcaatcggccttacctcaataatcggatcgagcagccctgtcggccggatgatctgctctaccatttcaggcgtatgctcaagttcataaggccccggcgtagccgacacatacacgatgttgtgaatgtgcttttcaaactcttcaaacctgagcggacggttatccaaagcggaaggcagcctgaatccatgatcgacgagaacctgttttctcgcctggtctccgttgtacattcctctgatctgcggtatggtgacatgcgactcatctatgaccatcaggaaatcatccggaaagtaatcgagcagcgtatatggagtcgaacctgccggacgaagcgtcaaatgtcttgaatagttttcgatgcccgagcaaaagcccatttcgcgcatcatttccaaatcgtatctcgtccgctgttccagacgctgcgcttcaaggagcttgccttcttcacgaagcgctttgaggcgctcttccagctcctcttcaatgtttatgatcgctttcttcatcttttcttcccgggtgacgaagtgggaagccgggaagatcgcgacgtgttccctctcccctaaaatttcgccagtcagggcatccacttccctgatccgttcgatttcgtccccgaaaaattcaactcggacgcagtgctcatcccttgaagccggaaagatctcgacgacatcgccgcgcaccctgaatgttccgcgctgaaaatcgatgtcattccgcgcatattggatgtcaacgagctttctgagcagctcattccgctcgatttccatttccgttctgagcgagagcaccatttccctgtattcctcaggagaacccaagccgtaaatacaagagacactcgccacaatgatgacatctttgcgttcaaaaagagcagacgtggcagagtgccttaatttatcaatctcatcgttaatgctggcatctttttcgataaatgtatcagtctggggcacgtaggcctcaggctggtaatagtcataatagctgacaaaatattcgactgcgttgttggggaaaaattctttaaactcgctgtaaagctgcccggctaacgttttgttgtgggcgatgacgagagtcggtttgttgacctctttaatcacgttcgacatcgtaaacgtctttccagtaccggttgcccccaaaagcgtctgatgctttctgccttcattgattcctttgacaagctgatcaatcgctttcggctgatccccctggggctgataattcgagactaattcaaagcggtctttcacataaaagcctccgtttctttacgaaatcttcctgtttattattttaacacacccgaagcaaaaatacgaactaaagttcggtttttgtgttttcccacaaaagccggcgatttctgatctatcaaaaaacccctcctttttgtcatcaaaagcagggcttcacggcaatcaatcttacggtttctatgagtcttccttcttttcgcccgccttttttgccgcatagagcgaaccggcgacgagcgaggcgatatcaagtcctacaataaaaaaggtttccgtataaccttttaaatatgaagcgaacaacagcgctgcagtgagcgcaattccgacgtaatggttataggtcacccttgtaaaaaacaagacaagaataaaaggaaatatcagtgcaaaaacggcttttgtaaacacaaaaaccctcctcacgtttcttgatcttattcgattatattaaagaacaaagaaacggacaaacatggacactcattcattttgtccatcatcttgccgcgttattcggaatcggacgttaaaaggcgaaaaagaacgatattccggcggccaggaggtttggcatggcgaaaatggcgagagcgtttgccagcttgctgttccactccccgtgctctttcgtttctgcatcgtgatttcccctgaaccggtcaccgctgacaaatacgcccgaacataaagcagacaacagaatcgcgcctaggccggctgctcccgaaactttgaaaatcagcgtccaatccccggccgcagccgaaaccaatacagctattaaacaaacgaaagcacctgcgagaaaagcccttttcatcaatcattctccttcaatgagttctatccatcatcctagcggaacgttttgtaaaagacaaccaaaaagtttcgaaacaaggcaaaagcaaaagcgcctgaaagcggcgcttttttaacatcggttattctgtttctgctgaggctgctgcctcggcatgcttcatcaccgcatcctcttcttttacaaagatgatgccgagctcatgatgctccccttcataagaagctctttgttcaaaacgaatctcattgtttaaaccgacgacttcaagcttgaagaaagccctgttcttttggagcgcttcgtagaagtccgccgcatttttcacttcaatcccgttgaccttcgtgatgatttcgccgatcttgagaccgagatcggctgccggcgtgttcggaataatcccgagcaccatcaagccctggtctctctttgaaaaatggaaaggggcggaattgtcgttcatccgctgcttccaggataaaaaggcccttcctgcgatcgctgctccggcggcaagggcggcaagcggagtccaccatatgcttccggccgcgatcagcagaatgatgatgccaagcacgctgatgcgcttcgctgtaattttaatgctttcaatcggaagcgatccttgaaccctttggccgaagccgatgaaatacggaatccacaagagctcaaagccgccgttaaatgacaaaacaggccaccacggaacagatgattcgatcgcatgtcccggaataagaataaacaacggcagaagccaggttctgcccgcaatctgctgtccgatcgggagaccccttgtgctcatgacaatcgcaggggacgttttgatatgtgccgttttatagacaagcactccttccgccaccaacagaagtccgagcaagacggcagcagccgaccaattcgcgagggacagctgcggcagaaacgcgtcaagcgctccgaaaccggtgtattcaatacataaaccaacgacgatgctcacgccaagcgtatatgccgctgacagcagactctgtctgaaagttaaagctgcggcaacgctgaccgccgctattaaaaccagcatgcccatcgggagatacagccccaagccgaacgaaacaatggacagtacaagtcctgccagaagtcccttggaatatgtaaatttgaactcgtcataaatatcttcaatacgcgtatggaacgtctttctttcacgtttgatccgggcatagccgtaagcaagactcataatcatcataaaatagaagagcgggtgcaaaaagaacaatcctgctccttttaaaagttcaattaagctttcttcaactgacaagggaacgttcaccgcctcagccaagcatttcaggccgccttcaacacggcagctttttaacgttggatattttaaggaaacccagcttgtctaaagcgtcggcacgaggaaatgacgggcggccgttcaggcgggatgcctgagccgtcagccgcagaaactttcgtcatgatgcttaaacgccggtgcttttcatgcgcattcgtgacgacaaatgctggcacctttaggcaagctggtgcattttattattattctaacaaataataaaatgcttgggtatggtaaacgtgaggtttatttctcctggctcatccaaagcgtcacattcgacaaagaaaaatctttcaggtaatgattgacctcgacatcaagaatatctcctatcagctgcattgaccgcttgatgtcggtcagattgatgccgagccgcttgtggttgtccatcaagtagttgaaataaagttccgcgcaatcctcattaatatcttccacactttcgaccgaagtgtagttcacgaggtatctgctgaacagcataagcaatcctactgcctttgtagcggaaaacgtaacgtcttgtgatcgaacttttaactgctccactaattcatagtattttttctctctcacaatacttgcccttttcaatcgtgtacccccatttattatttatatataagaaaagcgcaagcgtcagacgactccaccaacagagacgaagaacgcaaacagcgctaacattctccgcaaaaaaaatgcacacattataattcttgaaaaagctttggttctattttaaaaagttttcctatgttatacaacttgcaaaagttacatttttactgcatctttacatccttataaagtctcccatatacttatgttatcgggtcaattctattcattatgaatgttttttttatgaaaaagcaaaaattttaggtaaaaagattgagaatttactttctgagaataaaaaaagtgaggacatcccgtgccctcactttttgttaaacagcacttttaatgcggcttgcagctgaagatcgttcttttcatccatctttttctcctcaatccgcaggttcattgtatttgccgttttttggtcaatgatccctgtttgcttcagcttgtttgctgcctgaaacgccatgacggctttttttgtgctttcattgtaatagccgtcttcccggccggggacaaacccgagtcctttcagcaggaactgcgcccgcttaatttcattgttgttcatatccggcttgaggggttctttcagctgtaaaggccccgccgagaaatatgcaggctgcgtgactggaacggtcggctgaatgccctgcttatggatccaatttcctttaggtgtcagccatttgtacagcgtcagcttaatattgctaccgtctcccatcggcaccgcctgctggacggttccctttccaaaggaaggatcgccaaccacgtcgtagccctcggcttcttttaatgcgcctgcaagaatttccgaagccgaagcgctgcccttgtccgtgatcacgctcacagggtatggttttttctcttttaattttgagaagtattgttttttatttccgtttctttcggcgatttgtatatacggatgatcttttgtcacaaaatgttttaaaatgtcttccacgctttgcaagtacccgcccggatttcctcttacatccaaaacgagcccttttattccctttttctcaagctttttcagttcagcagtaaaatcttttgccgtatgttcggaaaaggaagatattgcgatatagccgacaggtttatcctgtactttctttatggaagcaaacaccgtttccagcgggatttcatcgcgcttaatcgtaaatgtcagctggtctttcattccgggtcggtgaactttcagtgtaaccgtcgatccctttttgcctctgatctttaatacggcgtcattcaaatccattccgctcatggaatcgccgtcgatgctaatgatttcatcgttcggctttaatccggctttctctgccggagactgtttaaaaggagaaacgataatgatttttctgtcttccattccgatttctgcaccgattccttcaaaagaggaatcaagggaatctgaaaaccgctttgccgtctgtttatccatatagaccgagtatgggtcattcaatgttgaaagcatgccctgtatggctccttccaacagtttttccctgtcgacctgctccacatattcatttgaaatcaggtcatatgctttctcaattttctccaattcgtttctagcggtgcttttggctgcagcttcttcagccgctgatgcttttgaaacgacatcatgtaacggaatcgggccggcgcctgttaccaagccgcataacaggctgagcgcaatgatgagccgcacaatcttctgattcatcctatacctcctcttctgcctgcactatgttttgttgcttgatgtagtatgcgccaaaaccgcccgtatcatgtaatcgattttccattccacagcaaaaaaagctgccggagtgctggcagctttcgcttatatggtcctcacgcgcttgatgatttcttctgtcacatcatccgtcgtacttgaaccgccgatatcaggcgttaagtagccgctctttagaacgtcttcaatcacgtcaagcaatcttgcaccgagttcttcttccccgaaatgatcgagcatcatttttgccgtccaaatttggccgatcggattggcgattccttttccgatgatgtccggagcagagccgtgcacaggctcaaacatagatggatatttgccgtttacattaatgttggcggccggcgccacacctatgcttcccataatcgccgccccgatatcggtcaaaatatcgccgaataaattgctggcaacaatgacgtcaagcttctctggcctcgttacaaaaaaggccgacagcgcgtcaatgtgctgcgaatctgcggtaatatcggggtagtcttttgccgtgttctcaaagacttcatcccaaaaaggcattgaataaacgattccgttcgactttgttgcgcttgtgacatgctttttccgcttagccgccaactcaaaagcaaagcgcatcgccctctccgccccttttcttgaaaaaacggcattttgaatggcgatttcatcttcatccctgaagattctgcctccgatcgagctgtattccccttcactgttttccctgacgacaagcagatcgaaatcttttgggttggccagcggagacttgattccttgcaaatatttcgcaggtctaatgttgatgacctgttcaaattcgcggcggattttaatgagcagcccccacagggaaatatggtcggggacaagcttgctgtttcctacagccccaagaaagatgctgtcgaactctttcagctgctccaagccgtcatcaggcatcatttccccgtgttccaaataatactcacagctgtatggaaactccgtaaaccgaaatgagagtcccccgtgaacatccgaaaccgctttcaaaactcgttgtgcagcaggtacgacttctttccctaccccgtcaccgggtatgctggcaatgttgaatactttcattggatcatcccctatttcaaattgtcgactgtcgacagttgtcactttcattgtatacaaaaaaaattttctgacaagaataaattttgagaaaaacccagtttgaataacaaaaagccgattcagtccatctccggacgaatcggctttcattttaaagcggtatataattggccggatcaacagcattggatttcgcgttgttccaaaggcctttatgaatttcaaagtgaagatgctgcccgtaggattggcctgtatttcccatcgttccgatcacttgtccctgttcaacacgctggcctgtctgcactttaattgaagacatgtgagcgtagaccgtctgatatgtttgcccgttgatgttatgggtaataaacacaacattgccgtagctggacgagtaatgggcgttatagaccgttccggcggcggccgcataaatcggaacgcctgaaccgcgcttggcgatgtctacgccgaagtgatttccgagcgaacgctttccgaacccggaagtaaatgtgccggaagcagggcggataaagcctgagctgcttggtgccgacggtttagatgaggaagcttccgattggccgcttgaagcctggcggctcgcttcagcttcctgctttttgcgatgcgcctcttcggctttgatcgcttcatcctggcgctttaaaatttctgcttcattttcgagtgaaccaagttcttcatgtgcatgatctttatcttgcttcacttttttcatgacatttgctttctctttttgctgcttgtcgagcgtcttttttaaatcttccaggtctttgagcgctttttcaaggctttcaagatccttgctcagcttagtttccttttcctcgacaagctgaagatcgcgtttttgctcttccatcaggtctttatcagcttctacaattgtcgaaaccgcacccgcgcggctgatgaaatccccgaagcttttcgagccgagaagcacatctatgtattgaacagaaccgccgttttcctgcattgagcgaacacggtctttcaatattttattgcgtttctcaatcttttctttaagcttttttatttgctttttcagctcttcgatgcttttctttgttttatcgatttcttcatttttcttttccagcttttcattcgtgtccgtcatcttacggtcgattttctcgatctcgcttctcaggcttgcttcctttgattcaagctctgaaagctcctgtttcgttttttcgagttttgactcgttttcagattttttgctttgaacgtcgctcttttttttctccaagtcttcataagctaaagcatggttgctttttaaggggatcagcactgccgacgatccgagcacagcggtcagccccagcgtcataagctttcttttcaaccttggttcctccttgccttcagaatcaagggagcccggcgctttgcaggcatcccagctttaaacatgatacaaccggcgaaagcgccggtttaaacttttaagaatttgcgaatcgacatcaagcttccccatacaccgataacggctccgatcagcaccaggatcgctgaaatctggaagacgaacggattgtacggcaagagctgtatgaaagtgccttgaactttcggagcgatccactgaacggcatgatgatacgttccgagcaaaatagcgatcggaatgatagaaccgcatacacccaagagcaaaccttcaatgaaaaatggccagcgaatgaaccagtttgtcgcacctacaagtttcataatctcgatttctttgcgtctcgcaaaaatcgtaattttgatcgtattagaaattaaaaacatcgccgtaaacagcaggccgatgaccaatgcaatcccgatgactttggcgacattgctgattttaaacaagcggtctacctgctcctgtccgtatgtcaccttatagacattggtcagcttctcaagcttcttggcagctttcggtgtgtcttgagggtcttttgtttttacgacaaatgcatcgttcagcgggttttcctgctcgaacatcgcaaagaatttcccgtcttccccaaagctgtctttcaggtttttgagttcttcatctttagatgagtatttgacactgctgatttccggtattttctttatttctttttccaatgtatttttttgatcctggttggccgttaagtcaaccagcactttgacttcgacttcttgttcggcttttaatgtcatattgtatacgttcagcatgatgaccatgaacacgccgaccaagataagtgtaactgttacagcactgatggatgcgaaagtcatccacgcgtttctcccgagagattttaagctctcgcgcaaatgccgtccgagagttctaatcataagaaccatactcccctctagcttcatcacgcacaatgaccccgtcttcgattgcgatgacccgtttcttcatggtgtttacgatttctttgttatgagtcgccataacgactgttgttccgcggttgttgatctcttcgagcgtcttcatgatttcccaagacgtctcagggtcaaggtttcccgtcggctcgtcagcgatcacgacatcagggtcgttgacgattgaccgcgcaattgaaacccgttgctgttctcctccggacagctgatcaggaaattgccttgctttgtgcttcagctggacaagatcaagcacttcaagcactttttttctgatcacctctgggcgctccccgatgacctctaaagcaaatgcaacattttcaaacaccgtcagcttcggcagcagtttaaagtcttggaatacaacgccgattttccttctgataaaaggaatctctttttctttgagctgcgccaaatttttattgtttatgacaatcttccctttggaaggcttttcttcgcggtaaatcattttaatgaaggttgattttcctgctccgctcggtcctacaacataaacaaattccccgggatatatagagatgcttattccgttcagcgccgagaccccgttggaataagtcttatatacatcttttatttcgatcatgtaatcacctaatcttttatgtttatacggtcatactcttcgaaagggcctgtcgttttgtgtcccctgccaatttcacgataaatggtattaattcaagccctttttcaacaacacccattatacgtcaagattagacaaaatgatattacagttttgtttcaatgccgacctaagttataggaaaaacgcaaaatcagccaaaaaatttgtactttgggccttatttaagacaaaagaacccgttaattccgttttcccaataggcaaaaagaccttttcaacaaaaaaagaacctttttcacctgaacgtgaagaaggttcttttcgcctcctgactggcaaggcatgcttactttttctctgaaagccacttcgcgaccgcttcagcttctttttcgtctacaagattgccaggcattccgccgcggccgttgactacaatgtccttaatttcgctttccttatacttgccgccaacttccttcaaactcggagcggaaccgccggccaaatccttaccatggcagcctgtgcagttttgctggtaaatctcttccccgtcggttgcagttgcttgcccgcctgtatttttctctttgctttcgttgttattgccgccgcaggcagccagcacaaaagaaacagccataaacagagtaaacagcttcattttcattttttcaagtcagctcctttaacaagtcaacctttattataacctcgattatgcgcgtttaaaaccctcgccaagcacctctgaagcatccatcgcaatgacaaatgcagactcatcaatgtgttttacgagttgtttcagctttgtgaactcggtctggccgaccacgcacatcaaaataggccgctcatcatctgtatagcctccgaccgctgatattttcgtaatccccctgtcgattttattcagtaccgcatgtcgaacttcctcttcccggttcgtaatgatcatcgccattttggaacggttcaatccgacctggatgacatcgatggttttgcttgatatataaacgccaagcatagcataaagtccctgttcgatgttaaaaacaaacatcgcggacaggacgatcgttccgtcaatcagcgccaaacatttgccttgcgacagcccggtgtacttatgaatgatttgcgcggccagcgcagtgccgcctgtcgagccccttccgagaaagaccatcccgatcccgactccgatgccgacaccgccgaaaatggcggccaagagcggattctctgtcgccggagcaatgtcccgcgtcacgtatacgacaaacgggagaaaaacagacccgacaagcgtcttgatgccgaattttcctccgagtaccagaaccccggcaataaataaaggaatattaaatgcccattgcacataggcggcttcaaagccgaacgattgcaaaatggtgctgatgccgctgactccgccggctgcaatccggttgggaagcaaaaacatattaaatgtcacagcgacgacggctgatccaaacaggatatagccgtagtcacgcagcaccgtaaacaattgatatctcgttttgtccatattcatgtctgtcatcctccgcacgattcattaccaatcgagagtatagcatttagcatactgtaagtaaataacagccaaataacgtattaattgaataaagcggcagagggacaaagcttcttacggcttaagctgcccagattcaggcaattttccccgcaaaaaaggcacatcctcacaatgtggatgcgcctttcttcaatttaggaaagcttggaacgcaaatatgcgtcaatgaaagagtcaatgtctccgtccataaccgcctgcacgttccccatttccgtgttggttcgatgatccttcactagagaatacgggtggaaaacgtatgagcggatctggcttccccagccgatttctttttgttcgccgcgaatttcgtccagctgtgcctgctgctcctcgattctgcgctgatacagcttcgatttcagcattttcatggcacgttcgcggtttttaatttgtgatcgctctgtctgacaagtgacgatgacgcctgtcggcaagtgggtgatcctgacggcggagtctgtcgtattgacgtgctggccgccggcgccgcttgccctgtacgtatcgactttaatatcttccgtacggatctcaatgtcgatttcttcgttgaattcaggcatgacatcacaagacacaaacgacgtgtgcctgcgccctgaagagtcaaacggagaaattctgacgagcctgtgcacgcctttttcggcttttaaataaccgtaggcattgtggcctttaatcaggagagtgacagacttgattcccgcctcatctcctggaaggtaatcaagggtttccaccttgaatccgcggcgctctgcccacctggtgtacattctgagaagcattgaaccccaatcctgtgattcggtgccgccggctcccgggtgaagctcaaggatcgcattgtttttatcataaggctcgcttaacaatagctggagctcaaattcattaaactgctttgttaagcttttcagctcgttgaccagttcattttgcaggtcctggtcaggatcttcttttaaaagatcatgtgtcatttgcagttcttcatgagactcgcttaaacttttgtacgtgttgacatagtcttttaacgcattcgcttcattaatgatcgtctgcgctttctgctgatctccccaaaagtcggggtcagccatctgctcgtctaattcgctgattcttgcttcctttgtttcgaggtcaaagagaccccctgaagtccgctaaccgagtagccatattttcaagttcctgtctgatttctgccaattccattattctttcacctcatcatatatttcagccggttcaaaataaaaagaggcgtgcacctctttttattctgttcttccgcagcagtttttatatttttttccgcttccgcagtagcaaggatcattgcgtccgatatccaccgctttgcggaccggttttttcttcgcttgtttttcctcatcgccttctttcggctgatgggctgtcgtctgtccttgaatgacctcttcgcgctcaaggttgttttcgatttcagccttcatgacgaatttggctacatcatcttcaatcgccgcgatcatgttttcaaacattgcaaagccttccatctgatactcgcggagcgggtttgtctgagcataagcgcgcagatgaattccttgccgcagctgatccatcgcatcgatgtgatccatccatttcgtatccacttcgcggagaacgatgactttctcaaattcgcgcatttgttcagagccgtaccgctcttctttctcatcgtatttcgttttgatgcggtcgtaaatgagctctgtaatctcctcgggctcttttccgaaaatgtcgcttttctccactccaccttcatcaaggaaattcgcatttacaagctccacaaggccgtcaagattccactcttcaggcagatcttccttcggcgtatatgaagcaacagcccgctcgagtgaagctttaatcatattttcgacgatggagcggaggttatcggaatcgatgacctcaaagcgctgtttatagatgacttcgcgctgctggcggagcacgtcatcgtattgcagaagctgcttacgggcatcaaagttgttgccttccacacgcttctgtgaagattcgaccgctcttgaaaccatcttgctctgtatcggcgtcgaatcgtccattccgaagcggtcaagcatcgccatcgtccgctctgcgccgaagcgtttcattaattcatcttccatggacagataaaattgggtgataccagggtccccctgacggcctgaacgtccgcgcagctggttgtcaatccgccttgattcatggcgttccgtaccgatgacggccagtccgccaagctcttttacaccttcgccaagcttgatgtccgttccgcggcccgccatgttggtcgcgatggtgaccgcgcctttttgcccggcatcttcgataatctgagcttcccgctcatggtttttcgcgttcaacacttgatgcgggattcctttatttttaaggagccttgatatcaattcagatgtttcaaccgcaaccgtaccgacaagtaccggctgtccgaccatatagcgctgggcgacatcctctgcaacagctttaaattttccttccatggtccggtaaattaaatccggtcggtcatcgcgggcaatcggcttgttggtcggaatcgtaacaacctgcatgttgtagatgttgcggaattcttcttcttccgtttttgcggtacccgtcattccagccaatttttcatacattcggaaatagttctggaaggtgatcgtcgcgagcgtcatgctctcattttggatctcaaggccttccttcgcttcaatggcctggtgaagtccgtcgctgtagcggcggcctttcatcaaacggcctgtaaaagagtcgacgataacgacctgaccgtcttcgacgacgtagtcgacgtctttatgcatcgccgcatgggctttcagcgcctgggcaatatgatggtttaaggcgacatggcggacgtcaaacaagttttcgatgccaaatgccttttcagcttttgtcatcccctcttcagtcagctgaacgccttttgttttcacatcgtatgtgtagtcctgatccgcttttagcgtgcggacaaacgcattggcctgaacataaagcttggtggatttggccgcttgtccagaaatgatgagcggcgttcttgcttcatcgatcaaaatggagtcgacttcatcgatgaccgcaaaatgaagcgggcgctgaaccatctgctctttataaagcaccatgttgtcgcgcaagtagtcaaagccaagctcattattcgtagaatacgtaatatctgctgcataggcttcacgcttctcgtcttttgacaggctgttcaggtttaggccgaccgtcagcccgagaaactcaaagattttccccatctcttcagcgtcgcggctcgccaggtattcgttgaccgtcacgacgtgaacgcctttccctgacagagcgttcaagtaaacgggcattgtggaagtcagcgttttaccttcccccgttttcatttcggcgatattcccttcatgaagggcgacgccccccatcagctgaaccttaaacggaaacatgcctgtcacgcgccgggaagcttccctgacaacggcaaacgcttcaaccaaaagatcgtcaaccgtttcgcctttttcaaggcgctctttgaactcgatcgtcttttgcttcaaagcttcgtctgaaagcttctctatatctgccttgagcgcatcaatctcgttcgctttcttttcataacggctgagcgtgcgttttgtcggatcaaacactttatttaaaattccaagcatagaataacgctcctctttaatttccttgtttaagcatgagtaaacagtaatttttatatatgcaatatcatatcataccttttgtcatttccaaacaatttaccgcgggggaacggaaaaaatcccctctgcggaagatccgggaggggactcgatatatttattcgttcggctcgatcaaaccgtattttccatcgtttcttcggtagaccacattggtcagattggtttcggcgttcgtgaatacaaagaagctgtgtccaagcatattcatttgtaaaatcgcttcttcattatccatcggctttaaattaaagcgcttttgacggacaacctgcggctgttcatcctcaatgtcttcctgcacggccgttccgatgccgtttccttctgcaaaaacatgcttcgaagaacctttttcgcggaatttccggttaacttttgttttatgcttgcgtatttgacgttccagtttgttcgttgcgagatcgattgcattgtacatatcttcgtggtgaacttccgcacggagagagaggtctgtcattggaattgtcacttccacctttgattcctgatcattgtagaattttaagttgacgtgaacaatcgcatcaacgttattttcaaaataacgctcaagctttccaatcttcttctcgacgtgttctcttaacgctggtgttacctcaatattttctcctctgacgttgaactccatcaaaagaacgcctcctttatattaaggatatgtaaatatatttcgtcttttccctgctgaattcctgcataaacgtaaaaattatgtgaaaaatccgtgaattttgacgaagtttgtctcctgccatctgagcccctttattaaatcttaaatatattcacatgcggataaaataagaacaaaaaataacggcatacacctgcagaatcctgacagatgtatgccattaatggatgacataaggtttcatgcattggtggatcgttttcatccattcccgataaagcggtaaaaagtgatggatcaagtcatgctgaaattcagcagacggataattgtagtagatcaagctgtcaaactcacggaagactctgtcaaaaaaacgaatcgaagatttggcacagcttgtctccaaaatcgacagcaaaacagcgtgcgacgaatccaactgaaaaaaagcatagattaaatcgttaaaaatccgctctccttctgtcttcgccaaatcttgattcgcttctattaaatagcaaaacccctcttcaatcgtaaacaaaagctgataataagtcgttaagagcatgtaatcgtcggtgcttgtcaaagcgatcacctatttgcgcttgtcataatatgtgccgtcaatcgtcatgttggcgtacggattgatataggaatgatgcatggcacgcttctgcttcgcctgaagcagctcctgcttgacagcctgctgcagccttttcagttcggccatgatcaatggctccatatccgtcacctgctgcagctgccgcttttccgtctcagaaagaggcggcttgatctcgcggatcaagccatcgcgttttttaagaaaatcttcaattgcctgaaccagctcgtcgctttccggggcgccttttatttgagcgagcatatgttttgtttcgctgtagagcagctcaatcttttccattatgccagtccgcccgatccgaaccggccctgccgttcaatttgaagcgcctgcttccaggcatcgcgtaaatctttgacatacccttcgacttccgccacgatatctttgtcattgttaatgtttgcttcaatcaggcggcggtggatatactcgtacatcgcccccatcgaagcggccaattcgactttccgatcaagggtgatattgagctcctgtataatgttttgagctttgacaaggttcgtatttttcgtttccatatcctcttgttcaatcgcctgtttcgccagcttcataaatttaaggcagccgtcaaatagcataagcgtcaattctccaggagtcgccatgttgattgaattttgctgataagctgcatacggattgtttaaagccattgttgatcctccaaattacaattattgtccaagcaattgcgccaagtatgtcgattgttcattcattttttgaatcgctttttccatcgccgtgaactttgtataatagcgattttcgatttgtgtcaggcggttattcatggacgaaatatcagattcaactgtattcaagtttttcccgattgtaaattgattgtttgccattgctgaatttccggctttatcttcaatctgcttcttcgtatcggtcaaaaccgtctgaaggcgtctcatgatgcctttttcattgtaattttccgtgctgctcgttcccgccataaagaggtttgccacactgtcagggtcttctttaattttcgctttcagcttttcttcgttgatctctaaatgaccgcgctgactgtatacgcttgatgtcgtaattccaaactgagtgagctgcagcgattcgccgttcacagagacattcgaataaaaatctgtcctcatttgattggtggcgccgcttaaaatcgtgtcgccccttaacaatccgcttttcgctttttcttcccacagctcaatttgcttttccgtcatatcttttttctgttcttctgtcagcggcgtatagtcgcggtatttcttttccgtgagcttgccgttgaccatatcgatcagttcgttgtactgtgtgacaaagtctttaatcttttcataaatcccgtcaacatcagtcgctacatcaagcgaaacggggctgtttgtcgtattcttcaactgatatgtcacattattaacggtaaagttgttcgttgtcttctcaatctgcaatccgttgatgacaacttcggcgttttggccggcttggctggctgtcagcttgttgtcggcatcaagcgcaaatccgagctgattggacataaagctcgccgtcgcatcatcagctgcctgtatgctgccccctgcgccggttgcttttgatgtgaaagcgatcgtttctacatattcagaaccgttataaatcttttctttcatagcggttacgcccaaatttgatttgttgactttggaaacgatgtcatccagcgtatccgtgctgctgacgctgatttcaacttttttcgcagtcgtttctccaggtgctgtcacttggaaagttagcgtttgatcgctcccggtataccctgaaaggctggaagatttataggtggccgcagtcgccagcttgttgacttggatcgtgcctgacgccgcattcgtggtgcctgttgccgtaaccgccgactcgtcagagcttgtcacctttttcgcgccgtacgtgctgggacggagcataaggttgatggattcctgcaaatctttaattttcgtattgatttcacgatagctgtcgcgctgccattccaaagtctgtttcttttgagtaagcttatcaagcgggacgcgctccgtcttcattaatttgctgacaatgtcgtctatatccatacctgaagctaatcctgatattctgatcgccatatctttaacactcctgttctatgtagttttatcgacaattaaccccataaattccgccatcgccgcataaaaatcgagccactcctttggcggaatctcgcggacgacttcctctgtccgattgtccacgaccttcacataatactctcccaatttttcgtgaagcacaaactgtaggtgcacctgcgacggctccaaaaggttgtttgcgccttgtatggttttttcaagctgagcaaatgtaaattctgcagcgtccgtctgctgcgggcgttccacagcttcatactgtttattcaacatctgtgttttgtaagcatcaataatgggttctaaagatgacaatctattgatcgacaatttttaccatcccctatgctatgatctaaaacttatatcggctaagggcgaatgagattaaatatctttatggaaaaaaattatgagaaaagacaaagtggtttaatttaaaaaaagaatccctgcaaaggattcttggacaaatgtaaaaaaagaccttggcaaaggccaagatctttttaaaattaacgaagcaactgaagaacgttttgcggctgttggttcgcttgagcaagcatagcttgagaagcttgagaaagaatgttgttctttgtgaactcgctcatttctttagccatgtcaacgtcgcggatacgagactcagcagctgtcaagttttcagaagaagcaccaaggttgttgattgtgtgctctagacggttttgtaccgcaccaagtttagcacgttgtgcagatacttggttgatcgctgaatcaacgattttaagttgagtatcaaaacctacatctgttgcagttgctgcattatcagcaaatttagttacatcgatatctttaactgattggttggttactagagttctgcccgtagtatctgcaggatctttgactcctaatgcatcagtgctcattttttcaatgttaacagaaatttgttgtgttgcgttagctccaatttggaaaactaaagatttttcacctgcagctgggtttgctggatctgctggtgctttgaaagtaccatccaacaattttttaccgttgaattccgtacgttctgagatgccgtcaatttcgtcttttaatgctttgatctcgtcttggatagctgttaaatcctcagtttgttgtgttccagtgtttccagcttgaacaactagttcacgaacacgttgaaggattgagtgagtctcagtcaatgcaccttcagctgtttggataagagagatgccgtcttgagcgttcttagaagccatttcaagaccgcggatttgtcctctcattttttcagagattgcaagacctgctgcgtcatctccggcacggttgatgcgaagaccagaagaaagcttctccatgttcttttggcttgcgccgttgtttgctgacagacggttcagcgtgttaagcgctgcaatgttgtggttgattctcattgtgtatttcctccttgaaatgtgtttgattgcacgtccatgtgcatgtttgaagcattcaggctgtccttcctgctacatattttatatcggaggtgccttgaaattgtttatagcaaaaataaaaaaatcctcactttttttgtgaggataatttcgcaagcaaatcgtttgagatggaagcggcccggctgttttcttcctggatcgccaaatagatttccttgcggtgaatttcgatatgcttcggcgcgtcgatgccgattttcacctgatctccgtcaacggatatgattttcacttcgatatcgtctccgatttgaatcgcttcattgagcttgcgggataagactagcatgcttcccctcctatcggctgctttgtcagataagaagagtcatgcaaaatcacttgcttggcaagcatctttctgcggttcaccactatcggcgccatcaaattggccgttgatttctcgaatggctcttcgatcgttaaaatcgccattacttcaacgtcttcggcagattcgatttcaagaagttcaaccgtcgtttcatcaagatcaaagccataatctttgaaaaagacgaacggactggcgacaatgaatgccagctcttccgactgcaccgactgaaggacgacgaacggcgaatcctcggaaagcggcaggatgacgaacttcttctcccctgtaaatccaggcaggccgtttttaaacacgattgtctggtcttcttgaatttgcgtttctccgtgatactttgttttaatgatcatcattcacgatcctttgctgaattacttttgttttgggtattccacatctatttttacctccggatattggagcatgtcaaccttcacactgcccggcgtatagttaacaaccggtttattcggcgttgcttcgatgataggcttgcgcggcgtcgcttcaatgttcactttagccggttcgtatgcgattttcaccctgtcaaatgacggcgtaaaatgaacgccgatttgaatcggttcaggctcgctgttccgcctcgcctggtctgcaagcggattgccttcgatttcgatccgcatcatttcgtctccttcttcagcggtccgtgccattccggcgagccaatcctgatagccctgctgcgccccttcttcaatccttttaaatatatgctttctttctaagtcttcccaagcttttgtctggtcaatcgtgagctttgaaggggtggttgtaatcttcagttcggccggcggctgctcgattttcaagtcagcgcgcggctgttccattttcaaatctggcggcgtcgttgttaaaccgatgcggccggggatattttgcatgatcagcctaggcatctccattatgatatcctccttttgctgaaaaaaagcaactcggatagagttgcttttatcttaaaaagtcaaccagtgtcggctgaacgattttcgcatttacggcaagtgcagctctgtgaaccgattgctgtgtaataaattcagtaatgatctcctcaagctcaacatcttcgttgtctgacaatacctttgtcgccgtctcttcctgttcgctcagccgcgcattgatcaattcgagccggttgtagcgcgctccgatatcagaccgctcattgctcatctgattggagaactggtcaatgtctgaaagggcgttttccattccttccattgttcccgcttttaaggcattttcgagagactcaatcatttcaaagacgttttgtccgctgcttgattgtccgccgaaagccgaaatcggatttgagtttacatttaaggttgcgtttggcgaaacattgatgagaacgtcagagctgcttgtatagttttcaaaattgtatgtgtaagtaccatcggcgttttttgtgatcggagcgacgtcagagttcgttccgttaaaaaggtagcggccgttgacctgcgtattggcgatctgaatcagctggtctttcagttggccgatttcgaccccgatcgcatttaattcatccttgccgtttgtactgttttgagccttaacggtcagctccctgattttcgccatgatatcaatgccttctgtaatgttcgtttccgtgttttcaagccatgtaaaagcttgcgaggcattgctttgatattgtttaacctgggacagctgtgtattgtacttcaggcttttcatcgcgacgacgggatcgtcggatgcctttgtgatcttttttcccgaagaaatctgggattgaagcttatccagttttccatagcttgaattgatgtagcgcaaagaattttttgcaatcatcccttgggttacccgcatgaatctctacctaccttcccacgacacccatgccgttaataatcttatcgaggacttcgtcctgcagcgtaatcattctcgcagccgcgttataagcatgctggaattggatcatgttcgacatttcttcgtctaatgatacggcgctaacagactgtctgttcaattcagcagtgtttacaagcgtttctgtatttttggccagtctgtttgtttcctgagcttttacgcccatttcaccgatgatgcctgcgtaatagtctaaaacggtcgtcgttttgtcaccgatttgaattttcttggtgaagacattagcgagatttgtcgcgttggcgttgtcgctcgcttcaccattcagcgatgcggcgactttatcgccttttgaattcatgatctcatcggctactttgattttgccggcggctccctttgcaggctcagcctctcctccggtaaattcaaagaaaatgcctcccggttctcccgatgaagtaaacccgctttgatggactgcattaaactctttcgcaaaagcaagcgccatcgtatccagatctgcgagcatttcgggatacaaacctttttcttcaccgtttgacatatatccgtaagattcgattaaaccgagcagggaccctttgctagtaaacgaatcgatgccgatgtccgtcccgccgagggaaacgcccgtcacaaggcctgtatcgttgtcgtaattcactttgacagtttcagtcgtgaagtttggcccgtcaagaaccttgcccagagactggccgtttacgtcaaggacttctattgacacaatgccttcagcggttgcgagtggattgccgccggttttcgcatagctgactttgatattaaccattgaagacagttcatcaaggagctgatcacgcttatcgtacaaatcgttcgggagatagccgttcggctcgactttggcgatttgctcgttcaagctgttcagctgggacaaaagcgagttaatcgtcatcacattttgatcaatctggtcgcctaaatttgattgaacggttgtcagcgattcatacagagtgttaaatgtatcggcgaccgcctgccctttttgcgcaacaacagaagcagcgctcggttcgtgggcgttgttcgtcaattcctgaatggaattccagaatgaattcagaactttgtttagtccggtgtcgttcagttcattcataatcccttccatttggttaaaagcgtccacttttgcattgtaatagccggcctttgtattctgcgtcctgtattgatagtccagaaagctgtccctaaccctttcaaccgaaccgatttcaacgcctgtacccatctggcctgcaagtccgacagagtctcttgatacggacggataaggggttgatgctttaaatgtaacacgctgtcttgaatacccttcggtattggcgttggatatattgtttgctgtcacgctcagagctgattgctgcgcggacaagcctctttttgcgatttccagccctaaaaaagttggatttgtcatctttttcactccgttctaagcttttgaatcgaataaagaaagccgtttcaccccgcctgtctggtttggctgctgctcttttccgtaattcgaaccgccttcattcggaaggagcatatcaaatgtaagcgagataaattgaagcgactgaaaagtcagctgcttgttcaaatcgttcacatccttcaaacgggtgacgagctgtgagagcttggcatacagctgttccagcacctttttctcgccgcccgcagctttgctgatacatgcgctgatcgtcgcgtccgagctgccgatacagcttttagttgcttcaatgcgggactgctccgtttgttcaatggcctgcacatacttttgttctttcgtcacgatttctgaaagtgcctttatttcgttcgtcttcagcgcctccgttttttgttccgacagagacagcagatgttcatgcagcacgcataagcgctccagctcttcaatcacccgtttcactgaactgacttcctccttttattgctgtttataaaaattgaccattttttcagctatgcctttgccgtcaactttgtacgttccattctccacggctgctttcagctgggcaattttctcctgacgctccttcattaaatcagggcctttttgcagctcctttgctttcgcggaaatctcaactttgtcttccggctgggctgctccctgtgaagaagctgtttgtttttcaaatgatttatgataaggattaacaggttgtgttccatattggttgatcttcatgggattcctctcactttccgccatagttatctatgatcatactcattttatcgtctgagcttcaagttagtttagggaatcagtcatttttgggcttaaaggtatagtacgtgcctttagaactattatttctctctctttcaagctgctccagctggtctaattgactcatttgcgatgccaaatcctgctcgcatgacatgcaataacgtccttcccgaataagcgtgccgcacctttcgcacggatagccgagattcgggaaattagagatttgaatgcgtttctgtctaataaacttcaatattaactcttcttcgacacctgttttttctacgatctgaaacatcgtggactgccggttttcctgttttttcagaaatttataaacaatttcatacgcgcgctcttcttctttcaagcatgaagcgcaaacggtttgaaaactgcttttcataaacaatgcgttacatcttggacaattcgccaattgactcataaactttgacccctatccttaaattctattttttatatcggcagggaagaaaaatgatttagcttctaattaatgtatatgatgatacagattttgcttctccggatgtcatcaggcaatcagcggcatgatgaagggtcgctcctgtcgtatacaagtcgtcaatcaatatgacatccagattctttactgaccccttttcggttctaaaaacggtttttggcttaattcgctctttcctgctttttttggattgtttttcattttcgattctgatcaagggatgaataacgggtatttgtaataaggaagcaagacgctccgcctgattaaatcccctctccgctttacgttcttcactgagaggtatcggaactaaaacagacgggctgcggcggaagtattgttgaaaagcgctgataaatgaaggggcaaaagcgaagaccagttcagcatcacctctgaacttaaaacgggcaaggacttctttcatgaaagtattgtagagataaacagagcggttttgcctcaaaagagagcgggttaacggattggcctcccattttgcgcagtcaccgcacagctcttcgctcccctgtggccgtccgcacttagggcatacggttcctttgatctcgataaagttctctttacattccctgcatattttctcttctgatcgtaaaaagaaaaaagaatgccatgagagagaatgtaaaagaggcgctgcacaaattaaacaattcagtttattccctccctcttcgattgcttgcgcaaagcgggttttcattcacctttctggcagcttcagccaaggtgacaagcattgatgtattcttttgtttgtcaacgagctctgcttttatgtaagccagcttcgactgatctgttacatattgcggttttactgcatttaaagccaaggcgagcacatcctccctgcacctgctgcacgtacagctcatgtgcagctgatcgatatactgatcaaacaactcttccaaaacagcttctttggcgttgactagcatccggcaccgctcctcattttatattcataggtatactttaccatgaatatcagactagtcaatcaacatttcctttttagacattttattcatgttttgaatatgacgtcgtgccgcattcatcgactttgtcctgccgtaatgaaagaaacagacgtctccatctgtgtgctcgggatgcctgccggctcttcccgccatttggacgagggcgctttcggtaaaaaccgccgactctgcccccaatactccaacctgcgcttttttgacggtcactcctctttccaaaatcgttgttgtcacgagcacctcaagcttactttccctaaaccggttcactttttcatttctgtcagggtcatcggcataaactccttcagcgcgaaatgtttcctttttcagcacactgaccacagatttaagaacagggacagagggaacgaataaaaaaaccggttgctgcagttcttggtgcttaaaaagccattttttgaggcgaaaaggaacttttcttcgtttcaaactctttttccaatttccgcaccaaatcaatgtaggttcaggcaaggggctgcggtggaatctcgcgggaatacggacggtgtccagctttccgctctcagccctttttttcatatctgctgaaggcgtggcagttaaatagatgtgagcgctttgccgttttgccgattttttaacagcgtattgcagcgtgttatcaatagaatacggaaaagcatccacctcatctatgatgatcacgtcaaatgcttctttatagcggagcagctggtgggtagttgaaatgataagcggcgagagattcccaacgtctgagcttcctccgtacaaagcggcaatttccacccctggaaaggcttggcgaaaccgcggagcaagctcgagtacgacatcggttctcggagtagcgatacatactgtcaagccgttgttcagcgcgaattcgatcccttgaaagagaagttctgttttccccgacccgcaaaccgcccagaccaacagttcttcttttcttcgtatagcattgataatggatttggccgctttctcctgacctgctgaaagcgcgcctttccactccgtatgaacaggcgcccatttatggctgacatgcatgtgccaagtcaacagaggcgtacaatcgctcaccctgcccatcatgacgcaggatcggcagtacacgcagcatttactgcaccgatagcaaggataccgggcgaaaaatgagcgttcgtgctggccgcacctcaaacaaataaagcctttcttcgtttttttaataccttcctccgtttttatcaagccttcttggatatgccaatcaacgacggattcacgaaaaggaagttcgcttttcagaaggtggcgctgctccaaacatgaccgcaattcacgggtatagaatgccggttgttcgatgtgaatcacctccaatctgccatttagtatctatcatccatggtttcttgtaaaacagtcaaaatctaaaaatctcccttcaaaacagttgaaaaaaaaatctccgttttgcaaaacggagattggcttttatactgtataccaggcgatacccatcgctccttcaccaaggtgagtgccgatcacaggcccgaaatagcttttataaaattcgacatgtgcatattgcttcgacaattcttcgattatttgatcggcttcttcttcacggttggcatgaatcacaaccgctctcagcggctttcctttctcggcatcttcgccaaaaagctcaaataaacggttcatcgctttttttctcgtccggattttctcgtagggaacgatcagcttgttctcaaaatgcaagatcggctttacttttaaaaggcttccgacaaaagcctgggcgccgctcagacgtcctcccctttgcaaatgtgaaaggtcgtcaaccataaaataagccctcatcgaggttttcatatgatccaagtggcggatgatttcctcaggagccgctcctttttccgccatctcagccgcctcgatcgcataaaaaccctgagccatgcagctgatttccgaatcaaacggatacactttaattccttcaagcataccgcttgctgatacagcgctgttgaatgttccgctgatgccgctggaaaggtggatgctgatgaccgcgtcatatgtttcaccgagtttttcatagagagaaatcaactcgccgtaggcgggctgggaagtcgtcgggagattttcgtgggcttttacttctttgtaatagtccttccagctcatatcgatctcttccctgtatgaagtctctccaaagatcacattgagaggtatcatatgaatattgtagcggtcacgcaggtctttaggtatatatgccgtactgtctgttactactgctgttttcatgaaataaaccttccttatgaaagatactcttttctattctaaaagaaaaagcagcttttttcattataaagtttaattttctgccaaaagaaaagacctgccttatggcaagtccatctttatctcatttctacccagccgtttttaatggctacaacaacagcctgcgttctgtcgtttacattcattttttgaaggatgttgctgacatggtttttaaccgttttttcactgataaataatgattcgccgattccgcggttgctttttccatccgccagcatctgcagtacctcgcattcccttcttgtgagaatgtgaagaggtctccggatttccggatacacctcatgctgagcgtgagatgatacaccgcttgttgcaagacggcggaattcattcacaagattgtgtgtaaccttaggatgcagataagatccgccttcagctactactttcacggcttcgatcagcgtatcggcatccatttctttcagcagatagccccgggctcctgtttttaatgcatgtgtaacatagttttcgtcatcatggatggataaaataataacctttgattccggatacaagtcgaccagttgttttgtcgcttctactccgttcacattcggcatattaatatccatgataacaacatcaggatggtagtgctcgacaatgcgagccgcttcatctccgtcgtctccttcggccactacctcaaaggtaggttcgaaatccaaaatccgtttgacaccttcacggaataactgatgatcgtcaataattacaatatttactttagtcacaagctacgcctccccattctcattgttaaacacaccgcttttatggtcaatatgtcttttgtctctattttacaattatctttacaaagacagtggaactttaatcaatataaatgtcccaagacctattttcgaatcgattgtcattgagccttcgagcaaatcgactctttctttcatacctagcagaccgaaagatttgttcttcttgccttttacttcttttaagtcaaagccgtttccattgtctttgataatcagcgtcacaaaatcttttgtcacttctactttaacatgaatttcagttgattcggagtgttttaaggcgtttgtcaccgcttcctgtgcaagccggaatagtgcaacctcaaaccgcggtgctattcttctttcttcggattctccgatgcattggaaatgaatctttgcttttccatgataatcttcgatcgtgttcaagtattttctgagcgtcggtatcaatcccaaatcgtctaaagccatcggccttaaatcataaatgattcttctgacttcataaagagcatttctgacgttttgccggaggtttttaatttcctgaaagccttcttctgttcctttgtctctgaagatgcgttcgatcagttcagatctcatcataacgttggccagcatttgcgcaggaccgtcgtgaatttcccttgagaccctttttctttcttcctcctgggcttcgataatccgcagtccgaaatcctgcttggcctgcgcatcttcaaggagaacgccgacctggcgcagatcctgatttaagtagtttaagacgacggtaatctgactgacaagcccttctgaacgctcgatgatttcctgaagccccaaaaggcgccgttccagatcatcacgcttctctctcagctgcttttcccgctgctggatcattgtcagttcaacctgcagtttgtgggctttttcataagcttcgcgaatctcttcttcactgaatttatgaaagtttctgctgacctctgacaagcggttccgcgcatggcgggcatgcacttccagcctgtctccaagatcgatgacttcgttgacctgctgtttaatctgtttcagctcttctaccaagccttcgtattgctggcgggactgctctccgatttgaaagacttcatccttgctcccgtcaaccgtttttaacatcttcataatgattgaatctaaaactttggagtccattttggaaacgctcacccattttccctccgtaacagcattgtcatttagttttatcataaatttcattgaactgaaattcgtgtcgaattataatgaaagaatgcgtattctggtttttttatggttaccgatccatttctatttaatcataacaaaatacgcgccaaaattctaagtctgttcgatttttaggagaacagccgcaggcttgtcaggaggtaagcaggcatgctgcaaagctatctgactgttgcaggtgaagggacccatgaaatcgtgattgaaaaatcccggtttatatgccacttgagccgcgtcagtactgaagaagaagcacagaactttatcaaccacataaaaaagcagcattggaatgcgacgcataattgctcggcttacgtcataggagaaaatgatcaaattcaaaaagcgaatgacgacggagaaccgagcgggacagcgggcgtaccgatgcttgaagttttgaagaaacgcaaccttaaagatacatgcgccgttgtgacgagatatttcggcggcattaaactcggcgcaggaggattgataagggcttacggaaaatccgtgtcagaggggctgaaccatgtcggcgttgtcgaactaaagctgatgcgggtcatgcacaccactgtgaactatacatggatcggcaagcttgaaaacgagcttcgcgagtccccttatcaaataaaagacgttcactatgcagacgatgtcgaatttgaaacgtatgtcaaggaaagcgaaaaacaggcatttacggaatggataaccgaattaacaaatggcaagagtgagaatagagaaggcattcaagtctatttggaagaagcttttaataattaaaggagaatcatcttatggctgagcgtattaaagtgaaagtgcggaaaaaaaagaataaaaagagaaggctgattaaacggtttatagtccttatgctgctcgcacttctcgcagtcggcggagtgggcatatataaaattataaacacgatttccgcggctgacggcacttatgatgagcttgaacgcggagagaagtcgaagctcagggacgatgttgttgatattcaaaaaaagccgttctcgattctttttatgggggttgaagattattcgacaaacggcgagcacggccggacggattccctgattgtcgtgacgctcgatcctaaaaagaagtcgatgaaaatgctgagcattccgcgggacacaagggttcatttggccagcgacacaaccggcacaaaaacaaaaattaatgcggcctatgcaaaaggcggcaaggatgaaacaattgagacggttgaggatttcctcggaatcccgatcgactactatgcaacggtcgattttgacgggtttaaagatgtcatcgatgaaatcggcggaatcgatgtcgatgtgccgtttgactttagcgaaaaaagcgatgtctccaaatcgaagagaatctattttaaaaaaggaaatatgcatctaaatggtgaggaagctcttgcctacgcaaggatgagaaaacaggataagcgtggagacttcgggagaaacgacagacagaagcaaattttaaaagccgctcttgatcaaatctcaaaaccgcaaaacctcgctaaaattgatacaattgcccaaaaagcaagcaaaaacattcagacgaattttagaatcacgcaggcgctggcgcttcaacaaatttacagcggctttgccggcgatgatatcaaaacattaaacatcacaggacaggatcttacgattgcaaatgtttactactttgagcctgaccagcaaaacctggaaaacgtgcaaaatgaattgacccatcatttgtacccggactcagctgccgattcgagcggaacatcgtctgaatcttccgcaaccgctgacggtgcggacagctcagctgaatcgtctgctgcttcttattgatcggctctgttgaatgttaaattcataaatgaataaattgaaggggaactctttatatatttagggttcccctttctttttaagctagcgtaacttactatttgaacaaggcaaatgattgatcatactatgctttaaataattatactgtttttcgctggtatctgagaatgcctcgtctctatttgagggaatatccatatacaggatgtcttctttgaattgagaaaccgttaaatcatatcttttaccattgacaaaattataaaaatgccacccttcaggcagctttgttttctttatttctccacctaatatatcatttacgactagcgcggttacgccgcattgtcccttggcagggttatccttactccattttgaacttgaatctgaagaccaggatttatacaatgctttcactatttgttcgatttgtccaaggtaatgatcatccataaataaccctccttttcataaagttttagttattcagccattattaaaaacccgcttatgatacttccggaaatgcggtaaaaataaaacccctggaaaccaggggttttttgcgttcattaattcctcttcaccatccgcctgtaaaacttcgtaaaaggcttgtactgctcatttacaaggcctgtcacctctgcgatgatctgcatgaacagtattaagccgaagatgatgaagatggacacccatagggttgcggtttttaaaagaatggcgctcaggctgaagacgacgccgattaaataaatgacgataacggctttccgatgggacaggccgaaggccatcagcctgtggtgaatatgcgatttatcgggagccgaaatcggctgcttgtttaaaatccgcctgatgatcgcaaatgtcgtgtcaaatatcggcactcctaatataataatcgggatgacgacgctgaacagagtcacgcttttatacagccccagcagcgacagaaccgagatcacatagcccaaaaacagcgagcccgtgtctcccataaaaattttcgccgggtggaagttgtagaacagaaagccgaccgtgcttccgatgactaccagcgacaaagagaagatcaagattttatcggcagaaaacgccatgacggcaatcgtcgagaggccgatgacggatatacccgcagccagtccgtccaatccgtcgattaaattgatggcattggtgatcccgacgatccacaaaatcgtcaacgggtatgcgagccaccccaaatcaaagcgaagatcccaaaacggaatcgataaaaattccattttcaagcctgtactgacgatgatgcaggctactaatacttgtacgataaatttaattctcgcgcttaaattgtatttgtcatctacaatgcctaaaattacgatcataaaagcaccgagtgtaattgctgttattctgttttcataaaggccgccggcaaacgaaccggtcaatactcctataaaaatggctaaaccgcccattctcggcattactttatcatgtatctttcgtttatccggctgatccacgaccccggatttgattgctagacgtttgacaagcggagtaataattaaaacagtaatgagagagacaaaaaacgcaattacagtgcgttcataagacataaggaagtctcctttttaaatgaagtctggtcgtataaaagatcataccttttcattatacaatttcattatttattataacaagctccagccaaaagaaacatcacgaattaatatcccccgccgcaaattatgcatccttattcaagttcaatttatcaagcatcattaaaaatagatgatgccagtctctttcacgtgcgatctttctgcgcagttccacatgggaaacatcatcatgcgcaagctccagctcttcacaaaccgctgtaaattcagcggggtcgtttcctgttaaatgacggtaaacgtgttcctgttcaaccttttccgttgaagggaggttcatacctgcgacaggctttccggcagccaaaaattcaaacagctttaaaggaaataccgcattgttatatggcgacggtttatacggcatgataccgatatccactacattcatataagctggtacttctgacggcgcagcggggcccgtccagatgacattatcttcttcaagaagcgctttaaaatcttcgtctccgtttgtcccgtcaggaccgacaaataaaaatgtccactctttttttgttctggcagcttctttgacgagcttaaaatcgagcttcggcttgattcctccgataaagccgaggacggttccttcccttcccttcaatacatccgctttttgcatattttctgcaaacaagctgtactccacaccgttttcgattgtaaaaaccggctttgtctctccttgaagccggtctgctacattttgttgcaagtattcggaagtgcaaaaaatcgtatcagcagctttgatgattctgccttcagcttcaaaaatgaccttttgcctgaatcctgagacaaggctttggctaccgctgatcggggccgcccacaggtcgctgcagtcatagatgacctgatcccattgataaagcgacgacagcagcggaaagccggggaaggtgtaccataagcacaccttttctccctgaacgtcttctttcagccggtcaagcagcggcttcagcttgctttgatagaaaacatctttgtagcgggcaaacctgaatattttctttttcaaaaaatctttgactgcaaattgcttgattccgttgtcaagcaatgtaaaagtctcacgggaaggattttcagacggacaaacccaaatgacttccttcgtctccttgcggcctgctaaaaactcagcaaggcggtgccttctgtatcttagctgatcctgcccccattcacctgtcgctactatgacgtgtatgaattgatctgctttcactttcaatcaccttttctgtcaatgccgttataatcttttcattactgcgttcttagcgtaatggaaaaagcaccatgtcgctttcatcaagtgaagtcgttcgatttccctgtatacgtaccaggtttttcgcgccgccttccacttgtttctggagatcgatgtttcaacgatgcggtattccgcgaggggttcgttcagtccatatgccttgaacccccgctttaatacggacagccatgtcgccaaatcctggcgggttctaatattcggcatccggatatcacccgtttgttctctgtcaatcatcaccgtcaagcagccgatgatcgtattttttaatacatcatcatatgtaaggcttacgggtgcatgaatggttttatgaagcggttcgccgtcttggctgatcagctcgtatgccgtaaatgagaaagcatgctgatgctttctcatgaaggcgagctgcttatccagcttttctgctttccaaacatcatcgctgtccaaaaaggcgacatagcgcccttcggctttgctgagcgccgcatttcgcgccgctgcagcaccttgattctctttcagaaaaatggcatggatccgctcatcatcttcttcatagcgcttcaaaatgtctcttgtcccatctgttgagcaatcatcggcaatgatcatttcccagtcggaaaacgtctgatttaagacggacttaatggttttttcgataaattcctccgcgttataggaaggcgtaatgacagagattaaaggtttttgcctcgtcatggtcctgatccacatccccaattaaaaatttaacgttctctgaaaacttccggaatgacaatgataaaaaatgacagcgctaaaccgatcagtacgcccagcaccgctcttttcttaggcgacatgccggcagcctggttatcaagcacgatcaacggctcaatttcttcagcagccttcatatcaagcttgcttgtttcaagctcatacaaaaaccgctgtttgtcaactttggaatcagcgctgactgtttcgtcttcaagcgccttaatattcttttcaatgacttcttctctttttgagaacagcgccttatcgcctttcatataggcatctttaatttttcctaaagtatccaatgtttcctgtttatcaggccctgtgtagcttaagttgaaaagtgaatccgttctgatttcaatcgccagatcgtctttcaattgcgccagatcctcttccggcatatccgggaaaatgtcctttaaaaaagcttcgtttttcaacagcagcggcacttgctttgcattgttgtacttcgcttctccatagttcccggttgatatcgttacagtagccgtgtaattagatggagcaacgcttcccttcggcataaaatagccgacaagaccaagaataagaggaagcgcaataatcgccacaataaactttttcactctaccagcaatacgtttgattaaattcatcacatgaatttctccctgtttttaaattcgattttcaaaaatcacctatactgttcggtttcatccgttccgcagactctaaaggtattaaccgtcgcaatcacaagcgcgaggaacacccaatggaaatataaattcgagacggaactcggactgatgcttgacacaaggaaggcgacgagcgcggctgtcaaaccttcaataagaagctttggccgtcttccaagcgatcttttataatatctgtaaagcacggttattaaataaatgtacatcgttaaataaccgagcatcatcaccactccaaaattcgtcatgatctcaacgagccagttatgaacctccacgacccggtccgtatcgaacagtgcatgatgctccaaataatatggcacattgccggcgccgacgccaaatccgtaagtatccagcacataatgcccggcgtttttcaacaaattcgccctggcgacattggatggcagcggctcgctgaaatcgtgtgcggtttgcggagccaaaaagtatgtataaaaagctccggtaatctttcctgcaaacagtgtgacaaaagcgatacatcctgcagctgcggcgatgagcgcccattttttaagcaccttcggcagcaaaatgaacacataaacggcaaggccggctatgacccccaggatgctggctcttgatccagtcaggaaaatcaagtatgccgaacagaacgcaaggagcagccccgctatttttaagtagctgtttttaatgtttttgaaaaaagataaataaaagaaaaagctgatggacagaaatgtcgcaaagtcattctggttgaaaaaaacggatgtcggatagtgctgtttatagtgcggcccgttataaagggtcgagctcggcaggtggtttaacgtaaagtgattgtaaaacccgatgaccattaaaaatacggtcatgacaagccatatgtaataaaacgcgagaatacgatccattttttgaaaaaacatgacaaccagaaaaaccaaaaacattcccattgccaataggaacagatattttatgccatcagtggcagacttgacccatagcagcgaaatcagtccatagcagaaccaaaacgcgaaaaacatcagaatgcctttgacatgcacctgcttccacttttcaaggtgctggctgcctttcaacatttccgctatgaataagaatcctgccagaatcagaagtattcgatatggaaacaggctgaaaaagcccaatttaatcgcaaaaaaagcattgttggcaaaagttgcagcgatgagcagatataatacgggcatcagcaattgctcggacgacaaatacttccggagcacaacgatcacagccagcgcaatcaaaattagacacgccagcaagattttttttgcattggactgggccaatacaacgaatgctaaccctgcggtcaatgcggcgagccaaaccagaacattgaccgcggaacgtttgagactcatttttccccctccttccgcttctttctggaaaagggctgccgacatcagccagcagccagtgatttacgtattcatttcttttttataatatgaaatggtcttttccagtccttcagcaagcggcatttttggttcccagtttaagattttctttgtttcttcattacacagtgtgctgtggcggatatcccccggccgttcatcttgataaatcggagaaagctcagagttcgtcgcttttttcatctctgtaaacagctcattgaccgtgatggaaaagccgtttgaaacatttaaacaaacgtttgattgagcttttagcgcctttacgttggcacaagctacatcaccgacataaataaaatcgcgtgattgttctccgtctccaaaaattaccggagccttgccgctggtcagcaaatcggagaaaatcgatacaacgccgccctctccttttgcatcctggcgcggcccgtacacgttgctgtaccgcaaaatgcaatactcggttccatatagatcataagccagttttaaatagttctccactgtaagcttcgtcagcccgtagggtgagcctgggtttgtttggtgacgggtgtcgacaggcaggtaatccggatttccataaacagccgctgatgatgcaaagacgatctttttcacattgcattcaccagctgctttaatgatatggagcgatcctctgatattgatgttttcatcatttaaaaaatcgctgacagactccgctacgcttacttgtgcagctaaatgaacaatataatcgggatcaatgcttttgatgacgtcgatgacttccggcttcgtgatatcctgctcataaaagtcaattgggagaccgtcaatgttggagcggtgtcccgtagttaaattatcaagaattgaaacccggtaattttcttttagaagctgttcagcaatatgcgagccgataaatccgcatccgcctgtcactagtactttttccattgttatccccccgttgtttatacgttggtcaggattccttctccctgtacttccggccgtccgattgaatggtagatcatgccttcgtttctcatttgttcaatttcaaatatatttcttccatcgattaagacggggtttttcaaagcagacttaagtttggcaatatccatgttctgtacttccggccactccgtcaatatgacgcacgcatccgtatcctgaatcgtctcatacagatcttcgctgtaaacggcttgatcgccgagaagcttttctgcttcaggtacagcaatcggatcaaacgctttgactttagcaccgaggcttctcagcatcggaatgacatccagagacggcgccgagcgcatatcgttagtattcggcttgaatgccagcccaagaaccgaaatggtcatgccgtttaaatcgccgaacacatcaaggagcttttgcacaatgtgggcgcgctgcttttgattcgtctcgatgacagcttcaatcaatttaaaaggataaccgactgacttcgcgatttgcaataaagccatcgtgtctttagggaagcaagagccgccaaagccgattccggcttttaaaaatttactgccgattctgctgtcgagtccgacgccttcagacaccttggatacatcagctccgaccctttcgcaaatattcgcgatatcattaatgaacgagatctttgtagccaaaaatgcatttgcagcgtatttaatcatttctgcactttcaaggttagacttgacgattttcgtttgaaatggcttatgaagctcttcaataatggcagcagccttttcgcttgtcgcgccgatgactgctctttccatattcatcgtatcgtaaatagctgttccttcacgaaggaattccggattcgacacgacgtcgaaagggaattccccttttgaattgcgttctataatggcttgtacgagctttcctgttccaacagggacagtgcttttgttgacgatgactttatagccgttcaggtgcttcccgatcatttcggcaacggatttaacaaatgtcagatccgcttcccctgtttccgacatcggtgtaccgactgcaatataaataatctcagcttcttcaatcgcttttggaatatcagtagagaaaaataagcgattttcgtttacgtttttatccacaagttcttttaggccgttttcataaatcggcatcactccggctgagagtcctcttattttttcagcatcaatatcgcagcagacaaccgagtttcccacttcggcaaaacaagttccagacaccagcccgacatatcccgttccaatgacagcgattcttttcaacattatcattcccttctttcagctgacccttcaaatccaatagcttgatttaggtaatgatctttatctctttctattgaaaaaatctgggtttttcgttttcccaatccttatttttattagcttagacgcaaataaatgggtttaaacagtattatattcaacattcatacgcatattaaccgacagaccccaacttaatttttgttcttgacaacatccccatacacatccagcagctttccggcatttttaaaggcgtcataatcctcgtgcaccgtttgatacagctcttcagcgatggcttcttgccaattgccgccttccaaatatcccttgacagcttctgttatgctggaagccgagtgcggcttgatcagaaggtgttcatgctttccgaataaagacggaacccccccgaccgccgtacaaagcaccggaaccttgagagcgagcgcttcaatgacaacagtcggcatcccttcagaatacgaagggagcacaaacagatctgatgcagccagatattctgatatctcatggtttgcgacctgccccgtcaatactgctttttcaccggcgatttgacggatgttctgcttctccggtccgtcgccgatgaatacagctctgtagctgtcatcaagctgcctgaccgcttctgccagctcggctactccctttcccttcaccaagcggccgacgaacgtcagcaactttttgtcttgcggcaggccgagtttctccctcaattcaagtgttgaagcggagggcttttgaaaccggtccaggttgactccaataggaagcaccgagctttcagcaccggtcatttctttcgttttggctttcagcgcttcgctgacagccaatacttttgctgcggaatgcacagctgtttcaaatgctcgaaaagcgcctttgctgtaatggggataaatattgacatcgcttccgtgcaaagtcagaacataaggaaccttcagcttctgtgaaacaacggcagcggcacccccggatggcatcgcgaaatgggcatggataagatccggcgcaagcccgtgcttctcgatcgtcctcaatacagactttgcgatccggcgatgcggctgagcccattttagctgtccaggcaaagccgtatacggcggcctgtaaaccgggatgccttttctttcttcatattccgggactgttcgcacttgacggtatttttttttcagcagcctgagaggagcaggattcacaggcaatggacatatgaccgtcacatcaacgccctgcatctgcagcgcctgaacctgtgtttcatgaaaaacgccttctcccggcctttgactgcttggataaacgctggtaatccaaagaaccttcaatgatgaaccgccctttctgctgtcatcttcctaattgggccctcatagcccgccgataaaatttgccgaccagaaaaccgtaaaaaatcccgctgatcccgacggaaactgccagctgaagcatggcgccgtgaagcagatgtctgctgccgacgctcaagacaagagccagcaatgccatgagcagcgtcaaggccagcggttttccaacggttctgaaatattcgcccagcttcagctggatgacatatttgagcagccatctgccgataaagaaattgaccaggctgatcgctgcatatgtccaggcggtgatcgtcaaatcattcgttaataccgccgcgtaaagagacagcccataaaggagcatgatcccgctgtcccaataaaatgccaggtctgctcgccccttcgccagcaaaaccgatccgttcggattcatcagaaccctgagcagcccgacaatcgcgaggatgttcagaaccggtacggcctgcagccatttttctccgaagacgacttcaacaaataaatctgaaacagtcgtcagtccgatcaggagcgggaatgaaatcagcgcgagaagctttgtcatatttaaaaagccttcgcgcagcgtttggttgtccccttgattctttgagaagacaggaaacgctacccttgttacgatcggattgatttttaatacgggaatcgtaataatctgatacgccaggttatagattcccaatgcttccgcaccgagaaaccgcccgattaaaatcatgtcgatattggcgccaagcctgtttacaagccttgaagcaagctgaaacgcgccgaacgagaaaaattctttcacttcccccaatgcaaagacgaaagaaggacgccatttttttaaatatacagcaaaaaacatgatgcctttaaccgaattaagaaaaacttgtgacaatgcataggccacaatcggatccatcagaaaaaccaaaacgagcaggagcacaaaagacaaaacggtgactcccgcttctattttgctcagcacattaaacttcagatctttttgcagcatatattgatactgctggccgaccggggcgattaaaaacatgacggccaaaatccgcactagaaaaacaagttcgtcccgctgataaaagtctgcgatgaacggactcaggaaaaagaggccgataaacaaaaggatgcccgttaggatattcagccaatacaaggtcgataattggcgttcactgatgttctccttttgaattaaagcggccccgaatcccatatcgagtacaatttgtgtgaaaatcgttacggtggtcagcattccgaccaaaccgaattcggcaattgtcatgatattgccgagcagtgcaaactgtataatttgaatgaccgtgacgatcaaagttgaaacacttgtccattttgcaccgcttaatatttgtttcgtaatggtagacatagcatattcctaacttcctcgtattatctggctccttcgccagtcaatactactttaatcgttttcagcataaccttcaaatcgagaagaaacgttaaattccgaatgtaatacagatcgtgcaccaatttttctctcggactgatatcatagcctccgttcacctgcgcaagtcccgttaaacccggcttaacgattaagcggtttttaaatcccggaatttcgtggtgaaactgagcggtaaacatcggtctttcaggccttggccccacaatgctcatgtctccggccagcacattgatcaactgcggaagttcatcgattcttgttcttcttataaaagacccgactgcagtgatgcgcggatcatccttctgagcccatttcgcaccggatttttctgcgtcaattctcatagaacgcagcttgatcaccttgaaatgcttcccgtcttttccgacgcgttcctgccggtataacggagaacccggtgtttcgatacagattaatatacaaaacagcagaataaacggcagtgtaagagcgagcccaatcaaggaaaggacgatatccattatccgtttcatatataaataacgtactgcttttttagatagagcacaggaataagtttgctggcttgaatattcattgtacattcttaaacttttgtcgatactcactagcatacacctcgattagtatgttactgtttgatctattcgtcagtgtagcatacgaacgtaaacacaatgtaaaggagttattaaaattagtaaattcgttgattttttgttaaaaatgcaccgcctccgttttatctttaatttcaccaaaaatatcatactatataataaagacaaaacaaaggcagcataggcaatttttcgaaaaacgagttttctgtttatattttaatagtaagcaacgattccgtcgtaaatcgctttagcgcctttttctttgtaagtcgagcttttgagttttgtcgcatcgcttacattgctgataaacgcaagttcaacaaggcagcttggcatttttgattccctgatgacatggaagttgccgatctttacaccgcggttttttgtattcaatgcaacatagagacggttttgaatctcggttgccagccgtttgctgttggcagattcatatgttgtataatagtaggtttctgttccggaagcagctggcgttgccgagtttgcatggatgctgacaaacaaatccgcatgatttgactgcgcttttgacacgcgctgtgcgagcgtcaggtaagtgtcgttcgttctcgccataattggcagagcaccgccgtttgatagtttcgtattaattaattttgcaacatcaaggttcacgcttttctcatataaaccgttgccgacggcaccgctgtctgtacctccgtgccctgcatcaatgaagatttttttgccgacgatcggattcttcagctgtgacacgacattggattgaagagaaaccgttccgccaagcacagtaaacgtcgtcatgtttttggaaccgatcacttctcttgtcggtgtcggcaaagatgatgcattcgtgaacatcatcggacggttttgcttagccgccagaacagatcctgttaatccgtcggcatacgcatagccgttgctgatgattgcattcttggcagaagaataatatttcttgacgacattggccgcgacttcatagcggttgctgccgccgatccgcgtcggagaagcaagctgtttgtaaacgctgctggagatgctgacttcaccgcctacgacaatggtcgatgttgttcctttgctcttcatcgcattttttgtcgctgtcggtatggaattcgacgatgttaaaagaatcgggatgccgtttctcgcggcatatgcgccgatcgcaaggctgtcagcataggccgtcccgtttgcgatgacagctttcgaattgctcggcagcttattcgcaatattcgccgcaacctcgtagcgattcgctccgccgatgcgttcgacagatgacacaccaagctttttgatctcgcttacgacaccgttttgaacgctgacggttccgccgattacgatcactttgctaggttttaattgactgattcggtttttagtggccgttggcagtttagacgcttccgttaatagaacaggcgcgttgtttcgataggcaaatggagtcgctgaaaggacgtctgcatatgcctttccatttgcaacaatcacagtgcttgcacttgtccacccctgcttggaaacgttcaccgcaacctcatatcggtttgcaccgtctaatcttgtgacagagttggccgcaaatacattaggcacaaacaaaaagaaccctaacaacaacataggtacagctttaagaaaaaccctcaaaaaaataacctccaaaaatgtaaatgttatgttttcccctgaacatgaacagaggaggcactgctgcctcctgttcaaactctattaatagcttgatagagtcgtatttggatagtagaaacttaaaatcttcttgtaatcgtgcccggcagcagctctggcatttgctccgtactgactcatgccgatgccgtgtccgaatcctttaccgctgagagtaaaagcgttcgtattgctggatacagaagcatacgtgctcttcatattcatgccgcccagcatcgatcttaattgagtcgtcgtcacggaaatcgtcgctgttttttctgaaagttttccgtttgatagaacatagccatttgatttttctttaacaaagtaagaaaacttcacctctgctgttttcggccgctgaccggcagtttttgcgctgctcagggtcaggcttgagattttcgtaatcttaatagattctgcactaggatatttattggtaataaaccagcttttcagtccagacaaataggcggagttcgtttcatttgtcgtattccaccatgtgccagggctgctcaggtttaagccgctggtattgatctgcgtcctattcaaggaaatcgaccagctgttttgcgggtcatatgtatccgctttggcaattaaatatggcacactgccgccccatacctctgcgcttgcttccgtatatcccccgttgcttgacgagtaaacggctgaaatcaaattgccgttatattttaaaacttgtccttttgtggcatttacaacgctggatgtcttcgaattccagtcgtatcctccgtatacttgaaacgcctgcgtatcggccactacttttcctgcggaaccgaccgaataagttctcgccgccaccgcttgggcttttaacgcttccgtctgccagcttgccggcatttcgtgcggcacaacaccttttaaataatcttcgaacggaatgttttcgtttatcggccgaacatatttgcttgattcaatcgtaaacttcatcttgcctaaataaggccttccgttgatgctgatggaatttgacgtcgaatattttttaggtgatgccgtaaatgacgttccaagcgttttgacggctctattatttttatagagcacaagctttccgctcgacacgttaacagagtatccgtctccggtaaacatatctgccaggctatttttcaatgaatccgtgatcgaggtggtccccccaagcaaagcaaaagactgtgttccttttttcgcgactacatctgcaacaggagtcggcaggctgcccgcttggacaagcagcaaaggatgcttttgtttggcagcaaggacggaaccggccagcgcatccgcaaaagtcgttccattagacatgaaaacctttgatgcgttcatgttaagcgtgttgacaatgttcgctgacacttcgtatctgttcgctccgccgatgcgggtaacagccgcttttttctttaatgtgttttcaacgcctgtgctgacactcaacggaccgccgacgatcgtaaccttgctcggaatattgtaatcgcttcggattgtattattccctgagagcagtatcggataaccgttcattgccgcataaggcgcgatagacagagcgtcggaaaagactaagccggtggcaacaatcgcttggctgtaggaccccatccggctcgcgatgtttttggacacatcatagcggttggcgccgccgatgcggtcaattgccccatactttttcagcgtgttttcaacatttttggaaacgctcgttgttcccccgataattaagatattatcaggcttcatcttggcaatttgagtttcggttttcgccgtcagcgtacccgcatccgttaatagaatcggcgcatcgtacttctttgcaagcggagttgcagaaagcgcgtccgcaaaagcgtcccgattgacaaccacgacagtgctcgggttcgtccatccggcagatgcgacattgtttgccacatcgaagcgggtcgccccgccgtaccgctctgtcgcggcgattcccgagcccgggatttcgtatgcgccggtaatgtcgacatcaacgcttgatttattgcccaaataattgcttaactttaccgaaatggttttgtcggcagcctgggcagattgtgtaaacatcagagctgcggcagttactgacgacagaagcagaagcttcatctttttcaaaacgttatgtacccccttgattcagctctttattttgtttcgatgcttttcagctccaaaacgccattttcaccttttgtatattggacttcgacttttttgccttcttcaatggaattgactttgtcctgaagatcttcatcgacttgaagcgttgtttctttgccgtcaatgttcaccgcaattgtgtggctgtcagccaaccccgcgaatgaaccttctttagtgacggtttcttcagaggccgcatttttattgtctgagcttgacttgtcctccgattggcccgaagtgccgcaggctgacaacaaaagcagcattgataatgttagaactatgagttttttcatcttcttcacctctccctttttatcgacaaattccaacagattctttaattatagcgaaaaattttgcagattgattggtttttttgaaacatttttctaatgatttcgtctatccaaaaggacacatataaatttttgttgttttcgaattttaagaaacttataatcaaagtagactattaaaaggtgagggctatatgagagctgaaaagaggaagaaaaagaaaaaaattctatatacaattatcgctttgattggcattttcgttctcagcacaggcagttatgcctattacttatggcataaagcggcatctactgtagcgaacattcatgaaaatattaacaaatcaaaaaaacgcgattcagctgttgacattgataaccatgacccgttttccgtgcttctcatgggtgtcgatgaacgggacggtgataaggggcgcgcagactccctcatctatatgacggtgaatccgaaaacgaaaacgactgaaatggtcagcatcccgagggatacgtatactgaaattatcggcaaaggcaagatggataaaatcaaccactcctacgcattcggcggcgttcagatgacggtagacacggttgagaacttcctcgatgttcctgtcgactactttatcaaagtcaatatggaaagcttcaaggatgtcgtagatacgctcggcggcattactgtaaacagtacattcgctttcaactacgacggatattcattcggcaaaggcgagattacgctgaacggaaaagaagcgctcgcttatacgagaatgaggaaagaggacccgaacggcgacttcgggcgccagaacaggcagcgtcaagtcatcgaaggtatcattaacaaaggcgccaatatatcatccatcacgaaattcggagatatgttcaaagtgatcgaaaacaacgttaaaacgaatctcacgttcgacgatatgtgggatatccaatccggctataaagaagcccgctcaaaagtcattcagcatgagctgaaaggcgacggcacaaaaatcaacggaatctattattacaaagccgacgaaagttccctttccgacattacagccgaactgaaagaaagccttaataaataaaaaagcttcctgaaaaggaagctttcatattgttggaaaaaatcccaaaaccaaaaccaaaacggttttggttttgggattttgtcatcttttcagcgtgattgaaaacccttgcagtctaggaaggccgagcatcggagcgcagcgaatgttggaattcgtgagcaccgacgcgcaggcctgacaacgaatgcgagggtttgtcgacaccgctgaaagcttcctgaaaaggaagcttttttatttatctttaaacacatcaggccgcgcgcttcggtatccgtaccgataaagcagcgcctccgcaattcgccgcgaagcctgtccgtccccgtacgggtttgaagccctggacatttttcgatattcatcttgatcggtcaacagctgtttagtcagctggtaaatcttatcttcatccgtgcctgccagtttaagcgtcccggcctggacgccttcgggccgttccgtcgtatcgcgaagcacgaggaccggctttcctagcgacggcgcttcttcctgcacccctccagagtcggtgaggatgaagtgagcttcagctgcaaagttgtgaaaatcgatgacttcgagcggctctatcaggtggactttattcaaatcgccgaaatgctttgcagccgcttcacgaacagcgggattgagatgaacgggataaacgacctggacgccgtcgaactcttcgacgatccgcctgatcgctttaaacatgttttccatcggcttccctaaattttcccggcggtgggcggtaagcaagatcatcttatcatttccgattttttcaagaacggggtgtgaatagccgtcccttactgttgtgcgaagtgcatcgattgcagtatttccagtgatgaaaatcgtctcaggatctttattttcgcggagcagattctgttcggcctgctctgtcggcgcaaaatgaagatcggcaatcgatcccgtcagctgcctgttcagctcttctggaaacggcgagtatttgtttccggtcctgagccccgcctctacatggccgacggaaatctggtgataataagcggcaagactccccgcaaatgtcgttgtcgtatcaccgtggacaagcacaatatccggtttgatagactgaaacagctcgtccagcttcacaagcgcattagacgtaatttcagccagcgtttgcctttctttcatgatattcaaatcaaaatcaggctttatgttaaaagcttcaagcacctggtcaagcatttgcctgtgctgggctgtaaccgtcacataagactcaatttcgggatattttcttaattctagcacgagcggagccatttttatggcttcagggcgcgtgccgaatactgtcatgacttttagtttcttcatttttctatcacctgttttctgtatgaacagcttttttaagaatcgtctgctgaatcgattgattaccgctttgcccgtgttttctcgttggaattaatcccgcccatcgattgcttatggacgatattctcatcataaaacatccgttgatcaaaccgcaaaccatcctgttgaagaatgagatttcccttcattatataacatctttgcgctttatacctgtttagacttgtttaagaattgtttttcttatatgatgagtttgtaattgtaatttttcggggtatatcatacatatattcagcatactctccgcttttctaagcgtattttttctggctgagtagaaaacacagtttaaggaaggtgtattgaattgaagaaagttcgtaaagcgatcattcccgcagcgggccttggaacacgtttcctccctgcaacgaaagcgatgccaaaggaaatgcttccaatcgtagataagccaaccattcaatatattattgaagaagccgttgaagccggcattgaagacattatcatcgtaaccggtaaaagcaaacgagcgattgaagatcatttcgatttctcgccggagctcgaacgcaacctggaggaaaaagggaaaatcgaactccttgaaaaagtgaaaaaagcgtcaaatctcgctgatatccactatattcgccaaaaagaaccaaaaggactcggacatgccgtttggtgcgcccgcaactttatcggagacgagccgttcgcagtgctccttggagacgacattgtccaagccgaaaaacctggccttcgccagctgatggacgagtacgaaaagactctctcatccgtaatcggcgttcagcaggtgcctgaagaccaaacgcaccgctacgggatcattgatcctttgacaaatgaagggcgcctataccaggtcaaaaactttgttgaaaaaccaaaaccgggcacagcaccgtctaaccttgcgattttgggacgctatgtctttactcctgaaattttcatgtacttagataaacagcaaatcggcgcaggcggagagatccagctgacagatgcgattcagaagttaaacgaaatccagcgcgtattcgcttatgacttcgaaggcaaacgctatgacgttggagaaaaactcggttttatccagacaactctcgaatttgccatgcaggacgacgaactgaaggattcgctgattccatttatgcaggaccttctggcaaaagaagaagtttaataaaaaagctattggatcgatatccaatagctttttataatgccatctgcaaaatgacgcgcctttccttttaaacaaacatcgctccggcagccaatacgaccaggatggacaaacctgcaatcggaatgatatttgccaaagatttttgtttattcttgtctttttcgagatgagccagatcttcttcggacaagacctgtttgcggctggctaactgctcttttttatatttgtctttctcttttttggaaagctttttaaaccagctgataaattctttatattcctttacgaccgtctttgtgtcatcaaacatgcgaagctcgccattatcgatccaggcgacccgatcgcaaattttctcaatttgaccgattgaatggctgacaaagaatatggttttcccttgatttttaaactcggtaattctgtcgacacatttatcatagaaggtttgatcacctactgataacgcttcgtcaataattaaaatatcgggatcgatatgcactgagatcgcaaagccgagccgggatttcattccgctggaatagcttttgaccggctgattgataaactcgccgatttctgcgaattcaacgatgctgtcatacatctcatcgatttctttatttgtgagccccatcattaagcacttgagacgaatgctgtctctgcccgtcagcgcattgtttaatcctgcggaaatcgcaatcagggaaggctgcccgttcatttcgatttcaccgcttgtcggcggaatgatttttgccagcaggttggacatcgtcgattttcccgatccgttaatccctacaaatccgatcgtctccccttcgtacacgtcaaaggagacattccgaacagcaaaaaaacctttatccttattcggaaaaaacagccctttaattttatccgattgtttttcataaagctgatactgttttgaaacatttcgaaacgaaacttttagtttcatcgttaaaatctccttacgtattaaagaaagtcaacaaacctgtccctgaatttcatatgcaggacagatcctacagtcaagagcaataatgtgaaagcccagaaatacaacgtatatgttatatcttcgaagaaccagcttccgtcgaaaaagctgtttctaaatccgtcgataatataaaaaagcggattcagcttaatcacgttcaacaatgccgggtgcttgtcccccagctgcgtagagatatcccaaaaaatcggcagcaggaaaaacaacagccttgtcaccgattgcagcagaaactgataatccctgaccagtacactgatcgttgaattaaacaaactgaatgcgaacataaaaacaatcatgcaaaacaaatagtaaatatattcaagccattgaagatttggataaatgccaaacgcaagcagcacaatgacataaatcgccatcatcacaaaatagctgaacaggttagccgcaatcgccactgaaggaagagagctgattggaaaattcattttggccaccatgttgattcgcttatatacactgtttgaaccatcaagaatcgtcgggctgataaaaaaccagggaatcaaaccggcaagcatccatatgatgaaaggcacttcgccgacccccgtaatcatctcactgctctttctgattccgatcccaaatacaaaccaataagccagcatctgaatgagcggattcaaaaactgccataacacgcccaaataattcatttgatattttgattttgtttcgtaagctgccaaacgcaagattaaaggaaacgatgttacttgttctttcagtattttcactaatgcattcattctaatcttccttaagggattaagatttgggctacaaaagaaccctgattaaaagcactgctctttattgtaacagatgatcagttttttttcacttttgggggcccaatttagatctcacaaaagcttcaaactacggaaccactttaccgattcagtgatactaaaaagcaaatgttgaggcatttgcctcaacattttctgttagttcaaaactttgtagaaggtatccatagcttttttattatactcattataatcaaaagcttgcataacagtattaatctctgttcttactgcttttaaaccattttcaagaccggctatactatcatctactaaggttccgtatctgccgttttctaaaactgttctattggcaataatgtcagttgccaatattctcattcctaaagtcatggcctctaataataccattggttgtccttcataatgggaagacagtacaaaacagtcgcacattttcatgaaaccaaacggattttccagttgtcccatcagatagacgtaatcttgaagttccaaactgtccactattttttggagatctttccttaaaggaccatcccctaaaatataaagcctgctatcaggataactctgaatatgagtatggaaagcttttattagattatcttgccctttttcaggggagagtctgcccatattaacaaagttgtagttacattcagatggataaggaacaagagtcttacctacttttattccaggaggctcaattacatttaaagatttgcgtcctatccaccccaacactttattatttaagactgctttgcaataagtgccttcttgtgtaagagcttcttcaacaatttccacttcttgttcattgaatttttgatagtcctctataggtgtacatccaggtaaatcaaaaggtttattatatataaagtcagcatcgcttaagttcacaatcgcattgtatttcacttctctgcttcttgcaatgacaggctcttctataatattaaaagctctagagtccaaccatccaattgcttttccatctgcatagaaccggtagtattccccttcttttgtcttatggctttttttgacaatgacaatggtatcgttaaattcttcagcagttgatatttctttacacccgttattaggataggctttggtccagattgtataattttcgccatttgtaatagtcgcgaataaattcatctttatttcttctaatgttctgttctccagcccctgaataatctttgagtgttttttataatttttgcgcttaattttggctttttcattctttatcgcagattgcttttctgtatcctctggatgtgactgatactcttttacaattttcaatgctgaattatcaatccaccctattaatatatcattaatatatattctgctgtagaaagaatgttgagttctgacttctttatctacctcaacgataatccctttatattgtttgctggaagatactttttgtacatctaaagttttataaggtttattccagatgtcgtttccattagggtgttgaatgactgccagtttattgactttcctctcaagtaaaatgctgtctggcaataactcaaaagcctctaggttcagccacccaataatactgtcatctatagtaaatttataaaaaacttttccatcattcgtatgagcttctcgtattatggtgacttctttattttcaaattccttagccggtgttaatttttgattcactttatcaaacagtgaattgataatgaagaagccttcgacatttacaatctttgcccttgctttaaaacttttattggctatgatttcttcatggttctgttcagcgattgctaatttctcagtatccttttcttttaaatgatcgatcccgagaattttttcaggattaatagagttcattatatagtcaaatttgtcctcatcagcatatatagcaagattctttttatttaactccatcgttccctttgaaacacttactagcttatcgaatttattgtaaatagagaataatcctctcagattaattttgtgcggacgacgcccattaaccaatctttcactatctgacaagaggtcattgtgcatatagcaaatcttcttttttgcatctgcacaaactaaatacttggcccagtataagctgtacccgctgaaatcaattacataatcaaatttagattttccaaaaagccttttatgttctcttaaatatgcatcctctgggtacaacttcttttcaagtttaccgttagctcccctattgtgcaccagcttatctttatatacatcaaacaacgtgtaaactggtaaaccaggcttaaatatgaacctaacatttttattcactttgttgatattgtttagaacctctcttgagtggggagttttcataaaacagcttacatcatatttatcaaagtcaatattattcattaaattaaggaaagaagatgtaatgccgttatttttcattcctcctggatagatcaagatcttttctttctttttatccagatctctaattacattcaattgtcccttgtttttgaagattttctcaactactcttttcgtaacatttccgtcgtcgtgattcgtaaatttcactttattcttttcataatttgtttgaaattctgatttcacttgatgaatattgccaattgcttcgactaattcccttacattgtataggacaggacctggaagatcttcattgttaatatattttcctcgttgtttattgtagtcatcggcatcccacatataaaacaaaatcggccgatcagtgacaagaaaatcaaaaaatatgctggaatagtcagttattaatatgtcgacagtacttaacaactggttagtatcaataaagtcaggtatcagtttcccttttaactctgaaactttagaagcctcactatataaaaacgggtgaactttaattaacacattataatcactgccgattttctcctctaaataattcatatcagaaataatttgaaaaacgtcgttttttacttttgatacactattccctttccatgttggagcgtataagatcgtttgcttatcatttgagatcagtaaacttaagtcttttaaataacttttaaactcttcggggctcgtgttaagggttaaatcaatccttggatagccttcttcaatgatctcaccgctgtacagcccttctaacttatagctgttcaaaaacatattggtagtatgcttatttggactcagcaggtaatctgcacttataaagtttctaagtacgttttgtgaatgggctggatttcctggaatatcaaatcccatgcttttcagtggcgttccatgccatgtgtttatatatacttgttcttctttgcatataaaaaatgactgtaacgtagagttattgattagatacttggcagtagccaaatattgcaggtatttatctgaatttcttttaacaaactcaacattcggcatatctttatacttggagataactggctcgagcgcttcaaaatctgcaatagtccaaatatgcttataatggttgaattctggattttttatcaaatagtcaaatattgcaaaaggactgtcagtgatactcttcccatcacggctttcgtataaaattgtgttgtccacaacattcaattttttataaaatttagcgtacttattgtttcttctatgatttctttttttgagatagttctcaatagggtctttaataaattttatttttcttttcaaaacttttttgttcattatttttcttgtctccttcaggattacatacgtattcttttattataagaagttttatttgtaatttagtctaattgttcaatgtactcggcaatcattattttgatttcggaactttttcattttataaaaaatgatattccgagtgattgttaatggcaagaaaaaaagaagtaacatacatcacttctaaaaaaaatgttaccattccaaactaattacaattgaaattttaacattcttgtaaaaattattaaacctgtttttattctacaagatctgttgatttcacaacatctccagatactatgttaaatctttgactgttgattatttttatgataaaaattataatagcataagtttgcttaaaagttaagaccatttaggcgatttagaataccacttttgtaacatttcacttgaacactttttattctcatagggaatattggatattccagcataatctatcatcgaaaacgcttaaatttttccttctgaaaacttcgccttctttctttattgttatcagaagatattttacaaaaaagccattacataaagcaatggcttttttgtatttatttaaataccgtttttacaactttttcagttgaattgcccgtctccaggtaacaaaacttttcataaaaaggctcaaaaatgtcaggcagacgatagtcagatgtctctgtttccttgattttctcaattacttcctcagtcgttttgaccaacggtcctggtgcttcttgttcaaagtcaaaataaaagccgcgcagcttgtcacgataggtttcaatgtctggaacgaagaaaatcatcggacgcttcaaatttgcgaaatcaaagaatactgaagagtaatctgtaattaacaaatcagataccatataaagttcgcgaatatcttcgtatgatgagaaatcatatgcgaatcctttgtacggcgataggtcaaagttttccgcgactaaatagtgcattcttaaaacgatgacataattatcgccgatctcctctcgcagcttttccaaattcaaatcaaggtcgaatttgtattttccttttttatagaactgatcgtcccgccatgtcggtgcatataaaatgacctttttatcttcggggatattcatttttctctttatggccttcatcgtttccgggcggttgtccgtatacagaaagtcattcctcggatagccggactcaatcattgttttgttaaattgaaaagcgcgggcaaagatttcggttgaatagcgattcggggagattaaatagtcccacttcgatgcttctttagtgaaattttgcttgtacttctcagtgttggtgcccggcatgtgcacttcttccatatcgacggcaagccttttcagcggagtcccgtgccatgtctgcacatatgtcgtgtgctttggttttgggatccacaaaggaagccggctgtttacaacccaatattcggcccttgccatggcgaacagccacttcagcgtgaatcggtgaatataagggacatttttttcttcaaaaatttctgtataactcggatttacactccatattaagttgtattccggatgatgttccttcatatattcgtaaattgctctcggattgcagctgtactgcttgccggcaaagctttcaaaaatgacggttttctttttaacagggagtttgccggccagtccaaaagtaaaatagtatgctctcttcaccatgcccgaaatctttttctttgctttattcttgcctttgcgtatgactgacatcagcctttttccttttcctttggcaaaataaaccgcacgggttttgatcgtatagtcattcattcttagacgcataccccgttttcgcttctgcggataaatgtgaaaacgagccggtcctttttttgtgttaacaattgaaaaactttctatatcatctataagcttgaatgccctgctttttatagcgatttcctcccctgttgcagcatcttcacctacgtattctatataaaacttaaagaaagcaggcatcctgttctcctcatacagctttttcagatcgatttccgcctcaaatccaacggcatgatcagaagaatcagctgacaaatcgacgcgctgaacgccttttaaagggaaattgaaaaccctttctttatcgttttggctaatttcctttaaaaccagctttctgctttttattatcgaacattcttccgcatcgagcagaaaagtatagcctctgatcattagttttccttcggagcttaacttaatgctgtccggttccgctactgcttttctccgtgaaacatcaagagcgaagtggccttttcgggtcgtatacggcaaataaatgaactgtttgactcgatcctgatgccaatacagctcaatcggttttgaggctgtgtaaatcctctttttacattgatttttttcattattttcatatagcacataaaaatcaatgaccgtttcgtctattatcaggttagaaaggttatttaaagatatctccgctgcttttaactgccctgaatcgcttattttgttacaagttacacgcatctcttttttcgaattgcggttcactgccaaaataccgacatgattaagagagatagaactttcgaacacaaaatagaggcgagcgtcgttaatttttatttctcgcagctgaaattctatcggaattgcactatccataaaatcagtctactcctctttttttattcaaaagcaaagccgttcatacttattatattaaaatgattcgtatacgaaacaaaaagcacttcttattttttttaagaagtactttttgaattttatttaactgagccgacattaaaggttcgcgatttcctctttgatcttcgtcgtggaaatcccttcggttctcggaaggtaaacaacctcgcagtatccttcaggaagtcgaatttcccttcccagtcatcccccatgacaaatacatcgatgtcatgatcgatcacatcttgtaccttttgatcccagtttttttccgggatgacttcgtctacgtagcggatcgtttcaagaatcagcttgcggtgctcatagctgtgatatgcttttttctgcttttgaagattgaattcgtcagtcgaaatcgctacgacgagataatcccccaattgttttgcccgttccaataacttgatatgtccccaatgtaataaatcaaacgttccatatgtgatgactttcttcattgtcatgcgctctcctttctaatcttaaggcgaaatgctatattgatatatcaaaaacactcgataagttacattcattccacaggtctttactgatcattcattatagcacatcgcctatcaaacgttaagtattctttaaggttaatgcaattccaaattttatctaaaaaaatcgaaccttttctgaataagacgtaaaaaatcttaatctaatgtaaagatattgttaagcttttatgaatgatctatgctaaaatatacgttagacctcctgaatttatgggctggtctcttaaacttcgactttcatacattcgtatatacttacacttcttaaaccggaaggaggaaaaaaactatgctgcaaacggaaacggttcatcatcttgcatatgttaacggggatttgcccggatttttgaatcatcttgaaaaatcctttatcgaccgcaatgagggggcatttatcgcaacggtaaaccctgagatcgggtatgcggctgcaaaagacaaggattattttaaaacagtttcatctgctgactttatccagccggacggaatcggcatcgtcctgacgtcaaggctgatcaacagcagattaaaatcgaggatcgcggggtacgatgtatttatcaaccttctcagcttggctgaccgcaaaaagaaaagggtctttttatacggggccaagcaggaggttattcaagctgttgcagatcggctttcaaccgaatatcccggaattgagctggccggatactcacacggctatgtcaaagacaaaggcgaagttgcgaagcaaatcgcggctgccaagccggacatggtttttgtcgctctcggatatcctcatcaggaaaagtttatttatgaacataagcatctatttcctcaggcgattgcgatcggcatcggcgggagcttcgacgtgttcagcggaaaagtgaaaagggcgccgaaaatgttcatcaagctgaatcttgaatggatgtaccgcctgctgaccaatccgacaaggtggaagcgcatgctgaacatcccgaaatatgtcttctccgttctgaaagaggaaagagttcaaaaacagcggcactactatccggagcagatcaaagagcaatctaaaatcgatttgtagaaaagagtttgggtaacgaatgaatatacgttctttattggttatggtttactcggccggtctcgctttgaccggttttattttcagattggtaaaagcgcgcgacagagctgtattgcttgtttcctttccggataatgcgcgcgcgctgcttgatgagtatgtcagcagcagccggccgtttgaaatggaagtcctctatacaaggcacgccgtttcccttgcagatgaatatccttccgttcgatcgcaagtgatcaacgagaaaaatccgattcatctcataaaagccgtataccgaatgttcaggtgtaaattcgtgttgacggataattattttctgctgacaagtgttttgaataaacgccctcagacgacatgcattcaaatttggcatgcgtccggcgctttgaagaagttcggactcgaagatatcggaaaccgctatcgatccgccggcgatatcaaacggtttaaaaaagtgtatcgttcatttgatcatatcgttgtcggctcggaaaaaatggcggatattttcaagcggtcattcggcttgggagatgaccgttttttgcggacgggtgttccgttaactgatgagtattttcatgccggaagacaaacagcggagcgtccggaccaaaaggttattctgtatgcgccgacatacagggactattgtttgacgtccgttcgtctccctttctctaaggagcagctctccggggaactgcagggagaatttttgctgctggtcaaactgcatccggccgtgcgggaacagattgcttttgaagagcacgaagggctgatcaaagacgtatcagacgttccgttaaaggatttgctgatggaaagcgacatcctgatttccgactactcgtcggtcgcctttgagtacgctttgttaaataaaccgattttgtttttcacgtatgatatggcagagtataatgaaaaacgcggactgatcgatgattttgaagcagtcattcccggcaaagcctgcatggacagcgaaatgctgctgaaagaaatcaaagaaatgtccgatacaaaggaagagatcaagaagtttgcggaagagtggcatcaatattcaacaggtgatgccagcatgcgcctgttgaactttatgagcgagcatatgacggcaaatgaaaaaagaccggccggttcctaatggaacatggccggtctttttatgatgattaccgataaaccggcacatcatagtacagcgtatattgatcgagcaatgtatacagactgtacattctccccacctgcttacaagcccatccgacatctgtcgcatattggtgaagggcattcggagaccatctcattttatagagggtgtcctgtttgtaagtcgggtggtgaatgtatttttcaccgatgaatttggctccgcccataatggcggcctcaggtgtgaaccacccttgttcataggcgtattttgcgccgtagtaaagcgggttgctgtcgtaagccccgacgccgtacatattgtaaacctttttgccgttgaacatcgttcctttagccaactcggaagttccgttgcccgtctcaaggagcgagtgtgaaatgaggtacagttcattgatgctgtatgctctcgccgcgtcgatgaacgcttgccctttgcctgtcaaaacccctttattataaaggatttttgcattgacctcggcagcattcaatccggccgtttgcgacagttttaaaaattggaagtatgccgagctgtcttgtgtgaaattttccggattgacatatttctcgacttcatccctgctggcatttcgccaattcattctgatttttgcccagccgttttcctgggagatgatgttgactttatcccctttttgcagctgtccgatgatgttgccgcctgtcacaagggggcttgacctgatattcagcagatcagccgtgacggtttggttcgccgtattgatgtagctcaatgaaacataagccggcgcatccgtttgcgggctgactttcatctgtttatcgatcatctggctgagcgtgattccgtagtcagtcgttgtgatttgcgggccgtttttcactttgacgacattcaccggccagccgtaattcgttttgatccgattggcggcagcatccgcacggtctttccctgtaaattgttcattgatcgagatatgaaacaggctgaccgtctttgtttggtaagttgcgctgacattgttcttcttaaagacattcaagcccttgtcgagatctgctttgcttgtgattcgacctgtcgtcacccggtactgcctgtagccgtactcacccgtttgttcaatcttgcccggtatattccgcttgctgaaaaatccgagcgcctgctgtaattgttccgtgccgatcagagcttccgaactcagtttgtagcggctgtaatattggccggtcttcacggcctctgcgtgaatgcctgtttctttaaagaaattgagcgcctgcgtcactttgttctgttcgtatacggattccgttgtcagctgatagtggctgtacactttttttcctgttgatccggccgttcccgccgcaccgtttttcttaaagaattcaagccctttattgattcgcgcttgaacggcggtttcagcagacgcaatccggaagcggctgacggtcgtgctgccggtgctttgcgcagaagcctgaatatttttgtttttaaaaaaccggatgccatcgtttgctttcttttgatctgaaagcgggacggaaacgattctgaaagatgtctgctttttccccgcctttgcagcagtataacgccacgttttctttttgaaaaaggcgtcgatttttttgaggttttgactgtctacgcttttcatgcttacgatccagaagcgtgtaccttttaccttttccgtgcttgaggcgagaccggttttctttttaatttgtccggcggcatttttcgcgctcttttcgtcattaaaatatcccgatttcacattgtatagctgtgccggctgaccggcggcttcatatgcccctttgactttgagctctttttcaaactgcttcagcaggtttttcgcgtttgtttcgccttgtatcgaacttgtcgcaattttatatttaggctgttgtttctttacggtctctatcgttcctttaagggccgtttctttttcaaactggacaagcaggcttttcgctttgctctcatctgcgatttctgcagaataaagcttgacgatcgcttgtcccgctccgtatggtgcatacgacgctttgaggccggtcgctttttgaaaacgatcgaggatggctttcgtgttgtcttcgccttcgattcctccggtggcaaccttcacgtatgcttccctgttccctgcaagtgtataggttgctttcagaccggtttctttttcaaattggagcgcccattccttggctttttcttcaccggcaaattcctttgataccgctttggaaaacggttctttttttccaatcggaccataggacgccttcaaaccggtttctttttcaaactgcaaaagcagattttttgctctgctctccccttcgacaccttctgatgtcaaaacgtatgttgtgccgtttttccctgaaggtttgacctcggctttccatcccgtgtcctttttcagttgttcggctgctttgagcgcttcgctttcgctattaaactcttttgctgtttcaattttgtagacggaagtatcggtatatgctgctaaagcaggaattgccgggactgccgtatgtacgagcaaaatgattgcagcaaaaataacggtttttctaatgtttttcacattctttactcccctcgcctatgagcctcccaatttctaaaacttgctttctctttttatcggcgagccggattatttttttacaataaaaaagcttaacggcctttttttgcagaccgtcaagctttttatatgtgtgacacgattagttcacatgttccttctattgtaaagtcattggtttccgccggcaggataaaatttgtccctttgctgatcggaaataattcgccgccctgagtgagctttccttctccttcaatcacgctgcacaggaggaaaggggcatcctgggtcagctcagcggcaccgtcgatctcccatttatatacggagaaatattcggcttcaacaaatgtcttaatggtaatgcctttttgagtttctgtcgattcgtcaacatagctgtctacatgcggtactgttgtgacattgatcgcctgtgtcaggtgaagttcgcgcttttctccgttttgatcggtccggtcataatcatataccctgtacgtcgtatcggagctctgctgtgtctccaaaacgaccgtcccctcgcaaagagcgtgaatcgtgccgcttggcacataataaaaatcgcccggtttgattttgatccgccttaacaggttgtcccaatcaccgctgttgatcatggtgaccagttcagtccgcgttctcgccgtgtggccgtaaacgatctctgctccttctttgcaatcgatgatataccagcattctgtcttaccgagttccccgttttcgtgctctcctgcataatagtcatccgggtggacttgaacggaaaggtcttgattggcatcaagtattttcgttaacagcgggaaacggtccccctctgcacctccaaacaattcacggtgttcgtcccaaagctcggcaagcgtttttcctttgtaaggacctgaagcaacgatgttcggaccgtttggatgggcggaaatggcccagcattcacctgtcaaatcggagggaatgtcatagccgaatgactcgcgcaaagccgttcccccccagattctctctttaaactcaggctgcagaaatatcggtgattgagtcatgttgccatctcctcccttaattcacgatagtcttatgtaaataaaacgctttcttttattgatagacatgtatgttgaaatataaaccttttcatattcattatgacgttatctcgatagaagccaatgccggaaaggaaaaacagaagccctcttcaggcttctgcttgtgatgatgcaaactcaataatccgctggtttgagcttcctctgtaaagaagcgtcaagtccctttttttgagttcgaacgggccgtctaccaggacatcgcaataggccagcaaggcgctgtgcttttcattcttcaagatttgttcgtacgtatagccgctgtaaagccagatgtccttttcggaatgctgcttaattttttctgacagctcgatcagttcgcctgcatgcaaaagcggctcccctcctgaataggtgacgtttgtaagcgggtttttcataatttcctcgaatacttcgtctacactcatatcaaatccgttattgatattccagctttgtttattatggcagccttcacacatatgcgggcagcccgctaaaaacacgactgttctcagtccttctccgtctacgatgctgtcatggataatattcatcactttcatagatgcttcactctgtccttttcttcttgtcttttcgccgaattccactttgacatatctccgactaaatatcctgtaatccgtctgattcgttcgatcaaagcctcatcccggtttttgcactgcgggcattcattatctatgattccggtaaatccgcacgccttgcagtggtcgacaggatggttgatcgaggcgtagcccatgcctgaccggcgcatggcggtcacaagcatgtccatcgctttaatgttttttttcgggtctccgtccagctcgatgtagctgatgtgccctccattgcacattaagtggaacggcgcttcttttctgatcttttcgaccgcagtcagcttatagtgaacagggatgtgaaacgaattcgtatagtacacccggtctgtgacattgcggatcgaaccgaactccactttgtcttttttgacaaatttccctgaaagcccttctgccggcgtagcgatcaaggaaaagttcaatttgtgtttttctgtggcttcatcggccttatctctcatcgactggacgatttttttgccgagttcaaacgactcctcgctttctccgtgatgttttccggtcaatgcagtcaaagcttcagccagcccgataaatccgatgctcaatgttccgtgctttagcacatcctcgagcgtgtcctcaggttcaagcttctcgctttcatgccagatgccttgtgaatacaggaatttaaagtcctttgctcttttcttgcattgaaaggcgtaccgttcaagcagctgttgaatcgttaaatccatgtagcggtttaacaaggcaaaaaactgttcaacgttttcgctgagcagcgctattttcacaatgttgatcgaggtgaatgacaaattccctctgccgacgctgttttcttttccatgaatattggacatgacgcgcgttctgcatcccatataagcgatttcgctttccggcgttccgtcataaaaaggtttgttcacgggcgagtcgataaagctgaagttcggaaacagcctttcagcgctcgtttccaatgcaagccggtacaagtcatagttagggtctgtttgatcaacgttcacgccttctttcattttgaagatctgaatcggaaaaatcggcgtctcacctttgccgaggcctgcttttgtcgccttaagaatatttttgatcaaaaggcggccttcccttgacgtatccgtgccgtaattaatggaaacaaacggcacctgtccgccgcccctcgaatgcatgctgttggcgttatgtataaatgcttcgcacgcttggtaagttgtgttgtccgtttcttcccacgctctttcccttatctcttcttctgtcaaagttgtcgggtattgtttgattttcgcaagatgcttttcgtacgttttgcggacgtaaggcgccagatcgtaatcgaacattgggaatgactggccgccatgctgcatattttgattcgattgaaaaatgatagatgcgagtgacaatgcgctcataatgtccttcggttccctgagggagccgtggccagtgtggaatccctcctttaacagccggaccaatggtatctgacagcaagtcgttgtcccgctcggcatatagtctaaatcgtgagggtatataaagttgtcatcgactgctttcttgatttccggcgacattaagtaatggagcgcataatgtctggaactctcggatgcaaaccggctcatttgccccatcggggagcggccgtctacgttggcattttcctgcataatatcgtgatttccatacccgacgatatcatgaaatgtttctgtcaattgcaataatccctgttctttaaagcctgttgtcatcctaatctctcctaaaaagtagcatatatagtgtttgttcatccaacagacactatatattgatattagcacagattatgttcgtcaaatttagcaatttggtgacgtttcaaaaacggtcataaaaaaacgccccggacaaatgtcccggtgcgcctgcggcaacattacttgtaatcaatcgtcatttgtttcggagattttctttgtttcgtccgtttttcgatccagacggttgcaagcggcgtcagaagcgaggtgacaatgacgcttgtcgcgatgatcgcggttgctgaatcagctaccggcgcaaacacggggtttgcatcggcaagtgcatacgggacggctaccgcagccccggccgttgatgacgccgctactcccgcgacaccgtctcctcttgcgacaaagcggtccagcaagtatagagatgcacccgagagaatgacgactgatacgccgacaacaatgcctaaaaggccggattgaatcaacatgttaaaatcaagcgtgtttccaagtgaaaatgcgaagaacggaatgatcgccggtacgacttttccgaacaaatcgcgcaattcagggtcaaggttaccgagaatgcagccgagtaaaaacgggatgacggttgcagccagcgtctcccaaggaaatgccgcaagccctgtcacaccgaaagtgaccatcgtcataaacgggcctgattccgtgctgataaaggcaaaagcaccggcgtcttcctttcttcccatgtgattcattaacgccaaatacagaccgccgttcgtttcattcataacggctacgatcgccagcacggacagtccggcaaaaaacccgctttgaatgccttcgtctggaatgaactgcgctgcgatcaaacccaataatgcggcaaagccgactttgccgatcagaagcgtcagccccttcctcgcaatatatcctgaagaacgaaaatctattgtcgcgccaacgcaaaagataaatactcctaaaatcggcagcgttccggtaatcagggcgcctgtaaatccgccgaaaaactctgcggttcccggtgcaaatgtattcagcgttgcgcccagaaagagcggaatgatcatcatgccgcccggcacacgttcaatcgttgctttaattttcatcatttttttctcccattctagaaattaatgaaaaagcaaagctgtcgatcttgcaaaacctgaagtctttaccacgctgcgcacgctttatttctgctgagcccgccgctgaaagatgcgctggagatccgcttctgacactttgttcagctggcttcccacacctactgccaatgctccggcatcaagccacttctccacatcgccgggatggattcctccggttggtatgaaccgaaccttcggaaaaggaccggcgaggttcttcatgtaaggaatcccggatgttccccctggaaacagcttaagaacccgaaaaccctttgagaccgcttccataatttcgcttggcgttaatacgccgggaataaaaaatgtatgcaatgatgcggcctcctcagccagtgattccgaaaaacccgggctgacgataaattttgaccccgctgccgcggcttccctcgcctgttcgctttcaaccaccgttcccgctccgacaagaagaccgtcttttcccgcaaatttttcaatcagctcagacgctcccggcgtcgtatatgtgatttcaatcgcagtaatccctttgtcgatcagtctgtgaatggtctcctcagcagcctccttaccgtctgcgcggacgactgcgatcagcccggcctcgcccagctgctcttgcacttttccgatcatagacatttccattacggtcaacctcctattttttggttgtttttctctccagccataaaagctttcaattgatcccttgacggcagaccgtccatatcccccggagccatgacggccagcgctccgatcgcattggccctctgaactgcttcttccagcggaagtccgtctaaaaggccgctgatcatgccgacggcaaaaccgtcgccagcgccaacagtatcaacaaccttctccacctgataacccggcacataaccttctttttccgatgtcctgtaataagccccttcttttccaagcttgatgacaatcaccttgaccccctgcattacataatgtttagcgatatcctcgggagaattgcagcctgtcaggagttttccttcattgatccccggcagaaaccagtctgcctgcgcggcgatttcattaattgtatgaaccattgtctgctgatccggccaaagctggaagcggagattcgggtcaaacgaaatcgtcttcccgtcttttttcatctggtgaacggcgtggcgggcgaagcccctcatttcccttgaaagtgcaggaggtatgcccgtcacatgcatatgtttggcttgcttgaaatactctgccgggtagtcatcaatgctcatcgtgcttgcggctgatccgctccgataatatgtgacatcagggtctccgctttcaacctttgacttgagcagtatgcccgtctgccggtctgcggtgcgtttgacttcagaaatgtcgacgccttcttttttcaattcatttaaaataaaggttccaagcgaatcggcgccgaccttgctcatccagccgacccgaaaacccaggcgcgacagtccgacggcaacgtttgtttccgctccggcaagagctttggaaaacgaagacgcctcatgcagtccgcctgcttcatttgcgtaaaacatagccatcgattctccgaaggtcatcacatcaagcgacatgatttcactctcctttcaaaatggtaccggtttcaaaagcagttgcgggaaaacactctcccctaagttttcgggtccatgagtgtttccgtttgacaagttctacagcgactgtctgagaacaagctccgcctcaagctgaatcgtctgcggggcgctttcgtctccttcaatccgtttgatgatccgctccatggcgaccctgcccatttcatgcgacggctgggcgatggtcgtaatgcccggaccgatcaatttataccattctgtatcatcaaatccggcaattccgacatcttccggaattgaaatgccaagctcataaaggcagctgatgattttcagcatcagaagcccgttgtttccaagaatggcttttttcccttctttcatttccaaaaagcttttgacggactgtaatagagattctttgtctttgacgtcagcctcatatacgagaggggtaccgccggcgtttcgttccagcgcgatttctgtataggcggaggccctttcctcccttggactgattcccttaatcggttcggtaaacagaccgacctgggcatagcctttgtcatacatgagattgacgatttgacttgtcacttcgcggttgttcgttgtgactgcatcgatcttgagcccgggcactttccggtcaacgagcacaatcgatacatcctggctgattaaatccaagagcacatcgttgttccttcccgtcgtattaataatcagcccttcaatgtaatgcgcgttcagcttgtgcagcatctccctttctttctcaggactgttgtccgtgttgcagaccatgatgctgtatccgtactgatcgcaaacctcttccacccctctcaaggtggctactgaaaacgggtttgtaatatcggcgaccaaaaatccgataactttgctttttttcaccttcagcccctgtgccatctggcttgggcggtaattgagctcctcgatcgcttttttgatgcttttcacctttttcggtgaaatggcatcaatcttcccgttgatataacgggaaaccgttgattttgatacgcctgcatgtgcggcgacttcgttgatggttactttcgctgtttgcttatccttcattcaagtactcctataaccttatgatttgaaaccgatttcaaaaactttataccaccagcatatcacatcatttaaaatttggaagagtcttttttaatatttcagcattgtccttttccaatattcagaaaaaaagtgaaaagactgttgacgctttcccattatttcctttaaaatttcatgttttgaaaaccgttaccaaaaaacttttggcacttcattcaagtcagtctaaaaacgtccaattcaaaggaggagaaggtatggaaaatcgttattctgttcatccagaccaagcgaaacggattcacaaccgcagagcttcgcgagcattttttaatagagtcattgtttgttgaaaacaaactgaatatgttttattcgcatgaagacagggtcgtgatcggcggagccgttccagtaaaggagtccatagcgctcgatgccggcgattttttaaaaacggactatttcctagaacggcgcgaaatcgggattgtgaatgtcggcaagcccggtgcggttaaagtcggtgatgaagaatacgtactggagcacaaagactttctgtatatcggcctgggaaataaagacgttttcttctcaagcttgaatgaaggcggggccaaattttatttcatctcggcgacggcacaccaaaagtatccggtgcaaaaagcttctctttcagagctcccatacgatcatttaggagaagaagcctcttcaaatgttcgtaatctatacaaagtgattcatgcagacggcattcaaagctgccagctgatgatgggcattacgtttcttgaacctaataacacatggaacacaatgcctgcgcatgtccacgaccggcggatggaggtttacctgtatcttgatcttgctgaggatgcaaaggtgtttcatttcatgggcgaaccgacggagacccggcatcttgtcgtcgggaacgaacaggctgtcatttcacccgcgtggtctgtccactcgggctccggcacatccaactactgctttatatgggcgatggccggagaaaactacacatttaaggacatggatgctgtcccgatgaatgtcattcggtaaggacgtgaacgtgagatgggatatcttgaatcgtatttttcacttgaaggcaaaacggcgcttgtcacaggcccgggaacgggaatcggcaaagggattgccgaagcgctggcaaaagcgggagcggatatcatcggcacttcgcatacgagcggacttgatgaaacaaagcggctgatcgaagaagccggcagaacgtttacttcttatcagcttgatatgggcaaccttgacgaggtcgaggcttttgcaaaagaggtgcctgaccgccatcaaattgatattctcgttaacaacgccgggacgatccgcagagaaaaagcggctgatttttcccgggagaactgggaagcggtgatcaatgtcaatttgaacagcttatttttgctgacgcaggctatcggccggcagatgattgagcgaaagcaagggaaaatcatcaatattgcctctcttctttcatttcaaggaggcattcttgtccctgcatatacggcaagcaaacatgcagtagccggattgacgaagtcttttgccaatgaatgggcggcttataatgtccaggtcaatgcgattgctccgggctatatcgcgacgaacaatacaaagcagatccgcgacgatcaaaaccgcaatgccgaaatcttaaaacggattccggccgagcgctggggtcagccggatgacattgccggcgccgccgtattcctttcgtcgccggcatccgattatgtgaatggacatgtgttagccgtcgatggcggatggctggcaaggtaatgcgaggaaaaggctgccggtagctcggcagcctttatcatcgctatggcttcaaaattactttaatgcaatcatcttcatggtcgttgaacaaatgataagcgcggccggcttcttcaagcggaagctggtgcgtaatgatttccttcggatcaaattgattctcttcgatcttcttgtaaatctccggcatcaaatggatgaccggagcctgccccatttttagcgtaacatttctggaaaagaatgcgccgagcggaaacatattgtaattgcttccatatacccccgtaatctgtacggttccgcactttctgaccgcctttgtagaaatttgaatcggtccgagcgtgccgccctgaagcttcagtttttgctccagatactcaagcggagattttttgccgtccatccctacgcagtcgatcacgacatccgccccgccttttgtaatctcctttaaatgctcgcccatatcaggatattttgtaaagtcaaatacttcaacgcggtttaatgcctcagcctgctttaggcggtagtccaagtagtctactgcaatgacccgcttcgccccttccatccaggcaaacttctgcgccattaatccaaccggcccgcagccgagcacaatgacagtgtccccttttttgacgcctgcgtgaagcacgctccaatacgcggttgggaggacatctgataaaaacagaagcgactcgtcctccatctcgcatgattcaggaatgacaaacggcgtgaaattgccaaacggcacttttaaatattcagcctgtccgccagggtgattcccgaatttttccgagtagccaaaatacccgcctgaatcataatggggattggcattgtcgcactggctttccagcttgttttcgcaataaaagcaatgtccgcaggcaacggtaaacgggatgacaacccggtctccttttttcacttttgttacatcaggtcctgtttcttctacaattcccatcggttcatggccgagctggaagccttttggaagagggaaattcccttgataaagatggagatccgaaccgcaaatcgcggtagaagtaattctgacaacgatatcatcgcttttttcaattttggcatcctccacctggctgacttcaacatgctgaggcccttgaaacgttacggctttcaaatcgtcacactcccattatcgttcagttgactttagtgtgagataaacccgggttcttattcagttttttaaacaaacgtttcattagccgtcatgtagaacggccatgattcatacatagaagaaaacggaggtgttgggatgctgctgcaaatactggtcggaggactggttgttttcattattttttttctcgtgtttcgggcaatcagaacgggcaatctgccgcgccatgacgattcgcagccaggagacggagagaacagagatcagccatgatcggccggcctcttcacacaaaaaaggatggggccttgcccatccttttgcctatcgttcaaccggctgtgtgtcagttgccgtgattccgcggtgcttgtcccgcaaatcctgctcgatctcttccagacttttccttttgtttctgttactttaaagaagacgaacaggaaggccgcgattccaatggccgcatagcacagaaacaggtaactgatgcccatcgcttccatgaggaccggaaaactcaaagtcacaattaagttccctgcatggagcattaaagtcgatactccggttcctatccctctgacatgaagggggaacagctcaggcagcatcacccagacgatcggcccccagctgacggcaaatacgacgatgaacacacctaagcagatgacagtcgtccatgccgcaccagaggtattgccgaaaaagagattagaaaaagaaagcacgatcaaactgatgaccattccggcatttccaaataataaaagcggcttccggccaatcctgtcaatgaagcggatcgccacaagcgtcatcaggacattgaccgttccgatgccgactgtccctaaaatggccgccgaatcttcaaatccgacattcgtaaacgtttttggggcatagtaaataatcgtgttggttccaataaattgctgcagaaatgccagtccgacccctgcgattaacgccgggcgcacccacggttccagcagctctttcaagcccccctggtcctgcttttccgcttccttaatttctttgacttcctgatcgacccgctctcctcctctcatctttgacaaaacccgccttgctttctcttcttttccttttgttaagagccagcgcgggctttccggcatgaaaaagataccgattaaaaggccgattgacggaataagggccaatcccagcatccagcgccatgcgcctgcatcactaaatgcatagttgatcaaataagagagcagaatcccgatcgtaatcatcagctgatttaatgaagaaagcgcgccccgggattccttcggagcaagctctgaaaggtacaaaggaacgatggtcgttgaacagccgactgcaaggccgagcacgatcctgaaagccaccatatattccgtgcttggcgccagggccgttccgagccccccgatgcaatacagcacagccgctgacataatcgcccttcttcggccgaagcggtctgtcagcctgcctgacaaacccgatccgaaaatcgccccgattaatattgcgctgacaaccagcccttctgtaaaggcattgagcccaagttcatctttcataaacaaaatcgccccggaaatgacgcctgtatcataaccgtagagcacaccgcccaaggctccaaaaaaataaagccaggcattcgatctttttcccttcatcacagtatatcctcctccaaggctcgtcttttaacctttaaccttgtcttgctttcttcaaacctctagaaactcggagtaccattaaaaggaatttaaaaatatgaaacattttatctgttatatcgtcttattataggcggcaaaatgatcagtcccgcggaatttccagagaatccccatatgcaaaacagcaaatatattgtaaaatccaagattgggaaactattttttattaaaatttagacttattcaacaattgtacgtttcaatataaataaaagaggagcttatacatgctacgatcgcagcgaacgaagaaaaagagactaagaaaatgggtgaaatactcactgtttttcattgccttaatcctgacggcgacggcagccgcaggcggctatgcgtactataaagtggcgaacgcctccaaagatgcgcaagtcaccctttccagaggtgaacagtccgtcaagcggattaaagagttcaaccctaaaaaagataacttctccatcctgttgatggggattgatgcccgtcccggacaaagcatggacaaagaacgaagcgatgcgatggttcttgccacgttcaacagaaaagacaaatcggtgaaactattgagcatcccgcgggattcctatgtcaacatccccggacgcggctacgataaaataacgcatgcccactcattaggcgggcgcgaccttagtacagaaaccgtcgaaaacctgctcgacattccggttgattacgtcatggaagccaatttttcagctttcaaggaagtagttgatgaactcggcggtgtaccgatcacgatcaaagaagactatattgtccggcagattaaaaaggatacgaaaggcaaagtcaaccttcaaacaggcgagcagacgctgggcggagaagaagccctcgcttatgtaagaacgagaaaagccgatacggacttgaagcgcggcgagcgccagatggaagtcatcaaatcgattatcaacaaatccaaatcgcttacttccattccggcttacgacgatatccttgatacagtcggaaagaacgtatcgatgaacttgtcgctgaatgatgcaatcggactgatcccgtttatgacgtccattcaaacggtcgatacccttcaattgaaagggagcgattatcaaccgggcaaagtctactatttccagcttgatcaggaaaacctcaacgaaattaagcaggaattaaaacagcagttagatgtataattagaaaaaggatgaatcatattcatcctttttctgttttaatgaaactcaatatttactattgaaaaaatctaaatttaggtttagccttttacataacatgtctttttagggaatactgccgaagagagctgtttttcgcctcccgaaaaacggcaaactgctcttacaggaggttatctttacataatgagattaattgcgatcgatttagacgggactcttttaaataccgaaagcaaaatatccgcagaaaaccgggccgctatcaaaaaggcgctcatttcagactgcatcgtaaccatttgcacgggacgggccacatttgacgtaaaagcgcttctgaacgatttggatattccgattatcgctgcaaacgggggaacggtccacgatttcaactataaactcctaagcagaacgctaatggacaaggaagcgggaaaaaaggccgcccaatacttaacagatcatcaaatctatttcgaggtttatacggacgatgcgctgctttctccttatgacggagagcagaagcttaaagcagagctcgatatcgtcacaagcgccaaccctgatgaagacagggatacgctttggcaaggcgcactgactcagtttaaacaattcggcatcaaacccgtccccgacattcgcgagatttttaacggagacgaacatatttataagctgttgtgcttctcatttgatatggaaaagctgaagaaagcaaaagatgatctttctgcctttccaaaactgggactcacttcttccggaagacatatcatcgagattctgcctgatgaatccggcaaaggccgcgctttaaaagagctggcccgccactatggaatcgagaaaaaagacatctacgcgatcggcgacagcccgaacgatctgtcaatgtttgaggaagccggccatcggatcgcgatgggcaatgcaatcgatgagctaaagcatatcagcacctttatcacgaaaagcaatgacgaaaacggcgtcgcttatttcattaacaaactgctggaaaatgaatatcaataaataagaaaaccgctcgagtccatcttcgagcggtttttttgctgtttctgctactcaattctgacgcttccggcgtatttatctttccaataggcgctcgtctccatatctgctgtcgttacaccggcagacaaggtgacaagaacgacctggccgtttccgatatagatggcgggattcataacagtggttcctttaaagaagacgatgtctccaggctcaagctcctgtttggtaattttcttacccgtgctgtattgtttgtcagcatacctcggaagctccactcctgccgccgttttgtagacatattggataaacccagccgtatcaaagccttctttaggcgatgtgccgcctttttgataaccgacttcgccgatatgcctgatggcttcggatacaatcggattttttggcagggacatgttgtcaaaacgtctgactcctgtgaacttcttctgccaataggaagccgacaagtaggatatcgtcactttatttgaacggctcgcatggataaaccgcccgcccccggcatagatgccgttatgggatattcccggtttgtacgtattgctgaaaaacaaaacatcacccggccggatatcttcaagcttcaccttttgaccgacagcccattgctgttcagccgaccttggcaaataaacgccgagcacctctctgaagacgtattgggtcaaccccgaacagtcaaatccgagatccggagagttgcctccaaatacataaggaacaccgacatagctttttgctttttgaacgacaggatccatcgaaatctcaggctcttttgtgatccttttcgctttaaaataccccgagctccagtaagagctgccttcaagctttgtcacgacaaccccgtttgattttgtgctgtggatgatttgatcatttcccaaatagatggcgacatgggtcggtccgtccgattccagctcggcattcttgaaaaagacaaggtcccccttttcgagctgctgacggccgacactgctcccaagagtcgattgttcctttaccgttctcggaagcgtaatatcgagcgattgaaacacatattgcacaaagcctgacgagtcaaaccccgttttcggcttctctccgccgtagctgtatttcgcaccctcaagctgtctggcagtttccgctattttctcgccgatcgtatcggcgcgtacatcattatgattcgttaaaaataaagacatccaaagcaccgcaattccacaaaacaaaaccaactttttgtttgccgctttttttatcaattgatctgttcctcctcttctttcctctttcatcgtcattcaactgggatatttaaaggactttttttgcatgtacagcagcgtcatagcgagaagaaacgctcagcacagcatgatcagctttttcacctaagcgcggattaaaaagatgaagggaaatattctaaagaggtcatgaacatgaggtgcggttcccatcccgaattggtaaggtgatgcattttcaaattttgcttcagtcgaaatttgtcagtttttattcccttcaaaagaatacaataaacatgaaccccaaaaccatgtatatatcctcctgattttctataaaactttatacactgaccggttaagaaaattgtcgtgtttccctttcaaaccggccgcttttcacaggtcttttataaccgggatcagcacacaaaaaagagagcgccggcggcactctcttttgcactgttattgcttgttttctgttgtttgatcctgctgattcactttttggatctccgtagagattttagctttttcatcgtttgacaattcatcagaatacttgaaagcagacatgaatgcaatgatcaaaactaaacctacgaacggccaaatggctctgacaaatttcatttgttcaccactccgtttttattatttttcagcttgtccgcatgatcgacttcaaacgttaattttccgttctcttctttccagtcgaggtttgttccttttgtcaattgacggaagatcgcttttcgttttaagaagtcgctcttgcctaaaggcgtcggcgttgcttcgcgaatgttgagaggcgttacctcaaagcgccctttgccgtcattcattaaatggtattgtacaagcgcgctgtcccgtgttcttgaccagccctgatcaaatacaaagttgccgaggctgtagaaaatcacagtaccgttatacacttcgatcggttcgagaacatggggatgagcgccgatgatgacatctgctccggcatctgcaatcgccttggccagatccttctgtctgtcgttcggttcattgtcatattcttgtccccagtgcacatggacaaggacaagatccgcttttttcgatgcttccgcaatcattggaataaagattttcggactgagcggcagcactccgcctctgttctttttggctgtaaagttctttgtgtagacgtctgtaaaaccgagcgttgcaatttttacgccgttcacattctgataggatacgtgctgtttcgcgtcttcaagattatttcctgctccgacaagctccagattctcatttgaaaatttattgagcgtatccttcaaaccgtcttccccgtagtccatcgcatggttgttggcaaaattcagtacgctgaagttcagctttttcaatgtttcgactgattcttgattcgtttgcagatggatgttcttttctgcctcttgatagtcctttgcattggttacagggttttcaaagtttcctgtgataaaatctgacacattaaagtacggcttcacatttttgaagacactttccgaaccgtgcaagtttgtcactttttctacgtttcttcccatcatgatatcgccaacaaaagtagctgtaagcttggcatcttcttttttgtccatttgcgaaggagttttggcgcttccgacccaagtaaagacaaacattaaacagaaaataacgggcaatacgataaagacgtgcttgtttgttttctttttctcctgcttcgtcaacttcagcagtttttcctgaaagttcagttgttttttcatcgatttgacacacctaactttagattagatagtaagcatacataatgacgaatgttgctccgctcaataaaagcgtacttccaagcgtaatcgttaatccctgtctttgaatggtattggcgatcagccccggcacgatgattccgattcccctgaattcggcaatctcaaacggcatcaccggatatataaaatcaaaaccgattttcaaaagaattcccgtaatcagcattgctgcgaattttctgcgtccgtatagaatcataattttggaaagtccgaatttcacgatgacatacgtcagcaaactgacaaaaagaacgagcagcatgaaaatcggctgattgaagacaagtcccaaataacccggtacgacgaggccggctggtacaattcccgttttctctgcaaaaatcaaactgagtaagactcctaaaatgagggcgatatataaatctgatccaaacattgtgttttcttcctcctagctaacgagctgcttaatcttgtaatcttgtattttttcaatgagaggctccgctgctccgtggatatttccgactccgtaaataacgcggccctcaagcttgtttttcagcatgaacatgatttcttccgttgatttgtgctcaaaatcaaacagcttgtccgcaggaattttgcctgcttcatatgctttgacgatcggctctgttgtttctccaatcagcacaagttcacttgcttcaatataaggaaggacatcttccgcaaactgctgtgttctgtctaccctgtcggcgcggcagttcataatgacgatcggctgatccgtaggatagcctatttcttttacacgcttccaaatgtttaaagtggaagctgcgtcattggccgcaaaaccgttgacgaaatgtccgggattcttggcgttcatcagcggcagaattctcatggctcccggatcaggcggcgcattcagcatgcctttaaaggcggtttcttcgtcaatgcccaacgcttgagctacaccgagcgcaagagacgcattatcagggaataccatgtactcaaactgtctgaggtattcatctgttattttagaattgtctgcgacgatgacttttgtgttcctttcttttgcaatttgcttaaagaaatcggtatactcactatcagtaataaccaaatgtccattataaggaatggttgctgtgaatgcttctgcgatttcatccaaagtcggtcccatcacatccatgtgatcctccagcacgttcacgatcacgccgatattagcctgaagcaattcttcctgaaagatgatttggtaatcaggattaacggccatgcactcactgacaatcgcattggcccctctttccaccgtttctttcataacctccttctgctctccgatattcggcccttgcggctttcttttgatcggcttctcttccggtgtgtcccaataaatcatccttgcgtctgtcccggttgtttttcctactgttttgtagcctgcttcgattaatatccctgttgttaatcttgtcaccgtggactttccgcgtataccgttgatgttcactcggacaggcagcgcatcgatattttgctggtggcgccttttttcataaatgccgatcccaacaacgatcacacaggctaatagcattacccacattgtttgtctacatctccttcttggaatctgatatgtaaattcattcatcagtatataggttcactatgaaatcacaatcggcattatgtaacagaagacgacgaaattttccgtgacaaagatcacctcgcccgagtcattaatgcctatctttttattgatatttttggaaatcgaaagttcttaattcctatcagatttttgtcagcgttttaagtatgcgctttcaaaattcgacattatgatttttgtacttttctccctatttcagatgaaaggttgaaggatggattcaggatctcttttttcccccgtccgcaatcccctttaaatgggctgtcagccgggatctctcttttcttttagtattttcgctcttttcgaacaggttaaaaagtcaccaatgttccctcttcaaaacaaatccgtcctatgacaatcagaccatctatcaaaaaatgaaaatctcttttagcataaagcgggattcattgacaaatccaaatattttgtgagtcgttcgatccaccttatttcttcagattttaggttaaaatcctaggatttaaaaagccattaatttttttcaatgataattcatcaaactttaacatttttaatttttcttactattctcattgttactgtattcgccattaaacgcccctatatatgtctcgatatcccagcccggtctaaaatttcagtgttcatccatttttttattgtgattttaaatggatcgtgataatctttatgtaaacggttacacaaatagagaggagaaggcttttttggctacgattaaagacgtcgcacttgctgcaaaagtatctgtcgctacggtttcccgggtattaaatgagacgggatacgttcatgaagacacgagggcgcgcgtgctgaaagcgatggaagaactgaattaccacccgaatgaagtagccaggtctctctataaaagggagtccagactgatcggactgctgctgccggatatcacaaacccgttctttcctcagcttgcccgcggcgttgaagatgagatccaccgcctcggctttcggctcatatttggaaacagcgatgaaaatctggaaaaagagcttgattatatgcagacgtttaaacaaaatcatgtggtcggagtcatttcagcgaccaattatccggatgcgccaaattatcaagacttgtccatgccgatcgtctttcttgaccggacgggcgagaatgcgccggctgtatttgcggacagccgcgaaggaggcagaatcgcagcggctgagatgatcaagaggaacgcgaaacggattacgctgattaaaggaccggctcaccttcagactgcaagagaccgtttcaacggagcgctggacgtgctaagcggagccgatatcgattttcacgtcatgaaaaccgagacattttcatttccggaagcccaaaaacgggcggcggagctgtttggcacatatccggaaacagacggcgtgatcgcaagcaatgacattgtggcgacagccgttttgcatgaagccttaaaacggaagatcaaagttcccgatgaactgcagattatcggctttgatgacataccgcaaagcgaattgcttttcccctctttatcaacgatcaggcagcccgcctatgaaatgggaaaagaagctgcaaaactgctgcttagattaatgaaaaatgaatatattgaacaatcggcagttcagatgccggttgcctttattgaaagacaaacgacaagaaaggcggaatgacaatgagtaaaatatgcgtgatcggcagctcttcgatggatttagtcgtgacatcgcccaagcggccggccgccggagaaacggtgcttggcgaatcttttaaaacggttccgggcggaaagggggccaaccaagcggtagccgcggcccggcttggcgccgaggtccatatgatcggctgcgtcggcgatgatcattacgggaaagccatcctcgacaattttcaagccaatggtgtcttgacagactatgtggaaccggttacaggtcaggaaagcggaaccgcacatatcgttctcgcagacggcgacaacagcattatcgtcgtcaaaggggcaaatgaccatgtcacacctgaatacgttcaaaaagcgctgcctgcgattaaacaggcagacatcgttctgattcagcaggagattccggaagaaaccgtcgattatgtcagcggactgtgcagctctctcggcattcctctcctgctgaatccggcaccagcccgtccgctacgcccggaaacggtcgaacacgcggcctacatcacgccaaacgagcatgaagcttcggtactgtttcagggcatgtcccgggaggaagcgttaaagcgctatccggagaagctgttcatcacagaagggaaaaacggcgtccgctatcacaatggtctggaagaacgtgtcgttccttcattccctgtcaatgcgattgatacgacgggcgccggagacaccttcaatgcgggatttgccgtcgcgctttccgaaggacaaagcatcgaatctgccttgcgctttgcgaaccgggcggcttccctgtcggttctgaaattcggcgcacaaggcggcatgccaaaacgggatgaagtggagcgtgaactgtcatgaaaaaacacggaatattaaacagccatatcgcaaaattgctggccgatctcgggcataccgataccatcgtcatcgcggacgccggtctgcccgttccgcccggcgtccccaaaatcgatctcgcactgacattgggtacgcccggatttcgagaggttacaaagctcatcgccgatgaaatggttgtcgaaaaagtgacggcagcccaagaaatagaaagcgtcaatcccggtcaagccgcatttttaaaagcggaattttcaaaccaaaagattgactatatcccgcacgaagcattcaaaaaggcaacgagccaggcgaaagcggtcattcgcacaggggaagcaacgccttatgcaaattgcatcttgcacgcgggagtgatcttttagatgtttacattctacatctggaaagaagggatagcccatgcatattaaaatgaaggacatttttaaagcctttggccaaaaccaggtgctgtccggcgtttccttcgagcttcaagaaggtgaagtccacgctttaatgggagaaaacggcgccggaaagtcgacactcatgaatctgttgactggacttcacaagctggacagcggaacgatcgagatcgacggaaaagaaacgtatttttcagatccaaaggaagccgaacagaacggaatcgcctttatccatcaggagctgaacatttggcctgaaatgaccgttttggaaaatctgtttatcggcagagagctttcttccaaacttggatttttaaacaacaagaaaatgaaagcgctagcaaaagagcagcttgaaaggctcggtgtctcaatttctcttgaaaaagaagccggagactgttccgtcggccagcagcaaatgatcgaaatcgcaaaagcccttatgacagacgcgaaagtgatcatcatggatgaaccgacggcagcgttgacagaaagagaaattgaaaaactgttcggcgtcattagagcattaaagaaaaacggcgtctccatcgtctatatatcccaccgcatggaagaaatcttcacgatttgcgacaggatcacggtgatgcgcgatggaaaaacggtggacacgaaacggattcccgacaccgactttcatgaagtggtgaaaaagatggtcggacgggagctgaccgaacgctatcctgaaagacagccaaatccgggacgcgtcgtcctcgaagtcaagcaggcatccaaaaaaggagtcttccaaaatatcagcttttccgtccgctccggcgaaatcgtcgggatttcaggactgatgggtgccgggcgcaccgagctgatgagagcggttttcgggctcgatccgcttgactcgggagacattttcatcgaaggcaaaaaagcggcgctcaaaaaaccgagcgatgccgttcaaaagggaatcggctttattaccgagaaccgcaaggatgaaggacttgtgctcgacacgtccatcagagaaaatatcgcccttccgaatctcgccagcttttcgccgaaaggatggattgacaaaaaaagcgagcaggaatttgtcgatcttctgatcaagcggctgacgatcaaaacggaatcgccggaaacccacgcgcgaaacctttcaggaggaaaccagcaaaaagtggtcattgccaaatggatcggcatcggccctaaagtgctgattttggatgagccgaccagaggcgtcgatgtcggcgcgaaaagggagatttatcagctgatgaacgagctgacagaccgcggcgtcgcgatcgtcatggtctcttcagagctccccgagattctcgggatgagcgaccgcgtccttgtaatccatgaaggaacgctaagcggagagctatcaagaaatgatgccacgcaagaacgaattatgacactcgctacaggaggacggtaacatgaaaactcaaccggctgtgaaaaaaagccttaatgttgattctgtaatgcaaaagctcggtccgtttctcggcctgatcattctcgtcgtcatcgtatcattgttaaatccgagctttttagaaccgttaaatattttaaacttgttaagacaagtcgccattaatgcgctgatcgcgtttggcatgacctttgtcattttaaccggcggcatcgatctttccgtcggagcgattttggcgctgtcaagcgcattgatcgccggaatgatcgccggcggcatcgatcctgttttcgccgtcatcatcggctgcctgatcggagccctgctcggcttggtcaacgggctgttaatcacgaaaggtaaaatggccccgttcatcgcaacacttgccacaatgacgattttccgcggattgacgatggtttatacagacggcaatccgattacagggctcggcaaccactacggcttccagcttttcggacgcggttactttttaggcatccccgtccctgcgattacaatggcagccgcctttatcatcctctgggtgatccttcacaaaacgcctttcggccgccgcacatatgcaatcggcggaaatgaaaaagcggccttgatctcgggcattaaagttccgcgcgtcaaaatgatgatttattctcttgcaggcctattatccgcgttggctggagccatcttgacgtcacggctaaactcagcccagccgacggcaggcacttcctatgaactcgacgccatagccgcagtcgtattaggcggcacaagccttgccggaggaagaggacgaattgccggcacactcatcggcgtcctgatcatcggaacgttgaataacggcttgaacctgcttggcgtctcttcctttttccaaatggtcgtcaaaggtgtcgtcattttgatcgcagtcctgctggaccgcaagaaatccgcttaaggagggctatactgatgaaaaaaacattaacggttttcaccgcattggcgcttctgtttctgtccgcctgctcgctggagccgccggaatgggcaaagccgaataaagaaaaaggaacggatattaaaatcggtttatctgtctcaactttgaaaaatccgtttttcgtttcattaaagaacggagttgtcaaagaagccaaaaaacaagggatagaagtgattgtcgtcgatgcacaggacgattcggcaaagcagacgaatgatgtcgaagatcttctgcagcaaggcgttgacgctttattgatcaacccggcggactcctccgccatctcaactgcagtccaatcggccaattcgcttggcattccggtcgtcacccttgaccgctccgccgaaaacggaaaagtagaaacgctcgtcgcttcagataacgtaaaaggcggacaaatggcagcggactttattgtggagcagctcggcaaaggcgcaaaagtggctgagcttgaaggcgtccccggcgcatcggcaacaagggaacggggctcagggtttcataagaccgctgatgacaagctgaatgtgatcgccaagcaaacagccgactttgaccggacaaaagggttgaacgtcatggagaacctccttcaaggaaaccctgatattcaagcggttttcgcacataatgacgaaatggcgctcggcgcgattgaagcgatcagaagctcagggaaagagattcttgtcgtcggcttcgacggcaatgaagatgcggttaaagcggttcaggccggagacatgtcggcaacgatcgcccagcagcctgaattgatcggcaagctcgccgtacaagcggcccgcgatattttgaacggcaaaaaagttgaaaaaacgatacccgcaccgctcaaactggaaacgaaaaagtaactgtgaaatcagacctcttgatacatggaggtctgattttttttggccacctccataaaagcccttgccgcccggctcaaatggcatttttcaggataagcaaacacaagcgtccgggactgatcggcctgcaaaggaacatagacgatcctgactgaccctttccgcaaaacggcgcgccgaattccggtcctcatcatgcgcaccattgctgtgcaacatgtttaaggaaggttagcgaaagcaaaaaagcccccttttcaaagagggctttttcatttactcgggattgccttcggccgcttcaattccggctgcaagatcgtgtttattgaaatccgcttgaaagaaatcttgcgtattcggcaatctgaggttcatattgagtttttgagaaatttgcaccgtgcattcttcgatttcataatcgaaaacgtgtccgccgacattgcggtcttcatctataaagtgaagatggaagccggaaactgcgattccgttggcatattgcggtgtccaaaagccgacgatcgtccccgtaatatcattaaaatcaaagatcggctgtgattttaccgcatcaaccatcggcacatacggtttttcctgaagttcaactgttctcgttttgactttcttaaaggttccgtccatgcgaatcgcgtaaaacaggttttcactcggcatgatccgtttcatttcttcttcgaacgcctcaagcggcatccgctgcttgatttcgtgatagatatccggccggaagaaagccagcgagcaaaatggagaacaatcgcttccttgaactgggtaggcttttccatcggaacggagacggtaaaactcaccgtcaaaaccgatcagctcgccgtcgagccggttgaacgttccgatcccgaagtctccgtgctccttcgcttcggacatataaaaatccccgtcgtaaattccgtccaataaagataccatcgttgagacctgatagacttgatcgaggttcttatcaacgggctgaattattttttgtttgcttgcacttttcattttcctcttttcactcccttgattttgttcgttgtgactggacatgctgtgatcaagattgcttagaggcttctttattaaaatgttcctcaaatttttttggaaaacgctgatcggccaaatgaatgttgtcgctgtaatcgaccggaatatcaatgacaacaggcccctctgcatcaagaccagctttaagcacctctgccaattcgtcaggtgaattgacccttaaaccttttgcaccaaagctttcagcatattttacaatatcgattccgccgaagtcgactccggacgtccgcttgtatttcatctcctgctggaacgcaaccatatcgtatgtgctgtcattccagacaatgtgaacgatcggcgcttttaatctgaccgctgtctcaagctccatcgcggagaacaggaagcccccgtccccggaaacagacacgactttctgtcccggattgaccagcgttgctgcaatcgcccacggcaaagccaccccaagcgtctgcatgccgttggaaatcagcagtccatgcggacggtaggtgcggaaatatctagacatccaaatcgcatgggagccgatgtcgcaagtcaccgttatgtcatcgctcagcagttcacgcaaatcgcgaacgatttgcagcggatgaacaagatcagtttttgtttctttaggaggttcgctttgctcctccagtgctttcttcaagtaatcaaggacaggtgcaaaggactcgtcgatggaaaccggcagagaatcatgttcaatatggtttaacgtctctgcgatatcgccgatcaactcgatttcgggctgatagtcatgatcgatatcggcttgtatttcgtcaagatgaatcacgcttcgttcgccttttccattccaaaagaccggatcgtattcaatcggatcatagccgaccgtcaaaacgacatccgctttttccaatagcatgtctccgggctgattgcggaatagtccgatccggccgaagtactggtcttccaaatcgtgagacagcgtacccgctgcttggtatgtttcaacaaacggcagtttcactttccttagcagacgccgaaccgcttcaatcgcttcaggtcttccgcctttcatcccgacaagcacgacaggaaggttcgcattgtgaattttggcgatggccgcgctgatttgttcgtccgaagccgcgcccagcttcggcgccggcatggttttcaccggcttggcagttgccggaccggccgtaacgtcctgcggaaagctgagaaacgctgcgccagcctgtccagaagccgccgctctgaatgcattggttacagcctcaggtatgttgttcgcatcttccacttctgcgctatatttcgtaatcggctgaaacaacgccgcattatccatcgattgatgagtttttttgagacgatccgctctttttacagcacccgccagggcaacaaccggatctccttctgtattggctgttacaagaccggtcgctaaattagacgctcccggacctgaagtcaccaggcaaacaccgggctttccagtcaatcgtccgactgccgccgccataaatgctgcattctgctcgtgacggcaaacgatcaattcaggccccttgtctttcaatacgtcaaacaccgcatcgattttcgctcccggaataccgaaaacatgagtgacaccttgctgaatgagactatccaccacaagctctgctcctcttacagtaagagtttcatttttagcggctacattattcaaagccctcactcctccattttcattcatttacaatgaatttttaataaaattattgtattattaaatatacatcttgtggaaattgttttccaatacttctttgtcttacaattaatatgtaaaacgactgaaatcgcattcagaaaggaatgagtgattaatggagctgcgccatcttcgttattttatggttgttgccgaagaactgcatttcggaaaagcagctcttcggctgaacatgactcagcctccgctcagccagcagattaaacagctagaaagtgaaataggcgtcaccttgctgaagaggtcaaaaagagccgtcaggctaacggcggcaggcggggtctttttaaaacaaatcaaggaaggactttcccagattgatcaggccgtcgacatggctcagcggacggcccgcggggagctgggaagactcgtgatcggctttgtcggctccgcaacatacgagatcatgcctcccatcatcagggaataccgaaaccggttcccgtccgtgcagatcgatcttcgggagctttcaacccccaatcagatcgatgcactgctaaacgggcatattgacatcggggtgctgcatcccccgttgggaaacgacgaactgaagtcatacacggtaaaaaaaagccattgtgtccttgcacttccaaaacaccacccgttgacagaaaaagcccgggtacatttgaaggatcttgaagaagaatcgctgatcgtcattgccaaagaagcgtggccctctttatacacggaattcaatttcttgtgtgaaaaagccggatttatccccaacatcgcccaggaagctacagaataccaaatggtgatcggcctcgtatcggccggaatgggaatcgccgtcgtgcctacggcggctaaacgattatttaaccttgatgttgtatacaaagaaatcgaagactttccccttcgcgccgaatggattaccgcacatcgaaaggacaaccgcaatccggcacttaagcatttcatcgaaatctcagatcaacactcatagccgtatagaaaaaaccccgtggacaaatcctccttgttcacggggttttttcctcatatagacgtttgcaagttttgaaaacgcagttaaatgccgattgctgccccatcgcttctcggatcgctcccccctctcaggaagccttgatcgtcaatctcaatgattccggcatgacccatcaccccgtcaaattcaccgacaacggttacatgatgcccatgctttcgcagttttgcaatcacttcaggcgccactctgctttctattcttacaccttccacccgctctccccatgttctgccccatacccatctcggttcatgaacagctgtttgcggatccatcccgtaatctaccattctcgtaataagagccgtctgcgtctgcggctgtccttctcccccttgcccttgcgttccgtaaaggaatttcggcttgccgcctctaaacgccatggcgggcatcagcgtatgaaaagttctttttcccggctccagcgtattgacatggtcgggatcaagcgagaaaaacgcccctctgttctgcaaaatgacgccggtatctccagctgtcacacctgagccgaattcgaaatacaaactttgaataaacgaaacagcattcccgtcttcatctactgctgctgcataagatgtatcgctgccgagcggccggctctccgcctgaagcgccggcagtccgatttttgcggccagctcccgggcatactctttgtccagtaggcgtccaagcggaatctgtgagaattccgggtcagtcaatactttgttgcagtcggaaaaacttaatttcaatgcttcgataagcagatgataatactcgaaagaaccgtgctcgatcatgccaaagtcgtagttttccaaaatgttcaatgtcataagaccggtaaatccttgtgaattcggaggcatttgatagatggcatatcctctgtatgtggaggaaagcggagacacccattcccctcgatgcagcccgaaatcttcaaggttcaagatgcccccgttgttttggagataggctgctaaagcttgggcaatttcccctttataaaaggtgtctcttcctttctcagcgatcaacgtcaaagtgcgcgcgagctctttctgcacaaaacgctcacctggagagggcggttttcctcccggaagataaatatctgcagtgatcggcatacaggaaagccattcagcgtttttcaccgtgttttgacattgatcaggcgagaccgggaaccccttttctgcatacataatcgccggcttcagcacctctcgaagcgatagacggccgtacgcagccagtatttcggcccagctgtccaccatccccggcacggtaatcgcactccttgggcccctgaccggaatggcgcgctctcctttatactgatcccggtccgctttccgccccgaccgcccgctgccattgtaccctttgatctccccgcttccattgtgatacatcagccaaaaggcatcccctccgagtcctgtcatatgcggatagacaacagctaggcacgcgcttactgcaacagcggcgtcaaacgcgttcccccccttctccatgatgatgctgcctgcaagcgaagcgagataatgaggactgacaaccatttgtttcgaaccgatcttcagcttctccatagctcattccttcctttcaagcattcatttgtcctttgaagtatagtggcccgttaaaagaggcgctactttcagggaagaaaaactaacgcccttttttcaataagtattaaaaaaacgttaaaatgattcatatcgaaacccttattatgatacaatttacaaaatgttcatttatagtgtgattgacaagcaatttcgaatgataatgaccaaacagaaaggaagggatatttgtgagcctcgactaccatatgccaaatttaattctcgatgaaacggataaaaaaatcctttcgatcttgcatgaggaaggaagaatctcttatacggatttaggaaagcgtgtgggactctcaagagttgccgtacagacgcggatcaacaacttgattgaagaaggcatcattgaaaaattcacagccgtcatcaatccagtcaaggtcgggattcacgtatcggtgtttttcaacgttgaagtcgaaccccaatatttagaggctgttgccgttgctttggaaaaggagcccgccgtgacaagcctctatcatatgacagggccgagcaagctgcatatgcacggcattttcgcaaatgatcaggagatggaggaatttttgacgaagcgcctgtaccccctgaaaggcgtggtgagcgtcgactgccagatgctgattaaacgttataagagccgaatgggaatgaagctttaactgaataggaggaaacgcaaaatgaagcacccttaccgggaactgatcatcgcaatgacaagaacgggaatattgggctttggcggcggcccatctgttatcccgctgatccgtcatgaagccgtttctaagttcaaatggatcgatgatgatgaattcggggaaattttggcgattgccaatgcgctgcccgggccgatcgctacgaaaatgtcggcatatttaggtcataaagtaaaaggcgttcctggtgctgtcgttgctacagcagcccatatcatgccgacatgcgccgcgatggccgccttgttcgcagccgttaatgtgctcagccactcaaaaatcgtaagcggcatgatcggcgctgtcacccctgtcatcgccgtcatgctcggcatcatggcttacgaatttgggcaaaaagcattgaaaggcttcggcttgctgaccggcgtgcttttctttattcttgcgtttttgggtcttcaagtgttttccatccaccccggcatcattgtcatcctgtttttaacgtttaaattaaaaagaaaagcggcccgagaaaaggataaaggagtgtccgcttcatgatcatcttttatctgttttgggccttctttattgcaaacttattgggctacggaggcgggccagcttcaattccgcttaattttgaagaagttgttcagcattttcactggctgtcaaaagaggaattttcaaacatgcttgcgcttgcaaatgcgctgccaggcccgatcgccacaaaaattgcagcttatgtcggctacagcgtgctcggatggcccggtgttttcattgctcttgccgcaactgtgcttccctcggccatcgcgctcgttttgctgctcaagctgatcggccgctaccgccagtcgcaggtcgtcaaaggaatgaccttgtcggttcagccggttatagccgtgatgatgcttcttttaacatgggaaatcagcggcgacgcgatccattcgatcggcatggttcaatcacttgtcatcgcgctgatctctttagtcgccttgacgaagttccgcgtccatccggctttcctgatcgtggcggccttcgcttacggcgggcttgtcattccgctgctgtagagagggacgtccggccgctttttatcaaatgacattaaaaatcagcgccgcataaccggtgctgacattttggctggggggcctttgtgaacaactttcacagcaggcccaacagctttttctttttgacgggacgcggtgtttctttatgaatctcccggttttccaggagcaggcccgcgttttctgtaaacacgttcaagaaatcgcggccgtaatcgttttctactgtatcaaaaaagaaagatcgggtcgtgaggttgtgggcgtctgatgcgataaagtggatgaggttcgcttcaagaaagcggcgggcgagccgtttgacgcttctgccgaaacggcctgcaagacttgaacatgtcagctgggcgcaggcgccgtttttgacgaggcggtacagcagatcgggattctccatcaattcaaggttccgctcggggtgtgcgatgatcggaatgtaaccatttaattggagatcgaacagcaccttttcggcataacgcgggacatggtggtaaggaagttcaatcagcaaatactttgtgccggcgaggctgagcagtctgccgcgctcaagatcgcgcttcaattcgccgtacaggcggatttcctgcccgggggtaatgagaaccgggatgttttccttttgcattctcgtctttaaacccgaaacagctgcaaggatggcttcttttggatgttcgtatacaccgtttcggtggtgcggtgtggcgataatcgtatgaatcccctggagggcggcttgtttagccatttctaaactgtcattcatacatgctgctccatcatcaacgcccgcaagaatgtggcaatgaatatcgatcatatgcgacctccccgtgttttcccgtttcagaatgtatggtctttgccgacaaagctttccagcttcctggcctgtccttttttcggttttacatacagaatatttcccaacacgtgaacattcagatctttttcgatgtcttcttcatttcgaacggtatttttcaaaagctcgagcaaaaatgctagcccagcgccaaacagaaggccgaaccctgtaaaaagagcgatgttgaacttcttgttcgggctgacgggaacaggtgaatgatcgggattggctttcgcaacaaggctgatttcggcattttcacccataatatcgccaatgtctctttgaaatacggcggcgactgtattcgcgatatccgccgccttggaataatccttgtcagtcgcggagatactgacaatctgcgattcattttcgctgataaccgtgattttttgcttcaggtcttcagccgtttccgaaaggttaagttcgtctttaaccttatttaaaatgatcgggcttttcataatgacgttgtatgtgttgataagttcaaggttggtctggatgtcggtgaagttcgacgtttgacggccgttgatgaggatttgggcggatgcctgatagacgggtttgagccaataaaagttgacggcagcgctggacaaagcagccgcaatggtgatcagtgcgatcagaacgaatctttttttcaaaacgatgaacacatctttaaagccgatatgatctctcataaaagcccccttctacgattcgcgtatttatttaaattttcagcaaattaaacacctacctttgattatacatggttatttcgtttccgaaagaaatgaatcctgacaaataacgggagataccggggaaaccgcgtctttatatggtattaaatatcgacttttgcaggatctgcgcacttcttgctgaacgaaaaagtgtgcaaaccgcagtttgcacaccttttacgtcgtatatccatttttgatatgaagaatgagatcttcaagaagttctttcgtcgttatgtctttcgatttttcaccaacgtcatacgcatgcataagaattctcaaaaattcttcctgattcaattccttgtcatccatatccttttcctttcagcttccataaattaaaacatttctgattatatttcaaattatatgatgtaaagaatcgatttgccatagtctattacattattcgacagccatccgtttttatgtccttttcctgagaaaatcttttttggacggattgattaagctataatagagagattggaaactttttaaaagtcattcggttaggagcgatagacatgcttcaagacatgatctcaaaaacggttgtgatggatgcagctgaacagtttaagcatgtactgccgtgcacagaagaaaacattcagctcatgaaaaaagcccttattttatacagacaggattccgtctatcgggtcaagccgatgagcgggcatacggtcagcgcttacgtccaggacgttgtcccggtaaaggtcttcatcgacctcgccgacgttaaaaaaagcagctgttcctgccctgctcaaaacatgtgccgtcatgtgcttgccgtttacttatatctatatgcacaatatgatcgattgggaacatttacggagttttggaaggaagcgcaaaaacgccgcgaaaaccgggagattctcggacagcttcagcgcggaatgaagccccgcagccacacgctcgatcaatggacctcctttttcaatacggagttcagacgctgggaggagcatacgcctaaaaaccagcaaacgatgcaatacctttactacgggtatttttcagctttaaaaaagcggacgcctgcggagccggagctgaaaaaaatgtatcaaatccacgcggctcttgcgacatggcttgctatgcattcactcgtcgagaaagggcgcatcgatcctgaaaaagatttttactcgctgaatccttatatcgaacagctgatggatacgatctacagctcgatcgatgaactgaaaacatatgcgctatcgttctcccttgacccgtttttagaaaaaacccccggcgtgattcgggaactgctgctcaagaaagatattttccagtatgaaaggctgcggattttcggggagatctggagtgcgcttctatcccggccaaactggctgaagcgggagctcgatgtgctgaacaatctggagccttcgcctgaaatacaattcggcaggctgcatcttgaatttctgctgaaaaacgatgatgtgattcttgatcaagccggatcgttttcaccggagattcttccgtatacgtttcaatggctcagtgtcatgaccgccaaaaaggactggaagcgcctgaaaaaatggtatgaacaccttgagcagctggcggccggcttctgcagactggataaaccgtaccgggaaatacgcgatgtactaagcgaattcttcctgtttctaagcgattacagcaaaaacgcaaaagaagagcatgtatttgaacggtattgcaaagagtgccttccttatacatttactgaatacagccattttttatataacaaaaaccgctttacggagtggatggagatccacagccttgtcggtttttcaatctctgagatagggcagaacgccttgaaagacattgcggcagcggctcctgaagcattgatcccttcctatcacagagaaatttccgggctggttgaacaaaaaaaccgctcaagctacaaagaagccgtcaaacaattaaaaaagctgcgcaccctttataaaaaagcgaaaaaacaggatgtctggaaccggtttatggagcagttttcagcccgctataaacggctgagagccttccaggaggagcttaagaaaggaaagttgatcgatggcgagtcttaaggaaatcgtaatacatgtcgaacagtcagaagactatacatttattttatcttgtcatgacggggatcatcagtttcttacgcgaaatgaaatggaaaggcatttgtttcagtggcacgaatcgtctttttacggaacatttctcgaggaagccggtttagatacccctgcggttctgctgtccccgtggatggcggtcgaatttctcggcaaaaactcatttaattcattcagcgacatcatccttactgaggaaactgaacctttgatgaaaacggcttccaccatttatgagtttatcgcagatgaagactttcttcccgactatgaagcatggaagcaggaaatgctgcgctggaaagataaagaagggattttggaaggctatacagccgaatggttttcacacgctgtcgaagactacatcaactacaatgacgaattaaaagcaaaatgggaatcgattgtcgcacattcccccgcagtcaccacatttcagggacattttcttgatgaagacgattttcttgaaacgattggctggcatgaaaaccctgtgccgtttaccgtcggactccgcttaaatgaacctgactttgacggagacgattggaaaatcgaactgtttttgcgcgacaaaaaaagcggagccattcagttctttgaaggcttgaacaggctgaaaaaatcgtggcaggcatacgctgataaaatcgaccgagaacaagacaggttccgccaaatcgtgccctggctgacgatcgaatcggggacgtcgcttttaacggaagaggaagcatggatcttcctgtccgaagctagcgaaacacttgtcagcatggggattgaaattctgctgccgtcatggtggcaaatcgtgagagacagcaatatgctgctgaaagcaaaagtgtcatcggctccccgcggcgagtcttttgtcggaatgaatgcattgatggacttcaactggcgttttgccaccaatggaattgaactcacagaggaagaattcgagcagcttgtcgccaataaaagacggcttgtcaatatacgcgggcagtggatcaaaatcgacccgaattttatcaaacaaatgaaaaagctgatggagcgggcagaaacagaggggcttcatatgtctgacatcctggcgcgcgagctgacagagcggagcgaaacccgcgaggatgatgatctgttcgatgcttccgcattcagcgatgtacggtttgaactgtcctatcagctgaaaaacatgatcagaaagctgagccagcgcgatgatctcccgtcatacccggtcagcaaatattttcacgggacgctcagagcttatcaggaagacggtttgaactggctgatctttctcagaaactgcggcttcggcgcctgcctggcagatgatatggggctcggaaagaccattcagatgatcgcctatttcgcctatttaaaagaacagggacaacaaacgccgtctcttatcattgcgccgacttccgtcctcgggaactggcagcgcgaactcgagaccttcgcgcccggcctgacggcagcgctccactacgggccaaaacgccctaaaggtgaagcgtttcagacatcttacaaagatgcggatatcgtcttgacgtcatacggcctcgcccaatccgactttgacgatctcagcagcgtcgcctggaactgcatctgccttgacgaggcccaaaacattaaaaatgcgcacacgaaacaatcccgttcaatcagaaagctgaaaggactgcatcatatcgcgctcagcgggactccgatggaaaaccgcctgacggagctgtggtcaatctacgatttcatgaacaaaggctatctcggaagccttggcagcttccataagcgttttgtcctgccaatcgaaaaagaccgcgacgaaaaacggatcgaacagcttcagcagctgatcaaaccgtttttattaagacggacaaagcaggacaaagaagtcgcgctcaatctgcctgagaaacaggaggaaaaagagttcgttccgctctccgcagaacaggcttcactatatgaacagcttgtcaaagatacgtttgaacatatgtcaagcctcgccggaatgcagcgcaaagctctaatcttaagcatgctcggcaagctcaaacaaatctgcggccaccctgccctttacttaaaagagaccgggagcgagctccttaacggaaggtcagtcaagctcgaaaaactgctggagctgacgaagacgattcgcgaaagcgatgaaagctgcttgattttcacccaatatctcgggatgggagatatgatgaagcgcctgctcgagaagtcattcggcgaaccggtcaagtttctgaacggcagcttatccaagcttgaacgggacaaaatggtggagcagtttcaaaacaaggaatttccgattttgatcttatcattaaaagccgggggcacaggcctcaatttgacggccgccaatcacgtcatccattatgacagatggtggaatcccgcggttgaaaatcaagcgacagaccgcgcctacagaattggacagaaacggttcgtccacgttcataaactgatcaccaccggcacaattgaagaaaaaatcgaccaaatgctcgaatcgaagcaatcgctgaacgatcaaatcatccaaagcgaaaattggatcaccgagctttctgagcatgaacttgaggagttatttaccctgaacgcttcggctattacaggttaaataaaacagctgtctgcgatagacagctgttttttgtgtttatgccccttaatgacagtcccaattaaaaaatcccgcgctgattgttcgaattgcccgcggaatcgggccattttttcgggtagttggaacggctgtttcattcttatcactctccttttaagcgggtgatcctattatttcaaattcaatcaatagttaaataggaatagtaacaaaaacaaccatcgccaacaaagaatcaaaagtcataatcatcgaggtcaaaccatattaaaaaaggccgccgacaatgtcggcggcccgcggaccaataacatccgctgcttaaccgcactccttcaatcgttacgctgccgtgtaccggcatcacgccgatttgaaaggatgtacgaattaaaccggtttgacttgctgttcaatcagctgatgcaggatgtgagcaacgccattttcatcattagtgagcgtcacctcatcagccatctctttaatgtctccgcgcgcattgcccatggcaaagcttttccccgcgatcttcagcatcgaaaaatcattgaggctgtctccaacggcagctgtttcctgaagggaaatgccgagcttgtgtgaaagcttctccaatgccagcccttttgacgcctgaagatgctcaatttcaaagttgtgctcggctgaagtgacaagcgtaatatcttgtgcatcttcaaattgcctccagcccgtttccagcttttccttatgaaaagaaaaagctaatatgttatatacattaacatcctttccggctaaaaacagatcggtataggagctgatgtacgcgtatccgttttggctgagctgctgttcagccgcgagttccagccttgataggtctgcctcaggatttgcgcttttcaagcggtccagctcaatgtcaagcagctcgcggccgttttgcggcgtgaagattgcttcatcgctgaacacctcataatagtagttattttcttcaagccatcgaagaattccttctgcccgtttccgatcaagcggcaccgaatggtaaaggctgccttcaggatcatgaatcaccgctccgttggcactgataatccatgttttaatacctgtcggctcaaatatcgtttgaacatcaaaggatgctctccccgtggcaactactacttcaatcccgtgttcccgcgcttttttaatcgcatcgatatttttctttgagatcttgctttcactgtttaacagcgtcccgtctaaatcgaccgcaatcattttcatctgctgtattcccccttaagtatcgtgatgttcagccacaagcagctccacatcgtgttcatcaagcagcttctgaaacggtttcgacggcagccggtctgtaatgagaaggtcaatgtcactgagttcagcgtatcggtaaaaatccgttctcccgattttcgaatggtcggcaagcgctatgacttgcttcgcttgggaaatcattttccgcttcaccattccgtcctcctcatgggcgattgtaagcccatgttcagaaacccccaccacgccgatcagcgctttatcaacatgatagcatgacagcttttcaatgacagaggcgccgtacaaaaaccggtgctctttttgaagctttcctccaagcaggcggatgtcagccccttttcttgaggaaagaacgtccgcaaggttaatcgaattggtgatgatcgtgcaattgacatccggcaaatgctctgcgcatgattggactgtcgtggaagcgtccaaaataatgcggtcgccttctctgattaaagaagcggctgcttttccgatcatgcttttttcttcggaaaccatgcccagcctgcccgaatagtctttgacctcatcatgaacggtgggcagaatcgccccgccccttgtcctgataatggcgccttgctcttgcagtttaaccagatcccgccttgccgtatctcttgaaactccgaataaagaacaaatttgttcaacggaaatccgtttatgctcttttaaatagtcgatgatggaaattagcctttcctcttggtacactggatcattccttctttgcgcaagtaaagttcatcatttataagtgattataagcaattacgccgaataaatcaagagtatataagtaatgataagcaaaaataaagcctgaggccggtttcccgtcccccaggctcgtactttaaaatgaaaatgttccatattgagagtgccaaatctcacgaaacgcatggatatcacgatctacagccggatgatcagccaaacggcttataagctcagggctgattgtcgcctcatggctccccgcttccatgacggcaagaatttgacggttatgtttaaagcttgccgcaagcactttgcaatttaaacagtttgtgttgaataagccgacaatcgttttgacaacgccagcgccattaccatactcttgatcaatgcgattgacatacggcgcgacataggaggcgccggcttttgccgccagtacagcctgtgcagcggtataaaccgttgtcccggtggtctggatattttcagccgcaagctttctgatcgcgtaaagcccttgagtcgtcaccggaattttcacagacacgtttccatctagccagttatagagtgccttcgcctgatcgaccatatcccgccaatggtcggcgatcacttgggcatggagaggcagatgctcgggaagaagccgccgaatatcttgaatctgctgtttaaaaggcttgttctcccttgcgatcagtgccgggtttgtcgtgacgccgccagcgggaaatgaatcaagcaatctttcaatctccggtatatgcgctgaatcaatcagcatgttcatcatcgcgtccccctcttgttttaatgcatgacctgccccccggttacattgatcgattgacccgtcatataagatgcttggtcagaggcgtaaaataagatggcattggcgatgtcatcatacgtacagccccgtcctagaggcactttttcggtgtacacgcgctctacttcgctctctggaatgccgagctttttcgcgtattgcgggatcaagctttggaacatcggcgattttaacaagtttcccggcataatgctgttcacccgaatgttgtgttcggcaagatcaagcgcgaggctttgcgtgagaccgacccctccaaatttagaagctgaataagctgtattatgcttgctgccgacttttcccgatttggaattgatttgaatgattgacccgcttccctgctcaatcatgacctttgacgtttccctcgcgcaaagaaaatacccggtcaaattgacctcgatggtccgttcccagtcttcaagttcaaaatccgtgattttattgcttttggcgattcccgcactgtacaccatcacatcgattttattgaattcgtccgtgaccctgccgatcatttttttcacatcggcttcctttgtaaaatccgcttgaatccacagcgatttgaccccgtattgaccggctgcatgatctgccgtcctttcggcgttctcgccgttgatgtctgcgaccgcgatgtcatatcccgcctctgccatccggtaggacagcgcttctccgagactttggccgccgccgcatatcaatgccacttttcctttattcatctccatattgcacccgctccttatgagaatcttttaacttgaatacagtctcctgctgaaacctccggcagttgttcttttcgttcaaggtacagtgttcccggcagttcggctgaaactgatccgtcaaattttagcgttatatgcccgagattcgccaagttttgacgaacggctccgccaacggctgtaattttgtaggtctcgccgcccagtatgagctcatcgccttcattgaagtcgccttctacaggctttatatcaattgataaacaataatctttcaattcatccggagcaccttcaccaaataatatgagcatcttttcatctgaaaacgccgctgcttgagctccgattctgtttatttttgtttcataaagcatgaccattattctccctccttaagaaaaccctcagctgtcatacatgccaaagctggccagccaagcaataaaaacggttggcgcccccgtgagaaaacgcgaatacagcaccgacggcaccccgacttcaaccgtttcgacttccgcttccgcaagacccagaccgactggaacaaagtcggcagcggcttgtgaattgattgcaaataacgcaggcagcgccaaattcggcggaatgtttcctttgccaatctcaacgccgatcagagaaccgacaacttgtgcaatcaccgcccccggtccaaggaacggggaaagcagtggaaatgaacaaacaagcgagattagtagcaacccgggcagtgagcctgcaaatggtgataaatatttggcaaaaatgtctccgatgcctgactctttaatgatgccgatcaatagagccacaaaagccatgaacggaagaattgttttgataacggtttcaatcgcttcccgtccagcttgataaaatgtgctgacgatcgatcccatggccatcccgattttcgccatcatccctttcggcgactgctgttcactaatctttttctctgtgctataatggttttgtttattttgtatttgtttttcttctggaatattagactgttcaggctcctccacagctcccagcagtttaatattctctttttttactccggaaacatatatatcttctgtaatatgggcggcaagcggcccgcttttcccggtcgccatcacattgatcgtcggaattcgcttttgcgggtaaagtccgcagcgcagcgtccctccgcagtcgatgatcacagcggccatttcgctttcgggtactgtcgttttaaagccgtcgaccagggtgcaccccgtcagctcagctaaatgatccgcaaaatcgggtttgtttccgccggtgacgtacacgattttatttctctcttcatcaggcgtgatcaccagaggtccgccaaaccctccaggcccttttgaaacttcaaccgaacgataggaactcatctcctaaaccgcctttcttatttaagatcaatcgaatctttcaaggcaatgccctgctgtttcgcgacataagccgttgtcatatccgttacccagcccctgagaaagtttgtcacaatcccgactaaaagatagcggagagcaagctccgtcgtttcatgcccgagcgttgtaatccctgcggcaatcccaaggaaaacaaacagctcgcccggattcacgtgtgggaaaagtccgttatgcgtgtggcacgaataggatgcagccgcataatagctcggtttgtatttttcaggcaagaacctgccaagcgacagcgtcattggatttgcgagcatgaacgtaccgatgacaggcaaaaccatgtatctggtcaatggattttttcccgacttcctcgcaagcgcttctacgcgcttttctcctatcaggcgtatcagagcattcatggcgacaagcagcataatcaataaaggaacgatgtctgtaagcataccgacaaacacttctccgccatgcctgaataagtccataaacttttccgcaagccatgttacgtttttcatatttcacctctttttttgatttgaaagctcatcagtttttgaagccgtgttttcttctgcggaacatcaccccctttcgtgatgatgtcgaatgttctcaaggcatcttcaattgcaagacgtgtgaggcggtcgtgccgggcaagctccgcttgtccgatcttcagcaaatactttccttcaaacccttttaaaggtctgattcttgaaaagacggtgacaccttgcatttttgatgccttcaaaattttgttgcgtttgtcgatgacaaacaggacgaccgttccggctctgagtaagccggtcttccttccgaccgcgactctccctatacgcctgtacgcggcgaacgttcgattgaaatgcctgatttgccaaaaacctaaaacgctctggagaagccatgcagctccaagggcgatgataaagtaaatgatcatgattgatttctcacctcctcggcaatttctctggctgtttcggcagttgtcactaaaacattaatatagcggccttttgcagccccgataatcgaaggaactttttcatgggattcggcaagacctatggaatattccaaatcctttaacctgttgatgtctatcgcgatggttctgtcatgaatctctgtttctactaaagctcccgaacgatcaaagaaacgcgagcatatatctccgactgcatgtttttcttcaaggcgctcgatatcctgatcgccgtaaaatccggtccagatcatatttgaagaactaagcggcgccccgattccgacggctgccacagtaaggccgttccacagcctttctatttttttgaaatagtgggacttgacgatttcctccttcgtttcttttttttcgacaacggctgccgcatctatgaagtaaggcgtgcctccaaagtcacccgcaatgctgtagacgatgctgttcacgtgatatttcgtatccatggcgcccggaccgccgaccagcggcacgaatgaagcgctccgttttttgacgccgtgaaactccccgatcattcccgccatcgtcgtcccccatgcgaagcctaccgtatccccgtctttcacgactcgttttaagatttcggctccggctttgccgacgagtttcttcttgtcttcagctgtttgttccggttttgcatcacatatgtacacttctttaagcccgagcagctgttcgagctcccgttccaaatcatagtgtgtcccgacatggtcatcgatcgtgattttaacgattcctgcctcacgcgcttttttcagcatacgtccgacggttgttctgtatatccctgttgcttttgcaatctggctctgtgtcatatcctcttcgtagtacattttgcagactttgatcagaaggcgtttatcatccctcatttccataagatcaccctttacctttgcgcatttgtgcaaacattggtcatttgttgttgtattcgcttacattatacatacggaatttttggacgtcaatttaaatttgtctattttttgtctaaaataaaaaaaccggtcattcaaaaccggccataaaaggggataaacaaggggatattgattgattctttttgagaaaggagtttatagaaggaatcttaggtttaagcatcagccggctcatgcgctttccggctttctcccaaaaatctgactgaccgggcgacaacttctgtaataaaggtgcgttcgccttctgaattgacgtattggcgggtctggattcttccgctcagcccgatgatggagcctttttcgcaatattcggctgtgttcacggcagttttgcgccatagagtgcaattgacaaagtccgcttctacttcgcctgctgcgttcttgaaaggcctgctgacagccagcgtcacatttgcaacagggacaccgtcagatgtataccgcagttcgggatcttttgtcaaacgcccgacgagcatgatctcattaaacatttcgtccctcccttcctgttcgggtatccccagtttataagagaacagattttaagcaaaatcctcataaaagaaaaataacccggaaaaaaacccgggctcatgtcataatttttgcttttttcttccactaatcataaaaatcatttcatttttatttgagaaatacgtatttttcagaaactgaaaaaaaacaggagatgacagccaccgctctgagtatacgcggacatatgagcccccgtcccaagcatacagacggaatgacaactctttctgtttaagcgttacttgaaattcgtatatttccattccgtccttcgtttcatagcgaaacatgatgccttcatttgcatatgtgctgatttcgtgctttttgttaccggctgaaaagcaaatcataggcatatattgacggcagtcagcagctgaattgcttgcgatcacaaatacttcctttaagtaaaaatggttcataagtcacctcctgctcaatatcacctaaagtataaataaaaataaagcattataaaatactttttgcaaaatttaaaatatgaatatgctcctattgcagaaacaaaccagggtcaagagttctcccaagcgaatgtgctataatggttatacaactatggaagcttgtgaggtgatactaatgaaaacctttaggcttattgatttaaaaattgtccgccaggatgacacttcaaagcggcttgaggagttcccgctgatcgacggccttatcattaataaggaagacggagaaaaccactggatggttgaaggtctggtttctaaagaataccggtattttttcgaatatctccttcaggaaggcaaagaagtgaaagcatatgtaacgatcacgaaaaaaagcaaccgcccagcacagctgttagcgaaggtcaaaaacatcacggtgctcggcgagcatgtttccgtcttattggacggcaaaatggtcagctcaaagctgaggaaaggctccgacaagattttggaagatttaatgaaagaaggatattccggagatcggcttcttgaagcatttaagcaaaatatataaaaaaggctgtcttcgccggacagccttttcatttatagctctaagaacggtttgtctgctcttttaacaaatcccgtatttccttaagcaattcttcctgaggatcaggagcagctttttcttcttcggcatccttcttcttcagcttagagatatagcggataaatagaaaaatggaaaacgaaataataaagaaattgacgatcgactgaatgaatagcccatatttaatttcggcatcaacaaatgtgaacgacagcgcggaaaaatccaggcctccaagcagaagaccgaggagcggcatcatcaaatcattgacaagcgaagttacgatttttccaaaggcgcctccgatgatgacaccaattgcaagatcgattacatttccccgaatcgcaaaacttttaaattctttccacatgaatgatcaccttttcgctttcatgataaaaaaacaaatgggcttttacgaaaacccattgtgtttacattattcctgcttttcaccaagagaaaacatcaattcggcttcacacacgacttctccgtccacttttgcgactccttttcctttgccgatggaaccgcggaaacgaagcacttcaagctcaagatggagctgatcgcccggtttcacctgctttttgaagcggcagctgtcaattcccgcaaaaaacgcgagccttccgcggttttcttccttcatcaaaagcgccaccgcacctacttgcgcaagcgcttcaacaattaaaacaccaggcatcaccggataatccggaaagtgtccgttaaaaaactcttcatttactgtcacatttttataacccgcggcccgttttccttcctctacttctgtcacacggtctaccagcagaaagggatagcggtggggaatgatttctttaatttgctgagcatcaagcattgccttgacatctcctttttcgaaaatatgtatagaatgatatgtcagtgccttattctgtacatctggaagtatattatgaaacggaatctttttcaacaaaagatgaggcacaaccggtttaaaacgatgaaagtgaaaataaaaagagcctgaaccaaacgtcgtttggccggctcctgttttgctgtgctaacgtactgaattgatcagccccatcatttgatcgcccatcgtgatggcgcgggaattcatttgatatgacctctgcgaagagatcagatcggtcatttccttcgatacgtcgacatttgatgattcaaggaatccctgttttagagaaatgtcctgccgcccggctccgttcaggttgataagagccgttgctctcaattcatcgctgacagaaaaaaggttgcttccttcttctgttagagcctgaggtttgacagcccggacgatccccaggttaaaacgcagtggcgcttctccctgattgtctgacgaaacggtgacacttcccgattcatcgactttgatgtgtttatagcgctggttgaagcggatggcatttccgttttcatcaaggacggcatgtccttctttcgtcacaagctgcatctggttggcgttccccgccgcaggcgtaaggtaaaatgccccgtctcttgtatattgcacttccccgccgacattgacctggaagtactgataaggagaagtcagtgcaatatcaagatcgcggcccgtctccttaaggcttccctgcttatgcgtcagccggtcggtcatgacggctccgacgccgaggcgaagtcctggcggcgtctttctgcttgcagctacttcattatttttctcgtttacctgttcaatctgctgcctgatcagctccgaaaagctcgtgtttttcgccttatatcccgttgtatcggtatttgcaagattatggctgatattatcaatttgtttttgcagttcaaacattgtgtttgaagccgtgatcatggatctaagcatcgtttttccacatcctccatttacgctgatcgcgatcggtcatttatccgatccttccaatctcattggccgccttttccatgcttttatcataagcctgaagaactttttggttggcttcaaacgagcggtaggcagcggtcatttccgtataggctctcgtcacgtcgacattcgaccgttcggtcatcccctgcttgacagaataagtgacttcaggattgccgactgcgcttggcagcgcctcaccgttttcagtacgatacagatcatcgccttctcttgctaaatttctcgtatcgagcgcgattctgacatcgatcctccccagattttggccgttttcagtcaccgttccgtcctcagcgacttgaaaattctcgcttcccaccgtgatcggccggttttccgttgaaaggacgagtcggccgtttattgtcaattgattattttcatttaaagaaaaacggctgcttcttgaatagcgtacatccccattttcaagccggaccgcgtagaaaagcgccgctttatcgtttgtttcgccgttgaccggaacttcggcttcgctgattgcaatatctgtcggctcattcgtgctttgcagatcgccttgagaaaattgaggcttcagttcctgcatataaacccctgtattgattgaaccgattggcgtctgtgttgaaaacgaacgcgaagcgctgccggctttgaaagaatcagactcaatccggctcaaaagcatttccgggaaagaacgtattgatccttggtcttctttatatcccggcgtatttgcattcgcgatattattcgtcagcatctctgtgcggcgctgctgggtgatcattgctgaagttgctgtataaagtccttttaacatcatttcacctcaaaataagtgtcatgctccagagtttcctatcgaaaaaacctcttttgcgaaatgcttgcaatttatatttgctaatacagaacgtttgttctataatggtattcaaacatactactctttttatcggcagccgttcagctcctttaaagcatttcacataaaaaaacctcattctcaaaaagaatgaggcttctgatcagctcagtttgcgcttgggaagcttgtccatgttatcaagcatgacacccgtaccgactgccacacaatccatcggattttcagcaacgagaacaggcactttcagctcttcggcaagaagctggtcaagaccgtttaacaatgcgccgcctcctgtaatgataacgcctctgtcgataatgtcggctgacagctcaggcggcgttctttcgagcacctgcttggcagcctgtacaatgacagatacagattcgcgcagcgcttcctccacctctttgctcgttaccgtaatggttctcggcaatcctgtgaccatgtcgcggccgcggatggaaatttcctcgtgacgtgcgtctgggaaaacagttgcgactttaatcttaatatcttcggctgtccgttcgcctatgagcagcttgtactcgcgtttgatgtagttcaagatttcaagatcaaacttgtccccagccattttaatagaagaggcggtgacaatatcgcccattgagatgactgcgatatctgtcgttccaccgccgatatcaactaccatgtttccgcttggctggaaaatatccattcccgctccgattgcggccaccttaggttcttcctccaaatatacatgctttccgccgcttttttcggcagcttctctaatggccttctgctccacagaagtaatatttgtcgggcagcaaatcagcatgcgcggctttgagaaaagaccttttacattcagcttgttaatgaaatgcttcagcatggcttctgttacttcaaaatcggcaatgacgccgtcttttaatggacgtatcgcaacaatattcccaggtgtacgtcctaccattctccttgcttcttcaccgacagcgagcactttcccattgtttttgtcaagagcaacgactgatggttcatttaagacaataccttttcctttgacatggatcagcacattcgctgtaccaaggtcaataccaatatcccttgcaaacatctatctatatcctcctcgaaatctgtttcacagcaatgtccacattctgccctaattatatattttatcataaatattagaaaaaaaagagagcttattaaagttcttcataaaatttttgtggctttttacggaggataccgggaaattctgataaacgctgctcgtttctgagccattattccttattgcacgggttctctttcaaagatttcctctttcttgtattttagttttgttgcttctccgccccgcaaatgtctgattgatttatgataatcaagaatttcttttacttcattggccaggtcaggattaatttcaggcagcctttctgtcaaatccttgtgaacggtacttttggaaacaccaaactccttcgctatcacacgaaccgtttttttcgtctccacgatgtacttccctatcttgattgttcgctctttgatgtaatcgtgcacaccactcgacctccctaaaatggatgtgagaagtgtgaaatgagatccgtcttgtgaaaaaattcgctatttgcgcagcttcttcgttttatgcttttccaagtagaattttgaaatactcccacgatccctcacctcaaacactctctttgttaggtttgtatcagtgtattagcatttaaatgggattatgctaaaaactcaaggaggacaaggggtttctcttataattttatttcgggcttcaaaaattttaactttacactaatcttgacttccggtaaaatgaataaagtttattatttacctaggtaactattttgaaggagtccgggaatggaacatatcaatcgaaagattattcaccagctcaatcaaagcactcggatggttgctaaaaaaacgaatgaacagctcgaagcgtacggcctttacggttcacagtggtcgatcctatattgtcttcacacctacggaccgatgacgcagaaagacatatggacttatttgcacgtcgaagcgccgactgtgacaagaaccgtcagccgcctcgaaaaaaacggctgggtcgaacggatacagggcgatgacaaacgggaaaaagtcgtcaagatgacagaagaagccaaaattaaatatgatgacattcaattaaaaatgaaagaatttgaagaggaaatgctttccgtatttgaagaacgggataaaaaaatattccaaaggctgttaagtcaattgttagaaggacaccaggaggagttgtagcctatgaagcaagctgaacccatttggaccagggattttatcatggtcgttttgattaatttgtttatattcgtctatttttacgcactattgaccgtgcttccggtctatgcgatgcaggagctcggcggctccgagtcagagggcggccttttgatcagcggcttcatgctgtccgcgatttttgcaaggccgttttcgggagctgttattgagcgttttggcaaaaagagaatggcactcatcagcgtcgtgctgtttactttggcatcatttctttatatcttcattcacgatatctacctgctgcttggcattcgctttttccaaggcatttggttcagcatcatcaccacggtgacgagtgcaattgcagccgatttaattccgccggcccgccgcggggaagggctgggctattttgctatgtcgatgaatttggcggttgtcatcggcccgtttatcgccttgaacctgctggataaaatgagtttttccgatctgtttattttattttcaggaatcgtcactgtagccatcctctgtacggcactggtgcggattcctaaaggaaacgacatccgttcagctgtgttcaggctgtcattttccaacatgtttgaaaagggcgcgattcggattgcaacggtcggcttgttcgtgtcgttttgttattcaagcgtgatttccttcatctctgtttatgccaaatccctcggccttattgaagcaagcagctatttctttatggtgttcgcggtgacaatgatgatcacgcggccgtttacgggaaaactgtatgataaagtcggcccgggagtcgtcatttatccgtccattatcattttttgcgccgggcttttcctgcttgcttttacaaacagcagtgcgatgcttttgctatccggagctgtcatcggcatcggctacggatctatcacaccgtgccttcagaccttggcgatccagtcttcgccgcctcaccggagcggctatgcaacagcgacttattttacgctgtttgataccggcatcgcagtcggatcctatgttttcgggttggttgtggcacaagccggtttttcaaacatttatttattctcaggcgttttcgtgctcatcaacctgtttctgtatacatggagccaaaaacctgcatccgcaaaggagaagcgggatatatcaatggctgaataagccgttcaacctcgccgggccgggaacgcccggctcttttcatgcaggctgatacagctcgatctgttatttaatgaaacttttgcaaaatgaaatacgtctcctaactgtctgcccaaaaattactactctattaaaaaggtgattttttgaactattggctttttacacgcattcatcaattagcaaaccacaacgacatcctggatggcgccatgattttgattacagaaaaagcgatttatatgtatgcgctcattttgcttttgatctggatattcggaaaccgttcttataaaataaccgttcttcaggccggtgtgacgggtattttcggattggcggcaaattatttgctgtcattggtttactatgagccgaggccatttgtcgctcatcatgtggacgtattgattcaccatgctgccgacgcctcatttcccagcgatcatacaaccggggcgttagccatttcgatcgctttttggctttatcatcggaaaattggaagctgcctgattgctttcgggttattgacgggcttttcccgtatttgggtcggacaccactaccctgttgacgtattgggcagcattttggtcgctttattcgtatcacttgttatgtttagattctccacgtatgtgcagccgctttttgaacggatcatttcactctatgaatcgatcttgcggaaattgcggaaagcggtatccagaacggtataagaaaacacccgaatcatgagattcgggtgtttttttatttccttaaccttttaaggcttcggttaacggcggaacaatttgttttttgcgcgatacaacgcctttcagtgtcgctgtgttgtctgccaatgtgacattgaacgctttttccactgcttgtgcagcttgtcctgaagcgacgacaaccgagtcgtttgttaaaatgtcagttacgacaaacacaaataaatccaaccctttttcagataccgcttttgcaagttctgcgtcaacttcctctttgcgggagagaacgtcgtttgtgtcgacagtgttaacctgcgcgatctctactttatggcttcccatcgtaaactcttttgcgtccagagaaagaagctgaggaatcgtctttgcgctcaaatcagctccggctttcagcatatctagtccatagctgtcagcatcaacgccggcaatcgcagccaattcttttgcagctttgacatcttcttccgtgcatgtcggggatttgaataagagggaatctgagatgatcgccgacagcatcagccccgcaatatcttttttaatttcaacgccgttttctttatagagcttgtttaagatcgttgccgtgcagcctacaggctctgcgcggtaatacagagggtcgctcgtttcaaagttggcgatccggtggtggtcgatgacttcaagcacgcgaacctgatccaagtcatcgacgctctgctggcgctcattatggtcaaccaaaatcacgctgtctgtttcattcgcgacagtgttcacaaggcggggtacttctgcattgaatttcttaagcgcgtattcggtttcgccgttgatttcgccgaggcggacaggctctgcgtccatgccgagctccttttttaattcggcatatgcaatcgctgaacaaatcgtatccgtatccggatttttgtggccaaaaataagtactttactcatgatataactccttactgttgtttttatagtaagcttacctgacaataaaaaaatctgcaaatctgtcacttattttaatatttacgaagtgttttgtcattttaaaaaataaaaaaagagccgttcggctctttttattctccatagtcaggtgtattgtggcttcgttttggagcgggcttcaagaccggtttttctccatatgcgacagggccgctctcatagtgaaattccgctccgtccggcgccttccctatcagccactcaaactgtgcgctttcttctccatccgaaaaattgtataaagagtgcgaaacttcttctttttcatattctggcggaacggtaccgggcacgatgacgccttctttttcttccagctctttgatcgcggcaatccactggttttggtgcatcgtatctcttgccaaaagaaaaccgagcatatcttgtacgcctttgtcatccgtcatttcgtacagccgtgcgacttgcagtctgccttgcgattcagcgttgacatttgcgcgcaggtcggccagaaggttgccgctcgctacaatatagcctgcattccaaggaacgccggtgctgttttcaggcatggcccccagacctgaaacgattgcgtgatgagggttcattccgcccataatggcgccgatgacaggatcgtctgctgctttttcctgctcgtaaaccggagcgtcttcaagcagccgtgcaatcatcgtcgcaatcatttcgacgtgtccgatttcttctgccgccgtatccatcagcaaatctttatacttttcatttccccgcgtattccacccttgaaaaaggtattgcatcgccacagatatttctccgtactggccgccgagtatctcctgcattttctttgcgaagacagggtcgggtctttcaggtttggcagggtactgcagcactttcgtatgcttgaacaaatcagatcactcctccgttttttgtatcctcgtttttgatttagccgaaaagggaaatcataaaaccgtacaacaggttcgggatgtgcttaaaacaggtcaaaattcgaaccaaaggagagctgttctatgataaaaaatacttctcaccgcccttttccactgcctgaaggaccgtggatgatgacgcaaacatggaatcatgtattatttgcccattgggctgtcgatcctgaagccattcgcggacaaataccggcggccttggaattggagacattcaacggaaaagcgtggatcggtatcttgccttttctgctgacaaatatgcgtccccgttttttgccgccctttcctttcatcagcagatttcccgagctgaatgtccggacatatgtagcatataaaggcgtcccgggcatttattttttcagtcttgacgccgcttcgcgcttggccgtcgccggcgcgcgctcaatgttccacttgccttatttttacgccgggatgcgctttgcacaacataaagaccgctttcagctgacaagcaggagaaaacgttcacaagcagagttttatgcagaatatcaaccggtttcggagcctttctcagctgataaaggaacgcttgaatactggcttgctgaaaggtaccgtttgtacaccacgcataaaaacgagctctattatgaagatatccaccattcagagtggcagctgcagcaggctgaagctgatatttttccggatccgctcacaagcgcaaacgatctcacactcccagacaccgcgccccttcttcattatgcaaaaaggcagcacgtcttattttggccgctgaaaaagtgggaaagtgaagaaacataaaaaaggaagagctaaaaacgctcttccttcaacctgtttaagccggttttgaaatttcgcttaaagcttctcccgctttctcatccgcatgtgagacggagagatcccccaaagcaacgattccgacaagacggtcatcttcaacaatcggcagcctgcgaatttggtgttccgccatcagatcaccagcctcttcagcagacatatccgggcgccctgtcaccatctgtgtgctcatgatatcccgagcagccgcatctgtttcattttcagctacacatctgataacaatatcccggtctgaaacgatccccgtcaattttccgttctcgcagaccggaattgaacctacattgtaatcacgcatcttaccggcaatttccgcaatcggggcagaaggctcgcagcattcagcattggttgtcatgatgtccttcagtttcattcggaattcctcctttatgatggggttattatgtgcttttccgatataccgcgggcttaaacctatttaaaagagcccttccttttcatatatcgttttttatccctcaataaatcgccggtccagcctttctttttcaaataccaatacacaagggcggtcgaaacggcgattaaaataagcgaaaataaatagccgtactttaaagagagttcaggcatgacttcgaagttcattccccacagggcgccgaaagccgtcatcggcgtaaagatcgtcgtaaaaatcgtcagcgctttaaaaatttcattgcctctgtgggatgtcaccacttcctcggaatgaagcaaataattgatttcattcgcatactctttgatcaatgacatgcctctgtcgatttcgtaaaacgtcctgcgctgttcgatttcgtcaaacgatttggttaaaaaagtttctttaaggcccattgcaacctttttcatcgataaaattaaacttcttatgaccaggagttcgtgacgccgcttatgaatcagttcaatgatgcttttattgttgtcatgatgaaatccccaccttacttttccaaggtgaacttcaaagtgctcaagttccttcaaatacattctcatcagttcgcccagcaggaccaggaacacttcaggggcgtctttgcatcgctttaagtgttgatcgatcggccttctgtttgcctcttcaaattgcgagatatctaaattcattgtgaaaaaatagtctttcgttaagtaaaaatgaaatgctgtccggttttgttgaacttccgcttcctggtcgtaaatatatgaaccgtagatcgcttccttgccttgaacggcagcattgatatcaaggcaattgatgttggccgagggaacgccttgaaaccagtttcggcattccggccaatgatcgggctggatcagcccttgtgctgttgttttttcgtgagggccaagctgataccatgtccagccctctccctgaaaaactctcatacttgtctcctcctcttccggcccactcgttttatatttctttgcccgccctccgcgtaaataaacatgatgtttgccgcgctgcggcacgtggtatgaagctagtatgagtttttcatagaaaaggaggtggcgccttctttactgagaaggcggggcattggagttattgaagctgattgcagtagcaggattaatcgcatttacgggctttttcgtcgcggtcgaattcgccatcgtcaaagtaaggcggacaaagatcgaccaattgatcattcagaaaaaaaagggcgctcttgccgcaaaagaagtgacctcgcaccttgacgaatacttgtcagcctgccagcttggaatcaccgtgacggcattgggcttgggctggcttggtgaaccgacgatgcagaccttgctgcatccccttttctcaaaaatcggcttgaacgagtcgattacacatattctttcatttttggccgcttttttatcagttacttatctcaatgttgtcgtcggagagctggcgccaaaaacgatcgccattcaaaaagcggagaccgttacgctgctttttgcacagccgatgatctggttttatagaatcatgtttccttttatatggctgctcaatcattcagcccgcatgatcacaagtctgttcggcctgaagccgaccggtgaacacgaattggcctattcggaggaagaactgcgaacgcttttatctgaaagctatcgaagcggggagattaaccaaaatgaattgaaatatgtaaacaatatttttaaattcgacgaacgtacggcaaaagaaattatggtgccgcgcaatgaaatgaccgtcttatctcttgacgacagtttaaaaaaagcgaagcagcttatcaaagaaacgaagcacacccgcttccccgtcatggaggaagacaaagatcacatcaccggaatgatcaatataaaagaactgctgctggcggagcttgcaggggaattttctttagaaacaaaatcgctaaagccatatatccatccggttatccatgtgattgaaacgattcccgtctaccagctgttcgtcaaaatgcagaaagagcatacacatatggcgattctcgtagatgagtatggcggaacatcgggtcttgtgacggttgaggatattgtcgaggaaatcgtcggcgacattcgcgatgaattcgatactgaagaagtatctgctgttcagaaactcgaagatgaccattacatcctaaacgcgaaagtactggtcagcgacgtaaacgacctgcttggaattcatttatcagatgaggagattgatacaatcggcggctggatgctgacgcagaatattgagagcaagcccggaacgacgatcgaaagtgaaggataccgttttaaagtaaaagaaatggacggacatcgaatcgttgcagttgaggttgaaaaaaccgcttaatcccccttctgtcggatatttcagcctctccctgtccgcttttctccccaaaaaccatgtaaggaaatctgacatgttcatcatgatatctcccttttgtcactataatgaaagaaacagagatctgctctcaatctaaatgactacggaggaatgaaacatgcagatgggggatacagtatttatgttcttttgcgctttgctcgtgtggctgatgacgccgggcatcgctttattttacggaggccttgtaaggagcaaaaatgtgctcagcaccgttatgcacagtttatcttcaattgccatcgtttctatcatatggattttgttcggctattcactcgctttcgctcccggaaacccattgatcgggggtttggattggatcggactgcacggtgtcggttttgaacccaatgccgattattcggagacgatcccgcatacgctttatatgatgttccaattgacatttgccgtcctgacgactgcgattatttccggaagctttgcggagcgcatgcgctttccggcctttattcttttctcggtgctctgggcggttttcgtttattcgcctgtcgcccactgggtatggggcggaggctggcttgacgagctgggagctattgattttgccggcggaaacgtcgttcacatttcttccggggtagccggtctggtcgttgcgattgttctcggcaagcggaaaaatatgagcgacaccgcccctcacaacctccttctgaccctgctcggggcgactttgatctggttcggatggttcggtttcaatgtcggaagcgcgctgacgatcgatgaagtcgccatgaccgcttttatcaacacgaatacggctgcggccgcggggctgatcggctggattttggcagaatggctgattaataagaagccgacgatgctcggcgccgtctcgggagcgattgcgggactcgtcgcgattacgcctggcgcaggttttgtcacgccattctcatctgtatggatcgggcttatcggaggaatcgtctgtttctggggggtgttttcgctcaagaaaaaattcgggtacgatgatgcgctcgatgccttcggacttcacgggctcggcgggacatggggcggaatcgcgacaggtttgttcgcgacgacatctgtcaacgcagacggtgccaacgggcttttttacggagacatcagtctcctttggaaacagctgattgcgattgctgcaacatatttgtttgtcgcaatcgtcacatacgctattattaagatagtcagtatcttttttaaactccgtgcctcagaggatgaagaatcattgggcctcgatcttacgctgcacggcgaaaaagcgtatcaagattaatttgtcaggagtgatggtatgagcggtcaaatgtataaagtggaaattgtaacccgtcctacaaactttgaaaagctgaaaacggagctggccaaaatcggggtaacgtccattacgttttacaatgtacacggatgcggcctgcaaaaagggcatactgagctttaccgcggggtcaaacgcgaaagcaatgtgtatgaaaggttaaaagtcgaaatcgtcgtcagcaaagtgcctgtcgaaaaggtggccgagacggcgcaaaacgtcctgaaaaccggggaacccggtgacggcaagatcttcatatacgaaattaaaaacaccatcaacatccgcacaggcgaggaaggtcctgacgctttataaaaaagatcgaagctcccggctggagttaagccgggagcttttctaatgttacaaaacagcatcaataacaccgtatgccttcgcttcgtccgcatccataaagtaatcgcgttccatgtcggcttttagtttttcaatgggctggcccgttcgttcgtgaaagaagcgctcgattttttccctcagtttgatgatccgcttcgctgaaatctccatgtctgtcgcctgtcctttgacgccgccgagcggctgatggatcatgatttcgctgtttttgagtgcataccgtttgccttttgctccgccggcgaggagaatcgctcccatggaagcggccattccgacgcatatcgtgcggacatcaggcttcacataatccatcgtatccaaaattgcatatcccgcggaagttgatccgcccgggctgttgatatagatcgaaatgtctttttcattgtcttcagctgacaaaaacagcaattgggcggtgacccgattggcgaggtcatcgttgaattcagaaccgatcataatgatccggtcttttaaaagtctggaaaaaatatcgtacgatctttcaccggcagccgttttctcaatgacgtaaggaatggtgttcatagcatttttcctcctaggcagcgcacctcatcatgctgatgcaagacggctgtgaagcgtcgaaacgccatgtctgtttggcaaattcgagcagatcatcggggttgtgatgcaatatcgcccgaacaagcagaccgatgtgttcgtcatccccgtccgccggctccttttgcagaacctccggagaaagcctttttaatcgctgacgcgatctaaataaaagcgacttgacggatgattcgggcttaccgagcgtctcggcgatttcgtgcagctgaaaggaaaacacatctttgagcagaaaaatcgttaattgcttcggtgttaaaataccggaaagctgtttcagcaggtgctcgaagtcatcggccgccttcatgcgctctgcccgcccgtcttccagattatcttcagacagaaagctttcgcgcttcctttttctgagcaggtcaatccatttatgctttgcaaccgtcttttgataagcatgtgacgcgtctgttcgattgatttccattaacttgaggattgtatcctggactaaatcctcggcatcccatttatcgcctgtcattctcaggcaatacttcatcagcgcttgctgttctaattcattcatgaatgcattcacactccttaaaagaggcctcttacttaataaacggctggctccgccgatttgatacgggtttttttatgattgtaacaaaaaaggcgcctatcgcatttgataggcgccctgagggaagcgtgccttatgactggcttgaatcgtcagactgggttccgtcttgattttctgacccttcagacgaatcttcccgcttggttttgtcgtcttttccatctgtttgatctttcgctttgtcttctgtttttgacttttcttcaacagaaggctgagcaggttctttcacttcagacgcttgttcctccattgctttttcaatgctggagaccggcttgtccatgaagttcagcgggtttagcgcaacaccgtctttgcggatttcaaaatgcacatggtttccgccttcttcattgtaaaggtttttgcctgcttttccgatgacttgattttgttcaatcttgtcaccttgtttgacgcttacttcagaaagagactgatacacagttgataaaccatcttcatgttcaacttcaacaacgtagcccagtacagggtcttttgcagctttgatgaccgtaccgcttagagatgcggaaacatcaaatgtttttccgtctttctcagccaagtcgatacctttgctcatgctgtacgtgttattatagtttacaagtgctgcttctttctcttctttagttgcgtcagtttcaaaaaactttttaacgacggaaacattttcagaatcagcaaccggcattgcgacattttcgactggtttgcctacttctaccgcatcatcccggttatcataggctgatttcttgccatcgtctgcaagctggtcttttacatcgttgttagaagccgattgataccatagaacggcggttaatacaacgacggcacttgtcaaatagatggccggaaatacccagcgtttacgaaaaaattgttgcagctttgtgattttggaagtacgattcttttcttcctctttcataactcatcacctcagcaacattctgaacacttttcagaaaatatatacatttacaaaaaacttttttcaatttattttgcaccggctgtttcgtttttatgtaaaaccgccctgaaaatctgaaaaatgaccggtatgcatgataacggaaaaaacgccgaagatataacatatgaagaaaggatagagagaatgaaattacgaatcgccaatcgggaagaccttcccgcagtagtcgatatttacaactccaccattgcgtcgcgaatggtgacggcagatacagaacccgtcacgcctgaagaaaggctgaactggtttttgagccataccgaagaaaggcctctttatattgcagaaaatgaaaaacgggatatcgtcggctggatcagctttgaatcattttacgggagacccgcctacgccaaaaccgccgaagtcagcatttaccttcatgaagaccaccgcggcaaaggggcgggttctgcggtgcttgaaaaagcgcttgaagctgctccaaagcttggaatccgttctttaatggcgtttattttcgctcacaatgaaccgagcatgaagcttttcaaaaaatacggcttcaccgagtggggacactttcccggaatcgccgagatggacggaatccggtacgacttaaaaatattaggaaaagaattgaatgaagcctgatcatcatgacaaaaaaagagctgtcatgcagctcttttttccatcaatcattcagccagcctgcgccttctgatctcttcttcatttaaaaattccaaaaagcttctcattacagtaaacggctcttctttgaccgcccgaacgtagcggcttttccgttcatcggaaagcacttcgcttgtttgcatccgttccaatatatacttcatcaccgattgctgaacatttcttttttggtatgacgactctctgaacagcgccatgccgaatgctgcacctgcggcagcgcagccgatttttatcattgaatcggttccataagctgcctgcccccaaaaagaggaaagataaacaaatgaagcaagaagcagcggaatcgcgataaaaagaaaaatcagccttttctttaagaacggcgccgccacgcgcttgaggttatccatttcctctttcataaaggccggcatttgatggaaacgttccatatccataatcaatccctcccgttttggttaaagaggcgttggtccgctaattaaatcacgctttttatatgtatatcgtaacttagatccaacatgttttacagttttttgccttcctccctttttctttagaaactttccggccgccgccccgtataacatgagatagttgcttgaaaggggagtaactgttataaatggaatgtataaaaacaaatccgtcttgtgaggttcaatatggatattattaaaaatatcagtatcacatcgatatttctcggttttatattagttttaaatacgcttttggcaatcgttgtgatctttagggaacgccgggatgcaagctcctcctgggcctggctcttggtgctcttctttattcccgttctcggctttatcctttatttgctcttcggccacaatttgagcaggaatcacctttttcaatgggaagaccgaaagaagatcgggattgaaaaaatattggaacagcagctgaccaagctgaaaaaccgcgagtttgaatttcgcaataaagcgacggcggacagcaaagacttgatttatatgcacattttgaataaccacgccgtttttacagaagacaatgcggtcgagctgttaacggacggacgccagaaattcgacaggctgcttcgcgatattgaaaacgccaaagaccatattcatcttcaatattatatttataaaggcgatgagatcggcaaaaagctccgggatgcgctcatcaaaaaagcaaaagaaggcgttgaagtccgcgttttgtatgatgaattaggatcaagaagcctcaggaaaagctttttcaaagagctgaaaaaagcgggaggatttgtcgaagtctttttcccgtcgcgctttaaatttatcaatttgcgcatgaattaccgcaaccaccgcaagctcgtcattatcgacggcgtcatcggctatgtcggaggatttaatgtcggagacgaatatctcggtctgaacccggcctttggctattggcgggacacgcacctcagaatcaaaggaacagcggtccactcgattcaaacgcgttttatcctggattggaatcaggcctcgcaccatcacgacattacatatatgccaaaccattttcctgacatcgactcccacggaaacatcggcatgcaaatcgtcaccagcggccccgattcagaatgggagcagattaaaaacggctatattaaaatgatatcaacggcaaagcggtccattcttattcagacgccttattttataccggacgcaagcctgctcgatgccctcaggatcgcttgtctgtccggcgttgacgtcaggatcatgattcctaacaaacccgaccatccgtttgtgtactgggcaacctattcttacatcggcgaacttttaaaagcaggcgcctccgtatttatttacgacaacggttttatccatgcgaaaacgattgtagtagatgaggaaatttcatcggtcggcacggcaaatattgatatgcgcagcttcaagctcaattttgaagtgaatgcatttttatatgatgaggaaattgcgagaagccttgtcctatcatttgaaaaagatctgcaagtgtcaagggagctgacctttgaggaatatttaaacagaagcaaatcgatccgcttcaaagaagccatttcgatcctgctgtcgccgattttatagcgcacaattcatgctgttaaaaaaatcctcccggaaacgggaggatttttgttttactcaccagaagctgccgcacctttgggtgctgaagcatgcttgtccatttgacggcctgtgtcagcgtccttgagcttgagtgcgatgaaaagcgcagccatgaggaaaccggctgcacagagcaaagctgtccggtaagctgataaatcaggctctatgcctgcgctgggctggctgagcacagcaaggacgcacgacatgacagcaactccaaaggcagatccgagccggttttgcacattaaacagcgttgttgcccggcccattgaggatgatgaaatgttggcaaaacaaacaacctgcgccgcaccaaccgcgtgccccaagaaaaagcccgctaaaaacagcagcagcctgagaagccaaagatttgacccatatccggtcaggctcagcagcccaaacagcacagcagcgcctaacagcgcaacggaaatgacccgcctcgggccaagctttgccaacgacctcggcatcagctgggacgccagcatcaagcctaatgcttcgggaaacgtaatcagcgcagtatctgtcgcagagtagccgagtgcttcctgacacaacagcggaaatatatagagcatgccaagcagtccgcctgctgtcagaagcgaaatgacgctcatcattccaaaaacccggtccttcaataagcgaagttcaatcaacggatgctcagccttcagttcgacaaaaacgaggattgcgaggagcatcattcccccggcccctgctgcaagcacatccggagagccgaatccacgcgcaggcccctggctgagtgcaaaaaccgccaacgccattcccggcgccgccaaaaggaatccaagccaatcaaatctgcccgcttccggctccaaatgttcatgaagatacaacaggccaaacagcagaatgatcattccgatcggaatattaatgtaaaaaatccagcgccatgacagctgatctgtcagaaacccgctgatgatcggcccaaccgcaggcgcgacggcaattggaagaacgaggactctcgaaattttggcccgttcatgcggaggaaacgtcctgaacaagatcgccattcccaccggcgtaatcaacccgccgccggccccctggatcacgcgaaatgcgtttaacgccgccagattgtcagcgattccgcataaggcggatgcagctgtaaatatcgaaagcgcggctaggaaaacacgctttgtcccaaagcggtccccaagccagccggctgcgggaagacagaccgccaagctgactaagtatccgatgttaactgtgcctgcagcagacggcaatgtttgaaattcggtcatgatggcaggcaatgccatgttgatgacactcgcatccatcgcagccataaacatggctgttacatatacaatgctgacaaccgtcctttgattgaacggccttctattcattgctgaccgccgtgtacttctgcaaccagcttgatgctgttcggcgagagatcggtccaattcgagctgatatagtcgatacaggcgctgcggctcgcttccccgcagacgacctcccaccctgccggaatatgaatgaaggccggccagagtgaatactggccatcctgattcattaaaacgacatatgtgccgtgttcattttcaaaaggatttgtcatcgctatctctccctacttatccgtatcttttttcaagtcgtccagcttttccgaaacccgacgtccgatttcggccagcggctccggctggcacaaatctttatgccggcaatccatatcatgaatatcaatgtttccgttcaaataaggtagccatgactccggatcgatcggatcaaaccattccggtatcacggttgatttgaaaaacagaatatcgccatgaaagacgcggggcttatattcgcttaaaatccggacggaattcacatacgtctcctttaagttcaagatcgcagcctcgtccaggctggcaagcgcactgccgtcgcggcgcagaatatcgatcgcactggaaaggttcagcggtgccccgtcaaggctgtccgggtcgtatcctcccaatgccaagagggcaatcaatgcttcctgctcatcaggcgcatctttaattggaaggaagtgattcgggtaagcatcaagcatgacaagaagcgatatgtcttccccttgttcctgcagctgagttgcgatcgcatgaacaacattgcctccgagggaccagccgagcagacgataagggcctgttggctgaatcgtacgaatgtgccgaatataatcagcagccatgtcgtcgagcgtatcaggtagctcttcctgccttgcgatcccgcgggcttgaaggccgtatatcgggtattccttgccgagtgccgtcattaaaccggcataacaccagctgaggcctccggccgggtgcacacagaacaggggatcttgactgcctccggttctcagcggaagcattacatccagcgcactttgcctgccgccggattcaagccgttcagcaagtccgctgactgtaggcgcttcaagcaggtcgccgatgccgagttcgactccgagcgcttcacgaatgcggctcatcagctgtacggcgagaagagaatgcccgccaagttcgaagaatccgtcatcaataccgactctcggcgcattgaggatttctgaaaaaagatcgcacaggatttcttcctgcggtgttcttgggccccgccctttaacagccgcggcaaagtcaggctcaggcagcgcttttcggtcaagtttgccatttggagtcaatggcagctctgaaatttttacaaatgcggaaggcaccatgtactccggcagagtgcctgcggcaaaccgtcgcagctcagccggatcggtttcttcttcagacgccgggacaacgtaggcgatcagacgcttgtccccgggctggccttcccttacgaccacagcggcttgattcactctatgatggcggacaagcaccgcttctatctcgccgagttcgattctgaagccgcggatcttgatctgctggtcggcccgccccatataatccagagagccgtcctggcgcctgcgggcaagatcgccggtgcggtacatccgggttcccggcggaccaaacggatcagcgacaaagcggtctgctgtcaaatcgggtctgcccaagtaaccccgtgcgagaccgcccccggacacatacatctctccggtgacgcccgggggcaccggttcaagatactcatcaagcacatatacacctaaatcgggaatcccctggccgatcaggctgttcgcttgaagtgccgcagtctgctgatcgagagaaatatagctgacatgcaccgtcgtttctgtaattccatacatattaatcagccgcgggaaatgatccggatggcgttcataccaatcttcaagcctcttcagctcgagcgcttcccctccaaaaatgataaagcgcaaggaaaggagctttcctgtctcagcattgtcccggtcagcctgcatcaattgataaaatgctgaaggagtctgattgagcacagtcactccctcgcgaacgagaagattgagaaattcggccggcgagcggctgattgtatgaggcaccacgataagccggcccccattgagaagtgctccccaaatttcccataccgaaaagtcaaatgcgtaagaatgaaacatcgtccaaacatcgtcagcgccgaaatggaaccattggtcagtcgctccgaacagccgcacgacattttgatgcggaacaacgactcctttcggcttgccggtcgaaccggatgtgtaaatgacatacgccgggtgaagaggcagcaaaggcgcggtgcggtcggcatcacacggattcgcagcagcgcatcctttcagttcctcttgtatacaaggatcatcgagtacaatcctttcaacagatccgggaacagaaagatttgattctaccgctgaactcgttacgatgcagacaggatgggcatcattcaacataaacgctatcctttccgccgggtagtccggatctaggggcacatatgccgcgccagccttcagcactgcaagcaatccgacaaccatatccaaagatcttggcagcgccagggcagcaaattgttcggggccgacccctttggcgatcaggagatgagcaagccggttagcgcgtttattaagctcgccgtatgtgagcgcattattttcacatataaccgcaacagcttccggatcctttgccgcctgcttttcaaacaaaacgggcaaagatgaacaaggtatgctgttggacgatttgctccaatcagccagcatgttttcccgttcggccggaaggagaatatcgagtttttcgatcggctgatcagggtcgtctgctgctgaatccagcagcctgacaagccgttctgccaatgtttgaaccgtatttcgctcaaataaatctgtgctgtattcaagaaatccgccgatacctgcgggtgttccgtccgcttttcgatgttcgcgaagctcaatcgtcaaatcaaacttggctgctccgacgctgcgaatttcaatgtctgacttgaggccggaaaggtcaagctcaggttcaggcgtattttgaaaggcaagcataatttggaacagcggatgtctcgctcttgacctgcgcggattaagcacttcaacaagacgctcgaacggaaggtcctgatgctcatacgctgcaaggtttacttttctgactctgttcagaagctcccgaaaactcggattacccgatgtatctgttcgaagcacaagcgtattaacaaacaatccgacaatttcgcctaaagcatcatcgtttcttcccgctatcgggctgccgagcggaatatcatggcctgctccgagccgtgtcagtagtgcggcaagagccgactgcaaaatcataaacatgctgactccggtgctgcgggacaaatcgaacaggcggccgtgcagctgttcgtcaatgctgagatcaatcgtaccgcttctgtagctagattccgacggacgcgggtgatcagtcggaagctccagctgatcaggcagatgttccaatgccttcgaccaatattcgagctgtttggcaatcagactgtccggattgttctcactgccaagcagatattcctgccatacggcatagtcggcatattgtatagaaagcggctcccaaacaggtgcctcaccttgcagacgcgcattataggcggtttccaaatcacgggtcagcggcattaaagaccagccgtcgccgatcatatggtgcaaaagcagaagaagcacaaatttgtccggtccgagtacgaatagctgggcgcgaaacggaggctccttttctaaatggtaacggtgccggacggcctcagccaggactttttccaactcatgttcgctgacatgggatacagtgagttcgggacgcgattgatcctcttccaatatcagctggtgtgttgtcccttgctgatccgggaaaattgttcgaagcggctcatgtcttgttgccacatcacccagagcagctgccagcgccttttggtccaaatctccagttaaatgaacgacaaccggaatattataggtcgggctcggtccttccaaacagtgcaaaaaccataggcgccgctgtgcgaaggacagcggaatctccttgcggcgctctcttttgcgcaatgccggacgggcgctctgcgcctgatcaagctgtttggcaagtccggcggctgtgggctcatcgaataaacggccgattccgagttcgacgccgagcatttcccgaatgcggccgacgagcctgcctgccagaagggaatgtccgccgaggtcaaaaaagctgtcatcaatactgactcgcggcacccccagcacctcagcaaataaatcacacaaaatttcctcttgcggagtcctcggctcgcgtccgcctgtatgcatactcaccgccggagccggcagggatttgcggtcaagctttccgttcggcgtaagcggcagttcatcaagtatgacaaatgcagacggaatcatatagtcgggcagtgtctcaccaacgaagcggcgaagctcggcaggatcaaggctttctcccgaagcgggaacggcatacgcgaataaacgcgggtcaccgggctggtcttcacgaacgatagcagcagcttgtttaacaaccggatgatttgcaagcaccgcttctatttctcccatttcaattcggaacccccgaattttgacttgatggtctgcacggccgatataatcaagcgacccgtcttcgcgccagcgcacgatgtcgcctgtccggtacatccgcgatccaggcggcccgtatggattcgcaataaagcgctcagccgtgagagcatgtcggttcaagtagccgcgcgctacccctgttcctgccacataaagttctccagccgttcccggaggcactggctgtaatccggcgtccaggacataaagctgcgtattccaaatcgcacagccgattcccggaggttccgtacagttgccttccagcgcagcggctgtagaccaaattgttgtttccgtcggtccataaaggttcgttaaagaacacgcgagctgctgcaattgccgggccaggctggattgcaaagcttcgccgccgacaagcgcacgaagacctttgagcttttccggggcgctcgaggccaatgcatgccagagggtcggtgtagcctgcattattgtaatttcgtatgtttcaatcattttggccaattcggacggatcttgtaccgtttccttctcggcaagaacgactgctgatccgctgatcagcggcaaataaatttcgagtgctgagatgtcgaatgcaattgtagtgacggccagcagccggtcatcttgattaagcgcgaacatgtcctgcattgacagcaaaaaattgaataagctttcagcttgtacgaccacgcctttaggtctgccggttgatcccgacgtataaatcatatatgccggctggttgccggaatgctgttcgccgggattttcttcagaacagccggacattttctccataacagtttgttcatcgaggattaacttcggcatttgcgaaccgatcgtgtcttgcgcttccttgctggtcataacaagcagcggctgtgcatcgttgagcatatactcgatcctgtcagccggataatcgggatctataggtaaataagccgctccagctttgagaacggcgagcatgctgacaaccatttccgctgaccgcggcaacgccaaggcaataaatgtctcgggtttcgccccctgatcgatcagcaagtgagccagttgattagccttttgatttaattcggaataagtgagaaccttatcattgcaaacgactgccggagattcaggacactcctttgccatcctttcaaatcgctgcggaagactctctttgggaagcccgtgttctgtttgattccattcaatcaatatttgagcgcgttcttcagggagaagaatgtccaacgtccccaccggctgagtttgttcgcaaacggcaatcgttttcagaagagtaagaaaacgattgccgtgatcttcaagttcatccgcatgataaacagcagggtttgcatccatgtttacttttagcccgccaccgtccggacggccgtaaatgttgattgacaaatcgtccacaggtcccgtggcaagattatgcacgatgccttgacagccggcaaaattcaagcggttctcaaaaggcatcaaattaagctgcggaccgaacagccgctggttttcgccaagcagcttgagatcccggcgcaattcttcgtggcggtaatgctgatggcgccgcagcttcatcatctcacccgagatttgcttgactagctctcctatgctcatttgcggctgcatgccaattcgaagcgggaggagattcatgaccattcccggaatatgaagagcggctgacccgaggcggcacatcatcggcatcccgagaacgacgtcatttgcccctgtcagacggtgaacatatattgctgctgctgccatcacggtttcgtgccaagttgcccccattctgctcgcggcagacagaagacgatcagcatcctcacttggcaggtgttcagacctgcgaagaaaacttgaagaggtacgcggcgccctttcggcaaggctgaccacctccggttcatcgctgaaacgcccaagccaaaatcgccgatcttcctgatactgttctgatgcacggtaagccgtttcctccgcgagaatcaaatcgagggagccaaaggctccgctctggtcgatcgatttgttctgcatcaatgcggtatatatttttgacagccgctcggcgatcaatgtaaagctgaacccgtctgttgcgatatggtgagttcgctgataccagaagtaatgatcttgcgccgctttaaaaagcgcttctgtaaaaagcgggccgcgagtcagatcaaccggacgggcaaggtcatccatcatccagcttttagccgcctgttccggatcggtttctgagctgacatcaatgtaatgtagcggaaaatctgttgacggaacgatctcttgccatggtccgtcttgatcttctccaaatctggcatgaaatgattcagcttctttaatgacatggcgcagcgctttttcgaaaagctcctgatcaagcgggcctttaatttcaacgtattcagctgtattgtagatcggattttccggatcaagctgctgagcaaaccaaatcccggcttgcgctcctgataatggctttcggttatgttgacattcaggcatttaggtgacctccttcattgatagtctgcatttggcaaaggtgcttctttagaggaggacaacagtctccaccagttttcaatcgaagggtcctccgcaagctctacaaacgacacctcccgccccgctcggcgccagcgctctgcgagactcatgattctcacggaatcaattccccggtagatcaaattttcgctgtcgcttatcttttccggcgattcaagaagaagcgatgccacctgttcgcgaataatctgttttgtcagtgcatgagagctttcttttgcgtgttcatggctttcgccatctttcagtcggctcagaagctgttccgcagtaattgtgacactgcaacggtcagctgcgtatgtgatggccatttcatgatgctttaatgagaaatccgccaccgcatctccgacgaaaaatgtttcaatatcttgcataaaagcatcacatgccgtcatcaggcagccgatatgggcatagattccggtgattatgagctgatcccgcccctgctcctccagcacgcctaaaaggttggtttttctgaaggcattgtacctccacttggtcaaaacaatgtcgccttcattcggtttcagctcatccacgatcttctgctcatcgggatcaggaccgattccgggtccccaaaagtcttggagaagcccccgttcttccggtgtctgggcgccgggttgagccgtgaaaataaccggcatgccgagctcggcacatcgcttccgaagcttcttgatattagccagcagatctgtgaccggagactcgccgtaacggtaagcgttgagaaaatattgctgcatatcgtggatcagaagcgccgcacgcttcggatgaggagtccatgacaccttgtttttcggcatatttgatgcttctggcatttggtacggtaagatggcaggaatggccatcaaatcacatcctctcattttttatcatctgacattctcagctgcagacattttttcagcaatcgccgcacgcagctcttttttgctgacttttcctacgcctgtctgcgggaaatcttcaaccatttctacccggtcgggtattttgtaggctgcaaggcccctttctctcaaaaacgattgcaactcagcctgagccggtgcagcgccgcgagggataatatatgcacacgccctttcgccgagaaattgatccggcatcgagacaaccgccgcatcgagtacccccggatgtgcgagcagatggttttccacttcttccgcggcaaccttctcaccgcctctgttgatctggtctttagctcgtccttcaacaatcaaatagcctgatgaattgactttaaccaagtctcccgtacggtaaaacccgtcttcagtgaacgctttggcattgtgctcctcagctttgtaatagccgcgaatcgtatatggacctcttgtcagcagctctcctgtctgtccgggtccaagttcgcgtcctttttcgtccacaattttaatctcgtcaaacggagacattggcctgccttgtgtgtgaacgatcgtgtcttcaggatcatcaagtctggtatagttgaccagaccttctgccatgccataaacctgctgcagtttgcagccaaacaccgatgaaacgcgtctggcagcttcggcgctgaatttcgctccgccgacttgaaagacctggaggcttgacaagtcgtcccggcgcgccgaagcagcatcaagccagattaacgcaagcggcggtacgagtcccgtgatcgttaccctctccttatcgatcagagggaaggtttcatccgggctgcctcctgatgcaaggacgactcggcctcccgcgtacagcgtaccgagcactcccggcgagctgagcggataattgtgagcgatcggaagagccgcaagatatacgctgttgtgatcgagcctgcaaatctctgcgctgaccctcaagctgtatatataatcatcatgcgtcctcgggatcagcttggacagacctgtgcttccccccgacaactgaagaaaggcgacatcttctggatagacgttttgcggaggtgccggctgatcataaaggcttgccagcgcttcaaactcctccggttccccggcgacaatgacatgacggagcccttgcagcttctcctttacctgtctcgccagcttgcggtagtcaaactttgcgtgacgatcgggaataatgtaggcagcagcttcagaaaactcgcaaaaatacgtgatctcgctatgccgatgcgatggaagcgcaaaaacaggcagagctccgatccggaagagcgcaaagcaaacttcaaaaaactcgatgatattcggcagctggacaacgacgcgatcattttttttgatccccagctttaaaagaccgccagccaaagaatcggctctcctgtctaactcacgatagcttaaatggatatctccgtatgtaagggcaatgcggcttccgtatttttcggcccgctccctcagcatttttccaaaagtttcgcctcgccagcatccctccttccgatatttatccgcaaactccttcggccatgtcgtgcatcctttcagcatctctatccctccgttactcactgttcattcccatcgcaagaagcattgtccgaaactttgcagacgtttcggcaagttcgtcttcaggcttcgacccggcgacaattccggcacctgcgtacagtcgaagcgcgtgttcctccgcctcggcacagcgaatcgttacaacccattctccgtcaccgtccgcgtcgcaccagccgaccatacctgtgaaaaacccgcggtcaaacggctcaatctgtttaatcgcttctttcgccgcattcgtcggcgtgccgcagacagcgggcgtcggatgaagggcggcggcaagctccaatgatgatacagagaggtctgtaagctctcccttcaattccgttgaaagatgccacatcgtcggcgtgctgatgagcgacggttccggcacctccagcttccggcaaaacggcctgagcgcggaagcaaccgcttcgacaacgaccgcatgttcgtgacggtctttaggcgaagcaagcagttcagccgcccgtcttcgatcttcttcgggatcatcgctccgaggtcttgaacctgctaaaggatttgccgtaacgcagaacccggaccgtgatacaagcagttcgggactcgcgcctatcaaagtggtgcgaggcgcttcagatgactgcccggttaaatcaacggcaaagttgtacccgcttgtattgcggcgggcaagatttcgcagcaattgaccgatatcgactttgatcggcgaggtcagctgcaatgaccgggaaaggacgatcttgctgtattctcctgctgctatacctgccaatccttgtctgactccggccatatacgcttccgggcttggaatctgctggacatcataggggtgcagggcaggttcaggcacctctttatcgtcttcttcacatgtcagcggccccgcatgccacgcttcgaccggcacggttaactgcgccggctttgcatcgtcaaatggcacagctccaactacaatcggattttcctgcccgttctccctggcttttttcagaacttccgcagtccgctgagcaaggctttgctcttcggtttgagaaacagaagcaaaaacaccttccgccagaatggtccgctcaggggaagagaaaaagaatgaagcaccggcctgatattcctttaacagctgatctgcaagcgcttctgacacgacatgacgttctatcatcatcaaaacctcctttagattgaatcaggctccaagcgttgctccgccatcgacgcgcaaatcgtgcatcgtaatatgacgagccccgtcagacagcaaaaatactacagcatctgcaatgtcagccggcgaagccaattttccgagcgggattcccgttttgaatgtttcaagtgatccttcaatgacgccttgcgcagcttcctcacactgccatagcgaccgctgcatcggggtatccgttgatccgggcgatatgatattgcagcggatattgtactcggcaagttcaaggccgaggcatttcgtaaacattaaagcggccgccttggaggccgcgtaggcggccatgtgcatccgcggcacagctgccgcatttgatccgacagtcacgatcgctccagtcctgcgcggtaccatccggcgggcgacggcacgcgatacgttaaaaaccccggtggagttgacattgaacgtcttctcccaatcttcatcactcaacgaatggatcagacccgttctgagcacgccggctacattgacaagcatgtctatcggaccgatctcgcgttcaatatcggcgataagctggtcaactgcggcactgtcgcccacatccgcggcaaaacctgaaccctgcagtcctttttgttcaagttcgtcttcaagttcaagcagcccttttcgattttgatcagccgctgcaacaaacaccccgcgtccagcaagcgccagggccacttctttgccgattccttgcgaagccccagtcaccaaagcaaccttgcctttcacttttatcatttcctttcttaaagccggcagcgcccgagtctcaaaaagtcactgccggctaaaattccaattgataatgataatcattatcgtttaaaaatataatataccaataactgctaacggtcaaatcgttttcgattgtttatccgtatcaatgcgcttggtatattatcagttatctattctcatgctttttcaaagctcggggcgccggaagcgccccgctatcaatcaggcttgaaggcaaaccgcagcgctctgctgattaacacaggcagaaccgatatatgaccttcccctttaaattcatggtactccgcgcgaaccccctgactttccaaagcggccaagcggtcggccagcctttttgcattgtcgttcatcccgcttttatgcgtcttttcgagttctccggccccaagcaatacctttacatcgccatcagcttcctgcaacttcgaaacaaagtcatgctctttatcaaaaaatgacggatgccaatggatggacggactgccggcgatatatgtctgaaatagatccggttttgtaaacagggtctgcaggacaaaaagtccgcctagggaatgaccgaaaatcgcctgccttttcacatcaatcgtgaattcctgttcgatctccggctttaactgctgttcgatgaaggacagaaaagctttcgccccgcctggttccggccagtctgctccatcgggcctcatgggcagctcagcgcccgattccggcagagtaaaatcataataccgcccccggtcaaagggagcgtcggtctcgtaaccgatgccgacaataacagccgtccctacaccggttttatcgggacggcgcgactgcatccgcaacgcctccaccatcgttccaaacacggaattggcatcaagcagataaatcacgggatatcctgcgggcggctgttccccaaatggtttcgcaataaaaatccgatatgtgcggctcccatccagtgaacgcatgcaccgctgttctgtccccggtatcgcaaccgggatgcattcagcagcattgacagactgctgaagtttttcttgagccatatcattctcccttcccctctttgatgagctaaaaaacagtctaatgaacagtctttttttgtttgaaaagtaaaaataagaagtacggcacaccgaaaatggcgagaatgatacccgcaggcacctcggacggctggaacagcagctttccggcaaaatcggcgcacaatacgagaaacatcccgatcaatccgcttaacagcaatgagtggcggtgcaggacgccggcgagcctccgcgagatgtgcggagcaatcaggccgacaaatgccatgctccccgaaatagccacacaggcgctgataatgccgacacaagccgtgagcagcaccaccttttcaatattcgcggatacgccgagactcttcaccgtatcttcatgaaagcgaatggtatcgagcaggccggacttcatcagcagaaatggaataagaacaagcagccacggcagtgccgcttgaatatacgtccaattcgccgaccagatgcttccgtttttccaaaccatggccatttcgtggtcattcggattcatcttcaatgacaggtaaagcgaaacagcgctgaaccctgaattaatcgcgattccaacgagaataatcctgcccgaatccaagttgccggcgtgccaggcaaagataaaaatgaatattgcagccaaaatgcccccgatcaagccgaagaatggcatccccattgcagcgagcaggcttgtcgtttcggtctggccttgaaagatcagcatgtagccgacgatcgccgcccccgcacctgcattaatccccaggattcccgggtcggccagtccgttccttgtcatcgcctggatgacggaaccggcaatgccgagcccaagacccacgagtgccgccgtcacaatccttggaagacgcagctcaaacaggagaatggcgtattgctcattcgggttgatgtgaagcaatgttgataacagctcagccggatgtacggcaaacgatcctactgttatgctgagataacagattgtgagaatcagcacaataaaaacagcatagatgactgcaacctttttaggcacgctgctcccctccttttctcttgatcaaataaaggaagaaaggaacgccgatcaccgaagtaacgacttcaatcggtgtctcaaacggatagttgatcagccggctgagaagatcggccagcgtcaaaaaaacgccgccgagaacgcaggagcacgggatcagccggctgtaatccgatccgacgagaaaacgcgtaatatgcggcacgaccagtccgacaaaagcaatttttcccgccatggcgacagagcagcctgtcagaacgacgaccgctgccatcgctgtccatttgacggcctgctttttctggccgaggctttcggaaatgtcatcgcccaatgataaagctgtcacttttttgctgagagagagcgccagaatgatgccgatcacaaaaaacggcacggcatacttcagcagctcgggattcaattgatgcagcctcgcgctgtaccagaagctgacgtcctgggaaatttgaaagtaaatcgatatcgccgcagacagactgctgagcagcatgcttgttaccgtcccgattatggcaagttgaaccggcataaaaccgtttggaatcaccgaggcgaggccgaagacaaggccggcgccgacggctgatccgataaacgaatagcccatcatctccagagaggatgaacccggaatcaccaccatcaacagcgtgatcacaaacgctgacccgtcggaaacgcccataatcgacggggaagccaagtaatttcgggtgacaccctgcataagcgcaccggacaccgccagcgccgctccgattaaaagagcgccgacagcgcgcggaagacgggaatgccaaatgatttgatgatctgtgttgcctggatcaaaatgcagcagcgccgaaaaaatcacctcgggctcaagctgttttgcaccgtaacataccgacagaaaaacagacagcagtatggcaaacggagcggcgatcataatgatgcgggtcatttgctttgaatgcatagctcaatgaaccttttctatttgttctgcgccaatttctcagctgcagcctttaaaaattcaaccttgctccatgccgttccgccctgcgcaagcgggtctacagcattgacaaatacacggtcatttttcactgcagaaatgcttttccaaattggatttttctccagatctttcagcgcattcggattgtcggcattctcatcgtctgagaattggacaaacatatagtccggattcatttcactcagtttttctaaagaaaccaactcctgggcttttgccgccttgacttcttttggagctgtgaagccgagctcaccgtataatgtggaattgaagaatacgtcttccggatagataaagatattgccttttctgattctgacaacgagcgcttttgtatcttttgccgttttctcaagctttgttttagcttccttgaggtcggcttcataatccgaaataatctgcttcgctttatcttctttgcctgtcagttcagccagcagctttaaattgtctttccagtttgaagaaacatgggaaacaggaatcgtcgtcgcgatgttatccagttttttcaccactttatcaggaaatttcgttgaagccaggatgacatccggtttcagctcaaggattttctccaggttcggctccattttttcgccgacagcggttgctttgtcagtaatgctcttaaacagatccgggaactttccggagaaggaaatggcaccggctgggtgaacatccagaagcttggcatcttccatcgattccacgcttcccgtaatgacgatttgttcggccgggatcttcaccttgtatgtatgatcgaggtactcgatgctcttctcagctgacgctgtgctcttgccatcgccgccagccttttctttgctgttcccgcatcccgctgcgccaagcgcgagaaggagaataaatagaaatattgatatttttctcatctgactgagaccccctgatttaattgataactattatcaattaaaattataggtaagcctcttcgataacaccatggataatatccggcaattaaaatggattttttccggacagcagccgaaccgcctggcggatgattcgttcatggctgcatgcggaatattcccgccaaggatcagaattcacctgatacacccggtgatgccgcaccgctttcaaatcctgccaagcagccgactgctgaagctccctgtagaatgccagcgtctccggctctttaaaaatgaaaatcataatgatatccggctgataggctgcgattgtttcgatcgacacggcccggtcagtcggttcttccagcgacacagccgattcaaagccaaggtcgccgaaaaatacatcttgaacagaacggttatgcgccagataaatctcgtgtttatgcaagcgcaaaaacaaaaagcttcggcgtccgcagatcggataaagcgcctctttcgcggtctcggtgagacgctggtaagacagcagccatttgtgagcctccgcttcttcgtccaaatgggatgcggtcagcataaaatgcctcctccattgttcctgtgaaggcaaaaagaagacatccgcgatcgactggagctgttcccgttcctcgtgagacacgctgtccatgctgataatgagctccgggtcagccgatgacaatgtccgcaggttttcttcccacggctcgtgaaagcggtatgcgctcagatggaccggaatatctgccgcgtaatgcttatagtaatatgatgtccacttcggatgcagggaagcggcgtaaggaatgaggtgaagcggtatcagctgtccgatcgtgttctggccgtaggcagccagctttctgcgcctttttttcatataaacggtcggggataagcctgtatgcttcttaaacgtcctgctgaaataaaattcatcctgatatccgatttggcttgaaatttccctcagcttgtagctcgcttttgccatcagctgcttcgctttcgtcatccgcgtctcagtgataaactctgtcacgctttgaccgtacagctttttgaacctttcgctgtagtgcttcgcgctgattccggccatttgcgcgagttgatcaagcgtcaggtgtgcatctgaatgctcctcaatatactcctttgtttttcctatggctgatgcggtgttttcgggatgagtcagtttggccgaatagatatcgtacagaagctgctgcagatctgcttggcatttcagctcctggagcgctgaagatgccggccataaggcggaaagttcctgaagacgggaggccagatttccgacaggatggacattcatcatctgaaggtcggaaaaagcgtcagggtcggtgtctgcttgaagcgtcaggcggcggtcttcatagcagtagggctgcagcctgatgagataaacgctgatttcctctgacgaagctgtgattccgaatgtttcataaggcggaacgatatacagcgtttctttttggaggggtctgcctgatgcttgtatatcgattctgccttcacccttcaaatgaaagatcaaaacgaaagagtctgcgagctgctgttcatccggaagatcgccgggctttcttatatgatcaatttgcaagagacgatagaaataagaagatttcatagaaaaaccgcctttcttaacccagtgatattacaaaaaataaaaatgcccctaaaacaatatggtaaattggttgcggggtgcttgtccggcacaaaataccagtttgcaaggtgcatttcacatcacttatagctgatatgcttcttacgatttactataacacagtcacttttattgtggaataatgtatccaaagagaccatctgcccaatccgcactttaaaatataataaaaaatcaatacttatcatttcaatatccttttacctagtgtataactatagagaaattactatatttacagggaaggcgtgacttcttattttggaaatgacagacagcatgaaaaaatcgcttgatgcgattgcaaaatggggaaaaataaccggagtttttatgattatcgccggaggcatctatgcctttttcggaatttctttgcttatcatcggagccgctccaggtgtgctgatgattttttcaggaatctatcttcttaaatcggcaaacgccgctcagaaaatgagtcatgacatgccgcaagaaccgcatgaagccttgcttgataactatgtgaagtttatgaaatggcaatttttctacttactatcgaatattgtgatcttcattttatgcataatcgtttttttcttcctgatctttttaggtgttctagccgattcttacagcgggtatgatccttattattacgaatgatgatcaaaagcctgtctcggatcaattgaactgacccgttaaaatgagacttagaaaaaacacctatgctgcctgtcccctgtattccagtggggacaggtagtttaattttgcctgaattcgtacatgattatatcgatacatgtattgatttacaatttgtactactttagaattggatatagatgctctactttgagcgttaaatccttccgactttagcgaggagtgaaaggattcaatgacggcattatcatggcagtttccttttcgagacatgcttgtggtaatgcctttttctttggccaaattctgatatgcatgtgaagtatagacagatccctggtcgctatgaagaagtaaccctactggtttacgtaattctacagcttccctcaatgtgtctaatactaggttaatatcttggctcgtacctattttgtaagccactatttcgttgttatataagtccataatcgttgataaatataacatagtcgagccataaggtaagtaggtaatgtcggttacccatttttcatttaatcggcttgctttaaaattacgattgagagtgttcggcacaataatattactctcaccacaaatgtacttttgtcgcttcttcttaacttgacactgaatctcaaacttttgcataattttttgtacagttttgcggtttacatttatcccatactttctgtttaagatggatttaattttacgatgaccatagtgatagaagtttttcttacacagcttgattactagctcttctaatgaagttagctcaacttttttatacttctttttccaacggtaatatgttgacttaggtatgcctaatactccaagaatatcaattattttaaaagtggctgagagttcttctacaacttggacaatgactcgtggctccaactcctttcgatctcctggtacttttttataattgccaattgagcctctagctgtttattctttagttttaattcttctagctcactcatttcctccgattctttaccgtaggaatattgttttccaacttgttgcgaaaatcgataggtttggcctgttttgtaccatcgcatccatgttttaatttgagtcttattttttatccccagttgttccattatttctttgtttgtcattccagcttgtttcattttaattacttcccattttacttcttctgcgtaatgtactcttgtgcccatagaaaaacaccctcctaagaatcatattgtattaatacgattcagggggtgttttttccttgtctcatttatttgggtctctccacaatttccgagacaggcttttattattgagcttctccgacaacagtgaaacgctcattgacatgctcgcctttttcagcctcgtccaccactgcaatggcgtagtctgcatagctgatgtagctttctccggcggtgtttacgattaagttttcctgacctttttgataagaacctgttcgctttccttccggattaaaaaatgccgccgggctgatgaacgtccatttcagtccatctgcttctttcaaatcctgaaggttctgcccctgatttttagccgtcggcaagtattctttaggaaactcaggcgtatcgtacagctgggttgttttttcctcatcgacataaaggctgcctgcaccgcctacgacgattaatcttgtttcaggaacctgcttaaacagttcaatcagctttcttccagcttcaacatggagatgctcctgccctggggccgcgccgaatgcattgacgacaacatccagtcctttgatgtctgccgctgtcaggttgaaaatgtctttttcaatgacagctgcatcgctgttcgccatttttgacgcacttctgacaattgccgtcacttcgtgtcctctttctgatgcttcttttaaaatcatgctgcccgctttaccgcttgcaccgataataccgattttcataatcgcttcctccaataatttgattatttgtaacaagatttgttacatgttgatgatgaaacatcatctcttgtttaaaagagatgagttaagacgtctttaagagacttgctggccaattcgttctccatcgcctgctgaacgctgtgaaacgtttgatcaagcgttgtttgaatttgtcttccaaccggacagtttggattcggcttgtcatgaatcgcaaataattcctcatgcggctgaaccgcgcggtaaatatcaagcagagatatatcttcgggatctcttttcaggcttgccccggccactcccggccgcgacgtcagaataccggcttttttgagctggctgatcatgcgcctgattacaaccgggttcgtattaacgctcccggcgatcatttccgaagattcccgcgggtttgcggcgattaaagacaatatatgaatggccactgaaagacgggtgttcaccatatgttttcaccaccgatgtaattattatagttacaggtcacgtttttgtcaactcttatcatatccttaatgatcgcaagaataaataaaaattttttcaaaccctcacgtctcacttcggaactttttcacagtctctttcgtatctactgatgaaaggagtgtttttcaatgaaggagataacagaaggaaaagcagctttggatagccggcttgagccgaatgaagagatcagatctattattctttgcgcttataacgcgagactgtctgcacgttacactccgtacagaggcgtgcttgccgccactgacaggcggttcatgttttattcctccctgtttggctccccttttcatcttgacatccgctatgatgccgtcacctcgtttcgccgcgaaaaagggctggtaacaagaggcgatcatctcgtcgtgatgaacaacggggatcgggaagcatttcaatattttagcggctgtgatcctttagagacattcgtcgaagccgttcgaaagctaaagaaactgcctgaagacatcattcattctgaaaaacgccggctccgggatgtgcccgcagccggctgctcagttattaatatcgtacttctctccatacctcagcactttataaattgccattccatcagaaagatgattttcggaatacctcacgggaatcaaagcaaaaaatacataataggttgaaaaataaacaaattggtagaaaaaaatattttcgggtatgatgtctttgataatcagcagattgataataaatatagacattaagttaaacagcgatccgccagcataaatcatcgcattcgtgaaacggttatcgtattttaaatccccgtatttgcagaaggaatccatgaagtagacacttctgatttgaacagggccgattttcagcaattttttgcccatcccgatttcaagcgaagatttcccgccgaacaacaccgccatggcgctgtggcccaagacatgaagcaccgacacggcaggaaaaacgatcaagaacgaccagaggaatttgacaatatcctgcagtccgaacattcaatcatcctttctgtttcaggcaatgttttttaagaaaatttccgcttttcccccgtatcaaacctgtcaatatgcaaaacaagcagacctcagcatgaaaaaaaccgcccatctactctatggacggccttctcaggagcagtcaattatcctccaatataggacatttcacctttttccgcggaaccgcttttgcaagagcgcggtcgagagaatattggtcatcgcgattccgccagacggtgccgatcgcctccgccagctcctgatcggtctgcccgcttctgatcaaggttcttaaatcaaacccgcttgatgcgaaaagacatgtgaaaagctcgcctttcgccgatagtcttgctctgttgcatgtggtgcaaaaagcatcggatacagaagagataaaaccgatttctcctgagccgtccaggtatcggtatcgttttgcgacttctccttcgtagttcgggtcgatcggttcaatcggcatatcttcattgatgatccggatgatatccgctttggccaccactgactgacggttccattcatttgtgttcccgacatccataaactcaataaaccgcaaaatatggcctttttctttgaaatagcgggccatcggcaaaatatccttctcattgacccctttctggacgaccatgttgatcttgacgccgagtccggcctttttcgccgcttcaattccggccagcaccttgctgacggaaacgcctcttccgttgatcgatttgaaacgctcatcatccagggaatccaggctgaccgttacacgtttcagccccgcttttttcagcttgtcagcgtaaaccggcagcaaaacgccgttcgttgtcatcgcaatatcgcgaatccctttgatccctgcaagcttcccgactaattccggcatatcttttctcatcagcggctctccgccggtgagacggattttttctaccccgaactgatgaacaaacagcttggccaatcgttcaagctcttcaaaggacaacagttcgccttttggcaaaaacggataatcctgcccaaagatttctgcaggcatgcaatacgtacatcttaagttgcagcggtcggtgacagaaattcttaaatcccgaagcggccggcttttctgatccaaaacttgttcactgttggtgttcacgcctgttgcctccttttatgaaaactgaattcgctcgtgatgcgtgtatacattgaatgaccggtttctcgcaaaaccaatcgtcatgatattcagctcctctgccatctgaatggccagctcggtcggcgccgacttggaaatgaccgcggaaaccccgattttcgcggctttaagcagcacttccgaagaaattctgccgctgaatacgatcagcttatcgcgcacaggaacctgatgaagcaaacaatatccgtacaatttatcaagcgcattatgccttccgatatcagatctgactgcaatcagcttgtctgtgctgcacaaagcggcattatgaacgccccccgtatggtgaaaaagcttgctgcttttctgcatgtcgcgcatcagcttcaaacagttctctggcgtaatggtcacgccgtcaatcgctgtttttgcggttttgacgtcctgctggaaataaaaatgcctcccttttccgcagcaggagccgatcacccgctttgtgtaatccttcagctgcagcttttttgtgctgacaaggtcgacatatgcgaacccgaggctttcatctattgtaaaccttttaatctcatttttaaatcggatcaccccttcagatgcgagaaatccgatcaccagttcttccaggctgtccggcgagcaaacaagcgtgacaaattcctcgccgttcaccatgacagtcagggggaattccgtcgccatctgatcttcttgctgcaccagctctccattatcataacggaaaatttttcggcttgttgtgatgtttttccccatgaataactccgcccctttgtttcttactatatctattactatactcgtctatcatgccgtttcacaaccgtcaggtcaaatttggaagcttcatcttgttgatagcttgaaaacatgatattattttttaaaagttcaaaaaatattcacttttcaaacagactgcccttcttcgcagcaacttcggaaaccgctttcaaacaatcgctccccggcagccttctgtctttattacagcctttttccacagggggttctcacatgaaaaaagcgaaaaacaggtggctcattgctttatgtgctgtaggcattcatttgtcaatcgggtcggtatacgcatggagcgtctttacaaacccgctcgctgaaaccttcggctggagcctcagccagatcagtctgacgttcagcatcgctattttatttctcgggctttcagccgcatttttgggacacttcgtcgaaaaacacggccccaaaaaagcaggcatgctcgccgcacttttcttcggagctggcgtgacgttttccggcttcgccgttcagatcggctcccttcccctgctttatttgttttatggagtcttcggagggatcggactcggcgtcggctatattacacccgtatcttcgcttgttaaatggtttcctgaccgccgcggcttggccacagggcttgccattatgggcttcggatttgcggctttgatcagcagcccgatcatgcaaaagctgatctcagcggtcggtatagccaacaccttttttattctcggcatctgctactttcttgtgatgatgctctcttcgctttacctcgccccgcctgaagaaggctggcagcctgaaggattttcaaccggaaaaagcggaagagcacaaagcgctgatatttcccagctgacggcaaatgaagcgattaaaacgaaacgcttttattatttatggctgatgctttttattaatgttacgtgcggaatcgccatcatatcaatcgcttcaccgctggcgcaggaaagtgcgggcatgtccgccgccgcggccgccgcgctcgtcggcgttttgggcgcatttaacggtttagggcgcatcggctgggcctctgtatctgattacatcggacggccgaatacgtataccgtctttttcgccatacagctgatcgccttcccgcttttgccgttcatttccgacaaggccgccttctctgttttgatggcattgatctatacgtgctatggcggagggtttgccgcaattccggcttatatcggggatttgttcggaacaaagcagctcggtgcgatccacggatacattttaacggcttgggcggcggcagggcttgcaggcccgatgttctcttcttgggtacgcgatgcaacagggagctacagccaaagcctgacggtgtttgcggcactgttcgccatcgccctgttcatttcgatattcattagaacggacattaaacagttgcggaaaaaagcggcggttcatgtctcaaactcgctaaaaggatgatctgcagtatccgctggaaaggagagaagggaatgggaaaaacaaagcatcaaggtccgatgaagctgaataaaaagcccgcgccaaaactgtgggcgtcttgggcgccgatgggactcggaaaggtaaagccgaagcatatcagagatacgatgaaaacagcgtgggacaataaagacaaccttccgtacgcctacagaattttgacgcaaggcgtgtgcgacggctgtgcgctcggtgtgtccggactccgcgatcagacgctcacaggccctcatttatgcacgacgcggctgaacgtcctgcgcttaaatacaatgcctgcgatcgaggacaaatggctgtccgccgacatcgaacagctgcgaaagctggacagcaccgagctgagaaagcttggacgcatcccctatccgctgtcgagaaaaaatggtgaacgatcgttctcgagaatttcgtgggatgaagcgctcagccgaatcgcggacaaaatcaaatcgattgataaacggcagctcgccttttatttaacagccagaggcataacgaatgaggtgtactatacggccgcaaaagcggcgcggtttatcggcacaaacaacattgacaacgcctcgcggatctgccactcgccaagcaaaacggctttaaaaaggtcccttggcatcggcgcctcaagctgcagctaccgagactggatcggaacggatgtcctcgtcttctgggggtctgtcgctgccaataatcagccggtgtcaacaaaatacatgtatgccgccaaaaaagcgggaacgaaaatcattatgatcaatccgtaccgggagccatcgatggagaaatactggattccatcgatacctgagagcgcccttttcggcaccaaaatcaccgatgatgtttaccaagtcaatatcggcggcgacattgcctttatgaacggggtgatgaagcactggtttgaaatggagcgggaggcaccaggttcaagcattgaccgcgcctttatcgatgcacacacaaacgggttcactgagcttaaacagcacatcgaaaaacaaaattggaagacgcttgaagagtcatccggcatatcaaaagagagaatgaaagaattcgccgtcttgctggcccgggcgaaaaccggcgttttcatttggagcatggggcttacacagcaccgttttgcgaccgacaacatttcacaggtggcaaatctcgcccttttacaaggattcatcggcagaaagcattgcggcgttatgccgatcagagggcacagcggtgtgcagggctctggagaaatgggtgccgatcctttcgtcctcccaggcggtgattttgacgaggaaaatgccgcacggatcgagaaggtttggggcttccgcttaccgacttggcaaggcgatacgatcggccagacgatcgaaaacatgctgctgccgagcggaagcgaaagaaaagtaaaagtgttttatacaagcggaggaaactttttggagacgatgccgaaccctgattttatcaaaaaagcattgcaggaagttgaagtgagagtccatcaggacatcatcttcaatacctctaccctggtcgatgccaaagaggaagtcatcattctccctgcgatgacaaggtatgaacagcctggcggaggaacctcgaccagtacggaacggatggtatacttcagccccgaaattaaaggaccgcgcatcggagaagcccgttcagaatgggaaatttatgtagatctcgccaaacgggtccggcccgaagacaaagaactgatccattttgacggcgctgcggaaatccgtgaagaaatcgctgctgccaaccggaattatgacgggattcagcatttaaaaaaacgcggagatgtctttcaatggggcggcgcctggctttgtgaaggcggtgtttgtccgacggcagacggcaggggcaacctgatccctgtcgatcttcctgaaaacagacaaacggaaggacgctttctcgttacgacaaggcgcggaaaacagttcaactcgatgatttatagtgaaaaagatcctttcaacgctgcagatcgccgggatgtcatgatcaatccaaaagatgccgaggagctttatattcaagatggagaagcgatcgttctattcaaccgctacggaactttccaagggcgggcaaaatatgccggcgtacaacgcggaaacacggcagtctactggccggaaggaaatgtgctgatccctaaaggcgtatacgaaaaccatgcccgtattccggaatacaacacggcggtcatgattgaaaaggcggagattttccattcgagaaaagatccgcgctatgcagaaaaacgaatcgaagaactcgaaatgtcgaccgattagcttaacagtcgggacggctctgctgccgtcccgttctcgtatggagttactgagacagttttacgccttcttctttccatacctttttaaaatcagaagctgagtcggcttcaatcaattttccgccgccggcgtcagctacttttttaagctttgctttttctttcacggtttttacatccagcccaacaatgttgacgatcgttttaatgttggatttgcgcagatcttttgctgcctgaacaggatcccctccgcatgtttcttcaccgtctgtcacgatgtagacataattcttcccatctttatcggcaagatcatcttttacatcataaagagattttgcaatcggagaccagcctgtaggcttgattccgcttaaagcgttttcgaatgaattgaaagaaaacggctgcagatcatagacggtttcagtcgtaccgcaggatacttcttttcctgagtttttattgttgcctttatgtccgaaaacattcagcatgacattcgcatcgcttgaaagcaggtcggcaaaatcggttacggattctttggcaatatcaaattttctttctccttcaaccttttgtgccatgctgccgcttgcgtcaagcacaactgcaacattgacatcttttttgctgttgtccgcatttccgttttcagccgcaaaagctgctgccggcgccaatgacaaaagcatggtgaacgttgtcaacagagcaaacctctttttcaactttctcactttcctttccgcatttgttttttcggaccgatcttccgcatgagatcaagtccaccaacatcgtaaaagaaggcttgatagaaataaataggccggatctccttttcaaattcacaaattcttcataatccttacgataatcgatcgacgcattcacttaagacctatcaaaaaagtctgctaaaaggccgatttcatcccaataaagctaccgttacgacaaataacccctccaaaggacgcagcagggttcaacgctctgacacaataacttaatatttgtaaagtatttttcttgacttttgacaatcttttcatcacaaaaggaaagctgcggaaacatgtccacagcttttttccagtttatttagaaagctcaattgcttcctgagtaaaaattcttttgatgtcatttttagtttttgcctggaaatattcaccgccgccagctgctgcgatactggtcaattgtccgtggaagtctccttcataatcaaagccgatcacgttgacaaccgcattggatttgcgcagttctgttgcgacttttaccggattgcctccgcatgtttcctcaccgtctgtcagcagatagacgacgtttttcccgttgttgtccagctggtcaagcgcgttttttgcatcttgcagcgcgtttgcgatcggtgtccatccggtcggtccgatgccgtttaaggaattgcggaagctttgctcgtcatacgtttggaagccgtacacccctctgattgcattgcaggactgcacttttccggaatttttattgtttccctctgaaccgaaaactctcatgagcacgtttgcattttcaagcttggaaccaaagctgaacgcttcatttttggcaagctcgtattttgagaccccgccgatctttttagccatgctgccgcttgcatcaagcataatcgcaacgttgggcgcatcttcggcaactgttacctcctgttttttctcagctgcaaaagcaggcgaaccaagactgagaaccatagcggtcaaaatgcccaatgtcatcttcttcttcatttctccctttcccctttctgaaataaagtcgttaacacattattatcgtagaagaacaccagggagaaataaatagggcatgtctccttttcctcgttattcaattcatcatacaacaagtatataaaatagactttataacctgtgacccctattgttgatacggcgtttgcggccttttgacgctgttcagcaagccctccggcacatgtttttagaaatatttgtataataatttagcgtgcatcaaattcatgggaatgccaaatttcgatgatattcaaaaagacgccgccaagaggcagacgtcttttgttttattttttcgccatgtatttatttaaaaattcatctgcattggatacggctgttcctttgtaataatacttgacgatgtcttctgctttcttgccgtctttcgccatataatgcgcaccgtattggctcattcccactccatgtccaaatccccttgtcgtgactgtaatctgattcccgtcgcgtttccaatcaaagtctgccgatttgaggccgagcttttcgcgaatatctcttccctcaagcttctttccattgatgacggcagtcgctacgcgttttcccggcgttctttcggtgatctctccgatgctgtttgaaccgggcagcttgacaccgagcttttgttcaaattcagcgacagtaaacgttttatggttcaggaatttcggcgattttgtgtcccaggagcttttcacgctttgcaggtacggaatatcacttgtccaataagctccggcattctcggtgtacccgttgctcgtcgagaagaacgaagcatcaataggcttatgctcataggttaaaattttgccttgcgtactggctacagcttcggtcacctttttgattttccaatcgtaatccttcttccacagcctgcggagctcctctttgtttttatacacctggaacatctgcgtatcatcgaccagcgagcctttcggcgactgtacagcttgctctgacaccatttgcctcacaatgtatgtgcgggctgccagcgcttgtgcttttaaagcttcgatatcaaaatctgccggcatttccgaggcaacgacaccgatgacatactcttcaagcggaatgtcttcaactttccggtcagccgttctgtagaccggaattgaaacgggagactcttttaaggtgactttctttttttcctcgtgttgctgagcgtgtttctctgttttaattgcccccggtcccccgtgaaaagggaggacaagcagtgttggtatgagtaaaatcagcgtgcagattcctgctagtacaattatgagctgtttcaaatcagtgcccccatttctgttttgtctctttcattttatgggcggggacaagctaatatgactgtactttttcaactgctgctacgtattttaaaagcaattcttgtgcataatgatagatatgggaggcatactgatatagaatacttgaaacgcaaaaatcagtatgccgtatgacatactgatttcaagttgatttatgcatttaaatcggatacaacttctttattttcaatatgaactgcttcttcatcgttaacgcgctcaatatcagcgccgagaccggcaagtttttggtggaagttgacatatccacggtctaaatgttttaattcggttacgcgtgtatgaccgtcagcaacaaggccagcaaggataagagctgcgccggcgcgaagatccgttgcggcaacttcagcgccttgaagctgcacaggaccattaatgatgacagaacggccttcgattttaatatctccgttcatacggcggaattcttccgcgtgcatgaagcggttctcaaagacggtttctgtgatcatgctggttccatttgcgcgcatcaaaagagccatcatctgtgactgcatatcagtcgggaaacctggatgtggcattgtttttaaatcaataggcttcaattcagaaggaccgatgatccgaagaccgtctccttcttccaagatttgaacgcccatttcttccattttcgcaattaaagatgttaagtgctcaggaaccgctccctttaccagtacgttcccttcggtaatcgccgcggcaaccatgaacgttcccgcctctatccggtcaggaataatcgtatgttttgccccatgaagcgccttaacgccttcaattttaatggtgcctgtaccggcaccccgaattttaccgcccattgcattgatatagttagccagatcaacgatttcaggctctttagcagcattttcgagagttgtcgtgccctcagccaaagctgcagccataatcaggttttcagttgctccgacactagggaaatcaaggtaaattttcgctccttgaaggcggccttctacagtcgcttcaataaagccgtttccgaccttaatttttgcccccattgcttcaaagcctttcagatgctgatcgatcggtcttgaaccgattgcacatcctccaggcaaagccactctcgaatggcctgtgcgagcaagaagcggacccatcaccaatacggatgcgcgcattttacgaacatattcgaacggagcttccgtagacaaagtgcgagatgcatcaaccgttactgtattattttcaaaatgtacacttgcgcctaaatgacgtaacacttcgttaatcgtatatacatcggagagcgtaggcacatcacatattacgcttttttcttcactggctaataaagatgcagcgataactggtaaaacggcattttttgctccttcaactttgactgtgccgtttaactttcgaccgccgcggacgatgattttttccaaggtattcccctccgcgtcccaatttctctatattaatattcagtcgtgacgattggtgtgccaaccgtgacggtaagtttttcgcccattcccgcatttctaagcgagacttgcaaattcatacggtgtttttctgtcttgatggattctttccactcgttagtgtaagcagaaatagaaacgaaatttggttcaattaaatcttcaactgactttgcatcaaattcatgtactagctcatttgcttttttttgcaaaacaacattcatcataccatttaaatggccctttagacaagtaaaaattgcggtcttttctcgcattatgtcgaatgcatcccgttcaaactgcttatatgtagcattccagttttcccgtggtcccgcgcctttttgctcatacaataaatacgaaacaagtctctggtttttgtgggtggataccaaatgtattttggaattgatatgattttttttgtcctgaaaaacacctgtcgctttaactgtatcgtcgtcttcccgcgttaaagtccattcatattgtcgatgctgtttcttgaaatgtttcagttttgcaaaaaaatctttttcacttagggtaagctgtttttttgtatgcatggtccactcttcaagctcgacatcatggcggctcaaaccttccgccagctgttcaagcggcgtattgcccgctgcttcaagcgattgaaagacatgaacaattaaaaataaaaccacaataaaaataagggcattaaccgtttgttttgtcttcattctgcatcatcctctcctactctccattgttgacggatcgcaggaaaagcatacgtggaaaaacaaggtctccggtgattttgcagaacgcggtgttacccatattcgtccattcccataaattcttttactcaatcatgaaaataaattttgaagctgtctggaataataaagatagtccaagaaaaaattgctgacggtggagccgacggcgattgtaatgatgatcattaacaccctcgcctgaatgacttttcctttcctgataagcggatcaatattgaccgccagaagagcccaccaagtcaatgcaataaaaaaaagatgaacgatgatactgacagcagcctgttgtccgatctcttccattattgatgacgcctccttacgttcagccggtttggtgcttccggccagcctcgtctcttctgccgtaggataaaggaatgttgctggtcatttcaagtcattttaacagttttgatgttgcatgttaagtcgttcatgatagaactttttcccatagatggagtgatcctctgttgcctgaggggcttgtgttttaggagcttacttgaatgtcttacgtcctctttttggtggaagagaacatagcttactattttgtattatagatagattcatactaaaaaggcgaacaatttgtgaacatttttcaacattttcaattctgtttgatcttgaatataaaagacccttcccatccttaaatatgggaaggatccttatctctatctcgcaacatccaaccggttaatcgcgcgttttaaagcaagctctgcccgaataatgtcaacatctggagtttgcttttgcaaacgttcctcggcacgccgttttgcggccaaggcgcgttctttgtcaatttgttcagatgtttccgccgtctgggccagaatggtgacatggtcagggcggacttccactatccccccgctgacggcaaccagctcagtttgaccgtcttttttcagacggactgcagcaatttttagcggagcaaccgtcggaatatggccgggtaaaataccaagctcaccgctctctgctctaacgcttaccatttctatatccgcatcgtatactgggccgtcgggagtaacgatattgacttttaaggtcttcatgcttttaccctcctaggaccagattatacttctacacccatttctttcgctttttcgacaacttcttcgattcggccgacaaggcggaaagcgtcctcaggaaggtgatcatacttaccttcaaggatttctttgaagccttttaccgtttctttgacaggtacgtaagaacctttttgtcctgtaaactgttcagctacgtggaagttttgcgacaggaagaattgtacgcggcgcgcacggctgacgacaagcttatcttcgtctgacaactcatccattccgagcatcgcgatgatatcctgaagctctttgtagcgctgcaggatctgctgaacgctgcgcgccacttcatagtgctcttctccgacgatttcaggcgaaagcgcacgggaagtggatgcaagcggatcgaccgcaggataaatccccatttccgacagcttacgctcaaggttcgtcgtcgcatccaagtgagcgaacgtcgtagccggcgccgggtcagtatagtcatcggcaggaacgtagatcgcctgaatcgatgttacagatccgacatttgttgatgtgatccgttcctgaagctgacccatttcggtcgcaagcgtcggctgataaccaaccgctgacggcatgcgtccaagaagtgcagatacttcagatcctgcttgagtgaatcggaagatgttatcgataaagaacaatacgtcctggccttctttatcacggaaatgctcggccattgtaagtccggtcaaggcaacgcgcatccgcgcaccaggcggctcgttcatctgaccgaagaccattgccgttttgccgataacgccggaatctttcatttcatagtaaaggtcgtttccttcacgcgtacgctcgccgacacctgcgaatacagagataccgccgtgctcttgagcgatgttgttgatcagctcctgaatcaaaacggtttttccaactcccgctcctccgaaaagaccgatctttccgcctttgatatatggagcgagcaagtcgacgactttaatacccgtctctaagatttcaacctctgttgatagctgatcaaattttggagcttctctgtgaatcggatctttggcagcatcagccggaagcggctcatccaaatcgatattttccccgagtacattaaatacgcggccgagtgttacgtttccgaccggaacggagatcggctctcccaggtcgatggcttccattccgcgtgtaacaccgtcagttgaagccattgcaattgtacgaactgaatcatcacccaagtgaagcgctacttcaagggtaagatcgatgtccacttcattctcgttctgcgctttatgtgtaactttaatcgcattatatatttcaggcaagtgaccgtcttcaaaacgaacatctacgaccggccctaatacctggctaacgcgtccttttttcatctctatccctcctgacaaactttttctattctaaagcagctgcaccgccgacaatttccgtaatttcctgcgtgatggatgcctgacgggcacggttgtatgacagttcaagatcggcgataatctcttttgcattgtctgtcgcatttctcatcgccgtcattctcgcagcatgttcgctcgctttgctgtcaagaagcgcgccaaaaatcaagctttccgcatactggggaaggagcacttccagaatctcttcttcatccggttcaaactcaaatgacgtctttttcttgttaggcgcaatatctgtcaaaggcagcagctttttctccgttacctcctgggaaatcgcgctgacaaaatggttgtagaacagatacagttcatcaaaggtttcgtcaatatacatttgcaccgtgctgttcgccaaatctttgatttctgaaaacgtcacttcgtccctgatccccgtcatttcagaaatgacaggaattccgcgctttttaaagaaatcgcgccccattcttccgaccgcgatgaccgcatactcatctttggattgatggcgttcctgaatcctttgatacgctttgcggagtacgtttgcattgaacgcccccgccaagccgcggtcagctgtgatgacaaggtacccggtccgcttcactgggcggcttgacatcatcgggtgtttgccggtgtatccgactgcgatatcggcaacgacttcctgcattttttccatataaggaacaaacgatttcgctttgttttcagcccggttcagctttgaagcagaaaccatttcctgggctttcgtaatttgactcatttttttatttgaagcaatcctggatttaatatcccgtaatgaggccaaaaggtttcaccacctttttgttttcaaattccttcgcattgacgtgaaaaagagagaaaaagatagcctttttctcactttttattgtttagttgcttggcgcgaacgtacgtttaaagccttcgattgcacccttcatgtcctcatcggcaggaaggtttcctgtctgggcgattgaatcgagcagatctttatgattttggtcaagatacataaagagctcttcttcaaaacgtttgatatcctcaacaggcacatcatcaaggaagcctcttgtcagagcatagagaatcgcaacctgcttttcaacgcgaagcggtttgtgcagatcctgtttaagtacttcaaccgtacgggcaccgcgattcagcttcgcctgtgtcgctttatccaaatctgagccgaattgtgcgaatgcttcaagctcacggtatgatgccaaatcaaggcgcagcgtaccggcaactttcttcatcgctttgatttgcgcggacccgccgacacgggatacagacaatcccgggttgaccgcaggacgcacgccagagaagaacaaatcagactgcaggaagatttgtccgtcagtgatcgaaatgacgtttgtcggaatgtacgccgaaatgtcgcctgcttgcgtttcaacgaacggaagtgccgttaaagatcctccgcctttggcgtcgctcaattttgcagcgcgttcaagcaaacgggagtgaagatagaatacatccccagggaatgcttcacgaccaggaggacggcgaagaagcaaggacagttcacgatatgcggtagcctgttttgaaaggtcgtcatacacaaccagcacgtgcttgccgttgtacatgaattcctctcccatcgcaacccctgcatacggcgcgaggtacaatagaggggcaggctgtgaagcggaagccgtcacaacgatcgtatagtcaagggcgccgtgtttgcgaagcgtttcgacaacgccgcggactgtcgattctttctgaccgatcgcgacatagatacaaatcatatcctggtctttctgattcagaattgtatcgatcgcaatcgacgttttacccgtttgacggtcaccgataatcagctcacgctggccgcggccgatcggaattaaagcatcgattgatttgatccccgtttgaagcggctcgtgtacggatttacgatccataactccaggagccgggctttcgatcggacgggttttgcttgtgagaaccgggcccattccgtcaacaggctggccgagcgggttgacaacgcggccgagcagctcttcgccgacagggacttccatgatccggccggttcttttaacttcgtcaccttcacggatgtctttgtaaggtcccaaaataacgatacctacatttgattcttcaaggttctgagctaagcccagcacaccgtttgaaaattcgacaagctcacctgccatacagttatcaaggccgtgtacgcgtgcgataccgtcaccgacctgaattaccgtacctacgtcgtgaacttctatttcagactgatagttttcaatttgctgttttatgagagtgctaatttcttcagctttgatgctcacttaggtttcaccccttctttcgattttcgcctgctaattgacgttctatccggtcaagctttcctcttacactgccgtcataaatgcggttcccgatgcggattttcacaccgccgatcagatccggattcacttcgtttctgacgcgcagtgaagcggcgcctgcttcttttgcaaacacttgagaaaaagaggaaatttcctcttcgctgagcggttttacagagtatacgatcgcatcttccgtcccgcggaaccggttcgccattttgacatattcgtccgcgagatccgggacgattgacgtgcggctgcggtcaacgagaagataaagcgtatgtaagactgcagtcgaaacggatccgaacgagtcttttaaaatctgctttttcttttcagcgggcactttaggatgacccagaacggcattgaggtctttatgctcaataaatatcttcttaacgacggtcagctcttcttctatttcattgaccagcttggattcaagggcaatgtcaaacagagcggctgcgtagcgtttggagacagctgattggctcatcggctttctcctacttctttaagatagtcttggatcaatttttcctgggcttgttcgtccagctctttttcgattactttagaagcgatcatcacagacaatgatgcaacctgctcgcgcagcgcggtgacagcctggtctctttctttgacgatctcgcttctggctgattctttcatgcgttctgcttcctggcgcgcagccttgatgatttcatccttttgctgttcacccagttttttcgcgttttcaatcagagactgggattcttcgcgtgcttctttcaaaagcgcctgctgctcctcaatgagcttcttcgcttcttcattctttttctcggcagaggagatctctccggtaatgtagtcttcacgctctttcattatatttaatagcggccctaaagcgtatttcttcaagagcgctaacaaaatcagcatggcaacaagctggaacagcattgttccggcgttaaaccctactcctgcacccataacctgtggtaaaaaagacatcgaatacggcaactcccttcttgcagattatctctccgaggccatcgaaaaatgttctccctcttttttcaggagggtgattcttccggccgttatgacagttcaagcaaccataaagcaatggcgaaggcctcttgcagtgatcttcgccatttaccagttttatattcgcttttagctgaagaacgctaagaacgcgataacaacagcgataatcggaagggcctcaaccaatgctaccccgatgaacataagggttctcaatcttttccagcctcaggctgacgagcgattccttctactgtacgcgatacgataagtccgttaccaatacctgcaccaagtgcacctaatccaattgcgattgcagctgctattaaactcatgaaaaagttcctcctttaaattgttatccttagcggatatgtcttatttttagtgttcatgacttactttgtgagacatgtaaaccattgttaacatcgtgaagatgaatgcctggattgtacctacgaacaagctgaacgcctgccatacgatcatcggcacaaccgctccaatggttccaaccagccccaggaaaatgctttgagaatagaagttggttgccagtccggcaagaaggccgagcagaatttcgccggcgaaaatattaccgtaaagacgcaatcccaatgttaatgtgttcgcaaattcttcaatgattttgagcggcactaaatatggaattggtctgaagaaatctttggtatactcccccaaccctttccttttcactccgtagtaatgagtgaggcctactaccatgacggcgagggttaaagtaaccgccggatcggccgtaggggatttccaccataattcgtggcctactgttatggaaaacggaaggccgagcatgttggcaacaaatatgtacatcagcagggttatgccaagggcgagaaagtctctgccgactttaagatccattgtgctgccgataatattgcgaacaaagtcgacaatccactccataaagttctgagctttcgtcggccggatcgcgagtgttcttgtggtcagcaccgctatcagaaagacgatgatgcttgtcacagtaatcattagaatgctagttaaatcaaaattgaggcctaagaaattaacaattctagattcgtgattcaaagggttttcacctctcttccattgatgaacgttttagctggataaaggaatctatcataatgacaggataaattgtcatcaaccccacaatgacgcctgccaaatgaatatattcagggtatttataagcaatggccgccgcgataatggcgttgcacaatctggaagcagtcccgagagaacggatcattttgccctttgccactgctttatcgaaggcctgcatccttttggccagcagccagagattgaaatagctgaaaacagtgccggtaatcaggcctaaaaaaattgcctgatatggcagaaatccatagcctaacacgcagactgctaaaatatataggacatatttttgttgcctacggaatgaaagactcgcatcggtcatcaaatacgctcctgatgtgaaaattttaaatctatcttacgattacggtaaactaggcggtctgaccattttacagaacgtagtgttctgctcaagacttcacacagtccgaaaattcttgggccggtgatctgtctgtcgcctgcaaatatggggttttcaaaggattttaacagaggactggtcattatgataaccgctatgaaaaccttatcataatagcctattttagcatacaatagcccccctgaggtgtcaatctgtttaaagttaaaaaactattcataatcacagcagctctcacaaaatgttcacaaattcgcctcatttaagacgcacacatgtttaattatggtataaaacacaaaaaaagaaaaccctttttcaggattttcttacattatttcgttccgaacatgcggtctccggcgtcgcccaatccgggaacgatatatcctttttcatttagtttttcatccagagcggcaatgtaaatgtcaacgtcaggatgatgcttctgcacttcgtctacaccttccggggcagcgatcagacacataaagcggatattttttgcgccgcgttttttcaagctgttcagcgcctctaccgccgaacctccggttgccagcatcggatcgacgacgatgaattcgcgttcttcaacatcggatggaagcttgacataatactcaacaggcttcaatgtttcaggatcacggtaaagcccgacatgtccgacttttgcagcaggaatcagcttcaaaattccgtctaccattccaagccctgctctcagaatcggaacaaccccgagtttttttccggcgatgacgtttgactttgccatttgcacaggagtctctacattcacttcctccagcggcaggtctcgcgtaatctcaaatgccatcagcgttgcaacctcatcaacaagctctctgaattctttcgttccggtctttacgtcccggatgtatgtaagcttatgctgtataagagggtgatcaaacacatatacctttcccatatccgtcttcagctccttttttcacacacttctattgattctacataaaaaaacagcttgtttcaacaaaaatcaggagacaattttatgaaaaaagccgccccttttcggagcggcgcaaatatcttagtaatcaagcccggtatacaacgggaatctgtttgtcagcgcttctacacgctgttttgcttcttcaagtttcgcttcgtcttcatggtttttaagggcaagcgcaatgatcgctcccacttcttcgatcgcttccagatcaaagccgcggctcgtcacagctgctgtaccgacgcggattccgctcgtaacgaaaggtttttcaggatcataaggaatcgcgtttttgttgacggtgatgccgacttcatcaagtacattttcagccacttttccggtaatgccgagagagcgcaggtcgaccagcacaagatggttatccgttccgccggatacgagctcgataccctcttttttcaatgtttcagccaagcgcttcgcattgttgatgacattttgggcatatgttttgaattcgtcctttaaagcttcgccaaaggaaacagcctttgcagcgatcacgtgcattaacggtccgccttgaattccagggaagatcgacttgtcaatttgtttcgcaaactcttcacggcaaagaatcatgccgccgcgcggtccgcgaagcgttttatgagttgtcgtcgtcacaaagtcagcgtaaggaacaggattcgggtgaagacctgctgctacaagtccggcgatatgcgccatgtccaccatcacataggctccgacttcatcagcgatttcgcggaactttttaaaatcgatggtgcgcggatatgcgcttgctccggccacgatcagcttaggcttatgtttgagcgccttttcacggacatcttcgtaatcaatatactgcgtctctttatcaacgccgtattcaacgaagttgtactgaacaccgctgaagttgacagggctgccgtgcgttaaatgtccgccgtgagcaaggttcattcccaacacagtgtcaccgtgctccaaaatcgtgaagtataccgccatgttcgcttgtgcgccggaatgcggctgaacgttgacgtgctcggcgccgaaaatctgcttggcgcggtcgcgcgcgatatcctctgccacgtctacatgctcacaaccgccgtagtagcgtttaccaggatatccttccgcatatttattagttaaaaccgagccttgagcttccataaccgcttcgcttacaaagttttcagaagcgatcagctcaatcttcgactgttgacgtttccgctcatcttgaatggcgctaaaaacttgttcatcttgcgcaggtaaatgtttcatcagcgagatcctctcctatctgtttccatttcgttaattataccatctcattgtacacggtttttcatgcaaatgtaagagattatttttaaaattcgttttttattattggaaaaaccgaatattaaacgaatagacaaatcatatagttcgatatatcatttgtttaaaaaattattctaataaagaaaaaagcctgtccggctcttccccccgcttcttccgctactccgcttcatagacggcgcggacgcctccaatcagcttcggccttgtccgcgcaagcgtcacgtgcgcttcgcctagctgtttttgagagacgcggacaggaacggcaacaggctttaaatgcattcctataaacgtgtcgccgatgtcgatccccgcatcggcctctatttgttcaacaagaacaggagccttcatatgtttataggcatatgaagccatcgatccccccgctttcgggacaggaatggcgaaaacaacgggaagacggtatgctttcgccgtttcttcctcgacaaccaacgccctgtttaaatgttcgcagcactgaaaagcgagggcgattcctgttctgtccctgagctcttccagtcctttgtagaccgcttcagcgatttgttcgcttcccgaagtgccgatgcgccttccggccacctcgcttgtgctgcagccgatgacgacgatgtggccttcgcgcaaattcgcttgctgatgaaattcatctaatatagaacgccatgtctgttcaagatttttcatgattgacgacaccctttattcatgcttgtcttcataatcggcgatttttccgatgcggacggcgtgccgcccggctgaaaactcagtcgtaagccaaacctttgcaatctctctcgctaaaccagggccgatgacccgttcacccatcgcaagaacattcgtgtcattgtgctctcttgtcattttggcgctgaaaacgtcgtggacaagggcgcagcggatgccttttactttattggcggaaatgctcatgccgattcctgttccgcatattaaaatgcctctgtcggcttccccgttcgccactttttgcgcgaccggaaacgcataatccgggtagtccacagatcctgaaccgcattcgcagccgtaatcttcgtattcgatgttcaattcgtccatcaatgccataatttcttttctgatattgattccgccgtgatctgatgcaatgattactttcattggaatgactcctcctcgtttaatgtgccgccaaaagtctcgcagaaaccgttaagccagcatacagccgttatatacttctgattgatcatgtctattgtacccgctgccgcttgatttgcaaacgctccttagccagcttctattcctgagatttcttcgcaagcatttccgccaattttctcagcagctgctccagctcatctctcgttctttgatagtcgctgagagaaccgccgaacgggtcaataatgtccccgccatctccattaacatactctttcagcgtatagatcttatcttggctctttgaaaattcatgtactgccagctgcttgtgctgctctgtcatcgtcagaacaagatcagcccattccaccttctcctcggaaagctgtgaagatgtatgattcagagcgatgtttttttcaaaaagcgcttcgacagcatataaagaagcttttccgttttcaggagcaaacaacccggcagatttgacggagacatccagatttttttcggcagccgcagatttaaagagcgcttcggccatcgggctgcggcacgtatttccagtacagacaaataatatgttcaatcttgttcactcctttgtttcatattataaaggattcagacggaaaataataaaatccgctccagaaatcaaaaaagaggggatctccccctctttttctaagttccattatgttatgcaaaacagaaaaaagattttcccatctttcaattaaatgggcagcaaaagcttcagaccgaagctcagcaagatggctcctccgagcgcttcgctgtaggcgccgagccacgtttgaaccttttttccaagcagaaggcccgcccaagttaacaccatgctgaacaaaccgaacagaaagatcgttaatatcggtttcgttccgtagaggccgaggctgagaccgactgaaaagctgtcaaggctgacgccgacggcaaaaacgaacaagccgaagccgtgcggagagatgatctgctccccgcttttattaaaagatgcgacaatcatctgaatgcccagcaccaataaaagagctcccccaatatatcccgccagcgcaccaagcgcacccgaaagaaactgtcccgcaatcattccgccaagcggcatgatgacatggaacaatccaataatgacgccgatttgaaaaacctggttccttttcagcttggccattcccattccaagaccgactgaaaaggcatccatgccgagtgcaaaagccatcatcgaaagcgtcaggatttcgcctattaacacatcaacattcatgcaattcccccttggacacgccagcttttctagcttatgcacgtccaaaggcagatagaacacccccgcttaggctacgcttcgattacgcggtggccggccgctttcaacagccggttcataatcgcccggcccactccttcctcaggaaaagactccgcaaaaataaaatcgagacgttcttcatcaaagctgcggagaacgtcatacaaaccggcggcaaccgtttcaagtcggtctcttctgccgcagatgcggacggcatcggcctgatagacatcggcccgttcctctgtcgtaaggacaccgactttcatcccgtctttctgatattggtcgatcagccgttgaatatcctcaactcccccgttcacaatagcaagaggtgcttccggtgcataatgcgtatatttcatcccgggagacataggcgcctttttttcgtcggtgaggccctggtcaatcaagacggggccggccgcttcttcgagctgctcttttgtgacgccgcccggcctcaaaatgaccggaatttcaccggtgcatgaaacaactgttgattcaacccctactcctgtagggccgccgtcaacgacacccgcaatccgtccattcaaatcgttgacgacatgctcggctttcgtcggactcggttttccggacagatttgcgctcggggcagccaccggaacgccggcctgtctaatcagctcaagcgccacaggatgatcaggcattctaaccgcgaccgtgtcgagccccgccgtcacccttgtggataacaccccgggcttgcacggcagcacaagggtcagcggcccgggccaaaaacgcttcatcagcatttcggcctgaggcgaatcaacttccgcaaattctgcaagctgttcaatttcagcgatgtggacaatgagcggattgtcgctcggccgccctttcgcttcgtatattttagctactgcttcgctgtgtttggcgtttgcaccaagaccgtaaacagtctctgtcggaaaagcaaccgtttcattttgctgaagcagtcttgccgcctgtgcaatttgtggacagtttgtggacaaatcgcgttttacatccacagtccatacttttgttttcattaacatcaaaactcccttaacaaaacactaaaaacgttaataattcatgtaaatcatgttgaaagtataaaagatgaaagaaaagaaaacaagcgttgtccacattttgtggataacgcttttgaatccgtggatatctctgtgtataagttaacggctaatttgacgttttctccattaaaaccgctccgtttacgttcagtgagtctgaaacatgctcggattcatccagctcatcaggaattgccgcagcttgtttaaaaccgagcacttcaaggaaatccatcgatgttcgcttattggctactaaataaagggtttggattcctcgcttttcgcacaatacctgcatgctttgaaacaaggaaacgatgtggccttggctgagcttgtcagacacgacaagcgagcgcagcagtccttttttgttttcaaattcctccattccgaggcaggcgacgatttcatcgggagggtcttccatcatgataaactggctcttcgcttcctcaagacccttatggcttgtccccgccttttttaaaaatgcttcgatcgcattcatgtctttcgtttccgctaacctcaattggtagaacatcttttcaccccgttttttaacttctctatccaatctatgagggcgacagtaaaatataccttttgatttggaagaatgccggctattcatttttcaattttgattagcaggaaccaacgctttgaatgagtatgcaaatgaacgctgtactggtgataagacagtttctcttctgccggcaatgtgattggcacatcagaaaggggcaaaaggtgtatatccgaaaagcagtatttcccctgaaccgttttggaaaattatatcatattcaaaagcttcaataaccatcatgaaaaaacaaacagtaaaaaaccgccctgcacacgaaagcaaggcggtccttttaagaaaaaagcccggtaatccattcgacaagaaaaaatttcacttctttgtcttctttatctttatctatgccagataccgtttcatccgccgcgtctgttttttcttcccggcggtcttctccggcagcggtttgttcgtcttcaggcgactttacggcttccccattggaaaaatcaagaaagcaaagtggcggaaacaggacgcaccaccagttggctccctctcccttgcctaatgtaattaaaacagcctcatattctccggccggatacaccatattgccgtatagctttgtcggaaatgaaacacgatcaaaacggacagacacggattgccgaacattttcgcgtttcatgacatccatggcaacctcttggatttcaggcagcttcgacctgatgacttgtctcgcttcctcaaccgaggtcaggttttccacccatttcgtaatttgtttattgacctcatccctgattttgcgtttgacgctctggtcgctcccgctgtcgctgtttgccaaaatccgcagccgaatcgcttcatcaggaatcacggcaggctgcccgcctgatgattgggcagtctcttccgtcgtgagatttgcaagcgctcctattaataaaagaaaaatatacatacaggcaatgtttgatttcttcattttccccaccgttcctctcgttcttcaaccttttctagcaatattatggtcaaagatggaacggtttaaacggctgctgaaaaaaatcctactaagcttgtaatctcttcctaataaatctacatatccaaatgactctgcttgtttttttgcaggccggataaaaaaatcaccgcgctgatcgccagcagcaagccccccaatccgccgaacagcaaaaacgggaagacagcggctgcgcttgcatcaatcgcccagccgatcaagaatgaaagaagcgctcctcccagacttgcggacgaaatgaagagactcgtgatttcctctgtaaaaggctttccagccaacgaggcaagagtgacggcgcacggaaaaatgccggctgccgacagcccgatgaaaaatacgaggagcagctgtgtttgatgaaccggaaaccacgcgagaatcaaaagcaaaacagtcaaggctccggcgctgaagatcagaaaggcaacggaagttatgcgtccgccaaaaatacttgtcaataaacgtccgcataccatccccgtccaaaaaaacgtgacgctgatcacgctgatttcttcagcccctttttccagcatcagcgccggcaaaaagtttgcgaaattggtctcgatacccgcatacacaaaagcgaatatgagaaagaggaaaatgtttttttctttccttccggtttcaaatatggctgatacagtcggtttttcctgataagccatctgaccggaagcagtgccgggggtttttctgcgcaaataaaccacccacatacacgcgagcacaaaaacgaagataaataaagcatacaaggggaaatgccaggcatatcgttccgtaaggatataaataagaaaaggaaacagcagcgcgcctaatccgaaaaaaacctctaaaatattcatccctttcgcatttttatcttgcgcaatcacatacgcccccatcgtcgtttctaaagtacccgcgccaaagccgagcaaaaatcccatgatgacaaaaaagatgaacatatcaaaaaggaaaacacctaaaagcgtaacgagaataagaagaaggccaaacgtcaatacagccgtatgagaggtgcgtctgacaaacatcggcgcaagcaggacgccgtttagaaaaccggtgaattggaaaaagatcaggaaggatagatcatgaagatcccgttgatattcttgaatgatgtacggtgacaggctccccagcagaatatggataacccctactagaaaataaaacgaacagccgaatagaaatatttttttcattagactcactccttcgttgcagaccataaaacccttgcggcttgggtggcacagccggcaagggtctttcgcaatgctagtttgcttgttttgaaagggacagctgctgacctttattgaaaaattcatttaagtagaactgcgtcttgtatccatcttcaaaagtggcaagagatgcaaaattgcgatcccgaattccgttcatccattggatcagctgaactctgaaggaatcggcccatccgtaaaattcattttcagggtctgtcagccacgtgtccggcattgttatcatctgctccgtcaatccggccctcagcaaaaactgatttttctgccgtgaatgatagtaaaatacgccgttttggccgttgacctcgatgctgaagccgcactcatccgattttgtgcattttgacgtaatcatattgacaaacacatgattttcaagctggccgtatacttctgaatgatcatcaacatatacctgtttttgttctttttctttgacgaccgtcatcattttgacttttaaactgtccagtttaaacgggctgtcgaacaaatagagtatgagatcgattaaatgcacgcccaaatctcctaatgccccgctcgttttgttgcttttcgaatgatcgcgccaagtatatttttttcttctcaaggcgctgtttttcttaaaatggacattgatggacaaaatatctccaagttcattgccggatatcatatcttttaggcgcttaacgaatgtgagatggcggtaattgaagcccatgatcggaatataagcggattgagacgccctgcttttcatctcctccgcttcttccattgagacagccatcggtttttcacacaatacatacttccctgcagccatcgcttcaagcgcatgttctttatggcaaaagttcggcgatgaaacgatgactgccgtcgactgattcaacagctcctgcatactggtaaaggcagttcctccgtattcaaacgcacatttacgagaggcaagcgagttgatatcaaaaaacccggaaagctcggcacctttgactgttgaaagagctttcgcatgggcttttgcaattcctccggctcctataattccgattttcatctaaggacactccttatcgtttgatatgggcttttagcacttctaaaattccagccgtatagctgccttctgtcatacgggaatggagcgacttggcttctgctgtcgcattccccaccagataaccatgtccggttttttttagcatatccacatcgtttccgctgtcgccgaaagcaaatgaattctccctctctatcgcgaatttatccaatataaaatccacaatgtacggtttgcctgtccgcaaggggataaagtccacatcatagctgttttccggatcgcctgccaaagggttgcagcgattgatatttactcctattccatgctctcttgcaagccgcctgatggcttcaagcgccctcttatctatgctctcttccaacgatttatagtaatagttgattttatagcgggaaaagccatgctgagtctgaggcacaagcgcaatctcatattttttagagagagtctgcttgatttcttcgaccagatcatgggagaaatttgattcttgcaatcgggcttcccaatctttatcagagacttggccttcttcagagaaataagtgatttcagtgccaaggtcaccggcgacaaaatgcggaagatatcgaaagcctccccgcttcatttttgcaagaacggatgacaggctgctcccggtcacccagccgagcaaaatcttgtgatcaagatggtgcgaatgaataaatgtttcaaggtccatgagcgcttttctcgattcatcggtgatgctgtgggcgaaatatgtctcatcaaaatcgcaaaatacggcgtacttcggcttgtttacttgctgcaaggtgtgaaaagaaagtgtttcatgatacgacatcaattaaggcctccattactttgtcttgttcttctacggtgagccccggatagagaggaagctgaagcatttgtttatgcactgattcagtgaccggcagtgatgtgtgccgataattggcttttacaagtggtgtgttttgatgatgggataaaatcgggtagtatatatctgtttggacattatgaaatttaagcatcatatctttgacttggtcacgatttccgtttagtattttaattgtaaacaaatgccatacatgatcatcggtcatttgaggcaatttgatcagacctctgtcttcatactgctgcaaatgcgcaatataacgatctgctaaatataagcgcttcagattatttaaagaaagatatttcatccttgccagtccaatagcggcttgcagattatcaatcttagcgttaaagccgtagtcagccgcctttttatttttttgattcagttcaaagccgtgatacatatattccatgcatgcggatgcaaatgatggatcatccgtcacaattgcgccggcttttccgcaagtgccgagatttttatacggattgaagcttaatatggagcaaaggctgttttttcccagatcggaaacgccgatcgcctggcaggcgtcttcaataatcgggatgccgtatttatcagcggtttttgcaatggcttccatgtcaggcagctttccataaaggtgtacaggcaaaatgcatttcgttttcaaagtgacacatgcttcaatttctgaaggatccatgcaaaatgtaacagggtcaatatcgcagaaaatcggagtgcctccagctgcgagcacggcgttttccgttgcagcaaagctgtttgcaggcataatgacttcatcaccttgtccaacacccgcagccttcagcgcgacaatcatggcatcggttccgctggatgaagccatgacatgctttttgctcaaaaaagcagctatttcagcttcaaatacgccaacataaaaaccgcttgtaaattgcccggtcggcagcacgtctttcaccgcatgaaccacgtcatctacttcttcttctgtgatcagtcgatgaagcggcataaagtcaactctggagggcggggaatccattctgttcagcaaattggcggttatgtcgaattgatcctgctgcaatgtctcttttaatttttgattggccagtgtgtcgtctatacggcattcaccagcgagctttccttccttcaaatcattcagaaggacaaatagctgtttgctcgtgcaagtcatgttttcgtttgcggttttcatcaatttcaccccatttttattattttgggaaattgtcatatttcatgacatatcttaaatgatggaatcgataccataacaactctttttttcaggaagtgactttatgcctacgattgacgaaattgcaaaattaagtaatgtgtcaaaaacaactgtttcaagagtactgaacgatcatccctatgtatctgaagaaaaaaggaagcgggttttggaagtcatcgaaaaattggactacatcccgaacacgtctgcacgaaagctcagatccaacaaaacgatgtttctcgcagtgtctgtcccacacgcggaccaccccttcttcgctcagcttatgaagcatatgtccgctgaagcgctgaaacaccaatacaaagtcattgtgtttcagacgttttatcaaaagcagaatgaactgaaagtactggagctgctcaagaggaaagaagtcgacggcgttatgctatgcagccttgaaaatgaatgggaagacatcaaaaaatacgtcaaatacggtcccgtggttatggcaaatgaattccacgccgaagcggacgtgccggtgatctgctatgacgaattcgaagccggatataaaggaacggagctttttattcaaaaagggcatcatttaatggccttttgctgtgacacgatacacagcaaggcccagattatgagaaaagaagggtttatgaaagcattgtctgatgcaggtttgcgtttccaggagaagtggatgttcagccacgcatttaccattcatgacggcttccgcattatggaccagatccacaacatgtccgaaaagccgaccgccatttttacgggaaacgaccaagtggccgcaggaattattaaaagggcccgatattatcaatatgaagtgccaaagcagcttgcagtgcttggatatgacaatcaatcgatctgtgaggtgaccgatccggaaatcacgacaatcgatatacctgttgaagagctggctcaaaaagccgtatgtgcaatggtaaaccttctgaatggggaaagcggcttacagagggatgtcgtgacactgtcccctgcattaaaaataagacaatctgtttagtatatatattaatcttgaactattttttattttattcagataaaaattttgttaaaaaatggtaaagcacgccgccagaacggtcaaggctgcggttcctattttccaccgggaatttgagccgccccccttttgttcgacacacttaacaattggaggcgcagttttctaatggctaaatttacagctgaggaactaaagggtaatttgcggggaatgaagggcataaacggatcaagatcaaatgaaaaggcatgagcctggtacaataccggaatcatgccagttaaactgtttcatgacattttattgtctaacttttggagtcacttttaactatgttgttcaattaccgcgcagacgatgcggtcttttccattaagatctttcttcacccgcacgtcagcatcaggaaagaaccggtgaaacatgtctttaacggcattcccctgagtccagccgatttcaaacaccaccagtgcctgatctgcgatgacagatggaatttccttcatgaaacgcttataaaactgcaatccgtcagcaccgtccgttaaagccccggcgggttcatggagacggacgacatctgacagcgtcctcatgtcttcctcggatatataaggtggattcgaaacgatgacatcagctttcttctgtcgcgcgataagcggttcaagcaaatcaccgcagaggaaatccactttcgccccaagccggtcagcgttgtgtcttgcggtacttaaagcttgttccgaaatatccgtcgccgtgacggaaaaacgcgggctctcaagcgcaagggtcactgcaatcgccccgcttcctgtaccgacatcgacagctttaagacgatctgtcccgtgaaaaactctttccgcttcggaaaggacagcttcaacgacttcctctgtttcaggacgcggaatcagaacgtgttcatttaccgaaaattcccttccgtaaaaggactcttttccggtgatatattgaacaggcactccttgatgatgaagctcgacagattttttaaacctcgcaaaatcagactctgatatgacatcatggaagcttgccaacagtttgctgcggtcgatgttcagctgatctgtcagcaaaatttccgcggcattccggtctcttcccgcttccgtcaaataagaagaagcccacctgagggcttcaaaaattgttttcatgtttagctctccgcctgctgaagcttgcttgcctgatcctctacaatcagggcgtcaatcacttcatcaagcttgccttcaaggatttggtcgagcttttggatcgtcaagccgatcctgtgatcggtaacgcggttttgcggaaagttatacgtgcggatgcgctcagagcggtctcctgttccgacggcggatttccggttttgatcatattcagcctgagcttcctgctgaaatttgtcgtaaattcgcgcgcgcagaaccttcatcgctttttctttgtttttgatctgagatttctcatcctggcaagacacgacaacacctgtcggaaggtgggtcagacggacggctgacatcgtcgtattgacgctttgccctcccggaccgctcgatgcgaaggtgtcgacgcgaatgtctttttcatgtatatcgacttctacctcttccgcttcaggcaggcaggctaccgttgccgtggatgtatggatgcgcccgccggattcggtctctggaacgcgctgtacgcggtgtgcgccgttctcatacttcagccttgagtatgcgccgttcccattgatcataaaaatgatctctttatatccgcctgtacctgtcatattcgcttccatcacttctgttttccagccttggagctctgcgtagcggctgtacatgcggtaaaggttgccggcaaataaagcggcctcttctccgcccgctgcgccgcggatttccatgataacgtttttgtcatcattcggatctttagggatcagcaataccttcagctgatctgtgagcgactcgatttcttcctgcagttcggaaatctcctctttcaccatctcgcgcatgtcggagtcaagcttttcttcaagcatcgctttagcatcgctcagctgttccgacgcgctacgataacgtctgtatacttcaactgtttcctgtaaatcagattgttctttcgaatattctctaagcttcttcggatcgttgacaacctccggatcgcttaatagttcatttaatttttcgtaccggtcctctatcgattttaaacggtctaacacgctattcacctctgtttgctgtgcgtaacattctaattatagtatagggactcttccccgtcaaaacaacttcgccgttatcggcagcagccgcgtctttttgctatacttttaagaaaaaaggagcttgactcaatgctggaatcgattcatcacatcgccatcatatgctcggattatgaagcatccaaaacattctatgtcgacaagctcggacttgagattctgagcgaaacgtacagaaaggatcaggaatcatataaactggacctctcattaaacggccgctatgtcatcgaactgttttcttttccggatccgcccgcacgccttaccagacccgaagctgccggactccgccatttggctttcacggtggccgatcttgaccagaccgtcaaggagctcaagcaaaaaggcatcactgctgaaccgatccgcaccgatcccgggacgggcaagcgctatacgttcttctccgacccggacggcctgcctttagagctttacgaagcatagcaacggctgcaccctctggggaaaaaccgctttctttgccgaatcccttcttcttttgtctaacaggaaggaggccttttcattcaggtcgaataccctttttaatgaacagttacaggttaaaaggaggtatcttatgaatactgctgatgcggcaaatgaactgggggtttcaaccaaaacggtgcagcgttgggtcaagcagctgcaactgcccgcttcccgaaatgagcttggccactactttttcacggaagacgatatcgccattttaaaagaagtaaaagagcagttgaaaaacggtacgcctatgcaggatgtcacggtcaaacgcccgaaaaaaaccttcttcatcaagaaaaacgaaatgattcaaacgaaagagcctgcactgcaattgaatgagcggctcgaagaaaggctgcagcgttttttagagcatgaacagcttgaacgcgagctgctccaaaagaaaatcgccgagctggaaagaaagctggagcaaaaagcggacgaggtcgtctcctaccagcttctgcagcaaaggcgcgaacttgaagaagaacggcagcagatcaagcatctcgagcagaaaatcagccaattggaaagcatgaaccgccgggaaaaagatacagccgtcagaagagaagaaaaaaaaccgaagagcaaattgaaatcgatcttctctttttaaagcgcaaaaaagcttgcaaggccataaacggcttcttgcaagcttttttcttacttaagctgtaattgcaatcaatatcggcagcgaaataattgacagcaccgcactgatcacaaacgcggatgccgtttccgcttcctggctttcaaagtttgtagcaatcatggccgccacagcagaaccagggaatgccacgagcagaaccgcttttgtcatgtcggcagaagaaaggccgacgaccatcgcgatcacaaacattaaagcaggctgagcagcgacttttaataaagcgatgctcaaggcaggcatgctgaatttaattttgcggattccgacagtcaccccgactgcgaatagggcgattcctgaagtcgtatctccgagcatatcaagcattttctgcggcaattcaggaatttgcagaccgaataacacaagaatgatacttgcaagcggtgcaaaagcaagcggttcagacaaaccgtgtaaaattgattttcctgtcaccttccaaatgctgtccgtcgtttccgtttgtttttttgaagaacggccgacggttccgacgatgatcgcaagaggatcaagcatcgcatttacgacaattcccgtaatcgcgattggaatcgcaacttcctgcatgccgaacaggctgcccaatacaggaatgcccataaaggcgaatgtcggctgtgctgagttcaatgagaacattgaagcatctgttaaatcgtatttaaacaaaaatcgtaaaagaagcaaaataataacgtaaaatccaacgataccgattaccaatgaaatcataagcggaatctggctgtaaaacttatcttttggcgttgacaaaatgcttgatacaaagtgggccggaagcgcgtatttcgttacgagcgtacttaccccttttgctgatttagcatcatagcttccaaagtgacccgcaaaccatcccagcgcaataacaaaaaatattggcgcaaggaggattaaaatatttaaaaagctcaaggctgtttcctcctctatgttgtccctttcagggacgtattaacggcggctgataaacgcggtcgccctgttacacagccgccgatcccatttttttcaaatttgattggtgcagcccggtgacaaaacatccgcacccgggctgccgtttcttttatcgtttcctcagaacctaatattagtcttgttttgcaacaattgttttatactccggacgccacatggcttcgcggacagccttttcgacatcttcaggctgaacttgggccacgccgtctttaatggcagcttttacaacgtcgatcgccacttgaacggatacgtcttgcaggtcgtcgattttcggcagaagacctgcacccggcttttcatgatccaccatgttcgcgaccgcgttggcagatgcagcaaacatgccgtttgtgatgactttcgctttcgcaacgattgtacccaggcctaatccagggaatacaaaagcgttattggattgtccgatttcgtgtttcacgccattgtactcaacagcttcaaacgggcttcccgtcgccacaagcgcttttccgtccgtccatttgaacaagtcttcaggaacagcttcggccagatgtgtcggatttgacatcggcagaatcacaggacgctcagtatgagccgccatctctttgatgatttcttcactaaaggcgccggcaacacctgatgtaccaatcaggatcgtaggcttcacttgacggatgacttcctcaaaggaaatctctcccttttcattgcgtttccaatctttcacttcttccgtatcgcgcaaatacggttcttggaaatccatgatttgatccatgcctgtcgttaataatcctctgtaatcgactgtccagaatgcacggttggcttcttcttctgaaagcccttcaagcaccatggtgtcgcggatttggtcagcgattcctataccagcagaaccaggtccgaagatgacgacccggtggtctttcaaagacgtgccggtctttttgacagctgctaaaatcgcagccagcgtgatagcccctgttccttgaatatcatcattaaatgttgcaattttatggttatatttactcatgatattgcgggcatttttatttccgaaatcttcccagtgtagaagcgcgttagggaaaagcttcaatgctgtttcgacataagcgtcgataaattgttcatagcgctcgccttctacacgcggatgacggtttccgatatagagcggatcgtttagcagtttttcattattcgttccgacatccagtacgaccgggataacgcggctcggatcgattcccgctgccgccgtatatactgcaagcttaccaatcgcaatattgatgcctccgacgccccagtcgccgatccccaaaatgctttcggaatctgtagcgacgatcaaatcgatgtcatcagcagatgcctgcaggtttttaaaagccgtttcgattccgtccatatcatcgattgacaagtaaacgccgtgcggtctgcggtattcgtggctgtattcctgaatcgcttcgccgacagtaggcgtatagacaaccggaagcatttcacgcaggtggttttgcaataatttatagaaaagcacttcgtttctgttttgcagatcgttcaaatatacgttttggcgaagtctgtcaggttgacgggaaaattgttcgtaagcccgttctgcctgctgatcaaggctgagaacagtcggcggcagaagcccttctagaccgaggttctttctttcttcaagagaaaatgcaacacctttatttagcgttggaatggaaagaacgtctttaccccgcaaagaagtctccaaatgtccttccttcgttcttctcatgttgttcacactaattaccttctttcttaaaatgttaatgaagtgaaataaatacggtaaacaatatagaatatttgcctttttacacatgtagatttgtcaaatatgtaacgcgcgttttttgacaaaaaactgaacatttcctaaaacctatttactttttactgactacagtaagtcattttatgcctgcttttgtcaaaattcaagcgatgaaaattagttaattttttcgtattcttaattaagttttttaattacattaattcccgcaaaaaggattcaataaaaaaaacacttgtttttaccaagtgttttcgagtgaaaatctatatgtttttccgatttcatttcgggtttccaggcacttcatgatggtggcggcagcgcgcttcatatgcttcggaggccccaaccaaaatgaccggatcgtcataagaagcaggttttccattgatcagcctctgcgtgcggctggctggagatccgcagacagagcacacggcttgcagcttggtcaccgtttccgctaaagccatcagatcgggcacgacgccgaaaggctcgccccggaaatccaaatcaaggcctgctgcaatcacacggtagccctgatcagccagagaagttaacgtgccgacaatcgtttcgtcaaaaaactgcacttcatcgacgccgatgacatccgtttctttgcttatgtattgaaaaatttcttccggagatgcgatggcatggcacacaatggatgtcccattatgcgatacaaccgattcgctgctgtagcgattatcaatggctggtttaaacactttgacttcctgcttcgcaaacgtcgcccttttgatccggcggatgagctcctctgatttgcccgaaaacatgcttccgcatatgagttcaagccagccgctttgcttcatgatgtacatccaactaactcctctccagcaattattgcaagtaaaaaacaggcaagaagaatccctgcctgtttatcatatctattattacttaagaccgtattttttgttaaagcgatcaacacgaccatcagcagaagcgaatttttggcggccagtgtagaacggatggcattcagaacaaatctcaacgcgtacctcttcttttactgaacctgtttcaaattcgtttccacaagcgcatttgactgttgcttttttgaactcaggatgaattcctgctttcatgtctgtcatctccttccgccctgaatccaattcggaaacagagtattattccggggcaaaacctccggaacgcacatgatagaattataacagcgattcggacgttttgcaaactaaagtttaaatcagcgccttgcagcagacatattggcttgtttccattcctggatcagaatatcgaaaaactcctgattcgttttcgtctttttcatttttctcatgaatttctcgacgaagtcaggcgtgtcagacatcgttttccggattgaccacagacgatcaaggtgctctttcggaacgagaagctcttctttacgcgtacccgaacggcgaatatcaatggcaggaaagattcttctttccgcaagagaacggtcaagatgaagctccatgttccctgttcctttaaattcctcatagatgacgtcatccatccgcgagcccgtgtcgacgagagcggtcgccaggatcgttaagctgccgccctcttcaatgttgcgggctgctccaaagaaacgctttggacggtggaaagcgccgggatcgattcccccggacaacgttctgccgctcggcggaatgacaaggttataggcgcgggcaagccttgtaatgctgtccattaaaatgataacgtcctttttatgctcaacaagcctcattgcacgttccaatacaagctcggccaccttgatatggttttcaggaacttcgtcaaacgttgagctgacaacgtctcctgcaaccgaacgttcgatgtcggtcacttcctcaggtctttcatcgataagaagcacgatcagctccgcttccggatgattggttgtgatgctgttcgcgatctctttcaagagcatggttttacccgctttaggcggagcgacgatcagaccgcgctgtccaaagccgaccggcgccatcatgtccatgatccgtgttgacaggtgattcggcttcgtttcaagcaccatctggcgatctggataaagaggcgttaatgccggaaagtgcacgcgttcttttgctgattcaggatcgtcgccgttaaccgcttcaacgtgcagcaggccgtaataccgttcgttttcttttggagggcggacctttccggacactttatcaccgtttctcaaatcaaaacggcggatttgtgaggcggaaatatagatatcctctgaactaggcgagtagttgatcggtctgagaaagccgaacccttcggactggatgatttccaatacgccttccatgaacagcagatcttcctgttcggcgtttgctttcagaatggcaaaaatcagttccttttttgtcagtttgctgtaataagagactttataatgccttgcaagctcatacagctcttttaatttcatattttccaaagatgaaatggatacatctttcactaagaacaccactcttttctaatcgaataatttactttgtctcatcaatttcacgaaagacgattaatgtatactgccgattcgttttaccggcaacgcttctacccatatatatcgacgtattgaaaaggattataagtatgagtcgagaaagaagcgaggacttaacaagagaagataatcgcatatctgatagatgcggcaggattttggttctctctaggaaccagcatgtgcagaaaatttcgcagcactctttagttttacctcatttgtcgtacatattcaacttcatttatgatttgacatgaaattgatagagatgaccctgttttgaaaaatgccttgacatgaagaagaaaagccgttagctattgtatcagagtatgaaccttgattcaattcgtgaagtgaaatacaagggaaaagcgggtcgtttatatccccgcttttccttttccttatggccggatgactaggttaggttttttcttgagactgtgtcttccgtccacaaaccgtaccgtaccggattttgccctcatgactacgctgtgggtcgttccaacagatcctttgaattgcacgcctttcaggagctctccgtctgtgacgccagttgcggcgaaaatcgcatcgtctcctttgacgaggtcttccatgcggagcactttgcccgtatcaagccccatcttttcacagcgtctcagttcttcctcactttgaggaagaagctttccgtgaatttcccctccgagagctttgagtgcaacagccgagagtacgccttccggagcgcctcctgagccgaataaaatatcgacgcctgtatgatcaaaagcggtgttaatcgcaccggccacgtccccgtcattgatcagcttgattctggcgcctgcttcgcgaagctcatggatgattttctcatgccgcggacggttcaaaatcgtggctacaacatcttccacatctttattctttgcttttgccacagctttcaagttatcaatcacaggcgcttcaatatcgatgcagcctacagcttcaggacctacagcgattttatccatatacatgtcaggcgcattcagcaggtttccgtgatcagccaccgcaatgactgcgagagcgttccatccgccgctagcgacgatgttcgtcccttcgagagggtctactgctacgtctactcgagggccgtagccgttgccgagcttttctccaatataaagcatcggcgcttcgtccatttccccttctccgattaccaccgttcccttcataggaatggtgtcaaacacatccctcatggcgcttgtcgcagcgtcgtcggcttcgtcttttttacctcttcccatccagcgcgctgactttagcgcagccgcttctgtcacacgaacaagttccatcgataagcttctttccattcctatctaatctcctctcacccatatgaaatcgttttatgttttatctataacagcatttgtcgatcacgagttttgcagctgttcaatttcctggtctgtcaatttttcgcgccagacagtggccccgagctttgtcagcttttcttcaagctgactgtagcctctgtcaaggtgctccaaaccggtgatttccgtgacaccttccgccattagaccggcaacaacgagacatgctcccgcccgaagatcactcgctttcaccttggcgccctgcaaaggagctggcccggtaatgatcgccgatcttccttcaaccttcatcgacgcacccatgcgtctcagctcgtcaatatgtttgaagcgagcggagtaaatggtgtcagtgacaacgctcgtcccgtttgccttcgttaaaagcgatgtcatcggctgctgcagatcggtcggaaagccggggtatacgagcgttttcaaatcgaccggtttcagctctttctgtccgccgaccattaaaatctgctcgctgctttcttcgattcgaacccccatttcgcggagcttggcgattaacgattccaaatgcgtcggaattacattatcaatcagcacttcttgtcccatggaagcagctgcaatcatgaaagtgccggcttcgatccggtccggaataatcgagtgtctgcacccgtgaagcgattcaacgccttcgatgcggatgacgtccgtaccggcgccttttatttttgctcccatgcttgttaaaagagtggcaacatcgataatctcaggttctttcgcagcgttttcaattacggttctgcctttggcaagcacggcggcaagcatgatgttgatcgttgctccaacactgacgacatcaagataaatgcgcgcgccttttaattcctccgcacgcagatagatcgcaccctgttcgtttgtcacttcggctccgagcgcctcaaaacctttgatatgctgatcaatcggtctcggaccaaggtggcagccgcctggaaggccgatgaccgctttcttaaagcgtcctagcatcgcgcccattaagtaataagaagcccgaagctgtttcacttttccattcggcaaaggcatgctgatcatcggcgcaggatcaacgaccatttctcccttttcaaagtgaacgtttccgccgatctctctcagcagatcgcgaagcgtcaaaatgtctgaaatatggggaaggccttcaagcgtaaccgtcgaatcagccaaaatcgtcgcaggtatgagagcgacagcgctgtttttcgctccgcttatatgtactgtgccattgagaggatcgccgccagctatatttaacttttccatgatcgtctccttccttaaagaagatagctaatggagcgcttcataatgagatttccttcaaactcaaaataaatggttcatttcaaaatctatccaattaaaagagaaagaatacaacacatttcaaatttatcgggaagaaaagtagcgaagcagactgcggcaaggttctcttctgcaaaacattcatttctctttgtaagacaaaatggtgacaaacggagggagcccctccacttgccacccacatgaagcaattatttattccagtcagccaaaaactgttcgatccctttatcagtaagcgggtgctttgtaagctggtgaatgactttgagaggcatcgtgccgatatgagctcccctgagcgcggcctcagtcacatgctgcgcatggcggatggacgcggcgatgatttgcgtgtccaaaccgtgcacatcgaaaatttgtttaatttcactgatcaagtcgaggccgttgtggccgatatcgtcaaggcgtcccaggaacggggaaacatacgtagctcctgctcttgcggcaagaagcgcctgatttgcgctgaagatcagtgtgacgttcgttttaattccgagatcggttaatgctttaacagctttcaggccgtcaggcgtcatcggaattttcaccgtaatattcggcgcgattttcgcaagctcttttccttcttcaatcatctcttcagccttcagagaaataacctcggcgctgactgacccagaaaccacttcggtaatttcacgcagacggtcatgaaacgaaatgttttcttttgctactaaactaggatttgtcgtaactcccgcaagcacgccgagagcgtgcgcctctttaatttcgtctaaatttgcagtatcaataaaaaacagcatattgataaaacctcctgtcatgaaaatgtctgaactgtggaacttgtttgcgctttccggatgatatggataaaaccgcctgtcgctatcaggcggcttttttgactgaacgggaagcaaaagagcctcatgccgtcacatggcatgtgttaacagcacttccctctaaaacaccagaaaaacatcctgtttccccggctttgcgggaaaacagatgcttttccaatcgtcattatgctttgtttgaagaaccaaattcgcgcattttgccgataactgtttctttgatagcttcgcgtgcaggtccgaggtatttgcgcggatcatactcttcaggcttcgcagccagcgtttcgcgaacagctttcgcggaagcgatttggttttcagtgttgacgttgatttttgccgtacctaaagaaatagctttcttaatgtcggcagtcggaatgcctgtaccgccgtgaagtacgagcggaagaccagttgtatttccgatttcttccatttctttaaatccaaggtttggttcgcctttgtaaggaccgtgaacagaacctaatgcaggagcaaggcagtcgattcctgtgcgctcaacaagctcttggcactctttaggatccgcgtagatgacgccatctgcaattacgtcgtcttcctgtccgcctacagttccaagctcagcttcaactgatacgccgtggaaatgagcgagctcaacaacttttgaagtcgtcgcaacgttttcctcgaaaggatggtgagaagcgtcgatcataacggaagtgaatcccgcatgaatcgcttttgcacaagattcaaagcttgaaccgtggtctaagtgaatcgcaacaggcactgttacgttgtattcttccatcagcgctttaaccattgcaacaacggttttaaaaccgcccatatagcgtcccgcaccttctgatacaccgaggataacaggagatttctcttcttcagcggcttgtaaaatcgcttgagtgaactcaaggttatttaagttaaattgtccgacagcatatccgttttcttttgctttattcaacatttccgtcattgatactaaaggcatgtcgaaagtcctccttatgtagcctgatttgcttttgcgaaaaaagcctccacacctacctagcatgaccagaaaaatccgccatatgtaaaatgttttgttttttaaaaaacgttagacagcttttctctacttatatagaataacaattaatcaacaaatcggcaacattgtgactgtgacaacatcaaaaacttttccgctatccgttggactttatgggcagatacgttttgacggcatcgcggatttcgtcgatgtcaaaaggcttagcaaagtgtgtcagggctccgagctccttcgattcctggatcatgtcgagctctccgtaggccgtcatgatgatgacgcggatcccctcgtctatgatcttcattctttttaaaatttcaattccgtccattccggggattttcatatcgagcagaacgaggtcggggcgctggtttttcacaatgtcaagcgcttgaatcccgtttgcggcctggaaggttttgtacccttctttattgaaaacttcattcagcagaacccgaatcccgtactggtcgtctacgattaaaatcttctcattcatgatttacacctctatatttataattttcgccaaaattaagcagtagtttatctattctgttttgtttttctcttttcctttaattaaaatatttaagtttgcgacatatttagaggatttttcccattattctcttttgttatataatgatagtcagtaaaaaaggaggagtcaccttgcttaaaattttcaccactcaattgacgggaatcttcaaccggattcaagagggcgaggcccaatcgatagaggacggcgcccgcttgttggctcaggcggtcatcagtgatcattcggtttatgtatacggaaaaaatgaattggaaggcattttgaaagaagcgatgtacagttctgaaccgttcccctcagtcaaaccgctgcagaaggacgaagaaaactggcccgattttgaaatgacggacaaagtgctgatgttctgcgccggttcagcggatgacgaagaactgaaaatggcggaaaaactgtatgaaaaaggaatcggacttgttgtcgtctccccttcgggaaaagacggcgtcccgatcgcatccttcgccgatgtccatatcgattcaaagctgagaatgccgcttcttcccgatgaagacggaacaaggtacggatttccgtccctgatggtcagcctctatatttatcatgccctatcctttacattaaaggaaatcctccaggaataccaataaaacagggttgcctaaaggaaattagtgacgtgaggccggcctaatgaatatagtaccagttcgggccgccattatcatcagaaagagccaaaaaaagcccgccggcgtgatttgccggcaggctttttcttttttacagcttttccgaagtctttagcgaagcatgtacgaagtctctgaacagagcctgaggtcttgtcggtcttgacgtaaattcaggatggaactgagacgcgacaaaccatggatggtctttaagctcgataatttctacgagacggccgtcagggcttgtcccggaaaatacaaaaccggcttcttccatctgctgtctgaactcattgttgaattcgtagcggtggcggtggcgttcatacaccacttcattttcatatgcctgatatgctttcgatccttcttgaagcttgcacggataaagtccgaggcgcagtgttccgccgaggtcttcaatgtccttttgttcagggagaaggtcgataatcggatacggtgtagacggatcgatttcggctgagtgcgctccttcaaggccgagcacgtttctcgcgtattcaatcgatgccacctgcattccgaggcaaatgccgaagaacggaatcttttgttcgcgggcatatttgactgtcgtgattttcccttcaacaccgcggtctccgaatccgcccggaacaagaataccgtccgcattttgaacaagatcggcaacgttgtcttccgtcacttcttccgcattgatccatttaacttgaatgtctgcatcaaacgcataacccgcatggcgaagcgattctacaactgaaatgtaagcatccgggagctcaacgtatttaccgaccaaagcgattgttaccgttttggacagatttttcacctttttgacgagttctttccactcttccatatcggcttctctgcaatccagcttcaagtggctgcaaaccaggctgtccaggccttgtttttgaaggtcgagaggaatggagtagagcgtatccgcatctccagcctcgatgacggctttaggatcaatgtcgcagaagagcgcgattttatctttcatgtcctgagaaatcggcatttctgttctcacgacgatgacatttggctgaatgccgaggctgcgcagttcttttacgctgtgctgagtcggctttgttttcatttctcccgccgctttaagatatggaacaagcgtacaatggatgtacatcacattgtcgcggccgacatcgctcttgatctggcggatcgcttcaagaaatggcagcgattcgatgtcaccgacggttccgccgatttcagtgattacgacatcagcgtgcgtttcttttccggcgcggaatacacggtctttaatttcatttgtgatatgaggtattacctgaacggttccgcctaaataatcgcctctgcgctcttttttcagcaccgtggaatagatttttcctgttgtcacgttgctgtatttatttaaattgatgtcgataaagcgctcataatggccgaggtcaagatccgtttccgcaccgtcgtcggttacaaacacttcaccgtgctgatacgggctcatcgtacccgggtctacgttgatatacgggtcaaatttttgaatggtgacattcaaacctctgttcttcagcaggcggccgagcgaagacgccgttattccttttccaagcgaggatacaactcctccggtaacaaagaatattgggtccttctgtgcccctctcttcgattaacgcttatttcttaaaatgctctttttatgaaaaatcatttacatcttttctaaatgatttaaatgattaggaggcggaaaaacaagaaagctccctttcaatttcttgaaagggagctgatagtccgtatcactcgaatctcttcgttttgaagagcccaaaatacatactacctagttcgcctgtgaaagtcaagatcgatttaaacatgaattccgttcagaaggcaattactcttcgtcttcctcttcatcaaaatcttcatcatcatccaggatctcgtcttcaagatcatccagctcatcatcgtcggcttcatcgatttcatcgaattcatcggcgtcaatgtccaaatcttcttcgacatcgtcaagaagaatatcatcctcgtcgatttcttcgaattcgtcaagatcaagatcttcttcaaccgcttttttcgcttttttctttttcgcttttacagtcggctgggtttcttcatcaagctgatcatacggataccagctgcgcaggccccacgtttggtctgacagcgccaaaaagcgtccgtcgatatttaaatctgtgtagaactgggcgatgcggtcttccagctcttctttccccattccaagcaaggaagccacttgatctgttagctcctggaatgtaatcggttttttgtgttccgagaaaatttcgtatgcgatttcaactaaagccatttcctttagctgttcctctgagtattgtttcaaactcatcgccagacactccctttctatcttcatgtatgtatctactatctctgtcatagaaaataagcatgtaatccctgtctttacgacaaaccatacctctcattataaacaaaagaaatcactttatgccacctttattcccgttaattcaataatttttgccggttgcattggaaatcggcggcaagcgggattgaaacatagaacagccgggagcgtccggccccttcaaaacaaaaaaactgcgccggcatcctgtccgccggcggcagatcaagccgggccagacggcgattttccacccttatttcatcagcattctcgaaatgacgagcttctgaatttcctgcgtaccttcatagatctgtgtgatttttgcatcgcgcataaagcgctcgaccggataatcctttgtgtagccgtacccgccgaatatttgcacggcctccgtcgtcactttcatggccgtatcccctgcgtaaagctttgacatggcagaagcctttccataaggcagtccttctgattccagccatgccgcctggtaggttaaaagccttgaagcttcaatctccgtcgccatatcagccagtttaaaagcgatgccctgctgctcggcgatcggcctgccgaattgcttccgctctttcgcatacgccttcgccgcctcaaatgcgccctgggcaatcccgacggcttgagcggcaattccgtttctgcctccatcgagcgtcttcatcgcgattttaaagccttcaccttccccgccaaggcggttttttaaaggcacgcggcagtcctgaaagatgatttcggttgtcggtgatgaacggatgcccagtttcctctctttttttccgacagaaaagccggggaagtccttttcaacgataaaggcggttgtgcctttgtgtttctgttccggggcaaggttggcaaacacgatgtagaagtccgcgattccgccgtttgtgataaagatcttcgtcccgttcaaaatatattcatcgccttttttttctgcggtcgttttcatgccgccggcatcggagcctgaaccgggctccgtcaatccgtaggctcctatcttttcgccgcgggccatcggctttaaatattcctgtttctgttcttctgttccaaatgcataaatcggccagcccgcaagcgatgtatgggcagacaaggtgacacccgttgaggcgcagactttcgaaagctcttcaaccgcgatgacgtaggcgagatagtcgctgccgattcccccgtattcctctggccacggtatacccgtgagccccaattccgccatttttgcaaacagttccatgtcaaaccgctcttcctcatcccgctctttcgcagtcggctccacctcgtgatgggcaaagtcgcgcaccatcttctgtatcatttggtgctcttcgctcagcttaaagatcatcctttttccccctttgacaccttataaatgtttaccgatgacgatccgctggatctcgctcgtgccctcataaatttcacacactttcgcatccctgaaatatcgttcagcgctgaaatcctttgtgtatccgaaatctccgagcagctgcacggcctctccggcgacatacatcgccgtttccgaagcgaacaatttggccattgaagcagctttccccgtctgcatgccttgctgtttcaacgaggcggcctggtagacgagaagcctggccgcctctgtcctcgccgccatgtcggccagcttaaaggcaagcgcttggccgttcttatacagctctccgtccggataccgtttttttagaaattgaacggcttcagaaagcgctccctcggcgatacccagagcctgcgccgcaattccgatccggccggtatccaggttggacagggccattttgaatcccattccttcctcccccagcagctgccgggcgggaatgacagcgttatcaaaatttaaagtgaccgttagcgaaccgtggagccccattttctcttcattttttccgatgaaaaagcccggcgtgcccttctccacgataaaagcggaaatgcctcccgttcccgcctccggatcggttgaagcgaaaacaagataaatgtccgcggctccgccgtttgtaataaaaactttcgttccgttcagcacataggtatcgccgcgcttttcggccctggtttttagactgcccgcatcggaaccggcactcggttcggttaaacaaaaagctcccaagtactgccctgctgccagctttttaacgtagtgctctttttgccgctcattaccgtttaaaagaatgggaatggtgacaattgacgtgtgtacagatagaaccgcaccaagaacggcgcttttctttgacagctcatgtatggtcatcatataggtgataaagtcatgaccggccccgttgtacttagccggtatcggaagccccatccagccgcgctccgccattttcttcaaaagagaggttggaaaacggcctttttccatttcaggtacaaaaggagcgacctcctgtttgacaaaatcccttacaaccttctgcatgcgggtctgctcttctgtaaactgaaaattcaagctcacccctccttatgtcggctgcttttcatacgtataaaaccctctgcccgttttctttccgagtcgtcctgcgctgacatattgtttaaggagcggacaaggcctgtacttatcgtcgccaaagccttcatgcagcgtctccataatatacagacacgtatccagaccgatcagatcggcgagagccaacgggcccatcggatggttcatgccaagcttcatgattccgtctatgctttctttctcggcgatgccttcataaagtgcaaaaaccgcctcattaatcatcggcattaagatgcggttggagataaatcccgggaaatcccgcacctctatcggaaccttgttcatccgctccgccgcagccacgacggtttcatatgtttcgccgctcgtctcaagccccctgatgacttcgacaagctgcatgacgggaaccgggttcataaaatgcatgccgatgacgttttgaggtttttttgtgacggcagcaagttccgtaatcgacagggacgatgtatttgatgccaatatcgctgagtcttcggtcacttcatcaagccgcgtgaaaatgtctttttttacgtccatttgttcaacagccgcttcaatgatgagaaaagcttcccgcgcttcgtcgagcgcagccgacggagaaaggcgctggtagatttgcttcacatcttcatgcggcagcttgcctttttccgcctgtctgaaaagctggccggaaatgcgcttcattcctttttcaatttgttcaggtgatacgtcatacatgtaaacattgtatccggcctgggcagagacctgagcgatcccggaccccatctggccggctccgatgaccatgatcgtgtcttttttcatctgaaatccccctttttatacctcgatcatcacggcgtctccctggccgccgccgctgcaaatggcagcaatccctataccgccgccgcgccgttttaattcgtacataagcgttaaaatgattcttgctccgctcgcgccgatcggatggccgatcgcaatggcgccgccgttgacattgaccttctccatgtcaagacccgcgatctttccgcttgccaaagcaaccgcagcgaaagcttcattgatttcaaacagtttgatatcagaaagctcagctcccgttttgttaagcagttctctgatgacaagcccgggggttttcggaaagtcttttgcttcgactgcaattgatgtgtgcgctttaatgacggccggcgccttcacattgagttcctttgccttgtcttcattcatcacgataagtgagcatgccccatcatttacccccggcgcgtttcccgccgtaattgtcccattatggtcaaaaaccggggcaagctttgacagcctttccattgacgtgtcgcgccgcggtgcttcatcttgatcgaccgttaattcgccgtcccgcttctcttggatgctgaccgggacgatctcttctcctagcgcgcctgaatccgcagcgtgtacggctcgcatgtggctcctgagcgcccaccgatcctgctcttccctagcaatctccaactctttcgcagcggcatttccgtaggagcccatgtgaacgcccgtaaatgagcatgtcagcccgtctgcgatcatcaaatctttaaccgccccgtctcccatcctcagcccccacctcgctttttgaagcaaataaggggcgtttgacatcgattccatacctccggcggcaatgacctccgcatcaccggccctgatgatctgatccgccattgtgacgcttcttaaacctgaagcgcacactttattaatcgtttccgttttgacgtcccacgggagtcccgcaaaacgcgcggcctgcctcgacggcagctgcccctgtccgccttgaagtacggagcccatgatgacttcatcgacatcctcaggatttacaccggaacgttttaatgcctcttttacggcgattccgccgagctccgcagccgtctttgactgaagcgcgcccccgagttttccaaaaggcgtgcgtgcgccgcctgcaataactgatctcgccacctgacatcctctccccttatcatgatttgtacataccgaagataaaagaaggcggagatccggctcacaccttctttatttaaaacctgaaatccgtctatgaggcatgttctttttgctctgacccgaatacggcgcgttcaagcagctccgctacatcatacgtgccgacctgatcctccaattccttggcttttgttccgtcgccgagcatcgtcaaacagtaaggacagcccgagctgatgacagaaggtgatgtgctgagcgcctgctccgttctggcaacgttgatcctcgcgcccgcctcttcctccatccacatgaggccgccccccgctccgcagcacattccgttttcacggctgcgctccatttccgctaaacggatgcccggaatggagcggagaatagcgcgcggcggatcgtaaacctcgttgtagcggcccaaatagcatgaatcatgaaaggtgacggtttcgtgaaccggaaactcaggtttcagctttccttcttcaatgagggcagcaagaatttctgtatgatgataaacttccgctttcagaccaaaatcaggatattcatttttgaaaatattgtatgcatgcgggtcgatagttacaattttttgaacatcatttttttcaaattcctcaatgttttttgcagctagctcctggaataaaaactcgttgccaagccgtctcggcgtatcgcctgaatttttttctttattgcctaatatcgcgaacgtgaccccggcttgattgaggaggcgagcgaaagccatggcgatcttctggcttctccggtcatacgatcccatcgacccgacccaaaacaggtattcaaaggactcgccttttttcttcatttcttttactgtcggcacctcaacatcgtctcttatatcacgccagttttcacgttcttttcggtttaatccccaagggttcccctgcctttcaatgctcgtcatggcgcgttgggcatctgcatccatttttccttctgtgagcacgagatagcggcggagatcgatgatcttatcgacgtgctcattcatgaccgggcactgatcttcacaattccggcatgttgtgcaggcccaaatttcttcttctgtgatgatgtcgccgattaagctcgggttgtaaagttctgaagcagccgcttcccttgacccttctccccctgccgccatggccagctggttgcctttcgtatgctgaaagagcggtgcgggtacccaaggcgttctcgatgtcactgctgctcccttttctgtcaaatggtctctgagccgcaaaatcagatccatcggcgaaagcatcttgcctgttcctgtagccgggcacatattggtacagcgcccgcattccacgcatgcgtaaaggtcgatcagctgggactgcctgaattcctcgatccgtccgacgccgaacgtttcttttgtttcatcttcaaaatcgattttttgaagctttcccgggtttgtcagccggctgaaaaatacgtttgccggtccggcaattaagtgggcgtgctttgactgcggtacatagactaaaaatgtcagcaggatgagaaggtgcgcccaccacgccgcgtagaacactgccgctgaagcggtttcccccataaagccgaaggcaaaagcgatgcctgatgccatcggttcgtgccatgataatgaatgttcatgccagatcatgttcataccgtttccgagtaaaacggtaaacatcaagccgccgatcagcatgagcacgatccccgacttaaaattgcgcttcagcctgacgagtttttctatataccgcctgtgaaaagcccagactaccgcaattaaaatcatcagtgtgacgatttcctgaaaaaacgtaaacgccgggtagacgccgccaagcggaatgccttgatcaggaacgagccctttcaaaataaaatcgatcgctccgaactgaacgagaataaagccgtaaaaaaacatgacatggatgatgccgctttttttatctttaagcagtttcttttggccgaacacgttctcccatatcttttgaaggcgctccttcgtccgcttatcaaaatcctctttttgtccgagcctgatgtaactgattctcgttctgatcaaatagacgaacagataaacggcgtaaacggttacacctaaaaacgcaatgaaattcaacgacagcaagacattcatcagctgctccccctttcatttccccaaccttaaatccccttgaactacctttatcttaaataatgaatgagtgttcagtcaatatattttcataaatgcaggaaaatagggggacactattctttacacgaaaaaagggagtgtcttcattggtgccgcttatgattatggtatgttttctcatcctgcttcttgcgctcgatttccattttggccgcaaagcctttgagaagaaagcctacgagcccgttttttcagagaagaaaagcgatattgaactgattcataatggagaagacttgtgtgagcggctgctggatgacatccgccaggccgaatcgtcggtgcatgtcatgttttatattgtgaagaacgatgacatcagccttgaatttttgaaggtgctgaaggataaagcgaaatccggcgtatgcgtacgattgctgatcgaccggatcggcgcgatgaaggtgaagaaaaaaacgctctccggcctgaaacaaagcggtgtgcacgtttttttcgccaacaagccgggcttcccctatttcttttaccggctgaatgcgaggaatcatcgaaaaatcgccgtcatagacggaaagatcggctatgtgggcggatttaacatcgcgaaagaataccttggtaaaaaagcggaattcggaccgtggaaggattaccatttgcgaatgacgggagaaggcgttgccgacttgcagcacatttttatatcggacttcaaaagagaagcgccgcaggcaaagccggccaacagcgtatttccgccgctgcagcaaggagctgtcacccatacaacccatgcgacaaagggattttctctagaggaaaaatacatttcatttatcgaacaggcaaaagaaagaatcatgatttgcacgccgtactatattccgagcccggctttgcagcaggctgttctctcagccagggaaaggggcgtgatcgtgtcggttctcgtgccgatgaaacccgatcatccgcttgtcaaagaggccgcctacacgcactttccagcccttttaaaagcgggctgctatatttaccggtactacagaggcttttatcatgcaaaagcattaatcgtcgatgaccggcatgtgatgatcggaacatcgaattttgacaacaggagcctgtttctcaatgatgaagtgaatgtcgtcatccatgataaagactggacaaagcaattcttcgacgtcgtcaaggaaagcattgaacacgccgagcttctgacaaaggagcggtatgcgaagcggccggtgatgcagcggcccgtcgaatggctggcgaaatcgatttcattctttttataaaacgtacgtttatcctgcatgacatgcgggtaacatttcaccaaagtgatgattacatacggaggggatgtacgatgaaccaagcagagtcgattaaactccgcgcccaatcgatgacgttaaaaaacttgattgagctgtacaagctttgccgctcagccagacatcagctatatatatgctcaagaaaaacgatgtgcaaaatcaaagatttaattgagctggaaatgttcagaatggccaatcgcgaaaatgagtgcctgattgtcatcgaagggaaaatggcgcaggaattagtaaaaaaagcacaatcgattctttctgacgctcaagttcaataagggaaggcggaagttcttcctttgcgagacgcctcctcaccaaatcaagaaaaaatcccccgttcaatggacgggggattcgttttacattttttcaggcgctgatacgccgatcagcttgagggcattatttaatgtgatttgcgttgctttcatcaatgataaacgggcccggcttttttcttcatctgccggatcgaggactttctcagcattgtaaaagctgtgaagcacagatgccaattcaaaaatatagtttgtaatgcggtgcggaatccgcttctctgcggcatcagcgacggcctcagggaacgagccgatcactttaagcagatcatactctttctcagaaccgatcttcgtaagatcaaggttcccttcaaaagaaatgcctttttcttcgccttggcgcagcatgctgcaaattctcgcatgggcgtactgcgcgtagtaaactggattctcattagatgttgagacggccagatcaaggtcaaagtccatatgggtatcggcgctgcgcatcgcaaagaagtaacgcacagcgtcaaggccgacctcatcaataagatcgcgcattgtgacggcttttccggttcttttgctcattttcattttttcgccgtttttgtaaaggtggacgagctgaatgatctcgacctcaagcgtttctttgtcataaccgagcgcttcaatagccgctttcatgcgcgggatatagccgtgatggtctgctccccatacattgatcagcttttggaagccgcggtcaagcttgtctttgtgataagcgatgtcaggcagaagatacgtgtaggatccgtcttttttgatcagcacgcggtctttgtcatcgccgaacgccgtcgagcggaaccatgtcgctccgtcttcttcatagatatgccctttttcgcgaagggcttcgagcgcctgatcgatctttccgttttggtaaagcgatgtctcagagtaccagacatcaaatgggacacggaaattctccaggtcttcacgaagtttgcccaattcgtactttaagccgtattcgcggaaaaacgcgaggcgttcgctctcttcttcatgaacaaaacgatcgccgaattcgtcggcgagcttttggccgatttccttaatatcttcgccgtgatacccgtcttcaggcatcggcttatcttttccaagcgcctgaaagtaacgggcttcgacggataacgcgaggttgttgatttgattgccggcatcgttgatataatattcgcggctcacttcataccccgctttttcaagtacattgcagagggaatctccgacagcggctccgcgggcatgtccaaggtgcaggttgcccgtcgggtttgctgagacgaattccacctggacgcgttccccgcccccgatatttgtttcaccgtaggcctctcctgcttcaagcacagccggaatcagcttcgttaaatattgattgttcatgtagaaattgataaagccaggtcctgcgatatcaagtttgtcgatcgacgcttttcctttgtcaaaggatgcgacgatttcttcggcaatattccgcggcgcttttttggcgattctcgccagctgcatagccatattagtggaatagtcgccatgcgacttgtctttcggaacttccagtacgacttctggaatctcgctttcttcggcgaggccggctttcatgacagcttccttaatttcctgcttcagcacatctttcatttgttcgactatgttcatgactcgtgtcctcctctatacgaaatcgacatcttatgtaaatgcttttgttcatcgcttacaatcatatcgtactcaatgctgatctttccgtccggcggctgatgtgtgactgatacagctttagtatccacgccgagctcgagtctgccgaatggcattttataatgagtgacggtgcggctgcccggcctgaagcgctgtttcatttcgatggcgccggaacgcatgaccagaacttcgttttcacttgccttgacgatcgacttcacctttccagcatcatgctcttcatgataagaaagatatattttatcttttttcatataataaaatccagttgtccggaactcgatcgtctccgtgtccgatccttcccggataacagatttcacatagatatgaacgggtgtctcctgatccattccgacacttcctttttcgatccgatttgacttgattagtataatcattcgggaaaaaaagttcaaccgcagctcctttatatcatcttaacagaacggacgggaagataaaccattttctaagaaaaaagccgtcctgaaaaaaggacagcctgttttatttcacccagccgagcagcatttcgcgaatcagcttgcttgccgtatttgcggtttgttccgaatggtcatagacaggagcgacttcgacaaggtctcctccaacgacattgacgtctgagcgggcgatttcgtgaatcgaagcgagcagctctttggatgtgatgcctccggcgtcaaccgtaccggttcccggcgcatgcgcgggatctaagacatcgatgtcgatcgtcacataaaccggacgccccgcgagtttcggcaggacggctttaagcggctcaagcacttcaaatttagaaatgtgcatgccgttttcttttgcccattcaaattcttctttcatgccggagcggatgccgaatgaatagacattgccgggtccgatcagttccgcggctttacggatcggcgtcgaatgcgagagcggctctccttcatagtcgacgcggagatctgtgtgcgcatccatatggatgatggcaagatcgggatattttttgtacatcgctttaatgaccggccatgaaacgagatgctctccccccataccgagcgggaattttcctttatctaaaatgctgtcgacatattcttcaatcatgtcgaggctcttctgcgggttcccgaaaggcagcgggatgtcgccggcgtcaaagaaatgaacctcttccagctccctgtccaaataagggctgtattcttcaagtccgatggacacctcgcggattctcgccggaccgaagcgggagccgggacggtagctgaccgtccaatccatcggcatgccgtaaaggatggcgtccgcctcttcccaatcggggcggcttgcgataaacaccttgccggaatatgcttcatcaaatctcatcttcaaaaacctccctgaaaaaaagcgcagaatgccatcctgcgccaaactgttttatttgattaaatcgctgacgaatttcggaaggacgaatgccgctttatgaatttcttttgtgtagtatttcgtctcaatatcaaagaagcggctgtcctccacttcaagaggatcgtattttttcgaaccgatcgtaaacgtccacaatccgcttggatatgtcggaatgttggccaaatacagctttgtaatcgggaagatctcttttacatcgcgctgaacgtttgtgatcagttcaggtgtaaaccaagggttgtccgtctgagcaacgaaaatgccgtcttcctttagcgcttttgctatgccggcgtaaaagccttttgtaaacaagttgacagcaggccctactggctcggttgaatccaccatgatgacatcgtactcattttcagattgggcaatgtgcatgaagccgtcatcgacttttacttcgacgcgcggatcgtcaagtttgcctgcaatggaaggcaagaatttcttggaatattcgatcaccttgccgtcaatatcgacaagcgtcgcttttttcacgctcggatgcttcaaaatttcacggataacgccgccgtctccgccgccgaccacaagcacatgctcaggattcggatgcgtaaacaggggcacgtgcgccaccatttcgtggtagacaaattcatctttttcagatgtcatgaccatgccgtccaaaaacagcatgttgccgaattcttcagtctcggccatttcgagcttttgaaaatctgtctgctctgtatgtaaagtcctgttgattttcattgtaataccgaaatttttcgtttgcttctctgtataccaaagtccgctcaaagcgtcatcttcctttcgtgataagctgtatttcaatctatttttctcgcctgcggcggcgattattctgcactgaagcatcggcttttgcctaaggaaaaagtatagaggaattgcaggtgattgtaaagacggatcgattcattttcacgagtcattccaagtccattatattcccaatcgccgatttttcttttataatggctaagctaagcacagatgtgcatactgtgcgcttttggaggtgtgctcatttgcagagcaaacaactgctcaaattgtatataaccagccgccggaaaaggtttttattgatattttttctgatcggagcggccgttttgtttttcagccccgtttatatccgggaggctgccgttccgtctttgccggattggcttctcgaagtcagcggatctgtttatttgatgcatatggtcgctgtcctgtccgcagcctgtttgttctacggcacagcgaatggatgcggcgttcagcaggtgcaattgcaacaaacagaacggtgttgccgttgattttgctcggctgcaccgtttctgcttttgtgatgatctgcctgctgttttggagtgcggccatcggctggtttacattcggcggctacggtgcggagaatgttcatcctttttttgagctgtcgggttctcccctctggtttgttgtctcacgcctgttcattgactggtggtcgctttgctttctgatttttctcggcttggcgggagtgctgatcgcaaagaaagagcagcttgctctatggctgccgcttgcgtggtcctcgggtttaatgctccttttcaaattcaatatatcctttaaagggctgctcccgggggaaggcatgctgttgtccatccatgcagcaggagcttccccgattctggccgcatcagtcagcgaaggtgcagttttcgtattatggctgatttcatatgtggcgaccgccaaaaaataggattcctcatattgctgtcttaatctccgcagagggtctgccgttttttccttcccgcttgtttaaatcctcctctttttcctcataatgataagaacattttatttatccgggaggagatttgaacatggacataatgacggacaagcgggtccgtttaaccatcaagacgatacgcgcatttttgttcatgggagcattgatgctgatcttcctttcaatcgttgtcatgacggtggtcttggcggccaaatggcaaggcgctccttcgattcaggtgccgaggtctaccgtgctgtatgacggaagcggaaagcaaatgggggaaacgcattacgggcaaaagcggtactgggtttcgctgaagaacatcaatcccgcagtcatcgatgccacgcttgccgttgaagaccggaactttttccggcaccacggctttgactatatgaggatgggcggcgccctcattgccgatttaaaggcgatgtccaaagttcagggagccagcaccatcacccagcaatatgcgagaaacctctacctcggccacgataaaacatggaaaagaaagtggaatgaagctttttatacgataaggcttgaacaaaactacacaaagaaagatattttggaaggctatttaaatacgatttattacgggcatggagcatacggaatcgaagcggcttcccggctgtattttggcaagcgggccaaagatatcaatacggcggaggctgcaatgcttgccggcattccaaagggtccttcagtttattcgccctttgtcaatgaaaaaaaagcgaaagaacgccaggaaatgatcctgacaatgatggagaaacaaaacaagctgacggaaatgcaggcggcagcactgaaaaaaatgccgctccgctttgaaaaacaggataagcaaacaaccgaaaaaaccgctccgtacttttatgacgaagctgttaaagaaatttcgcgattgctgcgtttgacgccggagcaagcggaaacaggcggctacaacgtattcaccacgctcaacccgcgtctccaaaaaattgccgaggatacgatcgaacacacgatagattcgtcatccgacattcaggcgggatttgcagcgatcaacccgtccgacggcagcgttctcgcgcttgtcggaggacgcgactacgaaaaaagcccttttaaccgcgtaacgcaggctatgcggcagcccggctccaccatgaagcctttcctttattattcggcggttcaaaacggctttacaccggccacccgaatgaggagcgcggaaacgacatttgagctcgggcaaggcagcgcttattccccgagcaactatcacggctattatgcagacggtccgatcacgcttctgcaggcactggctttgtccgataacatttacgccgtgaaaacccaccttttcctcggcatggacaaactgattgatgccgcaaagcaattcggcatcaacagcccgctgcaaaaagtgccgtcgcttgcgctcggaacatcccctgtgaagccgattgaaatggtgaacggatacgccatgtttgccaacggcgggaaaaaaatcgaaccttcctttattacgaaaattaccgatccgaacgggaaggttctttatgaaaaaccgaagcggagcaaacaaatccttgacccaaaagcggcttttatcacggcgaacatgatgagcgggatgttcgacaaatcactcaacggctatacatctgttaccggccggacgatcgcagatcagctgacgcgccgatacgccggaaaatcgggaacgaccagcaccgacagctggatgatcggcttttatcccggtcttgcttcaggcgtgtggacgggatatgacaaagagcggacaatcgatgccgtcgcagagaaaaactatgccaaacaaatttgggctgagtttatggaaaaagcgcttgaagacgcgcccgccgcagctttaatgccgcctgaaggcgtgaaagggatgtacatcgacccggctacaggttatgcggcggcgcccagctgcccgtccaaatatttcgcttattttatcaaaggtactgaacccgagcaggtttgctatggaaaggaaatctataaggagcaaaacgccgggcacgaaaagcccgccgctcccccccataagcggcaaaagtggtgggaaaaatggtttaaaaaaggagaataaactttttagggggatagacgaaccccccggacttcatggcagtccggggggtttttcctattgctggagcagtccctttttcagctcgtctgatgaacggtcccaaagcccttgatcatggtttttcagaaaatcggcaagaacgcgcttagaaccttcatccatatgctcgacgataatcttccgcttcatcgacttatccattaaattgacgtgctccggaagcgatttgtagccgcggcggatgcttctgtcgaccgtcatttcgcatgccgtcacacccgcataataagggccttcttccctgcggtcgatcgtaacccacacaagccagtaaggttttccgttcggcacctcttctttgttcggcaaaaatttgattcctttttcaaccgtgctgcgggcgtgcatggcgccgatatccacaaacgcttctttctcttcaacatcgacaatgacaggcgagatgttgtcaaggcttaatgcgcctgctccaaatcccccgtgtccgtctgtcggatcgcttttaataatgttgaatccgattgtttttttcttttttccttgttccatcaaaaatacctcctacatcagcggccggaaaacgctgttaaatatcgatatgatcaattcccgcccgtcattcaaaaacggccagaatacatattggccaagcggtgtaatgacgataatcagaaagacgatcgagccgtacgcctcatatttcgacagcttcgcccgcacttcgggggcgaccacatcctgtataacccgaaaaccgtcaagaggcgggaacggcattaaattaaacagaaataaaagcaggttgagattcacccaaatcgtaaaaaattgaagcaaaccgctgtaaaaaccggcaggcagcgtcccggacagcttcacggacaaaagcagcaatataaaaccgatgaaagcaaggatcagattgctgatcggtccggcgattgacacgagaaatccggccagcctcgggtttttaaaataaaagcggttaacgggcaccggctttgcccagccgaatcccaatataaagatcaaaatcgttccaaacggatcaagatgcttaagcgggttgagcgtcagcctgccctgccgtttggccgtctcatcgccgaatttgtaagccacatacgcatgggcgacctcatgcacagtgaatgcggcagcaagtgtcaaaacaacatacggaatcatttccagcggataaataagaaaacggtctaaaatgtggctttccctctttctcatatacaaagatttactatctccagtatactataagagaacctgatgctaaagtgagcagccattttttaaaaggaggaggagaacatatgccatacgtaactgttcaaatgctggaaggccgcacagatgaacaaaaaagaaatctcgttaaaaaagtgaccgaagccgtctccgaaacaacaggcgcacctgcagaaaaaatcgcggtcatcattgaggaaatgaaaaaggaaaactacggtgtcgccggcaaacgaatgagcgatatgtaaaagaaaacggcgttcgccgcttacgcgcgggacgccgtttttattatttataccaagctttgtttttagtgatctggctattgtgagctgaatcccaaacatcgaccgtgtatgcgtagtcgtagttcataatgcagcggattccgcttccttgcgcatcgtggttcaagccgaagttatgggaaaattcgtgggttgcagcttttgccgtgttggccgttccctggtcgaggtttacgctgaaggcgctgccgttcggcttgctgttgtatacgtatgcgatgccgccggcgtcaaaattactgttcgccgtaaatccgacgacgaatttatagctgcgcccgctgaaattgctctgaaggtttgatagaatttgagagctgttgctgcctgaagaggtccaaggcgccacagcttcgacgacaaaatcaacatcgtgatccctgttgaacatgacatccgcctgctcaataatttggacgattcttgtctgccaatcgctgtatttcgcccgatactgagcgtcagccacggcaaggacgctcactttctggcttcccgtgcctgcctgggttgaaaacgaccctttgcccgtattctttttaaacgttttcgttcccgtcacatttcctttctcatccagtattttcgtattgaccgttctttcaatttgaacttttcctttcaagtctttaaaatctttcgctttaggcaaagaatcaatataagttcctcttgcttcatgatcgtgctcgtgctcatgcccgcccgtcttggcggcaccggccgtcacaccgggaatgagactgacggaaagtaatagagataagaataaagaacgtttcttcactgcaaaacccctccttattttttgaacgaatgaaaaattctgctagttatcaaaaaattccttcaattcatccaaaaagaggaaatattgcatacgttcttttcactgcttctttcaatttccctacaaaaattccaaaacgcagacaaaaaaacaaaccaaaaaacctaccgtttttcggcaggcttatgaacaaagatttctgagcttttttatgtaagcgacggcttcatcgaattcttcgtccgtataccgctgtttgctttttacggtaaacactttttctctaatctcttcctgctccagcccctcaaaatacaaaatcgtcgacaccagttccaaaaaacgcgatgactggccgtttacgtcgtctaaataggctttaatatcccgcatatccagctcacactggctcaaaaactgctttcccgcttcagtgggtgaatagcggtattgataatagccgccctttttttctttgacttcatggagaaatccgagattgcaaagttcttcgacttgaagcgtcagctcctctgaataaggcccgtaaaaatgaaaatcatacttttcataaaaaggaagctccaatttctttgcgatataaatgattttctgcagctttttccgcccgacaatctcccccgaatccgagaagaccttcatcagctttgcatgttcttttaacaaatctccgccatctccttcatccttttctttctatttcagtccgagcaattctttcattcttttcgcatgacggccgtcaggcagcccttcgattaaatcgagcgggaaatacagcttatggtccgttctccgcttgcctgatatcgcatcgacaatatcggactgccgcgacagctccttaatctggccgttgtgcgtcagcaattgaatcgggaggcgttcctcttcttcccccggtctgtagaaatcataaggaagatctgaggacgaatccaccacaagataatattcgggatcaatccctgattctttaaacaagttggtcagttcaaagtaagtcgccatttcctcattcggattgaattccgcatactggaacagcctgcggttgataaaacggcggcataaatcagacaaaatttcgtcctcttctttttcccaggcctgaaaataataaagaatgattgattcatcaagacttaaataatcttccaatgtgacattgccttcaaaaatagaataaaaatgcactggcgcatgcgtgaaaacatagccttcctcatgaagctgctttgcacggtgaagaatcttcgtcaaaatcacttccgcacttcttgtcacaggatggaagtagacctgccagtacatctggtaccggctcataatatagtcctcaacagcatgcattccgctttgcttaatgacgatttggtcttcgcgcggccgcatgacgcggagaatccgctccatatcaaaatgaccgtagctgacgccggtgtaataggcgtccctctgaaggtagtccatgcggtcagcgtcaatctggcttgagatcaggctgacgacctgcttattttgataggttttcgcgatgacttcagcgacatcctttgcaaatgtcggacttaccttgtttaatactcggttaacttctgtatcgcctaaaatgatcgctctcgtaaagtcttcatgatcaagccggaagaccttttcaaacgaatgggaaaacgggccgtgccccaaatcgtgcagcaatgcggcgcaaaggcacagatcgcgctcgctgtcatcccattcctccctgcctttaaaaacgtcatcaaccattcttctgacaatttcatagacgccgagagaatggttgaaacggctgtgttcggctccgtgaaacgtcaaataggtcgtcccaagctgtttgattctgcgcagcctctgaaattcgcgggttccgatcaagtcccatatcagcttgtcccgtacgtggacatagcggtgaacaggatctttaaacactttttcttctgataattttccgtttggatacgccatttttgtccctctttttttcaaacgtgaggcaaactgatcgctgcccatccgtctctttttcttcggaaaactaaatgtatattgtaagtattgcccgatctgcttgttttctttaaggtctgcttctattatatcgagtctgtttttttgaaaacatccttgaatttacccggccatttgttccagcctgccaaaaagccgttaaacaagcaaaaacgcctgacccgttagggaggcggttattttttgagtttctttttcactttttcgatcagctcgtcttcatcaggagctgacagcggacgattattgacaaacgcaaacgatttttttcgtcccggcccgcagtaagactggcagccgatttccacttttgcatccggatcaatttctttcagacggggcaaaagcgtctttaaattggtggcctggcaatcgtcgcatactcgaaattcattagccatttcatacgcttcctttcgttttgttcatctgtctttatgaaaggcattcaactgtgccgaacttttataaaaaatgacaccatccttcattttacaaggattctttcattcctgcaaggatcgcgctaaaaaaatcagttcctattcttttagcaaacttgtataaatattttccaaaatggacaatctaataccaatactgacaatgggagttgagaagtgatgaaacaaagacaagacgcttggtctgaggaaaatgatttactgcttgctgaaacggtattgcggcatgtcagggaagggagcacacagctgaacgccttcgaggaagtcggagacagactgaacaggacatcagccgcctgcggttttagatggaacgcagttgtccgccaccaatacgaaaaagcattgcagctggctaaaaaacagaggaagcaaagaatgcgcgccctcggaaacggacagccggcgaaaaaacgcttattatacaagccgccggtcgaaacgaatgctgaacctcctgcagaaagcgttgttgagcagaagaaagcaaccgcagattcaagcgaacagcagccgatcgccagcgagcatctgccttatgttgatgagagctttaaagaagagttagctagtttatctcaccttctatcgccaaatcagccgcaggccggccatacagccgatacatcgaaagacatgacgatcgatgatgtgatccgcttcctgcaaaactatacaggaaacgaagaacaaactgccgctttaaaaatggaaaatgaacgtttaaaacaggaaaacgaagaactgacgaagaaagttgaaaagcttgaagcggaagtcaaaaagctggaaaaagaccagacaaccatccaggaagactacgaaacgctcgtaaaaattatgaaccgtgcaagaaaactagttttattcgaagaagacgaacacgctgcgcccgccttcaaaatggaccggaacggcaatttagaaaaaatggctgaatagcgctctcagaggatgcggcagagacgttcaggcagcaaggactgacaatgcatacaaacatttttcgatacgaggatacccctttctttaaaaaagggggtatttttacctttctgcggcttgcttttatatgacaaaaatttcataatagggatagcaattcataaggcggggtattcgatgaagtttgttttatatgcggttcagttcggcactgcggcccttttgtttttgttttctgcattggcaagctggtatcaaggcagcgagcttttaaaggtgccgtgggagtggaaatatacagccaagtttacaagttggctgtacggagaggactccattaaaaacgcacataatatttcacagcttgattttttcgtctatgcggccaagcatacgccggcaaccgttattttaatggccgtcagtttggcgtatatcatcgctttggcggcttatcttctcatcaaaacatatgtaaaacgaaaaagcgcttcgagcgcagcataaaaaaaccgctccggaagcggtgaggtgtggcaaaatcctaaaacgttcaaccgttttaggattttgccgtctttgaagcattttacagcccgctggtttttcaccgctttaagcatgcctgacaacgaatataaaggcggcggaggctcttcttctatccaaaaaccttttcattccgttcaatcatgcggacaaggtttttctcatacacttcctcttctgcgggcgtgagagggccttgataaatctccccgcccagctctttcagctgtgtcagaagcaagagcatcaagtcctgcaccgaaatgtcttcattgagaagctcagaaagcgaagccatcgtttccgggcgaatatcgggataaacggcttttgttttcccgcgcatgtctttcaaggcggtgtcgtaaaagcgtttgatcagctcagcgcgcccgcttccgctttgatcagcgcacaaataaatttgaacagccactccgcctctcaggcgcctctgggaaattcccgcaaatttccttcccccgatgctcaaatcaaagcttcctggacagtaggagcctttgatttcataggcttcgattgctgcgtcataggatgacagcattcgcttaacgagctcaaacatcgcttcatagcctctgtcgatatcaattccgtttttcttatcctgaaaaatcagggaaacgtttaaaaccccgctgtccaaaacgacggccagtccgccggaattgcggacgatggcttgatagcccgcttcttcaagcaatgaaatcccttcttgtaaataagggagccttgtatcctggattccgagcacaatcgtgtcatggtgcacccaggaacgcgcggtcgccggagataaacctttcccgacagaagcgcacagcgtatcatctatcgcaaatgattgttttgcatcaaaatatgggccgagactggattggtcaatgattctccatttcggctggatgagtagatcaatcggttgctttgccatatatagtgtaaaccctttcgttttgcatttcagccaacatccattataccatttacgaaaacatgtggtggaaattttcttatctccggcgcttccttcattcaagtgacgcttaaagacggttctccgaattcaagcggcagcccgacgtaattctcggcaagactttgagcggccgccgttgaagtcgtaacatggtcaagttcagccaattgaatctggtagtcaaaaggggtgtagccgtgatggcgatgcagcagggatgtcatataccaggaaaagcgttcagctttccagacgcggcggaggcaagactcagaatagccggccagccgttcgattcttccggtttcgtaatagtcttcgagcgcccatgcaagccgctggacatccgccatcgcaaggttcaggcctttcgcacctgtcgggggtacaatatgcgcggcatcccccgctaaatagagtctgccgtattgcattggatcgcatataaagcttctcatcgagacaatgtttttttgaatgatcgggccttcagtcagcttccatccgtcatcggccgacagccttaggtgaagcttctcccatatcctttcgtccggccagttcccgactgaatctgcaggactgacttgcaggtaaagccgctggatttccggtgtccttgtgctgacgagggcaaacccgtcttcatgatgggcatatacaagttcaggcgaggacggaggggcttcagccaatatgccgagccatccgtaagggtacaccttttcgtactctttgcggatctccttcggaatgctttgtctgctcggcccgtgaaagccgtcgcaccctgcgatgaaatcgcagttcagttcttctgtatcgccgttttcattctgataagtgatgacaggcgcttctgtatcaatatttgaaaggcggacgtcagacacattgaaaacgatgcgcccttccgattgcaggcgggcggcgattaaatctttgatcacttcatgctggggatagatggcaatgtatttcccccccgtcagcttgtgcatatcaattctgtgccgcttgccgccaaagcgaatctcaattccttgatgaaacatagctgttttcatcatccgttcaccggcacctgtttcattcagcaaatctaccgtcatctgttctagaacgcctgcacggacggtctcttcaatctcctttcgcgagcgggattcgatcacaaccgcttcgattcccctgcggtggagcaggttagcgagcataagcccggcaggtcccgctccgataattcccacttgtgtccgcaaaatggtttcctccctttatccatgttttgatgtggcttctaatgtatacccggcgctttccgacttagagacaaaatcaaatgaagcgtgtttctcttggacgagcatgatgccgagtgcagcaaaaacactcgggatcgcgaacaccatgaaagcctgcttcggctccatgccggaagcaaggatcaatgcaaacagcgaaggcgcaatgatcgctccgagtctgccgaccccgagcgcccagccgatgccggtcgctctgatttctttcggataatactcagaaatataaggattggcgatattttgcgctccgacggtgcatgccccgcctaaggcaatcagcaagtacagaagaacggggttcatcgtcattccaaatgctgcaaaacaaaaggctccgatgacatacatagccgcaagcacatttttatggccggctttatctgccaaatatccgccgaataccgctcctgcggcttgtccgcagcaaagcgccaagttgaatgacaagcttgacgacagcccgtagcctgacgcctgcatcattttcggaagccatgtatttaagccgtaaaccatgagaaggcagctgaaaacggaaagccagaatgcgaatgtgctggctgcacgtttttgtccaaacagtttttttaccggaaagcctttcttttctttcgcaatcaccgagatttgataattgtcgtcttccctgtagcgtcccgccggatgcacctgattgaaaatctcagccagcgctttcgtctttttcttcaaaacgtaaaatgacagagattcgggaaacctgctgaaaaagaacgggagcacgaagagcggcacggctccgatcagatagagcactctccagcttgtcacgggcacggcgaacatgccgacgagggaagccagcacaccgcctgcagaatagccgcaatacatagcggctacaatcaccgctctgttttttttcggcgaatactctgtcatcagcgaaatggcattcggcatcaacccgcccattccaagcgcagcgagaaaccgcatgatcgtaaacaaaagcggagaatcgatcagaccggctgctgcagtaaacaggctgaacagaaagatacagaagcccaacacctttttgcggccgtattgatctgcgatcggcgaaaaaataagcgcgccgagcatcatgccgatcaatgtatagctcccgatcgctccggcttggatggcggtcaggctccattcctccatcagccatggcaggctgacgccgtacattgcaatatcataaccgtcaaaggcaatggcgaaaaaacaccacaggaaaacagtcaggtgcactttgttaaatttgctggccgccatgacttccgctggatgaactgaacgatttttcatgttcccctccacgattcttatcgtattatgaaagcagcttaacgcacggtatctttttcattgaaagcgtgcgtgcgagctttttgtcccgccggctcgaatgccatgacgacattggagctcccggaagactgaccgtatccgtaaaacgtgcttttacatccgtcctccagcacgcccaatagcattgcaatgtggcggccgccggcttcaagcccggcgtttttagcatattgaggcagcatctgctgagctgataaaagatcgttgtctgttaagtaggtcaaaaattgtgcatcgagggcctgttcggccaatgtcggcatacattccggccccctcaccaaatgatggcttagcgccccgctgctgatgaacacggttttctttctgctttctttcagcactcttccggcaagccggccccacaaatgcgtttcttccaggttcgcggccaatgtaaccgataaatcgataaccggaatatctccctttggaacgaggtagcgcagcggaacgaccgtcccgtaatcccagcagtaagctggatcattgacaggaatgacggaaagccccccttctctgccggcttcagccaattgcagcgccaattcagtgtccccggggtaagaatacggaacatcggaaattaaattcggacactccaaagccgttaaaacgccttgatggtcgggagctgcatcgatcagatggtcaaagcttgacgtccagtgacaggaaatcaggacaacggcatcgggctcaattctttcaataatcctggagagcctcttcatgcccttgaccagctctctttggaagtcaggggttttatcttcaaaacacatcctcggtgtatgcggaacaagcgccgccaattcgattgacatgtagattcctcccatcgccttctttaaggtcttaattttgagaccggtgtgccgcctatgccccagtggcttttagaaacttcggtgacaagaacgcggacgttttccttcggagagtctagggtggcgctcaacgtttccgtcacttttcgaatgacttcctcgaccttttcaggcggccggccttctaatagttgaatatgaacaatcggcatatcataatcacctcaggttatggcttgaccgaaaatgatacatctcccagcccttctacttgtgctgaaacgcggtcgcccggctgcagcatgacagctcccgttacaccgcccgttaaaatgatgctgccagccgcaagcttttgttttttccgggagagcatgttggcgagcatggccgccgaatttgcgggatgcccgacaaccgctgctccagtgccccgctctttgacctcgccgtttatcattaaagagactcttgcttcatccagcttgaaatcgtccggcttcttcactttttcacctaacaccactcttgaagatgacgcattgtccgcgatgacgtcaggcaaagtgaatgagaaattttcatagcggctgtcaatcacttctagaacgggaatcaattcagcaacggcttcaaggacctgctcctttgtaacacccggtccttcaatatcctcccccagcacaaaagcaatctctgcttcaaccttcgggtgaatcagctcgttcatccggatgcttccgccgtttggcacgatcatatcttcaaaaatataaccgtagatcggctcctcgacgttcatctgcttcattttcgcccggctggtcagtcccattttcggaccgatgatgctattgccatcccataatttaagctgaatcagctcttcttggatcgcatacgcctcttcaacggtcagctccgggtagtcctttgtgattctttcaacttcacgcttctctgtttcggcaagatacaagagtcgcgccgtatcttttaatgctgcggtattcatccgcttccccccttttacagcttgatgcaaatattggttaattcgctgaagaattcgaggctgtgaatgcctccttctcgtccgagtccgctctgtttcatgccgccaaacggcgtccgaagatcgcggagaaaccagctgttgacccacaccatgcccgattcgatttgcccggctacgcggtgcgcccggcggaggtcgttcgtccataaggtcgcgcttaacccgtaatgtgtgtcgttagcctgtgcaatcacttcctcctcatcgtcgaacggaatcaccgttacgaccggaccgaagatttcttctttgatgagcctggaattgcgtgaaagtccggtgataatcgtcggttcaagaaagcagccggattcctgtccttcatggcgttttcctccggttaaaatattgccgccttcccgtttggccaattcgatgtagttcatcacacgctctgtgtgttcagaagaaatcaaggcgccgatattcgtgtccggatcaaaaggatcgccgactttgagctttttcgttttctcaacgaacttgttcagaaattcgtcatacgcttccctctcgacatagatgcgggagccgctcatacatacttccccctggttgacgaaactcgatttcaatgaggtgctgacggcttcatccatgtcggcatcggcaaaaataatgttcgggttcttccctcccaattcaaaggaaagtttctttaatgttttcgaagcagcttccataatgactttgccggttgtcgtttctccggtgaaagatatcgcatcgacatcgggatgctcagaaagcgcagcaccggcggaatctggtccaaatccgtggacgatattaacgactccgtcaggcatccctgcatcatggcagatttccccgagaagggtggctgtcatcggcgtcagttcagccggtttgataacggctgtatttcccgccgccaggcaaggcgccaatttccacgtcagcaaaagaagcggcaagttccacggattgatcagcccgacgacgccgaccggacggcgaatcgcataattgattgcaagatcgtcagtttgataagcttccgttccggctcctctcataaaatccgcaaagaaatgaaagttgaaagcggcacgtggaatatccaaagtgcttgagagcgaaagcggttttcccgtatccaatgtctcaagcctcgccagttcgtctttacgctcaagtatgatgtcgccgacctttctgatgatccgaatcctttcgtcagcggtcatgtttttccagcgtccgtttaatgcacgcctggctgccgcgactgcaagatcgacctcttttttgcctccttccgcaacgcttccgataatttcctgtgtagccggattgatgttgtcaaacgtgctgcctttctctgaaggaaagtacctgccgtttatgtagtgctgacagtcaaaaggttttacgagtttttccgatggagtttgaacattcatattctgcaaacatcctccttttcaaatcctttccattaaattaaaggattttaactgacaagaaaacagcaatgttcctctatgcggaacaaatcagacattttttccgaaaatttgatattttccgcttttttattttttatatcgtgttatattatggaataaaaggaaacaaaaacaagggagagagttgaggaacctatgactgttgagacgaaggaccaccagctgctcggttcagtaaaaaatgcgcttcggctgcttcaatcgtttaccttagacacaccggaaaagaaactaaccgaactcgcctcgtcgcttggcctcggaaaaagcacggtctcgcgccttttgtctacattggaaagcgaagggtttgtcatgaaggacccggaatccagaagatacaagctcggcttatcggtcctgcagttaaacaccattgtcaactccactcttgaaatcaaccgcgaatccctgccggtcctcaaacggctgaccgatgagaccggcgaaacgtcgcatatcgcgatgcgccgcggtctcagcgtcgtttatctcaatcggacggaatgcccccgcccggtcgaacttctctcatatatcgggcggcaaaacccgatgcactgcacaagctcaggtaaggtgcttctcgcctttgatgaagagggcatattggacgagtatgtgaaggaaggcttgaaaagctgtacgaaagaaaccattacagacggggacaaattgagggatgtgctgaaaaccgttaaagaaaacggatttgacgtcagttgcggggaattcatagatggtgtcacatcaatctcagctcccgtcagaaaccacgcaggtcgagtgttgtacgccgtcagtgtcgtaggccctgcaaaacgcatcaaggcccggcaggcgaaaatcatttaccaagtgaaacaagcggcccgggatatttccgaaaggatcgggtactggaaacgaatataaaaattgggggaatcagctttgtatgatcttcacacgcactttataccgcgcgatgtgctgctttggctggaagacaatgaaaagagagtccacgctgtccgcgaaaaaaaggctggatgccaagcggagtttttgacggtcaatcacaaatggggctttgaattaaaagagcttttctaccaggaggctttatatttggaagcccagcaggaggccggcgtcacacactcattggtatcgccggttccccagcttttcctttacgatctcgccgaagaaatcacggacgaattatcttttgtatacaacaaagcgcttgccgaatgggttaaaaaatacgacggccgcctctcgggactcggcacagtcccgctgaacagcccttcaaaggcgagcgagcgcctgaatgaagcgatgaacaacgggcttaaaggagcgattatcggacccggcgcttcgcaactacttctctcggacgaagcatttacaccgttttgggaaacggctgatagaagaaaagcgattatctttatacatccgctcctttctgaagatccgcggctccgccgcaggatgctgccaaacttgatcggcgttccgtgggaaacgacgatttgtgccgcagaccttttgttaagcgggtttacagaccggtttcgcaatgtgaaaattcttttggcccacggaggcggctttttgccttatcagatcggaagactgaacaaagggtatgacaaatgggccggcgtttcttcatcgctttcggctccgccgcgcgaatatttgcggaagttttggtttgatggtgtgctatgggagcaagaaagcgcggcatatttgaagaagcttgtcggagaagaccgccttgttccgggttccgattttcctttcgacctttgtcagtggccgcctctcgatcccggccggaaaggagcggagtctctgctgaatgtagcgattgaagcataaaaaaaggcgaacctcttcaggttcacctttttcaggaagcctattacagagcttgagccgccgtaatcagcgcaagattataaacgtcctcagcgttgcaccctctggacaggtcgtttacaggcatgttcagcccttgcagaatcggaccgaccgcttcaaagttgccgaggcgctgagcgattttatagccgatattccccgcttcaaggcttgggaaaacaaatacgtttgcatctcctttaatgacggagtccggcgcttttttctcagcgacagacggaacgaatgccgcgtcaaattggaattcgccgtcaagtgtaagctcaggcgctttttcttttgcgattgcaaccgcgttggctactttttcagtttcgtctgattttgccgaaccttttgttgaaaagctgagcatggcgacacgaggttcgatgtcgaacattttcgctgtgttcgcactttcgattgcgatttccgcaaggtcctggctgtcaggcgcaatgttgatcgcacagtctgcgaatacgtactgctcatcgccgcgcgccatgataaagacgcctgatgttttcttcacgccttcttttgttttaataatttgcagcgccgggcgaaccgtatccgctgttgaatgagccgcaccgctgacaaggccgtcggcaagccctttataaacaagcatcgttccaaagtagttttcgtctaaaaggatttggcgggcctgctcttccgtcgctttgcctttgcggcgttcaacgaaagcctgaacaaggtcttccatcccttcatatgtatgaggatcgtatatgtcaacgccatccagcgttaaattcaacccgtttgctttatctttgatttcctgctcgtttcctacaaggatcggctttaacacgttgtttccggccaatttgttgacagctgtaagaatacgctcgtccaaaccttccggaaatacgattttaactccttttcctgctacttttccctgcactgttgtaaatagatctgccactatataccctccttgaaagtgtcacaaatacttcatttctctattaagcatactcttttgtgatataaattcaatccttctgtattttattataacgtttacactttttaaacgctttttttaattaatttaatttcagaaaggctttaaacacttctattagtatataacagcctttcccagttatacgacagatggtcaccttttgttcaaaacttctaaacggataaaacgcggcaaactatgatatgatgaagacaagtacatacaaattgggagtgattgcaaaatgagcgaacagcaaaaaacgaatgaagccgcacaaacgcttgacggctggtatgcccttcacgatttccggacaatggactggtccgcatggaaaatgctttcaagcgatgagcgccagatcattatcagcgaatttaccggccttcttgaaaaatggggagctgcccaaaaagaaggaaacggaagccatacgctttacagcatcgtcggccagaaagcggacttcatgctgatgattttgcgccctacgatggaggaattaaatcaaatcgaactcgagttcaataaatccaaactcgctgaatacacgatacctgcttattcatacgtatccgttgtcgagctgagcaactatatgggaagcggagacggagacccttacgaaaatccgcaagtgcgggcgcgcctgtaccctgagctcccggatgccaaatatgtctgcttctatccgatggataaaagaagatcgggcgatgacaactggtacatgctgtctatggaagagagaagaaacttgatgcgcagccacggaatgatcggacgcggctatgcgggaaaagtaaaacagattattaccggctcaatcggatttgacgattatgagtggggtgtcacgctcttttcagatgatgtgcttcagttcaaaaagctcgtctatgaaatgcgctttgatgaagtaagcgcccgctacggtgaattcggttcgttctttgtcggcaaccgccttgcaaaagaacagctgcctgcatttttgcatgtgtaatgataaaaaagctccaaaggccgaggtctttggagcttttttgcctatttacttgcagttgcacggctgtgtaggcggagtcgcccgtttttgcacttcgattgaagattcggcatagaaagtcgatccgagccccagtactctgttctccgcccggaatgtatactttcctgcggcaggcagcgttttgttggccagcaccagcttaaactccgcaatgcccagcagatcaattgtaagcggcagccttaccgtttttccgttgttcaaaatttgccctgttgtcagcgctcttccattcaccgtatctttcgttgtggcggaaaatcccgacggcaaagtaaattcaaccgttcccagcgccaagattgagttaggacgatatgttaactcaatatccgagaacgaccactcctgtttgctggcgcctgttatcaccgaatacaaggaagcgctcgcagccgggcggtagacagattcagtttttgttgtttgggcgctggcctggaacgaaggcaggaaaatcgaagccatcatcacgagactaaccgccaagattgacaatttagaacgatacattcttttcaacacagcaattcccccaagtcatcatttttttcatattcgtcatgacgaaagcgtgcaagaaagatgtaaaatcaagcaacgccttctttccaaagcgccggcactttggtgatttctattaaaaactaccattttttctgcttgtagtaaatgttttccatgtcatatttttaaaataaatgcaaaataatagaatttaaccaggcgttgttcctcttgattttctccgctgtgctttagtaaaggacaaaaggcctgcccgcttcccttctcttcattctcctgattttttgttgacaaacgatggatctggctgtacattattgacattattgaagcatcacgaaccgagtttatgattgacataaccttgctttttctccattcatgttttgaatggatgaagaaaggaacgaaaaatgcctaaattggtttcttcaaatcttgtaaaaggtaagatcatcaatattagtccgccgcagacgctggctcttagtttcttgattatcattgcgatcggggcttgtttattgaagctgcctggcgcctccactacttatatctcatgggtggatgctttatttacggccacctcggcaactacggtaactggccttgttgttgtagatacaggggcagattttacagttttcggacaaaccgttattatgtgcctgattcaaatcggcgggctcggcttaatgacgtttgccgtcctcgtcgtcatgatgatcggcaaaaaaatcggcttgcagcagcggattcttgttcaagaagcatttaaccagacttctttaggcgggcttgtccgcttggtcaagcacctgtttattttcacgattgtcatagaatttgtggcgtttctgatcctttcgatcagatgggttcctgaatatggtttgcaaaaaggcttgtttcatagtttgtttaacacgatttcagcctttaacaatgcgggattttccctgtggcctgacaacttgtctcaatatgtcggcgatccgattgtcaaccttgtcatcacaggccttttcattacagggggaatcggctttaccgttctgctggatttatggacaaagcgaaacttccggaaattatcgctgcattccaagctcatgatcgttggaacattgatcatcaatacgacagccgcgttgctgattttcattttagaatactcgaatccgggtacgctcggcggactgcctttggccgacaaaatgtggggcgcttacttccaaggcgtgacaccgagaactgccggattcaatacgcttgatatcgcccagatgacaacgccgtccctcctgttaatcatcgttttgatgtttatcggagccggaagtgcgtcaacgggaagcggaattaaactgacaacgtatatcgtgatgatcttggcgacgatcacctttttaagggggaaaagcgagacggttgtgttcaaaagggcgattaagatgaaaaccattttaagagctttagccatcattgtgatcagttttttattcgtgcttttcgcattatttatattgacgatcacagagaatgccccatttttgaaaatcgtctttgaagtattttccgctttcggaacagtcggcctgtcgatgggactgacacctgatttaacggccgcaggcaaagcggttatcatgatgatgatgtttatcggccgcgtcgggcctctgactatggcgtttacgctggccaagccgaagaaggcgccgatccgccatcctgaagatgaagtgattacaggctaatatgcagaaagaccgctctattcacgagcggtctttttgtttttctctttccaacatgatgtgtcgtcatattccctcccgcccgttcatactgtaaaagggatgggaaatattgatctatcatcttgagtcagcccacagcttttcagccggatcgtcttcatagcagcactttatcattcctcatgtatagatggtaggcatgactttgacacaatgaaatgaggaggaacgagatgaaatttaaaaaaaatcagtttcagccgcttcaggagcttgagatgccggatttccggcagcaaatgggccccaatccttatccgcagatggggcagatggggcaaatgtaccagcagcagggacagcagcctttcacccaaatgggagggcagcaatcgtatcagcagcccggtccccagctgacccagccgcagccggcaggcgtccaggtccctccaatgccttcaggacagcagccttcaccgagcatcccaggcatgctgccgcttgagcaatcctacattgaaaacattttgcggctcaatcgcggaaaagtggcaaccgtatatatgacattcgaaaacaatccggaatggaatgcgaaagtctttcggggagaaattgaagcagccggccgcgaccacatcattttaagcgacagaaaaacgggcacacgctatttgctgctcatggtgtatcttgactatattacgtttgatgagccgatcacttatgattatccgtattcaatggcctcatatacaccaagataaaggttcggtttaactaagccgaaccctttttttatagatgttaagcgaagtttctcacatcattattgcgtttgaatttgtaaatgacgatgaggaaaaagacagcagcgaaagcaaacagaatcatgatattcaaatacagaccttgaagctgctgtccctcctgcaattttgccagcgtatccaacacccaccgctgcggaagaaagtccgcgattcgctgtgcgaaagacggcatgatttcaaccggccaaaaacatcccgacagcatgatcgtcggcataaaaatcaaatttcgcaataccccggatgacctggagctgtttgcaaagacgactgtgatcaatgccaggccgaccgcgctcagcgcaaagatcagcagcaccgctgccatctcccaaaatgagatgccggtttccatccggaaaacatatttcaccataatcaatgttaaaaaggtttggcatgtgatgacagacatactgacggccacattggacatgacgtactgccttgccgttatcggtgtggtcaaaagcctgaaatacgttctgttctctttttcctttactaacagttcggtcaagcttcccgctgaaaaaagcatcgccatcagaagaaaaccgaccgtccgctccgtcatgtttctatttttcgccgtgtcttcaatcgtagatgttttgacactcgtttcagaattccggtaatttttatacatttcctcaaagcgcttttcattcccctgcgccgatttgccgattgcggcgatattatcaatataatgatagacatacgatttcacgaatccggtgatttcagcgcctttgacagatgcgattgcgatgtgagccggttcgccgctctgcacgctttgagaaaagccttgttcaaacgtaatgacgcaatcaagctcccctgccgcaacttgacttttcccttctgcttcactgaccgcactgatgttgacattctcgatccccttcaaaaaatccttagtatcttcggcgattcgtccgccgtcatgattgatgattccgacgcgcaaatccgtcttttccatgcttccctctgtcaaaagcgatacgaatatgcctagcaagggcagacatacaaacagaaagatattgatcttctttttaaaagtgacattcagtgtgtttttgacaagccatagcatttctttcatcctacagcccctcccttctctgcaatgagacaacggcaatcagcagaaataacagggataagccgatgttcagcaagatggcaggcagccctgccgctaaatcgtccgcaaatatgatgttcataatagcttcgttcgtccaggcgagcggagacaggtctgtgatcaaagctaaaacaccttccgcatcgtcgacaggaaaataagcgcccccgaaaaatgcaactagcggaatcaacacgttaatgatcgccactgccgcttcccccgttctcgtcaaataactgacgccgaggccgaggcatacggcaaacaatacgatgctgaacagcacggccgctacaagcccaagatgctctccccagtacgctttaaatacgtatttgctgactgcgacgacggcaaaaatacacaatccgtttgtcacaagattgccgatcagcttacccgcaaagatctcgcctttatgaaccggtgccgcgatcagccggtcggctgtttttctaagccgctccccccttattaaatagctggcgcttaatgcactgtaaagcgcgatcagagtggtcatggcaaccgcataataatccatggagctgggctttctgtctgagctgagcgacgtctccttgatataattgtcgcccggtgcgtccccgagcacggcgcccgcttgctcaggagcagctttgatgatctccgctgcggcattgtaccggtttgcaaacgcggtcagcattccttgaataatgctgtttttcatactgtttttatccatttggtaaagcttgatgccgctgttttcgatctcaagataagcatcgtagttcccctgtttgatttcttgtttttcatccatatcggacaacacttttttaaaatgaacgccggatgttttcgcttcctttacgaatgttttaaagccttgcgaaaacgctccgtcagaattgtctttatacaaaacacgaacctcgccgaccgctgcttgttgatcgaaagcattcgtcagcgcagtgcctaaaatcataatcagtacaatcggaaatgccagcataaaaaggaacgtccgtttgtcccgaaaagcagatacaatttcttttttcgcaatgatgagtgtattcaaaccttggacctcctttctaatcgcgcaactgtcttccggtcaaggtcaggaacacggtttccaaattaggcgctttttcttccaatgaacgaatctcggccccgtttttcatcagcttttcaataatctggtttaaattattgacgcctgcatccgagttgattttgatcgtattgtcttcaagaacggccgcttccacgccgctgatcgttttcagttcgccgatatcgatattttccgcagatttaagaacgacttgaatatcttttgtgttggtaatgatcgatttcagctgctccttcgttccctcggcgataatttttccgtgatcaacgatggcgatccgagtacagatctcttcaacttcctccatataatggctcgtgtaaataatcgtgcatcccatcgcatttaactttttgacggattccaaaatataatttctcgaatgcggatcaattccaaccgtcggttcgtccatgatgatcagctttggcctgtgggcgatcgcgcaggcgatattgagccttcttttcatcccgcctgaaaaatttttcgggaagcttttatgcttatcacttaaaccgacgaactgcaatgcttcttcaacccgattgtgtaaatgggccccgcgcagaccataaagcccggcaaaaaatttcacatttgcatatgccgttaaatcttcgtaaatggccagatcctgcgggacaatgccgatgttcatcttggcgaacttgcggtgtttcgcaatgttttttccgagaatcgtgatctcgccttcattgcttctcaacaaactcgaaatcatgtgaatggtcgtactctttcccgccccgtttgcgccgagcaatccaaatatttcgccctcttcgatcgagagtgatatattgtcgacggcaacgaagtcgccgaattttttcgtcagatgatggatttccaatacattcatgttctcacctcattttgatttcattataaaaaaaagatgaatggtgcggcagtgcagcatttcatctttttcacatgagaaaattcatattcaattcatgaaatcattcatgcttgggcagcagggtggtgacagagaagccgtttgaaccgtcaacgatcacctttccgttaacagaagcggcccgttcctccatcccgatgatccccatccctttcttgattttctgccgcccttttccgttgtctttcacttcggctttaatgagcgtattcagcacatgaatacagatggatacatgtgtcgcttcagcatatttcaccgagtttgtcagcgcttcggtgatgttttcaaaaataatcttccattgaatctgagaaataacatccaaatcgcctttatgcaaaaatgaaatattcatatggtactgcgccgaacattcatcgataaacagcctcaatctgtggatgcccatctgttctgagggcggcttgacgctttttaacgtcaatctaatattttcgatcccgtccttggagatgttaatcgcattttgcaggagctctgaagctttttccttgtctatgtcaaggacgcgcttcgccgcttcgagctgaatcagcgctcctgtcatggaatgaccgattttatcgtgtatttcctgggaaagccggttgcgctcctcaagcttataagtatattcggattgtctgataaactctttgttttcacgcagcatgtttgtcagcttctgcaggtctcttctcgtttgatcaatatgatgttcaagcttttcaatccgcgctgcatcatggcttgccgcccagtacagcaaaaattgaaaagcggccgtcaacgcgtagaccgctgagatgctttcattgataaacaagaccggaacgattgaagcggcaagtaccgcccacttcggcagcccaaaatcggctgctccttcacacagggtaaaaggaaggaataaaataaatagggggtgcacttctgcataagaaacgattgaaatgatgacagaaatgataataaaaagcttttttgtttttcctttaggtaaaatcgcaatcccgaggttgatacagacgtaaacaagaaggctgaacacaagccacggcagattgtcactttccgaaaaaacgcattgatagatgataaatcccaacaaaatcagtttgccggtcataatccgcaattccatggtgatcccccaggttaaaagttaactttaccggttaaataataaatcgcaatttgcgtccgatgttcaagccctgttttccccaaaatcgaggaaatataattggcaatcgtaccttcagagataaacagctccttcgaaatttctttattggacagccctctggcgatcagcgccataatcccgagctcgcgttcggtaaacaggctttcgtctatcttaggttccgcttctttatgctccgccaaattggacttaatcttgtcgaggatgatatcctgcatcacaatatggccgttgaacacacttttaatcgcgtctctgattcgctcgggttcggcatttttcagcaaatagccttttgcgccgttccgtatcgcagcgacgatgtattcgtcgtcatcaaacgttgttaagataaaaggcttggcgcccgtttctgaaatgagccgcgcagcttccactccatccatgttgggcatgcggacatcaaggagtgcaatatccacagcttgggcgcggcaaaattcgaccgcctgcaagccatcctccaccgtcgccagcacttcaaattcatcataagtgctcaatatgattttcatgccctctcttatgaatgaattgtcatccgcaatgatcactttaattttcatcgtttgtacggagaccggtcctccgccgtgcacatcccttctgtcaaaatgcaaaagccgggtctttcgccctgttcataacattaaattaccatgaatcagcccctgttaaaataaaaaaagccaatccttttcagagattggcttttttagtaaaactacaaatatttgaccgctgagacaacgaccatgatccatgcggcaataaacgccacgccgcccagcggagtaatcgcaccgaggacgctgatttgcgtaaggctgaggacatataaacttccagaaaataaaacgattccggcaaacatcagccaccctgccgcagaaacgcttcccgcacctgccagttttgacgcgatgagcgcgacggcaattaaaccgagcgcatgatacatatgatactggacgccggtctgccagatttgcaaatatttctcgggaattttcccttcaagaccatgggctccgaacgctcctaaagcaaccgcaagcatagcattgacagcacctaaaatcaaaaataatttcacgatcaaatcgcccgcctttcctttatcatcatagcgtacatgtcatgaatttcaacttatgcaaatctcatgacacgatattgtcatatttctttttcctaagctgtatttgttccgcagcaatcgctacgattgttccaaggacaagcccattgcttaaaatggaaacaaaaacaggatgcatcccttccaaagcactctcaggtacaaacataacccccacaccggcaaggagcgcaatcccggtaacaaagcggatgcggccggcctcgtccttttcataagaatcgaattcggcaaatgccaggccgaccatcgttgaaaacacgacgaagttcaccgcaaaaccgaccggagacggcaggctggcaaaagtattcatgaccagcgggaagaagctgatgacgattacgatcagactcccgagcaaaaacggttttttggaagacatcctcgtcgtttgaataaaccctgcagctccggatatcggcacggtccctacagctccgagcagtccgctcagcaaatggctgacagaggcgataaacccggccggacgggcccgcttcctctcttccagcttctcaaactgtttgactgctccttcaaccacccgtatgcttgcgagcatattgacgattaacaaaactgtaatgaacaacgaagtaacaaccagcccgctgtcaaacatcggcatgccgaaaggaaaaatatccggaaggtggaacagctggttcgcacgctcgggcgccttcgccacgccgaatacggcaaataagatccagccgccgaaaagcgcaattaaaattgaatattgcttgagaatcggaacgtttgaccggctcatcagaaacgtagccagcataatcacaaccgccagcaaaaacacgggtatatcgacctcgtttttccggtagccgatccccatgacacctttaacgatcggatcgctaagctggatgaccagcagcagtaaataaatgcctgtcacaacaggagtaaacatcacagccagcttatcaatgactttaaataaactaaaaataaagaagaaaaccgcgcttagcagcatcgctccctgcagcccctggagcgtttcgatgtgagtcgcgaatacggtccctgtaagaccggcataaatcgtgtagacgccccaccagaggccagccggactctcattaatcggcaggcggtgtcccaataaacattggataaaagccgttgtgccgagcacgaaaaaagtgctttgaaccaaccccgcggtctctccctggttcagcccgaatgactgcccgattgcaatgggcaccacgattgcggacgcaataataaatgccgtccattgtaaagccccaaaaagcagtttcaagttgatcaacctctcttttttaaaacagacggacggcgcctagaaatcaaaaatagaatctccgttgccgtcatcttcatgcttttgtttctcttgttttttgtattgttcagcaccggcgctccccatcattttttcgagcatcagctgatcgctcgatggtttattggccgtttgaacataaggcgaagactggacggacggcccctgctgcggttccacaatgacgtcgcaaagggagcggatcaccgcgatgtgcattttcaattcgttttcctggtggcattcctttgcttttttcaattcgtcctccatcttttgcagcaaacttgatatatgtatgttcatcaaatcgatcctccaaaccgttttcagtttccatttcattttaccaaattaacttctctcatgccgaatgcacttttcaaatattccttgcgaaaaattgcctctgctgctatgaagcattgtcttttacatttcaaaaaagaatattccccggcaaaacgcgggtgaaaaaagccaattttcttccggacagaagttgacagctgaaaaggctgtcacccataatgaaaaaaacttcactcgaatttctaaaagcgaaaggaaacagggaatggcagaacgaacaacctccatcgaaacgaccgttaccgagcaaaagcaatattttttaagcggggcaacactagctgttgaaaatcgtctggaacagctcaacattctaaaagatgctgtaaaaaagaatgaacggaacatacttgaggcccttcagaaagatcttaataaatcagagcacgaagcctatatgacggaaataggcattgtactggaagaaatccgcttcatcagcagacgattaaaaaaatgggccaaaccgaaaaaggccaaaacggccgtttcgcacatcggttcaaaaagcatcgtcattcctgagccttacggcacggttctgatcatcgcgccatggaactatccgtttcagcttgccgtctcgcccctgatcggcgcacttgctgcggggaataccgccgtcatcaaaccgtctgagcttgctcccgccgtatcaaccgttatatccgagatgatcaaagatatctttccgcccgaatatgtgtccgttattgaagggggagtgaagacaaaccaagagctcttgcggcaaaaatttgactatatcttttttacgggcagtgttcccgtaggcaaagttgtcatggaagccgcggcaaaacagcttattccagtcaccctcgagcttggcggaaaaagcccctgcatcgtgcacaaggatgctgatctcaagcttgcggctcaaaggattgttttcggaaagctgacaaacgcaggacagacttgcattgcgcctgactatctgctcgtacacaaagatgtaaaaaatgagctgatgcgcgctctgaaacaatcgatccaaacattttacggagaaaagccggaaagccatctggcttacggaaaaatcataagtaaacgtcatttcgaacggttaatccgctttttacaaaacgagaatatcgtcacaggcggaacatatcaaaaagacgcactcaaaattgctccgtccattatcgatgaacctgactgggaatcgccggtcatgcaggaagagattttcggaccgatccttcccgtcatcggctatgaaacgatcgaagacgttatccaaatggttcaaagccgccctaaaccgctcgcgctctatttgtttacgaatgaaaaaacggtacagaggcacatcctcagccggatttcatttggcggaggatgtatcaatgacacgctgatgcacacagccacaccttacctccccttcggcggcgtaggcgaaagcggaatcggaagttaccatgggtatcacagctttaagacgttttcccatgaaaaaagcgttttaaaacagacaaacctgtttgacatttcattccgttatccttcatcgaaaaacgggctgcggatcatcaaaaaacttctcaggtagacaggagccagacaaacgaagaaccgcttttttagcggttctagcgattaaagattcggaagggaccagtcaatcggctcatccccgatttgttccaaatactgattggctcttgaaaacggtctgctcccgaaaaacccgtttctagccgagaacgggctcggatgcggcgattggataataaaatgcttggatgtatcgattcgttcttttttcatttgggcatgccggccccagagaataaaaacgaccggtttgtctcttttgtttaaaacatctattatactatctgtgagctgttcccagcctttccctttatgcgaatttgcctggccccgtctcacggtcaaaacggtgttcagcagcagaacgccttgcttagcccagctgacgagagaaccgtgattcgggatgtcggcgccgatgtcattctgcaattctataaaaatatttttcaaagaaggcggtggattgacgccgggttgtacggaaaaacttaagccatgggcctgacccggaccgtgatacgggtcttggccgagaattacgactttcacattttcataggaagtataatgcaaagcattgtatatatcgttcggttcaggatatacggtgtgttcagcatactcccttttcagcatttccctcagttcttgataataaggcttatcaaactcgtccttcagctgttgccaccagctgtcattcaaaatctgtttcaatgttcaggcctccttagttcaattgtcttgcagcagtgagcctggatgcaaccggttttccatcccagacgatttcgctttccgcttccctttttttcatggcaggttcttcgagtagcacgaaaaagttctttgtcggcagcttgccaagctgatgcttttcactcaagacatccaagtaatactgcctcattccgccaagatctccggactggttgtcaccctggtctgaaaacgcatagattacgcttgcgaaaggaactcttttcacgcgaaaccgctcagccgctctcaggaaaaagtcccaatcccaataattgtggacggcaggatcgaagtagccgatttcgtcatgaagagatcgtttgtacatacttcctgaaggaacatatgtagaaaacttcctcatttcatccaagttaaaggaatacgcaaaaaggtaacggcttgtcggaattctcatatcctctttttcttcaaaagacacaatctcagcatccgaataaacaaaatcggcggtctccagcgcattcaacattctctccatatggcacggcgtgaaaaaatcatcatcatcacacagcataataacgtctccggaagcttctttcacccctatatttctcgcttttacatgcttcacgttttctttcagatgtataactctgatcggaagctctgaataaaggcgctcaacaaagtcgacgctctccccggcatcattaacaataataacttcaaacggttcaacagactgttttgcaatagattcaagcaattcgcacaaagcggtgacccgattatgcgtgacaactacgatagatatgttcatgtttgtgatatacgctccttcttatttcattctaaacatattaaagcataatgcgaataatttcacatggatcaaaagatggtctggttttttatgccaatccattcacgaaattttgcagaggaccgctgcactataaagcggcagccatttcattgtgatcttgcgaaaagctgtctataataagtaataaaccaactttggatggaatctcttatcgtggaggattgactgaacatgacaatgcacaaagcactgacaatcgccggctctgactcaagcggaggcgccggcattcaggcggacttaaaaacgttccaggaaaagaacgtctatggaatgacggcccttacggttgttgtcgccatggaccctgagaacaattggaatcatcaggtgttcccagttgatacggaagtcatccgcgctcagctgtcgacgattgtggacggcatcggtgtagatgcgatgaaaacgggcatgcttccgacagttgacataattgaattggcggcagacacaattaagaagcacagcatgaaaaatgtcgtcattgatccggttatggtatgcaaaggggcaaatgaagtgctgtatcccgagcacgcaaaggctttaagagagcttttggctccgcttgccacggtcattacgccaaatctttttgaagccggccagctcagccgccttggagaaattaaaacggttgagcaaatgaaggaagcggcaaaggccatccacggcctcggcgcccaacacgtcctcattacagggggaggcaaactaaatcacgaaaaagcggtagatgtattatttgacggccgggatgcagaggtgatcgaaggagaaagaatcgacaccccatacacgcacggggcgggctgcacctactccgcggcaattacggctgagcttgccaaaggttcaaatgtaaaagaagccatttattctgcaaaagcgtttattacggaagcgattcgcgaatcgttccgtttgaatcaatacgtcgggccgacaaagcactccgctttacgactcagcggcaaataaaaaaagccccttttatgtaaaaggggctttcatttagctttcccgtttgatcgttcttgcagatgatcttaagaaagattcgatcgattccacaaaaagagcatattctttcatttgttcataagtgtcctgaagtttcttttgtacttcctcatcatttggaattggtttatcttcaataccgccgatcagcttcttcatctggaggagcaaaccattgtattcctctctcgtatcctcaatatggtccgctatttttttcaaacgcatagcggtcaatttctgctggttttgatccacaaaaacaacccctttatactgcactctctctaaaaaaagcatatcataaagggattgtacagaaaatagcaaacagcagccgctccctttatgccattgtccaggatgtcacattcattatgatttcttttctggcactgatccaaacatcattatttcccgggtaaggaaaatatcttgccgtaaagacttcctctccctcattgacgaagatttcaatagaagaggcgtctaaaaagatgtttaaattgcgaagctcctgcaaacggcactgtctggcttccgttttttcatcaacataactgtttctctccaaggttatgatgccttctgctttattgtatatgagtcgggctgcacccctgaaggaaatctcaaaaccctcttcaataactttcggactgatgaaaagctcagctttgtccggttgaacaatgtccaatttttcggtgccttgattaagcgatattgccgcgtttttttcgttttggcggagcgttctaagctcctcgaccggtttttgaacgattttatcgttttgtaaatgcaattccctcggcaatgtcatacagtgcacccattgatgcggaatcgtcggctggctctgttcatcttggtctggaacacccatccaggcaaccaatatcctccggcctgattcgtcttttgtcgtctgcggcgcataaaagtcaaagccgcggtcaagctcttcgaaatctccgtgtgtaaaccagggtttcagctcgttcaattcaccgacaaaatagcctgactgatagacgttttggtagagcatctcttctgcttcaaggccttgcggacagacaattaagacgtctttgccgtccagttcgaacatgtcagggcattcccacatatagccgaattccccgagctgatctgtatttgaacctgtgatatcgccgaggaactgccagtccttcagattatccgattgaaacagcaccgcccttccctcaagattttcagtctgggcgccgagcaccatgtaccagctgccgttctttttccatactttcgggtcgcggaaatgagccgtataccctttcggaagccttgcaacaaccccctgcttttcaaacgagatgccgtcttttgagacggcgagacattgataggtctccctatttccctcgccgtctctgacattccccgtgtaaaacagatgcagcacatcattttcagcgatcgcgcttcctgaataacaaccgtttttatcaaaccagtcgctcggcgtgagggcgatctcttcatgccgccagttaaccagatctgctgaggagtagtgtccccataactttgcaccgtgccccgttttaaaaggcatccactgataaaaaagatggtacacccctttccactgaatgaacccgttcggatcattcagcagtccgacaggaggcatgatatgataatgcagccgatagggatcaaggtttacaatatcccggtattcttcaacccggttcattgccttttgacgaagctcctgatcttgattcatcgttttccctccctccgtcactttttctcgtcttcattaatgcctaagataaaggctgtgataaatgcgacagtcacagaaatcgccattccgattaaatagtggatcaggttgcccattccaagcggggcgacaatcgcaatcatcggaattcccgtcaaaccgtatgcgtttgctgcaacattcataaagacaacgtatgcagctcccagcgctcccccggccattgccgcgataaacggccggcggtaacggaggttgacaccgaaaataacaggttcggtaatgccgagaaaagaagagaaagcggcaggtaaagcaatttcttttgtttttgcacgctttgccaaaaagaatacggcaagtccggccccgccttgggcgacattggacatagaccagatcgggagcaggtagttcctgccgatatcagcgataaggccggcctcaatcgcatggaaactgtggtggacaccagttagaacgatcagcgagtatgttcccccgaaaatcagtccggcaacaggcccggcaacgtcatacacatatgttaaaatgttcgtgatccctgtaccaagcattcttcctaaaggaccgatcgcgataaaagcaatgaatcccgttgaaataatcgtgacaaacggtgttactaatagatcgatcgcatttggaacgattcttcttacgcctttttcgattttactcatcacatatacggcaagcaaaattggaacaacggttccttgatagccaagcatctcgattttgagtccgtaaaagtccatcacatccggtgatgcagttgcaagtccccaaggattgaacaagctcgggtgaattaaaattcctccaagtacagcccccaggtaaggattgctgccaaactctttcgcagcactgacaccgatcaagatcggaaggataataaatgccgcgctcgagaacatatcaagcattttatacagcgccgcatcaggatcgacccactgaaatgccttcatcattcccaacagccccattaataaaccgcttgcaacaatggccgggatgattggcacgaaaatatttgacagcgttttcgcaaatcgcgctaaaggattcatttttccctttgcggcatcgctgtgctgaaccgtttccttttggtcaagattcagctctttggcaaactgttcatacactttattaacaagccctgttccgaaaataatctggtattgaccagagcttgaaaaggctccttttacaccttccagctcttcgaccttttcctggtcgatttttgcttcgtccttaatcaccaaacgaagccttgtcgcacaatgagctgcactgatgacattatcttctccgccaagaagctgtataagacgtacagcgatttctttatgaatcatgatgactcctcctttttttttaaaaaaaagcagaaaagacctaaaattcaccaacgaatggaggatagattttccccattcatctagcaaattttaggtcttgcctgctttaccagtcacaatccccggtatttattttttaatacgctttcattttattatgtgataacgctttcgtcaactacttttttattctctgtgaaaatcgacctaaaaaaagcctgatcgcgcgatatcaggcggtattacctataggaatcatttaaacgctggacatgcagcgtaatatatccgacttctgattccggaagatgaagatcatattcagtttttacgtaatccgccagccctgccgcacatcggtagctttcaggatacttttgccggatgaaataaagcatgtcatcgtccatgacatgaaacgcttcatttgattccagccggttgatggcatacctgagatgcgtgacaagacgctgatatgagatgctgttttcgtcaatcttctgattgaaacagcattcgattttttctatcaattctttgatgatgttcgtgtattttagagtcttctgcatgttttccgcatccatttttgcggtatgaatatgcagcgcaatataacccgcttcatcatcaggcaattcgactttcagtttttctttgaccaaatcgattgcccagagtccgatctcatattcttttttataaagcgctttgatttcatttaacaatttattttgaatgacgaatcctttgcggactcgctcgatcgcaaatgacaaatgatccacaagggcgatgtggatatgatcgctcaacggtgcggacagctgcccttccgcatagctgatgatctcttcggcagcttcaatatgttcttccggaagtgtttcgaggatttgtttaaacttttcattttcttcatgaatggtaaaaattttttctaccttgtttcttggaatggtatcgtttttgcctttttgaaaagcgataccaggtcccatgacaattttttcttgaccatcctcctttatgattgctgcattgttgttcaatactttatagattttcaaagctgtcacccacttcccattatgagtgggattttaccttgtttaagttcccgtgtaaagagttggtccggctcttacccttttcaccgcttttttgcaaacagcccggctgggttctgtcgtataactgccgggcttcattctcttacagcccgacatccgctctgtcttctcttctcttttttccgaaaagccgcctgcctgataagcatcggcagcctgatatgtaccgccggcgaacgccgtcaccttcatctgattttctctgacaggcatcaccgcattcagcagcacggctgtccataattttaaaaatgatatcaaacctttcataccgatccctccagtttcgttttgataaaactagcaactctattaaactttcttgctctatcttatcccagcaaaatgaaaatgtttgtcacaatgtgtgtgcaaaatgattctagtttttagaagttttgttgaaaactgaaggaatcgcatgattcagcggatacaaaccatgaatgtaacttactcacagcttatcctaaggataaacacatattacccacaggatatatccacatatccacatacttattcaatatttagtataagaacgtatattccctacaatatctatacacaagtttattcacttatacacagtaaattgtgcataaatctagagaaattcactccaatacattgaatctttgaaaattatttctatatatagaaggatttttttgaaactgagagaatattttaaaagttcgaaactctaataattacaaagaaacatttatccagaagggggaaaacagattgagaaaaagtatcgtgcgctattttgttatggcttttattctattatttgcgttatccacattcctcaccggagtgcaggcaacttccgttcccgataaaaagtcgcctgagcttgagaaagctgaaatctacggtgatattgatgtgacgtctgataaacagacgacggttatcgtggaactgaaagaaaagtcgcttgccgaagcaaaagcggacggagaaaaacaaacgaaggcttctctaaaaacagctcgaagcaaagcgctgaaaacacttaaaaaagcgaaagtaaaccgcgaatacgaccgtgtattttcgggcttttctatgaaactgccggccagtgaaattccaaagctgctcgccgtcaaggaagttaaagcggtttatccaaacgcaacttacaaacctgacagcgtaaaaggaaaagacgtgacacttgcagcagacgccatttatccacagatggataaaagtgccccgttcatcggagcggatcaggcatggaaatcgggctataccggtaaaggcattaaggtagccgttattgatacgggcgtggattacacccatcccgacttaaagaataatttcggcccatataagggctatgactttgtggataatgattatgatccacaggaaacaccgacaggcgacccgcgcggcggagcgactgatcacggcactcatgttgcaggaacaatcgccgcgaacggacagattaaaggcgtggcgcctgaagcaacgcttcttgcttaccgcgtgctcggccccggcggctcaggcacaaccgagaatgtgattgcgggcattgaaaaagccgttgcagacggagcaaaagtgatgaacctctcattgggaaattcgctgaacagccctgattatgcaacaagcatcgcactggactgggcgatggctgaaggggttgtcgccgttacgtcaaacggtaacagcggaccggaaaactggacggtcggctcgccgggaacatcaagggttgcgatttccgtcggcgcatcacagcttccgtataatgagtattcggtgacgcttccttcgtattcatcagcaaaggtgatgggataccaagaggaaaaggatcttgaagcattgaacggtcaagaggtggaactcgttgaagccggcctcggacaagctgacgatttctcaggcaaagatgtgaaaggaaaagttgcggttatccagagaggcgtcataccatttgttgataaggctgaaaatgccaaaaacgccggcgctatcggagccgtgatttacaataatgcaacaggggaaatcgaggcaaacgtcatggggatggccgtaccgaccgtcaaattgtcaaaagaagagggcgaaaagcttgttcaacagatcaaagaagggaaacactccgttgtcttttctttcaaattggacaaaaagctgggggaaacaattgcctcattctcgtcccgcgggcctgtcatggatacatggatgattaaacctgacgtttcagcgccaggcgtcaacatcgtcagcaccattccgacccacgatccgaaaaacccgtacggttacggttcaaaacagggaacaagcatggcttccccgcatgtcgcgggaacggcagccatattaaagcaggccaaaccggattggacgcctgagcaaatcaaaggcgtactgatgaatacggcggaaaaactgacggatgaaaatggaaagcctctccctcacaatacgcaaggagcgggcagcatccgcatcatggaggcccttaaagcttcatccattgtaacgccgggcagccattcatacggaacattcctgaaagacaaagggaaacagacgaaaaaacaagcgttcacgattgaaaacctttcttcacacagaaaagcctatcagctcgaatactcctttaaaggaacgggcatcacggtatcaggaacggaacgagtcgtggtaccggccaatcaaacaggtaaagcagcggcaaaagtaaccgtcaattccgcgaaaacgaaagcaggcacatatgaaggcacggtttacatccgtgaagacggaagaaaagtcgccgaaatcccgctcctattgatcgtcaaagagccagactacccgcgcgtcacatccgtaacagttgaaccgggagcaaagcagggcgcttacacgatcgaagcctacctgccgggcggggctgaagagctcgcatttctcgtctatgatgaaaacctgaaccttctcggccaggccggcgtttacaaaaaccagggcaaaggctatcaatcttatcaatggaacggcaaaatcaatgacgccgcatcccttaagtccggaaaatactatatgcttgcctatgcatccgccaaagggaaatcaagctacgtattgacggaagacccttttatcgtcgaataatgacaagccttgttgagaaccactcaacaaggcttttttatgttaaaatacggataatgcgttcaggagaagctcccccttctcttcaaaacgtgaaaaaagcaatcggaggacatcgtgtatatgctttcttttatcgtattattcggcttatccttcattattgtctgctttatatttttcacgattttgtacttcgccgtcaacctgcagaagcgcgagcccaagccttttcaaaaagctgcggagcaaaccgtcgataccatcatcctcattccgatcagctggctgtttaccgctttatacatatgcattctgtttattcttttcccaatccgccattttctcgatttttttcagcaaaaacgctaaattgactgatgaaacgcttcggccagcagccggtatgaatccaatctgtcttgaaaatcgtgggtgatcgtcaccgccatgatttcgtccgttccgtaagcgccggccagttcaagcagctgttcctttacctgctgcggcgttccgatgaccatccgttttcgattgtcttccactctctttctttcataaggagaatattgataggacagggccgtttccaatgatggaaagccttcggtcaccatcccctgttcattggccaataaagaaaaatccaagcttttggcaaggttctccgctttctcttctgtctcagcgcaaatcacaaatacggcaacgatcacatttggctgttcccctaatacagaaggttcgaacctctctttgtacagtctggccgcctcttctccgccttcaccgttaataaattgagcaaatgtatatgatgcccctgtttgggcggcaagccttgcgctttcccctgaggagccgagcagccaaacagcgggcgctgtggcgatgttcggcgttgcggtcaagttgggaaagcggtgatgttcatcggcttgatcgtataaatatgtgacgaggtcctgaatttgttctggatattggtcagccatccgtcttcctccattttgaagggccattgaagcgatcggcatccctcccggagcacgtccgacacctagatcaatcctgccgggcgctagtccttccaagacgcggaagttttccgccaccttgtaggcgctgtaatgcggaagcatgacgccgccggatcctatacggatcttctctgttttagccgcaagataaccgatcagaacctccggacttgaccctgccaagttcctggaaaaatggtgctcagaaacccaaaacctcttgtatccgagccgctccgccgcttgcgcaagctccaccgtatgctgcaaagccagttcaggtttgcttccttcagaaacaggagtctgatccagtatgcttaatgacaacatctttttcaccccaaatcttcgtttactttttctgcgcaaaaagaaataatagtatcatggataaactaaaggagctcccagtactgatgaatgagacgaagcaaaaaacgcacccgccagccgtagaagaacgctttgcaaaaggctgtttattcggaatccttttcagtctgcccttttggctgatgttttatcttttccttcaatacatgctgataagataagtcccctccgagtcggaggggaggttccttaccttttgttcaaaccttttcctttaacgaattcattcatatacgcacgcggcggctttttgaggctgccggtgatctggtctgtccatttgtcagaccgtttgccgtccgtccgcttttgataatagtttgaaatcgtttcgtcatatgcggacaaatgcttttcaaactcggcatcatccgcttgatagacattttcatgataaatgtgatcaagcggcagacgcggttttttggccgaagggttggccggctggccgacgacaagcccgaacagcggaagaacgtattcaggtgtttcaagaagctcggagacttcgttcaaattgttgcgaatcccaccgatatagcagatgccgaggcccattgattcggccgctattgacatattttgagcggcaagcgctgcatcgatgacgctgaccataaaggtttccgtcccttcaagagaagctgtaatatctacaccctttttccgagcgattttgtcatgcctgtaaagatctgcgcaaaatacaaacagatggccgtttttttcaacatatggctggttcccggccaattccgcaagcttgcgcttcttgtccggatcggtgacaccgatgattgaatatgcttgaatatagcttgacgtcgatgcgctttgagcgctctccacaagcaggcgaacctcttcttcggtcaggagccgatctgtaaaagacctgatcgaacggtgatttaaaatagtttcaatcgttttattcatcctcttacctcctcaacctttatcatatccaatatctgcttttctctaaagcaaaacggtttggcggactgcagatggattcaatttcatatggtaaaatgatagaattgtcttactattttcgaatcggaaagggagatgacggtgaaatccgtaattgaagaattagatgcattatttccggaaatgatcgaactaaggagacattttcaccaatatccggagctttcccatcgcgaggtcaatacaccgctcaccattgcaaattacttggaaagcctcgggattggcgtgagaacgaatgtcggcggccaaggggtcgtcggtcacattaaaggcggccgccccggcaagacggtcgccttgagagccgatttcgacgctctgcctttacaggatcaaaaaaatgttccgtaccggtcgactgtccccggcgtcatgcatgcctgcgggcacgatgcccacacgtctgctctcctcacagccgcaaaagccctggcaaagcatcgaaaagacttgaagggaaatgtcgtgctgatccatcaattcggtgaagaggttacaccaggcggcgccaagccgatgattgaagccggctgtctcgaaggcgtggatgccattttcggcacccacatctgggctccgatgcccgtcggtcaagtcggtgtcaaatcaggcccgatgatggcagccgctgataaatttaaagtcacgatatccgggcggggcggacacggaggcgcgcctcacctaacgacagacgctttaatcacgggagcctcggtcgtcaaccatctccagcaaatcgtcagccgcagaatcgatccgacagaagcagccgtcttgtcgatcggaacatttcattcaggccaggcatttaacgtcattgccgaagaagcggtcattgaaggaacggtccgcaccttttcaaagcatgtccaggaaacgatcatcgccgagatcgaacgcgtaattaaaggcgtctgcgacagcaacggggcctcgttttcactcgattatgaaaaaggctacccgcctgtcgtcaaccatgaaaatgaaacggacatcgtccgtcaatgcgccaaacatgtcgtcggccctgaagccgtcatcgaactcgaaccgaatatgatcggcgaagatttctcttattatcttgaacatgtccctggatcattcttttttaccggcgcgggcaatccgcagactggagccgtttacccgcaccatcacccgatgtttgacatcgatgaaaaaggcatgctgaacgcggcgaaaattcttgtgtcggcggctctagcatttttaaaccaagactaaaaagacagcctgattcggctgtcttttttatttaaacatatagcctttatatttcgtcagctggcagctggcgttataaacgatcgcatagccgatcagcgcggacaatacagagctccctccgtagctgatgaacagaaggggaacgcccgtaaccggcatcagcccgacgttcattccgatattttggaatgtgtggatgacaatcagcgccgtatacccaacacagaaaaacgatgcaaacttgttgtacgggtgtatcttatcaatcagcacgacaagccggtaaatgagaaggaaaaacatgatgacgacaaatgtacagccgataaagccgaaactttcgccgatgacggcatagatgaaatcggtttggccttcaggaacgtatactttcaaattgttaatgcccgttccgaagatttctcctgagccgatcgccgtaacggctttttcggtctgatacgtatcattcgcgtcctgctggctcgaatcgacccatgtcatcacccggttgatctgatattgctggatatgcaatgtatcctttgaaaactccggaaaattgatcaccaaaaacagaacgagcagtacgagcgtgatgcccgatcccgcgactatgaaaatcagcttccagttcacgcctgataaaaacaccataacggcgacaaagaacatgcagataccggccgtaccggcgtcctgcattaaaatcaatccgaccggaaccgccgacactcccgcgattttcagcaacaggcgaacatcctcctgcatcgagcgcgagcctttcggacttgctttggaaatcaccgaagccagcatcataatcaggccgattttcataaattccgacggctgcagcgtgatcgtaccaaattgaaaccagctttttgcgccgtttttaatcggagcgatcgactccggactaacttttaacacgagcaacgacaagatgccgaataaatatatgtaaatgcttaacttttcaagctgctccagatcaaaatagagaaagccgacgatcaccgaaatgccgagcagataaaagaacaattgctttgccggataacccttcggtgaaaaagacggctccgcagcgtaaacagcgatcacactgattaaaaagaacatggctaatataaaaatcaaatcgccctgataatagggacttgtcgtatttttcttctggcccattataccccgccttatttcttcatcaaaagcactaactttcattatagcatgaacaaccgttcacattgcgaaaaagggtgaataaaataacagcccgcatacatcaggctgttatttgaacatatagctttgatactttgttaactggcagcttgaattgtagacaaccgcgaagccgagcaaggttgctacgactgagctgcccccatagctgaccaaaagcagtgggacgccggtcacgggcataatgccgatattcattccgatattttgaaaggtatgaatgacaattaaagcggtaaagcccgcacagaaaaatgaggcaaacctgctgaacggatgtattcggtcgatgagcacgacaagccggtaaattaagaagaaaaacataatgacaacaaaagtgcatccgacaaacccgaaactctcgccaatgacggcaaaaataaagtctgtttgcgcctcaggtacatagacttgaagatcgcttacaccatttccgaatacttttcctgaaccgatcgccatttgcgccctttcgacctgcattttatcgtcggcattctgttcgctcggattgacccaggtcataacgcggttgatttggtattgttcaaccccgagcgctccgcaacatcggggaaatttgatgatgacatataaaatcaaagcaacggctgcaagacccgttccgaagataagagagatcaatttccagttcacgcccgacaggaataccatcacaaggatcacaaacgcgacgatcccggctgtacccgtatcctgctctaaaatcaagccgaacggaacaatgatgataccggcgattttcagcagaaaaatccagtcttctttcaacgtacgcttgccgacagggccgtttttagacatgaaggaagccaagtacatgatcagcccgattttcataaattccgcaggctgcagcgtaaacccgggaagcataaaccagcttttggcaccgttgatgaccggcgcaaacctgtatgatccgatatatgccggactgaactttaacacgatcagcatcaaaatgccgagcagatagaaataaaagctgagcttttcaagctgctccaaatcaaaataaagaaacacgatgatgatgaaggcccccagtaaatagtaaagggactgtttcatcgcaaagggttcattatattgattaaactgctgagcagcgtacacagccacaacgcttatgataaaaaagacaatatagacaaaaatcaaatccccctggtaaaagggatttgtaatattctttttctgactcattcgaaatcccgcccttataatatgacacaatgaattaatgcaggaagacggcatccgcttcctcacaaatgatatgacgtacaaaagaacaaaatgtttcgattttattgcgaacaaattcctattctattttaaaggatttttccaactattgtcgaatgtgataaattcattgatttttgcttgaaatgtattaaaatgagtaatgttgcataaaattaaacttttgcctccggcagaagtggtacagaatcaccaattcataaggagtttttcatttggataaagcacttcaaaagcgtaaacggcttgatatcataaaatttttggtcccttcgcttatcggaattattctgtttatgattcccgttaaaattgaaggaaatttaacgattccaattgctgttttttcaaatgcattgcaggagctgcttcagcagcaattgccgctgatcatgacggtcatcgtaaccgcaacatttatcttaacctttatcaccaaaacctttcatccggctttcatcaaaaaaagcgagtttttctataacctgctgaatgtatctttattttggtatatcgtccgcctagtcggcatgattttcgccgtgatggcgtactttaagatcggacctgaagcggtgtatgccaagagtaccggcggaacattattattcagcctgcttcccgttctcttctccgtctttctatttgcaggcctttttctgccgtttctgttgaatttcggcttgctcgaactgtgcggcgctttgatgaaaaacctgatgaggcctgtctttaagctgccggggcggtcatcgatcgattgtatggcttcatggctcggcgacggcacgatcggcgtgctcctgacgagcaaacagtatgaagaaggattctacacgaagcgtgaggccgccgtcatcggcacgactttctcagtcgtctccatcacgttttgccttgtgattatttcacaggttggccttcctcatatgttcgttccgttttatttgacgatattgctggcgggtgccgcagctgcggtgatcagcccgcggattccgcctttatcaagaaaggctgatacttatattacagatcaagcggatcaggatcaagagaagattcccgaaggatacactccgttccaatgggggctcagccaggctgtcgcaaaagcaaaacaaaatacaagcgtcaaagatttcttgcaggacggggctaaaaacgtactcgatatgtggatgggcgtcgctcccgtcgtcatggcgctcggcacagccgcgctgattgtcgctgaatatacgccggttttcaaatggcttggactgccgttcattcctcttctcgagctgctgcaggttcctgaagccgctgaggcctcacaaacgcttgtcgtcgggtttgccgacatgttcctgccgtccgtgctcggaagcggcattgaaagtgaaatgaccaggttcatcatcgcctgtgtatcggttacacaattaatctacatgtccgaagtcggcggccttttgctaggttccaaaatcccggtgacgttccttgacctcgtcttgatttttctcgttcggacgcttattacgctgcctgtcattgtactgtgtgccaactttattttttagacaaataaaaggctcccggcgccaaatgccgagggccttttttgtttagaaaaaaatcgttgatccaaggggtctgcggccttatcgtacgatccgcctgtccgcttcttcgcttcccgtaagcctgccggcctcgtataggaaacgcgcggttcttggctaactttcgcatgatcaatctcctccacgcattttcgctattcacttcttctccccttcaccctttatgtcctaactgaatcaccgtgaaaattgagccgatagttggagcggaaaatgctttccagtatgtatcatttttcgaagaacgtggtataataaatgtaacagaatgttcacaaaatattctccaattagacacaattgatgtttcattccgctttttttgacagcgctatcattatcgaaaggggctgaaaacgcatggatatgtttttcgcttacttgctgattgcaagcgccactcctttatttttatggctggacaacaaaaaggtcgcaatttcttctattccgcccatcattttaatgtgggtattcttctttttctatatgaccagcagcctttctcctacaggacactctctcatgatcgcactctttattctcaacgttgtcatcgcccatgtcgccgctttcatcatctacggacttccattgatccggaagcacatgagccgataaaaaaagtgccggtttttccgccggcgcttttttgctgttaaacgcaactatagatcaaagttaaatgttgaatgcgagtaatctttgatgaatgtttgataccggctgctgaagtcaagcaggcggtatattttcgatttttccgcaaaccgcttatggttgtctctggccggataataaacggacatgccgcttcctcttggatgctccggagatttgatgttcatgatgacagccttcttgacggattttacgacctcttttgcttctttctcggctccgatctgctgaccgatcaagcttgacaaatccgccaaatcaaccatatccgattcatctgcataatcttcagcagcgagacgcgcgtagtggagcaggcgctttccgtcaggctctttcaatgccaggttcatgtttacgctcaatctgtcgagggcatcgacagcgtctttgacacggttcaattgaattaaagactgctgcaggtcttctgtttcaccgttttcttttgactgctgtacgtagcctgcagcgatttccctgccaagctctttcggatcgattgaagggtcgtcttgtacagactgcagcgcccttttataatcccagccgttttgattcgtatagtcgactgaagccagcatgtacttaccataatccctcaaggcatatgccgtttcaatcccggccattttgcagttgtcaaaaccgattaaatcaaacttttgcttcgtatgttcataggccgttttgattcccgactgcagctcgcttattttcattttcttattgccgaagttttcgtctcccccgtagccgtcaactgagccaagcccatgcccccaaaagatcaatacatattttttagccggatatgttttgactccccatgtgataaaatctgtgacggagccgggactgtccatatttttcttcccgacattttcgaggggcaccagcttctgatgttcaactttccacctctgattcaccttgtgactgatcgacgggttcgcccatttttttgctcctcctgtctgaagaacgacattgacgtttgaagatgaacccgcatccatcatttcctgaatgtcatcgcttgccatatgaaaatcgctttccatgtcagaaccaatcatataaacaagaatagtatagtcgtccttttcttttaatagagcggctggtgccggctgaaaaaaggcgaatgaaataacggaaaacaaaatccatttgatcaagttcatcttcttatgctccttatttaagattccgggaaataaataagagagtagtagcagtcttcgtccggctgttcgtgttccaatgaatacccgacggatcggaagcacgctaagcacctcttgttatcctcttcaattccggcgaaccatttgttgatccggctcatttccggcaatgccatcgtccttttgatgagcgcttttccatatccccctccgcgcaaaaacggatcgactaaaagggcaatgttcccggtcaagtcctcctcaacttcaaccatgacaacgccgacaggcttgccgtcctctaaagccgcccatacccggtagttttcattaccgcctgcaaaattgaaccattcgtcaagagggagcatcccttccagccgccttttcacctctgcatcctcaaaccaggtctgcagccattcaatatcttcttttcgaaaaagacgaagttcttctatattgctcattgctttctcctttattgcgcgtatttttcagcttgcaggcgataaagctctgcgtactgtgcctgatttttcatcaattcttgatgggttccggcctccgccacccttcctttttctaaaaagatgatgtggtcggcaaaacgggccgtgcttaaccggtgcgagacaataatgactgttttgccctgcgtcagcttttgcagcttatcaaatatctcttcctcaataaatacatccagcgcagaagagggttcatcaaatattaaaatgtcggcagactcatcacgcataaatgcgcgggatatggcgatccgctgccattctccccccgacaaattcctgccgccgaacaatctgccaagctctgtttcatagccgtcttcaagcttatgcaaaaactgatccactccgccgaaagccgaagcactttttattttggccaagtcggtgcatgaagaaatgtcgcccagaccgatattgtatttcaatgtcatttcgtaccgcaaaaaatcctgaaacacggccgcggcatttgaccggtaatgctctatatcatacttataaagcggtaaaccattatacgagatcgtgccttgattgggatcaaaataacgcagaagcaatttaacgagtgtgcttttgcctgatccgttttctcccacgagaacggtcgtcttattcaatggaatatcaagctgttgaatatcaagtaccgttttggttccatcataagaaaattccacttgatcacatgtaaatcctttttgcttttgaacagctggagcggtttccccattttccatggaatttttgctgtttaaaaaagaatgcacatttccgaggtgcctcgtttctcttgctccgatcgcaaaagcagcgaacatttcattgattccttcattgaactgaaccgcggctccgataaacagcatcacatccccgatggataatcccccatgaaaagcctggtgaacgatgtaaatcaggacggcacctgcggccaaagattgtaataccgaccagaacagctgatacagcgccagttttttttgatcgttggacagcgtatggaggagctccattgaggtgtttttataaaaggatttaaaaaaaggaacaagattgtatatcttgacctctccggctgtttcagacataagagggacacctgcataatattccgcgcgccgcctcagttcctgaacctctttccgtccttcaaaggtcgcgttgtttaacttcgcctcccagtacagtttgggaacggccaatatgagaaacagcagcggcacccacggtgcagccatgccaatcaataaactgctggctgcaatcatcaccattccgccgaaggtttgagacacgatggaaacccacatcgtgacaaaatattcattatagcggatgatttgtgtattggtatgaaaagatgcgtcttcaaaagccgcgatatcaggaatggaaattgcctttttcatgagcatttcatcaagataagcttcgagcttggcggtaaggagccttttctgcatttcagctacaggctgaagggcatctacgatcagcgtaaaagcaatgtatgcaaaggccgcccaaaccagtgcattccaagaagacagctcaaacggcgcccgtgcaatctcatcgatcacctctgcactcagccagactaggagaggtccgagcattgcattcagcagtgtaattaaaaacagaaccgccgacttaaaaggatcgcagcgccaaaacaacgttaaaccgtaaaatatgatggaagcggtttgaggcagctttttgaaaaacgaataaaatttcagcaatatacctcatccttcccctgaaacgatttggcctgcatgcggaacattctgctgtattccccgttcttgtccataagttcctgatggcttccctcttctgcgattcttccgtttttcaaaaccagtatgcggtcagccatctttaccgtactgaaccgatgggaaatcatgatcaccgtttttccctctgtgaagctttgaaactgccggaaaatatcatattcagcccgaatatccaaagatgcggccggctcgtccaatatgacaagtccggcatctttcataaacgatctggctaaagcgatccgctgccattggcctccagaaaaatcggtgccgccccattcagggccgatcattgtttccagcccttcaggcaactcttcgacaatcggttccagcttggcggcccgagcggcggcgcgaagtttttcttcatcgcctaaagcttccgttcggcctatcgcgatattgtgccggagtgacaattcgtatctgccaaactcctgaaacacgaccgccattttgtttctcagctgttgaagatcgaccttgcggatgtctttgccgttcactttaatctcaccctcatcatactcataaaaacggcagagcagtttgatgagcgttgttttcccagatccattcgcccctacaatggcaattctttctcccggtgatactgaaaagctaattcgattcagaacatagcctgtgtgcatgtcatacgattcaggctgttcgtcttgtccccgcatctcttcatcttcaagctcatcgagcatatccaagtcttcctcatccacatcagcttcatttacccgggagccggcagccgcttctctgaaaggatagcggaaggtgacatttttgaattcgactgccagcggtccttcgccctcgagagattcgccattggaaggaagcctgatatccttttcggcgttcataaaaagaaaaaagtctcttcccattctccatatatccaacgtatctgcaccttctttggcgatatcccggagtgccgttgataattggaacacggcccccaagtacagcgatatatcccccacagaaaaactgcttgaatgggattgggacagaatccaaaagtaccccaaacccgttcccgcccccgataagaaacccgttaaaaccgaccagcgcgcgcttctgacctgaatattccgcagcacagaatataggcctttaaaagcagattgatataaatcaagaaagaaagaccccaggccaaaaaggcgtacttctttggccgatcgtctcccgagcagaatgtggcgcgcatatgcggccctccttcttacaggggcataatccttgtgatattcccactccatttcattgtaatgattatggacaaaagcaaatggagcggtcgacaaaataaggatgaaagcaaggacgggcgacagataggcgatgatcaaaacgacgcccgccaaagacataacggcggtcaccaagttcgaactgatattaatgaattgggaaggaagccatgtcgaacgatcccgcagtgtttccagccggtccctgtactttggatcctcaaaaaaacgcatccccggaatgcggtcaaaagcgtcgatcaacaaactgttgactgtgatcatcgacctctcagaaagcattgccttcacccatttttccaatgatttaacgacactgaccatgaccaggcttcccgcataaatgacagcccatatttctgcatagatgacggcttcctgatcgacaatgccgtcgatcatttgctttgaagcgtacaattggattaaaggtgctccggcttcgatcagcatgaagataaccatgcaaatcatcagccgcggaccggatttccagaccattttcccaagcaggcccgccgtttgcagcggctcttgaatatgcttcatcttccacacatgcttcaccttcattttctatacctattgtggtcattgatacgagtatattttggctttctccggcgtattgacggtttcgatatcagccatgacccttggctttaccggacggctccggtcgagaaggtgctccttccccttggatgcttctcttagccatatttccaagtcaataacagatctcatgtactgatagcccatgcccagatcattatttggatcttcagagcggatagccatagccagcaagtgtttccaccatatatcgcgcttaatgatgccgagttcttcaacgaagacgcgctctcccggctcaaataactgaagaacgtgtctgcggtcattcataaagcttttcctggccatatgggcatatgttgttttcgttgatctgttataaacataggcaggcaggatatcggtgaaagatttgcgaagaagcattttagagcctgcataatgttcttcaagcccttttaaaacatcaaaatgctgttcaggcggtacagaaaatgagaactcgatcagccgccggtccaaaaatggatggtacgtatgcaatgtcacaccaacagcatccatgtacctcgctctcggccacaaaaagtcatagtgaaacctcttgccccacactgagagctcccggctttttcgatagcgtagatgatcctctttattgatctcccattctctctttcggtgttcttcagtgaaatattcaggcagctcatattccgtatctgaccacagcaggtcgtaatagagcttttctccaatataaggcatgaaaggggcgattccgtattgaaatccgagcttcagcatctctttcatgctgccgcctgaccattcgcgaagcaatttgtagatttcagaaaaccgtctctgccgaagcaaggaatcgatcactgacacttctccgctaaaaatgaaatccccgccctcacctgtaaggacagacgaggcaccatactcctcagcgatcactgtaaaagtctcattaaccagtgaattggctctcggatcaggaccgtctacaaaccaaagcggatcacgcccaatttccgcgtttggaattttggctgtagcgtctccaagaatgatcaggccggggatatccatatctcgcatcatattctttacaaggtccctgtcgtggcttaatatcatgtcgggttcggcaaatgatatattgacggccagcagctgttccttgcgtccgcctgcaactgcggcggcggttacggcagctgaatccagtccgccgcttaattcgacaatatgcctttcatcctttaaacgatctgctgtcacttcctgaaaaagctcccggaacctcggaacagcgtctccagcaagatctttctcgtttaatagctgcggaagcccccaatagctgtgcacgtgaaccgcttgatcccggccgagaaaagcgtaggacgccgcaggcactttgcgtattcctttaaaaaacgtccgatctcaaagccgttttctcctacagcaaagcccgaagtaggaaacattctgcacacatcttgatcgatcgcaaaaggaatgtcatgaacaagcaaaaggatgcgcatgtcattcgctgcataccattctcctttcggactgacccagtagtaaaccggacgggttgcgtatgtatcagtcgccaaaacaaggctatgcagactgtcatcccaccagaccatcgtatattcgccatgcgagtgagacagcatggcagctttgtcctgcttcaatgatgcgtacagcttgtcatattgctcgatctttcgggtgccatccgattttgcgttaagaccgccgctgatccagccgtctaagatgacggggtgcaaaagatttatttgagttgaaggtctaaaagcttcatcgtatcggatatgcgcttcagccatgtttgcgatcccgcagctgtagctgtgaatccgttccgcccgtccccatttcttgacggcggaaacccactcttgccataaagcggtgttgtttccctgcattccaaaccatattttcatactagagataacacccacctttcagcgtaagcgctcatcttatatgtctgtaaaacttttaaattcttatttttatgattcggatcgatcgatttgccgttttccatttgaacccacgcgtgagaaaacagcttgtcatcaattttcttgaccccgatcatgagatcagcatcagacccattgctgaataatatagattgaatcgttaatgcaatagaaacgcatgaagtgaccaaatggtcgtcttcatcaagggaatacaaatattcgccgttccggtgcagttcgtctatatcaagaagccctgcacctctttgctttgcgctcgcatacagcggaaacaggtggatcgcaattttttcataagcttcttcaaagtcataatttaacagcatcatacgtacaaaagcatgaacggttgtaaaatattcgtggtttttgacaagcgctctttttttcatcagcttttatcctctattttaatgagcttatgatgtgtcagttcctgtatcgcctcatttaatatcgctgatagttcttcttccgtctgatcgaacgccgattgccacttgatcagaatatcttttttatcctttcgctcattttcaatttcgatccacagctcttttaaagccccttccaatccgaaatactgcccattgtccaggtttaggacgatgcattcattttccaacacggttgtcgctgtctcttgatttcgaataattttcaaagattagacctccccggtatgcatgatttcagaaaaataaaggagaagagagccggcaagctctctttcagcactttatgcatgatgttctttccacgccctcgttatcatttcagcgctggagcgttttaaaaagagcctgcaatgcgacgatgcccctgaatttaccaactgatcacatgaatcagattatcacaggacaatattaaaaaaaccgcaaaaaactaccgaaaaccgacatgattagccaatggcatcaatgggccattattacgggatttattcggaggaaaaagaaaaagagagcctatcgactctcttttgcagggaaaaacgaatatatactttgtctatactttctgcttgatcaaattaagcatcgtccctttttttactgcgcagtaccgcgacgttactttgagctttttatagattttgctcaagtgatactctacgttccgcgtcgacatttgcaggtctgctgcgatctctttatttgttttaccgctggccaccttctgcaaaatatccagttctgtgtctgttaaatgctcgtccaccgagagatcggagtcgagtctcagtttttgcagcaagccgtcgggaaataacacagccccttttaaacacaataaaatactcgaagctatcatgctgtctgtatacgatttatctataaaccctttaactccggcctcgatcaacttattaaaatatgagtgaatttcatctcccgaaaacataatgataattttggattgaggttcgatttccagcgttttaagagacagttccaacccgttcatccccggcatttttaaatcataaagaaaaacgtctatatgtacctcttggttttttaagaggtcgagagcttcatttccttcgtggcaaacgatgacatccatattatatttttttaatatttccttcattccggatgtcagaaccctgtagtcgtctactaacaacacgcgtatcatcagtaacactctccttaaatcagtttcctccgaacaaataccgcaataaaaaccccatgaatagaattgaaggatgatgtcgggttttagtgcctttttgtggtttttaccactatattctatgatagcatgattatgtaatcaactggaagtaataaggaggtgacacagatgcgcaaattggaaagtgctcaagttaaaagctatggttcattcctgactgttactctttctaaaaagagcaagccgggcgacggcaaattcggccgcggcgtaaaacgcggttaagagtgtatgaaaaagagtgcggatagttgaaatccgcactcttttgccaatcaattaatgtccgctgtgctcagaatgttttgcacctggagaaccgccctcagggttgtctccgtgatagttgtgagcagcgaagatccagacggaaccggcaataatcgcaaccgcaataaacgcggcaaacagcgtattcccgacttggattttgccgctgtcactctcagtcatatgcataaacattaagagctgaagtccagcttgaatgatcgcaaaaccgaaaataatccacagctttgcagccatgcttaaatccgtatagatcacccacaaggccaataaggtcagcacaatggacaacacgaacccgacaatatgcttccaaggaaagtggctgtgttcagccgattgttttgctgccattatacattcaccaaccctatcaaatagacaccggtaaagatgaagatccataccacgtctaagaagtgccaatacaaacttgagataaacagcttagcagacgtttgcggggtgaggccgcgctttttcgtctgaagcaatatgccgataatccagaagataccaatcgatacgtgcagtccgtgggttcccaatagaacaaagaatgctgaccagtaagcacttgtcgataaagtggcaccttcgtgtacataatgattgaactcataaagctcatagctgacaaagccagcaccgagcaacagggtaatgatcatccagatcatcacgcctttcaaactgccgcggcgcatttcatgcactgcaatgccgcatgtgaaactgctcgttaacagcaggaacgtcatgattaaaacgagcttcgcgtcgaacagttctgccggcagtacgcctcccgctgttctgttatgaagaacagcataggtcgcaaataacgtagagaataaagcaatctccgctccaagaaaaatccaaaagccaaggatattcaaccttccgatttcagaacggtattccataggagcgttagaattgctgtgttctgcatgttccatcaatcccgcctcctttacttggcattctttcgttcagtctcttttatttcctcaacacttacatagtagccgtcgtcatattcaaatgaacgaagaatcatacagaggaatacaccgatcagaccgacgattcccatccagaaccattcaaagacaagcccgaatccagcaaatccgaagcataatgacatgataaacggacggcctgaattgctcggcatatgaatctttttaaacttgctttcaggatgaatctcgacattgtcttccttcatttgcgcaaatgcgtcaggtgaagtgacctcaggcagaaccgcaaagttatagtgcggcgggatcgcagaagatgtagcccattcaagcgtgcgacccattccccaagcatctcctgattcctcgcgttttgaatgacggaagctgtagaaaatgttatagcagagaacgatgaatcctgcggccatcagcaatgcgccgaatgtcgcaatcatgttcaatgcagtccagccgtcttctgctccgtatgtgtaaatacggcgaggcattccctgcaatccaaggaaatacatcgggaagaaacagatgttaaagcccgtcatgaacagccagaagaaccattttccgatgcgttcgttcagtttgtgaccgaacattttcggataccagaagatcaatccggcgaaacatgcaaacacagtacccgcgatcagcacgtagtggaagtgcgatacgaggaagtatgtgttgtgatattgataatccgcagctgccatcgcaagcataacgcccgtaacaccgccgatgacgaagttcggaataaatgcaagcgaccacagcatcggcgttgtgattttaattctgcctcgatgcagcgtcaacagccagttaaagattttaaccccggtcggcaccgatatcgccattgtcgtaatcgagaagaacgagttgaccgccgcgctgttgcccattgtgaaaaagtggtgcagccaaacgataaagctgagaaccgaaatcgccacaatggaataaaccatcgctttatagccgaacagctgctttctcgcaaatgttgcaatgatttctgaaaaaataccgaaagcaggcaaaataacgatgtaaacctcaggatgtccccaaatccagaacaggttcgcccatagcatcggcataccgccgtttgccaaagtgaaaaaggctgttccgaacaagcggtcaaatgtcatcagcgccaaagccactgtcaagacagggaaggcgaaaatgataatcacacaagtgatcagcgttgtccaagtgaacatcggcatccgccatagagtcatgccttttgtacgcattttcaggatggtaaccataaagttgatcccggtgagaagcgtaccgatacccgcgatctgaagtccgagcaagtaatagttctgtccaggtccaggactcagctcgttgcctgcaagcggcatgtaagccgtccatcctgcattcggcgatccgccgatgacgaatgaaatgttaaacagcatcgctccgaccatgaaggtccagaagctcaagttgttcaagtaaggataagcaacgtcccgcgcaccgatttgaagcggtacgaccacgttcattaacccaataagaaacggcatcgccatgaagatgatcatgatcgtaccgtgagtcgtaaatacttcattatagtggttggaatctaaaaagccgttattaggaagcgtgagctgggcacgcatcattaacccgtcgacaccgccgcggaagaacataatgactgcggcaatgatgtacatgattcctaaacgtttatgatcgacggtggtaatccactctctccaaagccatttccattttttgaagtatgtcagcacaaatacgattgcaattgaagtaagcaaaatggaaatctgtgctccaagaattaatgggtcacctgtaattatgaattcgtcccatttcaaattcatgcaagcttcctcctttcctagtgagaatcttggtcttcagattgtttttgatctttgtttgtctttacgttttcaaacggatctgatttagagtgcggagacaacggtttatagcccagtctttcgcgcgctttaatggcgtattccgcatcatttccgtgattaacgtacttcaggtgtgtagatgagaacgtcatttcgtccgcatgctgaggaagcatcagttcatcgtactgggttttcgtcagcttgggagcttctttctgcgttttcttcacccagtcattaaacttgctttcagataccgcattgacattaaacttttgttctgcaaaaccttcgcctgtgaagtttgcatttcggcctttataagtaccctcatggtctgcctgtaaatattgctccatttccattccggacatggcgtatttttgcccgccaagctgcggaatccacagagatgccatagagtcggcagatgagattttaaacaagatcggtctgtctgtcgggatattcaaatagttgaccgtttcgatatcctgttccggatagctgaatacccatttccaatcgacagatgtagcatatacgaccaaaggttccttgtcctttgatgcttttggagcctcttctagagaataaattgtttgaactgtcggcactgacagcgcaataacaattaaaatcggaaccactgtccagacgatttctaaaaatgtattgccttctacttccgggctgtaaggagactttctgtctttacgctcacggtatttcacaatcatcacagtaaaaaggacaaatacgaccgctacgataaacagcataaatccaatcgataatagaataagatctctttgctgcgaagcaaccggtcctttaggatccaataccgcgatttgactgcagccgcccaataaaaaaacggaggaaagcagagtcagcataatcagtggtttaaatgctctgaacaagaggatcaccatccttccttaatgatgtctaaaatttggtcagaatatctaagataaaaggattctgaaaaacttttttcttctaccttgctatgctatcaaaatcttcaccaattagccttatttttttcgattgttcacctttttttcacccaaatgtcacaaaatcgtcaaaatttgttcatgatattatgaataacaaaggaaaaagactggtaattttttagttctttttacacacatagcaagcgctgacaaatccctccggaacaaaaaatctgtcaaatttaggtttaccacaataaaaaactttggtcaatcattaatttcacattgttaaattttttcatggtgaatcattatccttctcccttccttttccctgctgacaaccggttttaaactaaagaacatcaaaaaagagctttcttctgtgactgaaagctcttttttatcctatataataggcgttatcgcattctagctttgatagccgttcggatgtgctttaaaccacttccacgcgctgtcaatgatcgtttccagttcggcgtacttcggctgccatccaagctctttcaccgctttttccgaagaggcgatcagctgtgccgggtctcctgcgcggcgctctgcaacctccgccggtatcggacagcctgtcactttccgggcagtttcaacgacttctttgactgagaagcccgttccgtttccgagattgtatacggcgctttctccgccgtttcgaagcctctcgacagcgagaatatgcgcgtcgaccagatccatcacatggatgtagtctctgatgcacgtgccatccggagtcggatagtcgtcgccgaaaatcataatcttgtcccgtttgcctagcgcgacttgaagaatgatcggaatcaggtgcgtttcaggctggtggtcctcgccgatcaagccgtctacatgcgccccggcaacattaaagtagcgaaggacgacatgacggattccgtatgccttttcagaccacttcagcattttttcaattgcaagcttcgtttccccgtacgggtttgtcggatccgtcggatctgtttccataatcggcacccgatccggttctccgtatgttgcagcggttgatgagaaaacaatttgcttcacatcgaactctttcatgacctttaacaggcaaacagctccgtaaacgttgttgtcataatatttgagaggatctgttacgctttctccaaccaatgaatcggccgcgaaatgcatgacagcctcaatgtcgttttcctgaaacacctttcttagaaatgcttcatcgcgcagatctccattatagaaagaagctccctttaaagccgcctcttcatgtccagtttgcaggttatcaataattacgacatcttcattgcggcttaacagttccgctacagcatggcttccaatatagcccgcccctccgcatactaatattgccaattcatttctctcctttcagcggcgttatccttctattttaaaatctataaaacgcctgtgaatctctttttcaaacaaagatgatatatttgcttttttcattttaccaccttcagcattttccggcttgtattttcatcatttcttcaaataaaaagttgggggaaaaacgaattgagagaccttcattccattaaataccttacaaggaatagttcgggtttttatccatatcaatggttttctcttggtgaatcaacgcgattttgaggcaaaagctatacttttttcactgcatttgaaaccaatgttctttttttccacttaatgctgatcgataatagtattttcgtattacccttctttaacccatacagcaactaagcccaaagaaccctctccacccattagatctttaatctaaataaccccttcaaaccatcgattttccaatatttccacacaatgacctctcaaaaatcccttccttgtttttagaatattcaaaggatattcggctgcaattgagaaattcttaatagggaaaaatgatcatttttatttgaatactatccagtcagtaattgattgtttattattataagtaagaatctaagattttttggtttttttagtcagttatttagggaataggtaggtttatcaatgatgactttgtgaattttttatgaaatttgtcattgttttcacatggctgttgttttataacttttattgcatctcaaggaagaaccgttttttctttgaggtgaacaacgtcttatcatattggaggaagctatgaatactcaaacgaaacacaagttggacaaagattgggtgattttgatgaaggaggcgaaaaaacttgggctgcaaattgaagatgtgaaagaatttcttcgcagtcagcccatccaaagcgatgctgaaaaacagataaagcaataagcgtttaaaagcatcagttatccaaaaaaacaggcggttctgttgaatcttggtctatcaagatgatccaaccggctgttttaacgagtgttttaattgataatgacgtatttgagcagcaggcttgctgcctgtgtatagattctgtctgctccatagaaacgagcattttaaggagcagccttaccttttgccctgtacataggttgtttcactttttccagcttcactctcttaaggggtaccagaccggattgattaaggcgttttagaggcattgctgaccaacgctgatgccagcagccccatacactttcttctgtatcggtttcgattgcctttctcctgaaagggggcggagcttttggccttaatccttttgataccatcctcgggcttcctttccatactcccttttctgttaaccatccgcctatataatcggttttttcgatgttaaatatctaaaatatcaattttactgatggttgttgttatcttaaactgaattcatgacccattccagaggaggatgatgaatatggggatagcagcaatctgcggaagctcccgcgaaaacggaaatacggaagagttggtgaatcgattagtagacggacttgatgccgataagatctacctgcgaaactatcacattgagcccgtatcggactacaggcacggcaatacagcccctttgtatcctgatgatgactacagagacctgatcagccgggtgctggagaaggatatcctgatttttgccactccgatctattagtacggaatgtcgggtttgatgaaaaactttattgaccgctggtcacagacattgattgagcacgggagatctgcatttaaacagcaaatggcgaaaaaaacggtctacgtcgcggctgtcggagacgatgatccccgcttgaaagggctgccgcttattcaacagtttcaatatatctttgattttatgaacatgacattcgacggctatttgctcggcaaagggaacaagcccggcggcgtggtgacagaccggacagcgattgtgtctgcaaatgaactgagaaggaagctggcagaggcggaaacggggcggaaagcatggcaaataaaaaggcgaacaaacggttttatttatggaaaaagcatttattcgagatgatcaggtctttcatcttatataaataaaaggctttgtgaaaattgaagaataaatccggagcttgttacatacctttgttgtatcttttcagacaaacacaaggagggtcaaagaacaaatgggagaaggcaaaatagattacagcaaagctgcggcatctccggagttccagcggttgttaaagcggaaacgggcttttattgtaccgatgacgattttctttttgctcttttatttcctgctgccggttatgacatcatacttcacatttttgaatcagccggcagtcggggccatcacgtgggcatgggttttcgcgattgctcagtttgttatgacgtggacgctgtgcattgtgtatacgaaaaaagccggtcaattcgatcaaattgcaagcgatttcaaaaagaagattggaggcgttgattcatgagtgccacagcctttattttgtttcttgccattgtcgccctcacgcttgtcattacgtatttcgccgctaaacagacaaaaacggccaatgagttttacacggcgggagggggacttaccggcattcaaaacggactggctattgcgggagattacatgtcagcggcttctttcctcggaattgccgggatgatcgctttgaacgggtttgacggtttcttctacagcatcggcttcctcgtcgcttatttagttgtcctttatattgtggcagaaccgctccgaaacctcggcaaatttacaatggcggacatgattgcctctcgttttaaacaaaagaaaattcgcggtgtcgccgcattaaacacaatcacgatctccaccttttatatgattgcacagttagtcggcgccggcgcgctgatcaagcttctgctcggcatcgattatacgctggcagtgtgcattgtcggggttttgatgaccatctacgtcgtattcggaggaatgattgcaaccagctgggtccagatcatcaaggccgttcttttgatggcggggacgctaatcatttcggtcatcgttttttcaaaattcggcttcagcctgacgaacatgttcgaacaaatgaaaacagctactccgctcggggcggattttctaaaccccggcaataagtataaagttcctcttgaaacactttcactcaatttggcgctcgtccttggaacagccggcctgccccacattctcatccgcttttatacagtaaaagatgccaaaacggcaaggaaatcggttgtctcggcaacatggattatcggtatattttatattatgacggtctttctcggttttggtgctgccgcttttgtcggttttgaaaacattttagctgccgataaagcggggaatatggccgcaccgctgcttgctcaggcgctcggcggagattttctgttcgccttcgtctcagccatcgctttcgccacgattttggcggtagttacaggacttgtcctgtcggcggcttctgcttttgcgcatgatatatacagccagattatcagaaaaggcgcggctacggaaaaagagcaaatgattgctgcaaggtgggcttccatcggcgtatccgtcctttcaattctgcttgctgtctttgcccaatcgctgaatgtcgcgtttcttgtctcgctagcatttgccgtggcggcaagcgccaatttgccgcttattatcttcaccgtcttctggaaaagattcaatgccgccggcgctttggccggcagcctgaccggccttttaagcgctctgatccttgtctccatcagcccgagcgtatgggacccggccggaaacgccatctttgttggagacccgctcatcccgctttccaacccgggaatcatctctattccgctcggctttttaggcgcttatcttggaacgattctatcttcaaaaacccctggtcaagacgcgtttgcagaaattcaggtcaaagcgcatacaggcatccacatggatcaatcttaaaccgtgtgcagccgaaaaaaacttatgagccggccggcccataagtttttatttattcccgaaagcttgccagccgctcgttcagcgttttcgtgtgccggtagacatctctgtaaatttgaaagagagcttcgtattgtctgctgtattcacggcggggcgaaaaggtttctttgatgagaacgaatcggtctgcacaagcctcaagcgacggaaaccagccgcacccgacggccgcgatcatggctgcaccgtatgccggcccctgttcgcttgtcagtctgatgatgtcggcgttgaagatatccgcctggatttgcagccattgattgcttttggcgcctcctccgattgaaatcacacggctgatgtcttttcccccggcacggaattgttcaatgctttcatgaagggagaatgtaatgccttcaataacggctctgacaaagtccgcccgtgtatgtgcgctgtccatcccgatgaagctggcgcgaatatctgcgtcggcatgaggagttctctcccctgacaagtaaggggtaaacagcagtcccccggccccgggacgggaatggccaatatcgctgattaattcgtcaaatgacgcctgcccggcaaatacatctttaaaccagctgaagctgcgtcctgcagaaagcgtcactcccatcgaataaaacgcatcgggggctgcatggttcagaaaatgaatattgccattaaactcttgatcacggtttgattcatatgtgagaacaacccccgaggtgcctatgctgcaaagggcggttccttcttttaaaataccggcgccgacagcgccgcatgcattatcagcgccgccggcaaacaccttgacttcaggagacagcccggtttcggccgcgaattccggtctgaggccgccgacacaagcgcccggttcaatcaaatccggacataaggactccgggatgccgagctttctgcagatttccccgctccatgtttgatgtctcacatctagcaggagcgttccggccgcatctgaatattcgctgtgaagacgccccgtcatggtgtacctgacatagtctttcggcagcaaaaaaacggccgccttttcaaacagctctttttcatattctttcacccataaaagcttcggaagggtaaaaccttcgagcgccggatttttcgcgatctcgagcaggcgctcctttccgattttgtcgttaatcagccggcattgttcggttgtccgtgtatcgttccacaggatcgcgtttcgcaaaacctctcctttgccgtttaaaagtaccaatccatgcatctgtccggaaaagctgacccctttaatctgagatgcttttcccgggaaatgcccgaccaattccttaatggcttccttcgttttgtccgcccattctgcgggatcctgttcggaataaccggaatggggctcaatgatggaaaacggtttggagacctcgccgcacagctctccccgctgattgacaaggatgattttaaccgtgctggtgccgagatcgaccccgattacgtattccactagtgtgtctcctttcctgccggcgcttcgcgcaaagcgttcaataagtaacggttaacggtcgccttcagccgttcttggcggcctgactgattttcaatatggtcgttttcaagagcgtaagcggcgagctttttcagatcggtgcggccttctttgatttcaagcccgatgcctttcgtatagctctcataacgttcttcgataacctgatcgagcgctttatcttcaagcagacgggaggcgactttcaagccgactgcatacgtatccattcctgcgatatgagcgtgaaacaagtcctcatcggcaaatgacgggcgccttactttagcatcgaagttgatgccgccggttttaaacccgcctgctttcaaaatttcatacatcgccagaaccgcagaatacagatcggtcggaaactcatcggtatcccagcccaagagcaaatcgccctggttggcatcaatggaacccagcatatcgtgcaaggcagccacccttagttcatgctcaaatgtatgcccggccaatgtcgcatggttcgcctcaagattaagtttaaaatggtcttttaaaccgtaagtttctaaaaaagcgatcgttgtggctgcatcaaaatcgtattggtgcttcgtcggctccttcggcttcggctcgattaaaaattggccgtcaaaaccgatttcacgcgcatactcaactgccattctataaaatgaagacaagttttcgagctcaagcttcatatctgtattcagcaatgtttcataaccttctcttccgccccagaacacatagttttccgctccaagctctttggcgatgtccaggccttttttcacttttgcagctgcataggcatagacgtctgcattgcaagaagttgcggccccgtggacatatctcggatgcgtaaacatattggctgtattccaaagcagctgaacatggcttgtctccatcatttctttgagaaaagacgacatttgatccaaatacgtgaaagtttcacgcaatgttgctccttcatcgacaatatcaacatcatgaaaacagaaatagggcacgccgagcttttcaaaaaattcaaaagccgcttccgccctggctttcgctttatccaaaggatgtgtcagccggttccacgcccggaacatcgtcccgtcgccgaaagggtctttcccgtccgcatcaaaggtatgccaatacgcaacagcgaagcgaaggtgttccttcatcgttttgccgccgacaaattcatcagggttgtaatatttaaatgcgtaaggattttccgaatcggccccttcatactcaatcattccgatatttctaaaaaacattccgatctcccccttcacttttccttgcaaacgttaaaaaacaatgtttgtttaaccattaaactaacttccttgtatgtattttacaggatcaattaatcgctttcaatggaaatagaggaaaaaataagttttcaaaatttgttatactataataaattcacagcttcaaagcaatggagtgattgacattgaatacagcggatcaagcccttgtaaaaaaaatgaacaaagccctgatttttgagcagattattgaaaacggacccgtctcaagggccaaactttcggaaataacaggattaaataaagcgaccgtttcctcccaagtgtcttccctgcttcaaaaggacatcatttatgaaaccggccccggcgagtcaagcggcggcagaaggcccgttatgctgaaattcaatcgaaaagccggctatgcggtcggtgtagatgtcggaaccaattatataattgttgcgttaaccgaccttgaagggcatttgattgaacaattcgaacgaacgcttgatgaagaagacattcaggcgacagaagaggcattaatcgaattgacggggcttgccgttgacaaaataccgccttccccattcggattgaccggaatcggcgtgtgcgtgcccggcttggtggacaacgaacggcatgtagtctttacgccaaataagccgatccatttgattccgataaaagaaaaactggaagaaaggttcggcgttcccattttaattgaaaacgaagccaacgccggcgccgttggcgagaaggaatacggggaaggcggccagcttgagcatgccgtgtttgtcagcattaataccgggatcggtttagggattttaatgaatggaaaattgtttagaggtgtgcaaggtttttccggagaagccgggcacatgtccattcactttgacggtccgttatgccggtgcggaaatagaggctgctgggagctttacgcttcagaaaaagccgtcttctctcactatgcagcgaattccggggcccagctttacgaaaccgttaaagaacttgcagaccgcggtgatccgggcacgatggagacgtttgaacgctttggctttcatatcggcatcgggcttctcaacatcttgaaaacgttgaatcccgacaccattatcttgcggaataccatagtggaatcctatccgagcatcgtcgatgcgatcaaaaaaacgattgcctcaagaagcgcagcagaagccttgtctaattatcatttaaaaatctccacgctcggccgcaccgcctcagcgcttgggatgtcctcccttgtaaccgaacgttttctggaacggtttatgaacgagagattttaatcttcatataaaaaagcgcatattccatttaggaatgtgcgttttgcagattgttgataaaatcccaaaacggctttttgttttgggattttatcatcctttcagcgtgattgaaaacccttgcagtctaggaaggtcgagcatcggagcggagcgaatgttggaattcgtgagcaccgacgcgcaggcctgacaacgaatgcgagggtttctcgacacgctgaaaagcgcatattccatttaggaatgtgcgctttgtttggtagcttggactttctcgctaaacgcctcggcggcctgctttggatcggcggctttgctgatggcgctgatgacactgatgccgtccgccccggcctcgatgacggggacgcagttttcgaccgtgatcccgccgattccgaccacaggaatgccaattccctgcctgcggatctcttgaatgagcgagacgccctgcacagcttttgtatcccgctttgtttcagtagggtaaacaggccccgcaccgatgtaatccgctccatccttttccgcctttaagacttcttcaagtgtatgcgcggaaacgccgaggattttgtccccgattctcgctctgacgtctgcggccttatcatcatcctggccgatatgcacgccatctgcgtcaagttcaagcgcgagttctacatcatcgttgataataaacggtacattgaactgtttgcacagcgcctgcacctgtcgggcaaacgccgtttgatctccggctttcaacgcaccctcgcctttttcgcggaattgaaaaagggtcgcaccgccttttaaagctttttcaataacagttaaaggatcccctgcggtattgtttgaccccataataaaatagaccgacaacagatctttcattgcttcttctgagactcgcgtcatcttattccacctctctgatcctgccgcgttcttttatatccatagcttcaacggcagcaagctgattcaaaaactcgatttggaaacttccgggcccccggctttccgttttcgccgcggccaactcggccgctgttccataaaaagcggctgcagatacagcggcacggcaaacgtctttttcaacggcgcaaaacgcaccgatgacagaggtaaacaagcagcctgtccccgtcactttcgtaagcagctgatgtccgttgcccacggtatacgtttttgtaccatccgttatcacgtcttcagcaccggttatgatgactgctgtatcccataatttcgcggctttttttgcgagctccgttctgtcgccgctctcttcacccgcgtccacgcctttgatcagccagtcttccccaagcgtgttggcaatttccgcagcattgcctctgacggcagaaaccttcactttgcgcatgatcgcttgagccgattccgttcgaaacggcgtcgcccccgcaccgaccggatcaaaaataaccggcaccccatgttcattagctgactttcctgcaataatcatcgcttcaacagattcacggctgagcgtgccgatgttcagcacaagggctccggcgatctttgccatgtcggcggcctcttccctcgcatacgccatcaccggcgatgcgccgagagccagcaaaccgtttgccgtaaagttggtgacgacattgtttgtcatattgtgtacgagcggtttttgctttctgactaactcaattccccttgcggcatcttccatattcattcgcctgcattcctttctgtttttgaattctcgctccatatatacgattttgtatgatcaatccacgccctcgccgcgaacgacagatagcggtcttttctccaaatgacggcgacatgccaaggaatggccggcctcaccagcggaatgatcctcaccctttcagggtcaagatcccggcagatcctttcgggcaaaagacctatcccaaggttcgcggaaaccatttcgctgatgaaatcccattgtgaggtttcataaatgacattcggctgaaatcccgccttcaagcaggccgtaatgatccgttcgtgaagaacaaagtcttcccggaagaaaataaacggttcttcgcttaactgccgaagctcgatctcttccgcatcggcaaaacgatgggacaggtggacgattagcattaagtcttctttaacaattgtaaaggagtgaaaaatctcctcttttgcaggcaggacgacaacgccgatatcaagcgatccgtcctctactccctcctgcactttcacagacccgtgttcaacaagctgaaaggtgacgttcggatacttatctctgaaatcccctatcactttcggaaaaaaccggagccgatcatcggcggcagaccgatcctcacatgcccttttttgacgtccatcaagtcgttcagctcagaagttaaattttgaaatgacttggtgatttcctgggcctgcacatacatgctttgccccgcatcagtcagctcgatctgccggccgcgccggtaaaacagctcgatgcccagctcttcttcaaggtttttaatcattttggaaatcgtcggctgagatatgtataatgactgagcggcttttgtgaagcttttcagacgggctacctccaagaaataggttaagtggcgtatgtccatttgtttgacaccctttcagagttcctgcgtgtattcatattctaaaccaaattcattgttttctgcacccccgcgagagccacaataaaaaaaacgccgccggcatacagccggcagcgcctatcttcgggcaatcgcctcatcctgttccttcagcgtgtccacatttgagcgggtgtcctcaatgtttttacgaacagcctctttatactgtttgaccatattgcaaatttcggcttctcgttcaagccactttttcgtaaaatcaaggttgttccgcccgagcgctccggctggcgggctttttaaagatacggcttgaagcgtgctgcttacttgttccagcttcttcataaccgctgcatggttaagtttaatcgttttgctcatttcaaccatccttttaaaccgttgattgtgctgtgcagagcgtcgacggcttcctctcctttttccatcagaaagtccgcccggtcggctgaccagcttgcagcctgaacagctcctttttcagcatctaaagcaaatatctttaaatcgattttatgaatataccgatcatactcatcggtgaaaattctgtacattgccgtgtgcgcttcatcacgtgcttcgtcaaaatcggctgccctgcttccggtccacgactcattaagattcggccgcaaaatctgcctgatttcttcgattccgaggttttgttcccgctctacatcgcgctttgcccgctccagccttgcaatttgttcttccagctctgccgccttatgggagaggacaccgtgtattttttgcagcgtgtctgagtagtccattattgtcacctctgaaattgcagtatgattcgcattgattatttccttgtcaaatcatgatccggtttgtttttcatagattcacatctttgactagacttgctctcatttccaatatttatagtttaagtcgaaaatcacggatgttgaataggctttaaagactgtttttagggatatatacacagttcgccatcatcctcacaccgcatttcaaggacatataacccgtctttttgaatcatctgtacaccgctttcattgcggacaagtctaaaggcacgggaacacggcggtttaatggtcacaaaaaatcgccaaatgattccgtatgacgttttccaattttagttattaaactgttgcttttgacctgatttgcgcttttaactatagacaaaatgaataatatatattctgtatatgtattttacctatacttgaaactcatgtacactcttgtttagaaagggggataatgacatgaaaacattcattaaaggattaggtcaggtcgctcttttgtttttattcgcccgtttcatgaatctgattgtcgaggttcttcatataaacattcccggcagcattctcgggattatcgtcatttttgcgcttctccatttcaaaatcattaagctggaatggattgaaatcggcgcgctgtggcttctcgcggagctgcttttgttcttcgtcccttcagccgtcgggattatgaactacggagatattctggctgaattcggcacaagcattatactcgttgtcctcatcagtacattcgtcgtcatggtgtcgaccggaatgctgactcaattgattgccaaaagaaaggaaagaaaaaaaacatgctcatcggatgcttaagcctgatcgcaacagttttaatctatttgggcgcaaaagcggtgtattcacgccatccaaaggtgtatgcgtcacctttattggtcacgccggtgatactggtcggcctgctgcttttcatcaacgtcccttttgaagcgtacaatgcgggcggacgcttgttgacggacatgctccagccggcaaccgtggcttttgcgattccgctgtacaaatactttccagtcttgaaaaaatacgcggttgagatcattatcaacgtggctgtaggctgctgtatcgcgatcctgtcaacagcgtttatcgcaaaactcttcaagctgaatgaagacctgatcgagagcctcgttcccagatctgtcacaacgccaattgcaatgaacgtttctgaaatgatcggcggaatgccggcggtgaccgctgtttttgtcatattgaccgccttgttcggatcagtgatcggaccgatggtcattcgctacttccggattgataatgaaatcgcgaggggcgtactgcttggcacaagcgcccacggcgcaggtacgtcaaaagcatttgagctgagctccgtgtccggaacgatctcaagcgtgtcgatgatcctggccgcgatcatcacgctttgcgcagcgccgtttctgatttcccttattgcagtgtaatagccgaaaaaaaaaccaaattggtgaaggtttttccgccaatttggttttttcatttagaaatcgatcagccatatgaatatagacatcatcaataatacaacggccagaataaaagaaatacacctaaaagacctgtcatgcagcagttttggggaaattgcttttaacagtttgacgttcagtaaaccgatcaaaccgaaaagtgtgaagactcccgatccatccgccgccatttccgagaaaaatccatcgcctttttctttggaaaatgcccacaggaatcctgcgaaagcccctgtgagaaaagcggtcgtcaacaatactttgacaaaggccatcactagattctcaacctttcagctgttcaaccgcagtctcaaattccttttcaatctctgcccgcggcttctttgtcatcaggctgacggcgatgatcacgactgtacaaacaataaatccgggaatgatttcataaaccgggtcaaacgctttcacttgctcccacacaataacggtcagcgctccggacagcatccctgcaagcgcgccccacttcgtcattcgtttccaatacaggctcagcaaaacgacagggccaaatgccgccccgaagcctgcccatgcatagccgacaagattcagaatcgtttcattcggatgaagcgccatcaagagtgcgatcagtgaaatggcgaggacagacagccttccgacaagtacaagttctttatcagaagcccctttccggataaacgctttataaaaatcctctgtcagcgcgcttgaggttacaagaagctgtgaagaaattgtgctcatcaccgctgctaatatggcggccagcaagaaccccgtaatcattgaagggaacaaaaggtcggcaagcttaatgaatatcgtctcggcattctttaacgtaagatgattcgcactgaaataggcaatgccgacgagtcctgtcagcatcgctccgcaaatcgaaaagatcatccagcccatgccgattcttctggcactcttcaattctttcacgcttgaaatcgccataaacctgacaataatatgaggctgtccaaagtagccgagaccccatgccagtaaagatatgataccgattacggttgttccttgaaacggacggaggagatccgggttaaccgcgttcacttccgaaaacgccggcgcaattccccccagttgaacaaacacgactaccggcattaagatgagcgcgataaacatgatcgtcccttgaacaaaatcggtccagctgacagccaaaaagcctccgaagagcgtataaagaatgacaaccccggccgtcagccagatgccgatccgataatccaggtggaatgcggttctgaacagctctccgcccgccaccattccggatgatgtataaaaagtgaaaaatactaaaataacaaaagccgacgtcatccgtaacagtcttgaaccgtctttaaaacggttttcgaaataatcgggtatagtaatgctgttgccggccgtttccgtatacgtccttagcctcggcgcgacatacacccagttcaaataagcgccgattgtcagaccgacaacgatccagccgctgctcaatccgttcaggaacatcgcaccgggcagccccattaatagccagccgctcatatcggaagctcctgcgcttaacgcggtaacggcgggacccagatttcttccgccaagcatgtaatcggtcaaatttgatgtcctgcgatatgcaaaatatccgatgaaaagcattcccgccatataaatacctatcgatattaaaattccgtaattcatagcttccccctgcctgtgtgatttgcgtaatatcaatatacatgaataattgaccgacaggtattgtttttatcgcaaattttttctccagccttacattaacgatggcgaacctgtaaaaagacaacttttaaataatcgccctcaggatagcttttcaccgttttaaaatcttcgggaagcgaatgctcctcaagcactgtaaagcgcgtccccgtttctttgcatgcctcttcgataaagcctttgaattttttcattccaaatgcgctgctgttcgtcgaagcgacgatcacaccttgatctttagtgattcgaatcgcgtcttttaacagatttttgtaatcctttgccgcgctgaatgtatgctttttcgttctcgcaaatgaagggggatcaaggatgacaaggtcaaaggcgagttcttttttggccgcgtattgaaaatatttaaaaacgtccatgactttaatctcatgagcttcatagtccagcccgttcacactgaattgttcgatcgtcctgcttaagctgcggtttgcaacatcaacgctcgtcgttttttcagcgcctccgagcgccgccgccacagaaaatgcgccggtatatgagaatgtgttgagcgcggttttcccttccgcataccggtccctaaccgccttgcggacatggcgctgatcgagaaaaacgccggtcatcgctccgtcattgaggtaaacggcaaaatgaatgccgttctctttcacaatgatcggaaagtctcctctttcgcctttgacaaagtcgtcatcttccacatactgcccggccgtattaaaccgttttttctcataaacagctttataatccgtcaattcatcaagggcttccataatcgtttctttaagcgtataaatccctttgctgtaccattggaacaaatagtagccgtcataatagtcaatcgtaaagccgccgattccgtcgccttccccgttaaacaaacgaaaagcggtcgtatccgggtcttgaaaaagcgattttctggcttgaaatgctttcgccagcctgcttaaaaagaatgactggtcaatcgattccccctcgtttcgagtcagaatccagccgatccctttgttttgctcgccataatagccctttcctaaaaacctgccgttttcatcggttatcctgatcagcgatccttcttttatgccgttttcttgcgaagaaacggcctctttttcgattaggggatagccctttttcatttttgcagcgaatggatgttttatttttaatgtatgcattttaattcagtccttatcttaaagtcttctctatcctaccataacgcctgatagatgttcttattcatcatgtaatcgatataattgacagatgattccgatttttctaagatgatggagaaactaaaggaggaatggcgaaatggcgcgaatcgaccacgtaggactgatggtgaaagacattgatgcttcgatcgcattctaccagaatgtgatcggaatgacgctgaaaggcagaatgacccatacaaacggcgtcatgaaactcgcttttttaggctttgagaacagagacgagacagagctcgaactgatcgagggatataacgacaaccttcctcaggaaggaaaagttcatcattttgccgtctcgaccgatgatatcgaggctgaatttgatcgcgtaaaaggcgccggcatcaagctgatggaagatgagattaccgtattgccgaacggcttccgctatttttttctttttgggcccgaaggagaaatggtcgagttttttcaaagaacataaccggacgcggcttatcgccgtttccggtttttattgaacgcggaaagccggctgctgtttttcgataaaccttttgatgttttgatatgtcatctcttcgatgcgcctgatgctctcatacgtagcgccgccgatatgcgccgtgcaaatgacattgctgagaccggcgatccgggcagccggcggttcggtttcaaagacgtccaatgctgcgcctctgatctgtttttgctcaagcgcttgaataagcgcgctttcgtccaccacttctccgcgggcaatgttgatcaggtacgcggttttcttcatttttgccagtttttcttgattgattaaatgataggtggcaggtctcaatgatgtgctgatacatacaaagtccgatttttccaggagatcgtcaagctcggcgaacctcacattcagccgtttggctgcattgtagtctttgtatgtgccgtacgccaaaacgttcatattaaacccggcagcccgccttgcaacctttttgccgatttccccaaaaccgataagccccagcgtttttccatcgagctcatagcccatcgccgcttgccataagcccgctttgactgccgcgtttgactgcgggatcgaacgggcgccagacagcagaagaccgaatgccaaatcggcgaccgccgaggcattttagccgggtgcattcgtgacgagaatccctttttcgtttgcatattccacatcaatattgtcgattcccgcgccgaatttcatgatataccggagtcccggagcggcgtcgatcagctcccggtccgctttttcaacgccggcgatataaatatggacatccttgatatgagtcagtaaatcctgtctcgtcaaccgatttgaatccaaaaacgcaaattcggcgccgagccgttcgaccctttctctcaagcgcggcgcagcgcggtaaaacagtccgttgagcgtcaacagcactttaaccaaaagctctcctccattcagcaggaattttcccgaccagaaaaatgcttgtttccgaaggaaacaagcgaatatggggatacgtcagggtttgttgtcattatatcgattcatcctgcgatttaaaatgagattggcatgttagctgacatggtttttagacaatttggccggctggttaaaggctgtggactgcaaatacttaaaatattgacgggcgtacgggtgtgaggtgtttgaattccaaggcttgtttccgccgcagaaatgaacgattgccgggtttgcccttgtttccatatagcgcttttgatcgatgagggaagccggtgttttttcttttaaaataatgtgtgtttgggcgttccacctcggatgaagttcgagccactgatcataaagaatcgcgttcaatgcgtcttggtcatgaaacacaaacatgtcttcatcgttgttattgataaagtcgatgacttttttcgaaatgtcgttttttctccaagcttccatatcgatgatcattaagcccgagttaaaatattttgcttcatcgctgatgttcatctttttcagccgttcatgctggcctgcatcttcaaccgccgccgcgaaataaggtgaaatgtccatgtcccacagcttcgatatatcctctaaaactaaggcgtcgcagtcgacatagatcattcgtttaacggattcgtcatcaatcagatcgggaatggaaattcgatagtaagccgcttttgtaatatggctgctttcgaccgctttgtcatactggcttttttccacattaagaaatgtaataggagctccgaattggagggtcgtctcttccagacgctttttattctccggttcaatccctccgtcgatgacatacagtttcacctcgcgcgtctgatccatattcgtcagcaatgatgagaacatcacgcttaaatgctgtgcgtagttattgtctgtacaagaaataatatgcatggttcggtcgcttttcatatgtcgtccatctccttttctttttttgttctattcccttttttcgaaaaataaacaccgttgataggccgaaaaaaaaaaggatcatgcaagatcctcagattgtatagcgtctattttgctatcttttagcaagatgctgctttaaataaaagtaaggatagccaacaatgataagcggagctgctaatgcaaggagtatccatgagcctgagtgactgcctctaatgactccaatgaaaatacaagtaccgacgagaaaatataataaagcacctaagaaccaatacatcttcattcctctttttctttacgcttgttcttggattgacgatttttgtatctatgcttgtctgttttttcgttcgcattgcttaatcgatcagggcactgattttttgacactttctcagttcggattccttttctttttaatgataaaattgtgagatcaatcgatttcaatgttgatcattcctttaatcaatagtgagttcctcattattttaaatgtaaatttggaaagataaaacgtacataaaggcagaatgcatatgtacgtttgggcaatgttcatatgttgggaagatctaatggttcactgcacattggtattgttgtgttccttctcttcctataaaatgattggataaatatatgttgacgttcaatgaaatgggatcgattttcataagtctctttttggttaaactgttaaaggaagtggatgaggtttgctgataaggaatcctttcaaagaaaaatactactcacatgataggcgggcattaaatatgcttgcactcagagtgccgggcctggcttttattctcatgatctatgtcgcctctatcgtgctgcaatttcttaatgggagctggtccattttattgcttaatgtgtttacggtattgaccgccatctttgctttgttgcattggcactcatatcgctgggttaagaaaagggtgattctgtacttcgtattacaaggtttgatcacttttacacttgctaatgtcatgtcaggctttttagtgctaatcatcattggcctttatgcatttttgatcggacagattataggaatggcagacagaagaaagacgttcctcatcctttatttattgcttctgctgtcaatcactgtactatatcatattcacaaaggtgaatatttgcattttcttgtcatagcagtacctattatgatcgtgattatcacatatgccgctacattttttgcccaagtcgatgaaaagacaaaagcgcagctgactcttgaaaggctggagctggctcatcagcaggtagaacagctgacgctgcaaaacgagagacagcgtatggcccgggacttgcacgatacgcttgctcaggggctggtcagtttaaatatgcagctggacgctattcatgttcatctcgccaaagacaacacagagagagcaaaagaaatcgttcaacaatctatgaatagagtgaaaagcacactagctgatgcacgttcagcgattgacgatctgcgcagcaaatcagaagaaatcggttttttaaaagaaagaattacctcattaatggatcattttcaagagtcgacaggcatggcttgctttttagactacagattagaccaagtgccggacgttcgaacagctgaaaactgttattacatcattggagaatgcatagcgaatgccgtaaagcatgctgaagcagaaacgatctcagtgtccatttgggatgatgataagaggaggctccatttaaccgtcaaggataacggcaaaggatttgatgttgaaaaaggcaagaaaaagagaggacattatgggcttctcggcatagaagaacgcgtcagagcaatgaaaggccaattcaatataaagagtacaacatctaaaggaacacaaattgatatcactgtaccaattcagggagagatgccagatgaataaggttttaatcgttgatgaccatcttgtcgtgagggaaggtctgaagcttttaattgaaacgaatgatcactacatcatcataggagaggcggaaaatggcaaagcagcagttcgccttgcagatgaattaaaaccggatattattctcatggatttgtatatgccggagatgagcgggttagaagccattaaactaataaaagaaaaacacgacatccccatcattattttgactacgtataatgaagatcacttaatgatcgaaggaattgaattaggggcgaaaggatatctattgaaggatacaagttcagaaaccctttttcatacgatggacgcagcaataagaggaaacgtgctattgcagcctgatatcttaaaacgtctgcaagaaatccaattggagcggatgaagaagcagagcagtgatacgcagctgacagaaaaggaagtcatagttctaaaagcaattgctaaaggtcttaaaagcaaagcgattgcctttgatttgggcgtctctgagagaacagtaaagtctagactaacgtccatttacaataaattaggcgcgaattcaagaactgaagcagtgacgattgccatgcaaagaggcgttctgacattagactaataatatcaaattaaaatttgcccaaacgtacatgcccgaatgtacgttttttttatttcattgtccactacaatgagaaagaatgtgatcaagcaatgtgttgaaaggagattatcatgtcaaaaatgttatataaattaggaggatgggttgctcgcaatcgcataaaagtaatatgcgcatggatcgttgtgctagttgcttcgataggccttgcaatcacgttaaaaccaagtttttctgaggatatgtccatacctgacacaccttcggaaaaagcgatggatgtcattcaaaaagaatttccccacggtcctgataaagggagcatacgggttattttcggtgctgaagatggggagaaactgacttcgaagtcagcggaaaaagcaatagaaaatacgttaaaggaaatcgataaagatggttccgttgactcgattgcaagtccttttgtgacaggaacaatcgcgaaagatggcacagttgcctatgctgatatcaagtataaatcatcagcagatgatattaaagattactctatcaaacacttaaaagacagtttgaaaatggctgattatgaaggattgcaaactgaactaagcggagatgtaccaggagctgagatggagataggcggtatctctgaaattgtcggcattattttggcctttatcgttttggccattacgtttggctctttattaatagcaggtttgccgattttaacagcactgattggattaggtgtaagtattgggcttgttttgattgggacacaagtattcgatatcgcttccgtcagtctatcattagccggaatgattggccttgcagttggaattgattatgctttatttatttttacgaagcaccgccagtttttaggcgaaggtatacaaaaaaatgaatcaattgcgagagctacaggaacagccgggagtgcagtcgtttttgccggacttactgttatcgtagcactttgcggattgactgtcgttaacattccttttatgtctgcaatggggctgacagcaggacttagtgtactgatggctgttctcgcttcaatcacgcttgtgcctgccgtcttgtcgatagcggggaaacggatggttccgaaagcaaacaagaaaaaagaaaaacaaagcgcggaaacaaatgtctggggacgctttgtcacaaagaatcctatcatgctaagtgtatgcagcattctgattttgctcgttattagtatcccatctatgcatttggagctgggcttgcctgatgcagggatgaaagcgaaggataacccggatcgccgggcttatgacttgcttgccgacggttttggagaaggatttaatggtcaattaacaatcgtagcggatgccgcaagtgtaacagaaaataaggcggaagccttcgcagatgcagtgaaagaaataaaggaactggaccatgtagcgagtgtcactccggcaatgcctaataaagaagggaactttgccatcattacagtagttcctgaaacaggtccaaatgatgcagcaacgaaggatttggtaaaggatgtacgcagcttatcagataaaaacggagtagatttgctcgttactggatcaaccgcagtgaatattgatatttcagatcgccttaatgatgcgataccggtgtttgctgtactcattgttggttttgcgtttgtattgctgacaatcgtattccgttcgttgcttgtgcctcttgttgctgtcgcaggtttcatattgacgatgacagccactcttggaatctgtgtatttgttttacaagacgggaatctcatcgactttttcaaaatacctgaaaaagggccgatactcgcgttcctgccgattttatccattgggattctgttcggattagcgatggattatcaagtattccttgtaagcagaatgcgtgaagaatatgtaaaaacaaagaatccagtacaagccattcaggctggattaaaacacagcggtcctgttgtcaccgcagccggcctgatcatgatattcgtttttgcagggtttatctttgctggtgaagcttctattaaagccaacgggttggctctttcctttggtgtgctctttgatgcatttattgtacgaatgacactgattccaagtctgatgaagctgatggggaatgcagcctggtatttgccaaaatggctggacaagatcattccgaatgtagacatagaagggcatcaactcacgaaggaaatacagccagaaacagctcatgaacaaaagaaacaaatcagtatgtaatagaaagcagatcttttacgagatctgcttttttgcttcatacggacgtttattttttagaaaaggttaatcgctaatatcagccatggaaaagaatcatgcatgatcctttttttctctcaccttcccggcgatccaaaacggcaaatagagaagatagaagaagacgatcgtgaccgcttcagctgataaaagataccacggccatggcccgagcacatctaacagcgatgctccgccgccgggcttcttcatcatgtacatatagttcgagttcagcaaacggttgatcaaaaaaatgagagcgccataaacattgacaagaagaaacgtgacccagagagagcgaaccgtcggcttatacctttcggctgcaatcatcaggaggcaggcgagaacgacgatcccgtgggaaatgaaaaattcaaaaaagcggaaatgaggaaagccgtaccttcccaagtcaggcgtcagaatcgcctgcagcgcgcttcccaaaccggcaaaataaagaaatttaaacaagttgaggtttttcgtcaataacaggatgatgacaaggtaaaccgaaaggtcgctgaggtggagcggcaaacaatagcgcggcgtccatgagttcacataaacgaaccaggagtggtagccgatttccgaaataatgagaaccgccacaaagacataacgaattaaccggttccattccggcttttggagcgtcttcctgaagacgaacagacaaacaccaagcgccgcaatcactagcaaagtcacaatatgggatgctgaaaatagctgaaacgagccgagctgataatctttttgaaagtatgttttcatcctgagcacctgtcatcaaaatatttgaacgttattttgtgacaaaccatgatctattattcaaaaaggccgccgaatatccggcagccgggtgtcacatagaaatagaatcgttttcctctgcgttatcattgacctgaatccgttcaacctttccgacaagaaagatgtaggaaagcgctcccgcaagggcgagggctccgataaagacgagggcgggcgcaaagcttccgccgttggcgagaaagccgatgacaatcggaacgataacggaggcgaggctgccgacaaaattaaatactccgccggtcagcccgatcaaatgcttaggcgctaaagacgatacaagcacccatgtaatggaggccaaaccgtttccaaaaaaggcgagcgtcataaacaaaatgatcagagatgtctgatcgacataattggcaccgataattgaaatagacaggaacaatccggtaataatcggtgttttgcgggcaaccccggccgatacgcctcttttgatcaaaaagtcggacaggaagccggacaacagaacaccggtaaatgccgcaagaaatggaagcgaggcgagaaaaccggattggagaaaatcaaggcctctatattttacaaggtatgtcggaaaccacgtcagaaaaaaccataaagtcgaattaacggcgaactgtccgatatatatgccccacagcttgcgatgagcggtcacttgtttaaaatgcttccaagtaaatgccaatttctctttctcggaagtccggccgcggcggacgatacccccgcctttttcaatatggtcaagttcagccttgtttacctttggatgacgatcaggatcacgataaaagatataccagatcaggccccagatgatgccgatcacccctgttacaataaaaaggccgcgccagccgacgacatgctggatggcgctgagcgccggcgtcaaaaatgcaaggccggcaaattgccccgacgtataaaatgcaatggctgaagctctttcctgttcagggaaccatgaagtcaccacccggttattggtcggaaaagccggcgcttcaaacgctccggtcgcaagacgcaagccgaatagcgaaccgaagccgcggacaaacccctgaagcaatgttgcgagcgaccatgtaaccaaggtaaagccgtagacaagcctcgggccaaaccggtcgacaagcccgccgcccggtatttgcagtgcgcagtaagcccagccgaaagctgaaaaaatcaagcccaattgaacggcagacaagtttaaatcgtccccgattgcagaagctgcaacagagatattgcttcgatccatataattgatcacgacacatacaaaaataaacagcagtacccgcactctaacctttgtcggcttctcttttaaagttgtttgtttcatgacaggccctctccttttatttgtttgtgatgacggacaccttttgaaaacggtatcatttttaccattcagctatgcttccgtccttgtgccgccataccggattgcgccagttgtgcccgatatcagccattttacggacgtgatcttcattgatgtccaccccaaggccaggtccatccggaatccggacatagccgtcctcatagaaaaacaccttttgatctactatataatcaagcaaatccgtccctttgttgtaatggatccctaagctttgttcctgtataaatgcattgtggcacgttgcatcaacctgaaggcatgccgccagagcgatcgggcccagcggacaatgaggggcggcggcgacatcaaatgcttccgccatcgacaggatctttttgcattcggtaattccgccggcgtgtgacaagtcaggctgaatgatatcgacatagccgtcagtcagcaggtttttaaactgccactttgaaaacatccgttctccagtcgcaatcggaattgagacgaggctggcgatatcgcggagcgcctcgttgttttccggcagaacaggctcttctataaacatcggccgaaacggttcaagctcctttgccaagatcttcgccatcggcttgtgcaccctgccgtgaaagtcaatgccgattccgatgtacgggccgaccgcttctctgactgctgatattctttcaatcacctgatcgattttttcatgtgaatcgatgtattgcagctcttccgtgccgttcattttgacggctgtaaagcctttatcaaccacctgtttggcagcgaggccgacgtcttgaggcctgtctccgccaatccatgaatagaccttgatcgattccctgttcttccctccgagcagctgatgcacgggagcgttgtaaaacttgcccttaatgtcccaaagcgcttgatcgatgcctgcaatcgcgctcatcagaatgggcccgccccgataaaacccgcctctgtacatgacattccaatggtcttcgatgttcatcgggtctttgccgatcaaatattccattaactcgcccacagccgccttaactgtcgcggcctttccctcgattaccggctctccccatcctgtaatgccttcatccgtttcgatttttaagaaaagccagcgcggcggaattaggaaacactcgaatcctgttattttcatctctgatctcccctttttactgttttgctgcttcaacaaattgctttgcttttttggacagctcttctaaaaacgcgtcattaacatctttattagcccgaacaagcgaaccgccgattcccgctccgaccgcaccggcctgcagaaactcgtgaaggttttccaatccgactcctccagtcggaagcagcggaatatgcggaagcggtccgtggatatccttgatatagccaggccccattgttccgggaaataccttgatgatgtctcccccgctttcatacgccgtcaatatttcagtcggggtaaaagcgcctggaatgctgaccgctccataccgttttgtcagcttgatcgtctcttcattgacggtcggagacaggataaaccgcgcgccggctaaaagcgccgctctcgcagattcgggatcaagtacggttcccgctccgacaagcatttcgtccccaaaatgctctgaaaccgcttcaatcgctttgatcgcttgaggggaattaagcgtaatctccacaagcctgatgccgcccgcttttaaggcgccggcaatgctcactgcctcctccggattgtatccgcggatgatcgcaatcagtttttgttcttcgatgtgtgacaataccatcatttctgccaccctttctctacggtttttttatcggctgacatcttcttcatcagattgttccataaacgcaaacagtgattcgcggtcaggcagcccttcaatatcaccgtttaccgccgctaccatggcgccgacggcacagccccgtttgacagcttctgaaagcggaatttgatcaatcaaacccgataatacgccggccgcaaagccgtctccggcacccacgggatccgctgctgcctgaatctgatagccttccgcatagccgctttcgttcccgccggcataataggcgccttttgaaccaagcttgatgatcgcagtttcagcccccagcccgcggatggcttccgcaatttttttctcatcagcggtgccgaacaaaaaacgcccttcgctcaaccccggaagcacgatatcagaccgtttgataagttcaaacatggtctgccgcgcccgctctccgtcccagagcttttttcgaaagttcggatcaaatacaacgcatttattgtgctttttggcgagctccactgcataaaacaccgcatctgaagcgctttcacttaaagccggggtaattcccgtaatgtataaaagccccgctttctcaatgtattgctcatcaatatcgcatttctttaaaaaactcgccgctgaaagcgtcctgtaatagaagacattgactttggccgcgcttttcctttctttaaaaaacaaaccggtcggcgccgcgtcatcgagcttcacctggctcacatcgactccttctcctctgacagaagaaagaatcatcgccccgaactcgtcttttccaagccgtgtaatccagccggcttttttcccgagcttcgaaagcccgatcagcgtgttggtttctgcgcccgctattctcacctgatagtttcttgcgtatctgagagggccgtcttcattcggagtgaacagcgccattgtctctcctatgctaataacatccatcagaactctctcctttgctaaagcggctttctatatccgccaatgctttctgtaatttttccggctgtgtgaagcagctgctcaacgataacggcctttcttgcgagcatgcgctcctttggcccggcggtgctgatcgccgccttcatcacgccatccggaccatagacaggcgccgccagacaaaacaaaccttcttcattttcttcattgtcaacggcatatccctgttccaaaaatgtctgcagctgcttttccagctcttctctggcagtgatggtatgcccggtaaaccggataaactccatgcggtcgagcagcccttcccttttgtcctccggcatgaatgccaaaaatgccttgccaagcccggtgcaataaagcggtttgcgcgagccgggctgtgcggttgttctgattgacctgttgttatcgatttttgcgatgtagacgagctgatcatcggatagaacggccataaacaccgtttcctgaacgccgtccatcagctgttttaaaaaaggaacgccctgcgatgaaatgtctatcgactccatggcagcggttccaacttgaatcaattttgcccccagcctgtaacgcttgacagcatcctgctgaaggtaaccttcatccaaaagtgtagcggccaaattgaatgtactgctctgaggcagcgaaagttctttgctgatttcctttacggttaatccatccggatgatttgacagcaattcaaatatacgtacaacacgtaccgcggattttactgacatgacaccctccaaaattcacatatgtgattcaaaatcaggatcctgataattcggacgtattctaaacagaaagaaggctcacgtcaaccatcctatcaaacaaaaaaatttttttattaaacttcaaattaccagtctatcgaatcatttatctgaagcatgcaggattcacccgttctgctgcgaatatctcttctcaggaaaacaagaccatcaagggggtttatgtatgaagagaaaaatgatgatgttcggattggcgctatcgatcattgcaggcggcgtggtcgccgatggaacggggaatgcagctcaagcggcccctcaggaaacagccatcgcaaaagatatcgaaaaattcagcaaaaaattcaacgagaaccgcgcctatcaaacgatttaccatttaagcgaaacgatcgggccgcgtgtgacaggcacggcagaagaaaaaaagagcgccgcttttatcgcctcacagatgaaaaagtcaaatctgaaagtaagcacacaaaagttcagcatacctgaccggctggaaggaacgcttaccgttcagggaaataacgtgcctgcgcggcctgccgccggttccgccccgactgcagcagaaggcttggccgctcctctctatgatgccggcctcggcttgcccggcgacttcacagaagaagcgaaaggaaaaatcgccgtcattttgagaggagagctgacattctatgaaaaggccaaaaacgctgctgacgcaggcgcaagcggagttatcatttataataacgtcgacagcctcgtccctctgactccgaatctaagcggtaataaagtcgatattccagttgtcggcgtcaaaaaggaagacggggaaaagctgctttctgaacaagaagcgatcctgaagctgaaagctcataaaaatcaaacctcgcaaaacgtaatcggcgtccgcaaagcaaaaggtgtcaaaaatcctgacatcgtttatgtgacttcgcattatgacagcgttccatatgcaccgggagccaatgacaatgcctccggcacttcagtcgtccttgaactggcccgaattttgaagacagtgccagccgacaaagaaattcgctttattacattcggagccgaagaaatcggactcctcggttcgcgccattatgtcagcacattgtcaaatcaggaagtcaaacggagcgttgccaactttaacttagatatggtggcgacaagctgggagaatgcttcacagctgtacatcaatacgcccgacggttcggcaaacctcgtctggcagctaagtaaagccgcttctttaagccttggaaaagacgtattatttttacatcaaggcggatcatccgaccatgtcccattccatgaagccggcatcgactcggccaactttatttggagagagccgggaacaggcgctttggagccttggtaccacaccccttacgacacgattgaacatatcagcaaagacaggctgaaaacagccggtcaaatcgcgggaacagctgtgtataacttcaccaagaaggaaaacagaaaaccgtcttacagctcagttgcccagtaattttaaaaaggagcagattgaaaatctgctcctccttcttttcatagacccaaagcgcctttcctccccaccgcttccgtatcatcaccttttcagctattcgttatctttattatcaaacaatcaataagcaaccaatatcaatttgttaatttttgtctctttgcttttccaatctccaaaagaaagcaaaaaaatggagccgcatctcgcgctccatttttcaatccttcatcagcttgataaatctgaagctcatcaaaatgctgccgatggcaaccgcaatcatgaccatccccagatcctgaaaatgccccgcggttatttcttctccaaacaacagacccagaatgacggacgaaaagatcgagccaagatagcggcatgtttgaaaaagccccgaagtcgtcccgacgatgtccggcggacttgccgtaaacatggcagcctgcagggcgacattgccgaggccgtagctgaccccgagcaaagagaggatgatgcctttccacaacatcggtgcatcgacaaaaaacaatgtgagcaggatagcgcccgctgccattaagcaagaaccaattaacacgggctgcgtttctcctgaacggtcaatccatttcccgacgaaaggcgagatcaatacgctcgtcccggacatgaacagcatcaaaagaccgctcgtttgaacggaaaggtgcatttcatcctgaaaataactcggaagtccaaaaaacaaacagtagttaaagatgttcagcataataaattgagcatagaccgaagttaacgtcctgcgtgcgatcaacagcctgatatcaataaacggactgttcactctcagctcccaccaaacaaacatcaaaagcaagacgagtccgaacatcccctcggcaaaacggggctcgcccgtgctcaatgagagcagaaatgccagcaggagaacgattccgcccgcaaacagaagaattccggtgagatcaagccgcttgatcacggcgcggacatttaagccggcttttttctcatctttcgggaacatgtacatccccagcaaaaagctgaacaaaataaatggaaagttcacgaggaagatggcgggccatcccccgagtacgattaaaaatccccccacggtcggtccaaaggcggtcattgccgaagaaaaaatggacagcacactgagtgcagacgcctgcttctcatgaatgtggcttctgatcaggcccactcccgaagggtaaatggcgccgctcccaatcgattgaaacaaacgcatgatcaacaagacggaaaaagccggtgcgagaggagcgccgattgccgatacggcaacgagaacaagccctgacaaaaacatctttttccggccgattaaatcgccaatttttcctgtgacaggctgtgcgaccgcactggctagataaaaagatgaaatcagccacgatacggttgcaaatgaaaggtgaaactcatgctggatgctgtgcagcgccaaagaaatcattgaagagttgagcggattcagcatcgtccctgatgcaacggctgttaaaaacagggcccgtttctttttcaatccggccatttacttagggtacagcagcctttcgccagctccgcccgctttaccgcccgcccccgcttccccgctcatcagacggctcctatcatcacagccgaaagcattgaggacggccccgtataaagcagcatcaagccgttgcgactcccggttcatcattgcttccgttccgttttgcaaaccgcattccgcacgtttttcaatatccgatttcatatttagacctcctcgtgctcttatcattttcttgttttcctttttcgattcatgacagtcataacctttgatacagaggagcgttcttcctcttttctgttagttgaaaaacgcatttgacggagctggcatagtgaaaagttcaaaaaaacttatcagtacgctgacaaaagaagaacgccatcgccgggccatgatttccaaaacaaaaagcggaaagaagtcgagcgtcttgccggagatcaagtgaaagtgtggattaagagcgcgctcggcaaactgcagggcaaataccgggcggacgtcttgaaattcgggtatcgaaaaagcggaagggaaatgggatgagattttcaccgaagccgatattacatatcatgttgatatcaacattgacaacttcgggtcaagcggcagaaaaaaatagcagccgggcatttctttagcccggcttccttttattgatccgcttttgttcgaatatgaagcatcttttcatccaagtagttcgcgatgtcagccgcttctttcagctcatcagtgagctggttcggcacttcattgttcaatttgtagtagattttatgctcgaggctcgcccagaaatccatcgcgatcgtcctgatttgaatctccaccttggcgtgctcgacgcggttggtcaagtaaacgggcacttctacaattaagtgaagactcctgtatccgttcggcttcggatttttaatgtagtccttcatttttaaaattttgatgtcttcatgttccttcagcacttcaaccatattgtaaatgtcggataaaaacgagcagacgattctgagaccggcgatatcattgatgtgctccttagcggcctttgtcgtaatatcgcagcccttccgcacaagcttgttaatcaggctttcaaagcttttcacccttgatttcgtatgttcaatcgggttgtggccgtgaattaaattatattcctggctgataatcgaaaacttcgtatccatttgatccaaggcaaatttatagacgaggagttcgttcttccagtcctccatcaggtttctcaaatcttctatctgggcttcaggcagtcctatcatcttatctatcgccatatccattgtatttttctccttataacatcatttcgtttcgttttttcagttaatagacgggtacctccatggtaaagtttcgacttaaagcggagatcaaaaaatagcctggtttaccattttccacatttttaaatttatacccctttcaaaagtcataaaactatcatattctgtaataccacttttcggaggtgagaatatgtcatactctaatagcttcgctttgattgttgtattatttattttgctgatcattgtgggctccgcttttgtaaagtattaattcattcgcgcacgaagccttcttccgaaaaactgcaggttcatatcgaaaggcgctccgcttttcatatgagcctgtttttttgtaatttaaaaagaatttatttccacaataacaaaaaatgtttataataggataggctctgagctgacggctgacggcgctcggaaataaaaactctcccacaaatgaaacttttatacaacattttcgtcttatactgttgttaaggcaattcaataacggaaaggaaaagatcaatgttaaataagctaagaatgttgtatgaaaaaacaacaatgaagtggctgctcaacacttcctattactttctcattctggtgctgctgtttttaatttacggattccatacagcaaatacaggttcatatatttataatgacttttaatggagaagaaaacaatgaaactgattgaaacaattaaaaaatacgcgcaaacacaacccgatacccttgcttttgtgaatgaagaagaaaagctgacatacggagagctttggtcacaatctgagcgccttgccgcaaggattcaaagcgaagctttaacagatgcttctccgatcattgtctacggacatatgaaaccggttatggcggtttccttcctggcttgtgtaaaagccgggcatccgtacattccagttgacgtatcgattccggcagaccggattctgaaaatcatcaacagttcaaaagccgagcttctgctcaataattcaggcacttcggttgacacgggagatgccctcatttccgtagtggaaccgggcgttcttgaaggagacggggtgccggagacagatcccggacgctgggtacatggggaagatactttttacattatctacacatccggaagcacgggaaatccaaaaggcgtgcaaatctcagccgataaccttcagagcttcacagattggatcacgaatgactttccggtggaaagcggccaagtgttcttaaatcaagccccgttttcctttgatttatcggtaatggacctttatccgtgcctgcagtccggaggcaccttatggacggttacgaaagacatgattaatcggccgaaactattgtttgaagcactgaaacagtccaacgtcaacgtctggacatcgacgccttcattcgcacaaatgtgcttgatggatccgtcttattcggaagagctgcttccggagctgagcttgtttatgttctgcggagaaacgcttcctgcgtcagtcgccagacagcttaaagaaagatttccaaaggctcgtgtttttaacacatacggcccgaccgaagcgaccgttgccgtcacttccatcgaagtaacagacgacgtattaaacaagtattcttctcttcccgtcggttctgaaaagcccgaaaccgaaatcgtaatcatcaatgaagacggaaaagccgtccaagacggggaaaaaggcgagatcataattaccggagcaagcgtcagcaaaggctatttaggcgaaaaagcgctgacggaaaaagcgtttttctcttacaacggctcccctgcttaccgcaccggtgacgcaggttacaaagaaaacggccagctcttcttcctcggaagactcgatttccaaatcaaactgcacggctaccggattgagcttgaagaaatcgaatatcagatcaatcagtcccgatatgtgcagtcggcagtcgttattccattctaccgcgaggagaaaatcgagtatctgatcgccatgattgtgcctgccgaacacgatttcgaaaaggaataccagttaaccagcgcgattaagaaagatttgggcagcaagctgccggcctatatgattccgagaaaattcatgtatcaaaaagagattccgatgacagcaaacggtaaaatcgaccgcaagagattaaaagaagaggtaaccgtatgacgccttatggttcatttcttttcttcattatattaggaattttactggcgccgaccatcattctcggactgaacggaaaaagcttccgcttatataatatggcggtttccgttctggttctggcgcttattttttcgaacagcctgcacgggctgatcatgctgtgcctgtttacgctttggcagacggttctgatcaaaggctatatcgcttaccgtctaaaagcgaacagcggcatcgtattttgtctggctgcagcagcttctatcctgcctctggcactgtcaaagctgctgccgtttttcgccgttgacaactgggcaacatttctcggaatctcgtatttaacttttaaaggggttcagctcatcattgaaacccgcgacggtctcattaaaaagcagctcccaatcagcagactgctttactttattctcttttttccaaccatctcgtcaggtccgatcgacaggtaccgccgttttgaaaaagacgatcagacggtttggacaaaggagcaatacgaagaactgctttacaaaggaatcaataaaatttttctcggctttttgtacaaattcattatcggctactgcattaatacgtatgtcataatgaaactgccgtttttgacttccggcagcttctcgcatggattggcatacatgtatgcgtacagcctttatctgttttttgatttcgccggatacacggcttttgcggtcggcgtcagctatatcatgggaatcaaatcccctgaaaactttaataagccgttcatcagccgcaatattaaagatttctggaaccgctggcatatgtcgctttccttctggttcagagactacgtcttcatgcgctttgtcctttggatgacgaagaaaaaatggatcacaaaccggatggctgtttccaatatcggatatgtgctgctgttccttctgatgggcgtctggcacggccttgcccctcagtacatcgtctacgggctgtatcacgcgctgctcatggtcggctttaacttctttgaaaaatggaataagaagcacaagtggtggccgaacaacaagtggacgacagccgtctcaattgtggtgaccttccactttgtatgttttggatttttaattttctcagggaaactaatacactaaaaggagattttcataatggattttaatcaagaagtactttcagttttagcagaggtatgtcaggacgatatcgtaaaggaaaatccggatattgatatattcgaagagggaatcctcgattccttcggcacggtggaattgctgctcgcattcgaaagccattttaacatcacagtgccgattacagagtttgaccgggatgcatggaacacgccaaatcaaatcataaagcagctgaatgagttgagataatgaaaaagcgttttttattcgggccaatcatcttggcatttttactttttttcaccgcgatcttgatcccaaatgcatggctgacaaagctggttcctaaagatcgcgtcgaaacttcagctacagaattaaacccgatgatgttccaggggatgtatcttcaaggcaaagcgcttgaagacccgaaatatctgccgattttcggatcatcggaattgtcccggttagatgcattccatccgtctaactattttaaagtaaacaatcaagggttcacgccttacctggtcggaaaaggcggctcacagtccttgattcacgcgatcaactttgcggcgcagtctgatcaattaaagggcaagaaaatcgttttcattatctctccgcagtggtttcaaaaacacggctcggacgaagcccactttgcgccgaacttctcggctttgcaggcatacgatcttgtgttcaatcaaaatgtcgattccgggctgaagaaaaaaatcatcaaacgcatgcttaaatttcatgcagtgaaaaatgacgctctgctttcagccctttttaaagccgagctcgaccaggacaaggtggcactgtctcttctgacgccgccggcaaaagcttaccaaagcattctggagaaaaaggacatctattattccatggttgaaggagacggaccgaagcggaccatttcccaagatgtaaaaaacaaatcgtgggatgaattaaaacagatggccgaaaaggtcggcgccaaagaatcccggaacaatgagtttaaaatctcaaacggcgtttataagaaattgaagccgaagctgaaaaagcttaaaggccataataaaaagatgaactatgccgagtccgtcgagttccacgatttccatctcatgatggatgttttgaaagaatccggcgcagaaccgctgttcatctcggttccggtccacggcaaattttacgactataccggcttccctaaaaaaggccggacggatttctataaaaagatcaaaaaagaaatcgaacaagagggctttcaagttgctgatttaacgaatcatgaatatgatccgtacttcttgaaagatacgctccaccttggctggaaaggctgggtttacgtcgatcaggagatcgaagctttttataaaaagtcatcataaaaaaggattccccgctggggagtccctttttttcctgttttaaatttttaatgtttccaaaaattctattttacaaatttctctgaaatctattgcgattatcaagagaaggtttaaaatagaagataaatattttttggaaaaagactagaaacggcagggagaatgaatatgacaaaacaaacgatcagcgtacagctcagtacagcaaaaaagcaaaagccagaggctgacaagctcgaattcggccggacctttaccgaccacatgtttatcatggactatacggctgaaaacggctggcacgatccgagaatcgttccttaccagccgattgaaatggacccggctgcaatggtttaccactacggacaatccgtttttgaaggattaaaagcttatttatcaagcgaaggcagagttcttctgttcagacctgaaaaaaacttcgagagactcaataaatccaacgaccgcctctgcattccccgggttgatcctgaaatcgttctggaagggctgaagcagctggttcagatcgacaaggaatggattcctcaagctgaggggacatccctttatatccgtccgttcattatttcaacagaaccgtaccttggcgtcgccccatccaatatgtataaaatgctgatcattttatcgccggtcggatcttattacaaagaaggcatccgccctgtgaaaattgctgttgaaagcgaatttgtccgtgctgtggcaggcggtacaggcaatgcaaaaacggccggaaactacgctgcgagcctgaaggctcaggaagttgcggaaagcaaaggcttctcacaagtgctgtggcttgacggagttgaaaagaaatacattgaagaagtaggcagcatgaacatcttcttcaaaatcagcggtgaaattgtcactccggctctaaacggaagcattttggaaggcattacgagaaactccgtcatccatctcttaaaacaatggggactctccgtaaccgaaagaaaaatttcagttgatgaactggttcaggctcacaaagacggcctgcttgaggaagcattcggcaccggaaccgccgctgtcatttcccccgtcggcgagctgatctggaaagacgaaagccttgtgatcaacaacggtcaaactggagaaatcgccaaaaggctctaccaaacgatcaccggtattcaaaaaggcgctttgcctgacacattcggctggacagttgaagttgataaagtaagccagtcctgctaagcggtttaagctctcttttgcaaaaaagagggcttgcacccttatcgtaaaattcgccggcgccaggctctgtttccaccctacttgcctctttttcaatccgacttgccatccctcccgcataaagcgattccattttatatactttatgttaaaattatcaataaccatgccggaaaggagagattatccgttctgatgtaacacgcaaatcaagaaaggacgctgaacgatggatcaaacaaaattgagcgtctgggaaaagaattacacgttccttttcatctccaggctaatcaaaatctctgctgactgttttgccttcaattctattttatggtttttaatctttgacggaaaaggtgcaatcggcacttccctgcttcttgccgtcacttttctccccgaagcctttttggcgccgattacagggcctttagtcaaaagaagcgccctgaaattctggatgtacttttcggatttaacaagggcagccgtcgtcattactataccgatttgctatttaaacggcttttcaccgatgtggtttgttttaggcctcatgatcatccattcggcaacaggcgcgacatataacccggcgtcaattacgctgattccgcagatcgtgaacgaaaatctcatccaaaaagccaacgcgattctccagtcttcttcagaaatcatcaggctgggagccgttacattgtgcggagtgctgctgacttttatcggtcctgcaacgactttggtcttttcatttatcttttatatcatatcgggcctattcatgctttgcatcaaatacagcatcacccggactcattcacagtctaagtctcttgctcaaagaggtacatattttgcgagattaaaaagaggatttacattggtgaaaaaccacaaaatattatatccgctcgcgatttattgcatcttcatgaacctggcggcttcaccctgggaagccctttccgcggtatatgttgctgaggatttaaacggaacgccgttcatccactcgctgctgaaggcgacgacggcaggaggagcatttttactgggatttatccttgcaaaagtaaaaatcaacaggtacggactcctttttattacggcaggcattctcgaaggtgcagcttattttatcgcaggactgaatactttcctgccgctcgtatttctcgccgcctttgcattcggggcagccatcagctcgattaatgtccccgaattcacgattatccagacatctgtcgaaggggatgaccagcctcaagtgtttgcagtcatccatatgatcacaaatctatcgcttcctttaggggcaattgcctgcggatatgccgcaaaaatgcttggcgcgggaaacgtgattgcaatcggcggcttcatcgaaatcattgcgggcatcggcatcctcatatttactcagcttgccagggcccggcggtcagatctgataaaagaaaaagaagctagcgcaaatatgtagtacgaatgtgacggccgcagtttcaccgggtcaggcgggcgcagcggcgcctccaacaatgaaaaggttccggcaaacacaccggaacctcaaatctattcctatgcttctacagatctaaaaaactgcggaagatgctctttatgcgcttcaagcatttcgtccagtatttgtttcgcaattttgtcggacggaacgagcgggttgatcgtcatggccacaagtgcagtgttgtaatcgcctgtaacagccgcttcagccgcaacgcgttcgaacgatttaatttgctggacaagacctctcacggtgacaggcaaatctccgaccgcgatcggtttcggcccgtttttcgtcatgacacagttgacttccactgcggagtcatcaggaatgcttgcgatcgctccgttattcatcgtgttaacaggttgaatatcgtgcttgtcattgtaaatcgagctgatcaagttgcaggcggcatcactgtaatatgcgccgccgcgcttttcaagctggggcggtttgatcgccagctccggatctttatacagctcaaacaattccttttcaacttgctgaacaacctctgcacgcgttccttccgtttttgaagcctccagttcgtgttcaagcatttcctgtgttttatagtagtagcggtggtagccgcacggaatcaggccaaggccgcggataaagtcgggttcccacgattctccggagatatttttcatcgtcatcgcattttctggatctgccatcgcttcgatcactttgtctttgacgctgacgccgtcaaggaaaacgtcgagtccgaacaccatatgatttaatcctgcaaattgaatgtctatgcggctttcatcaacatcgagcgcctttgcaacccccatcttcatgccgatcggcacattgcagagcccgacgacttttttcaaattagaatagcggagcagcgcttcagtcaccatgcctgccgggttggtaaaattgacaagccacgcgtcggggcacagttcttcgatgtcttttgcaatctcaaggatgaccggaatggtgcgaagccccttgaaaaggccgcccggtccatttgtttcctgaccgatcaccccgtattttaaaggaattcgttcatcttttgctctcgcttcgagcaagccgacgcggaattgcgtcgtgacaaaatcagcgtcttttaaagcctccctgcggtctagcgtcagatggactttgatcgggacgcctgctttttcgaccattcgcttcgccagcgtgccgacgatattaagtttttcttccccttccggtatatcgacgagccagagctcgctgaccggaagctcgtcatgccgtttgattaatccctcgacaagctcgggcgtataacttgaacctccgccaattgttacgattttcaatccttttttcatcaattgacacctccgtggatattcattttttcatagagctcgacaatctccgcggccaaatctttcatggtcatcgcattcattaaatgatcctgggcatgaatcatgagcagtgaaggttcggttttcgcacccttcgcttcattttgaatcaaagctgtctgaaagtgatgcgccctgatcagttcttcgtcagccgcccggatcttttcttttgcagctgcgaaatctccctttttggcttcggctatcgcttccatgcaaaagctcctgccgtttcctccgtgaaggataatttgaaatatcgtttgttccaattcctcggacattttggcaccccttttctatacactgacctgttgaccatcgcttgcagccgttccggtctccagttcgctctcttctttcagcttttgtttatcccacattctaaagaacggatagtatacgacaaacgagatcaacagattgatcagctgcatgaccgctccggaaattttccctcctgttgccaaatatccggaaaagccgggcggcatcgtccacggcacggcaatcccagccggctttgcaacaagacctgtgctcattccaatataggttgccgttatcatcagcagcggcgacacgatgaacgggatcagcagcatcgggttcatgacgatcggcatgccgaagataatcggttcgttgatgttaaaaacagcggggccgatggcgagtctgccgagctgtttcatttgcttgcttcgcgccctaagaaacatcgtaatgaccaaagccaaagtagcgccgctgccgccgatgttgatccaaatctcaaaaaactgcgtcgtaaatatgttcgggagcgcttctccggcttggaaagcgagacggttttcgtccatcgctccgtaccagatcggcgacatcactccgccgacaatgtttgctccatgaaggccgcaggaccacagcagcattttcacagtttcggcaataaggcttccgccgagactgccgccaaggacggaaagaggcgttcccaaaaggacgttgacgacattatggaggctttcaaacggcgtcatttcaattaaaaggcgggccgcccagatcgagccgataacggcgaatcccggaatcagagcgataaatgatttgctgacagccggcggtacgccgtccggcattttgacgacaatatccttttgaacgacccagcggtaaacctcagtggagaacatcgcgatcagcatgccgacaaacagacctttgcttcccattaatgaaatcgggatgccgcctgacactaaaatttcctctgttgcgccttcgggtgtgaacggaatctggtagggggtcgcaagcagaaaagctgctacggcaatggcgcccgatgacagggcatcgatatcatatttctccgccagacggtaggcgatgccaaacgtggcgatcagcgccataatgtcaaagctgacattaaccggatagcttaatttctcagcccattgatcgccgaaaatccccgccatgaattccggatatcccggaatcggcaaattggctaaaatgagaaacagcgatccgataatgattaatggcatggtcagaataatgccgtctctgagagcctgcaaatggcgctgggcggcaattctgccggcaaccggcatgatcttctcctctaaaaatgcattaaacttgttcacttgtgccgcctcctttaagagccggcaagctgttcggcggattttaacacttcagctccattacaagttccgtaatggaccgtattgatgacatcgacggatacacctttcgattctcctaatttctttaattgcgggagcatgtaacggacttgcgggccaagaagcaatacgtcggctttatcgatatgattctgaacctctcctccggaaacggcccagattttatagtcttttccttgttcctctgcacttttttccattttcgtcacaagcagactcgttgacattcctgcggcgcaagctaataagatattcatgttaaatagtcccccttttacgtatcttgtctgatctctcttacagtttcatcatataatgaaaccgttttcatatacacttaatgattttcctcagcgaagaggaaaaaagacaaggggacatcttcatttggcatatcgatgagccggcccgctttttttaaagacggacataaactccccgtacgttttgcatttcaggagttcccggacaatcgccctgtcatctaaaacacggcccaaaaatttgtacatctcctgcaaatttgctgtattgtccttttctacacaaagaaggcagacgaattgaaccctcttattctcccagactatcggtttttgcagcgtgcaaaccgcccaaaaagttgaagcggtttttggtgtcatcggatgcggaatcgcaaccagattgccgaagcaagtgggcgcaacggcctcccgttcaaagaccgaggcttcaagccccgcgtctgcaagccctgattgcgtcacttttccgcacagaaagcgaaggacatcctctcttgaagacagactttcccgcaaaaagacaagctcttttctcgtataagtcgaagcgattccgtcatcttcggcaagcacttgttctattttcgttaaatctccccctcccagtattgtgtttacttgaatcaccggaatgggaagatcatcggacagcggtattgtgctgataacaaagtcgagtgcatggagcgacatttgattcagcttgtagtaatcaaccgttccaaggatctcaagctttgaaccgaatgttgcccgcagtctgtcctgaagcagcatggcgcttccggcccctgaagcacagacaatcatacagcgttttgagggcctgttcatgtttcttctttccatggctgcgcctatatgcaacgcgaggtagccgacctcgctttcctgaatgtcaaatcccgtctctcttttgatgacttcaccggcttgaatacccgcttcaaatgcgagcggataattggccttaattgcatccagcattggatttctgatattcatgccgtatctgcagcgattcaaagccggttttaggtgaaggccgagaccgatttttaattctttgtcatccccaatgccgagggtgaatttttgatcgatggttttcatgatcaattgcgtcagccggtctgtctcttcttcatccatcatgctttcgattgcaccgctgcgaatggcggccataaccgtccttttcgcgccaagcaaatggatggcgatgtaggccgtttctttttctggaaacgccacgtgcagcttttgttcaagagtgcggacaatcgccctcgccacttcatattctttatgattcataatctcctttacatctttggaataaagagaaacatgtttgccgcttcggatgcgtttgcatgcaatggcgacgtggatgagaagattgtttagtccgatatctgaaagagaaatttgatcttcgcttattttttctaaaatcgtttgacggatcatagcaagctcttcttttgggagaatggatatccgggtgttcataatatcaatatccgtttcccgctttggaaaaaggtgctctgcgatgcacgatcgcagcttcatctcatctcccttcagcttaaagccgtaattcggcttgatcttcagctcaatgtcgtaaggtttaagccttttcttcacatctctcatatcgttttggaccgtcgatttgctgatatacatctcagcggctaaatcttcaagtttgacatactcctcagttaagagaagcctttttaataaatagagaatacgctcatttggaaaaacgggagtagaaagctcttgatgaaatgtgtgctgcagaagctggcgaaagaggcggtcattcttgatggagagccgatagcctgcacccctgatcgattggacggcagcgccgtttttggagagaagccggtctaattctttcacatctgatctgatcgtccgagaggtcacatttagctcattggccaaatatgcgctggttaatggtgattctgcccctatcaattcgccgaggataagcttaagccgagcattgagcatagaaaaagaccctcccactaagatacttgaaccgagaacaaacctatacactcaggtatattcattttttttgtgaaatttgtctcatagttaagtaaattctattatgactgcgctttcaagtcaatttggcctttctccaagaaaaaagccggtttaaccggctttcagattctttttctcccttcggtttttaatgattttccatgcgatcggatagatgacaggcgcccatttgacggcgcttttaatcatttttttcatggcttgactccctcctgttttttttactgttttccctgatgaacgggagccaaaccttttaactatcttgagacatagcggttcccttttatccagaatcgccaagggtattccctcgcttcacctgagttgtcaatgccaattcgcggaccgctcaaaatatcttggggttcatacccttttgcgatataaagcggcggccccgtcagcggtctgccgtaatcgttcatcgtgatggaaagcgcctttgtcagctttcccggaccgtttgtccaatcgcgcggtttctttccgctccttcgcttctccatcagcgcgaggccttcatgaggttcaagcgctctgatcagcacggcctcaggttcatcggctcctccgcttacaacattgatgagtgtgtgggtatgcatggtgtacgtatacaccacgccggcttcacgatacatgatttcggtgcgctttgtccggcggttgccatagctgtgagctgctctgtcccctggccctttataagcctctgtctccacaatatatcctgaagcaggcccttcttccgtttctttaacgagaagacagcccaacagggacctggcaagttcaattgttggcttgttgtaaaattcgagcgggagaggttcgtgagctggattcatttttgttggcctcctttttgctaaaaagcaaatcgcctctttgtcgattgtgatatattttaccattttcgacagacgagatgccagaaatgaaggcaatgatgaatgagatgatttattggtcttcagtggatgacattgacatatctgtattattgtatacaataataattatattctgaaaaaaggaggcgaaagcttttttcatgcactcttcaaatccagtcaaaagacagtctgcaagtgattacgcttataacgaattaagaacgaaaatcatcgaacttgaatatcctccctctgaacagcttgctgaagacagtcttgcaaagggtttaaacatcagcagaactcctcttcgccaggctctttaccggctggagcttgaaggattggtcagtaaacagccgaacggccggcttcgcgtatgcccgatttcgctcgctgaagcgaaagaggtttttaaagtgcgtgaagcgcttgaaggactactcactgccgaagccgcacagctggtgacgccggagagccttcatcagcttgaagaccgcatcgaactgatgaagctggctgccgtaaagggccgcaaaacagatacggtcaaatacggatcagaatttcattctatcttgcacgccatcagcacaaatgcaaccgcaaaacgttttctggatcagcttgaaagcaggattgaacggtatcgcagaatcagcggatacaaaaatcctgactacaaaccgtctgtatctttcaatgaacacttggatatttttaatgccgtcaaagaaaaaaacagcgttttggcagaagccgccatgcgttcccacattaaacgaagcttacgttcaattgaagaaacgctcgaacgttcatactaatccgccgaacagccaatgccattctcacagcacgtttttgacacaaatgttaaaaaacgaataagaggtggaaaaatgggcaaacaaggtgtatttaaaccgggattagaaggcgttattgctggagaaacgaacatttctttcttagatacggaagcggaacaaatcgtcattaaaggctatgatttaatcgaacttgcagaacaaaaaacatatcttgacctcgtctatcttctccttcaagataagctgccagatccaatggaattgaaaggaattgaaagcgctttaaaaagtgcgtatgaactgcccggcggaatctatactattctgaagtcgcttccgaataatacccatccgatggatgcgctccgaaccgggatttccgctttagcaggatatgatcccgaattgaatgacagatctcaagcagcaaacagaagcaaagcgctgcgcttgatcgcacaggttccgaatattaccgccaacagctaccgcatccttcaccagaaaaacgtcatcacgcctgacaaacagctttcattcagccagaactttttatatatgctgacggaaaaagaaccgactccccaagaaacagccgtctttgatcagacattaatgctttacagcgagcacgaaatgccgaactccacatttgccgcaagagtcatcgcatcgacaaacacagatatatacggtgctttcacaggcgctgcagcatcgctaaaaggacatttgcacggcggtgcgaatgaagcggtcatgtacatgctgctcgaaggagaaacaaaatcgggcttctgcaagctgattgaacataagttaagcagaaaagaaaaaatcatgggctttgggcaccgcgtctatatgagaaaaatggacccgcgcgcagccttgctgaaaaaggcgctctattcgctttctcataaaaccggcagacaggatttatatgagatgtgcgatgccggcgaaaagctgatgcgcgaagaaaaaggcctgtatccgaacctcgactactatgcggctccagtctattacctgctcggcataccgatcgatctctatactccgatatttttcgcggcacggtcggtcggtcttagcgcgcatgtcattgaacagcatgaagacaacaggctgttccgcccgagagttcactatacgggaccgcgtcatcttcatccataattcgctttgattcagaaagaagggagatagatgttatgaaaactgaaagtcaaacgctccaaaactgtgatcaattgctggaagagatcgccgactatacggtaaatgccaagatttcaagcgaagaagcgattgaaaccgcccgttacgtcttaatggatacactgggctgcggaatattggcgctcaaatatccggaatgcgccaagcatctcggcccgattgccccgggtaccgtcgtcccgaacggcacccgcgtcccgggaacgcaatttgagcttgatcctgttcacggcgcctttaatatcggctgcatgatccgctggctcgattataacgacacatggcttgcggccgaatggggccatccgtcagataacctcggagcgattttagcctgcgccgactatgtcagcaggcagctgctcgcggcgggcaaggaaccgctcacgattaacgatgtcctgacggcaattgttaaggctcatgaaatccaaggcgtccttgctctcgacaacagcttaaacagaaacgggcttgaccatgtgctattcgtaaaagtcgcctccactgctgtggcatgctcactattggggggcacaaaacaggatgttatcaatgccgtctcccaggcctgggtcgataattcaagcctgcggacgtaccgccatgctccgaataccggctcgcgtaagtcctgggcagccggtgatgcgactagccgcggcgtgaggctcgcgatgatgaccttgaaaggcgaaatgggatataaaaccgctttgtctgctccaatgtggggttttcaggatgtcttattcggaggaaaagaattgacgctcgccagaccgctcgactcttatgtcatcgaaaatgtcctttttaaaatttcgtatccggctgaattccacgctcaaacggctgctgaagccgcgatcaggcttcaccctgaagtgaaggacagacttgatgacatcggccaaatcgtgatcacgacgcacgaatcggccatccggattatcgacaaaacgggagaattacacaatccggctgaccgtgatcactgccttcagtatataacagcgatcggactgatctacggcgatattaccgctgaccattatgaagacgaaaccgcgcaaaatccggagatcgacaggctgcgcgaaaaaatgacgacagtcgaaaacaaacagtattccgtcgattatctcgacccggaaaaacgctcgatcgccaacgctgttcaagtgttttataaagacggcacacactcggaaaaaatcgcggtcgaatacccgattggtcatcggcgccgccgcaacgagggcatcccgctcttaaaagacaaatttatcaataatttaaaaacgcgctttccggcggggcaagcggaacgaatcaacgccctgctgaatgatcctcacagattaagcggtgcacctgtaccggatttcatggaattgtttgtcatttaggaggttttgaatatgtggattgtctcgaaacaatcaactcaggaagagctggccaatgcattcagaaaactgatgaaagcacctgatattttgaaaatacccggtgttcatgacggaatggctgccattaccgcaaaaaacatcggcttcaaagcgctctatctctccggggccgcctacacggcaagccgcgggctccctgacctcggaatgatacactcccaggaaatcgctgaaaaagcaagcgaacttgtgagagccgcaaatcttccgcttttggtcgatatcgacaccggctacggcggtgtcctaaatgcggcacgcacggccgccgaaatggccgagagcagagtcgcagccgtccaaatcgaagatcagcaactgcctaaaaaatgcggacatttaaatggaaaaacgctcgtacccgcagaggacatgatcgcaaaaattagagcgataaaagaaaccgccccttcgctcgttgtcgtggctcggacggatgcaaaagcagcagaagggatggaagccgccgtcaggcgcgccaatttatatgccgacgcgggagccgatgccatctttcctgaagcattaacgagcgcagccgaattccgggaaatggcttcttccattaaagcgccgctcctggccaatatgaccgaattcggaaaaacgccttattatacggctgacgaattccaaatgctcggctgcagcatgattatttaccctgtgacttccctgcgcgccgccgcgaaagcttatgagcgggtcttcgcggagattttcgaaaaaggcacgcaaaagggtgtgctcgatgacatgcagacacgcgaagaattatatgatgcgattcattactacgactatgaaaaactggacgaaaatattgccaaaacggtgcttcccgaaatcggaaaagaacaccgttgatacgcgaaacaaggctgccgaatgatcggcagccttctccacttacaacagctgcaacatcgcaccgccgacagcaccggctgcaacgatgatccacggcgagagcttccagtagacaagcaggctgaacaaaaccgcagcgaatgcaaaatcgatcggcgccaatacggagctggtccagatcgggtgataaaacgcggaaatcaatatccccacaacagctgcattcactcccattaaagcgccttttactttaggattgcggcgcagcgtatcccagaagggcagcgtccccagaatcagcaggaacgccggcagaaaaatcgccgctgtggcgagcaatccgccttgccagccgctgatcaccgcaccaagatatgcagcgaatgtaaacaaaggccccggaacagcttgtgcggctccatatccggccaaaaatgcctcttcacttaaccatcccgccggtacaaattcccgttctaataatggcaggacaacatgccctcctccgaagaccaaagaacccgacctgtaaaagctgtcaaacatggcaatccagccggaagatgtcatttccctgagcaccggcagcaaaatgagaagcccgaaaaacaagctgagacagaccgctgcaaaccggcgcgacacaggaaactgcatgacggaatcatccgtttcaacttgctctttatagataagatatccggcgaaagcggcgagcaggatgactccgacctgtgtaaaagccgtctgccagagaagagtggcgaccagagcaaacagcgcaatcgctttgcgccttttatcaggtgtcagcttttgcgccatccccataacggcatgggcgactacggcgacggcgacgattttcagtccatgaatccagccggctgttccaatatcgaagccttgcagaaccatggcaaataatacaagcgctatgacagatggaagagtaaacccgatgaacgctgagattccgccgaggacgccggctctcatcacgccgattccgatccccacctggctgctggcaggaccgggcagaaactggcataaagcgaccagatcggcatagtttttttcgtccatccattttcttttacggacatattcggcatgaaaatatcctaaatgtgcgatcggacctccgaatgatgtcaatccaagcctggttgaaacgaatagaatttcaagcagcgacttcaagcttctgtccgctttatgctttgtcatcattccactcccctattctttaatttctttaaacagttcatatgctttcaatctggcttccttcagtacgcttgctcctttttccgtggttgaatagtattttctgatctttccgtccacattctgttcttcttttcgaagaagtccgtcagcttccatagaatgaaggatcggatacagcgttcccgcactgatgttatatccgtgctctttcaattcctcaagcatccacaatccgaaaatcgggtgttcgctggcgtggtgcagaatatgaatttgaataaatcctagaaatagctttcgcaataccttatcttccaataccgcaccccctttaacgaaattcaatatcgaaatccgatatcgataatatataacgaaagtgtagcatccgttccctttcttttcaaggtcttttgcccttaaaaaaacaagcccaaacatgggcttgcctgtttccaatcatttacgactgatactgtacacgatgaagatttgcgaaaataccgccgcgctcaaccagttcatcatgtgtcccttcttctgcgattccattctctgtcacgaccacgatccggtcggcattgcggatcgtagcaagtctgtgggcaatgacaagcgtcgtcctgtcttttgcgagctccgtcaaagcgttttgaatcacctgctccgtctctgtgtcaagtgctgatgtggcttcgtccaatatgagaatcggcgggttttttagaaacatcctggcgatggcaatcctctgcttttggccccctgacagcttcagccccctttcgccgacctgggtttcataaccgtcggggagcgactcgatcagctgttccaaatgcgccattttggcggcccgctgaatttcttcatctgtggcatccagttttccgtaggcaatgttttcgcggagcgttcccgtaaaaagaaacacatcctgctggacgatgccgatttgcgaacggagagagcgttttgtcatatcgcgaatatcgatgccgtcaattgtgatggccccgccgtctatatcgtaaaagcgcggaatcagcgagctgatcgtcgttttgcccgctcccgacggcccgacaaaggcgacggtttctccggctttaattgacagatcgatgcctcgcaggacgggtttatgtttttcatagccgaacgtcacattcttgaagacgatgtttccttccagcgccggaacatcaatcgcatctttgcggtcgacaatctgcggctttgtatcgatcaactccgtaaaccgcttaaatcctgccattcctttaggataaagctccaaaatggcgctgattttatcaatcggcttaaacagcacgttgacataaagaacaaacccgacgaattccccgtaggacatattcccggaaaaactgagccaagctccgaacacgagcactgccagaatcatcagccgcgtcatcaaaaaggttccggcagtcgtgagagccatcgttttgtagcccttcagcttcgccttgcggaacttttgattgttttttaaaaaccgggatatctcaaagcgctcattcgtaaaagattgaacgacgcgaacgcctgaaacgctgtcctcaaccctggcattaacatcggcgatttcgctgtacatctggcgccaagcccggttcatcctgatattggaatagatgatcaagataatcaataacggcacaaacagaactgcaaccaatgcaagcttcacattaatcgtcagcataatccaaaatgcacctaaaaaggtcatcacggcgatgaacaaatcttccggtccgtgatgggccagctctccgatatcaaacagatcatttgtgatgcggctgatgatatgtcctgtttttgtattgtcaaagtagcggaaagattggcgctgtacatgttggaaaagctcctggcgcatatctgtttcaatgttgatgcccagcttatgcccgagataattgacaatgtactgcagacctgtgctgagcaggtagatcagtaagaggccgatgcttacccagacgatttcaagccagtctcccccgggaatcagcgtatcaatgaaccactgaacaactagaggaaaagccagctccagcactgcaacgacgatcgcgctgctgaaatcgatgaagaacaaacgtttatgaggtttatagtatgaaaaaaagcggcgtatcataggatgatgtgcactccttttgaaaatctttacgagattgatcgtatcacagtttggcatcggaagtgcaaaaatttcgaaaaataattgaaaattattctcaagtaggctgttttataaaggaattcccgcttcttttgcttcctgtgcaacaagcttagcgatttcttttgccccgaagtcgcaaaagtgggtgtcatccctggctccgtccggatagttggggtgttcccccggttcaagccataaatacagctttttggaagcttccggtcctagcgattcaagcaattgacggcttttgaaggcgagatcgataagcggcacccgaagctcttccgcaagctgtatcatcgcatcaggatagtcgccatgggtatttttaaagcggccatcgcttgcaaatgatcttctctggaccggtgtaatcagaacaggattggctttctttaaccgtgcctcatctatataccgggtcaaatgctgcttgtaagttgtgtatggctctgtatagcgatcatccggtttttggtcgttatgaccgaactggacaaacaaataatcgccgcttttgatctgtgttatgattcgcttcagcctgccttcttcaataaagctttttgagcttcttcctgatgccgcttcattgcggatcaaaacacctgcgcttaaaaactcgccgattttctgcccccagcctgcacgcggcgccctattctcatcataatcgcaaaccgttgagtccccggccaaaaacaactgaatgtctcgcatcatccatccccctgatccctttttatttatattaaaacgcccctcaaggaactgcaacaaatatacataattaaccattttgttctttatacgactcctttttataaaaaaaaggcgtcaattgacagaaaactatcaatttatactaatttttttagaaatttatctaaaaatatttacttggatggtaaatggtgatagattaaacaaacaagaaaaggaatatagttgatcgcgatctcatttctgccttttcttgaaaataataggacgtcctctactttaacttaaacattgcaattaggaggaacttatcgatgctaaacgaaaattcattcgtaaaatcagtgttggtctattagcttctgcagcattgttttcatttatcattcctacccaaggagcaaatgctcaagaggtgaaaacaaatcattttagaggaccgatcttttgtccgccgccattcaagccggcacctaaaccacagccgcctcaaaaaccgcagccggacaatccgcaaccggataacccgactcagaagcctgtgcttgaggcaaaaactattaacagcaataaagagtggtcaacttcagacatcgaaattacttatagaccaaacgcatttgtcggttcaagctatgttgaatttcattttccgtaccgctttcatgcaagcacaagagatacactaaatggaaaaacgcttgactatacacaaattttaaatgatggacaaacggtcagagttcctgtctatgctttaagttcctctgagttcaaactggtcatggttcggaaaacgcttccaaatgccggcactcacagaattactgctgaactgcagcaaaatggaaaaaacatcaaccatgctgaaacaactttggagattgtccctcgttaaatcaatgttcggcccgccggcatgaatgtgccggcagccgttctattgtatttttctttacatatcatgcattttttaaatgtttttagaattttcctttaaaaatatttacttgattggtaaatgatgatagattgatggagcgggaaaaggaatatagtagattccgaacttattttttcctttttcatcattttttaaaaacatttattaggaggggtaagtacatgttgaaacgtaaatttatcggtaaaattggagtcggcctattaacttcagccgcattgttttctttcattcttccgacggaagaggcgagcgccactttttacagaaacgctccgacgctgcatgtcgagacggttgacagcaataaagaatggacaacttcagacattgaagtcacttacaaaccgaacttttttgtcggttcaagctatgttgaatttaacttcccataccgcttccatgcgaatacgagagattcgctgaacggcagaacactgaactatacacagattttaaatgacgggcaaacggtcagagtgccggtttacgctttcagctcttctgagttcaaactggtcatggttaggaaaacgcttccaaacgccggcactcacagaatcaccgcggagctgcaaaagttcgggcgaaactacaaccacgcagaagctacagttgatatcctgccacggtaaaattttaagcctgccggcataagagccgccaggctttttttcatttaagcgctgcccgccgaaccagtatgttaaaacaagcgagcgcgctgatattgcaaaacagaatgacgactgccatcggcaaagctgtatggcttccggcaataccgacgagcggcgccgcggcagctcctaaaataaacggaagcagtcctagaagcgcagatgcgctcccggctgatttcccctggctctgcatggccaaggatccgctggtcgtcgtcacgattccgatgcaggaaaccacgacaaacagcgggattaaaataagaatcagcggagctttaaaaaagacagaaacaaataaaacaacgcttgcggtaaaagacagcagcaaaccgctccgcaaaagggacgcttcaccgaaccggccggcaagcctgcccgtaatctgagctgcgataataatgcccaggccgtttaatgcgaaacaaaaactaaaggcttgagccgacaatttgtaaatgtcctgcaaaacaaacggagaggccgatatatagccgaacatccccgctacgatcagcccttgcgccaaggcgtatcccataaatgtacgctggccgaagagccttccaaatgatacaaacgtctctttgaatccgcctgccgtacggttttccggagacagcgactctttaaccccgaatataacggacaaaatcatcagcaggccaaaaaggccgatgatgaaaaatacgccgttccacgtcgtccatttcatcagctgtccgcccgctaccggagatatgataggcgctatcccgttaacaagcatcaagagcgaaaagaactttgtcaattctgttccagaatatagatcacgggcaatcgcgcgtgatatgacgatgccgcctgcccccgccgcgccttgaataaagcgcatcgcgatcaaaacccatacagaagatgtcatagcacataaaaaagaggccgcggcaaaaacggacagcgacacgatcagcggaagccttcttccaaggacatcgctgaaagggccgatgacaatttggccgattgccagccccagtaaacacgatgttaaactgagctgaacgacggaagcattcgtatgtaaatcagttgccatctgtggaaggccgggcaaatataaatcgatcacaaccggaccgattcccgataaaatacccaatatgacagcgatccataccctgttcggctttgctttcgaatgagccgcaagatctgcctggctgttaagcgtacccattggatcactcctttattatatttttaaatacgccctcgaaaccttccagtgtattgtataccttaagttatgaagatgacaattagaaaaaccgggcgagcccggctgattagtaagattcatatcttttaaaaacaaaaacggtgcacatgaacaaaagaattacaattcccaaagacgaaaacaccatccagccgaaagcatggtcccatgaaccgtgcatgataaaataatcagcctggcttttcgccttatcaggcatccattcggtaaagcggggaaataaggatcccgccaatgaaacgaaggcgatgaaacagatgctcatgccggcaatccccccgatatggcgaaacagagcactgaaaaacatcgtgaccgacatgacaaatataatccatatactgtacacggataaactaaataaaaaccggtcaaattcaaccttgccgaatagcagatttgtatagtagaaagccaaaccgtagcttgcagcaaacgaaaccaatacgagcagcacctgctgaagccacttgctgccgatatactgaagcgggctgacaggtctcgccatcaccaatgaaagggatccttggtttcgttcgtggacaatgctgcccatcacactgaaaacgaaaattgccgtaccaaccgtgccgaactgggacaaggtgctcgccattacctcttcacctctcggccttggtatgtcgatcacggatccctcaggcaaattcccggccatatcgataatttgaggcatataatacaggctgagcggctgaatcaagcccagaaggatcaaaatgacaggcagccaaagcagctttccgtctctccatctttccgtccattctttttgaaataacataaaaaatgaattcatagccccatcaccttcagatacatatcttccaaggacatcgttttttgttcaaaacgaacaatcgatacttgtctgttcaagcattcagccaacagtcggcggctgtcagaccgatctgttaaataaaattcagcttgtgaaggcttatgatacacgactttgctgacataaggcaggtgttccagccatccttcaagactttcttcagctgtcagcatatatgatggctttaaatgacggttcttcaatctgtgaagcggaccagaccatttgacagccccttctttcagcatgatcacttgatcgcacacctcttcggcatcatgcagcacatgagtcgaaaataggattgtcatcttcttttttaaatccttcatcatatcaagcacttcgcgccgccccgccggatccagggcggaaacaggttcatccaaaatcaacagcctctgctcatgaaccaaagcctgcgccagcccgagcctttgcttcatccctcctgaaaaaccgccgattttccggtcttcttccttttccagaccgacatagcgcaaagcggttcgactcttttccagggcttcacgacgtttcattttggaaagccttgcagcgaataccgtatattctaaagctgtcatccatgaaaaaaacgcaggatgctgaggcaaatatccgatttccagcctgtttatcgattctctccccaaaaagcggatgcgtcctgatgtaggggccaataaaccggaaagcatttgcaatgtggtcgtttttcccgctccgttcggcccgagaagggcaacgcattgctgatattcaaggtcaaagctgacattttggacagcttggtgctgctgatacatttttgttaagccattgacggacagcatcacacccgcctcctctcatatgtttttttaccgatgataaagtaagagacgggaccgacaaaactgatcccgaaaatgatcaaaatccacatccactttgggccattcgttttctcctgttttatgcaactgaccaatgcggacactgctaaaatgaaagacagcacaatgaaaggggcgagcagcgcccaaggtatatctgctccagtcatgataacggcctcctttttttatgaaacggccttacaacaaataaataatagaataataaaggcatcggtgtttggatcaagccccatattccccagaaccacgcattggctccctttttcttcgcattaagaaatagaaagatactctgcgcaaataaaagcggtgaaatgcaaagcagcagcagcagcagtttttcctgagtcatgtcaagattcatttaatcagcctcctcatcagccgtatgccgccttttttctatcagggcaagcgctggcagcaagataagcgccgctccctgcaccatgataaaaacagccggtacttgaacggaaatcgtcaagtaggccgataaaatcaccagcgccatgacgataaaacaaagcaattcctttttaagcgcccgcttgcgctcttgcttaaaccgcgctaaacgctgattcagttcaaatgcttgaggaaccggcggcacaaaattatcatcaattctttcgagttcgcgtttcaaatgtgtaaccgtttctttttcatctcgttcattcactgtccccactcctttcgaattttctttaatccatgatgcacgcgcgatttgacggtaccttcttttattttcagcatgtttgccacttcagggtaagtaaacccgtaatagtgtcttaacaagattggcattctgaactcaggctcaagcgcagcaaacatctccaagtattcgctccattcgtggccgtgaagggcagaattccatttcatttttcgcaaggcttcctctcctgctgcttgcgttttgcggttttcgcgttttttccggcgctgatggtcgataaacagccgggaagcaattgagatcagccatgttgaaaattttgcattgccctgaaactgatgaaggctgacatacgctttcagcatcgtttcctggaccaagtcctctgtgagatctgggttcagcgttaatttcagaacatattgatatacaaaggggtaatgaagctgaaacagtttcgtaaaagccgcatcttcaccgtcttttgcccgtatgatcagttctttttcatctgcttgatccactaaaacgcaaaccccctttctttttgtctctgtatctaggacgacgcctgcaagcaaaccgttcaattctatttcaataagataaaaaatcatcttgtttttcggccgggatttatgatgtacttgaatttaaaggggtgtgagtaaaaagggatggagcggcaaaaacaaatcgtctatgaagaaaaacaaattttaaggaaagatcatatgatcttttggggtgccgtcttttgtttctggtttgctacatacatctatgtccctgttttcggattatatttagacaacatcggattttcatattcagcgataggaatcgtacttggaagctacggcgtcactcagatattactgcgttttccgttcggcatcctgtctgatgttctttcgccgcttagaaaacagctgttgatcagcggctttgcaatgtctctgttgagctgctgcatatttctgttgtccgattcgttcatcatggtgatcacagccaggctgctcgccggtatgaccgcggcgatgtgggtgatggcaaccgttttatactcgcagtattttacaaaagatcaatcatcaaaagcgatgggcatcctgcagtttttaacggtccttccccaattcatcagcatggcagtcagcggctacctcgtccatttgttcggctggatgtttccgttttggatcggtgttgccgtatcatgcatcggactgattctgtcattttacattaaagataacgggccccgccatacggccaaggggatggctttgtcagactatgttaaacagacgttgcgtcttcctgatttaaaagcgattacaacattatcgtttttagcccacgctgtactatttatgaccgtgttcggatttacgccgatttacgcggaatcggtcggaatcgatgagaaacagctgatttgggttatgttcgccttttttgttccgcaaacgctggcttccgtgtggtgtatcttttacaaagtaaaggccgccgatgcactgatatggatatcttatgtgataacggctgttttcttttgcttgctgccgtttgccgaaacccttttcgcggtatgtatcgtccacgccgtgacaggactgacattgggatttatttttccgcttttggtcagcaaagtcgttcagcttggtacgcctcagctcaaaatgtctgtgatgggtttctatcaatctttttatgcgctcggtttttttctcggaccggttgtggcgggaaaagtggctgaactgttcgggctgccgaaggtgttttggtttgccggcgcattgtcactggccgctgcatgtatcatgcttttttccaaacagtttcgtatatttacagcaggaagacgggataaatcctcaaatatcgttcagccgacgaaggtcttccgtaagtgaaacagcgatgaatcccacaagaggttcatcgctgttttcttctttaatacgggtcttgagagtgccctttttcttccgcctgtctcggggcatcttcggcgccttctgctccgatcggctcccggctggatgtattttggctggaggcgttttttaatccttcctcgactctgcttccatattccttgtcgcattgcttcagcatatcgatcatcttcgtttgaattctttggtcgcacggggcaagtgtattgaccagattcgtaatcagctcgtccttttcccagtcttcgaaatgcctgtaagtgtccccggcctgcttgaaattattctgcctgtcgatactttcgcgcacaaggtttccttccacatgcggggtgtattctttgccatcctgctttgcttctttcagcccgttgatggttgaaggttcatagttgatgtgcgggctttgatttttgcctaaatcgaccttgtactgcatctggccgccccgctgattggttgccaccctttttttcggcgcattgatcggcagctgcagatagttggctcccactctgtagcgctgtgtatccgagtaggaaaaagtacgtccctgaagcattttgtcatcggaaaagtcaagtccgtcgacaagaacccctgttccaaatgccgcttgttcgacttctgtaaagtagtcttccggatttttgtttaaaaccattttgccgacaggcagccaaggaaattgatcttcaggccacagcttcgtgtcgtcaagcgggtcaaaatcgagctcaggatgctcatcatcgctcatgatttgaacgaacagctcccactcgggataatctccgcgctcaatcgcttcatataaatcctgtgtggcgtgattgaaattcttcgcctgaatttcttccgcctctttttgcgtcaagttttttatgccctgcttcggttcccagtgatatttcacaagcacggcttccccttcttgattcacccatttgtacgtgttcaccccggacccctgcatctgccggtagttcgccggaataccccaaggcgaaaacaaaaatgtgatcatatgcatcgcttcaggcgtgttggaaatgaagtcaaagattctttcgccatcctgcaaattcgtaaccgggtccggcttaaatgcatggattaaatccggaaactttaccgcatcgcggataaagaagatcttcaagttgtttccgaccagatcccagttaccgtcttcagtgtagaacttgaccgcaaatccgcggggatcccgcagcgtttccggtgaggatatcccgtgagtcaccgtcgaaaaacggacaaacaccggggttctcttgcctttttcctgaaaaagctttgctctcgtatactttgagaccggctcatcgcctgctgtcccataagcttcaaaatagccgtgcgctccggctcccctggcatggacgacccgctctggaaccctctccctgtcaaagtggctgatcttctccaggaaatcatagttctccaatgttgatggcccccggttgcccacggttctgatattctgattgtttgtgatcgggtggccctgccggtttgttaacgtatcatcagtctccatgtcagatttctgctcgtttgaatgctgatccattcttcttccccctttatttggaattaacaataatttatcccaatccagaaaagttattcagcatttatcatgatcaaatcaacgataataaatttttctttataataattataaataaatattgtttttttcttgagaaatgttatcattgttttgtaattaaaatttacgcgaggtgatcctttgatgacgacaaataaaaacaacctaacaaccagctggggcgctccagttggagacaaccaaaactcaatgacagctggttcacgcggaccgacgctgattcaggacgtccacttgctcgaaaagctcgcccacttcaatagagagcgtgtgcctgaacgggttgtgcatgcaaaaggcgccggtgcgcacggttattttgaagtcacaaatgacgtttccaaatatacaaaagccaaatttttatcagaagtcggaaaacgcacgccgttatttgtccgtttttcaactgttgccggcgaaaacggttcagccgattccgtccgcgacccgcgcggtttcgctgttaaattttatacagaggaagggaactatgatctcgttggaaacaatacacctgttttctttatccgcgatgcgattaaattccctgacttcattcatacacaaaagcgccatccggtcacacatttgaaaaacccggatgccgtatgggatttttggtcattgtctcctgaatccctgcaccaggtaaccatcctgatgtctgacaggggcatccctgcgacttaccggcacatgcacggcttcggctcccacacattcaaatgggtgaatgccgaaggagaaggcgtctggatcaaataccacttcaaaacagaacaaggcattaaaaacctgaccgaagaagtggggacaaagattgcaggtgaaaaccccgattatcacacacaggacttgtatgaggcgattgaaaaaggcgacttcccggcatggaagctgtacgttcaaataatgccgctggaggatgcggatacgtaccgttttgatccgttcgatgtgacaaaagtatggtcgcaaaaagattatccgctgattgaagtcggccgcatggttctaaaccggaatccggaaaactatttcgcagaggttgaacaagctacattctcccctggaacattggtgcccggcattgaaccgtctcccgacaaaatgcttcagggacgcctgttcgcatatgcggatgcacaccgctaccgcgtcggcgcaaaccataacagcctgccgatcaaccgtccgaaagcggaagttcataattatcaaagagacggacaaatgcgctttgattcaaacggcggcggctctgtctactatgagccgaacagcttcggaggccctcaggaaactccggaaaacaaaacaacggcttatccggtgtcaggttcggcggacagcacggcctacgaccataacgaccactatacacaggccggagatctttaccgcctcttgagcgaagaagagcggacccgccttgtcagcaatatcgtaggttcgatgaagcaggtgacaaaagacgaaattaagcttcgtcaaattcagcatttctataaagcagatccggagtacggcacacgagttgccgaaggattgggcttgtctgttccgcaggaagtttaaggctaatatcatttcaatcattctcaatgaaattctcattttctcaggtacaggcacccgtcctcttaagcatgcgggtgcctgcccttaatcaaagaacgacaggggatgttacgtgtggaagacgagcagctcgtccctttattaaaaaagcggggtttacgaattacagctcagcgcgtcctgattttaaaaacgattgcttctttgggcggccatccatcggcggaagacattcaccgggaattgccgtacatgagtctcccgacaatctacagcaacttgaaactatttgtgaagctcggcattttaaaagagctgtctcacggagacgcaaaaagcaaatatgaactgtttacatcacagcattatcatgtcatttgtaaatcatgcgggaagatcgctgatctggactatcctcacctcaaagaggtagagcatgcggcagcacaattgacgaactttaaagtgaactcgcattttctaggaatctatggaatctgtacaacatgccaagaacagcagcagaggtgaagacatatggaacgaaaaaaagtcggcctgttagtcatggcatacggaaccccttatcaggaagaagatatcattccgtattacacgcatatccgtcatggaaaacgaccgtccgatgatatgattgaagacttgaaaaaacgctacaagcatatcggcggaatctctccgctcgcgaaaattacgctcgctcaggcaaaagagctggaaaaaacgttgaacgagcgccaagataaagtcgaatacgtgatgtatctcggcttaaaacacatctctccgtttatcgaggatgcggttgaacaaatgaaaaaagaccaaattgaagaggccgtttccgtcgtcttagctccccactattccaccttcagcaccgaagtatacaatcggcgcgccaaacaggccgcagcagcaatcggcggaccacggatcgcatcgattgacgagtggtatcaggaagaaggctttattcgctattggtctgaagaaatcggcagcattttaaacgacatgtctgaaaaagagcgggaaaaagcggccgtcatattctcagcacacagcctgccggaaaaaatcagggagcatggcgatccttacccggatcagctcgagaaaacagcacaactaatcggagaacggctgtcatttgaccagatcgccgtaggctggcaaagcgagggcaacacgcccgatccttggctcggcccggacgtccaagacttaacaaaggaactgtatgaagaaggcttccggtcattcatttacgcaccagtcggttttgtatctgaccacctggaagttctgtatgacaacgactatgagtgcaaagtggttacggacgagcttggcgcaagctatcaccgtccgcctatgccgaacactgatccgcggttcatcgatacgcttgcttcagtcgtggagcgaacatacaacagcacagaacaggagaaagcggagctgtaaatcgagctccgctttttgctgcaatgttatgacgtgacaatatcccgcttttgaaaaacccaaaaggagacagccagaaaaagaataaaataaacagcaatcacagccgctgaaaatgaaagagtcatatcttgaataaacggctccccatcaatgtattgactgagatctgaatttgcaaagatcgtatacttggtccaatcaaattttgccgctaaaaattgagtaatcgcagaccctgtaaaaaagacgaacagcgaaagaccgacagagacgaccgcgcttcttaggatgaccgaaatcataaaggccagcgtggccagcacaataatattcaataaagcggctccatagtctaaggctaaaaacttcagcattgacatctttatcacttcgccgcttcgataggacaaatagtattggcttccctccaaacctagcagggcataccctaaaacaaacgcaaataaaagtgtcgcagcaaacataaatacagtgttgagcaagatcgacaagtatttccccaatagataatgccaacgcttgaccggtgttgcaatcgcaaatttaatagttcctttgctgtgctcaagcgcgatggagttcgctgccagcacgattgcaatcaacgcgattaatgttgtgatcggttttaactccttcagcatcgtccaaacattgtatttcgcagaaggcggcaaattatgctcaagccggtattgattgaccgcgatctcttcttttaaaaattggtatttgggaaccgctgggctcagctctctcatttctctttcatactgagcgttttgaacggttaattgctctttccagttacctgtctccttctccttttcgccattgctgaccatccatgcaacagcgattgtcatgacaagcagcaagcttaacacaatccaggtacttttcgtcaccatcagcctgtaaagttcatttttcaagaccctcatgccggtcaccccttattgatcaattccagaaagctttgttctatcgactgtttttcctgcttcatatgcagaactcttattttgttctccattaacagattaacgactttcataatgtcttcttccatgcaaaggacataaatctcatttttatcttccgtgagaccgcctgcatactggtactcattcaacaggtcagccgcttcatcggcgtggccgtttaatgtaagccgataacgaaccgtatcggtatcgcggtgattgctcttaatttgcaggagttctccgtttttcatgacgccgtattcatcacaaatcatctcaacctcagacagaagatgactcgaaatcaaaatcgttttgttgaaggttttcgccaagtactgaaggtgttcgcgcaaatcaatgattccctgaggatcaaggccgtttgtcggttcatcgagaatgagaaattccggatcatgcaagagcgcgacggcaaggcccaaacgctgtttcatgcctaatgaatacgttttaactggtttatgaatacttcctgtcaaatcaacaagctgaacgatctcttctatgcgctcctttgacacgtggctgtggaatccgccgagatatttaaggttttggtatcctgttaagtgctcataaaaggatgggttttcaacaacagaaccgactcgggctgccgcttcctcgtaattgcttttaactgaatagccgtcgatgcggatatctcctgatgtcggctttgccatcccgacaatcattttgataagtgttgtcttgccagcgccgtttggcccgagcagcccaaaaattgtacctggggcaatttgaaatgtgatattttggacaattggtctgccttttattcgtttacttacaccttcaaattcgacttgactcattttgtattcctcctttttggtatggcctgatctgtttcaatagaagagaaaaaaagagctgcgaaaccgccgtgaaccaaacaatcgaaccgataagaacggcaactgacttctccattgcaatgagggccgtcacaggaaaagaccatggaaagagaagccctaaaggggattgcgaaacgccgaaactcagcagtgaacaaatgaatacgataatgtttaatgaggtcttttccttactggtgaatttaagccataggaccgtacagatcagcggaaaggttgacaagagattgagaatgaagcccttcatccaagaaaaccaaggggcaggcccggggaaccccgatattaaaccgaaggcaagcgattcgatcacacagacggcatataatgcggctgcgaacagtccaataaacaaaaccttagcaaaaagcatggctgcgaaaggctgcggcgataagattcgattcagccacactcggtttttcagttcatccttatgcaaaaatactgtgaccgaagagacaagccagggataaatcgtgctgaataccaacagcaatgtaagatgccttaacgatgtccattcattccctcccgcaaacggggtgattcgttttgccataaaccctgtaaacactaaagatgcggtaagaatgaatatgctcgtcattgtaaaatcagagttcctgagtttgatccattccgctttgagcaaatttttcacggatcttttcctccccgctccttaagatccaacacatacagaccgctatataacccgccgaaataagataaactgccaggcctatatcgttcactgaatattcagtcaacaaaagccaagaaactccccacggcaaataaagtgttccactttgcataaaaaacggcgtcagcgtcatcaacagcacaaatagatattctgcctttaacgtcttcagaaaaaactggacggaagacatgatcaccgccagtatcgcaacagcggctaaacgctctggcgaaaacaaaacatccttttgaaacagcagactgactgccaaacagccgtaaagcaagaccagcgctgagacgatagttatcacggcgattccagtcagcacccaagtgaacaggcgaacgggataccgcaagataaaagcttgatgcatcatgcgtccaaataatcttctgcctgtaatataagtcagccaaaccgagacgacataaacagccattccctccatgctacggatttctttatttgccccgtttttataaaagagaagataattaagcaaaacggcgagcaccgtgatgatcataaccgtacatgcaaacgtctgaaatttcattctctttttcaccgcttcgggacagcttaaccaaaaataaactttaaacaatttcatttaaacgcccgctttctatggctagaaaacgatcaaacaattcgataaaagtttcgttccaatggcttgatgccatgatggtcccgtcataccgccttatgatgtctacaacgctttcctgcgcttttcggtcgagcccatttaaaggctcatccaatattaagatggaaggctgatgaaataaggccattgcgatcttcagcttttgcctcatgcctgttgaatagtactgtactttcgtgtcatcagccggattgataccgaaccgctctagttcagaatagatccggtcatcgtcatctattccgtgaagcaaggcatggactctcagattgtccgttccagtaaggtgctcatgaagcggcacttcgtcactgacatagccgatatgcccgacagcagcttccctgttttggataatcgattgaccgtaaatcaaaatttcgcccgcaaataaagacaagccggtaattgctttaagaaacgtcgattttcccgatccgttttctcctttgagcaaaacccggctccctttgtccacagcaaggctgacgttttcaagaagtttcctgtctcccgcccgcacctcaacatggttcatgacaattggaagctcaaccatggctacacccttgaacgaattcccaacaaaatgaagaatccaatgaaatacggcagcgaaaaagccagtgtgaccatgtttttataattggcgaacgacaaatcgacccatgaacttgtaaaaataacggcggatattccaagtgtaagcaaaaagaacatcacccgaaagaatttgttttgaatatatgccccgcgttcatcctttccgtcaaggctgattaaaataatgattccgataaaccccgcaaatcctgcgacagcaccaattgaattgatcatttctagcatcagcgatcatcctcctctagttggtattgaaatacctcgttgatgtccttctcaaataacgcggcaatgcgaaaccccattaacagggatggtttgtatttattcttttcaatggaaatcacagtttgtcttgttacacccaatagatcggcaagctgcttttgcgtccaccctttctctgctcgcagcacaggaatccggttggttaacaccccgctttgcttttcaatctcaatcaccctctttatttgcaaatcatttacatatatagagtacaatgttttttacacattgtaaagagtttataacaaaaagtaaaaagttttttaccaaaacagactaaaaaaagatcttcacgtgatgattgtgtgaagatcttttcgacaatcaagatttaggtttttcaaaaatcagttcgatagaagaaacctggcctccggcccttgatggaacagaaaagacgctgtgaagcttccagcctttttcagcatattcatgaatcacatcagaataatttttctcaagttttccgttgaatgctcctacagcgattgaaactgtttgatattcatacatacccttcactccttgttcatcattttcagcgcttgataagcgcgtacttccccgtagccgtatataacatctttccccggtttgcccaggtctaatgccgatttcctcaggatgtgatgcacttgtttagccgatggcttcctgtgatggcgctcccggtattcagatataaccagtgcagctgttccagctacctgcggggcggccaagcttgttccgtatgagagggaatatccctttgggatgtttagcatctggtctaatgcggtgttgtccttccctttcggatacgttgtcagtacgaggtctgtcacacgaaccatcccatcctgatcatacgtttctcccaaatatcctcccggggctgtgaattcaatttcccgcccttgattggagtatggggaaatattgttgcttttcatattgctgccgactgatacgacgtgcttcaaagcgctcggcaaatgcaccttgttttccgttttcctcatctcatcaaggttgactcctttattgccggcggaagagaagaccagcacctgatgctttgcagcgtagtttgcagccctttgataagctttcatcagcacttttccttccctgtcaagagaagtatagcttcccgtactgatgttgatgacttcatgcccgtcattgactgcatcaaccatcgccttcatgatgttgtagctgtctccgcctttttcgtccagcacttgataaggcgttatcgtcacatctggcgcaatgatattgatcatcccggctgtttgtgttccgtgtcctgtcggatctccggatacaggcttgccgtcaatgtaattccagccgccatttgtattgacggacgcttttaagtccggatggtcaagatccagtccgctgtcaatcaaggcaactttgacgtccggatgccctctttcgatttgatacgtgcgataggaatccgtctgctttgcagcgaaccatagatattcttttagttccaaaataccgtcaagcccccatgcaggcgaaccgctgatgactgattccgtttcgtttactgctgtatttgcaatcggcttttcaatgacgtcagccccgactttttcagcaagcttctttgtaaaaggagcaagcttttgtttttcaccggtcacttttgcaaatccgatttcttcaatgacatcggcatggatgtgaaattgttccgccgtgtccagcagtttcgatttatcttttacatgttcaagcaaaagatactgttctcctgcttgttcttttgcttgagccgtctttccgccgaccggcagcaggactgcaaaacataagagaaaaatatatattcttttcacatcatcacctctgcagattgctctttttcaaggaactttcgataaaaatctccgtaaaacttgctctcattcagcaatgtttcatgcgtacccacatttaaaaccatgccgtcttccaaaacgatgattttatcggcatccatgattgaagtcagtttatgcgcgatgacaattcttgtacatttcagctcccttaaaaaggcgtcgatttttttttcattttgatgatccagcgaactcgtcgcttcatccaacagcatcacagcggggcggtttagcagtgcacgggccaaggcaatccgctggcgctgccctcccgaaatattcatccccatttcagaaatcatcgtattaaagcccatcggcatattttgaatgtcatcgtatatttgcgccatttttgcgacttcatgtatccgctcaatgtcaacatcttcactgtataaagaaatgttgtctttaatgctgcggttgaacagcgttacatcttggggaacaacaccaatttgtttgcgaagagcgcttaaatccttgtttttaatattcacgccatcatagaacacactgccttttgtaggcatatagaggccaagaataagttttgccagcgtgctttttccggacccggattgtccgacgatagcgattttttcgccaggcttgatatgcaggcttacgtctttaataacttcttcgctgtgcgggctgtaacggaacgaaacccgttcaagccggatctcccccttaatcggggagttgtctttatttccaggtgtctcttcaatcgggctttgaaggatatcctgtatccgatgaagataagacgtcgtcaagattaccgagttgacggtttggacgatcgagctgcttgtattaaagaattgtgtggataaagcatgaaatgccaccagctccccaaccgataaattcccttcgaacacgagcattgcaccaatccataaaatcagcattggtgatatgatctgcatcgtgcctgtcagagagttcacgatgttaagaaacccttccttgcgtcggtatgccccgatcagttcccccagatagtgatcccatttttgatacgtttctttttcgattcccgcagtcttaataccaaaaatcccatataaaaactcagtctgatagctttgaatctgcgaagtctttgcgatttcgtcctggtttttttctctcagcttcccgcggctgagcgccgtgatcccgacattcagaagagccagcagaataaccagccctgctaaaggcggcgatttataaaacatataaaacgagataaataaaagtgcgccaaaatcgagtacgccgaggaccaattgggaagacatcatatccctgacaatccggaggcttgtcgcgcggaaaaggagatccccgaacgacctcaattgaaagaattgatagggaagcttcagaatatgcgagaaaaatgttctcatcattcgtttgtcaaggaagttatttaatttaatgataaattgacccctgatcaattgaaccgtgccttgaacgagcattaaaacaagaacgcccgtcataaatgtttgcagcagagcctgctgattttgagcaaggatgtcatcgatcaggtattgcacgagcatcggtatgcctaatgaaacgagctgaaagatcatcgcaaacaacagcacggtcgcaagcagagaaggggattcttttaaatgaaaaagaaaatgcctccagacgggcggttttttcttcggcctgatccgctcggtagggatcatctccagcacgatcccgctgtaattttcgagaaaagcttcgatactgagtttttttcgtccaatcgcaggatcgatgatgttgacatgccggtcttttatttgatcaataaccacataatgattatcggaccaaaaagcgattgccggcagacgcacatgtggaagttctgccgcgcctgccctgtacacctttgcgtcaaatcccagattttcgctgagctgacgcatatgaaaaagggtcataccgtccctgccgcatcccgataaatccctcagctcatgcagagtatgatgcgaaccataccgtccggctaccatcgccatacagcacagtccgcattccgtctgctgcatctgttctataaacggtgtcttatgaaaaaacaagccttatctcacctgcccgtcggaatatcgagagttaatacggatggaacagattcatcgaggagccgcaaaagcccgtaggctattcctgccgtcccgacaaacatgccaagcgattccacatcggaatgcaaacccgttttccatccccggtttttcgttttataaatgcaaaatatatcatcagggacatgaagttcccggttcagccttttgatatccagcagaatgttcaaattcccaattaaaccgtggcacagcgaatgattttgacagtctgctagatttaaagaactttgaagcgcttcttgaagctttaaagtccgggtagtcaattcaggaataaaagcctgaatgtgcgctctccccagcaaaatcccgggagctccatgacaccagtagcttggggacagcgtatgcgaatcatttcgtaaatctagccagtttagatgatccttttgaaaatagcggtcctcttcttcgacaagctttaggacaagctctttgcagctgtcatcgtgtatcaccttcgccgcctttgcgatagaaaatgcgatccccgtcaagccgtgtgaaaatcccgtcaacgaaacggcatcctgctcgattgaatcaagtaagcggccaattcgatcattcaatctgctcagtacctgtcttatagagtccaatactgctgggtgctgcttgatttcgtacagattaacaagcactgtcagcaatcctgaatcccctgcgataaaatccgggttttgtgtttgattcggctgatccaaaactcggggaatgaggttcaacgccctttccaataaggaatcgtcttcccatagactgccaagataggaatacaggtaaatgaatgagcctgtgccgaaaaaagcagaatgggaattcccattttgaacccaataactttcttccttttgaatttcttctatcattgatcttgccgtatccgtatatacctgctcgttcagtaccttgcctgcttgtgcaaaaaatattgccagccctgccattccgtcgtaaagccccataggaagcggcgacaaaaacaccattttttcgtctccggcattattgctgatccagaaaggaccttcaccgcgctctgaatagatcgccttctgcagcaaatcatcagctatatgcttgacctcttttccgagatcagcgaccgtttccttctgtccaagcccgctttctgcatggtcccagacattttcaatcaacgtcgccattgataaagaaatatagcggagctgatgattcaaatccttttccgagaaagattgaatttttttctttgccaaatcaatacttgatgtttcataaaaaccttccgattcttcccctcttgaattgagcagggaagtgcccccagcataaaaagtaaagtagggaatatcatgaagcagcagatcgacaatttcgtccggaataaacacgtttgccttttccgactgtttggcgagcatccacatataatcaaataattgctctcgtttatctccggcggtcaagtagtcagggtgggtgctcgcttcgagaaacttgccgtacacatgtgtcggccggaagacgtggcggacttcgtcgtgcttaaacagattcaaaaaccccgagggtcctgccagttcttctttatgtttcatcataatggcataagcatttttaaatccttccacgataaagtccgtatagaaaacggcggacaccggacgtccatttagtttgggcgcattcaatttttcctcggtggtcagcgatgtttcttttaaagacatcctgtcctcaccgtaattcaggacggcgtagcccttcgctttctttgactgctggccgcctttgccgccgatcccgcttaaatcaaaatcgagcacttcatcatgtttgaatttgaccggaagcatcatcgaagacagcacggaatgcttcagctccaatgcggtgacatggaggttttgattttgagcgaaaatgctgacatggttgtcaaaaagagtctccagatcaatcaggatggggtgttcgcctgaggcgatgatattttcattatgaaaatcgacggagcgcaatccgtacaatatcgccaaatgtccgccctgccggaaataaaatctttccagttcttcttctgaagaacagccttcatgctttacaaattcctgccagccgtaatttcccctgtcaagcacttccgcagcacggaggctgtacttcattccccgtccgttcagccagttcagcagctccctgtaatgttcgtcaattgacaaggaccgcggtttatacacgagctttccgttgtttaacaccagcactttgacactctgcccgtttttgtgggaatctcccaaatccccttcaaatccaaccaattcgggggaagcgatattaaattttttcgcaatcaggctgcggtcgcttaaaaatctcccaataatttcttcatgaatctcgagcaccctgagaaccttctcagccatcagcctgccaagcacagggtaaagctcgaaaaattcccggtaaatttcaggatcggaaatgtattgttcaacaaagtaaacatatcgctcttccggtgacgccccctttagccggccgtcttcccgggctacattcagctctgtgataagtgttctcgtcgccagcttatcaaggcattggtgaagttcagacatgatgccgtcttgatagccggcagcgtcgattatgccggatagaccgccttcctgcttctcaaattcagaaaaagctttcgacatccgttcttgtgcaaataaaagaaaaggaaccaagaaggtgacaaatgacatgtggggaagcgggtgttttaattcggaaaccgctttagggttgtatttcataatttcagacaaacaggcagcccattccggcattttgccttgcagctgcacaggctcattgggtgaatgttggacagaagaaaggtgaaaatccgtaggacgagacggagtttttccgttttccggaaaaaagccggacggatgttcttgaccttgaccgcctcgttcattgctgtaaagagctttatacagataaatttcgaattctttcatgctcattctcgtcatccctttggcgaagaaaaccatccctgcaactccgttgcaaggatggattcttttgaattttttatgattccctagcatcggcttgtacacttagttgttgggcataatgaagcagaaaccgttacaccggctgtgatgcaagtccaagaagaggttgtagcaggagttgtttcaggattgacgtcatttcctcctaccaaagctttcaattcctcttcggaaaccatccctgccggatgattggctcctttgaaggcttcacgggcagctgaatttttcattgttttcatgattctcacctcctagaacgggcaaactatcgaaattttcctataatttagaattgactcgccgttccagtcaaattatactataagtacatcaagaaatcgacaaaaaattataaattttctaggaggtggaatatatgtcaaaaaaggaaatgattctttcatggaaaaatcctatgtatcgcactgaatcttcttatcatccagcagggaacatccttaaagaactccaggaagaggaacagcacagcatcgccggaggcacaatcacgctcagcacttgtgccatcttgagcaagccgttaggaaataacggatacctgtgtacagtgacaaaagaatgcatgccaagctgtaactaagttcccaacgcgggggccctgctcccgcgttggcatattgatagaaaaagaggtcgatagaatgaatgaaaaatccgccggatatcacgaacggcttcccgtcgcccaaactcaatccccgctcgtaaacgataagataaagtattggcgttcccttttcggcgatgatgataaatggctcaataaagcagtttcattattaagccatgaccctttgtcctccatcgcacaatcctcggtatcccagtcagtcgggctgaaagacagccgtcgcggcccatggcagaagatgcaaaagcggatctttgaaacgcccttttcctacaaggattctgctctgcaagattcagaattgctgttcgactccctgctgacccgttttgcgtctgcagcacaagatgctttggaggaacaaaatatcatactttctcctcctctttgccggcaggtgctgacacatttaaaacagacgcttcttcaaattgcccatcaaacattaatactggaactaaacattttaaggcttgaagatcaattgaagggcgacacccccgaaatgcgctatcttgatttcaatgataactttttagtcaatccaggatacctgcggaccctgttcaacgagtatcccgtattgctgcgccttctgtgcacaaaaaccgattactgggttcaaaacttttctgaactgtggaagaggctgaggcaggaccgcgaacagctgcaggctgcatttcatattgccggcgatcctgtccatattgagcttggggtgggagactcgcacaataaaggaaagatggcagccatccttacatattccgatggaaaaaagattgtctataaaccgagaagccatgatgttgacgacgcatttcaacttcttctatcatggatcaatgaccgaaattcaggcagccctttaaaaactttgagattaatcaataaaaaacggtacggatggtccgagtttattcctcacgaaacgtgccatacgaaaaaagaactggaaggctactatacacgcctcggcaaacttttggccgttttatacagcatcgatgccgttgactttcaccacgaaaacattatcgcctccggcgagcatcctgttttaatcgatcttgaatcaatttttcatcaatataaaaaacgagacgaacccggctcgaccgccgttgacaaagcaaactacattctttccagatccgtacggtctaccggaatcctgccgttcaacctttacttcggaaggaaaaaccgggataaagttgtggacatcagcggaatgggggggcaggaagctcaggaatcaccgtttcaggcgcttcaaatcaaaggatttttccgcgatgacattcgcctggagcatgaccgatttgaaatcggcgaggcgaaaaatctgccgactttagatcaccagcatgtccctgtcgcagattatcttcattgtatcatcgaaggattttcagcagtataccgtctgatttctgatcatggcgaaagctacctggctacgattgaacattttaaaaactgcaccgttcgaaatattttgaagccgacagcgcactacgcctctcttttgaataaaagctaccaccctgattttctcagggatgcggtagaccgtgaagtgtttttatgccgggtggaaaagtttgaagatgcagacacagatattgcagcggcaaaaacagagctgaaagagctcattcggggagacatcccctattttctgtcgaagccttcagatacctatttgctcaatggcgaagaagaaccgattgccgcttattttgaaacgccgtccttcacaagagtaattaagaagatctcatcattttcagaccaggacttaaaggaacaagcgaatgtcatacgcatgtcgattctggctgcatataacgcgagacatgaaaaagacgcaatcgatatagaccaaaatcacccgagtcctagatcaggcgccttgcagccgctcgccatcgctgagaaagcggctgacgatttggctgaaaagcgaattgaaggcaatgatggaaaggacgtcacttggatcagtacagttattgaaggcgtcgaagaaatctcttggacgatctcccctgtcagtcttgatttatataatggcaatgcaggcatcggactttttatgagctatctgagccgcttcgcaaaacggccggagacttactcgcatataaccgagcagtgtgtatttgcgattcagcgagcgttgaatgaactgaaggaaaaagaagaattcctgaagtacgccgactctggggcattcacgggggtttccggctatctgtattttctgcagcatgcgggaacggttcagaaaaaaaacgaatggatcgaactcatacatgaagctctgccagtccttgaagctgtcatcgaacaagacgaaaactgcgatatcatcagcggttctgccggtgctctaatggttctgatgtcattgtatgaacaactggatgacccggtttttctaaagctcgccgaaaagtgcgccggccatttgcttcagcataaaacaaatattgaaaacggagcggcctggaaagatcctcatacacaaaactattacacaggatttgcccacggcacttccggcatcgccgcagctttatcccgattcaataaagtgtttgattcgcaatcactgaaaaaaatcatttcgcaatgcctggcatttgaaaagcagctgtacatcgcttccgaaaaaaattggggatcaaaaggaagagaacaactgtcagttgcatggtgccatggcgctgccggcatattgttgtcgagaagcatcctccgagaaaacggagtcaatgatcccgggctgcataccgacatcttgaacgctcttgaaacaactgttaagcatgggctcggcaataaccgctcattctgtcacggcgatttcggccaactcgaaatcctaagagggttcagggaagaattcagcgaactgaacaccattatacagaatacggaagatcggctgttgacatattttcaagaaaatccattcagtaaaggggtatcacgaggtgtggattcagccgggctcatgcttggtttaagcggagtcggctacggcatgctgcaatgccaatatggagaagaactgccggaactgcttcagctcagtccgcctcaagcgcttatcaaaaagaacagcaaagcttttaaaagagaaaacgtgttttaaaatcaaaatctatggattttcatccatagattttttttgcaacattacgatgaaagaccttcatccaaatgcgcttattctcagattcgtgtcatttggcataatcaccagcttatgagcaaatccaactcacaacatgattattcagacaattcagaaatatatgctatgctctctctgattccaataaaagggagggatgatcggtgcccaccattcagtatccgccgtaattgtaagcgcttcccattcagcgttggcatcaaaaaagaaacaataggaggaatataatgaagaaattaatcagcatcatctttatctttgtattaggggttgtcgggtcattgacagcggcggtttcggcagaagcagcttctgccttaaactcgggcaaagtaaatccgcttgccgacttcagcttaaaaggctttgccgcactaaacggcggaacaacgggcggagaaggcggtcagacggtaaccgtaacaacgggagatcagctgattgcggcattaaaaaataagaatgcaaatacgcctttaaaaatttatgtcaacggcaccattacaacatcaaatacatccgcatcaaagattgacgtcaaagacgtgtcaaacgtatcgattgtcggatcagggaccaaaggggaactcaaagggatcggcatcaaaatatggcgggccaacaacatcatcatccgcaacttgaaaattcacgaggtcgcctcaggcgataaagacgcgatcggcattgaaggcccttctaaaaacatttgggttgatcataatgagctttaccacagcctgaacgttgacaaagattactatgacggattatttgacgtcaaaagagatgcggaatatattacattctcttggaactatgtgcacgatggatggaaatcaatgctgatgggttcatcggacagcgataattacaacaggacgattacattccatcataactggtttgagaatctgaattcgcgtgtgccgtcattccgtttcggagaaggccatatttacaacaactatttcaataaaatcatcgacagcggaattaattcgaggatgggcgcgcgcatcagaattgagaacaacctctttgaaaacgccaaagatccgattgtctcttggtacagcagttcaccgggctattggcatgtatccaacaacaaatttgtaaactctaggggcagtatgccgactacctctactacaacctataatccgccatacagctactcactcgacaatgtcgacaatgtaaaatcaatcgtcaagcaaaatgccggagtcggcaaaatcaatccataagctttgaggtgaaacgtccggggcattccgggcgtttcacttatttccatcctcatacgctttccataccgttggcagcagatcggaaagttcatgcgcaagaagcgcatgagccgatctggtctttgtccatgcgtccgcacatgcgccgtgcaagtggacagcattcagcaccgcttctctcgaattctcatgacagcacagcatcccgagaagcatacctgttaacgtatcccccgttcctccctttgccagcgccccatttcccgttacattcctccagcactcgccgtcggggaaagcaacgatcgtttcattgcctttcaagacaagggtaataccttgttcctccgcataatctcgagcataaccggcccggtttgcttcaatttctcgaatggacaagcctgtcattttcgaaaattcgcccggatgcggcgttaataccaccggcgcttcccgttcatgatacgatcgttttgaaagagcacccgcatcaagcacaaccgggcagtctttcgctaatacgctttgaaccgcttgctcagtcatttgcgaaggcggcagcccaggcccgatcgcaatcgcccggtaaggttcggcaatctcgcctgacgccgccttttcggcgccgtcccgccaatacgtcgcctcaggaagaacggggaggatcagcggaatcgcactcccgcacgttccgatgacaagctttcctagaccgctccgcatcgccccgattcctgcaaggagagccgctcccggcatatcatcgcttcccgcgagcaaaaggccggttccataagttcctttatgactatcatttccccttttcggcaatgagcccttcacgcagtctttcgtccatatcggcaattgttctgcagacatcccggatcacacctttcaatatagtttaaacaaacgtttaattaaattgtaactgaatcatacccttcactgctctttaacatgcaaaatagcactgatgaacggatcagtttacgttcatataaaaaagacagcttcacaacttgaagctgtgcttggcgttttcgactaaaaaagccggctgacaggcgcatccagacgataaagtcttgaatagcgcggattgttttccaaaagctgctgatggctccctgccattgcaagcttccctttgtctaaaaacagaatccggtcggccgcttcggctcctgccaaatggtgtgtaatccatagaacggtctttccatcaagtacttgaaacatcgttgaaagaagctccttctctgttttaggatcaaggcctacggtcggttcgtccaacacgacgatgggtgcgtcctgcagcagaatccgcgccaaagcaatccgctggcgttctccacctgaaaaacggatgcccgtttcctgtacagatgtatgatatccatcgggaagagactgaatataatcgtgaagcttcacctggcgcgccgcccaatacacgtcctcatcgctcgcgtcagggttcccgagccggatattattcaaaaccgtcgtatcaaacaggtgcggctgctgattgaaaacggagactacgcgtgaaatttctccctgaagagactgcacagaaatatcgttcaatgtaatgtttcctttagaaggagcaagcgccccttgtatcaacgacaagatggtcgatttacccgcaccgctcgggcctagcaaagcggtcttttcaccctgctttaatataaatgaaacaccgtccaacaccggctggccttgctcataagaaaaagaaacgtcttcaaagcgaagcgtgacatcgtccaaacctacagcctccgcccgttcctgctgaacatcggccccgttcccccttttcggcggctgcagaccgtccattctttctaaagaatcctgatactcagggattgaagccgctgcgtccgaaagcggaaagaaagcttccgtcaaaggaaacacaacaaggacaaacgccgcaataaacacaggagccagagccccttccgcgctttggccgcccgcccatattagcatcagaagaacaagtcctgccgccaggcattgcatggcaaagtccctccaacgactgaagcgcacctgtttcttttcgatcgccagccattcatgttctgccgcttcatacgaatggacaaagtcgttttgccggccgctgaaaacccaatcgctcacccccatgaccgcgtctgtcagctgacggtacaagtggctccgtcctcttttcagcgcaacattttttgcccttgtcacaagcagggaaacaagcggaacaagaaatacgaaaaccgcggcatagaccgccattagtccagcaaaaggccatgaaaaaaagccgatagctgcgatgaatacgccatataaaagaagagccgacagcccgggaaataccgttctcaaatacatgtcctgcaaatgttcaacatcgtcggccaaaatgccgagcatatcccccgttcggaaacgttcacgccattttaaagcttgaggttcgagcatcctgtaaagcctgacgcgcatatcggataaaattttcaaaatgatatggtgccctgtcaaccgctcaacatagcgcgacaccgagcgcagaatcccgaaggtgcgaaccgctacgatcggaacatagatcatcaaaacattttccggacgcgtagccgctttggatattaaataaccggaggtaaacatgagagcagccgccgagcatgccgtcaacccgccaagcagcacgacaatgatcaaaagccttgtatttttcttgatgtagggcagaatccacccgtcttcattgttcatgatgcacctccaaacgactgcgccttcacgagctcgtaataaacgccccgcttttcaatcagttcttgatgtgtaccggtttcagccacctgcccatctttcagcacgataatttcatccatatcaagcatccagtgaaggcgatgggttgccaaaaaaaccagcttgtcttcaaacagttttaacatcgtttttttcaactcgtattctgtttcgatatccaaatgagcagtgggctcatctaaaagaataatcggacggttgccaaggaaagcccgggcaacggctgtacgctgcgcctgtccaccgcttaatgccctcccgccttcaccgatccgctctttcaagccgtttggaagctgatcaatcagctccgagagcccggcagctcttgctgcctgttcaacgtcttcgtcagaagcggcgggatgataaaaacggatattggctgcgagcgtatccggaaagatatagggatgctgcggaatatacaagagctgattttgccagctgtccgtctgcaaatgcgttctcttttttcccccgactttgataacgccgcttttcgtttccaggaagccgccgagcacatcgataagcgtagattttccggcaccgctttccccgatgattccgatttttctctttcccttaaatgaaagagaaatcccggataaagagcagttttcctcatcttcatgccgcacatctacatgcttgaactcgatttgatcgtcgtcagaccatcgctcaagacttaaaggcgcctcatccttgaaacccggcgaatccaatatcgccttgatcgctttaccggcttcgcgtccgttcaatgtagcatgatagtcattgccgacttcccggacagggagaaaaaactcaggggcaagaatcagaatggcaagagccggctccagcgagatgctgccgtcaacaagaccgagaccgagaaaaacagcaacggtcgctacggacagcatggtgaaaaaatcaagtgcaaacgatgacagaaaggcgatcttaagcgtactcatcgtcgccttcctgtaccgttcgctcacatgaaatatattcttagtatgtgaacggctgatgcccagcactttcaatgtttccaggccgcgcaaggaatctgtaaaatggtttgaaagcatctcatacgttttccattggctgtccgcttttcttttagccgcatacccaagaaggatcataaaagtgattaaaatcggcatcgtaatcattaagactgcagcggaagatgtgtctttaaaaaagacataacagacaaccgccggcggtataacggccatgctgaccattttcggcaaaaacagctccaaatagcggcggaactgtgcaattccttccatcgcgagcgtgacgacatgaccggttccttctttcctcgccagcctggggccggattggaaaagcttctccaaaaactttttccgcatgccggcccccgtctcggcggcatagtcaaatatcagcttttgcctgacaagggtaacagcatgtcgaaataaaaaagcggcggtaaataagatgagcagcggaaagagcgaaccgacgcgttctccgttaaaaaggcgggtaaccgcttcagcaagccattcggcctgcatgataatggcggcgccctgcatgcatgtcaggacagtgagtactgcaagtattcgtttcatccctttatattgcaaaagatcttttcccattaataaatcattggctccttgctgctgacccgttttctaaaaacatagtagctccagatctgatagcccagcacgaacggaagcagtgccagcgcgacgatcgtcataacctttaaagaatagtcgcctgatgaagcattataaacggttaagtcatatgcgcttttcaccgagctgatcatgacgcgcgggaacagcgcagtgaaaatcgtcgccactgtaagagcgatccctgcgcccgtcatggcaaatgtccagccgtcgcgtttttgtttcataaacacgatcgacagcacatagcaaacgacaatcagagccgcaagcggtatcgtcacatgccccctgcccgtgaacaagtccgtttcaaaaatggataatgcaacaaaggcaacaagcgccgccaaaacggcgaatacgacttttttggccagctgtcttgcccggtcgcgcaaatcggcttccgttctcaatgtaataaagatcaggccgtgcagcaggcagagaagcgtaacggcgactccccctgtcacggaatagacgttcacataatcggtaaaaccggcgtgcagattcatatcggcatcaatcggcatgccgcgcaggatgctcgcaaacaatacaccgaacaaaaacggcggcagaatgctgccgaaaaatacgacccaatcccatgtattcttccattttgcggtttcgacttttcctctaaattcaaacgcgaccccgcggccgatcaatgcaagaagaacaaagacaaacggaatgtaatatccgctgaacatcgtggcataccagttcggaaaagcggcgaaaatcgcgcctcccccggtcagcagccagacttcatttgcatcccagaaaggaccgatcgtattgatcatcaccctccgttcaagatcgttgcgcccgagaaaccgcgtcgccattccgacgccgaaatcaaagccctcaagaaagaaaaaaccgatgaacagcacagcgactaatataaaccaaaattcattaagagataccatggtaaacctcctgatcaaacgggtctgtcgatacggaatcatcatgatggtggtcatggtgtgcagccccttttttaatctcccgcacaaacaagtagacaagaacgagcgccagcacaagataaatcgctgtaaacgcgatgacagagaacagcagcattcccgctgatacgttcggcgacacggactgcgccgttgtcaaaataccgaacaccgtccacggctggcgtccgatttcagtcatgatccaccccgccgtatttgcaatgaatggaaaggcgatcaaagccaccattgtccgcaagaaccatttgcttgtttcgagtcttttgcggaagctgagataaagaccggtcaaagcggcaacgatcattaaaagtcctgatccggccatgattctgaaactccagaatgtcgttttcaccggcggaatataatttccttctccgtatttttcttcatattgcttttgcagtgtcttcattccgggcacatcgccgctgaattgtttataagccaaatagctgagcgcatacgggatgctgagctcggatttgttttcctgcttgtccgtgtcaatgttcgcaagcaccgtccatgcagccggatcgccgctgtcatcccaaagcgcttcgctggcagccattttcatcggctggctcttcatcagatgctgtgcctgctcatgtccgctgaacgcaacgccgcccccggaaacaagcgccacaatcatcgcgatttgaaaggattttttaaaaaagagcaattcctgttttttcagcattttatacgcgctgacaccggcaatgaaaaacgccccagtggcaagcgcaccgaaaatgacgtgcggaaattcaacccatagctgcgggtttttaataatcgcaaaaaaatcggtcatttccgcgcgtccgtttttgatcgcaaatccgacaggctcctgcataaacgagttggccgctagaatccaaaacgccgacatgatcgtgccaagcgaaacaagccaaatggacagcaaatgaatcttcttcggaaggcggtcccagccgaagatccacaaaccgataaacgtcgattccataaagaaagcgagcagcgcttccaccgcgagcggagcgccgaatacatcaccgacaaagcgggagtactccgaccagttcattccgaactgaaattcttgtaaaatcccggtgacaacaccgactgcaaaattaattaaaaataagtgcccccaaaatttagccatcgttctgtaaatgtcttttttctttgcgacataaagggtttccattaaagcaaccataaagacaagcccgattgacatcggtacaaaaataaagtgaaagatcgttgttgaagcaaattgaaatcttgccaaaatgagttcgtccactgttcctgtctcctcctctttgttctagccgggcccgtttgccaaatgggcatcacacttgctcagactttcacatgcatcttattaatgtgattatgattacagacaaaagggtgacctcggcccgcattgatgttccgttattatcaggatggttatttatacctgtactttaccgcgaattccttcttaaataaagtacattttccctaatttatggatgtcattgtgacaattatacgaaggaattatagatattttgtgacacgctggttaacaagcactaaaacaacatgagaaaaatgccccgaaattcacgtggaacatttcgtcattcaacatctgtgattcttcgcgaaagcctgtcgcatcaaaagaaaaccgttatatgcagtgaaacaaattcggggttttccttcagtgtgagcgcgccttacggaaagttctgctgttttgtccaatctgtgaaatcttccttccgccttctgcgcattcccttcatccatttgctgatttatctccactgaagccttcacgcagcacgagctgactgcaccgcacgtttttccccctgcacagccatccagctcccgctgactattaacggaggaagggaaggaatatttattgctttgaaataaacaataacgataccccgtttattctatgaaaatcgaaccatacatttgttcaaacaaaatacacaaaatttgtgaaatgtttcacaatatcctgctatacttaggttgtatttatgatagatacttcttaagtaaacacttgatggtggtggaaaacatggaatctaaatcacttgttctagtcgaagagcttgctttaaaaaagcaaagcatctttgtgcaaagcccgcttcgctatcttttacgggctatgctggccagtatgtttatcgggttcggagtcattgtagcgtttaaaacggggaatctcttttatgttgaacattctccgttcacatatccaattgcagcaatcacctttgggggcgccattattctgatcgtctatggcggaggagatttatttacgggaaatacattttattatacattggctgcgcttcgtaaaaaaatgcgctggcccactgtgatcaagctgtggatgttcagctatgcaggaaatttaatgggcgccgtttttttcgcaggcctcatctttgcgaccggcttatttaaagatccttcttccaccggctttattctcagcgtggcggagcataaaatgaatacgccggtgaccgaattgttctttaaagcgattctgtgtaactggcttgtctgccttgcgtttttcgttccgatggcgcaaaaaggggacggagcgaaaatgttctctatgatgctgtttgtctttactttctttatttccggttatgaacacagcatcgcgaacatggccacttttgccgtctctctggtcaccgagcatccggagaccatttcgattgcaggcgcaatccataacctaattccggtaacactcgggaacctggtcggaggcgcgtttatgatgggcttcatgtaccactatgccaacaagccgggcggtgaagaaatcatcaaataaaaagatcgtccatttttaatggattctaaatatgcgggctcccttcataaaatcgtggtaactttaaaaatggaggttcagcgatgcaaagttttcattcgctttgccggcaatttggacatattttaaatggggagccgcacattgaaccacggtgtctgttctgtcagcatcaaacggaatttgcgtgtcgcgattcaaggaagaccgagccggggagtcggcatggaagaaatcatgttcgaatcgctcgatcaaaacggaatcgccttgaatatggccgaagtcgcaattttgcctgaagaagttccgctgtttacaaaaaagcttgtcgatcagggcatcattatcagtgctctccacaatcattggatttttacagaaccgaatattttatatattcattttcaatctgtagaaccgccgttaacattcgcgaaaaaaacagctgccgctttatccgtattgcgatgaagcagcagctgttttctttatccgttgatttttcccatttctgaaagtgcgaccctttcgactgctttggccacaatctcgtgaacttcagggttcagcggatgaggcacaagatcgccttgtcttgtgcaggatgcgatcgcttcagcggccgcaaccagcatcgggtggctgatcgaatcggctccggcatttaacacgcccctgaaaatacctgggaaccccagcacattgttgacagaccgtccgtctgcagcgtaggctgccccggcctcgagcgcatcctcaggctcaatctccggcttcggattggacagagccaaaatcacctggccttcccgaacccatttcttattgatcaatcccggaacaccggttgtcgcaacgacgatatcgcagctttccatcaattcttcgatgctttcagccgcatggccgccatagttctctaaacgcgccatcgcctcaagcgatttatccgttccgacaacacgttttactccatatgccataaacatcctgcagatcgcgacacccgccgcgcccaggccgatttggccgacatgggcctgcttcagatccacccctgcactcttggctgctgaaatggcggccgccagcgtcacaaccgccgtaccgtgctggtcgtcatgcatgaccggaatattcaggtcgtttttcaggcgctcttcaatttcaaaacaatgcggtgaaccgatgtcttcaagcaaaatgccgctaaagccgggcgcgatgtttttaaccgtccttacgatttcatcaggatcattcgtgtcgagcagaatcggaaccccgctgatatccgcaagctggtcgaaaagagcggctttcccttccataacaggcattccagcaactggccctatgtctcccaagccaaggatggccgtgccgtccgttacaattgcaaccgaattgccgattccggtataaatattcgctttttgcggctcttctttaatgagctcgcacacgttcgcgacacccggcgtatacacccgacgcagatcagcaagcgagcgaatcggcatcttgcttttcatgcggattttgccgccttcatgtgcagccagcacgtcatctgaaacggtatgaagatggatgccttcttttaagttgcggatcacttcaagaatctcggtgagctgttcttcatgctcaacttgaaccgtaatgttccgcatcgtataattcggccctaccttgatcgtttcaatctctccgatatcaccgccggcaaggccgatcgccgttgtcacctttccaaggtttccgggtgctgaagggatttccagcatcaaattccgaataatattgttgccattcataacagaatacctccatcaattgttttaaaatcggctactgaaccggcgagtcttttttatcggtgtaccaaataaatttacctgtgtatccgtacaaaatcgcaaggccgattgaaacaaagctcagccacatgaacggcacataagagaaggtcgagacgccgagaatccccgccatatatatgccgttgtccgaccacggcaccatgcccgacgtcatcgtaccgccgacttccgcgtttctggacagcaccctccggtcaattccgagcttgtcatagcttttttccataattttcggtgttaaaatgagcgagacatacatcgcgcagccgaacacatttgccaagaaggcgacgataatcgtcgagaatgtgacgttgccggcagaagtcagcttttgctggaacttggagacgatcacttttagaacgcctaagtgctccaagaggccgccaaagcccagaccgagaatgatgacgacgaccgaaccgagcatgccctctattcctccgcgatttaagagctcgtccataaatttgatcccggtgtcaatggaaaagccgttgtatgctgtgccgatcgcatccgcaaagtccatgccttggaagaccgcagcccagatcgcgcccaaaagtgcgccgatcgcgatcgtcggcacagatggctttctcatcgccaatagaacgatgacgacaacagccggaacaagcatccaaatgtgaatatcaaacgtgttctgcaaagaagctttcaaaaattcaactttttccaaatcaacatttcggcttccatacataaagccggtgatggtgaacaggaccgccgtgattaaataggcgggaatcgacaagtacagcatcgctctgacatgggtaatcacttcgacctttgaaagggatgacgcaagcaccgtactatcggaaagcggcgataatttatctccaaagtaggctccggacagcacggctccggctacaagcggaagcggaagccccagcccttccccgattgccatcatggcgatcccggccgttcctacagtcccccaagacgtacctgtggcaacagatgtgatcgaacaaataatgagcgtggcaagcaggaatatgctcgggtggataaactcaagcccgtaataaatcaaagtcggcacaacaccgccggctatccatgtgccgataagagcgccgacggcaatcaggatcaatatcgcttcaagtccatttgaaattccgtttgtaatcgatttttgcaaatcttcataccggtgccccaggcgcagtccgagcaaaatcaccaagaaccatgaaataaacaatgccagctgaatcggcagctcgaatttgactgtaaatgaacaaactatcgctaaaaatgcacctaatacacaaatgatttccaacattgatggcaaccgtgctgttttcaacctaaatcccccttaattattgaaacgctttcaaaataaactacataaaaatagcaatctgcttcaattttttcttaaaaatttaactaacaacgaacagtataccatgaaaaaggctgatgcggtaccacttcaccgctgttgtcctttctcttcataaagttattgaaggaaagcgaaaacactctgtgtttctatcccggtaaaatgtcagagtgttttcgcatactgttttttccagatcaatcccgatttaaaagttcagccccggcaatccccggttttgtcatttcataaggattcaaaatcagatcaagctcttcttctgtcaacacatcgtttttgaagacagagatcgcggacggattggcctgttaaaatggcttctctcgcaatccttgcagctgcttcgctagccaagatgcggattgaccgcagtgatgacgccggcgctcttttcgacatatgcttttaagcgtttttcattcgcttcaatacctgctacacagtgatcagtgacgaacggaatccgttgttcatgatgctgatggatgcaggagattaaagacgagcactggctccatcacattcagttcgagctgtccggcttcagaagcaaggcagatcgtatgatcgtttccgatgacctggaaggcgatttggttgatcagctcggccataaccggattgactttccccggcataatggatgaacccggctgtcttgccggaagggaaatctccgcaagtcctgcgcgcggacctgatgccatcaaccgaaggtcgttggcgattttcgacatgttcatcatgcatacttttaatgcagctgaaacttctgtgtaagcgtccgtattttgcgtcgcatctaccagatggtcagcgccgacaagcggaagaccgctgatctcagccaagtgcttgacgacattttcgatatagcgcggatccgcgtttaatcccgttccaaccgcggtagcgcccatattgacttcatacaaatgctggcgcgattgtttaatccgtttgatgtcgcgttcgatcacgcggctgtaggcttcaaactcctgtccaaggcggatcggcacggcgtcttgaagatgggtgcgccccattttaatgacgtggtcaaagtcgcgtgcttttttcttaaaggcatcaagcatgtattccattgtgtccagcagcttttccagcagcttaagcgttgaaatatgaatcgccgtcgggaatacgtcgtttgtcgattgagacatgttgacgtgcgtattcggactcaggtgaatatattcgcctttgttgtggccgagcagttcaagtgcgcggtttccgatgacttcgttcgcgttcatattcattgaagtgcctgcgccgccttggatcggatcaacgatgaactgatcgtgcagctttccttcaaggatctcatcagcggcttggacgatggcatctccaaggcctttataaagacgttttgtctccatgttggcaagcgccgccgcttttttcaccactgccagcgccttgatcatttcttcgtggattttatatcctgtaatcgggaagttctccgctgcccgcaatgtctgaatcccgtagtagacatcggccggaatcttcttctctccgagaaaatccttttccgtccggtatgtcatttcagctttcattttttaaccctgctttctttttatatgatgatatcgtctgcaatcggcgtttccatgatctttttgacttcagcttgttgtccgtttttccctaaagcccacatcagcttcggaacgatcgcttcagtgttcatatttctcgagcggataatggcatcctggtttaccttgcggccgacctcgtaaatgctcatatcctctccttcttcaaggcattgcgtcgtgatcgctacgaccataccggaatcgatcagctcgttcactttttctaaaatgtttcttttctcaaaaggaatgccgccgcttccgtagctctcaatcacaatgcctttatatgaacctttcagacaatcgaaaaactctggttttaaacccggatgaagcttcaccagacaaacgtcggtatttaaagaggtatcgagtttcaaagcgcctggctttacttcgggaacccgtttgttgtactcgatttccttatcgtgaatgaaagcgatgtaaggataattgatgctttcaaatgcatcgtagctttttgttcttaatttgatcgctctcgtgcctaaaatgacgcggccgtcaaagacgacatatactccgccgatgccgtcgcacgcaaagcggaccgcatcttttatattttttttcgcatccgttttcttaaacgtaatcggaacttgggaacccgtaatcgcgacgggcttatcaatattctgcagcatgtatgaaagcgccgctgaggtgtaggccatcgtatcggttccgtgcgtgatcacaaagccgtcgtagcggctgtaattttcatatacagcctcagccatcatcacccagtgttcaggctgcatgttggtgctgtctatatccattaaagattggcaatctatcgtataatttgaatgatcatcagataaatagctgagaagctcttccgctttaacccccggagccagtccgttttcgccttctactgaagcgatggtcccgccggtggtcaacagcagtaactttttcatgtgctacacctctttaagaagtagttttatacagtataaatcatgatttattttagcaaagaaggcttgatacatcaggaatgtatacgctttatgcgtaccttcaatgcaattatagtcctcaaatgtgaaataatcaagaaactttattcatttcgcgtacacttttactgataatgtgctataatcactgtgtatcaaaaggagcgtaagatatgaatttagatcgattaacaacactgagaaaaaacaaaaaatggtcattgcaatatactgccgaccgcggccttcgggttatttggcggaaaaaggcacctttaccgtctggtgccgaccgcctcggtattgcgaaaagcacttacgcgggctatgaatcgggataccgccgcccttctttagaggcgcttatcgaaatcgctgatttattcaatacctccaccgattttttgctcggaagagttgacgatccccgggatgaaaaggctaaaaacgaagccattgaactgacggattgggctaagctcaagctggcagtcgacggaacgcttctttccgaagaagaaatcaagcagatggttgcgtttatcaaggtcaaaaaagggctggatgcggagtaaaatgacagcggttaaccgccgcatgctataaaaagaaaaaacttgactggctaaaaaggccaatcaagttttttttgcttttattgatgtaaaaatttcacacaaaccgcttcaggagcaggaactccagactctaaaagcgtcagccggcccgttgtccggtctctttcaaacaatgtcaaagtccctgtttcctggttggaagcaactaagaattgctctgaaggatcaatctcaaagtcgcgcggccattccccttcagttgatacgtgttcaaccagggaaagttcgcccgaatactcgttgacgctgaagacggcgatgctgtcgtggccgcggtttgaagcgtatacaaatttgccgtctttcgtgatgtggatggcgccgccttggctatggccgtcaaagccttccggcaatgccgaaatcacttgaatctctctgaattcacccaaatcggggttgtattccagcacgatgacttcattactcagctctgttaatacatacgcatacttttcctgtggatggaactcgatatgtctcggccctgagcccggtgcagcagcgtgttttttcacttcttcaagccggccctctttcaattgatacgtgatgatatgatccgttccgagatcgacggccactgcatatttctcatcaggtgagaatcctgaataatgagtatgcgctttttcctgcctctcatgcggtcctgatccctcatgctgtacttttgatgaaggctcaagcaggccgcggctttcatttaaaggatatgccaagatcgtcccgttgtggtaattggcggacagaacataacggttatcttgatccacactgacgtggcaaggcgacggtccttccccggtctgctggttgacgatagtcagctctcctgtggaaccgtcaatacgatatgcggcaaccccgcccttatcgccgtctttgaccactgcataaagcatgtcattgtctttggcgatattcaaatatgtcggactgcccagctttgctgccggcttcggcgtgcttaacgcctttttttccgtatcaagctcaaatgtataaatccctacgctgtctgcttttgtatatgttccgatataacctctgtatttcgccatttgatcctctccttttttgacagtcgtccattcctattttaactcagagaaactgaattatcatgatctggtatgcaaaaaccttaagcgctcacatgaaaaaaaactttttatgatattcttaacattagaggcccttcactgccgcttttataaagaaatcggcagcggagacttgttcataggagtgttcaaaatgacgaaaatcatgattgtcgaggacagcgaagacattcggaagcttttacgcgatcatttagaaaaatacggatacgaaactgttgcagcgactgatttcacctctatccttgaaatatttctccaagagaagcccgacctggcattgcttgacatcaatctgccggcatacgacggttactactggtgcaggcaaatccgccagcattcgacttgtccgatcattttcatttcggcgagaagcggagaaatggatcaggtcatggcgatcgaaaacggcggcgatgattatatagagaagcctttttcctatgaggtggtctcgctaaaattaaaggccaaattcgcagggcatttggagaatacgcagtaaaacaaggtgaaaaagtgattgaatttgaaggcgtccagctgtttgtcgaacgttttgagctgcactgccgaaatgagaagctcgagctttcaaaaaaggaaagcaagctcttggaagtgctgcttgaaagaggagaaaaggtgacaagcagagaccggttaatggagaagacatgggaaaccgatacatttgtagatgaaaacacgctaaatgtctatattacaaggattcgcaaaaaactgcgaagcatggacgtgcccttctcaattgaatctgtgcggggcgaagggtatcagctgaggacgaaatcatgaagctgttcctaaaaaaccatgccgttctcatttttctgtttctctttcagggcggattcgtatttttttactattggtttgccggcatgcagactttcacccaccttttttacattctcggcgttcagcttctggcgcttgcgctttatctttcatacaaatggtatgaagaacacagagtctaccaatggatcggctcagatcaaaaagatacagaaattccttttttggggacgtctgaattttgctcagagctctatgaaaaacatatggagctgagccggctccaccaccgcaaaatacatgatatggagtccaagctggaagatagggtaacctacatgaatcaatgggtgcatcaggtgaaaacaccgctttccgtcatcaatctgatcatccaggaagaggacgaacccgtttttaaacaaatcaaaaaagaagtccagcagattgaatacggactggagacgctcctctattcatcaaggcttgacctgtttgaaagagattttaaaattgaggccgtgtcactagacgagctgcttaattcgctgattcagcgctataaacgctattttatacagcatcgtgtctatccaaataaacaggttcccgctgaagacgccgttatttactccgatcgcaaatggctcagattttccactggccaagtcatcactaacgctgtgaagtactcgtcaggaagaagcgaacgcatcgatttgacgatattccgtaaaggcgaacgcatcattctggaaatcaaagattacggaatcggaatcccttcacaagatgtgaaacgcgtatttgagccttattacaccggggaaaacggacggcgctttcaggaatcaacaggcatcggcctctaccttgtaaaagagattgccgaaaagctcaatcatgatgtgagcatcgattcagaagaaggaaaagaaacgactgtgcaattttcatttcttacaaaaatgtaagtcttctttaataaaaccgcatagctcatccccatcctccttgatatgatttgtttacaaaacaaacgtggcaaggaggattttttataagcaatccgagtctatgaaaagagtcggcacattctgttatataaacgaggccgccgttcttagtttctggacaatggccattcaagcctttcataaacgcattttggctgaaagcattccggaggagcccgctggaatggataacataccggaaacggtcatccttaaaaagcgcagcaaaaggaggatatcatgacaacaaatatgctggtcgttaaaaacatcaataaaacatataaaggacaagtctcccatcaggctttaaaagatatttcattcaatgtcgaggaaagtgagttcacggcgatcatggggccgtccggttctggaaaaacgacgcttctcaatatcatttcgacgattgaccgcccggattccggcgacattttaattcgcggagaagacccgcatcatttaaaaagggcgaagcttgcccactttcgccgcaggcagctcgggttcgtattccaggattttaatttgctggatacactgacgatcggcgaaaacatcatgctgccgttaacgcttgaaaatcaaccgctttccgtcatggaagataaacttcaggcgattgctgaaaaactcggcattgaacaacttttgaacaaacggacgtttgaagtatccggcggacaaaagcagcgggcggccatcgcaagagccgtcattcatcagcccgccctcatcctcgccgacgaaccgacaggaaacctcgattcgcaggcatcaaaagacgtgatggagacgatgcagcatcttaatgaaaacgacaatgccacgatattaatggtcacgcacgacccagttgccgcaagctattgccgtcgcgtcatttttattaaagacggaacattattcaatgaaatttaccgcggcgccaaccgccaagtattttatgaagagattctgaatgtgctgtctatgctgggaggaaataccaatgacctttcttcagttcgcttataaaaacgtcgtccggaataaaagagcctatctcgccttctttttaagcagctcattttcagtgatgatttttttcacatttgcgatgtttttgttccaccccgctttagaggaaggctacttaaacaccattgcaaaacgggggttgtcggtggctgaatggatgattttcgccttttccattctgtttgtgctttattccgtcaacgcctttctcaagtcgagaagcaaggaattcgggatcctcaccatccagggaatcgctccgggtcaattgaggaagctgattaccgcagaaaacatcatcatcggcgtgctttcgatcgttacaggcatcatcggcggtcttgtttttgcaaaaacattctttacgatcggcgcttatattctggaaatggacgctttgccattgtatctgccttggaaagcgatggcccttacatccgcctgctttcttgcgctgtttattctgctgtcgcaatttacggtgttatttattaaatcaaaaaccgttgtcaagctgatcaaaggcaccgggaaaattaaaccggagccaaaaccgtccattattttttcggtcgtcggcatcggctgcctcggctccggctactggcttgtattgttcgccgacatccattttccccaagccgtcacgatcttaattttgacgatcatcgggacttatttcttcttcagccaaagcagcatttggctgctgcggctgttaaaaaagcggaggtcattttatttacgaggaaaaaacgtgctttggatatccgatcttgtttatcggctgaaggataatgcccgcctgttctttctcgtttgcatcatttccgcggtcgcctttaccgccatgggtgcattggtaatttccaagacttctatcggaaaattggattcccgatatgagatagagtacttattatacagcgggagccaaaaggaacaaacacacgttaaggtgatcgaacaaaaattgaaggacggacatttttcgtatgcaaaggaagtgacaaaaggaatttatatgagctatagccagggagatctccttcctccggtgctcctggtctctgaaggcgaattccaaaagcacttcaagttaaattccggtgaactgaaagacggtgaggcgctgtattatccaaacgcctttgaggcaaaagaaaagcgggaaattcctgagaccttggacatgttgaacaaagatttgaagccggcaaatgaacggctaaaggtaaaaggtattaaaaaaccgctcatttcgttagaaagcatcgttgtcgtaaacggcaaaaccttcgaaaagctgaaaaaacaaggcgaatccctcacattgtacggctatcagtacaaccgctggaaagagagcctcgacatgagccaatcattggaaaaagatctcagagaaaaatctcacaatatccaatttcaatttgaagcaaaggccatcaattattttgaaactgttcagcttccaagcctgagtctgtttatcggattctttattgcggttctcttttttacggcatccgggagctttctgtacttccgcctgtttaccgatcttgaagaagatcaagagcgctaccggtcactctcaaaaatcggcctgagcgaaaaggaaatgtcgcagagcgtaacgattcaattggccatcctgttcttctttccgttcgtactcgcctcaattcatacgtattttgcgatgaagacgctcgaggcacagagccttggtcatttcgcatctccggtgatcatgacaataggcggatttctgatcttccaactattattctttatgatgattcgaaaaagctatctgaaaaaattaaaaggatttttaaggtgataaaatatgaaaaaaacaatttctctcattacagccgctttagctgtatgtatcggcgcatttctgttgattcataatgaagtgacagacaggttcaatccacttgtgaagaaagaaagcgtatatgtccagatcaacaaagacggtaagcacctgagcccgggccgctatgagtacacgctggaaggatataatgacaccggtaaggaaaaagaaattacattctccgccagcgattcccttcgaagaaacgcctatctaaaggtaaacgcgaagggaaaatatgttgagacatgggaagaagtacagcccggcggcatgccgagtgccgttcagaaaaaattgatcaagcaataaaaaacggcgtctaagccgttttttctatgaatcactatattttaacaaaattccgaaactttttggcccgttgctcgtataaaaacagaagtcatattgtttaggaggttttcatatgattgttggaataattggttttatactggtggttttccttctctacgcctccatgttgccgtccggggaaaaaaacagcggcagcagctcttcgactttttttattggaggtcctgactcatccggagacagcgggggtgattgcggcggcggcggcgatggcggctgttaagacctgcggctgcgttaacctaacttctgctcctgctcggatccctaggctgtatgcagttcttgctgcagtgagccgggtatattccagctatctcccttcatcattcattcaacatcaactccaaatacgtcattattcattcagttgtttaacctgacttccgattgggaatgatgtaaagacagcagattcccgctcttcaaacgatttaaaagtcacaataaagcgattctgatacaaaacatataaaactttgcacctacttgttcgatattaaaagaagacattcatgataaggagggttttttccagatgatttttttactggttttattggctctgtttattttgtattcattcttttttgacaagaacaacaaaagttcttataaaaaagcggcaccgaaaagcagaatattgatccgccaggcagctgcgccgaccggagttttgagggtaatcgaaaccgctcccggacagacggcaaaccgccgaacctccgaaggtatgcgcccgaatctgcggcttgtcatgagcccgacgcaccaaaacgaaaaaaaataaggaaagcggcatcatgataaatgccgtctttcctattgtctgctgtgttccaccattttcccaaaggcgtccggcgacatccccggcgagattcggacgcggtggagcgcatacatcccctgatccctagatgccgctcccggttctgttgtgacggccatttgatagcctgcctgctttgcgagtttcagcgtatcttcgttgtagcgcccgaccggatagctcagcatcaccgtattttggctgaacatgcgatcaaacagcgctttggaacgcgtcatttcatcgagctgctgtcccggtgccagtccgttcaattcaacgtgatgaatggtatggctttgaatcgaaatgccgtttcgcctcatttcattcatttgtttctccgtcaaatggttcttcccgccaaccgatttgccgatcataaaaattgtcgccttcatcccatagcctttcaaaatcgggtacgctttttcaaagttatctgtataaccgtcatcaaacgtaatcagcacgcatttatcactcggcattttatcttgcgttaagacaatataggcttcctcaggtgtcaacgtgtaatagccgttatccttcagccacttcatatgcccgcggaattccccttccggtacgcgcaggctgtttcctgaggaaatgctgtgatacatgagaatcggaatgcgggccgggcttttcactttgacccacttggatgatggatcatgttccgcctgctgttttgattgttttgccgctttttgagccgtatttggttctgttttttcctctccttttgtttcatgaccggaacacccgtacagcacccccatcaacatagacagcacaagtaacattttcgtttttttcacaattattcccgctttctatctactgaatcctttttaatatcggtgcggaacgggcatttttcactgttcctgctttgaggaggagagccaagctttacgcagtctgctgatcccttcttcaatttccgctgcagtaagacccccaaatcccgccatgacgattgaagagctgctttcatgaggcttaatccagaaatcggataccggataaactttcacaccgagtttttccgctttatgtatgaggtcttgtgcatgtcggtctgtcttcatcaaaatatggagccccgctttttcgccgatgattccacgtcatttccgaaatgcgttttaatggccgatattaatgttttgtgcttttcttgatatacttttttcattttacggatgtgcctttcgaaaaacccttctttcctaaataaaaacatcgctttttgaatgatgggtgaagcagactggctgtagcggccaagcttctcttgaaattcatccgccagttttgaaggcagaacgatataactcaatctcgctcccggaagaaatgactttgaaaaagtccctaaataaatgacattttcttttttatcaagcgcttttaaagatggaataggcctgccctgatagcggaattcgctgtcatagtcgtcttcgataatataggccttctcacggcttgcccattcaagcaatttcagcctcttctgtatcggcagaaccattccatacggaaactgatgcgatggcgtaatataaacgagtttcgcccgtgttgcagcaagctgtgtcaaattgatcccatccgtctccagaccaattggctgaatatcacatccatggttaaggaaaacagaacgcacaccatcatatcccggattttccaacgcaaccaatcggccgttcattgagagcagctggcaaagaagtccgactgcatactgcgtaccggaacagatcacaatttgctcaggtgcacagcggacacctctttgttcagccccgagagatcacagctaaagaaaacatgctgaaccaaagcatgaaattcgaatacgggcggaccgtacaggaagaccattgacaaaaaaagacccgcagcttatgctaccgggtctcccattgattttgatgcatgttcatctaaaaatttcaatcccgctgtgtatcgctttctccgcttctttatccagcagacgagcgccagccgctgatccgggtccttctcattgatagaaaccagcacatgttcattgatttcaagcgggaagccggattcaatctgacagcctgacaagctgatatccttaatcataacctcgtgagcccctttctctgaatcacggggaaacagcagtgttcccagaccttgaaaggcctcgcgcacgtattttctcttgaatgcatcagggcttttttcagttttcgttaaaaagcgtatcactgttgacaacgtatcagcccgcttttcccggtcggccttttttgcattttcttcattaaacataaaaccgatcagtttcacatacagttccttgtccatctctttgaagtgcagcccgatttcaatgtcggcctcgtccttcgtcgtccacatcacccgggccgggacttttccgaccgcatctatgatcagaccgtctacatgatagtacatatccgaatcagccgtataaggcagtctgatacgcgcgcccgtgtcgctcacatcgatcagttcacatttgtgctcatctactgaaacggtggaaaaagccgccggcttgttgactgtgaaacgctcagagcttcggaacctcggcctgtcaaaggcaacgagcagcgcaagtatgagccctgtcatgttatagagaacccaaaataaattatacgaagtgacgtttatatcaaacgtatgaagaaacaacaattcataaagggtttttccgagtgcaagcagcgtcattgcgagcaaaatcgcacacggcagcgccgttgtatatttgaattttcgccgatctgtgttgacgcctttcggtgtgactttaaaatcaaaccgctttttgaaaatgaattccgacaaggccgatatcgccatgtgcggcgccatcgatgtatcgtaaatatggctccagttcatactgcgctgccggtccgaaacggctttaaatgaaaggtaagaacctaaaaacgcaggcagccaaaacgaagtgatcgaccacagatcagtctttaagctatgtatgccaaacagcaaaaacatgagcggcgcgaggatgtataccatcttaaaaacgccgaaaaaccaaaagagaatgccgtcaaaataaaggattcgctgcatgggcgtcaagccttttaagaaaagcggattccacttctttccgcactgaatgtttcccctgcaccagcggtcgcgctgtttcaaaagatccatccacgtttccggcgagagaccgaccgcaagcacttctttgacgaaaacagatttaaattttgtttgcaaaagcatccctgttgccatatcctccgtaatcacacctgtcgcaaaaccgccgatttcctccaaagccgttcttctgaaaaccgtattgctgccgacgtacatgacagcattaaaacggtctttcccagcctggagcctgcgcatgaaaaagtcctgctcattcggaatgttcgctccggaaaataagttgtactgataaggatcttcattatagaaagcctgcggcgtttgaacaaaagccactttttccttcttaaaatagccgacggttttctgcaaaaatgaagggagcggaaccatatcggcatccatcgtcacaatcagttccccgtttgagcagctcatcgcatggtttaaattccccgcttttgcatgctcattgttttgccttgtaacgtaatgaacgccaagttcctcagccagcttttgaatagccgtccgccttccgtcatcacacaaataaatgttgacaagctcttttggatagtcgaggttcagacagcctgccaccgactttttcagcacatggcgctcctcgttataagttgcaatgagaatatcaacgctcggccgatggtcttgatcgcccagcttttccggctcccgcttcttttccttccatactagcgtataaaagaccaagagctgtaaaaagccgatacattcagttgcaatcaggatgacgcccatcacgatatcggcggggcgagagacgggcagcgtaaagccgaaccgccatacaatatacacaccgttcgtcataagacacagtatgattaaaaacttcttaaaacgcgaattcacccgcgatccccaaaaaccgatgagaatcagagcaatcattgccgcgggatagtagtgtaaaataaattccattttcttctccttatgtgatacataaaaaaacctttttacagggtttctctaaaatattcctttatttctttcttttgcactcaaatatattaccactatttgtcctaattttctttaaaaaattataaaaattatatctttttatctattaaaaactgaaattatacgactatagtctcttgttcaaaaaaatcataaggctcacattgataacccttcacatgtaccccgtatcaagattgaatcttttgtctcagacgtcctgtgtcttttcagagaaaggagctgaatgtatcaacgctttacaaaagaaaaaaggtctctgctcctaaatgtttgatttatttttgacggattaacagctattttgtgtcgatttttattccataaaaagggaatccaggaataattgcatcaaaaacggcctgcacaagggccattacctatatccagacacgtctttagccaaatggagctgttcttgatcattatgggaaaacagttaggtcttcctgcacggttgtctgaattttgatttttttagtatacttaatttagttaaataactcagcaaggggatcacataaaggatgggggaaagaatatggaagcaaaaacaaaggtacaacatataccgattcaaacaacaaaagaacaggatgaaaatttttttgcaagagcaatgaatgttaaaatcggcatcattccgctgcccgtatatttgctgctcttcgctttgattgtgacgtttgtctatatgcacgatctgaaaagcgacattttaacagccattgcggttacgggctttttcggattcaccttcgcccaaatcggaaagtcgctgccgcttcttcgttctgtcggcggtgccgctatacttgcgacgtttattccttcagctatcgtctattaccatctcattcccgatgacattatcaaatcaacaactgaatttacagaaaactcaaactttctttatttgttcatctctgccattgtagtcggaagcattttaggaatgaaaagagaaacgctggtcagggcgttcattaaaatttttattcctctgattgcagggaccattgctgcagcggcagtcggtctggcggtcggtacaatgctcggcctcggatttcagcatacgctgctgtacattgtaattccgatcatggccggaggggttggcgagggagctattccgctgtccatcggctattcggaaatcatgcacatgtcacaaggggaagcttttgcacttgtcattccttccataatgttcggaagcttaagcgccgtcattttgtccggaattttaaatgtaatcgggaagaaaaagcctgaattgacaggcaacggaaaagttgaccgttttgatagcggggacgcacagccgctcgaaagccgcgacaaagacaaagaaagcctttttaatctttcccactttgcgtcaggaggcattctcgccgtctcattatatttggtcggtatgctttcacatgacttgttcggatttccagcacccgtcatgatgcttctgctggctgttgccctgaaactgtttcgtctggctccggcgaatttggaaaacggcgcctacggcgtgtcgcgcttcttttcaactgctgtgacatatccgctgctttttgccattggcgtctccatgacaccgtgggacaagctgatcgcagcttttaatatcgccaatattattacgatcgtatccgtcgtggtcacgatgatagccgtcggcttttttgcagggaagtggctgaatatgtacccgatcgaaaccgcgatcatcaatgcttgccattccggccagggaggcaccggcgacatcgcaattctcagcgccgcagagcgcctcgagcttatgccgtttgcccaggtgtccacaagaatcggcggagcgataaccgttacgctgacgctgctgctgctagcccagttttattgatgaatgaaaaagcctgcagagcgagctgcaggctttcttattgtggctaccgtacttttttcggaacatagtcgggaaagtctgtcacaatcccgtccacgccggcctttaatagcggaggcacttcatcgcgggagcggacggtccaaggcgtaatcttcatgccgagcgcatgaattctcggcacaagcgtaggatcagcggccacatttttcaagttggcgttcacgtatttggcatagccggaaaattccttaagctttgcatctgttaagtccgccgcttttgacgtcaagacacctgtcggcatcgatggaagcagctgatgaattttatagacagagttaaaatcaaacgattgtacaatgatttttccgtttttaggcttatccattctccgctctttcaatgctgctgacacttttccttcgattcccggatagcgtgcaggctctttcaattcgatcagcattccgaccttccctttataccggtcaagcacttcttcaaatgtcggaatgcgctctcctgcgaactgcggaccgaagaagctgccggcatcaagcttgcgcagctcggcaagcgtcaaatcctttacggcaaccggcagcactgagtcaatatctgtcgtacggtttacggtcgtatcgtgaatgatgacaagctccccgtctttggacatttgaacatccagctcgatataatctgctttcatctgaagcgctttatcaaaagcagccatcgtgttttccggcgcatatcccgaagcgcctctgtgtgcaatgacatccacttttttaggcttcaccgccggctcttgtgcacccgcattcggtgcaaacagcgctgacccgatggaaaccccgatcaatgaagataacatcaattttttgaataaagctgacacatcatccactccccttttgctcttctcttgccaaagtataggttcgcactgttaagattatgtttcagcagtctttaattttcataaatttcctgataaacaaaaaaagatcccttggcagagatctttttttggatatatcagcgctcacaggcaattttgtctttatcgcggtccagcttcttattggcatcataaagcgcttttgaaacatacggcttgtacttcgtttttccgcctttgtttttcaccgatttcgtacgggcgacgccgcctttatagtctttgtttaaagctttgcagtttttgtacgtctttaccttcgtttttgcttctgccacatcgccggcgccccaggaaaaaccgatgatcagaccggcagacaaaagacccgctgctatttttttcatcccatttgacccctttcgtctatttgttatgtatcttttaccatgataaaatatttttcttattcgatcaagaaaaatatggcattttattgaataaaaagtatgaatcgaaaaagcgtctcttcgcacaaaaaccggccgttatgcgccggtttcatccacatattgatgttcgcaagtctttttcaaaacagcgttaatctcatacgctaattccttcggatggatgcacagcatgtcttccaaagggctgtcccagttcccgttctttatcaatttcagcgcataatggcctgccggactgcactcgggataccactctacatcgagcagaaggcgttcttcatcatgccgcagcttcaaaaggtcccgtttgaagtcagacagccaagccttgctgtcaggcgctagttcatcggggtttgtatcagttaaagagtgatgcgcaactgtccagccggccgggattctaagccttagcaaattgcgggcgccatcagaggcacgcatcaagtcttccaaccgttcgatcagctgttcatacggcgcgtcagaatcttcgctgaccttcgattgatcagcattttgcatcctgatgacgtacttcagttctccagcatattcaacttgtaccattttaccgcagctttcattctccaagatcaatagcgtatggcgggggtcgcgaatcggcttttgatacaaatgattttccttcaccttccagccggccggcaccatcaaaggatgcaatttaaagaaatactgagatttggtcaacgctctcacatcctctttcattgttctgtcttctttcctatcaatctatgtgccggacaggcttcttagaacaacggcggagcggccccacaaaaaaaccgcctgacgcttgttaaagcagtcaggcggttttttgtcttttattctccggttttttcttttccgtaatgatattttgatggatcaacaggcttgaagtctgaaatctcgtggaatctcaacagatctttatagagtacttggtcggacagatccagctgttcggacacctgcgatttcaggttttccgtctcttggttgcccttgatctcttttcctgtctttgtatcatatacggtcgtatcaatcatcgtgtacttcggcgttacatagtttccatttctgaaagccacggtttggtcgtggtctttagaaaagaggtctgtaccaaagttgatgtattttttgctgtcaataccttgcaggtgaagaagtgtcggcatgacatccatttcaccgccatacgtatggttgactccgccttttttgcccggaatgcggatcataagcggtacgcgctgattcatcgcgttttgatacggtgtaatctctttacctaatacttctttcatcgcacggttgtgattctctgagattccgttgtggtcaccatagatcactataacagaatcatcaaataatcccgcttttttcagctctttaaagaaatcttcaagcgcttcgtcaagatagcgcgccgtctggaagtaaccgtctaccgttttgtctcccgttgttcccttttcaagggtggcatcctcttcatccaaaatgaacggatagtggtttgtcaacgagattaaatgcgcatagaacggctgcttgagcgatttcagcttcggaattgattcttcaaagaacggcttgtctttcaagccaaggttgacgagattatcctctgacatatcatatgtgctggcgtcaaagaatttgtcatagccaatttgtttatacacctggtcgcggttccagaatgacttgtagtccccgtgcagcacggcgcttgtgtagccttctttttggttcagaatcgccggcagggactggtacgtattttgcccttttgttacaaacgcactgccttcaggaagtccgtaaaggctgttgtccatcatcaattcggcatccgctgttttaccttggccggtctgatggaaaaagttatcgaaatacatcatgtcatcctggccgtgcgccagcttgttcaagaacggcgtgacttcttttccgttcagcttataatcgatcaaaaacgtctggaagctttccaaatgaatcttgatgatgttcttaccttttgctgcgccgaaatactcgtcattcggtttcgcataatgcgaatttgtatagttgatgacgctcgtcaggtcgtcgctgctcgcgtatgccttttggctcgcgttttgagcggcctgaacaccatcatagatcatgtaattgtaaggccccaaatacttgacgatgtaatttcggtcaaatgttcttgtcaaaagctccggacggtctgtctcggcaactgcaaggttgatgaaaaacagagccactccgccgagaacaacggcagcagcccatctttttttcagttgtgacgccttcagttcaggcagcttcacacatagagcaatcaaaatgatcaaatctgcgaaatagacgatgtcatgaaatgccatgatgtcaaaaacgccgtcagacatattgccgaggtttccggcttgttttaagtttgcaaacgtcaaaaagtcatcaaagaaacggtaaaacaggacatttgcatataaagcaaacgtcatcacagcatcaatgatgatgatccatatcgccgaccggcggccttttgcaaacaaagccaaaccgagtgcagcaatcgtgaagctcaatgggttgatgaacagcagcatgtgctgcgtagaccctttcacacctaaattaaactctaaaaagtaggaagcataggttttagcccatacaaaaacaacagctaatacaaaaaagcttagcttatgagagaatatttttttcatgataacctctacctttttaaacttttttcagaccgctttctgtttcagtcaatgaagcgtgaggaaacgataatatatcattctactaaaagtctcggcggttttacaagcacgtcctggtgaaatcccccggcttccctcactcaaacagtctacgcctgcgaaaaaaattttccgcatgtaagacaacggcctttaattaagacgaatgaatttccccaaaggtttcagttattttctttcatctagaaaattgcagtttcccggacgattaaatatctttatgaaattcatttaaataagcctttctttgcgcttctgtaaactgaccgatccattccgcacgcgcttcctccgtcatatacggcaggatgtacagctcgaccgctttataaaattccggctcaggcagaatgttgtacgtcggaatccgcaccctgccgttcccccgtgtctctatcagtatatccatcaagaaaatgcctttcgggctgtagcggcgctccgccattttaaggcttttgatgtccttgaacaacacagatttcttccctgagaatatccgcccgtcttctccctcgataatggtgaagatgatgtttccttttttcgtgaaggccggaaaaaccattagaaaggtcatcaaaccgtagatgaccccgaaagttccaactcccacgtacagcaaggaatattttgattcgagttttattgcttcataaaagagccatgctccaatcaatccgaaacctgcagtccctgcaaaaacccatactctaaaggacattctgcttttcacatcaaatgtctgctttttttcctgttccaaaaataattaggccctcctctacttcagcaagcggattccgctacaaataatattcatgccaagacctaccttaccacagaaaccagttcctgcataaaacttcatgtatttgtctgtccctaatcagaatgaatacagaaaaggctcccggccatctgccggcagccttcccctattttgaaatatcaacaaatccctcgccgaatacatccctgacatcgtggatgatgacaaatgcttttttatctgtgcttctaataattttcttcagcatggacagctcttgtttattaatgacaatgtataaaatttctttggagtcgcccgtatagtgcccgcgtcccgataatatcgtgacgccgcggtccatcagggtattgacctgcgccgcgatctcgtttttatgctcggaaataatcgtgatcgcctttttcgtgttgagcccttcgataatgaagtccatgaccttcgtggcgatgtacagcatgacaatcgtaaacatcagcttttcagctccaatgataaagtaggaactgaagacgacaactaaatcgatcatcagcaaggcatagctgatgttccagtcaaaatatttattggcgattctcgcgagaatcgcagacccggcggtggttccgccgacacggatgatcatgccgattccgacgccggcaaataccccggcaaagatggtgctgatgatcacttcatcggccggcaccgtccaatcttcggtgacgtgcagaaagaacgaattggccgccaccgcaataatagtgtaaatcgtcgtctttttatccaaaaagcgatagccgataatcagaagaatgccgttcagtacaaagtttgtgatgcccggagaccattcaaaaacgtagtataaaatcagcgtgatccccgtgacgccgccttctcccaagtcattcgggatggcgaacagattcacggctaacgcaaagaaaaatgcgcctataatgatcaatattatgtccattgctttctttttcataaatacatccccttcctttgtccttaatcgatttcctgtaaaaagtaaaaaagcccaggagagaagctctttgattaagagcaaaaactcctgggcttttatcccaccgtgtcataacgatacttcgctatgtgttttctctcggaccagaccagcgcgggagggcactgcggaaccctagaaaaccaccttttctctgctatcaatttgtcatcttcaagcattataagtgaaattctggggtctatcaacccctatatcagcctgaaagatttgtttttttgtaaaatagcttccatctgtcagcgataaaaccattctataataatagatatacgtgttttgcctgggaggcgctcttatgaacaaacaaaaacggcaatggctcatcaagcagaccattctcgaacatccggtagaaaatcaggaacagctggcatccctgctggaaaaacgcggcatcaccgtttcgcagtctaccatttcccgcgatattaaagaaatgtatcttgtgaaacagcccggtgaaaacggaaaacttgtctacacgacaaatgcttctttatccatcaatccttccaaaatattaaaagataaaatctctgacgttgtcctgcatgtgcatcgaacggacaacttgatcattattaaaacaatgcccggcaacgcccatgccatcggcgttcttcttgataagctcggaagcccggaaatgctgggctgtatatgcgggaacgatacatgccttgtgatttcccagtcacctgaggcagcccaatcattttatgaccatttatgctgatccggccgtccggatcagctttttttgcccttcaaaaaaatttttttcgagaaatccccgttaaaaatatacacgttttatacgttctattctccgctccgacaggaacttattttccatttatcataattattcatttttgtttttgcttcatcaaaaaacatgtgaaatatatcacgtttttgttgttatcgctttcacatcgcgcttctccttcctgttttaagctgtacatgtaacaaaaagagcttaggaggcgggatgatcatgacaacaccgatacacgtttactcagaaatcggccctttaaaaaccgttatgctgaagcggcccggtcgggaactggaaaaccttacacccgaatatctggaaaggcttctctttgacgatattccctttttgccagcggtgcaaaaagagcatgaccaatttgcagaaacattaaagcaacagggggctgaagttctttatttagaaaagctgacggccgaagctttggatgacgcattagtccgcgagcagtttatcgatgagcttttaacggaaagcaaagcggatatcaacggcgcatacgacaggctgaaagagtttttgcttacctttgacgccgattcaatggttgaacaggtgatgagcggcattcgaaaaaatgagcttgaacgcgaaaaaaaatcgcatcttcatgagctgatggaagaccattatccattttatctcgatccgatgccgaacctttatttcacaagagatccggcggccgccatcggcagcggactgaccatcaacaaaatgaaggagcctgcccgccgaagggaatcgctgtttatgcgctacattatcaatcaccacccgcgttttaaaggacacgagattccggtttggctcgaccgtgatttcaaattcaatatcgaaggcggagatgagcttgtcttaaatgaagaaaccgttgcgatcggggtatcggaacggacaacggctcaggcgatcgagcgtcttgtccggaacttgtttcagcggcagagccggattcgccgtgtactggccgtcgaaataccaaagagcagagcctttatgcatttagataccgtcttcacgatggttgaccgagatcaattcacgatccatcccgccatccaggggcctgaaggagacatgcggatcttcgttcttgaaagaggaaaaacggcagacgagattcatacaactgaagaacacaatttgccggaagtgctgaagagaacgctcggcctttcagatgtcaacttgatcttctgcggcggcggagacgaaattgcttcagccagggagcaatggaatgacggctccaatacactcgcgatcgctccgggggttgtcgtcacctatgaccggaattacatttctaacgaatgtttgagagaacagggcattaaggtaatcgaaatcccgagcggggagctttcaagaggacgcggcggcccgcgctgcatgagcatgccgctctaccgagaagatgtgaaataaccaacctaaagaaaaaggagagagatccatgaaccaaacgattaatttaaaaggcagaagctacttagctgaaaaagatttttcagaagaagaaatcctctatttgctcgatctggcccagaaactaaaagaaaaaaaagcacaaggcatcaggcatcgctatttggaaggcaaaaacatcgctttgctgtttgaaaagccttctacaagaacgcgctgcgcttttacgacagcctgtatcgacctcggtgcgcatcccgaatatttgggcaaagacgacattcagctcggcaaaaaagagtcgatcgaagacacggccaaagttctcggccgcatgttcgacggaattgaattccgcggatttgaacacgaaaaagtgatctcactggcagagcattccggtgtgccggtatggaacgggctgaccgatttatggcatccgacgcagatgcttgcggactttatgactgtgaaagaacatacgggacgcgtaaaaggcgtcaagctcacctatatcggcgacggccggaacaatgtcgccaacagcctgctcatcggcggcgcaaaagtcggcatggacgtaagaatctgttcgcctcaagagcttttccctgatcaggacatagttaaaatggcggaagcgttcgctgaagaatccggcggaaaaatcaccgttacaagcgatacagataaagccgtgtccggagccgacgttctgtatacggacgtctgggtatccatgggggaagaagacaagtttgcagaaagaatcaaactgctcaagccttatcaagtgaatatggatctcgtcaagaaaacaggcaacgacaacgtcatcttcctgcactgtctgcctgccttccacgaccttcatacaacctacggacaaaatgtttacgaacagcacggccttaaagaaatggaagtgacggacgaagtgttccgcagcaaacactctaaagtgttcgatgaagctgaaaaccgcatgcacacgattaaagctgtcatggcagcgacgctcggcgatcttgactgacaggaaaagggactcattcccttttccattctaaaccgaatgaggtgacaaaaatggcggaagaaaaaaaacttgggctgtttgcgctcatcgcgcttgtcatcggatcgatgatcggcgggggcgccttcaaccttgcaagcgacatggcttcaggggcgggggcgggagccattttaatcggctggatcatcaccggagtcggcatgattgccctggcattctctttccaaaacttgacgacgaaaaggcctgatttagacggcggtattttcacttatgcccgggaaggattcggccatttcatgggctttaacagcggctgggggtactggttcgcagcccttctcggcaatgtcgcatatggaacgctgctgttcagcgcaatcggatatttcatccctgcgtttggagacggacaaaacatcgcatcaattatcggtgcaagcgtgatcctctggtgcgtgcactttttgatcctccgcggtgttcagtccgctgccatgatcaacttaattacgaccatttcaaaacttgtaccgattttcgctttcattatcgccattatctttgtgtttcatcttgatttatttacgaacgatttctggggaaaagggctgtcgctcggttccatcggaacacaggtcaagagcacgatgctggtgaccgtctgggtgtttaccggaattgaaggggccgtcttattttcaagccgggccaagaaatcaagcgatgttggcaaagctactgtcatcggcttgatcagcgtactcgtgatttacgtcatgattacgatgctgtcgctcggcgtcatgaatcagcaaaacttggccgagcttccgaatccttcaatggccgcgatcatggagcatatcgtcggcaaatggggagccgtgctcatcaacctgggattgatcatttccgtattgggcgcctggctggcctggacattattcgcgggcgaactcccgctgatcgcggcacgcgaaggggtcttcccgaaatggttcggcaaagaaaataaaaacggtgcgccgacaaatgcgctgactttgacaaacgccattatccagctgtttttgctgacgtttctcatttcagatgcggcctaccagtttgcattttccttggcttcctcggccatcttgatcccgtatctgttttccgggctttatcagcttaaatacagctggctgcacaaagagcctaaccggggcaaaaatctcatcatcggcatcatcgcaagcatatacggcgtctggctcgtatatgccgcgggacttgattacctgcttttgaccatgattttatacgctcccggcattctcgtattccgggctgtgcgcaaaggaaaagaaggcccagtcttcaataaagccgagcttttgattgccgccctgattcttgtattggccgtgatcgccgtgatcagactggcttcgggaagcatttcaatttaacaaaacagaggtgattattaaatgaaaaaaagaaaaattgtcgtcgcacttggcggtaatgccattcaaaccggagatgccagcgcagaagcgcaaaagcgcgcgcttgaagaaaccgccatgtatttggcggatatgatcgacagcggcgctgaattaatcatcacgcacggaaacggcccgcaggtcggaaacctgatgatccagcaaaaggaggcggattctccgaaaacgccggccatgccgcttgaaacctgtgtttcgatgacccagggaatgatcggctattggctgcaaaatgcccttgaccgggcgcttcacgcaaaagggaaaggcggacatgcggcaaccgtcatcacccgcgtcgccgttcgaagcgatgatgaagcgttccgcaacccgacaaagccgatcggtccattttacagcgaagaagaagcgaaagaactgatgaacagccgaaacggcggcctcgtttttaaagaagatgccggaagaggctggcgccgcgtcgtaccgtctccggccccggtatcgattcttgaacacgatgttatcaatgatcttgtcgaacacggacatatcgtcattgcagccggcggcggaggcgttcccgtcatcgaaaacggcgatgccgtctccggtattgacgccgtcatcgacaaagactttgcagcctgcaaactggcggagcttgtgcaggctgacgaactggtcattctaacaggtgtcgactatgttgccgtcgattatttaaagccgacagaacgtgcgctgaaacgcgtcaccaccgaagaactgaaaggttatataaaagaaaagcaatttgcagaaggaagcatgctgccaaaagtcaaagcagccattcagtttgctgaagctaaaaaaggcaacaaaacggtcatcacatccctgaaattagccaaagacgctctccaaggaaatgccggcacgattgtcgtccaagcctaaatgcaaaaggaagggctcagggagggttcttccttttgccaatcgtcaaaaacaagtaaaatttaaagtatatagccgcaacataagaaaatcgataagggtggtccatatgaagaacaaagacatcgtacatcagctgaaaaagtttcctcttctcgcttccctgaataaaagagatctggaagatatgaaacagtttatctattggcgctcttaccataaaggccagatattatttatggaagacgacccccgggaacgaatgtaccttcttctcgacggctttatcaaactcgaaaaatcaaacgaagccggatccatgttttataccgactatgtacgtcctcataccctctttccatttggaggcttgtttcgggatgagcattatcactatgccgccgaagccttaacagatattgaactctactatatacccatgaacatcttcgaagatctcgtccgggacaacaaaaacctgctttacgatattctcaatcatttatcagacatccttgcccttcacgaggaaaggctgaagcgcatcacactctcccatgcccacgacagggttacacaagccatttattatttaaccgaaagcctcggtcaaaaagaaagcaactcaaccgtcatcaactgtccgatcaccgctgccgaaatcgccaaaatctcggggacatcccgcgaaaccgtcagcgccgtcctgaaaaagctccgctgcgaaggcgttatcagtcaaatgaacaagcagatcatgatcaatcggccggaatattttatgtaggcatatatgagaaatcatcccggcgacaagcgggatgattccccgccgtttttatttataccggaattcctctgtttcaaaccgtctgtttttgatgatatcccgataaaagcaagccgattttttcagcgccctgctgcggttgttctccaatcgaatctcgacaaggccgtagcggtttttaaaggcgttcatcggagagacgttgtccgtgaatgcccaaagcatatatcctttgcagtttgcgccgtcggcgatccctttcatcgcctctcgcaaatgggctgaaataaaatcgattctgtagtcgtcctgaatgaccccctcttcatttttaaaacgctcttcatgttcgacgcccatgccgttttcagcaatcagccattcgatatttccatactcatatttaagtctcatagccatatcgtacacaatgcgcgggcagatctcccagcctctgaacggattcatctttctgcctggcagctcaaagggctcatagtaataagcaggatgaaaaggcgtcgattcattccattgccttgaaggcgcttgaactctcttcggataatacaggttcacaccgacaaaatcgaccgtattccgcttgatgacggaaagctcttcttcatcatggtcaaaaaggatgtcgtgtttggccatgagctccatcaattcatcgggatagacgccttttatgctcggatctaaaaaaaccctgttaaaaaacaaatcataaacttgggccgctttctgatcatggggcgcgcttgacctcgcatacgcgacctcaggatttaagatgacgccgatttttgcgccttctctaaaactgggcttccttttccggaaaattgccacggcctttgctgtcgccagtgctttatggtagttccactgcatccattttttcgtgttctgctcgtacggatagcgaagtgcgtcaaggtagatccgtgtttgcggcacgatcggttcattaaaggtaaaccagtatttcaccctgtccccataccgttcaaacgctttttctgcataagccgcaaataagccaaccacgtgttttgatccccatccgccatactgttccagcaggacagtcgggatttcgtagtgctcaagacaaagcatcggttctactccgcatctcttcagctcatcgatgacgtcatcaatgtagcctgcatacacctcgtcaacttcggcggtttcataatccaaaagaaaccgcgaccagttaatggatgtccggtagtgggttagcccgatgtctttcatatattgaatatcttctttgtagcggttataaaaatcggttgccacagccggtccgtatccgtcatgccatacatcaggatcatttttgtaccacatatccaaataggaatcctgtgtcggccgcttcccgtcccacccctctgtctgccacgccgacgctgctgcgccgagaataaaatcgtcgggaatcttccacgtttgtctggccatctcattcacacctttctttgctttacatagacacatttttttcagaactaatcgtaaaggtccgattcaataaaataacaaacggaagataaataaggacggagacgatgatgcatacgatttgtgtgacgacggcaccgaggcttcctcctgttgacagccaggcattgataatcggcggtgtcgtccacggcaccatgacaacggcttttccggcaaagcccgccgctgtcgcgatgtaaccgatcgcacccgtcacaagcggcgtcacaataaatggaatcgccattaacggattcagcatgacgggaaccccaaagatgaccggttcattgatattgaagatgccgggaccaaacgaaatctttgtaatgctgcgcaaatcctcccgtttccccgcgataaacatcgcgatcaacagaccgattgtgacgccggatccgccgatgctcatgtacacatcccaaaacggcatcgtaatgatattcggaatcgattcgccggctgcgtatgcattcatattgacggtaatcgaagcgagcagcaaaggctccctgatcggcttcaccatctggtttccatgtatgccgatcacccagaaaaactgtgcgacaaacaccagcaagagaatgccgggaagaccttgaatcgcgccctcaagcggcttttgcacgacattgtacacggcttcatgaagatatacccccgtcagccgatgaaacgcaaatccgaagctggcgatgatcgtgacggtaataatcgaaggaaataaagtgccgaatgatacagagacatttgccggcacgctgtccggcattttaatcttgagccggtccatgcttgacagcttgctgaagatttcaacagacacaatcgaaataaacatccccaaaaacagcgacttcggatccgtaaattccttggccagcacgttaaccacttcctgcatcgaaccgttcacttccaacagcaccgccgatggaatgacagagatataggacatgagcgccatcaagccgggaaaaaacgattcatgcccattcagcttcccgagctcaatcccgatcaaaaacaccgcgccgatcgtaataaagttcagcgtcgcataattgattgacgccataatcggctcaagcgcagacaagaaccgaaaaggcctgaaaaccgcaagtcccgtctcggggctcatcaccatattctgcatcaaaaccgcaaacgccccggcaatgatgaccggcatcagtgtgacaaacgccgacttaatgaccatgatatatttgaaacttgtaattttaaaagcgacccgctcaaacatctcagtcaccttcgccatcctgctcatttactctccccctttttttggtggtttgcttttactttataatgaaaacgctttcttttcggtgcatattttttcctttgggagaggaaatttttcaggttggacggccagcaaagcagacaacccgccgtttcactgaaacagcgggtcatatattttactgtggcaactgcactttgatcggcttaaacggtgtagaataaaatgcgcttaaataaccaaattcgacatcaagcgaatatcggtcaaggctgaagtttttcgctccaaattcaccatctaacgtaaagtctgatcggaatcggagctttttaggatcaagcacttttgtaaaattaccttttacgctgtgtcccatcggcgcttcgtcaatgcttttataagcagaatcaaccagtgacatcgtttctaaaaagttttgcatgctgtcaatatcaatcttagattgatcgacatgtttcagatgatagtcgacagacaatttacttccgttttgtttcacctgatcaacggcaatctggaagtcatgacggtcagcgctcagcgcggcgggcgtttttgtgagaggcagcgtcttttcggaatcgcccatactgctgctcgcctcaatcttgaggtgttttgttcctttattcacttttccaaggatcagcctttcttcgtgacgaaccttgtttccgttctttgtactgtccgtcgtccactgcccgccactcaaataaggaatttcatttcctttatcatcggtcacttttataaccgatgtacgatcgttcggatgttcctctgaattggatacttcatagtcgatgacagtcgattcttttccgagaattaccgtttttacggcgagcttatggccatccgccgattgtgtattgtttttggttatgtggagcgttttatacggcagtttatcaaccggaatgtcgaacttccatttccctctgattccgttaatatttgtgatcgtaaccgggagtgtcagtttatcgggaatatgtttgtctggatagcctacttgaatgtagccggtatagccgtcctctgttttcttcaagtctccttgagaagcgatagcccatttgcgctcgccattaaataatgtgaaatgaatcattctcgctccatcatctaaatcttttcttgtatcgcttttcaccttaaacgtcataccgatgattccgccgtcaaaataaacgcttgtagctgtcacgtctatgttgttgctggacgctttctcgttcagttcagtgacaagctggcccgccaccaagttttggccgacatagtcatggaattgttgatacgcttttccaatcagcgggacgtcagccaacacgctttgcatcgctggggaaacgaagccgctaccgagaaggagcacggcggccgcgctcgaaacaaaaacagtccttttcacggcgcgcttcggccgaaacgttttttcccgcttggcccgcttgatgcctttatcaatcgattcgcggatttcttttgtagggacatcgatcttgtttacttcgtttttgaaccgttgtttgtccatgcgtcttctcccccagtcagtagttgttttaattcaagcttcgctcttttcagataggtcttaacggttccttcaggagcattcatcacctcggcgatatcatgaatcggcaggtcgtgataataaaataaaatgatggcggtttgatattcttttcgcaactgctgaacagcttcaagcatccctattctgtcgtccgcatgcatctcctgctcccggccttcgtcctgcagcggcctgtccattaaaaccactttctttttcttgtccaatatggcatatgcatgatgaatgaggattttcgtcagccatgtcaaaaagtattcgggattcctcaactgggcaatcgataaaaatgccttgtacgccgtttcctgtacgatatctaacgcgtcctccttatttcgcacatatatgtaagctgttctgtaaagctgttcgctgtgcttttgaaacagcatttcaaaagctttggcgttgcctgcgacagctttcttaactaatctgatttgcttcactgctgcgcctccttcaaacattagagaggagaaatgatgagaaaagtttcagaaagatggtttttttcacataaaaaacccgctttaggtaatatagcgggttcaaatgttagtttctgttggaaactttatgtttagataattcttcgtataaactttgcaattgttcttgacgaatcattccgttgattgaaactgtgccatcgggttctaaccgaacttctattttatttgaaattgattgaagctgaccttcaagataacgatatctctcagtcaaaaaatgatatcgttgattagaggaacctgtccatggccggcttaaatctatattttctttttcgaaaggaccatcaatgaacaaatcagtcaattcaagtaactctagctggccctttcgtggattcgactttatatcttccaagtatctgccgctaaaggtcaaaatagaaagtccagcaatttttattttatccgcaagttctgcaagggcttccgcttgatccattggctcaccaccaagaaatgttacaccttcaatattgttttctttttttgaatcaacaatctttttaaagaggtcgtctacactgatgtcttttccacccttgtcagaccatgtccacggtactccgcagccttcgcagcgtaccgaacatccctgcacccataaacacgcccgtttaccgggtccttctgcttcagtaagcggcaaaaaacgatggattcgtattttcattaaatatccaaaacccttccttcagcattctcatcttttctatcccttcggtcaactggtttagagaatgagagatacggctctaccttcaaaagcacatgcggcttcaatcctaactgttcgccgaaatgatcaatagatgaaaagccaccgatttcttcacgcatggcgaccgcttttttggcgaggataattcccaactgcggaatcgaagcgatgtcttccacactcgcttgattaatgtctattttccgttccgattgtttatcggtttggctcgttcgagccgcggcggtctctggatactcatttttcagagatttacgcagctgatctatttcagcgcgtttcaactgttgaatggactctaaccgaattaaaaactccggccgcacttttaaagcgtgaacaattgagacaccccagccgatgatcaaaagaaccatggccgcattgaataaaggtgttccattagaaagaatagtgaataaaaaaatagcaaaatagatccatccggcaattaaccattttttttgttttgcccgagcgaaaatatagaaaaaagaaacccaatttaaaaagccaaaaggagtaaatacaaataggacccatatggattgaaacagctcccatttcactcccttattggtatatccattagccattacggtgcccccttataatttgctgatgcctcaaaacatcaacctgttccgtctcaaagtattccgccgtatatgatgaatcaatcgtttcagcctcaagcagctgttccagaactcgaatataatctcggcatttcggtcctttaatcccttttgtttccacattaatttgaccatcctgctgaatttcaacaataattcgctgactcatgaaatgcctccttatccattcaccttgaacgtcaataccaccgaattctcatttgtcaccgtttcattttctaaaaccaatccttcatgttcggccttttctataagtttcaaatatgtttcctgctgcaatatccgtttgtactcctcttcaatttgatcaataaattcccgcgcctggtttttatcaactgaacgatcaaatgcagctttaaaggtgccttcttctgtcaaatggaaagttacagctgaatcttccatgattgcttcgacgtttgttgttccaagctcgatcgtcttacatccattttggtcaagcgcttttttgagaaggtcttcatccttcataacggtaggcattgtataaagacggcctgattcgttttctgccaaataggatgcaatcgcttgggtcgctgcaatcgcaactggtaataaaacaatttcaatactcatgctttgacacctcttcctaaaactctacagctctgccaccccggcttgtatgtaaatcggcatctttatcacgcggattttcgtcatctttctttagctgaatagattggtattccttcagatcttcctgacgggcagccgatacagcccgaagacttgcccattcccgaattgcaagaatttgctctgattgcgtaacagccaaaggaacagtctgcttaatcactttctcaagatcctcaaccgttaagcttcgattttcagaaaaggcttcaaataatgcagaaattacgacttgttcgatttcagcaccaataaatgattccgtcagttctgcaagcttgtccaagacaggtggttctattgaaaaattcccggcagctttcgggtttgttagcctcttttcaagatggatgcgaaagatttcttttctttcttttttcgttggcagatcaacaaaaaatatctcatcaaaacgtcctttccttaagaattcgggcggaagagcgtctatattatttgcagttgctatcacaaatacaggctttgatttttcctgcatccaggttaagaaattcccaagcactctcttcgaagtccccccgtctccagctgttccgctattccccaatcctttttcaatctcatcgacccacaaaatagacggagaaatggcctctgccgtagataaagcgtttctcatattttcttcactgcttccgacaatgccgctgaatatttttcccatgtccaattttaaaagaggaagcttccacatagagctgacagctttagcaattaagctttttccgcagccgggaacccccgttaatagaagacccttaggggatggcagcccatagtcctgagcggagtccatccatgacttgtttcttttattcaaccaacgtttgatattttccaatccacctacatcctggatatttggttcacttttaataaactctaatacgccggtttttttaatgatttgctgcttttcaaaaagaatttgatcaacgctatccgaatctagacgccctttgcttactagcgccagtgcaaacgcattttctgcttcttttaaagttaatcccagtgctgcttttactaggcgttcttcttcgtcctcagtcaagctaacgattgcccgattttgcccttgattcatttcgatcattttcttgagcgtttctttaatttctgcaaagctgggcaattgaaactctacaattgtgatgtccttttccaattcaggaggaagcgttaatgttggcgccacaagcacaacatttttggaaacaagactcttttccaatacagagacaagatctttcattttacgaatcaaacggtattcaggggggcgattatttgcacccaaataaacataaaaatccttcaatataaagactgctggctgatcatatttttcaatgaacgccaaagcctttaacgggtcttttgtttcggctgatggaggcattccattgctttcaaaccctttggttaaactccaaacaaataaggttcttggtgttctaatcaattctgtatccgaaacaatatgactcagttgatctatgacacgttcttcttcccatgtagaaatatacaggaacggaaagcgggccctgaaataattcgctacttcttttctaaagtgatgatatccttccatttttctccctttctattgacctattttttattattatactaaatttttccacaacaggaataaaagatttcaatcctcccattcgccttctctaaatgataagattaaaataaaaccaacaattggagatgaaggaaacatgaagaacaaattgattgaacgcctcatttcttatgcgaaagtggatacgcagtcaaatgaaaacagtcagacgacgccttccactcccgggcagctggcgcttgccaatatgcttgtcgaagagctgaaagagatcggcatgaaggacgtcacaatcgatgaaaacggctatgtgatggcgacgcttccttcgaatacagaaaaagaggtgccgacgatcggtttcttggctcatgtggatacagcaacagattttaccggaaagaacgtcaatccgcaggttatcgaacaatacgacggaaaggatattgtgctgaatgaatccctcaatgtcgtcttatcgcccaaggaattccccgagctagcagattatgcgggacatacgttgattacaaccgacggaacgactttgctcggcgccgacaataaagctgggatctctgaaatcatgacggcaatggaatatttaattgcgcaccccgaaatcaaacacgggaagatcagagtcgcttttacacctgatgaagagatcggcagagggccgcacaagtttgacgtcgaggcgttcaatgccaaattcgcgtatacggttgacggcggaccgcttggcgaactgcagtacgaaagcttcaatgccgcagccgcgaaaatcacttgtaaaggaacgaacgtccaccccggcacagcaaaaggaaaaatggtcaatgccgccaaaatcgcgatgcagttccacgccgcattgccggaaaacgaagctcctgaatttacagaaggttatgaaggcttttatcatctgctttcaatcaagggcgatgtttctgaaacgagcctctcttatatcattagagattttgacagagaccgatttaacgagagaaaagacaccgtccaaaaaatcgcaaacaaccttaaagcgaaatacggcgaaaacagcgtcacagtggacatgaatgatcaatattacaacatgagggaaaagatcgaaccggtcaaagagattgtcgacattgcctataaagcgatgaaaaaccttgatattgaaccggtcgttaaaccgatccgcggcggtacagacggctctcagctctcatatatggggcttccttgtccgaacattttcacaggcggggaaaactttcacggaaaatacgagtatatttccgccgacaatatggtaaaagccgcgaatgtcatcgtggaaattgtgaagctgtttgaagaaagagcttaaacgaaaaaagcggaaagcggctgcaagacaaagcagccgcttttttttccagatcaatctttatctgcgctttgctgaaattagaacatgttgcaaggcggtttctttttggagcgggataaagccaattaacatctcaccgatgcaaaaaattctgttcatttggcttcatcacctttccaaatatctttcaacgtccagtaagtgaattcttcaacccgtacgttgcctttctcagaaaacagctcaatccccgctcttccttccttcggatatatgcggcttgtcattgtcgcttcaccatgatttgcaaatacttcaatagacgatctgtcgagaaacagatgcaaagtgagcttctcatccgcttcaagccgtacgtttctcacaccgtccctcgctttgccggactttgaacagtcgagcgtcagcttttgatcaatcaagctgtacttgatggttgtttcttcctgttcaattccccggatctttaagccaaccgtttcggcactgcaaattgtcaaatcaaaaacggccaccacttcaagaagcttttcggctgtctttataaaatagctgccggaaatcgattgattgtcacactcatgatgttccgatccacgaagtaatttagtctcctcgacgggattcattaaaattttgtgaccatccttcaacgtcaattcacgcggcaaagttaatgccccgcaccatccgtctgctttcgtcggcatctctgactcccacatatccatccagccaatcgcaattctgcggcctttgtcatccaataaagtttgcacggcataaaagtcgtggccgtgatccaactctttaaaggagccatgtacaaactcattcgtttcttcatcatagtctccaatcaaatagcctgtttgatacagattttgatatgattcaccatcagcctctataccctgaggggaaatcagcaaaatgtgtttgccgtctagttcaaagaaatccggacattcccacataaagccgagatttccgtcgctttgggcgagaacgcctacgtactcccaatctacaaagttaggcgagcggtataagatgacccgcccgacgttctcttttgaggagtttccgaccaccatataccagttctcacgatgcttccatacttttggatcgcgaaagtgacgtgcgctgtcttccggcggctctgcaataacagggttttctttcagtttttcaaagacgataccgtctttgctgactgctatattctgagtttggtagaaatcgtctttctcttcatctatcatattatgcccagtatagattaaagcgaggtcgccgttatattcgactgcgcttcctgagaaacagccgctctcatcaaattcgtctcccggcgctaaagcaaccggcaagtgctcccagtgaataagatccttgctcttcaaatggccccaatgcatcggcccccaattctcatcatacggatgatgttgataaaagacatgatactcccctttatattgaataagtccgtttggatcatttatccagtttgcccggggcatcatgtgatagcccattcggtaacggcgattcacttttttcccggctttctttaatgcttcttctgcctgctgaattctgttcatctgtgacatcctctctatatatgattgctttgtagattttgagcaaattcaacatctttctttgagtctagcaaggtaaaaatcgaaataatggtaaaacaaaggaccattgctcccatgatgagataagtgtggcgaaatccgatgctgtcgtataaacctcccgcaagcggcgaaaaaatcgacgtgcctacctgggatgcgaattgaaagccgacaagataaagtacggatgaaagacgattatcaaaattagtcgccaaatatttaaacatcgcaatcagcataatcggcaattctaaagcatgaatgagtttcatcgatgaaattccgaccggtccgctgacaagtccggaaccgataatccggaaagccattaacagccccgctaaaatcaagctttttttaggaccgagcttattgacgatgaaaggcgcaagaaacatcatgcccgcttcaataaatacttggaatgaattaaggtatccaaatatttggttccccaaggccgcagtcggaaataaggaagcgtagtaaagcgggaactgctggtcatagacgccgtacacgcatgttacgccgatcacgtacagcatcaaaaaccagaaatcttttaagagaaaaagccctcctacgtcttttaatccgaccgagtctgctctttccttttcatcatctgtcatctcaatttttacggaaacaataatggccaccaatatgattgctgaggcggacgcaacccagaagttgatattcggatcgatattgaacagctgacctgcaaaaaatgtcgccgcagcccagccgagggacccccacatccttgttcttccatattcaaattgatatttgcggctgaccttttcaataaaggtttcaatcgcaccgattccggcgagaaaagcagttcccaaataaattcccccgacgatagccccaagaaagacgttgtattgcaaaagcggtccgtagacgaaaatataaaagggacccgtaaatacgagcagcaaactgatcataaataatatgtttttcttcagcccgagcttatcggagataaaaccgtacaaaggctgcatgcacaaagtaaagatagcgtttacagaaaagataatgcccgtcgcggacccgttcaaattgatttcttgccctaaccaaatcgcaaataaagaatagctggaagaccaagtaaaaaagaaaaagaaaaaataggcgcttagtttccaatacagactgtttgagcttttcattttcatttgctcctttaacccgatttggatgtatctatttgatgcctgtccctgaaccgcccaggccatctaaaatgtagcgttgggctacaatgtagatcagaatcagcggaatcgtggaaatcgtcaagacagccatcacctggttcgtataaaccggctcggtgctgttgatggctgtaatcgccacctggatcggaaatttcgacttatccgtcaaaaccatcagcggccaaatatagtcattccagctgccgataaaagccaatgtccccaccgtagcgacagccggtttggacatcggcagcatcacccgccagaaaatctgccatgtatttgctccgtccagcttggccgactcaatcatctcccccgggatcgccatgaaaaagtttcggaacaaataaatattgaaagcccccgcaagcgccggcaaaatcacggcaaggcgcgtatcaacaagtccgagcttatgaacaattgtaaactgcgagattaaaatcgtttccatcggcacgattaaaagcgccagcaatatggtaaacagcacttttttacctgtgaattgcagcttggcgaatgcaaagcccgccattccgttgataatgaccgctcccgctgccacacacaaaccgtaaaacagactgttaccaatatacattagtaaatcaaaccgtgacagcacttccctgtaggattgaaaccattccgacggatgaaaagacggaagaaacgctttaatgctgctgatattgttgtaaatatcggcttccggtttcatcgatgaagcgaccatccaaatcagcggaaatataaacagagccgccagcaaaacaaggcatatatattccagtatcgttaaaggtccgaatttccttctcatccgccttcatcctccttcaccaacttgcgctgcgcaagcgtcaccaatccaattatcgtgccaaacaagagcgcaattgaacttgcatagccgaccatccgatcggtaaatcccgtttgataaatataatagacaactgtcatcgttgaattgaccggtcccccctgggtcatgaccattggctgcacgaggagcttaaacgcactgatcagcgtcgtaataaagataaaaaccgacgtcggtttcaacaaaggcaatgtaatataaataaaccgctgccatttattcataccatccaattgcgccgcctcgtagacatctccgggaatgttttgcaggcccgctaaaaaaatcagcatctgaaatccggctccctgccagactgaaacgaaaacaattgtaaagatcgcctgattaggacttgtcaaaaacggctgtggcggcaaaccgacatgcgtcagtacgttatttatcattccttcattcggattcagcaagtacagccacaaaacggagatgacaacaagcgacatgacgacggggctaaagtatgcgactttgaaaaacgtattggccttgcgctttttattcaacagaagggccagcccgagagcggccccgatctgtaatggaatcacaaggacaacaaatttcaatgtgttgctcaaacttttcaagaaaatagggtctttgaacaatttgataaagttgtcaaaaccgacaaacttgcgcaggtcaggtgttaacaaataataatctgtaaatgcgtagtaaaccgccataatcgaaggaatcacgagaaacactgacaaaatcagcaaggccggacctaaaaatgtataggccagcacattgtcccgccaccctattttactggcagggatttttttcagcggaaaggccgtccttgcttctttcaacggaattttattcatggctccaccttctagtttgccttatcgatggctgattgcatttcttttgcacgcgtatccagaaccgattgaatatcctgatgctgatcaaagaagctgatgtcatcgatcgcttgctgaaatgcgcgcgtcacctgtggatatgccggtgtcaccggtcgtgcatgccccgtttctttcagctgctgcaagaagacattcatttcatctgagaattcttttgccagcactttctctgatgaatagcgcacaggcagcgcggcgatcgaacggctcaattccaagttggattccttgtttgtcatccaatcgaccaattttgccgcccattccttgttttcagacgtctgtgtcatggcaaactgccagcttcctgaaggggacacaagcttttttgtttttggcgacacaggatacggcatcacaccataatcgacattaggaaaatttgtttccatgtcggttaccgtccagacaccgctcattttcatcggatatttttccgtttcaaacgcctgcttaaccggagtccgggtcgtgtaaccctctttcagcattgtttgaataaatgtcatcgcttcaacggtcagtttgtcgttaaaaacaccctccgctttcttgccatcttttgaaagaacatcgccgccagccgaccaaacaaatggcaaaagcgcataggtcagcatttcgtcttttgactgcaactgcatatcgatggccggtttgtcatatttatttttcagctttttgcaaagctcaaggaattcgtcccacgtccatggattctcaaccgttggcagcgttttcaagtcaacgccggcgtccttcagcatttttttgttatagtaaataccgaccgatgattcgctgacaccgatcgcatacagtttcccctggtaggttccctgttgcttaatgctcggcaataaatcatcctggtctttgatatactcatccaatggcgcaataacgccggatttcgcataagccgccgtgttcggtccgtccaaagtgatcacatccggcagggtattcgttgtcagcgccgcgttcactttgtcttcatatccgccgccgtttccgcttctggggatgaaatcaattttggcctcgatgttttcagaggcatactttttattaaaagcgtccacccgcttttgatagacctttccttcttcactgtcatcagatacgtgcacccacatcgtaagcgttttcccatcttggctatttgcacttttgctattgctgcagccccacatcgcaaacatcagcaacaacgaaaaaattccgaagagccaccttttcatctttgtcacttccccccattttttatcaattaacaaatgaaagcactttcaagtgaattgtatgtcaaccggtttcatatgtcaaccggttgacatattttttccccaattattcatcccggtacatttctcagaatcatggcattttcttgcacatatcggcccgattctctaaaataagtgcgtgacgagaattgtaagccatttcagtaaaaatagcagggggaaaagggaatgaagcctagcattcacgacgttgcaaaaaaagcgggagtttcaccaacaaccgtatcgcgggtattaaataaccgcggctatattagtgaaaaaacaaaagaaaaagtctataaagcgatggaagaaatcaattactttccaaacgatttggcccgctctttatttcgtaaacgaactcatttaatagggctcatcatccctaactccagcaacccgtttttcggcgaactggcctttcatattgagagcatctgcgctgccatgggctacaaactgctgctttgcaacagcttaaaccgcaaagacaaagaagaaaaatacttggaaatgctgatgcgaaatcaagtggacggcgtcatcgccgtgacttacaacaggggaattttaaattatcatcggcaaaacctgccgattgtcgccatcgaccattacttgtcggaaacgattcccgtcatcggctctgataactatgacggaggaagaaaagcgacagaactgttaattgcaaaaggctgccggcacatcatccatatcaacggaccaattgagctgaaaacaccggcaaatcttagaagaaaagcatatgaagatgtgatgcgacaacacgggagacagccgattacatatgaagttccctttcatcaaaattaccgggaaatcatttcaaaactgtttgatgaacagcctgcagctgacggcatttttgccagtgatgacctcatggccgctacagtcatcaccgaagcaaaaaaacgcagaaaagacattcccgggcaattaaaggtgatcggctacgacggaacggaagcggttcagtccattctcccggaattgacaaccatccagcagccgatcgaactcatttccaagacggccattgagattttgtccaaagccattgaaggcgaattcgatgatttgccgctggaaacctatttgcccgtacagcttttagaaggagagacgacttaaaataacgggacaaaaaaaggagacattgacgtctcctttctccatacatatcctgatctatccaattataaaaaagataaaatttacattgctcacctaaaatttaacttatatttctagacaaactcacctccccatgataaatttaaagacaagttttcgaaaaattctaattttggcgtggaggtgcctttaattgaacgtaagccacttttttcctgaaacctttgtttctcttgtaaaagacatgttaaccaaaaccgatggttcaacaaccaaagcgattgaaacgctgatcggcggcaaagccgaaatcgaagtttttcagcaaaataatattgattatgacaagctttcacctgaggaagcaaggctgtttcaacgcgatgatgacatcttgtttagaacctcgtctttgaaaacaggcgatgattatttatcttataattatgtctatgtcaaaacaaacttactgccgcccgccatcaaacaagatttgcaggaagaaaggcttcccatcgggaaaatcattgcagaactggagtcaaggcgtgaaattttcagcacgggcgactgcctgggaaaacatttcacacaacttgtacctgtttcagcagaccggacatatgcttttaaaaaataccagatcatcagcggccgacagtgcatgttctatgtctgcgaactgtttgatttagaaaaaatctgcaaactgactgcgggctgaatcatgcccgtcagctgccgctttatgaaagagcttccaaaacctcctccttccttcttccctcataataaaaacccctgagaaacaggggctgttatttattgatacaccgttttcggaactgcaacgaccggatttccggcggcataaggggcgacatcgtattgttggaagacgatcgcaatgccgtcgttagtgtaatagaaggccgtgtttttaccgaggacgatgtctttcttcttcacatccggaaagaaaatgtcgctgtgtttttgaatatagttgtaaatgtatgtttttgtcttatccattttcgattttgtatttaggatgtcggataaatacacccgttttttagagacaaggtcatagttgaaagagcggactgccgtatttccgtgcgctccgccggaatagacgtaattgcttgtcaggatgctcagcttttggccggtccggtatttcacttcaaaggacgtttgataatccgtttggtatccgtgctgttggccgtctttcttgttttttacataatctttgtaggactgctcaatataatgtttaaaatctttgttgatcttgttttggagagatttggggcttacatttgaaacttgcgggtatttcaaagccttaatgtttttgtacgtatggctcgtgaccgtcggttttttttcgtttgccgcgtgtgcagaaggaagtgcggccgcactgtacagcgcaaaaaacaatacccctgtcatcaacattccgaacgctttaaacactgtttttttgttcataaaaaccctccttaatctgtcattttttataatacccattttgaaatcaggtacacattatagaccggtgaactcaataaaaagtttctgtttttggaaataaaaattgaaaaaaattctaatttattctgtttgttcagcatcttgttgactgtttgaacggctgtcctgacgaaaaattcacacattgattcgatacgccctccagtttaaccgcagaagaagaaaatgaaaaaaacgaagagtttttttaaacccattgacatttttataaaaagtattaatattaaaactattaaaaaatcgcataaaaaggttttccttatcaagagtggtggagggactggccctgtgaaacccggcaaccgctgtctatgacagaatggtgctaaatccttaagagcatgttcgtgctcttgaagataaggaggagattgaatatatcaagctcttccttatcgggaagagcttttttatgtctataaagaaagagggatgaagcatgacacaatcaaccgatgtactgaagcaaacgcctggaagaaaaatcggaccgtacagagctgatcaggtgggcagtcttttaaggtctgagcccgtaaaaaaagcgcgcctccaaaaagcgaacggcgaaattagcgctgaacaattgcgcgaagtcgaaaacgaagagatcaagcgcattgtcgaaaagcaaaaagaaatcggtcttaaagccgtgacagacggggaattccgcaggtcatggtggcatttcgattttcttgaaggacttgacggcgtagaaggatatacagcggacaagggcattcaatttcataatgttgaaacgaagccgcgcggcatcaaagtaacaagcaaagtcgactttacaaaccatccgatgctggaagattataaatttcttcatgatattgcgggcacacatacgccgaaaatgacgattccgagcccgaatatgctgtttttcagaggaaagcttggagaaagcccgtatgaggatcttgatgaatttcatcacgatgtagctcaggcttacaaaaaagcgatccgcgcattttacgatgccggctgccgctatttgcagctggatgacacggcctggtccgtatttttctcagacaaaggacatgagcagatcaaagctttcggccgccagcctgatgaactgcgccagtctttcgccaacacgattaatgaagcagttgaagggcgcccggacgatttgacggtcaccatgcacatctgccgcggcaacttccagtcgacatgggtggcggaaggcggctacgatgcggctgctgaaacgattttcgacggactcaatttagacggacttttccttgaatttgatgacgagcgctccggcggcttcgaaccgcttcgctacgtccaacggaaagacttgcaaatcgtcctcggtttaattacatctaaattcggcgagcttgaaaacccggatgatattaagcggcgcattgaagaggcgtcccgatatgccgatctgaaccagctgtgcttgagcccgcagtgcggctttgcttcaacggaagagggcaacctgcttaccgaagaacagcagtgggaaaaactgcgccatgtcgtcgagatcgctgaagacgtatggaaataacacctcatatttgagacatgcctcctgacggcatgtctctttttttgcccctctatacaatttaaaattccttcttgatttgttcatagtttgatcatatttggcttctataatgctctttagtgaggtgatcgaacaatgattaagaaaaggaaaatcgatatattcctggtcttcattcttgtattatctgcagcattaaacttgtacggcatctggaatagtgacacagacaacgcctactatacggcggccgttgaaagtatgacccaaagctttcataacttcttttacgcatcatttgatccggcaggctttgtaacagttgataaaccgcctgtcgcactctggattcagacactttttgcacttgtattcggcgtgcacggctggagcgtcgttctccctgaagccattgcggaagtgatttccgtagcactcttgtactttattgtaaaacctacttttggcaaaacggcggccagaatttcagctcttattatggcgtgtacgccgattgccgttgcggtcagccatacaaacaacgtcgacagcattctcgtcctttgcttgatgattgcaacgtggctgttgtttaaagcagtccggaaaggaaaaatcggctggctgctcggcgcattctgtatgatcggtgtcggttttaacgtcaaaatgctgcaagcttacatggtattaccggcattcctgctgttttacatgattggagccaaaacgacgattcgcaaaaaagttgtgtctcttatcacagccgtgatcgttctggcaggtgtttccgtttcctgggcggttgtcgtcgacagccagcccgagatttcgcgcccttatatcggaagcagccagaccaactctgtccttgagctggcgtttggctataacggcatccagcgtctcacaggtcaaaacggtgcaggcgggggcggaacctcctcatctgatcatgatcaaaagaatcagcagcaaagcggcgatattgaaaacaactcagactcggcaaatggacaaatggctccgccgagcggaggcgaaatgccttcgggcggaccggatggccggcagggtgatgtccaaagcggcggcggaggtcccggtggcggcacaggcggcatgtttggcactggaaccccgggtcctctcagactattccaatctgagctttcaggacaggctagctggctgatcccgtttgtcctcttcggcatcatcggtttgctgatcgcgggtcttcgcagacaaagaaaattcaatgaaacaacgactgaaacaattttctggatgatgtggcttctgccggtcgctgcattcttcagcatcgcaggattcttccatcattactatctgattatgctggcagctccaatcgccgctttgtcaggtgcaggctggacggcgctcgttcgcctctatcaggaagaaagcggctggaaaaaacggctgctgccaatcggcattttgctgacaaccgcatttgaattgtatattttgagtccttatctcagcgaaatcggcttcatctggagcatattgatcggcgctttcggcattgtcacaagctgtcttctcatctttctcaagaaaggaaagtcattcagctactatgtatcacttgcagcgctgcttggcatgctgatcgggcctttctattggacaacggcgacgcttgctgacggtgtaaacggcatgattccacaggccggacctaaatccgcacaatcatttgccggcggtggcggaggaggtaagatgcagaataacgacggcagcggacctcccggatttggcagccaagacggccaaacagacagtaatcaaaacaacaataatggccctggcttcggtccaggttcaaacagccaaaacagcaacgattcttcagctgataccggttccggccaaaacagccaaaatcagaatgacgaaggcgcaagcggccgtcaacaaggcagaccaagcggcggcggcagccctggaagcggcgagtcggtcgatgaagaactgttgagctaccttgaaaagaacaacaccggtgaaaaatatttatttgcagtctcaagtgcaacttctgctcaatcttacatcatcaaaacgggcaaagctgtgatggcgatgggcggattctcaggaagcgacccgattttgacggttgaaaaacttgagaagctcgtcaaaaacggcgaagtcaagtacttcatgatcggcgacggccgaggccgggacaattcagaaatcaccaactggattaaagaaaacggcacagaaatttcaaaaagcgaatacagcagctcttcttctgatgattcacagtcaggcggacctggcggaaatcaaacgctttataaagtggagctggattgatgaaaggaaaggtgatgaatatgcagaaacaagtcacattttcaatcgtagtacctgtctacaacgaagcggaagtgcttcaaagcacctatgaccgattaaaaaccgtcatggactcgacaggcgatccctatgaactgatttttgtaaacgatggttcaagcgatgacagcattcacacgctgaagtcgcttgctcagtcagaccaggcagtaaaatgcatcaatttctcaagaaacttcggtcatcagatcgcgattacggccggcacagactatgctgccggcgaggcgatcgttgtgatcgacgccgatttgcaggatcctcctgaattgattttggaaatggcggaaaaatggcgccaaggctttgacgttgtatacgccgtccgcacaaagcgagaaggagaaacatttttcaaaaagcaaacggccgccatgttctaccggattttaagaaaacttacagacgttgatatcccggtggatacaggagacttccggctcatggaccggaaggtggtcaatgaaatgaacaagctgaaagaaaaaaacccgttcgtccgcggtcttgtcagctggctcgggttcaagcagacagccgtctattacgagcgccacgaacggcttgcaggggaaacgaagtacccgctgaaaaaaatgctgaagctctcgctcgacggcatcacttcattttcctttcagccgctgaaactggcaagctactcaggaatcgtgctgtcagcgatcggctttatatacgccttcatcgtcgtctgcatgaagctgtttacgacaagcaccattacaggatggtcgtcgatgatcattctgcaatgcttgttcagcggatttatcctgatcatcctcggggcaatcggcgaatacatcggccgcatttatgacgaagtgaaagacaggccgctttatatcattgacggaaaatacgggtttgaagaacagcggcgggcgcgagctccccagcgccatattatgtagaaagatccaaaaggagggattccgatgagcgtactagttgtcgggggagccggttatatcggttcccacgccgtttacacgttaattgagaaaaaagaaagagtcgttgttgtggattccctggcaacaggacacgcagaagccgttcactccgaagctgcgttttataaaggggacattcgcgaccggcattttctcaagcaagtatttgaaaacgaggacattgaagccgtcatgcatttcgcagcatctccgatttcctcgaaatccaaaaacgtgtttacttcctttaacgaaaacatcacaggaatggaaacactgcttgacgtgatgaaagaatacgatgtcggccggatcgttttcgcgtcaagcgcggccgtctacggcagtccagaagacctccctgtcacggaagaaaccgaacctgagcccgttcacgcgcacggcaaagtcaaatggatgatggagaaaatgctgatggaagcggaaaaagcgtacgggctgaaatatgtgatcctccgctccttcaatgcgtgcggcgctcacccatccgccatcatcggcgaagaccgggggagcgaaacacatctcatttcaaatgttctgcgaaccgctctcggacaccttccttttgttcacatagatcaatctgaagacggaactggcgtccgcgattatgttcatgttcaagatttggcagaagcacacgtgctcgccatcaatcacttgcggaaaggcaaggatagccgaatctacaatctcagctatggcgaaagctactccgctgaacaaatcatccttgccgcccaatatgtcacaggcattcccctcatcgccgcaaagctgacagaaacggacatcgattcacaagcaacatttgccgcttcttcctccagagccagaaaagaattaggctggaccccacagcacaacagcctgatcgcgatcatccgcgacgcctggaactggcactctgcgaatccgaatggatatgcgtcggagaaggtgaagcaagggtgaaaatgaactgcacccctatcgttaggcagcgtctaactatggaggtgcgtttttttctccatcggctttgcggtagttggtgatcatcggcaggccattgaaatgtttttatttgagttccaaaaattacagaaggcttgtcccaattttgtggcctacctttgtcaaataagaaaaggactgcataaaaactcttcagtccctctatgattcaattcctaaatcaactaaataagccgttggctgttgtttgtttttttgtaaatcaataagtacattaacagaacctgctgtaccaattgtcttcccatgataagaaatatacaaaactacataatctttattaaaataatgaatattagctatcctcgcatcacccgcgtttaaatccatctcttttgcaatttgtttgaaatcaatcttaaattgagcttcatatttttcatttccttttagataattatccattgtttgtatctgttggataccatcaggcattacatttgtttctttttcttttgctccgttaatataaacatacttaccgtctttgctcagaatatcagtgtttttgattttcctaactttgtttttcttttcatcaaaaatgtatttatcaaataacttacgatatgctccatccttcgctacatttggaaatacggataagtattccttcagtttcccagactcaattgttgaatttaattcctcttctttaacaatccggtattttgaaagatcactttttaaaaaaagataatatatttgtctgtctccaaggtcaccatttttaaatttttcatatacgtccacttgtataagcatgctgtctttgctaacagctgctaacgccagatgtacttttttatccttggctgatggaaactctatttttttttctccgctttttgttttcacttttagaacattctttttatctaatgtcatttccggcagattatattcaagtttattgtggataagtttttctttagttaaaaattcagttgttttcaaatcatataattttgtcgcaggatatttattagccgaaagaaagggactgtaaaaatcgtctacttcttgatctgtatattgatagtaccgtagcccctttttatcactgcgcataatcgtatatgtactattttgataactaagagttgcgtctgtcgctaaatcaagttcatgtctcataaattctctaaatgctggactgtcttctttgggcaagccttttttatagatggcttcctgaacatcatctttgccgcagccggtggtggcgagcagtagaaacactattaaaaaaaatatacttataaaccctttctttttcatcgaccttctcctattctgcttcttttttgttgacctctcgaatcaagtcaacaaattcagagtcttcaatttcataaatatgtccaggattggttacaccggaacctcttacttcaatttctggctttttatcaatgagatcgcctaatatgtcaccgtgttgactttcgaccgaaacgatatcatcactgtttattttatgttttccgcttgcggtatagtaaggggaaaaacttacagtatcctctgttctgtatcccgccgcagcggtaatgtccatcttctgcagcttttgatacacctcaggattggcagatttcaaatgattaatatcttcagtcatcgcctcacagtccatatcagtgtaggcattactgtaatcttttccattatcattgtttttgttttcttcattaaaatctaaataatcacttgtattcatagtatctcttccagcagcattatctgcaagccagcgcgctctatttgccccggcagctaagagatttttatcatatggagttccgattgttgtgatgcttcgcacatggtcagggtaatccatcgcaaattgcagcgatcttcttcctccatagctgtgcccgaacatatcgatctttgtctcctcattcatcagccccatctcatttaacttttctgctaaatcgtcacttgttgcttgccgatgctcattgggttcatttgtgtcataaacaatatggagacggccgttagtgtcgaagtattcaagaccttttatttcttcataagtttcctttatatacatttttccatatttgtcaatataatagtattcataaacatattcgtttttttcatttgttgtaatacgaacgataaggtcgccctttttcgcagcatcctttacacttttatagaaaccattcccactatcctcaatcccatgcacataaacagaaacattcttataatccgaaaaatcgccttttacatggttaactgaattatacaagattgagaggtctgtcaaagcttcgcgcatcggggcgcggtgggtgcgggcgacattgctgaaatcttgttccacctgatcaatgccattttttagattctcgtattggctaattaaaagaacagcgtcactcgaaatattgttgcgttttcttaagtcttccggtgtggggtcttccatagactcaaatttgcgcctggcattctcctggcactcttttaaatcctttatccaatcgttgatttccgatttgatatccgccacattaaaatccattacgttttttgatacaaaattcggaagttctttattttctatcgaaacccatattttattaaaagtatcaagcagacggctggattgggctaaccgcagcagctggttcgcttttctttcatggtttttgagaatgttcgtgatttctttttctctattatgataagccataactctgtttcccttccatcatttcactctttgcagttgctgtgagattatgttatcgacgcgctttaattccttaacgatgtttttagcatttgccgaaagttctttgactctttttttaagctccgtcatgattgagttgatgtgcgactttgcatcagaccagacgtcatcgaatttttcccacggaaattctgtttcatacatcatttctctgagcattgtgtcaaaatggtgcaaaacttcatcaagtgtagatagatttgattcaaactttccggttgcctggtgtaacgattcaccgtttactttaatttcactttgaactctttcagccgaaaacgtatggtttctttctgatctcgactgcggctgaacattggccggcttgtcggattcgtccgtcagttcgaccgcttttgcaaaacagcgtacactgtctgcaaaatataataaacagctgcttgctttactgaaaaagttgatgttgtcgctcatttttttctgcagcgctgctgcggcttttccgctgtgccggtctaattcttcacgaaaaaacaccatgttctcaaatacatggataaaggcgttttccagctgactaatggttcccgctgccttgtgtgaaagttctttgttgaagcgaaaatgtcccatcgtcattgctccttattttctttttttcctgcttcagcttctgttagcagttcatcaagctgcaattctttttgatcaacatacccgtaatggtataccacttctatgtcctgtttattaaatagaacaagctgctcttttggatcggtaaatccatttggatagtcgacagctgcataatctctgatcacgtgatttgtttcagaaaacatttgccggccgatgacgagcagacgccttgaatcattatataagccgacaacactgccgacaggaagatagttcttttttaacagcataattcattatccctctttttctctgaaattggacatacatacaagttgtaaaaacataggaaaatcatagcaaaaaggtatcatttcattcaacgaactaaagcaccgcgaaattttgcctatttaaattcagagacttttgatttaatgttcgctcattacgcaaggtttgtcggtgtcattagtatgttacagtgaggccttagcactgaaacgattcatcatacttacgggaacttccagataaagtttctcaaaaaaaccgccataataggcggcatcatgaagatataaagcgcgatcgcttacgattctcctctaataaaaagaattttatcactttcaatttttcgtctgttgttctgtgcatcgtcacttcaatcatttttcccgcttgaaaatccggctttcaaagactaagcaacaagcgccctgaccctctcctagacatgacttcatttgaaatgtgaaaatatatttttagcttgaattttacacaatctcgagataaaatacagtcaaaataatagaagcccacttcttgtatataatcagtaatagggtctgattgtttctacctggcaaccgtaaatcgccagactacaaggaagtttgaatagatttgatcatgtaaaaagtgtattgcgcaaacaatatatctatttttcatttgctcttatttttcatgctttctttatcggaacccatgaaaaataagagcttttttattttcaaaaaacattcgggagttggcatcatgtattttctcattaatattttaggcattttcattgtcatgtctgtaatttatttttgttccccgcgaaagaaaagcgtaaaatggaggccgattctctcccttttcatcgttgagcttttggtgacgtggtttatgcttgggacaaaaatcggcggatgggccatcaacctgatcgcctctttcttttcgtggctgatcgcttgtgcaagcgacggcatcgcttttgcctttccgtccgtgatgggcaatgaaaccgttgactttttcttcagcgccttgctgccgattatttttgttgtgacattttttgatatactggcttatttcggaattttaacatggatgattgataagatcggctgggtaatttcgaaagtctcacgccttcctaaattagaaagtttcttttcgattcaaatgatgtttctgggcaatactgaagcgctcgccgtcattcgcgggcaattggctgtattaaaggataaccgcctgctgacgttcggcattatgagcatgagcagcatcagcggatcgattctcggttcttatttaacgatggttcctgcgacatacgtatttaccgccatcccgctaaactgcttaaatgcgttgatcttggccagcattttaaacccggtggaagtcactaaggatgaagacattatttacgtaccgccaaaagaagagaaaaaggactttttctcaacgatttcaaacagcatgatggtcggaatgaatatggtcatcgtcattctcgccatggtcatcggatatgtcgctttaacctcatgtttgaacggtattttgggcttgatcgtagacggtttgacgattcaaaagatcttttcttatatcttcagtccgttcgcattcctgcttggactggcgccgggcgacgcgatgtatgttgcacagctgatgggcatgaaactcgccacaaacgaattcgtcgcgatgatggatttaaaaacgcagctagacgcgatttcaccccatacagccgccgtggccacaacatttttgacgtcgtttgccaacttcagtacgatcgggatgatctatggaacgtacaattccttatttaacggagaaaaatcggcgattatcggaagaaatgtgtggaagctcctcgtcagcggaatagcagtgtcgctgttgagcgcggggattgtcgggctgtttgtttggtagaaaaatagattaaaagggcaggcatctagcctgcctgctttattattaaacttgcctatcccaatggcggtgcccgctgatcgcttcgaccagctttttgccgaagtcgtctttgttcttatcaccacgagaggtgataatgcccggctgtgaagccgcgtgggccccggcggcggacagcaggagatcgaccccttcgcctgcggctccgaccgctttataatgtccgaatgcttcattgacaaaatccgatgcggctttatgcaatttcaggcgttctatgctttcttggccgcccggaatataaacggcatcgtacagcacagaatcgaccgtctgcaaagtgtttccgacttcaatttctgtgccgccggccccttcgattactccgagtgccgagctgacgatgtccggaatgatgccggcttttttgaattctttcaacacacggctcaagtcttcatcatcaaaaccttgttctgctaaaatggcgactgtccttgtctgcggcagtttcaccgtattctcctggctgagcgcaggggatttgaacgtcacgttggagccttcgtctttttcagggggctctacgcctacacccgcagcgatttgcttggcaagctccccgtcaacccggttaaacatatgaacgacttggcggcggacgtccttgcttttgacctttccgacttcaaagcggaacgccgaaatgatatgttctttttcaacgggggacatgctgttccaaaacagcttcgcttgcgaatagtggtcgttaaagctttcgctgcgctggcggatttttttgccctcgactttttcctcgtagtgcacatatccgccttcttcttctgaagcaggcgccggatcgttgttttgaagcgaatttttatgataagcgacaggccctttgttaatcgtcatcctgtgatagccgtcatactggttgttatggaacggacagaccgggcggttgattggaatttcgtgaaagttcggacctcccaatcggatcagctgtgtgtccgtataagaaaagagccggccttgcaatagcggatcgtttgtgaaatcgatccccggcacaacatggcccggatggaaagcggcctgttcggtttccgcaaaaacgttatcctggtttcgattcagcgtcattttgccgatgattttgacagggacgatttcttccggccaaagctttgtcgggtcaaggatatcgaagtcaaacttgaactcgtcttcttcgtcaatcatttgcacgccgagctcatactccacttcatcgcctctttcgatcgcttcccacagatcgcggcggtgatagtcgggatcttttccggcgattgtctgcgcttcgtcccagacgagcgaatggacgccgaggacgggcttccagtgaaatttaacaaagtgcgccttgccttcttcgtttacaaacctgaacgtatgaacgccgaagccttccatcatcctgtagcttcgcggaatcgccctgtcagacattgctcacatgatcatgtgggccgtttcttcattgttggcgacaaagtcccaaaacgtatcgtgcgccgtagaagcctgcggcatttcgttgttcggttccggtttaaaggcgtgcaccaggtcagggaacttgatggcatcctgaatgaagaaaacggggatgttgttgccgacaagatcatagttcccttcttctgtataaaactttgtcgcaaatcctctgacatcgcgtacagtgtcacccgagcccctggaaccggcgacagtcgagaacctgacaaacaccggtgttttcactgacggatcttgaagaaactttgctttcgtatactccgtcatcggctcgtaaacctgaaaatagccatgcgcgccaaaccccctcgcatgaacgactcgctccggaatccgttcatggtcaaaatgggtcattttttcacggaaatgaaagtcctccatcagcgtcggaccgcgcacgcctgcttttaaggagtgctcgtcttcagatacgcgcaaaccttggttcgtcgtcatttttttgcccctgttgtcagaccggtactgttcgagttgttgatccttgctgtgcccattgactttgcggcggccatcattgttattcacttgtcatccctcctcatttttattccctatgtagctgatctggaatgctattttatgatttaccctttctgtcggcgggttaaactctttttatagattcaaagttttgtgtgacaactacacaaaaaaacgaattaaaccgattttaagggcacacatatttcgcaatacggactgttcaccatatcaccaacgtatttttccatgattggcctattgtccaattggtatttgttttgcagagatgagaaaatatctgaatatgctttttgaatagcttctgctgtatgttcaacctcgtaaataaggtattgtccgccggaaatttcgccttcaaaaacggtatcatcgacttgataatcatgcggtatcacaatacaagcatcaaatcgacaatgatcaggaggcgttgttttcgggttatcttgtggaatcgcaaacagaatggcggattcaagaagatcttttttcttagcccatttttttaatctttccattacctcaatgttggcggggccgtatggaccaactcggcgcatatatgcaatgcggtagtttggaagtgtttcgattttgaatttcataggttctttcttcctttccatcattgttgttcgttccgtttcgaatgtaacacgctttaaagatatttacattcatatttttaaaattttctgcaaattttaaaatgagcattttcaaaccaaaaaagaggatattcagagatcatctgaacatcctctttctttgtttaatcgagtgtttcgccgtttgtagcaatcaggtttttataccagtaaaagctttttttgcgaatgcggcgcaagtctttcaaatcaaattcatcgcggttcacataaataaatccgtagcgttttgaacagccttgatgggtcgaaattaagtcgatggcagaccatggggagtagccgaaaacatcgactccatccgtgattgccagctgaatttgcttgatatgctcttttaaataatcgatgcggtaatcgtcatttacgacatctccgtcttcaagctgatcaaacgcgccgaggccgttctcagtgacgatcagcggcagctggtagcggtcgtaaatttcgcgcagcgtcgaacggaaaccgacagggtcgatctcccagccaaatgcgtttttctttaggtgcggattgctgcttcccctatatacgccttcttctcccgtctgcaaatgctggtctccgcctcgagcagccgtgtcgctgccatcacccctgcttgcttcagccgtttgcgatgtatagtagttaaacgcgataaaatccggcttggccgaccgcagaatgtccatatccccttcagcgatgaccggtgtgcagcctttttctttcatatatgcccacgctgttgtattgtaccgtccgaatacggccatatccaagtaaagccagtttcggatcgcattatagttaaaagccgccagcacgtcctccggtttcgaagaagcgggatagatgagcgcaatattcggcgcaggaccgatttttgcttccggcagcatctcatggcaaagcttgatcgctttcgcctgtgcgacgagcatgtgatggttttgctgataaagctcttttttcggattttccaagttcggatcgagtgtaccgagtgcagatccgtggaggatcatcatattttgctcattgatggtcagccagtatttgacgcggtcaccgtagctttcaaaaaggaccttcgcatacttttcaaaagcatcaatcgtggccctgtccgaccagccgccttttttctgcaaagcattcggcagatcaaagtggtacatcgtaacaattggttcgattccatactttagaagttcatcgatcaaacggctgtaaaattcgattcccttcggattaatatcaccgtccccgtccggaatgatgcgcgtccaggcaatcgaaaaacggtacgctttgaagcccatttccgcaaataaagcgatatcttctttatagcgctggtaatggtcgcttgcgactttaaaatcggttgtcccttccgggtagctttcgcgcgcatcgatgacagaaggcccttttccatcttcgtcccaagcgccttccacttgataagcggaagtagacgcgccccacaaaaaatctttcggaaattgagctaatgttttatatttcatgattattttcctcccttggtgatgaaattaaagtgatgatccgttcttcagttttcacctttttttgatccgttggaatgacatccgtgtattgaccggaatttgtaacgatgatcggcgttttcacgtcaaacccttcttctttcaaagcgtccagatcgaattctgcgagtatatcaccccgtttcacattttgcccctgcacggctttaggattgaagtgctttccttcgagcctgactgtgtccattccaatatgaatcaaaatctcggctccgctttcggtcgttatgccgtatgcgtgacccgtcggaaatgccgttgtcacgatgccgtccgcaggggcggtgacaacgccttttgacggaaccaccgcgattccctctccaagcgcccccgatgcgaacactttatctgatacttctgttaacggcaggacttctccttgcaaagggctgtaaatcggttcaccggcgcttttttcaacaggctcctcttttgtcacctccacagggtcgtcaaagccgacaatgtaagtgagcaaaatcgataaaacaaatgaaactgaaatgccgatgatgaagccgagaaagcccggtccgtaaaaaatcggaatcgtcaacaagcccggagcgccggaagcgagggcgacgctgccggagtatccgataatggctccgcctgccgccgcgctgatgacaccgcatacaaacggctttttcagcctgagcgtcaccccgtagacggccggctctgtaatcccgaatatcccggtaacggcagctgatcctgccaatgctttcagcttcttgtttttcgtcttcagcatgacgccaaatgcggctcctgtttgggcaaacacggcggctgccgtcgccggcttaatgtagtccttgccgtggacggcaatgttgttcaaaatgacagggacgatcccccagtgaatcccgaagatgacaaggatttgccataaggccgcaataatcgctcctgccagaatcgggctgaaatcaaaaacggacagaatcgccgccgcgatcccgtttcctgtgtaaacgccgagcggtccgaatacgatcaaagttaacggcaccatcaccgtcaggcataataaaggggtgataaagttcttcacgctttcatgaataaagcgcatacataatctttcaagatagctcatcacaaataccgcaaggataatcgggataacggtcgacgtataattcatcaagacgaccggaatgccgaaaaactccgtatgggcgccgctgtttttcagttcgagtatcgtcggatagatcagcgctccggcaatcgtcagcgctatgaacgggttcgctccgaattttttggcggccgtaacggcgagcagcaaaggcaggaaataaaacaggctgtcggctgccgcgtatagaatcgtatatgtcgtctcttccggcgagagccagccggcgtttgtgcaaatcaaaagcaggccttttaaaatccccgctcccgccatgacgccgagcagcggagtgaaaatgctggatacgacatctactaatctaccggcgaggcttcctttctctttttgactgtgatcggccgcagaactttccaacagttgagagatccggccgatttctttatatacttcaggaacgttattgccgataacgacttgaaattgcccgccgctctccaccacggttaccacgccatccgtattttcaagcgcttctctgtctgctttggaacggtctttcagtttgaagcggagccttgtcgcgcaatggactagcgatacaacgttcttctccccgccgacgcgcgccagaatttcttttgccattgattgaacattcatcgttgatcatctcctgtctctcgtaaagccctatcaagctgttaaaaaataaaaaacctaaactaaagcctgtacaaagaaggcttagtttaggttttgcctgccgaacagtaacaatcccacttaagacaatatgaaaataaaaaaacctaaatcactatgaaaaacaagggcataagagtcccccttcacagtcatttaggttttgcctgcatcatcagtaacaatcctaacaacctgtataagttgatgtaagtaaaaagtagcatacatttatccaattgtcaacgctttcatttgatatcatcctctatttttgatgaacgactcgctcgatatgaatcgtcaaatacagaagctcttcgtttgtcagctgatgaccgtattctttttcgatatactgcctgattttatttgtacaaacataagcgtcccggtacttatttttgacggtttcaaataaaaagtcgtcccggctttccatataggttccgctgaacagccgctgggcgaaaaatttcaaatgggtaatgaagcggtaatagtgaagcgattcttcgtcaaattcgatatgaaagtgatacttgacgatgcttaaaatctcctgcatgactttcgtaatattgacgatgttcggcatttcttcattcagctcggcgtttacgatatggagcgcgataaaggcggcttcatcctccggaagagctgtccccgtcttcttttcaatgatggccagcgcctctttgccgatggcgaactcatctttatacagccgtttcgtctcccaaagcagggcatttttaatatccagtccctttttatgccgttcgacggcgaaatgaatatggtcggtcagcgagacataaatgctgtcattcagctttttgccgagctttaatttcgcataggagataatttcttcagacatttccataaattcaattggaatttcgtccaacagcgtcttaaacctttctgatacatctttattatcaagcctgaaaatcttctcgattctcgattcatccaccgcttcgccaggctttttttgaaaagcgattcccctgcccatgaccactaattcctgaccctgttcatttaaaacactgatcacattgttgttgatcactttggcaattttcacatcgcgccactcccatcttttaaggggatttttttatacttcttttttcaaatggtacacattgattgtacaacctttttggcctaggtcaatatatttcagtcaacgtccgaaatgtttgcattttacagaatgcccgcctgtacccgggtttataaaaaaagagccgcaaggcggccctgtaaaaaaccttcttaaaaagtgagcaaaatccccgctgcgactgatgccagacccgcaaaatatacgaagtcttttccggaaagccccgctgtttgatagtaggtgcggtcttttgtaccggtaaaccctctcgcttccatggcaacggcgattctttccgatttgcggatgccttgcgaaaacaacggcagcgcatagcgaataaacgccttccagctgtttttttgcttatagcccctgattttgtgcgccgccttcatttgcgaaagctccgactgaaaaagcgggacaaaacggaagccggccagcaagccataagcccatttaggcgacaatctgcattgatgaatcaggctcataataaactgcgtcaaatcggttgttgacgtaaacaagagaccgtatgtgacaaagccgagcatccgcagcgcgattgtcagcccattgccgacgctttcctcggtaacgcggaaccaggcccattcccaaatcgtttcctcgcctttcccaaaagcggccatcatccaaaatacgagaataaaaaaaataagataaggcagcagccgtttacttaaataagacaaagtccatcccccgaaaaaaatcccgatgacaaccgcaaacagccaaatgaaaaaagtcggtttcggatttgaaacaaacatgagaatgcacatgaccaggaggtgggaaaagagcttggcgctcgggttcaatgccgaaagaagtgaaccattgcttttcatacgggaaccctctcctttctttcgtgcatgaaccggtagtgaagcggcggtatcaatgaaaagcggcggaccaggtcttggtcagagaacaattgatacggcgttccttgatatgccgctttcccttgatgaaatacgatgacccggtcggagtgctcgtctacgatgtccatgtcatgcgtcaccatcacaatcgtcgttccccgttcctgccgctcctttaagcgcttgatcaattcttttgccgtcttttcgtcctgaccgaatgtcggctcgtcaagcagcagcaaatcctggtcaaacaaaagcatcgtcgcaacgcttaaacgccgtttctgcccaaggcttaatgtaaagggatgcgctttttgatgaccatcaagtccgaattcctgcagcaattcagccgttttcctttcgacctgctcctccggccagctccgctgtctcgctccgaacgcgatctcgtcaaacaccgtgtcccgaataaattgaagctcggggttttgaaagacaaagccggccttctcgtaaagcgtacgatcggaccatttcttcagctcccggccctccagataaatgcgcccttttttgaccgcttcaagcctgatcagactttttaaaaacgtactctttccgctgccgttcccgccgatgacggaaatccattcccctcttggaatctccaggttgatgccgtcggcaacgatctttttccgatagccgatcgccgcgtcctctgtgcggatcaatatgtccctgtctgctgacggcctgtttttcgcttcctcctctttcattttcaatgtagaagagagcttgacggcgagcggatgatcatcttgtgtggtaacatcttcccatactgcggggtacagtttgggctgccagatgcctgccgctttcatttccggctgaaaatgtttgacgatttcttccggctttccatcagcgatgatctgtcccttttcattgaaaaggatgactcggtccatccactcgatacagccgtccagcacgtgttcgacgaacaccatcgtctgtccgctttttcgggaaacgtcgcggagcaaggcaaagatgtcttgccggctggccgggtccagctgcgccgtcggctcatcaaaaaacagcacttcaggctccaaagcgagcaggcacgctaatgccagcctctgcttcataccgcctgacaaggtttcgatcggcgttttcttatctatctttaaaccgaccagctccatcagctccgagatgatgcggtccatatcttttggcggaacggatcgattttcaaggctaaacgcgatttcctcatcaacatgaagcatgcaaaactgcgaatccggatcctgaaacataacgccggcgctctttctgcggttgacctcgcctgtgacttcagcttcgatatgttcaggaatgatgccggaaagcacggacaacagcgtcgattttccgcttccgctcggcccgagtatcagcactttttctccctgctcaatcgacagcgagacccggtccaagactgtttcaggacgatgataaaaacggacggaaaggttactgcatccgagaaatgaacgcatcggcatcatccttcttccggtgttctttcatgatctcatactggttcaggactcccgttttcgcaagcgcttcgacaacggcttttgccagccagccgccgagtacaatgccgctgatgatttggatgataagcgtcaatatcagcgtttgcgtcgtatagtaggcaaaaccgtttgccatcaggctgtatgtcgcgctccccaccgcggctagcgcaccggaaagcataagggtaaacaagttatagcgcttatagcgaaagatcgcaaacgcgatttccgcaccggctccctggaacacaccgattaataatgctgaaagcccaaaatggcttccggtcagcagttcgaccgccgcagctgccgtctcggcaatcagcgccgcacccggtttacggatgatataagcgacaatcgggctggcgatcacccatatgccgaacataaagttcgctccgacgggcccgacgatagctgaaacagggatccacaaggtagaccaccctaaataaatgacgccgcatgccacagacaagatgactgtcatgacgacttctttcatgttccaattcatcgtctcaccgcccccatttccacaggccaatcttcaaccgtataagccatctcccaaaagccgtattcaagctgacagctttgcaaaaagagctccttcattttttctttttcagccttgcccgctgtttcggcccattcatccaggcgggcgcaaaactttgtcgtgattgaatccgttctgtttccgtaaaaacagatccagtcataaaatggatgcgatggatcaggctgaacgtccttcatcagtttttttccgatctcccaatatgtccatggacaaggcagcaagacggctaatatctctcccagcgtaccttcgtgcgccgccgtcagcatatggcggacataatgatgggcggaaggcgcaagcggatagccctgcagagtttcgtactccaccccagcggcccggcacaggtttttgtgcgggtgcacttcgctgtctagcacaaatgaaatctgctcatgaaacatttccatatcttttcgattttgacacttggaaatcgcaattccgtagatttgaataaaggcattcaaatactcgtaatcttgctttacataatgaataagctgctccttttccagcctcccggacgccagccccagtacaaacggatgctcaaaaatggcttcaaaaatagggtctgcctcgcggcgaagttctgcggaaaaactcatgtagatagcctccttagcaatcggttttataggaaggcacaggggggcaagcggctttatacgcaaaaaagccgccccaaaatggagcggccttagtatgatgaaatcattaagacaccggctccacttccctacgctagtatgaactagatcaggttcaaagggtccaagatcgcttcttgtctcagccggcttacggctcccctagtggacttcctattacattaacttttactctacacatcaatggttatgatgtcaacctgagtttttcagttttattcttgtatagaaccgccgggtttcatacagaaagtcggcaatcggaaatatttgtagaaaaatataaattttctgaaaccttttccgggcttgttcgtcttatatagtgaagacaaaaaatttggaggggatatttatgatgatgtttatcttgattttgacaatggccgtgtatttgttctattctttcagcaaagacaaccggccggccaaaacaaacaacaggaatcatcagacactgactgttattagggaaaactcttttaccgccccttccaatgatgtcaattgctaacttgatagacaacaagcaagccgcccaatgacgggcggctttttcacgtttttatgattgaaactgttccgcttcagtcgatcccttcagtgcagtggttgatgaagtcccgcctgtcacaacctgggcgacttcatcaaagtagctcgttccgacttcgcgctgatgccttgtcgccgtatagccgtggacttcgctggcaaactcggcctgctgcagatcagagtacgccgccattccgcggtgcttatattggcgggccaattcaaacatgccgtgatttaaggcgtggaagcccgccagtgtgacaaattgaaatttatagcccatttcactgagctgtttctggaagttcaagatcgtgttgtcatccagtttggccttccagttgaacgaaggggaacagttgtaggcgagcagtttgcccgggaatttttcatggatcgcctgtgcaaaccggcgggcttcttcaatattcggctcagacgtttcacaccagatcaaatcggcatacggcgcatacgccaagcctctggcaatcgcctgatcaaggccaggctttgttttgaagaacccttccgctgttcgctctcccgtcaaaaacggtgcatcatatgaatcgacgtcgcttgtgatcaggtctgccgcattcgcgtccgtgcgggcaataagaatggtcgggactcccatcacgtctgcggcgaggcgcgcggcaatcaaattacgtaccgctgtttgcgtcggaagcagcacttttccgcccaaatgcccgcactttttctcagacgacagctggtcttcaaagtgaactcccgcggcgccggcttcaatcatacttttcatcagctcgaacacattcagctgcccgccgaagcccgcttcagcgtcggccacaatcggagcaaaccaatcgatgtcttcctttccttccatatggtggatttgatcggcgcgctgcagcgtgcggttgatttttttgacgacttccgggacgctgtttgccggataaaggctttggtcaggatacatgctccctgacatatttgcatcggcagccacctgccagccgcttaaataaatcgctttcaatccggcctttacttgctgcatggcttggtttccggtcaaagcgcccagcgccgggacgaaatcctctgtatggagaagcttccacagcttttcggcgccgcgccttgcaatcgtgtattcaatctcgagcgtgcccctcagccgaatgacgtctgccgcctcatacggccttgtgatccctttccagcgttcatcatgctcccagctttctgcgagttgtttttctttcagcatcgcacattcccccattatatattttcataagccggtatcgttagaaactccgcgaattcatcatccaaaatcagctgttcaaataactgtccggcctcttcaaaccggccgctccgaaaatgttccacgcctgcttcatcgatgattttctgcatttctttctctttcatcatcttgaccatttccgcggtgactttccggccatcgtcaagaactcctttcggatggcgaatccattgccacagctgggctctggaaatctccgccgttgcagcgtcctccattaagtggtcgatcggagcggcgcctctgcccgacagccatgaagctaaatagcggatgccggcgctgatattggtacggacgcctgcttctgtaattctgcctttcggtacttccagcaagtctttttcctcgacctttacgtctttccgctttctatgaatctggttcgccgacggcatatgctgattgaatacatcgagcgccgtttgaatcatgccgggatgcgcgatccatgttccgtcatggccgtcttttacttcacgttccttatcttcgcggattttggcaaatgcggcttcattgatctcaggtttgtctttagcgggaatttgcgccgccattcccccaatcgcatggacgttgcgtttatgacacgtttgaatcgccaagagggagtaggctctcatgttgggaactgtcatcgtcacggctgagcgatctggaagaatgacttcatccctgttcctgaatttcttaataaagctgaaaatataatcccacctgccgcagttaagcccggctgaatgttccttcaattcgtagaggatttcatccatttcaaaggccgccaggatcgtttcaacgagaaccgtcgctttaatcgtgccctgcggaatgcgcaagtcgttttgcgcataaacaaatacgtcgttccacagccttgcttccaggtggttttcgatttttggaaggtagaaataagggccgcttccttttttgatcagctcttttgcgttatggaaaaaataaagaccaaaatcgaacaggcttgctgacacgggcctgccgccgatcagcacatgcttttcttccaagtgccatcccctcggcctgaccatgataacggcggggttctctttcagctcatagcgtttgccctgttcattcgtaaaagaaatcgtcccgcggaccgcatcccgcaaattaacctggccttcaatgcagtttttccacgtcggcgagttcgcatcttcaaagtcggccataaagactttcgctcctgaatttaaagcgttgatgaccatttttctgtcgaccgggccagtgatttcaaccctgcggtcctccaaatcccgggggagcggcgcgactgtccagtccgcctcgcggatgtgcttcgtttccgccaaaaaacaagggttcttcccttgatcaatttcagcctgcctgatcgtccgcaaatgcagcaattcccgtcttcttcccccgaaatggcgttcaagacgtccgataaactccatcgcttcttttgtcaaaatctcttcataatgcggatttatcgatccggttatatgaattctcttctcctctgttttcatgtctccctacccctttacatgctttgttataaaacagtttgcctactcgccttttttggcaagacagcgctcgcattccatgaagtaagattcagcctgctcctccatcttttcgccgcattcagggcacgtttttttcggaagcgttctgaaaaattccatcggacttttcaagctcatttgtataacctcctttttatagaacagttttatgttttatatttctgttgtagtacagtatacagcgcaaaaatgaaaatgtacacacctttttccaaaaaatatttatttttttccattcaaacaaaaatagattgttctctttttattcatagcttgttcatatttttcttctagaatagggaacataaagaggtgaaagtgatgatgaaaataaaaaacaaacaacttgatgtcattctggttctaattttgttggcagctcttattctgaatacatataacatttggctggacgatgccgccaaccagtattacttggcagcagtcaaaagcatgacgcaaagcttccacaatttcttcttcgcgtcattcgactcttccggattcgtatcagtagataaaccgcctgtcgttttatggattcagactatatttgcgaaaatcttcggcgtgcatacgtggagtgtgattttgccgcaggcgcttgcaggggcgggttccatctatctgctttacgcactgataaagccgaaattcggaaaaggcgccgcccgcatttcagcgctggtgatggcgctgacgccgatcgcggtcgccgtaagccgaacgaataatatcgacagcatgctcgtcttcacgctcctacttggtacatggtgcctgatgaaggcggtcaaacaaggcaggctgatctggcttctcgctgcattcggtctcatcggcctcggattcaatatgaagatgtttcaggcattcatggtgcttcccgcgttcttgctgttttatctcattgcggcccatgcgaattggaagaaaaaaatcgtttcagcggttttatcgcttattgtcctcaccggcatttcgctttcttgggcgcttgcggtcgactatacatcagccgacagccgcccgtatgtcggaagcagccaaaccaactctgtgcttgaactggctttcggctacaacggcactgagcggcttctcggccagacgacgggcaacgcccgcggcgatatgaacggctttggaggagacatgcagcagccgaacggcaatgcgcaagctcagaacggaaaccgttcgtccggcggctccaatggacaaaacggcgcgatgcagccgccgggtgcgggcggttcggcagacggcagttctcaaggggcaaacggcggcagccagcagccagccggaggcggaccgggcggaggcaacggcggtcccggaggcaatggcggcccaggcggaggtcaaggcggcggacaaagcatgaacatgttcggcaccggtgacgcaggaccgctgaggctcttccaatcggctttatcgggccaaatcagctggatgctcccatttgcattattaggactgctcggcacgatcatcacctggtttcgcggccgccgcgaaaaagcaggcgaaatgaaagaaacgatcttttggtctgcatggctcgttcctgtcgccgggttcttcagcatcgccggattcttccaccactactacttgattatgatggcgccgccgatcgccgctctgtcaggaatcggatggtacgcgatgtacggcctttacaacaatcataaagactgggcaagctatctgctgccggcagccgttctcacgacagcagcattccaagtgtacattttaagcgcttatacaaaccaaatcggcagcgcttggatgtatgtcatgggaatcctggggctgggtgtcaccatcgccttactaatgctgaagcgacgccatccattcggaaagcagctcaccatcatcagcttgtgcgtgcttcttttgacaccggtctattggtcggcaacaccgatcctttacggagggaacagcgttcttcctgaatcagggcctcagctgcaaagctccaacggaggcggaatgttcagctcggacgtggacacaggactgctcacatacctccgggaaaataataccggcgaagagtaccttttcgcgacattgacaacggtaaccgcagccacgtatatcatcaatgccgacgaaaatgtcatggcgctcggaggcttcaacggcacagacccgatcctgtcggtcagtgaactgaaaaacctcatcaaaaaaggaagagtaaaatacttcctgattagtgaaaactcaggcaacagcgagctcgtctcctggatcaaagaaaacggaaccgaaatttcgtctgaccaatacagcagtacagacagcttcgcacagcagggtgcaagaggcggcccaggcggcggacagcggcaaacgctctacaaggttgagctgtagaaaatgaggaagcccatcggatgagtccgatgggcttttgattatgcttttctgaaaataaccggcggatgatgttcaatatggtaaaggagtttttctccatatagggtcatcgttttcattcaagcgacgcgagattccacatgactcagctacagcgccgacttgatcactttcttgccgtaaagaacggaaagcaagccgaaaatagagtacaggacggtgtacagcaccatcacgatgatcatcggcgtccacagctctgccccgaataggaaccagccggactggacggcgaagtagctgtgagacaggccgataactaatggaatgccgaagttgtagatttgtttgattcgtatccccttcaacagatcgttccgtgtgaaaccgagttttctcaaaatcgtgtaattcggtttctcatcttcgctttcgtccatttgtttaaaatataggatgcatcctgaagtgatcagaaacgttagtcctaaaaagcctacaataaacatggcaaggccgaaaagcgatttttgagctgtgcttgcatcaaggagcgataaatgctgatcgttttgattcactgttgcaaacagctcatttgcctgctgaagctgatcttcatgttttaaattgattccgtaaaaaaggctcggcttctgctgcagctttggatctttgtcttggctaagacgtttaaacagcgcatcatctacaacggcaacaggcaatccgccgctggtaaagttgaaggataaaagagactcttttttcaagcctaaatagtttaatgggattgtctcatgcctgctctttaccttaacggcaccggtctcttttaaagccataaatttctggagaaggtcggtatatcctgaaaaaatgacgtctccttttggcacgtccatcccggcaatctctgcatcgctgaccacggcgaggggcaatttccccgggtctccagccatattttcaggatctccatcgacaatttgttccagattaaaaaccgcttgaatgacatgaatttcttttttgctgtaggaaatgttattttcgtccaaaagttgttcaaaacgctttgcatccttttgatttgtcatggcgaaatcagccgccacgttttgttcggcggttttctctgcagaatagtacgaaatatagctcaaggataacaatccgatcgccagcgccgaaacggtggtaatgattgttaataatagggcgtttgatttcatccggaacatgatcgatgaaagggacagcacttcataaatattcaagtagcctcctttgcttttgcggatgatgttggagacaaagctgaccgatcctttatagaagaggtacgttccgatgatgacggttccgagaataaagctcatcgcataaaacagctcatctacggtcttgaattttccgctgaaaagctcagtggatacatagtatccggataaaataaacaagatgcccaataagccgatgatcatttggaaaacggatattctctttaccttatcctccgtagctgatgtcactttaaataaagataaaatgctctgctttttgataaacgcataattcatcaccattacgagaaggtagatgccgcagaatacaatgacggtttgcacaagcgcttcgacggaaaaattcaatttggcttcggcttgaacatctacaattttaaacaaaatcatgagcacgagctttgagatcgaaaacccggcaaacaccccaatgaccaaagagccgaaatacagcatgacattttccaagcttaagatgcggaagattttttgcttcctcatgccgattaattggaataaaccgatttctttgcttcgtcttttgataaatatcgtattggcatacaaaacaaacaccgctactactgccacaaggagaatggaagctgccttcaaagccgctgcgccttttatcgatgccttcacttcattgatcgctggatcatactggagcgtaacaaacgcaaaataaagcgctgcgctgaagatcaacgcaaacacataaaggtaatagttccgtatattttttttcaggttgcggatgatcagctgattaatgctcatgctgaaccccgcctaacacgccttgcgtcttcatgatgtcctggaagaacatctgcctgtcctgtccgcctttattcagctgcgtataaatttgtccgtctttaatgaaaaccactctgctgcagaagctcgcggcgacgggatcatgggtaaccataacgattgtggcccggcgcttttgatttaattggctcagcttgtttaacaagtctgatgcggatttcgaatcaagcgcaccggtcggttcgtcagcgaaaataatgctcggctcatgaataaacgccctggctgctgatgtgcgctgtttttgccccccggaaatttcattcggatatttatccttcagctcgaagatgcctaattctttcgcgacttcctcaaacttttgaccggcttctttttttgatattttcgtaatcgacagcggcagaaggatattttctttcactgtcagcgtatcgagcaaattgtattcttggaagataaatcctaaatgctgcttcctgaactcggcaagctgtttttccttcatattcgtcatctcagcttggttgatgttaatcgttccgccgctcacctggtcaatagaggacagaacattgagcaatgttgttttgcctgaaccagacgggcccataatactgacaaattcccccttttgaatctgaaggtcgattccctttaacacttcgtgtttattgtgcttatttccatagctttttcgtatttttttcgcttctaaaatcatcattttaaaatctcctttttactggatatttttattatagaaaggaaggcagccgttttccttcgattaagcgaacaaaaaagaaaagcgtgtgacatttttgtcacacgcccagcacacgggaaaattcattccgcattggaaaaatcagcgtaaaggttgtacccgttcccggtttagaatcaacctcgatatgaatcaggagcggctttgccgctttttttgccaagtacagccccattcccgtggcggcctgatcatgatgctccgttgttgatgtaaagcctttgtcaaacacgcgcggcatatcttttggatcgatgccccgtccaaagtcttgaacagcgagatgcactttgccatcctgctcatagcttttaatcaaaacatcggatgcttcgctgtatttcaccgcgtttgtcagcagctgcctaatgataaaagacagccacttcgcatcgctgagcacttcccccgcctccagctgtatatcaaacccgatcccttttggaatgcaccatgattgcaaatcttttatttctttaaagatcataggtttaagctctaggacttcaagggacaagtcattttcgataaatgacatccgcttttgatggagctggcggtcgagcagcaggtggatgcgcagccattcgtacgcaagcctcgcttttaaagattgatcctcaatcgtctccatgatcaaatgcatggcggtaagcggcgttttgacttcatgtatccaggccatgagctcatctttttcattctccaatgccaggcgatgctgtgccgcctcttgctttaactgtttcgtttgttcggctatgcttttttcaatcatcgtttcaaaaggggtttccgcctctcgaatgtttgtcacatcgagattgtggtcccattcttcaagacttttataaaacttcgtttccttccgaaagcggacaattacaaaaacgataaaaataaacgaggacaaataggtcatatacaaaatcgacgtaaaaggaatggatgcatcgacataagcgataaacagaaagaggatctgctgcaaaacaaatatggcgatccagcttcgcctctcggtcaaaaacgctttcagcattctcatcatccttcttctttcgccatatagccctggccgaccttcgtctcgatatattgccccaagttcaaggcatcgagtttttttcttaagcggtttacgttgactgtcagcgtgttatcgctgacaaagcgttcatcgttccataggcttctcatcaattcttccctgctgacaattttgtttttttggtcgatcaattgttttaaaatgaacatttcattccttgtcagttcgatcgcccccgccttattgctgacgcggttttgttcgggatcaacggttgcaccgcaccacgtttttttaagaatctcaggctctgtattatagtcgtagacgcgacggaaaatcgcctggatcttggcaatcagcacgtcaaaatgaaacggcttctgaatataatcatccgctccgaactgcatggacatgaccatatcagcaggatgatcgcgcgaagataaaaagagaatcggaacgttggaacgggagcggatctgccggcaccaatgaaacccgtcatatttaggcagctgaatatcgatgatgacgcagtctggcttaatcgccgcaaactcctgcatcacttcgctgaaatcgttgatgccgtatacctcgtatgaccacccggttaaccgctcttttatttcttgaaacagcgattcatcatcttctatcaacagcagtttaaacatttgcctcaccgcgcttttttctattttctaaatcaagtgtatagcaaattgttttcacgcgctacagagaaaaaaaagggccgtcctgtaaaggacagccattctgtatatcacaaactctcgccattcgtttcgattactttcttataccagtaaaagcttttctttctcgttcttgaaagcgtgccttttccttcattgtcacgatcgacgtaaatatagccgtagcgctttttcatttcggcggtggatgcgctgaccaggtcgatcgggccccatgatgtgtagccgattaagtcgacgccgtctgcaatggcttctcttacttcttttaaatgatcgcgcaaatagttgattctgtagtcatcctggatggagccgtcttcttcgacgacatcgacggcgccgagcccgttttcaacaatgaaaagcggcttttgatagcggtcgtacaatgtattcagcgtaatgcggatccctttaggatcgatctgccagccccattcggacgattcaaggtacggatttttgacgccgccgagcaggttgccttccgtttttgccaagtcttccggactcgtgcttgcgaccattgacatgtagtagctgaaaccgatatagtcgacggtgttttcctttaagatgtcttcatcaccttcagccatttcaatcgtaattccgttttccttaaagaagcgcttcatatagcccggataagccccgcgcgcctgtacatccgagaaaaacagcgttcttctctcattctccatcgcagcgagcacgtcttccggctttggcgtcatcgggtatgtcgtcgttgcggcgatcatgcagccgattttagcgtccggaatgatgtcgtgccccgctttaacggcaagagcgcttgcgacaaatagatgatgcgccgcttggtacatcgcatttaacttgttttcgccttcttcaaacacaaggcctccgcctgtaaacggcgcatgcagaaccatgttgatttcattgaatgtcatccagtattttactttttctttatagcgggtgaaaaccgttttcgcataatgctcatagcaatcgatcactttccggtttttccagccgccgtattttttaatcagaccgagcggcatttcgtagtgggaaatcgtcaccactggctcaatattgtattttaatagctcgtcaaagaggcgatcataaaattcgagtccctcttcattcggttcagtttcatcgccgttaggaaaaatccgcgtccaggcaatcgatgtccggaatgctttaaatcccatttcggcgaaaagagcgatatcttctttgtagcggtggtaaaaatcgatgccttcatgatacaggttcaatgactccatcgactcatcgaatggatacatgacgccgttcggcgacacatcggctgtcgagagtcctttcccgccgacattataggcgccttccacttggtttgcggcaaccgctccgccccataaaaaaccttcaggaaactttttcgtttgttcagtcatatcatttcacctcatccaaatttgtcaggctttcctctttctacgccagcgcgatcagcgcttcctcaatgtcaacgctttcatctgatttcaaaggtttgatcgactggtaccggtccgtatttgtgatgataaccggcgtgatcaactgatagcctgcatccttaatcgcatccatatcaaatgagacaagctcgtctcccggttttacagcgtcgcctttattgacatgcacggtaaagtgctcgccgttcaatttcaccgtgtcgattccgatatggataataatttccgccccattgtcgcttgtaatgccgagggcgtgcttcgtttgaaaaacggttgtgatcgtgcctgataccggcgacaccactttgccttcttcaggctcaatggcgacgccttttcccatgacttctccagaaaatgtcgcatcatccacttcactcaatgctttgacttcgcctttcagcgggctttgaatgatctctcccgcgcccgcttcagatggagcggctccttgttcagcggcttcatctgaaggaatgtcttcaaaccccaatacaaaagcaaacgccgttgcggcaaagaacgcgatgacgataccgatcattgcctgtataaaagtcgggccgataaacgtcgtaattcccggcaaaccgacgtttccgccaataatatatgctgctacgccggtgatgccgtaaaatgctcctccgacagcggcgccgagaagcgcggatacaaacggctttttcagcctcatgttgacaccgtacatcgccggctctgtaatccccatcaaagccgtgatgcttgtcgtcagcgacaatgatttgaatttcttatttctggatcgcaggaagacggcaaatgacgcgccagcctgccccatattcgccaagaacatcgcaggtatcaagtaatcgtagccgttttgcgtaatgttgttgaacataaccggaatgaaagcatagtgcattcctgtcatgacgatcagcgagaacgttcctgctaaaaggatcatcgtgattaaaccggcattttcaaataaaccgttcacaccgattgacagatagttccctgcaatcgcaccgagcggaccgaccgtaattaatgtgacaggcacgacaaccagcagcgtcagcgtcggtacaaaaatcatcttcaacgaagtcggggtgactttgtcaatccatttctcaacgtaagatgcaatccaaatcgcgagcaggatcggaatgacggtcgacgaataagtggcagcggttacaggcaatccgacaaaggaaatgcttttccctgaaccgagaagcgctgtcagatcgggatgcagaatcgccgctccgatcgccgccgcaacataaggattactgccgaattttctcgcggcactgaccgccagcaaaatcggcaggaagtaaaatgctccgtcgccgatggcggataaaatggtgtggacctggctagtttcgctcatccagccgaacgtgacggcgattgcaatgatccccttgatcatacccgctccggcgatcgccgggagaatcggcgtaaatacgcctgatatcacatcaaaaatggcggacagcacgtttttctttttgccagcttgctgctcgcccgctttttcatcgctgagcccgctgttggcaatgatcgctttatacaccttagggacatcatttccaatgatgatttgaaactgctggccgctgatgttggtgcccattacagccggaagactttccagtttcgcgcggtctgccttcgcattgtcataaagattgaaacgcagtcttgtcatgcagtgaatcacgctctgtacgttctcttcaccgcccacgagttgtaaaatgtccttcgatactttattataatccatatgagtacctcctctttgggggaatctgccggactgaaggtggccgccttcacccggctttttttattggcctgctgccgaaagaatcctcgaaatctcacatcacctccttattttgggtataaaaaaaacctaaattacgccggcttaaacgggacaatgccccagaaagctgtacgcaacttaggttttgcctgcaaaagcagtaacaatccttaagaaacttgctgatattagtttgtaactatactttagcacccgtttttgttcatgtcaacgctttcattacaaatgtctcataaaaaatagaatacatgaaaactaaaaactaagactttataccttcatttcttcgttttctagctttcgccgcctttttcataagcaatgcagggtttcgccttgctttccttcgcgccgccggctctacaactgcttctttcggttcctgctgcttatgaagaatgaatccggcagccataaacggaatccctgataagttcgtgaaaatgtttttaatgcccatcgctaaaataaaagatccccatggagaaaacggatcttttttgatttttacgtaagcggcgatttccaaggcaataaaaatgatcgactgtgctaatatcactatcagcaagcccaaaatgaacaagaggcccaaattaaataatgtgcctgagtagagcatcaatttcagcgcagctacgaaagttccagcctccatatatccgtccgtgacatttggattccaaacagcataagcgtcaagctgatgtttgaaatgaaaaaacaaaaataaaatgaacaaccaatatatgctatgtaaactgatgcctaataaaatgagtctgtctgctgctttgttttgcaatgttgctccttctttcgtttatgattgaagagaatgaaccgtctcttcctgctttggctgaaacgcctttaattcgttgctgtccaggtcttcctgtaataagcaaaccttttgaatctgcctgttttgataatggtgaaaatagtagctgcacgtctcgctgcacattaccgccgtatattgggtgtaatcgtcttcgccttgatcagtcataacaacccctttaggaatattcatattggagaggacatgaaacgcggcagagacgccttctgtttcatcggacacaggcttcatgtgctctttcaaaaatgcagccctgacaaagcgggatggcggcgtaaaatctcctggcaatccggacagcccggaaccttgaccaaaagccgacagcgtcaggcctcccatttttttcgcggcaaactgtcccggctgaagaccgataaagttgcgcaaattggtcaaatgccaagggaaatccggactgttcgtcagcacgccgaccggattatcatgaatttgaatgccgtctgccgtcggttcaacaacgacgcttgccccggagcggtccgttaatagccaatgcagcggcgtcaccgtactcagcaagctgacctctctctcaacaatgtttaaggaaacagccgcttttttcacatcctccaaatcgccgcattccgacagcacccatgtcacgaattcgtgcggcgcaagattgcggctttgctcttttgcttcgttttcatacacagcatagcccgggaaataaagcgccgcgcaagacaatcctttttcattcacaccatcggcaaacagagcattcttgagccttctgcccatcccgataaacgcataccggccggcatgctcgctgccgtccgcttcacttttccatttgtagcgacgcggatgcaacagcacctccccgttaagctcaaaatcaaaatccatcgtcctcgccaataaatgctcccggcccgcagtcgtcaacgtgatacttgtacacattgcgcttcatcctttttgtttgatattacacttcgtgaactatttttatgttatcgaattggaaaagattcgtcaaaatgaaaggggttatagaaaaaagccggggttttcatcccggcacataaattcattcaacaatttttcttttttctttaaatttagtataatcatcaactatactttttaaaagtcgatctatagctgtaaataccgtaaggattaagaacatgatatagtcattagcagaatcagcaacctctaaccctattacaattttaaaatcggaaaaactttttgaaatggttataatcaacaataacaggtacccaataatccttctaatattttgttcttccgtattgaaagttgaaaagtaaatccaacttgctaacgttagaggtagggtcaataaaaataaataaaaaatactataaggtatactgttaacttcggttaaaaaagttaaaattaaaattaaaaataaacaatgaaaatacagactcattcctgtttttccaaaaaacacttttaatctatcaaaaatataactatttctattcactttagagatagtattttcaattaaactctcgtattctttttgatttttttctaattcttttttaatatttaaattaaaatcccctataaagatagtacaaaaaagaaagaaagctagtaatccaaaaaataaaaaattgagaagagagttgcttggtgataaaacacaaaataaacttacggcaataaagataatcattaataaaataaaaaagtactcactagctctcaatgtctttttataaattaataaggtatttttttgttcaacaaactttctaaactttttaaagctctccttactcatgtatttgatagaaggaaatataaatttatcaagaacaaagttagatccaaactttactatacatgcaataataattaataaaatgattaataaaataagactcatttcatctacctcgtatcaaaattaaaggtgtataccttctacagttggagacccttagtctttttaaaatccaaactagtttcaaagagttgaagagtatcaattggtttaatgtaattaatatttaaagccatgaactgctcttttttaaatttaacgccaaagatagtcattgttttctcatgtccatccactgtatcaattcttttttctaaaacattaatcgatacagtctcaacaggaattatttgaaagattacttttgctaaacctatagaaagactggcaataaagtttaattggttttgataatattttgttttggttagctttttagttaacaagttcccagcagaagagatgtattcttcttgattcggtaaaattgatgtgtccactaatagattcaataaaacttcactattttcattcgaaataatctcttttatttttcctatagtatcttcaatcttaataatatcttctaaaatttcactataagcaacactgtttttgtcatcaataattttcacaaatttttgttgctttacccactcatcatattctttcttatatttagtttctgcatcagtaatttctttatttaacttttcaatttttgttttatctaatctaagaattctctcaaagaaattgggtttataattatttaaatcactttttaattgagctacattaatctctggcggtgactcttttttaatttcttcccaatttatttgcctgctcgttaatctcgtatgaaatgaagttaaatgattgaggtaagcattaagctctaaattatttgaataattgttattattcaagtgactttgtttttgtgatgaagaaatagatttactggaactataagatagacctgtaccggggatttttgcacttgttgttactttgccagaagtattataagttatcctgccatttttgccccctaaagtcatcccaacactttttttatttatattaagtttgacaccaggcattattttaaaactccttttaaaacccattttatcaacaccccttgttgatttttcttcatagaatctcacgaacaacttatgtagtaaaaaagaccatatatgtattatcgtataatccatcctgaatttccatattaaaacaaccatttgatctaaatcatttaaaaagcacatacctttaatcaggaatgtgcttttagagatgaaattccttttaaaattccgctctttttaaactactcccccaaaccgcatctccctcacgagacaacgcactaaacgtcatcaccttacgctcagaagccgcatcccactgacgcaaaaacacgccatcgtaggtttttccgtcgatcttgagttctattttgttatgccccgtgttcttccacgttccggctactgcgcctgttattttgccattttgattcaagcggatttctttcgattctttaatatctgcggagatgtctttgccgtgcctcaccaattcgtaatcgccaatcacatctgactttttcaccttttcaagcttctctccggcatagcggtgaggggcgacaaccggccagccttgtttgttcatcagcaattggtggacgcggacttcgtgctcctcgccccgtcccgggaagcgggtgtggaagattaaatatgatttaccgcttttttcatcgtaaaaggcagagttatggcccggcgacacatagccgtttttattgttaaatgagaaatttcccatcagtttgacgccgtacggttcgattgaacgatcgtcaaaaagcgttccttctttgccgcggacgtcaatcatcgcgtggccttctgcatcataataagggccgtcagggtttttggagcgggcgacgcgaatgttgtacccgccgtcagcggcaagccccccgaaggacatgtacaggtagtaatactgtgtttcaggatggtagagaatatatgcgccttcaatacggctgtggttgccgccgatcagctttttgccgtatccctgtcccggaagcggaaatccggttttcttgtccatttctaaaataaaaattccgccggaataggagccgtacaccatccacagctttccgttttgatcaaagaatgtgtggggatcgacgacatttgggtgctttgtcgcgtcataaggcgtcccgtcattgctgatcccatccattcccgacttcagaaaaatgcctttatttttgtatggaccttcaatgtcgtctgcgacagcaagcccgagggcggatctcggagaatccccgcggcaggcgttgtaatacatataaaacttgccgtcctcaagctgggtgacatcaggtgcccacaacgtatcagattcagcccattcaaaggtttcttttaattcttcatagacgttcggaatcagaggattgccgtcgtggacactcgaggaaatttgcgtccaattcatcaggtccgtcgatttggccgaagctaaatgggagccgaagacatagtacgtgccattcgctttaataatcgatggatcatgtaccgtcacttctgaaaaaacaggtttttgagtttgtgcagaggcttggtttggcgcgaaacatgcagcaatgatgaaaagcaatgcaaggacttggatgaaacactttctcatattcatttgttctcctctcttttaaaacgctttcattttttgacaatccatcatatgctgcttatccaaggtttattacgagcaaaaaagctcccgacaaaatcggcagcctaagattatttcctcgctttatgcactttcagcaatttccctttcactgtcgtgtttttcatcgcatctaagacgagcggacctttgccgtttaaaatttcaacgaatgaaccttgctcctggatcgtgataatcccgatatcctcggcggagacgccgtcaattttagcaatcgttccgacgaaatcaacagctctaagcttcttcttttttcccccgttaaagtagagcctcatgatttccttatttaacgattcgctcttgtcctgtttaagctccggcttcctattgattttcttttgaaacgccgcttttgcccgtgcaatttcttcttttgacggctcctcaataataggaatatgaaaaccgatatagtcttcaatgtcagcaatcatcctcttttcacgcgcactggcaagagtaatcgcttttccccggctgccggctcggcctgttcttccggtacgatgcacatagctttcttgatctaatggcagctcatagttgatgacatgtgtgatgttctcaatgtcgatgcctcttgccgccacatctgtcgcgattaaatagcggaacgctccccgtctgaaacggttcatcacggcaaaacgatcctcctgaggcatgccgccgtgaattttctcgcacggataacccaaaacggataggcgccactgcaactcattcacttgctcctgtgtgcggcaaaagacgatgcagctgtccgggttttcaacaatgaacagatccactaaaagcgaaaatggatcattttcgtttacaatgatcagttgatgctcgatgtctgcggttgtcgtaccgcctgctttaatctcgattttcaaagggtctttcatatattgaagggatagatgctccacatcctccggaaaagttgctgaaaacagcattgtcagccgttcttcaggcaaatggcggatgattgctcccacttgatcgataaatcccatattcagcatttcatcggcctcatcgatgacaaggtatttcagtttttctaatggaagggttcctttttcaatgtgatccaatacgcggcccggcggcccgacaacgatatggcatttttgcttgagctccgttttttgccgttcaaaggatgacttcccgtaaacagccgctgcttttattcttttatagcggccgatgttcgtcaaatcctccttaacctgagcggcaagctcgcgcgtcggtgtcaaaaccaaggcttgtggtttgttctcttcccattcggtcagctcgcaaagcggaattccgaacgcggccgtcttcccgctccccgtccgcgatttcaccacaacatcccgctttttaagcaccgcgggaatcacttcgctctgcaccgcagtcggctccttatatcctaagtgatcgagcgctttcgtaatatcgccgcttaatgcatagtctctaaaactggctttgctcatgaatgaactccttttggtcatatgatttccagtggatgacggtgttatgaatgtgattatacgctaatcatgactgatttcaaaaagacatgacaaagaggctgcaatcagtgcaaccctaagaaacaccctacagtatcaattgttttcaaaaattaatccgatcatagtaagctcccacagcaaaacagcgatgaaaatgacgcccagtagacgctgtaatacaaaagggaggcgggctaaaacgatttggacttcgtaatttaaagaggaaaccagaatggctacatatcgaaaaaagtcggtgatcagcccatttgattcgtcatatacgttgacttcatatagcttaatgattaatgttggtacaaacaaagaaacaaatgcaaacaccatgttaattgttaaatatatgataagcgcagaattgggatacggtatatcccctgacatcgcaaatccaaaaaataaactaaaaatagaaaaaacaaatatacctattgggatattggtctttcttatagctcttgaaggagggcgcgcaattgtcttttttgtttgaaaaccatataccaatgcaagtaaaatgataaacagctcagcaatgcaaacaaacataaaaaacataacattggcgtttttttcccaataaggtttattcaacaacaatagagcagttaacaatattagaataacattgcttctcagccaaaagaatcggctttttttaaaagagaacataaatagaaatcctttctactataaatcataaaattcattcattgtatccactattttcccaaaatattcgtcgactgccactggtagaagatatagcgagccagtttttttaatattttcataatctaaatgccaaatgaaattatcacttcttaataaaaaagcaacttgatctaatcttgtttgattttgaatatagtcactttctacaaaagaaatattatcgagctcttggttgtttgctaaaaagtcaaaggaaaattgacttatagtcggatgcgttttcgggtcttccgccattcttttaataacgtcagcttcaacctcgtgaaactcatcaaatgaatcttcatccatttcaaaaatttcatgttctggttttttatctgtatatgaatgataaaatgttttcaacatttctaaaaacgactctctgcttcttaaaatcgaaaaactatgattttgattttcgatctcctgcacaatgagttcatctttttgaacatggtgtacaatcagcacccttttccgatggatacaacgaacttttcgctttgattgaatgagtaagtgaatcaggttttctaaccctttttgtaaattagattctgtgccatcagcccaatatcctctttgttttaaaagattttcggcttgaattgaaaatggctcaatatctttttcatcttgaatcaactgctgatcattgataatatcttcagcagctttttcatacctacacaataaaaatgcggcaacgagttcatttgttgttaatataattttagagtctaacattatactcctccttattacctgaaccagctagtgacaaattcctttgcacctgagagtccgtctgaaattgtatctgtagtttcagaggccttttgacttaaccattcaccagcttccttacctttatcttctatccaacctgcagcatcttctccccattcttttacttgatctcccgcaattatggatccagttataccaataccagctccaattgctcctccaataagggtgccaggacctggacatactaatgaacccagtccagctccgctagcggtcaacgctccaactccagcatccattccaatccctgctgaaaatcggccaaatttttcgaaccaagatttatctttattatcatcactaaaaaactcagctccatttgtagtcaaggagaatattgttccagcataaggtatttttttggcgagttttgtaatactagcttcatccttaaacttcccaacagtccctttcacatcaaccttagtcttataactcttcagttcctctggcttatgctttaggaaactttggctctccaaaattttcttgtaggagatccttgttgtgttaggccccaatccaacaatctttctcaaaaggccgcttggtttattttgaaatttgccgagccatttttttattggtttgcttgagtttggatcgccttttttcaggatgttgtaaacaaactgagccaccttggaatcgtattttccgttagctccttgcgtccatttcggagaggctttcacacggaagtttccttttccgtctttttcaagctcaagcattttcgtcgccagtacattcacggctatgacgccttttgttacggccaacgcgccgtttcctgttccgattaaatcaagccattcagcgattctgcccatcattgtcggatcgtcttgtttttctgctaaatcaacggcttcgtcaatcatttgtttaacgacatctgtttcagaaaagtagttttcaacctctttaatcgtttttttagataagatcgcgcctccctttgaccaagtgttcaccttttcagtgagcttggatagctgagcgatcgaatttgacgattgttttaatatagaattagcatcgcgatcaagctcttttaaatcagacaccgtgttgttcacatgttttttggcttcggaaatatgctcattaaatgatgccaaagagatagatccgcccccaattaagtggctgattttatcaacttcgtcattaatcgaatcaaccgtatcattcgtttgacgtttcagttctgttaagccctttttgacgtcatgcgtcagaaattcttcttttacaaaaccctctgttgattcataagttctgatttttgctttaatgtcttttaaattctgtatgtattgatctataaagtgctgaaaataaagcagcacgggaagatgaagaacagaaaagtgttctttgatcgcatttccgccttctccttttaatgcatcatcaagctctgcaattttttgtacactttcccttatggcgttgatctctttttcctcctgctttttttccttaatcaattggtcaatcgcgtcaatgacttcagaaacatctaaaactttcaagagaaaaccagccctccttatttcattttttgagagatgtttttatcagtatcaatcaagactttaatgtttgaccatgcgtccttttcaactgatgatagcgcctccttgtatttttttagtagttgctcgtattccttttcgattttttttattttgttcactacatccattgaagaattagagatatcggcttttgaacctgatatcgaaagtgcgctgatttttgtctgaaggcttgaaaacaccgttttgacttcttctgcttttacctttatttctgccattatttcacctcaatgattgacttgtttttttatatctgtaagctgttgtttttgtatacttagaaacatctccatattagaaatttgcatttcaagattttcaatctcttgctcaatatgcgaaatcagaccatctgtttctctctgtatattttgatagctgtgtgcaatgtttgatctaatattgataaattgctttgtatgtctgccattccatatatgtgatgtaatatctggctgattgatgagagtggcattgtttgaaagggtgtgaagttcaccggtaatagctgtttttgcttttttcagttcagcgattttgctttgggtatcctttatattgtgagataaagaagaaatatctttttccaaagaagagattttagcagcatggttagacatatcgggttcacctcatttttcagaaaataaaaatccgcacgttactattcgcttattccactgtatttcggttaggtatattgttgctttacgggagaatctaacgttcttgtaaatcagacctttttcatattacaatatcatccaaaataggtaaataggataatggacttggttttcttggattttcttgaatcgatcaattcaagatacaaacgatgttatttaaaatagcgtcctggacttagttcaaatgaccttttctcaaattccgtgacatcaaaaaaacagcacacacccaaaggtatgtgctgttttgcatgttcctctattccgtaatcaccgtatgcacaagcttcggtgcttcggctgtttccgcgatttggatgttgtcgtagacttttgcgatgacgtcatcgacattttcgcggtttgcgtatagggtaaccaatggttcgcctttttcgactgcgtcgccgacttttttgcggagcatgatgccgacggcgaggtcgattttgtcttcttttgttgcgcggccggcgcccagcagcatggccgcaacgccgatttgatcggcgacgatttcagacacgacacccgcttctttggcaggaacgtcgattttataggcagcctgaggcagcttttctgggttatccgcgacagagctgtcgccgccttgattctgcaggaagtctttgaatttttgcagcgcttttccgtttttcatcacgtcgatcagtttctctcttgcttcgtcaagggtctccgcttttttggcgagaacgaccatttggctgcccaatgttaagacaagctcagtcaagtcttcaggaccttcgccttttaatgtatcaatcgcctctttcacttcaagcgcatttccgatggcaaaccccagcggctgggacatgtcggagatgacggccatcgtttggcggccgacattgtttccgatgcggaccattgcttttgcaaggttgactgcatcttcatcggttttcataaatgcgccggcgcccgttttgacgtcaaggacaatcgcatccgcccctgcggcgattttcttgctcatgatcgagctggcaatcagcgggatcgaattgaccgtgcctgtcacatcgcgaagggcgtacagttttttgtcagcaggcgtcaagtttccgctttggccgataacggcgaccttgtcgcggttgacgagctcgatgaattcatctttggaaagttccacgtgaaaccctttgatcgcttcgagcttgtcaattgttccccctgtgtgtccgaggccgcgtcccgacattttggcgacgggtacgtcgagagccgcgacaagcggtgcaagtacgagcgtcgtcgtgtcgccgacgcctcctgttgagtgtttgtcgaccttgataccttcaatcgcggaaaggtcgatcgtttcgcctgagttgaccatcgccatcgtgagatcggcccgctctctgtccgtcatgtcctgaaaatagatggccatcgccagagcgctcgcttgatagtcaggaatgctgccgtcggtgtagcctttaatgaaaaattgaatttcttctgttgtcaattcttctccattttgtttttttgtgatgatatcaaccattctcattgtgatcaccagtccttttttcaatgtttatcaatagatcaatcctacaacggtcgctgtcaagaaactgacgagcgttgcgccgtacagcaatttcaacccgaagcgcgcgacgacgtttccttgtttctcattcagtcctttaaccgcaccggcgataataccgatcgatgagaaattggcaaatgagacgaggaagacggaaacaatcgcttcggtgcggccgctgaaatggaagctgccttgtgcgagagactgcatcgcgacaaattcatttgagaccattttggttgccatgatacttccagcattcaccgcttcatgccatggaatacccatcaggaaggcaaacggcgcaaaaataaatccgagcagttcctggaatgatatacctagtgcggcgctgaaaatgccgttaatcattgcgatgatcgcgacaaatccgatcagcatggcggccacgacgacggcgactttaaagccgtccataatatattcgcccagcatttcaaagaaggattgtttttcctcttcctgtacctctaccatatcatgttctcgatcgacttcataaggattgataatcgaagcgataataaatccgccgaataagttcaatacgagcgcggtgacaacgtattcgggcttcagcatcgtcatataggcgccgacgatagacatcgagacggtcgacatcgccgaagcgcacagcgtataaagtctgtgtttaggcagcaggccaagctgcttttttaacgaaatgaatacttcagattgccccagtatcgccgaagccacggcattgtatgactccagtttgcccatcccgttgattttgctgagcgcaagaccaatatattttataataaacggaaggattctccaatattgcagaataccgattaaagcagatataaaaacaatcggtagaagtacgctgatgaagaatgtggattcattcacattcaccagtccgccaaagacaaaattcacaccttctgccgcatattcaagcaaatagccgaagcccttggcaaaaccgccgacgagatagtttccgacacccgtgttcagcaatatatatcccaatgcgaattgcagcacgatcatgacgataaccgggcggtatttcactcttttctttccgctgctgaccagccatgcaagccctaagacgacaaataaaccaatgagcccgatgagatatttcatgttttgatcctcctggtgatgtattcgcttacatttttgtatctgcgcgcaggaagcttccgcttcccgccgcactggatcttagtagttatcttcattttttccttctgctccgctgacgatggaaacgcctgcgcttgcaccgatccgggtcgcgccgtttgagatcatggtttcaacgtcctcttttgtacgaatccctccggatgctttgacaccgatgtcaggtccgacggttttccgcatcagggcgatatcttccgctgtcgctccgccggttgagaacccggttgaggttttgacaaagtcggcaccggcagcaacagccaggcggcaggcgcgctctttttcttcgtctgtcaacagacacgtttcaatgatgactttaacaagcgctttaccttttgcggcttcaacgaccgcgcggatgtcggcctcgacaaagtcatcgtttccgtcttttaaagcggcgatgttgatgaccatgtccacctctgtcgcgccttttgcgatagcgtcttttgtttcaaacgcttttgtctctgtcgtgttggcgcccagcggaaaaccgatgaccgtgcaaacgtcgatttccgttcccttcagctcttcggcggcaaattcgacccatgtcgggttgacgcagactgaagcgaattggtatgctttcgcttcttctattaatttcttaatctcggatttttgtgtatgcggtttcaatgctgtatgatcaatgagatttgcaatcgtcatttactagcacttcctttgtataagatagtttcagcataaccgatttttgaacaaatgtaaattatcatatgaaattttgttcaatagaaaataaagtaaaatccaggctgttcttcctggacacttcagtcatcaagcagttctttcgccgtgtgctgatcaataatcagcacattggcatacttgcctttgagcgcaccatgaatagcggcttttttccggctgccgcccgctacgagaatcgaccgttctttttccctcaagtcagccaattcaatgccgatcgtccgcgaatcgatagcatcgctgcaaatgtttccttccgcatcaaaaaagcgcgaacaaatatcgccgactccacgttctttcaggagggctttttcctcttcatgaaaataccccagcctgaacagcaaggcttcatcgcgtaccgtgccgactgtaaataacgcaatgtttgcctgttttcccatttctatgatccgcttgatgtgcctgtcctgttccaccatctgtttgacttccggattgtcaaacacgaccggaagcggcaaatacctcggcatcgtttgaaaagcttcggcaaacagctgaatcgtttcagacgaataagtgttgacgctggaatggctgattccgcctttcagttgaacgacctctgcgcccttcacctgtttaggctgcatattttgggcgatttggtacatcgtcgtcccccagctgacgccgacaatgtcgccgtccttgactgcgccgtgcatatattcggccccgaagcggctgagataatgcgtgatggtcgtataatccgcggtcggcgaaaagacaacatgcgcttctagaagcccgtatttttcctcaagcatcgcaccgagcgcatccatatcttcaaacgggtccataacgcggatttggacataccccttttccttggcgaactgcagcagccttgataccgtcggtcttgaaatctgcagctgttcggcgatttgctgctggctgtagtcagactgatagtagagcctcgctgcttcaatgctcaattgctgtttttccttgtccatcacgttcctcccctttagtaacgctttaacccatattatataggttcatgctccttctcatccagctgaattgcaaaatacggtccgtatgcagactcatgcgtcaccgcatatgtccatgtcatatgtttatccgttatatatgcatcttcttctcctttcagatctgcggctatcagttgttcagcatgttcaagaatataggcgtcatccgtgtgctggtagaataaaaagcaatcgcgcttcggctgttcgctaaaggcttgatcggcctgtccgccggtaaaacacggcttcatcccatagctgaataaatgccacaaaaaatggctcaccaagatcgcgtccctttccggaagctccatgcttgcggcaaaacggttttcccacgtttttctcaagtaagagccccacttcggtatttctgtcactttcacattttgtctttcaagcttgctgatgatgtacattcaggccctccgtttattttatttttccaagcgctagcacacccgctagttctcttctacatttccccttttaaaaatcaatacgaaaatcctgctattgatggaaaaacattttattattggacttacgtcctgtttttggatagtccaaaaagatcaaataaatctagcaatctccattttttcatttataataaataagtcaaaatcattactcaaaaaaacattcggggtgatctatcgtgaaagcacccgtgaggtatatatggattggtatgatcctgtgctttttatccgtcagtctggccgtcggctgcatcaaagctgaagatcagtcagatgatgagaaaaatgatgaagcgcttcagcctgccgaacacttcgtttaccgtcatttaatgagcgatcaggggctgatcaaaaccggcttttccgaccagcctgtttacttgtcggaatcgcttggcttgtggatggagtttttgatcagcaaaaaagacggcgagcatttccatgagcaatatcagcacctgaacgaatccttccttatgaacaacaacctggtgtcatggcaaatccaaaacggccaggcaagcggggtgaacgccctgatcgatgatctcagaatcatggtgagcctcgatcaagcggcagctctatggggaaacagcgagtataaacaaaccgctcggaacatcggtgccgcattaagaaaatacaacatgaacaacgggatattgacggacttttacgactccgcctctcaatccgcggcaaaagatatcacgctttcctatatcatgccggatgcgctatccatcttgaaaaagaatggagtgataaataaagaactcgaaagtcggaatgccagcattctttatctcgcccctttgaaaaacggttttctcccaaaagcatacagtacagaaacgaaagcatacacctatgaccatgaagtcaatctcattgatcagctttacgcagcttggcatttacctccgaaggatcaaaaagccgctgtattagcggattggctcaaacagacgtttcaaaccggcggaaaactgtatggccggtattcgctcgatacaaaaaagccggcggtccaatacgagtctccatccgtctacgcgttggcgattttattcttcatcaaccaaaacgaagataaaaccgtcattaaagcgctgtatgatcgaatgaatgattttgaaattcttgattcgtccgagacgtattatgggggatatatgagcggaaatgatacgcattcttttgataatctgctgcccctattagccgaaaggaagcttttaaatgaaaatctcattcaatgaatcgcataaaatgttcgcttatatgacaggacttgcagcagcgcttgcgttgttcatccattatatctcagtccagcggttcgaacccgttctcatcatttgcatcacacttgccatcatcgcagcaggaatatggctcggatcgatttacgcactggctgggaccatcatcgtcctgtttgttctcggcactttgatgatgttttttcacacaggccaaggagaagctgcttcgtctgaaaccggactgcaaatgctcgtcatctggggagtggcgctgttgctgttttcctttatgtcagggagaatacacgacatcgcgatcggacttcaccgctccgtcaaacaccttcaagacgaaatcaaaagctttgttgcgattgacagggtgacaggctttgataataaacagaggatgaagctggagctgtcagaagaaatcaagcgggcggagcggtatggcaactcgtttgtttttttactgcttcatatgcattatttcaaagagttcaaatccctgtacggagaaaaagaaaccgatcgtctctttcaatttgtcagcagtcaaatcagatcatgtgtccgggaaaccgataaaaagttccggcctgccgaggagcggttcggcatcctgctgacacacacgcctgccgaacatatgcccgccgtccttgaaaaactgaagaaacagctggatacgtaccagctgaaaaacggcaagtatgtcaccttgaccttccacgtgtgccacttatcatatcagaacgatttaaagactgccgatcaatttttagaagaactagaaaacgagatgatgatgaatgaactgtaagcggctattacttctatacgcggctgtgcttatcctgtctgcggctttttatgttccggacagcgccgaggcaaagcagcaggagcacggcattctcatcgtctattcaacattggatggaaaagagtcagccgatgtgaaaattctcgaccttatcgccggccatttttcatcccgtgtggccgtcataaaagacgcggatgtcaaagcatcggatctcgcaacaaaagaccgcgtcatctattacggacaaacgaaaagaaagctgagcaaaaagctcgcgcagctgatcagctcctccaaaaaacctgtgatagcgatcggctttaacgccgggcagttcagccaatttgcaggtcttacgctcaaaagcaaagacaatgtgtatcagattcgcagcacaaatgaggaaaacgattcctctttagaaagcggagtccgtgtcctcgacgtatcaggattgaagggaaaagcattgtacacatacaaagctgacgaaggaaaagctcgtccttttggatggaaaaccggcaaaggaaacgtgtacatcgggttaaccgatttgctaaacaacagcctcctcgccgctaaacagctcagacaggcatttggtgaaacggccggcagcacgctgttatatttgcggcttgaggatatcagcccgatgtcggatgaaaaactgctgctccaagccggatcttatctgcataaacggaatattccttttatcctttctgtgattccggtatatgtcaatcctgaaacaggcgacaaagtctatatgtctgataagccgaagctggtcaaagtactgaggaagcttcaggatatgggcggaagcgtaattgtccacgggtatacccatacataccgctacagcgaaaccggtgaaggattcgagttttgggatgccaaagccgatcagccgatcacatcggaaaatgcggaagagcccgcgacccttttgcaaaaggaacagagctttccgaatgaagaggcatatcgaaactatttgaagccgttcagaaagaatgaagaaacttacacgcggcagaagctgacgaacgctattgaggatctcaccgcggaagggctgtatccgctcgcgtttgaagcgccgcactatacggtgtcagagcacggctatcaaatcgcctcacaatatttcacaagcttgttcggccaggttcagcttagcgatacaacatggaaaacgtcaggcgccggtccatttgttacgaatccggccatgctccatgggatgacgctctatcccgagacaatcggctatgtcgatcaatcggagcaaaatccgctcggcaaagtcgaggagcgcatctctcaaatgatcgattttgaaggcggagtagccggcgcattttatcatccttatcttggaatgaaatatcttcctgaactggttgatcaaatggaacgcattccaaacagcgaatggctcgatattaaaaagacaaagcaaactgttaacacagataaagtagaaattcacacaagcggagatggaacgattcaagtcaaaagcaaagtcagccccattgagacgtttttcgatcatcaccagcaaagcccgctggaaaaggcgctttggattctctctcttattgtgctcttgtttgttgtcatgtttgtgagctataccctttacttgagagccacattaaaaaaacgaatctttaaggagagaaaaagccgtgggtaatgttctgttcctagtctcgttaagcttaatatgggtcatgcttctgtatcacatgtttttgatgcagggcggattccgccactatatgaccttcgaacggaacattccgaagtggaaagagaacgtgaaggatctcccgaaggtcagcgttctgattccggcgcataacgaagaggtcgtcattcggcagacgctgaaggcgatggtcaacctctattatccgaaggaccggctggagattattgtcgtcaacgacaattcatccgaccggacgggtgacattgtggatgaattttccacgcaatacggctttattaaaatggtcgtgaccaaaccgccgcatgccggaaagggaaaatcgtcggcgctcaactgcggttttgccgagtcaaacggggacgtcatttgtgtatatgacgccgacaacacgccggaaaaaatggctgtttattaccttgtcctcgggctcatgaatgatcagaaagccggagcggtggtgggaaaattccgcgtcatcaatgcggcgaaaacattgctcacaaaatttattaacatcgaaacgatttgttttcaatggatggcacagggcgggagatggaaatggttcaaaatcgccacgatccccggcaccaatttcgccatcagaagaagcattatcgaacagctgggcggctgggatgataaggcgctggccgaagataccgagcttacgatccgggtctacaacctcggctaccacatccgcttctttccggcggccgtcacttgggaacaggagccggaaacgtggaaagtctggtggcgtcagcggacaaggtgggctcgcggcaaccagtatgtcgtcctgaaatttttggctcagtttttcaagctgaagagaaaacggattatttttgatttgttttatttcttttttacgtattttttgtttttctttggcgtcatcatgtcaaatgcgatttttgtcatcaatttattttataatctgcatctttcattcggttttttgtctatcattttatgggttttggctttctttctatttatgacgaaggtcatgattacactgagcatcgaaaaaacagaaatgaacaggcaaaactttttcatcgtttttctgatgtactttacatactcgcaggcttggattgtgctcgtgatttattctttattcgtagaaatcaagcaccgcctgttcaagcaacatggtacaaaacagaacgatacaatcaaaagaaaagcgggtgacttttttgaaatatatcatcatatgtctggcaagcttcttgctgatcacggcgacgggacaagcggctgcagccaaagacgttacagtagacggctcgatcctgggggaaaacagccgggaacaagccaagcagcaagtgctcacaaacgatctcttgactttatacggggcaaaagacagcgccgagctgacgtatcaaataccggcgggcgcctcctctacccatcagcagcttacacttaaatacgaggcctcagaccttttaatctcaccgtcttctttaacagccgagattgatggcgaaccggtcaaaacggttaagcttgaagggaataacgggaagaaaacgctgaagctctcgctgaacaaaagccagtcgtctccagggtttcacagcttatcactgaagttctacggagtggttcatgaaggcgtctgcgtcagacaggactcctccgggaactggatcaaaatttatccggacagtcgtctgaatatcggggaaaagaacgaatctaaaggagcggcgctcgaacattatccttatccgttcgcccagtccggcagctccgtggaaaaaacggcaatcgtcattccggaccatccaagttcggctgaaatcgaagcggcagttaaaacagaagcatacctcaaaacggttgacaacagcatcagcacgaagatcttgggtgaatctgacctggcgaagatcgacaggccgacgattgtgatcggcgttcaccatcactggagcggcaaagtgaaaaagctgttgaaacaagcgaaactcgaagcaaaagaagacaagcttttgcttgcgaaacggatgctcaaagcaaaggataagcagcagcctgtattgtttgcggccgcagcatctgatgatgtgctttctgaaaaaatcagcgtcatcaccgacaaaacgtatgccgcccagctcagcggcgacacgctggcaatcggcaaacttcagcagcatagcaaacggggcggcagcaagctgacacttgaggatttcggggcgggggatttgacaatcggttcgggacagacatcttccgagcatttttattatcccgcgccagctctattagacaagaatcagcctgcaaagctttcgcttgcgatgaaaaaatcgaaaacgattcaaaagcaggccggccaaagcgacttagctgcggaacaggcggagctgaaggtcatgatcaatggccagcctcattccgtcggacttgacgatataggaaaagaagacaaaaacggcttttaccatgtttctttaaaagtcgatccgaaacttttgcaaaaaagccgttacattgatattcaatttgccgcttcaggcttgaaagagaacaacccttgctacgcggtgaacgaggacaaatggatttttatcgataaacaaagtgcattgtcttaccatgtcagcgacacgtcagcttcagcagattttcaagcgtggccgcttccctacgcgggtgatcataacaataaaacgctgatgatcctgcccgacaatgcggatcagtcgaagattgatgagctttcgcttgtagtcggctccttcggcagcgaagcccggcaggcattcacagtaaaaacatcctcggaagtcaaaccggatgacgtgaaaggaagaaacgtaatcttcatcggaagcgtcgatcaattctctctgctgaaggaaaaaacagccgaattggctgttccgacggcgaaaaacggaacatttgatgtgtcatcttttcaaatgctgaatgaaacgacaaaacaagtcgcgtttactcaaacgtcgctgtgggattcaaattactcgatggctgttttcgcgccgtttaaagggcaaggcacagcagtcacaaaagaaatgatcaactttttgaacagcaatgatttcgcagcaaccgttgtgaatgaaacggacagccatcagctatttacaaaccatcaacagctgacagcaaaatccgccgaaaccaagacggatgataaacaggaaagcaatcagcagcatgtgctgtacattgccatcctgatcgtaatcatagcggcagcggttattttgatcttgacaacggcaaggcgcagaaaaagaaaggccaatgccggcggagggattgacgaataaaacaggggcttgcttttagcccctgtttttttataagtattcaacctgtttctcatatacacccttcgcaattttagctaaaacatcgattccccttataatatcttcatccgccgcggttaggctgattcgtatacactggtgtgaatgcgccaggcgccgggattgacggtgaaagaaagatgatccgggaacgataatgactccatccgctttcatatactcatacagcgctgcatcggtcaccggcaggtcttcaaaccacagccatccgaaaagcgatccttccccttgatgcagataccatttgatgtcttcaggcatcttgcataaaagcgtttccttgagcagcatgaatttattgcggtaatatggcctgacttcattcagcgacacgtcggcgaggcgcccgtcattcaatactgatgcagccatatactgccccagccttgaagaatggatcgccgcattcgactgaaaagcttccattgcctgaatataccgggacggcccgatggcgattccgatcctttcgccaggcaggccggcttttgaaaggctcatacagtgaatgatctgctcgttgaaaatcggttccatgtcgataaagtgaatcgccggaaaaggcggagcatatgcggaatcaatgaacagcggaacattcgcttctcggcatgcgtctgaaatgaatgctacatcttctttaggcaagatgtttccgcaaggattgttcgggcgcgatagcaagacagcaccgatgcgcatcctctctaaaaaccccttacggtcgagctcatatcgaaacgtatgatcatccaatttcgatatgagcggagggatcccctcaatcatctcccgctccagtgccgccccgctgtatcccgaatagtcaggcagcatcgggatcaaggcttttttcatcacagatccgcttcccattccgcaaaacgaattgatcgccagaaaaaacagctgctggcttccggctgtaatcaacacgttctcttttcgaatgccggcgctataccgctctgaaaagaagcggacaacacttgcaatcagttcatcggttccatagctcgatccgtattggccgatcaccgaagaaaacctgtcatcgtcaaggagatcggcaagagccgacttccacatggctgacacgccgggcaaaatcatcggattgcccgcacttaaattaatgtatgaccgttcaccgccggccaggacttcctgaatatcgctcatcacagccctgacccctgttttctcaatcattttctctccgattttgcttaatggcggcttcacgcttccagtctctcccgttcaaatcgaagacgggcggtttcgattttcttattgatctcgtcaatgaaatactgttccgggacgctgaatcgctcgccttcccgtcccggaggcaggtattgtctgacatagcgctccgcggcctctttgtatgccgtgtcatcctcgatttcttccagctgttcaatttcggccacaagctttcttaaatcgtccatgcagcgtggaaggtcaagcgacacgcgcttctcttctcctttttgaatggaacggccgttttcaatcatccagctgaacagaaaatagcctgtcccggaatcaaaattccgcgttgcattatgctggctcggatagcgcagcagccgctcatacaaaacaaattcgataatttcctcccagccgtcatattgccgctcccacaaggtcaggattgcttggcaatcgaccttgacttcttctaaaatgcctgcgaaaaaattcattttcgcctgaatatggagatgaaaaggtttttttccgcaatgatgaaaatagtcgtgaaggtagccccacaacacccttgcttcatatgtgcggtcgtgggaaagctgagccgacttgaaaggcgcatgttcaaaaatggccctcgctcttttgagcgtgtcctcatggtaaatgtgataaaacttattaaagtagaaaatcgcgaatgtctgtgatgtgattttctcttttgttttcacattttcagggaagaatacgatgcatttttcttccgtgaacccctttgttccggcgagcagcttaagggattggcagccgttttcaggatgaggcagatcctcttctatcggcctcatcatggcaggttcttcacgaacggctaaaaaggcttcaaaatagcagcctttcgcatgaggcccattcggcgtcacgatcggcgccgcaaaaaaggtcgtctcctgatcatgcggagcccggtaagccgtcaataaccggtcaaaatacggcgtctcccctaatccgcggctgatccaatccaaaacgtcctctttaaacgcctcttttgcagccgttaagtgaaccgcttcataaatggctcctgcgtcttcaatcaattgcagcagaagctgttccgccctttcgtgatgctctgtaatctgtcctttatcattttggtacgtctgcaattcatgtatgttcggtacaatctgctcgttgaccatgtttacaatgtcccctgtcaaagtcgtcatcggcttcctccttcgattgatttaagcccgtggattgtaaagcacatcggtacttccccaaaatctttaatgactttcaaacggtgttcatcggctgctttaatcgtcgtgatgcagccgtcagccgcgtttgaagcgcaggccagggccgcttgagcattgctggtgacaaattggacttgactgctgaacagctttgccagatgagccggagcagggtgtgaagcgacgatttgaatatccgatgccatcgtgtgctgttttgcggcaaacaccatgttgtatgtaggcatcacaaaactgtctataatctttaagtccgctagattctcaaatacgatttgatgcaaaaacgggtaaacggcgcagcctaagaggactgaattttctgtcgatttaacatggagcagcgcttcttccaacgtttcataaagcctgacttccccgcggacccctttatttttgagccatagcaggccggctttttcacagttcgtgcctttgggaccgagcgtatggacaatcatcacggcttgctctttgtgcactttagtcgagatcatcttaacctcctattgtacccgtcaaattattttgataaatgatatgaagctcatcatccagctcccggtagaaagcttcacattcttcataagaatgatggcttgttaatataaaccccggataaccggaaaagtgcgggtacgggaggatctttgcgcctcttctcataaattgaaacacccgcttaacctcctgcctctgtttgacttcttccagtccgtcgattttttcaaaagtgccggagccctgtacaggaatgatataattgccggctgtccttacaggcctgatctcgccttcaaactcgctgctctccagcggctttaatgcattttgcaagacaagctgcataaagttgatgcctgtgctctctttgacgatgtaatgggaaacccctgaaccgccgattctggcgcccacctcgataacataaggtgttccatccttgtccagcctcagctctgtatgagccggcccctggtgaatgcccagcgctgaaacggcgcccgtcacttccttgacgatcgcaaggcgcgtctcttctttcaattgagccggagcaatatagaccccttcttcaaaaaacggccctttgctgttccctttgtatccaatcgaaagaacatgtacgtttccttgaatcgacagcgtttcaatcgcgaattccggcccatcgataaattgctcggctacgatgcccgttttgccgtgcacgaatcgattgaggtccctttggttgacggcctcgactttccggacggcctcctcaagctccttccgatcatcaacacggacgacgccctggcttgagaagccgttgaccggcttgacgactaatggatacgacagtttcctgttttccaggtcagcgagcgtatggaactcgtgaaaaaccggcgtattcaatccgttttgctgaagtatgctgcgggttttatttttattgcggcagttttccattgttgtgaaaggaagccccggcagattcaaagcttcagcagcttttgccgtgaaaggcaaagccggttcaaacagtgtcatcacgccgtcaaacggaaattcgacaaatgtctgcctgacgacatccatcgccgcttcttcatcttcaaacaacggcagcggcacacagcgttccacagccggaagattgcccgggaaatcttcggccgaattgtaaaagaacgtgaccttcaatcctaaacgctcagcttcttcaaaaataaatggcaggtgcttattttgacaaatgatggccaagtttttgtttcgtttcgtcaattttcgcgatcctctcttctttttttaagttgatgaacatcacaccgaatatgacaaacagcgttcctaaataaatattcgcattcagtttttcatccagaaacagaaatccgatatagagcgcaatgacaggggagatgaacaagtgggaagtcgcttttgagatgtgccattttttaagcagataaatgttgatccaaaaacccaaaatcgagccgacaaccgctaaataaagcagcgcataaagactcacaccggaaaacgttcttgtcccgctttcaaagatgaggctgctgatgagcaataccgctccgccgctcagcattgaaagggagttaaagcttaagatcggaagcgaacgaattctctgctgtactttgatttgaataaaagccgagccaaacatcgcacacaaaatcacaatcattgcgacaatttcaataacatcgactttgatcagcagttggttgccaaacacgattgtaatgccgagcaaagccaggcatatcccccatttctgcagtttcgtcgccggtgtccctttgacgaggcggttgatcatcagggcaaagactgaaatgcttgccgctaatatagacaccaacccgctcggcaaataaagagaggcccaataaacagatccgaatggaacggaaaaatacatgatgccgttcaaaaacgacagcactagcagttcctttgacagaacaaactgcctccgtgccaacagaaacgccgcgatcaaaatgcttgcgatcatgaaccgcatgccggcggaccaaaatggaaggctgtcactcagcccggctttttgaaaagcccatgtcgtcccgccgatcaaacataacacgataaataaaatatgaacccgatactttaaaacgtttgtcagcatatagcattcccctgatttagttattgtcttgctgtcatttattttcagaaaataaaatcttttctgatcaaaatggattatgagggaaattataactattatatcaattacagtcaatcatacttttgaacctttagaatatctttacaaatactgcgaacaaaaaaacactcacttcgattaagtgagtggaggcgatattggtttagcttatatttctatcttttgggtgcataccgcttttccggatgacccgaattctctcatcttatgtttaaccgtttctttgactgcgctgatccctggcgtcatataggcgcggggttcatataaatcgggattgtctttaaatatgctgcgcgttttctcagtccaggccaccatgcattcggtattaatgttgattttcgcatggcccagacggatcgttcttgcgatttgatcagccgggatgcccgaagctccatggagaacgagcggaatgtccgttacccgtgagatttcttccatttccttaaatcccaaattaggctcgccttgatattttccatgaacggagccgagcgcggctgccaaagcatcgataccggtttctttgacaatccgctcgcattcaccgatgtcggcatactgcactccgccgataagcccgtcttccatgccccctacggtgccaacctctgcttcaaccgaaacattgcggaccccggcatatgacacgacctcttttgtcatggcgatattttcatcgattggtgaatgcgagccgtcgatcatgactgagctaaaacccgcgtctatcgcttgcttgcagcgctccggacttttgccatggtcaaggtgaagcacgacgggaacggagatcgacatttcctcaatcaaagccgcaaccattgcggaaaccgttttaaatccgcccaaataatcgatgagccgatctgaagcggctgcgatgacaggtgaccgttcttcttccgctgcctctagaatcgcttttgtccattgaaggccattaatattaaattgaccgattgcataatgatgttcctttgcttcttgaagaagttctttcatggaaacgaaagccacgttcacccctcctatcccgtattaaatcttgaagtattttgaaacaacttcaactgttgtttctttggccgttcgaatcgtttcttccgcgctcagcttatagtattcaggtctgaacaattcaactgatacgacatccgaaaaaccgatgtctttcaaagttgataagtgggcatccaagtcgatggctccctgtcccggccaaacacggtcttcatctcttaaaaatccgattggaaagtcttccgtgtcatcgatatgataaatgaagattttcttgccgtccgccttttttaaatcctcaagacttgagcccattgcatggaaatggaagctgtcaaaaacaaggccgacattatcgcggttcacggtcatgacgatgtcataggcctggctgaacgtattgaccgtacactccgggtgaccgacaaactcgacagcgatctttacgccgtacggctcagcgatgtctgacagctctgtcagcacttcgacggagcttgctttaatatcttcttttaagattttttgttcggtgacaagcggtaccgcgaccacgtatttcacaccaagcattttgcacgtttccatcatgcctttaaattcttcgatgatttcacggtgccctttttcatcgcggttgttgaaaaagacaagggcattcaaggccagcggcttaatatgatgagtttgaaaatactcggctaactctgagagagcatggtcttttaagtactcaggcagcttatccatcgtccggatttcgatataatcgtatccgtgcttctcacagtattcgaggtcttttgcaaggtttgaattttccaacgtcgttgcttcattaaagcatagcttcatattcgattctccttctctcatatccttgtgaagagaagttcggcagggcgccgaactcaggggggggcttagcctaataattcttgtttcaatttttcaagcatgaatctgcttgattcatccgctctttcatcgacccaagcaaaaacggcgttcgtcgcaattccgtcgaacttcatctctctcagctttctgaagatcatatcaaaatcgacctcgccttgaccaatgtccaaatgctggtgaaccgttacttttgcgtcaggcggattgacgatgtagcgaaggccatgagccgctttatgattatacgtatctgcgaataaaacatgtgtgaggcggtcgccggcttcgtcaaacattgtctcgatgtcgcctttgccgtcatcataaaagaatgtatgcgcagtcgagtagacaagattaatccaatccttgtcaagcgcgcggatcatatccaacgcacctttgtgcgtttcgataaaatcgtatggatgggcttgaagattgagtttaatgccttctttttcaaagattggcagaagctcatccatggatttgataaatttttcttcacttgttaaaggatcgtattttgaaccgctgaattcactgttcatcaaatcgacttcaagctcgaccgcaatttcgattgcccttttccaattgcgcacggcggcctgacggcgatcttcatcaggacctgcccagtggtaaagcggaaggagcgatgaaagcttaacaccggtatctcttaaaagccgctttaattgtttgattttagctgaatcgactttcggatatttatagaatggacaaaaatcttcgcgcggcgatagttcgatatattcgtagccaagctccgccgttttatagaccgtttcttccaaagtcaaatcatcacgatacatcgatggatccaatgctaatttcatacttttcactcctcggaatgtttttattttttaacagttgtgaacgtttgatagaattccggcttctcctgaagcgccacaggttctttctgtccggattcctgagctttcacacaggcgtccgtcgtcacggcggcgatatagccgtcccacgcagtcggcccgctgacctcgcctttctgttggatcgagtcaatgaaatcttgaatttctacatcgtaagcgtctacaaagcggcgctgccaatccatgaggatatccgtcgagaatttgccgtcttttctgagagagatgcttgatggttcaggaagcttcacgattccgtcctcgccgacgatttcacactggatatcgtagccgtatttgcagttgacatagatttccgcattgatcacgactccgccttttgtttcgatgatgacgatttgcggatcacgcaaatgaggaagcgcgtttttcgattttttcggataaatgacctgaacggattcgtagtcatcattaatcagccagtgcagggcgtctatttcatggacaagcgtatcgacgacagccatatctgttgtatagttgtcgcctacaaccgggttgcggtgcgcacagtggatcatgaggggctcgccgatgacccgattgtcgatcgcttctttcagctgtacgtaaccgctgtcatagcggcgcataaagccgacttgaacgagacgtttgcccgctttgacttcttcattgacgatccgcatgcatccttccgcagtcgtcgccagaggcttttcgcaaaatacgaatttgtttgctttaatcgctttcaaaacgcttgattcatgtgccggtccccagcttgttactaagactgcgtctacattttcggctgcgattagactgtcgtcatccggatagaccttggcgttcaggctgtagtccgttacaacttgctgagctgcctcctggttcacatcggtgaccgcgacaatttcgccgccggctaatttatttgtgatgcggttgatgtgttcttttccgattgctcctgtaccaataacaccaatgcgtagtttcattgatagccactccttcaaatgtagttacataatttttcttgtttgcacttgcccagcttgagccggaggagtcccatacagctcttcctgaatttgttcaagcgacttaccggatgtattcggtgcaaaaaagagcccgatgagcatgctggccgttacacatccaaggagaatggccgccataaatgcaattccaaaattcgagatgatcattggaacgaaaaggctccaagccccgattgagatacgaacaaggaagaacatcaatccttgtgcagatgcgcgatattccgtcgggaaaatttcactcgcccataattgatagttggcctgttgccccgccccgttgtttatgccgatcatcacgataaagaggatgagaatcggcatgccctctgccggaagcagaaacaatgaccagccgatcaccgccgcaaatgcggagatcccaaacactgtcttcctgtatttgtctgcaaacggcatgaagataaaagcgacgccaagcccggtgaaaataaacagccccatctgcaaaatatttgccatggtcgctgatacatcgccgacctgctgataaatgtaaggcataaaaaaccccatgacacctgcagccagattccaaaccaagtacacgcccattaagaataaaatgcttttcaaatacttaggctgaagcaaatcgagataaggcgtcttcggcttcctgacggcttgagccatttcggattgatcctgccaggcatcggattccggcagccttttccgcagaacataagtaatcagtgcgataacgagcaaatgcccaaacacgattttattgcccaataagcctaaatcaccgagcaggaccgacagcagcagaaccacaaccgctcccgcagcccatgcgacctgtgcaaccccgcaatgacgcgccctgtttttcttaggtgcgttctctgcgatgatcgtccaggaagccgtaatatcagctcctaccgataaaccgataataatgtaaccgcttaacaaaaaggggaagctggtgccgaataaaactaaacaaatgcccagtgcataaaccagcatactgttcgtatagacagcctttcggccaattttgtcggccaaaaagcctccgagcagcgctccgattgctgccgaaatggcgttggcgctaaatgcgccgagcagtccgatctgtgtatcagaaagcttcaggtaactgacccataaagataatcctgccgatcctgcgacaatggagcctgcatcaatgtaatttgccaaagctgctgcgacggttcgtttattgaatggtgagactgctgcacttccattgctcaatttagagcccccttaattggttgctgggacattcaacaagtgacgatcgatgtactttctggcgatcaatgcgtattcaagcgggttggcaacatcgggatcctgctcggcttccactacgatccagccggaatagccgtgctttaaaagcgtttgatatacttctctaaaatcgatgcagccgtcgcctggaactgtgaacatcccttgcagaaacgcctgttggaacgaatttccttcccgcttgcatttctccatgatcttaaggcgcgcgtctttaaaatgaacgtgcctaatacggtcaatatgcttctctaaaatgttcatataatttccatctgaaatgtaggcatgccccgtatcgtacagaaggtgcacaagtgccgggtcagttcccgccatgagccggtccacctcttcctctgtctgcacgcctgtgccgaggtggtgatggtagacaagcttcagtccgtaacggccggcgatttccccgaggtgatttaaaccttcaaatagccgctgccattcttcatcggtgaaataaggcttttctttaaacacgtttttatccaagccctgcacactgtacgtctgttctgatacgaccgcaacatcggcatggacgtcttttaagtactggcagtgagccgcaaattccttggctgcttcttcaatgccgtcccgaatgatatagctgctgaaccacttgccggcaatccttagattcctcagctcgagctctttattgagaatggccggttccggaaaaaagccgcccacttccgtgccttgaaagcccgcaacaacaatgtcgctcaacaaatgctgaagtgtgtttcccgcgccgatttccggaatatcatcgttccgccatcctatgggggcgatgccccatagaatttgtgtcttgcccatcctggtgcctcctttaatactgctttgcagattccagcattttttcttttgctttatacgccttttgcacgctttcctgttcggaaacctctgcaacacctacgtgccaccagctgtcatagccgtccgtcatcgttttcggcagcaccttcatttcaatcaatgttgagacatcttgttttttggcatcttccagcgccgcttttaattcttcaatcgtgttcgctttgtaggttttcgctccatagccttcggccactttcgcataatcgacattgagaatctgattgtctgctgttctgaattcacagtagtagctgccgtttccatggtccatttgcagattgttgatgcagccgaatcctgagttgtcaaagagcagcacgttaatttttttattatattggattgctgtaatgagctctgagtggagcatcaggaagcttccgtctccgaccagtgaataaacttctctatcaggatgcgccaatttcaagccgagcgttcccgatacttcatatcccatgcaggaatagccgtattccaggtggtacgtattcggtacgtttgaatgccacagccgctgcagatctcccggcaaagagcctgctgaacaaatgacgacgctgtccggatcaactgtttcattgatggcgagcaatgccgttgtttgcggcagttcggtttgcagcacatccgcatattcgttgagtatgtcttgagaaaagtgatctttaatttcaggagtgaagttttcgcgcttaaatgttaccttgcttaagcggtcgcgttcagcaagccattcgtctttcagctccttgatggttgaaccgaactcgctcttatagccttccaataagccgtgcagtttgccgagcgttacttttgcatcggcaacgacttggaaagcatccagtttataagcctgcattctgctgacattaatgtttaaaaattttgcgttgtcaaagtcaaaagcggtttttgatgatgtcgcaaaatcggtatagcgcgtgccaattccgatgatcaggtctgccccgcgagccgctttgtttgccgccagcgtaccggtgattcccattccgcccaaattgttggcaaaatcggcttctactgtggatttaccggcctgggtttctaccagcggaatattgtaagcttcagacatggcgatcaattcgtcgcgcgcgccggaatatttcgctccgccgccgaccaagatgagcggttttttgctcgacttgatcagttctgccgctcccttcagttcacgctcgctcggctctttgcgatcaacatagtgaacgcgtttttcaaaaaagctttcatcgaaatcataggcctcgccttcaacatcttgagaaatgcaaatcgttgcaggaccagcttttgcagggtctgtcattacttcaaaagcgcgaatcagactgctcatcaactgttcagggcgcgtaatacggtcccaatacctcgaaacaggcttcaatgcatcgttcgtcgtaatcgccgcactgtattcctgctctacttgctgaagaacaggatcaggctgtctcgtggcaaatgtatcggctggaatcaagaggactggaatgttgttcgcaagcgcagtacctgcggctgccacaaggttagctgctcccggtccgactgatgtcgacacggcatagatcttccttctcagcatttgcttgctgtaagccattgctgcatgcgccattccctgctcatttttgccttgaaacacctttaagtggccggcatcctgttcaagcgcctggccgattccaacgacgttcccatggccaaaaatcgtaaagattccctcgacaaacggagtttcttctccatctacatggatgtactgctgatttaagaacttaattaacgcttgtgctgtggttaaacgtattttcttgcccacaaacgatcccacctttattcatattcttcatttaagactgagccgcaataagctcttcaatctcggcgactgtcggcatcgcttcagatgagctgtgctttgaaacaacaatcgaggcggaagcgcttccgtatttcagcgcggtttcaatatctttgcctgaaacgagtccgtagaggaaggcggaggcgtatgaatcgcccgctccaaacgttttcaagaccttcgttttgtacgctttcgcccggaagacgtccccggatttgctgtatgcatatgaaccttcgacaccgtgcttgataacgacaagatctgcggaatgtgcaaataaatgctgaacagattcttcattgctgccgccgctcttattttccattacatcaaactcatcacgcgtcccgatgacaatgtctgattgttcggcaacaagcgtatagtagacggccgtttcctccgcagatgtccacgtatatggacgatagtcaagctcaaagaccactttcacttgatgctttttcgccagctgtacggctttcagcaccgcttcgcgggaagggcttttagccagcgccgtacctgacacaagaagcatcttcgatttggcaatatagtcttcgttcacttcagaaggggcaaggtaaagatctgcaacatcatccctgtacattaaaatgctgcattcttcagggcttaaaatttctgtgaaagcaagcccagctttatgtccgtctttatcaaccgccatttgtgacgtatcgacacctgtatttctcatataggtttcgatgaatctgccgtgctggtcatccggaatcttcccgataaatccggtcttcaagcctaatttggaactgccgattgcaatattagccggggagccgccgacatattttgaaaatgtcatcgtctgctccatcggcctgttgtattcgactgcgtttaaatcgatgcatgcgcggccgatcgctacaatgtcaaattctttctcttcattaaacgtatacttcatcttcaacagcctctccttgccttattgttagcgttccaaaatccattcatggtcagggtcgttatgaaacttccatttacgcgtcggccctgccatcacgtttaaataataggatgtgtatccgtcaggcaccccgacaggatggtatccggccggcacgatgacaacgtttccattttcaacagtcatcgtctcgtcgatggaacggtcatccgtgtatacgcgctgaaatacgaagccttgctgcggatcaagttcatggtagtatgtttcttctaaaaaggactcttcaggcaggttgtcttggtcatgcttgtgcggcggatagctggaccagtttccgctttcagtgtagacttcgacgactaaaagactgttcgctgaaggatctgaatccggaagtatgttatggacggttcgtttattgctgaattttccccggttctcaataccgttgtcttcagctttgatcagtttcgtcggaagctggttttcagaaggtgaatagcacagggcaactcttgcctctgtaacggcggtaatgccgaacttgcggtcatttgacacatatacgctgtcggtcggctttctttcgaaaacgctttctctcgtgccgatattttcaaatgtctgttcatgatcggttgcggtaatctttccggtaagcgcgacgatgcagcattcttgtttgctcagcgattcttcatagctggatcccggtgcaagatcaaggactttaaactcgacataacttagatcggaattcgattttttcacttcgtgtacaagcttcacgccttgtgacagctcattcgcctgcggcttgcgcaacaaatgactcatggataaagcctccttttcaaacttgaaacatgatccgaacagcgcgggaaccgcaccgcccggttttttcacaattaattgaagtcaggcgccggatatcttgcagtgacgacctttttgcgcgtatagaaatcgacgctgtcttttccgttggcatgcaatgtaccaaagaacgaagacttccatccggagaacgggaagaatgccatcggagccggtacacccaggttgatgccgagcattcccgcatcaatgttttcacggaaatagcggatcgcattcgaattcgatgtgaacaagcatgcgccgtttgcaaattcggactggttggcgatctcaaccgcttctttcaagttcttcacacggatgaccgatagtacaggagcaaaaatttcgtccttccagatcgtcatatcagttgtgacattgtcaaagattgtcgggccgacgaaatagccttcatctgtaacattttcgcgtccgtcgcagacaagtctcgcaccctcttcaattcctttttgtatatagccgagtgtgcgtttcttgttgtcttcgcgaatgacaggcccgaggaatacaccgtcgtcaagtccgtttccgattttgacttcagatgctttctgaaccaatttttccatgaactcatctgcaattccttcttcaaccgttactactgcgcatgccatgcagcgttcgccggcagatccgaaagcagcgccgataatatttgttaccgtatcttcaaggttggcatcgttcagaacgatggtgtggtttttagcgcctgtcagcgattgaacgcgtttcagattttcgcttccttttttatagacatattctccgaccggttttgaaccgacgaatgaaatcgctttaatttccgggtgttcgagaatgccgtttactacatcatgtgcgccgtataccacattgaagaccccttttggaagtccggctttttcaaacagttcaactagcttttccgtcaaaagcggcgtccgttcggaaggcttcagaataaatgtgtttcctaacgcaatggccattgggaacatccagcatggtaccatcatcgggaagttaaatggtgcaattccgccgacgactccgatcgggtaccggtagttcgccgcttcaacatcggttgcaattgtagcaagtgaatctcccatcatcagtgaaggcgctccagctgcaaactcgacattctcgatgccgcgtccaacttcacccaacgcttctttcgtgttttttccgttttcaatcgtgatgaggtgggcaagctcctctttatgctgagttaaaagctgctgaaagttaaatagaattcttgcccggcgcggaacagccacttttgaccatgttttaaacgcttcagccgctgtttgcgctgcgtattctatatcctctcgcgtcgaaatcggcacttggcacagcacttctttcgtcgctggattgactacatcttcatatttgtcggttttgctttcaacccattctccattaatatagtttcttaactttctgatttctgccattcttataacctccttgaatattaaacatctcctggtacagatggggcaggtttcaaccattatgtatgaatgccgaacagctcttcattgcacaacggattttcgcaaaaaacaggaattaaacgcttacaaaagaaattaatgaatagaactatgattttatccaaagaaccatgacgcaataaaacgtttacacatcagaaatttctcaacattatcatgttttggtcacttcttggttatattttaatccggccttacccataagtcaatcaaaatcattaaatttttcttttgtaagatttgtagaaaacgttaaaatgatttagggaaacattgtataataaaaagaaacagggcaaatcttgcaaaaaataatcaccaatggtatcattttttaagcaattattggttaacttttgggttcgtcatatatatttagtcaaatatactagaaggagatacttagtatgaagttaatgcggattaaagaaatggaagattatattttgaccaatggcaccgtttcgcttgatgaactatgccaggtctttaatgtttcaaaaaacacggtcagacgcgacattaacaagctgaccgagaaaggagttataaaaaaagtctacggcggcgtaacagcgatcgaaaaaacggccttgatcccttttgaaaacagaaccattcaaaacaaggatgccaagacaaaaatcgcgcgctatgcttcacgctttattgaagaccatgacctgatttttattgattccggcacaacgacccgatccatattggaaactcttgatccaaataaaaatgtaaccgttttaacgaacagcctcgacattatcaacgctgctgcagcgatgcaaaatataaacttgatcatcatcggcagcaactacaaacggaaaacgcagtccttcgtcggcatggatgatccgggaacgctggataaatataatattaataaagctttcatgtcggcaaccggcgcaacacttacccatggactgacaaactccgatctgcttgaatatgaaattaaaaagaaaatatccgaaaaagcaaaacaagtatatttgctggccgaccattccaaattcgggaagtcgaccctgctgacgtacgcgccgtttgacagattgcacgcgatcgtcacatctcaggcgcttgatgaggaatatcacgtgtactgtaaagatcgcaaaattgaaatccatttggcaaaacatgtatagttgaagcggacacccttgaccggctgtttccaagcggccggccaagtttatttatctacacatcatatcaggaggggaattcaatgaaaaaagttaaagttggcaaatcagacttgcacgtatttccgattggtttgggaaccaatgctgtcggaggacataacctttatccgaatctcaatgaagaaacgggaaaagaattggtgcgggaagcaataagaaacggcgtcacttttttagataccgcctacatatacggcatcggccgttccgaggaattaatcggcgaagtccttaaagaattcaaccgcgaagatgtcgtgattgcaacaaaagccgcccataagaaagaaggagacgattttgtctttgacaactctcccgcatttttgaaaaagtccgtcgaagaaagcctgaagcggctgcaaactgactacatcgaccttttctatatccattttcctgatgaaaatacgccgaaagacgaagcggttcaggcgctccatgaactgaagcaggaaggcaaaatcagagcaatcggtgtatccaacttttctcttgagcagctgaaagaagcgaacaaagacggattggtggatgtgctccaaggcgaatacaacctgctgaacagggaagctgagacgacattcttcccgtatacacaggagcataacatctcatttgttccttacttcccgctcgtctccggattgctcgccggaaaatacagcgaagatacaacgttcccggaaggcgacctgagaagagaaatggaaaacttccaaggcgaacgcttcaaagaaaacattagaaaagtgaaccagcttgcgccgatcgcggaaaaacataatgtcgacatcgcccatatcgtcttggcctggtacttggcgcggcctgaaatcgacgtgttgatcccgggcgccaaacgcgctgatcagctgatcgacaacctcaaaacggcagaagtcaatctgtctcaagaggacattgatttcatcgaccggctgtttgcccgctaaatgatcaggaaacctatcttaaaagataggtttctttatttttaaaatcctgttgacagcgcttccatttttgatatgataggaaagaagttaatacaagtgacggagaatgggagattcacaataagaccctcttgtgccaggggtttttttgtggatctctttttcttcgtcatctaagagggggcgaaagcaatcgtaatgaatagacggcacctttattctgtataacagcttgaaaggagagatcatgttatgaaaagactagtccgcagcatcttccttataacggccgcaatcgctgcttttggttttggattcagcgggcatgcggaggcggcaagccattcccagccgcagctcaatccgaacaagctactaaatgtcgcgcaccgcggcgcatcggggcatgctcccgagcacacgcttttggcttataagcttggacaaaaaatgaaaggcgattacatagaaatcgatcttcaaatgacaaaagacggccacttggtcgccatgcacgatgagacattggatcgtacgactaatggtacgggttttgtcaaagactatacgctgaaagaaatcaaagagcttgatgcaggctcctggtttaacgaagcatatcctgagcgggcaaaaccggagtacgccgggctgaaagtgcccacccttgaagaaatcatccaaacattcgggagaagcgcgcgctactatatcgaaacaaaatcaccggaagactatgatcatatggaagaaaagctcctggacatcctgaagcaatacaaattgaccggagcagacattcattcaagcaaagtcatcattcaatcttttagtcctgaaagcttaaaaatcattcataacgctaatccaaacattccgctagtgcaattattatggtacgacaaacctgctgccattactgacgccgaattaaaacaatatcaatcttacagcgtcggactcggcatgaactttgaccgcattggccgggcatacgtgcaaaagattcgacgcaccggcatgctggtccatccttatactgtgaataaaaaagaagatatgaagcggctgctcgattggggagcgaccggaatgttcaccaactttccggaccggctgcgcgatgttttgcgcgaaaagaagtaaatgaataaagaaggggaataccatgttaaaactgtttaagccagcaccgccgattgagcggctgccggaagatcaaattgattcggaatataagaaattcagactgcaagtttttctcggcatcttcatcggttatgcggcatactatttaattcgcaaaaatttctcgcttgccatgccttatttgatcgaagagggcttttcaaagtcggcgctcggctttgccttgtccgctctatccatctcttacgggctgagcaagttcgtgatggccacgatatcggaccggagcaatccgaggatgttcctgcccgccggtttgatcctttccgctgtcatcagcctcttgatggggtttgttccttttttcacctcatcgatcgccattatgtttatcatgctgttcttaaacggctggttccagggcatgggatggccgccgtcagggcgtgtccttgtccactggttcagcgtcagcgaaaggggaaataaaaccgccatatggaatgtcgcccacaatgtcggcgggggactgatggcgccgattgccgttgccggcgtcgccatcttctcaggcataacgggatctgctacaggctatgaaggtgtgtttattttgccggccttggtcgccatcgccgttgccgtcatttcttactggctgatccgggatacgccgcagtctgtcggacttcctccaatcgaggaataccgcaacgattattcaagcaaatcgaagaaaacctttgaaaaggaattatcaacgaaagaaatccttttcaaacatgtattaaataataaatgggtgtgggcgatcgcacttgccaacattttcgtgtacttcgtccgctacggcgttctggattgggctccaacctatttaagcgaagaaaaaggctttgacatgagcaaatcaagcgtcgcttattttctgtatgaatgggcggggattccggggacattgctgtgcggctggatctctgacaaatggtttaaaggacgccgcggaccggcaggctttgtctttatggcaggtgttttgatcgcggtgcttgtgtactggttcaacccagccggcaatccgatgatcgacatggcatcattgatcgcgatcggattcctcatttacggtcccgtcatgctgatcggccttcaagcgcttgactttgttcctaaaaaagcggccggcacggctgcaggattgaccggtctgttcggttacctgggcggaaccttgacggcgaatgcgctgatgggtgttatcgtcgatgcatccggctggaatgcgggctttacgcttttaaccgcttcatgtgcaatcgcagcactcatatttgcgatgacttggaatgtgcggggacaggaagttgtgaagcattaacatcaaaaaaagatacatctcgcaagaagctgagatgtatctttttttatttttatgccattactttgcatatatcgttcgtaaattcgacggggtcttcaattggcaagccttctatcagcagcgcctggttgtacaggaggccggtgtacagtttgaatttatccttgtcgttgtcaaaagcattctgcaatgttttgaagacttcgtggtttgtattgatttccaatactttatcagcctttacatgctgattgtcaggcattgcgtttaagattttctccatctcgatggtgacttctccgtcagcggcaaggcatacggagtgagtcttcagccgttttgacgccctcacgcttttcacttttccatccagagtctttttcatctcttcaaacaggtctttgtattggctgtcatccccgtcagattggttttgctcgtcatcgttttcgattccgaggtcgccgcttgataccgacttgaattctttctcttgataattcgccagcattttgatggcgaactcatcgatatcctcggtgaaataaaggatttcataccctttttccgaaaccagctcggtttgaggaagcttttctattcggtcatacgagtcgcctgatgcataataaatgtatttttgatcttcaggcattctggacacatattcctcaagggtgaccagctttttctcttttgatgaatagaaaagcagcaggtctttcaacagatctttatgggctccaaaatcattgtataccccgaatttaagctgtctgccaaacgattgataaaaagactcgtatttttctctgtcatttttcagcaagctcttcagctcattcttgatttttttgctgatgtttttggcaatcagcttcagctgcctgtcatgctggagcatctccctcgaaatgttgagcgataaatcttctgaatcaaccattcctttgacaaagctgaaatggtcaggcagcagatccggacacttttccatgatcagcacaccgttcgaatacagttccagacccttctcgaattccttcgtgtagtagttgaacggaatattttcaggaatgaataaaatcgcatggtatctcaccgcgccgtctacgcttgtatggatgtgcgcgagaggcttgtcaaaaccgtaatgcttttccttataaaacgcctcataatcttcatctttcagttcgcttttgttttttctccaaatcggcaccatgctgttgaccgtctgttcttcctggacttcttcaaattcattttcggcgccttctttcggcttgttgaccgcgacatccatcttgatcgggtagcggatgaaatcagagtatgttttgatgatcgcttttaagcgatgaacatccaggtattcatcatagttttcatcgtctgtattctctttcagcttcagaatgacatcggttccggctgattctttcgcagccggttcgattgtatagccgtcggctccggctgattcccattgatgcgcttcatcgctgccatgggcttttgtaatgacggtgacggtgtccgcaaccataaaagcggcgtagaaaccgacgccgaactggccgataatatcgtgcccgtcttttaattcgttttcttgtttaaacgcaagcgagccgctcttggcaatcgttccaagatgctcttcaagctcttctttcgtcatgccgattccggtgtccgcaatggtcagcgttctgttttctttatctgcggagatttttatgtagtaatcgtctttgttaaatgtcagtgaatcatctgtcagcgctttgtagtagattttatcgatggcatcgctcgcattggatatcagctcccttaaaaagacttccttttgggaataaatcgagttgatcatgatgtccagcaatcgcttggattctgctttgaattctctcttagccatctatccctctcctcttttgctcatatgatatacatatatcgttcgattctgttcacaaattaaataacacactgcctacacgatgtcaattgataaggcagcggtttgacaagcggcattccgcttcatataatgtgttgtgaaggtaaatttgaccaaaatgaggtggaaaggaatgaaaatcttatcaactgttcttaaaagagaattggcttaaagacgggagaagtctgcccttttttagacaagccatctcgggaacagtttgatacgatttgacatcctttcttgctgtattttaaatatgtagcgggtaaggtgtagtttgccttacccgtttttttgccggacaggatagcgatgcttcacgctgttctctttagatggcttgttttttcaaaaataagcctgaaggagagaatcatcatgagtattgttcatgtaacgaatttgacccatatatatggagaccgcatgatctttcaagacgccgggttccgcctgctgaaaggggaacatgccggtcttgtcggtgcaaacggagccggaaagtcgacattgctgcgcattttgacgggcagccttctgcccgatcatggaaacattgaatggcagccaaacattcgggtcggctttcttgaacagcatgccaagctgacggaaggcacaaccattcttcagtacatggagaaagcgtacggccggctgtttgaaatcgaaaaggaaatgaatgggcttgccgaaaaaatggccgatgccggagacaaccttgaagccgtcctgaaaagatacggagagcttcaggctgagctggaagcttcaggattttaccaaatcggaacgaaaattgaggatgccgcacaaggcctcggcttggcggaaatcgggcttgaccaggatgtcacggctttaagcggcgggcagcgtacaaagctgctgcttgccaaactgctgcttgaagagcctgatgtactgctgttggatgagccgaccaactatttggatgccgctcacattgagtggctgactggctacttgaaaaactatgagcacgcatttcttgtcatctctcatgacgaacgcttcttaaatgaaattacgacggttacattccatctggagcatcatgtgatcaaacgttattccggcaactatcaatatttcctgaaggagtatgcgcaaatcagggcacaggctgaagccgcatatgcaaaacagaacagggaaatcaaaaagttagaggcgtttatcgaccggaacagagtccgaaaggcgaaacaggccaaaagcagggagaaagcattacgcaaaatcaagcgaatcgaaaaaccgacagattcttatgtcccaagctttgcatttaaaacggggcgaaacccggcgatgactgtactcaaaacggaaaatcttgaggccggctacacagttccattatttaagcctctttccctgaccgtaagacggggcgataaaatcgcgattattggagaaaacggcgccggaaaatcgacgcttatcaaaacgctgctcggcgacctcaagcctctgagcggcatcgtcacagcaggacagcatttacaggcggcctatttcaggcaggaaagcccagcttctcatgatacaccgcttgaaaaattgcgggcgttctatcctgatctaccggaaaaagacatcaggcagacgctcgcggtatccggcttgacgccaaagcatatcagccagcccctttttacgctcagcggcggtgaacaggcaaaggtccggctggcggagctgatgctttcaaacagcaacctgcttgttcttgatgaaccgacaaaccatcttgacgcatcggcaaagcatgcgttaaagcaagcgctctgcgactataagggaacgattttgctcgtatcccatgaaccggctttttatgaagactgggtgactcatatctggcagattgaagcatggcgccgttaagagtaaaagccggcctttccaagggccggctttttttatttggacaatacaagctcacgaatggcgtgggcaacgccgttttcattattcgtacgcgtttcgtaatcggccgaagcttttacctcagggatcgcattccccatggcgactccgcaacccgcccattcgatcatggacatgtcgtttccgttgtctccaatacacatcacttcttcctgcgcgatgcctaatatgtcggcaagctgctgaacagcatttcctttacttgccgcagggtgaagaatttcataaaagaacggcgaacttttcaccattgtatagcgttccttgacgtcttccggtattgcggcgatcgtccggtccagcttttccggctcatcaatgtacatcgcctttggcgccagaagatcttgcgggatttcttcgatcgtccggaaccggagcggcactttggtgacgtatgattcgtaaacggtatacgggctgatttcccggtttggcgtatacaaataagccgaatcaaaaaagtgcatcggagtatcaagcttttggctgagctcatataacgatttcacatcatcatagcccagtgtcagttctgacacaacttcctgagtatgcgtattttgaacgagcgctccgttataggcgatgacataatcgccgtcttcatttaaattcagttcttccaggtagcggcttacaccgccgaggggacggcccgtgcagagaacgatttttacgccttgttttttcgcggcatgcagggcattccgtacttcctctgttacttcatgaagatcattcaacaatgttccatccatatctatcgcgattagtttgtacattttacactctccctgatcagaatcgagccctaacatcgtacttatgacccataccttctttattgtatcacagcttttcccggtcattttcatctgatgcccacggaaaaaacgccttacagcaaataaggcgtttttcgggcaagcttggcctgcttaaaatatttcttgcagaatcggatcttcatcaagaatgcgaagcgctttttcgcgatagccggcttcatgcaagtacgtatagcggttgggcttgacagtgtgcgacaaattgatcgcctcgcgaaactcatctttgttcagattcagcgttttgacatattggaaaaagcccgttctcgtaaacaccttttcaatccgctcagcccggtgatcctgtacatgggccatgatgtaggtggctaccccgacttgaatgccgtgcatctgcggttttttcgaaattttgtccaaggcgtgggatatcaggtgctcagaaccgctgatcggcgcgctgtttccgctgatttccgtagcgatgccgcccattgtcaaagaactgacaagctcttttaagaagatcggctgtttaatatcctgcatcggcgtacggacaaagctgttgaccgctttcttgctgagcatcgacgcaaacgcatttacatcgccgaccccgtgccgctcctcaaactcccaatcataaagggccgtaatattggacatcaaatctccgatccccgccaaaataaagcaatccggcgctttttgaataatgctcaaatcagctatgattccgtagggaacccttgccggaacggttgttttttttccttcgacctgaagcgagcaattgctgctcgcaaacccgtcattggatgccgacgtcggaatgctgatgaacggggtccgcttggaaaaggcgatgtattttccgcagtccacaacatacccgccgcccatggcaataatgacatcgcaattcccgatcgaaaatgcccgcttcaaaagctcctgtatgtccagattggacggcagcagaacggcttcaactttaacatgttgaaatgcggttttcagtgaatgctcatactgctgataggaaaaatcgtcaaaaaacatgatcgccttgtcaaactgatgttttctcaatatctcatccaaccggccaagcacgccctcactaatgtccaaaaccgcggggatggctatgctggtaacctggcgcggcattagacgatccgccctttttctttaagatattgttcaatgtcttcaaatgtttcaacggctacaaatggcaccccctgctgacgcagcaaatcctggagcgcatcctttgcaaacgtaacatccgcaaatttagccgggtgcgaatccggttcactgtcgcctgcaaaataaaccgtctcatactcttctttcagcttttgaatgacctttgatttatcaatcccatagcgctcagagtaatgccaatgattctcatcaatgtccatatgaacattgtcttctttaaaaaagcctttatttgaatagacctcaacgtctgtaatcccgtatttctttaaaatataatgaatgtaataatccgtgccggcgcttaaaatgtagaagtcgccgccgcttttctggacatgctgaatgaagtcaggcacatattcatcaatcggtatggaatggatgtcatcaatgattttttgttcgctttgattaatcgaagcaaaaacggttcccaaaaattcgatatcttttaattctccggacttccacttcttgaacaattcacggccttcgggaaaatatttatcaatgaccatccagtaaaaatcctgtttggaaatcgtcccatcaaagtctgatacaaatgcccatttcttcatgctgcatacctcttttctatggtattttaaaagattagattcattatacaaaaagtttgtgaatcattgaacataatattatttcttttttgtgtactttcgttcacaagctgaatattcgtccccctgaaaggaggcgtatataatcattcttgatctgtacgctgcttacctttctctgttacggcaaatttccgcttcatcgttttgatgttttccgccttgcgaaatctgagcgcagaccagtcttcatcaattgcaatttggcgaaccggttcatagccctggtctgcaagcagtccggctactgtatcgcggctgcagtccgatcctttgtagactttcgatgattttttcgggtagcaaagccaaaacagaccgtcttccgccaaatgacgttcagcctccttggctaaagcctgcagctttgcgttggtcgctgcgaatacctgaacaaaatcatattggtccgattcggcgtgatgatgaacagggccttgaaattcagcgatgacgccgctgtatgcctcaggcggattcacaatcagtacaggctgtccattatccttgaactgcaattttttgatcaccgggttcgtttctgccatctctcatcagtcctttttctgtttatagtaacaaattaaccaaaaccacactaatcatacttagcaaaaaaagtgatagacgagagagggattgatctgctatatttacattgataatgcgaatcattatcacttaggaaatgtcatatgtttcacatcaacaggagggtcaagtgaaaaagaacttattgataatcggtttagttatgctgttgtgtatagtggtcagcgcctgcggaagcggcaatgcgtcaaacggtagcaaagaaaaagcggctgaagaaacgacaagaacatatcaatcaacgcgtggaagcgtgaagattccaacacatccaaagcgcatcgtgacagacttttatgccggtgaactgttcacggtcggcgccaatgtcgtcggctccggctcgtggtctttctccaatccatttttaaaggaccgtatgaaagatgtaacggatttaggcgacccgattaatgtggaaaaagtcatgaagctgaagcctgatttaattgtcgtgatgaacgatgataattacgacaaactgtccaaaatcgcaccgactgttgtgattccttataacacggcgaaaaatgttcaggaaactgttaagatgttcggcgacattgcaggagctaaagaagaagctgaacaattccttgccgatttcgaccggaaatcgaaagcagcgaggaaaaaaatcgctcaagtcgtcgacaaaaatgctactttcggtatttatgaaaacacagaaaaaggccaattctgggtgttcaatgacaacggcggccgcggaggccaagccgtgtacaacgcgctcggcttaaaggcgcctgaaaagattcaaaaagacatcttcaaaaaaggcgaaatcaaagaactttccttggaagtcgtacctgaatatgcagcagactacatgttcgtgacagactataacccgaacggcgacagcaaaacgctggacaagctgaagcagtcttccatttggaaaaaccttgacgccgtcaaaaacaaccgtgtctttatcaacgactttgacacgttctatccgtacgatccgatctctgtcagcaaacaggttgatttgattacggagatgctggtgaagcgcgaaaaggagaataagtaaaaaagctggaatttccagctttttttattgttttctttcttgaatgcttgaaaacctaaaagcaaattgaaagatcaaatagaaaggaatgtagaaaagaaaaaacatcatgatttgaaataataaccctttcaaactaaatggatatgaaatgtcatgaaacaaaaaagataatgccatccaaacgacaaaggcagaaaacgcagctttaaagccgagtcccctcttttttctcaacagacctttgctcacgagcctaatagaatagtagccgctgccgatgaaaaatagaatgatcagcaacagattgctcggtatttcgtatgctgtcgtgataaaaatggaaataaaaatcagtgaaagaaggagcacaaacccttcaaatccaatttttctctcctgttcagcctttttattttcattcattatgttcgcctcctttctattgttttccattaaaagaaacagaagccatgttaacaataatcatccataaaaacaatgatttgacacgcatgccgctgcttcagcccatcactcctgtttcacgtgaaacaaaaaatgcatcgaaaaaatatatggaatcaagtgtgtgaaaatgaaaataataacaaaaaaaggagagatgatgatgggaattgaaaaggttggacaaatcggggtgccggttcaagacttggagcgggctgcggcattttatcaggatgtattgggcctgtcccttttatttcagacagatcgcatggctttctttgagtgcggcgaagtgcggcttcttctcagccttccggaaaaagacgaatttgctcatgcaggctccgtcatttattttcaagttgaagatttgccggctgtatatgatgaaattgcaacaaaaggcgtctcttttccaatagagccgcatgtggtggcgaaaatcgagcaaacggaaacctgggtggccttctttgaagataccgaaggaaataccctagctttgatgagtgaggtgaacatataaaaatgaaaaacagctgatccctcagctgtttttcgtttttacatcatcacaagccgattgacaggtgcgatttaattcacaggcggcgcattttcctttccggcttcgtttgacaaattttataagcgtccatgccgcataactaaagataagcgctccgatcgtaatattaaacagcatgctgtcacatccttcctatgataacccaagcagtcgtccgccctgataaatcaggaacgcgatcgcatatgcaatggccagtccgtaaacaatggacaagaacatccactttttcgagtttgtttcttttttaatcaccgctactgtcgcgaggcatggtacgtataaaagcacgaaagccataaatccgtaagcggccaacggtgtaaattgttcagccatcatgccttgcagctgggcttcgggtacaaaatagatgatgctcatcgaagcaacgacaacttccttcgcgagaaaaccggttaatagtgatgccgctgcctgccatgtgccgaatcccagcggcagcaatagcggtgcgagcactcccccgatcatcgctaaaaaactgtcatccatcgcaacgtccgttccgccgggtcccgtatacgacagaagccaaatgaggacagacccgccaaaaatgtaagtgccggctttgcggacgaagcctttgcccttctcccatgttgcccgccacaatgtacgcgcttgaggcaaacggtacggcggcagttcaatcacgaagaacgacttttcttctttgagcttggatgaggataaaaacttcgccagcaccagcgctgcggcgatgcccagcacatacaaggaaaggacgacgaaagcctggtgggccgcgaaaaaagcccctgcaaacagagcataaaccggcagccttgccgaacaggacataaatggcgtcagcataatcgtcaagagtctttccttaggctgctctacagtccgcgcagccatgacgccgggaacattgcagccgaagccgataatcagcggaataaaggctttgccgtttaaaccgatcgcctccatcaggcggtccatcaccatggccacacgcgccatatatcctgaatcttcaagcaccgaaatgaagaaaaacaggataaagatctgcgggacgaacacgagcacaccgccgacaccggcaataatcccatcgagaataagcgcctcgataaacgggctggctcccattgccgacagcgccgaggccgtccattccgtcagcggtcccccgatgaaaccgtccagtgcatcagacaatggaacgccaaaccaatcaaacgtcagcatgaacatgagatacatgaacaacaaaaaaatcgggatgccaagcacctgatgcgttacgatctgatccacgcgttcagtcagcgtcagttttcgctctgactgatattgcacagaagttgacaagatgcggtcaatccatcgcgatctctcattgtaaatatgctgatgcagcgatcttacggaatgctcctgatgaaggcgtttttcggtctcctcgtaaatttcctttaatctttcgctgtcggccgcgtcctccagctgttctttcattttcgagttgccttccaaatattgaagggccatccagcgctttaaaacgccggggagttcgggtatgatcgattcgatccggccaatcgcttcttccactgcgcttccgtaattgatgacgagcggctccgccctcttttccttttcaaaaagcaaatgcctgctcagttcatcacatcctttgccgctgcgggcaatcacaggaattaccggaacacctagcgcatcagacattttttgatgatcaatgaagacgccgcgctgtcctgcgacatcgatcatatttaaaccgatcgtaagcggatgcccaaattccaggagctgcacggttaagtgcaagttccgctttaactgtgatgcatcgacaatattcaatatatctgaaaatgaatcattgagcaggaagtctgtgacaaccccttcatcgcgggacagcggactcaatgtataaacaccggggagatcgactatcattccttgtttatgacggagcagccccacctttttctcaacagtcaccccgctccagtttccgacatactcataggagcctgtcagcgcattaaacaatgacgtcttccccgtattcgggtttccgaaaagggcaatctgccggctgttcatagcttttcaatcctgatcttttttgcttctccaagccgtatgccgagacactgcccgcctgactcgaacatgaacggaccgccaaacggcaatttgcgcttcacgcaaatttcatcatcttctttcattccgagctgtatgagtctgcgctgaacaagttcattcacgtctgaaaaatctatgattcttgctctctctttttgttttaattcggctaaaaccatcgttgaggcctccgtattctgaaaatgataatcgttatcataatatgattataggcaataagtcaccttccatttaaaaggagatgtgtcaaaaccggaacatttttatgagaatataaaaaagcgaaaaaccccggcgatacaatctttcgctctggcttttcgctctatcaagttatgtcgttaacctgcatgatggcgcactttttgctccattcgcctctttttcggcacataaatttttccgacaaacatatagccgtacttcaatttattgacggcccaggatatgaaaaccgcagcgcctgtagaaatgaaaaacaaaagcaaaacagccgataccgtaccgatgctgtcaagggcggttaagatgaccaacccgaaaatcaggataaaagcgtgcagtaaataaatagaaaaagaatagttgctgatcatcataatcagcttcggtaccgacttcagttttgaaaacaggtggaagcataagaaaatgatgcttgtcgaataaagcaggatatccggacgctttgacgtcaccgcgatgtcttggccgaagtaggaaaccgctacaatgaaacatccggtcacagcagccgccgcatacaccgcatgcctgtaccgttccagcaatgccaaaaagcgctcgtaattcttgccgcaataataggccaaacaaaagtaaaagagccagccgggaaacggcacccacgaaaaaggaaacggcgcctcctcctgaacgaccggaggttgaatgaacgtgaaatagctcaaataagccgctgtgaccgcaaaagaaatcgaaagcacccatttaggcgaagccttttgcaaaaatgaatggaagcacatgtgcagcaagtaaaattgaaaaatgacgagaatgaagtaaccgatgaaattccccaagaatatattcgccaacagttttttaataatgaccgatgcatgaaattgctgcatcatcagacctgcggtcataaaagcatccaaaacagcgataaatagaaaagggatgaaaattgttttaaaccgcttttttaaaaacccttccggaacaccaccaggataggcatgcgcgagcaaaaattcggaaatgaaaataaacgccggcgtactgaacatcaggagcgttctgaaagattcaacaacccggaaaaccgcatctccgagcatgtccgcccgcaccatgagcaccattgatatcgcatgaagcaaaacaacgcttaaacaggagatgcagcgaatgacaaaaatttcttttacttgcaaatcgatcactcctctttcaaatttgaaataatatcaaattaacataatcatccaaatgaaggaagaggcaaaatacataggtatgtttatcccaaatttgccggctgcaagtataaaaaaaagattagacacgtagtctaatcttttttaaatcgccgcttttatctgttttgtatagtagaagcggacgatgaagtaatatatgacctggatggcgaagaacacgccgagcaccattgcagattccttgaagaggttgtactgaaaggcatgcgataaagcggtcagcgccacagctccatggacaagggcaacagcgataggcgcgaagaacaagatgccgatctgcctgttcagcactttatgcagttcgcggtctgttaagcccattttggcaatcgatttgaatttctgcttatcatcgtccaaatcagtgtacaaccggaaatagaggaagcttcctgctgaaacgaagaagacgattccgataaacagtccgacaaataatatcgggccataccctttgcttatattatatacctcataatctacagccccgaaatacatgtaatccagtttcttttgcaaagcctccccggctttcactaaagccatgccgtcagcttcttttgcctgccatgcatagaaccggttttcgcttttcggttttttcagctgtgcgaaatctttgtctgtcacaatataatagctgggttcagataacgcttttgaacggatcgtttgatcagccttcagttgttttccatttgcaaaagggattgacgaagggagctgctggtcatcatctccctctaagccgatcttgacctcatactcggcagccgccgcttttccgtcttcaagcttgacgtggtcggctccgacgagatcggcaaacttgttatagtcagattctttcacaatcagcatgtcattgccgccgacatcgaaatattgaaggacagctgaagctttgtctgttttgatatttctttcatccagtgtgtcattgatgaaagccacgtctttttcgatgtgtttgtttgtttccggcggcttatatgagaacgtatgcgggttcatctctttaattccgtttgtcaccagagtttggaaaccgtacagcgtcccaatggcgctgaatgcgacagtagagataatggccaccataaaaaacgtccgcgaattgtctttcatcctgtaagacagatcagaaaacaaaatcatattcgttttccgccaaaacagggtttcccgttttttgagcctgcggatcacataaacactcagctgcgtaaacagcagatatgtgccgataatgacaacaatcgtcaccggcaccatcgccacaagaacgcctccttctttgacaatcaaagcggtgtaatagcctccggcaagcagcacagcagcaaccagcgtaagcaaggcagatgctttcggctcccctttggagattttgttcccttttaacagaacaatcagcttctcgctcctgagcacaaacgacacaagaaaagagataaataagaacagaccgttaaaagaaataaacgtcacaatcatcgccatcaacgggaagtaaaaatcgagcttgttatcaataatcaggacattttccgcagtgagcagtatcaatttggcgaagacgagcccgagcacaatcccgccgattgtcgcaaaaaatccaatcagcatattttcaagaaataccatcatgcgaatttggcgcatcgacatcccttgaatcattaaaacgccgaattccttttttctcgattgaagaaatgaactcatcgagtacagcacaaagaaaaaagagaagacaaaaataatgccgccggcgaccagcaggccaaaggatgcatgctgcccgatgccggaagtcaaagaatcactggtcatcaccgggtggaaagcaaaaatcgcaaatgcgaaaaaaaccatcaccgtaaacatgctgctgagaaaataagcggcatacagccttttgttgcgaatgacattgttaaacgcgaactgacgaaaggtcatttgcatcccctcccaacaaggacagtgtatcgagaatcttttggaaaaacgcttggcggttatcgccgcggttgatctccgaatacagctttccgtccttaataaagacgacccggttgcaatagcttgccgcctgagggtcatgcgtgacaagcatcatggtcgctttttcattgcggttgatcgactcaagcatttccatcacatctttggatgactttgaatcaaggttgcctgtcggctcatcggcaagcagaagcttcggcgaatgaatcatcgctcttgctacagcggcgcgctgggcctgaccgcccgatatctcatatgtgcgctttttcatgatctgggtaatcccgagcttttcggccaattcgtttgccctccgcttcatttccttgaccttttcgccgtcaagcgtcaaaggaagtacgatattttcttcaacggttaatgtcggcagaagattaaagtcctgaaacacaaatcccagctctctgcggcgaaatttagccaatttttcttttttgagaacatgcgggttttggccgctgatcaatatttcgcccgtcgtcggctcatcgatcgttgcaatcatatttaatagggtcgtttttccgcttcccgacggccccatgatcccgacgaattcacctttatcaattgttaggttaatatctgttaacgcgcggtacgcaatttttccttcgtaaatcttactggcttgtttgacctgaagcatcacaagatctcctttcacctttaactttcgatctgtgaccagtttacctaaatctcttgttgatgaactatcgattcttctttcactttcattacatcgatgtaaggttttgcgtagccgtgaaaatcagccgaattgtcgtgcctttcccttcttgtgaatcaagttcgatccggtggccgagctggtcagccgccgattttgccaagtaaagacccattccggtcgattctctgaaacggcgtccgttttctcctgtgaaaaacgggtcgaaaacccgcttttgatctgtatccgggatgccggcgccgaaatctgccacttccaataccgcttccgaatcattttcgtatacagaaataatgactgtattgcttttccccgccgaatatttgaccgcattgttgacaaactgggaaatgatgaaaaacagccacttttcatctgtttcgacggtgatgccttttttgatttctttgaacttaggataaacttgactgcgaatgtaaaagcgcttattttcgcgattgacctcgtgaacgatatccgccaatgcgaccggttttatacggaaatcctgttcgatcgtccgcagtctggccatatagagaatcgtattgaggcccgttttcatccgctcggtctcctcgcggatgctggatgattccggttcatccaaattttgagccgtcagttcgatgaccgacaacggcgtcttcatttggtgcacccattgatccatgaaagtcaaatgctctttttggccaagctccagcttctttaattcttggcggtattgcttgtactggcttttcagcagctgttcaagcgcttccgacaaaggggattggggctgattcgattgcctgaaggtgtcatccaatgactccagcccgctcgtcatccgtttgtagaacttccggcgcgtatagtaatggtagaaaagatagaagccaagaaagaaaaagccgagaaaaacggcataaaaagccggtctgatgtgctgatacccatcaagccagtacactgacagcattgtgataaactgcagcgcctgcacggcaatcaacaaatagtgctctttgaaaaaaagcttcattcctctcccgccttcacccaggatacattcaagcgatagcccgcgccccgcactgtttccactgcatcttcaataccgagctcctgaaatttttttctgacgcgcgtaatgttgacattaagcgtgttttcatccacatatgcctgatcatcccacagcttggccagcaaatcttcgcggcctgaaattctcggatggcgttccattaagctttcaataatatccgcttcttttttcgtcaaagcagccgtttgaccggcaaatgtcagttcaagtctttccggatacagccgcagcccttctttttccagcagccgttcctccgccttcgccgcgtattcgccgtaagccctgcgaagctggctgcgtatttttgccatgacgatctcggcgtgaaacggcttggtgataaagtcatctccgccgttttccaatgccatcacctgatccatttcacctgtccgcgcagaaataaacaagacggggcaaatcgattcctggcggatttgccggcaccagtagtagccgtcaaagctcggcaggttaatatcaagcagaacaagatcaggcgccgtgcttctgaactcatccatgacacggtcaaagtctttcactacatgaacgttgtatccgtatttgacaatatgcgattttaacaaatctgcaattttcgggtcgtcttctacaatcatcactttttgcatctcggtctctccttttggtttggatatattatgacacgaagcggtctgataaacaaaaactgccgcgatccatcctaccttacaatcatgtaagtgtattgtaataggaatcaatatcttctctctgcgcttttttataaaataataccatccacaaaactgaatgaaagaggagacggtatatgaagacacgggcgggcggcctgattgccgcggttctgatcgccgttgccggcgtttttatcctgcagaaagcgacaggaggccttgtgccgctggccgatgattatatacaaggccagggaaagcctgaggcttattatctcaaagctgaggatcatgcagaaaagccggataacggaaagtacaactacacattaaccggctatgacgcgagcggacacaaacagcagattgaggcagaggcagacgaaaaactgcatcccggcgctttcatcaaagtattggcgtacggaacgaaagccaaaagcttgactgaagtacacgaagaagaaatccccgagggcgctttggctgccatgaaaaccaattaaaaccccatcgccggatggggttttctgcttaatatttaaatcgattgataatggtttgaagttcttcagccaattgggacagcgattccgctgcatatgagatttcttccattgaagccagctgctcctgggttgaggaagcaaccgcttttgtgctggctgacgtttcctgtgatccggaagccaatgtttgaatggtgttttgaaccatttcgacacctgatgtcagctgctgagtagaagccgcgacttcttggatttgagaagcaacctgttccaccaagtttaaaatttcgttgaaattaccggtcgtctcctgcgacaaagctataccggagctgacattttcttgaacgactttaatattatttaccgtttctaccgattcattttggatcgttgtgaccaatgattgaatgtggctcgctgacttattcgtttcgtccgccaatttccggacctcttccgccacgacggcaaacccttttccttgctctcccgctcttgctgcttcaattgccgcgttcagcgccagcaaattcgtctgctccgaaatatcggtgatgagcgaagaaatgttgctgatttccgccgtgctggacacgagcgcctgcaggccgctgccggccgagtcgactgacttatcaatgaagttcatttgttcgagcattttatgaacggactcggagccgatttcggctttgtctctcatcgaagacgacagatccgctatgctgcctgtattggaggcaacggatgataaacggtccagcaattcatgaattgcttctgaactcttttctgtcatttcgctttgcgtcatgttgctgtcggcgatcgcctgcatctcttcggaaatcagttcggaagtcgatttcgattcctccgcgcttgcggacaactgttcagaggatgcggcgacttgctcagacgagctgctgatctgcttcacaatttgcgtcagcgactggacaaaagcattgaaagaattggcaagctggccgaactcgtctttatttttgacgatcacttttttcgttaaatccgcctcgccgtgggcgatgtcctcaagctgctgattcaggcttctcaacggtaccagaatagacttcaagagcagcagactcaaaacaattcccaatatcgctgatactcctgtgacagcgatgatgacccattcgctcatcgtcccattggctctgatctctgctttcagatcatccacctcttgttccaggctttcgaccagctgattgacagacggatcgaggacatcttttcttaatgttctttcctctccgaaatggatcgattccgcttttttaaggcttgaagcgtaagtctgcatgacttgttgatttaaatcccaataagccttgaagttttctttaatttcttcgacgttcgctttgtatgatttttcccggatcagttttccggcccggtcaagactctttaaaacatcgtcggccttgtccttcattccttcactgtattcatcgtctccggtcataataagggctctctcgtcattcgacaagccggtcagacggtattgaatatgcttaatctctttttgaaattccatcttgtccttaagttcttcattctttttcaccgtagaagaaatcataaaaacagaggagattccgattccgaggattgaaacgactagaattgatatgattcccagcagttttgttttcactttcattatggtgatcctttctcctttatgtcatcaatgatgaaaaacagttttcaaatcaaacatcttcttccctccatagtatcgacatatttcgtcaaaatttgagaaggtgcagaatataagccgaagaaaaagctctgccgggaaggcagagcttttaatgaattggtttacttggcgggcccgccgatttggtatgttcatagaagtggtgaaaataatcatttgtctctgctttgatgactttccaaagcagcaggatggcgatcaggtttggaatcatcatcagcgcattcgccatatcggcaaacgcccagacggtgacgaggttggcaaccgtcccgatgccgcaggcgaggatgtagaccagcctgtagcccgcaattcctttggcgcctgccaaatattcgaagcacttttctccgtaaacataccagccgacaattgtagagaagccaaagaaaatgaccgacagagacacaatgtattcgcctgccgcgccgagtactgaagcaaaagctgcgcttgtcaatgccccgccttccaggctggcattatgggccacgcctgatatcaagccgccggacgggtcccagaaaccggtaatgataagggttaaaccggtcattgtacacaccacgatcgtcacgataaatgtcccggtcattgcgacgagcgcctgttttaccggatggtctgcgcgcgcatttccggcgattagcgccgccgtcccaaggcctgcttcgtttgagaaaataccgcgggataccccgttccgaaccgcttcagatacggcaattccaaggaagccgccggctgccgctacagggtggaaagcataataaaaaatcagcgcaaaagccggaataatcttgtcataattcaaaatcagaatcaagatcgccccgcccatgtaaagaaaagccatgatcggcacaaagaagctggcaacggtgctgatccgctggatgccgccgaagataatgacgctgacgagaatgacgagaatcagccctgtcacccagttttcgatgccgaagctgttcttcgtaatatcagcgatcgtattggattggacactgttgcctatccccaaagcggcaaaagctccaaacagcgcaaaggcgatggcgagtcctttaaatttgcggccgagtccgtgttcgatataatacatcggcccgcttgaatattcccctttttcattttttacgcggaatttaacagccagcaaggcttccgcgtatttcgttgccatccccaacagcccgacaacccacatccaaaagatcgaacccggtccgccgagtgtcaatgccgtcgcgacacctgcgatatttccgtttccgatcgtagcggcgagcgctgtcatcaaagccttaaaatggctcacatccccttcggcagccgcgtctttgctgtcttctttgccaaacccgatcttaaacgcatagatcaggcggcgaaattgcagtccttttaaaacaatcgttaaaaataagcctgtcccaaataataaaattaaactgggcggcccccatagtaccttattaatcttgcctagtatttctaagatatccatatgactcactcctgacaaagataacgctttcatagctgcatgagatattctatcacaatggaaaatggttatgtttgtgaaacgacacaaaatgtaatcgcttacatttgtttttttaacaaagctattttttaaagaaaaaaattttaatagataacttatctcctcaagcctttcaccttattcaacgttcaccaatttgttaaatttcacaaaaaagcgcttacatttttaattttacacacgatgctcttcccgattcagagatttatactagcggtagaatcatatttcatttgagggggacgacatcatgatcattggaattcctaaagaaattaaaaacaacgagaaccgtgtagccattactccggccggagtagtcgcgctaaaaaaaagcggtcatcaagttttaattgaacagggagccgggcttggaagcggattcgaggacgccgactacaaagcagccggggcggacattttggctgaagcgaaagatgtgtggggaaaagcggatatggtcatgaaagtgaaagagccgatcagctctgaatacggctatttccgaaaaggacttgttttatttacttatctgcacttagcggctgaacctaagcttgcgaaagcgcttgtggacagcggcgtcacagccatcgcttacgaaacggtcgaagtgaaccggacgcttccgctcttgactccaatgagtgaagtcgccggacgcatggcttcgcagatcggcgcgcaatttcttgagaaatcaaaaggcggcaaaggcatcctgttatcgggcgtacccggtgtaaaacgcggcaaagtcacgatcatcggcggcggagtggttggtacgaacgctgccaaaatcgctgtcggacttggcgctgacgtcactttgatcgacttgagcgctgagcgcctccgtcagctcgatgaccagttcggcaaagacattcaaacgcttatgtccaatccgctcaacattgcggaagccgtaaaagactcagaccttgtcatcggcgccgtcttaattcctggtgcaaaagcgccgaagcttgtcacagaagagatgatcaagtcgatgtcgccaggttcagttgttgtagacgtggcgattgaccagggcggcattatcgaaacggttgataaaatcactacgcatgacgatccgacttacacgaagcacggcgttgtccactatgccgtcgccaatatgccgggagccgttccccgtacatcaacgatcggcttaacaaacgtcaccatgccttacgccttgcaaatcgcaaataaaggcgttgaacaagcagtcgccgaaaatcaggcgctcgctctcggcgtcaacgttgcaaacggaagcatcacctacaaggccgtcgcgcgcgaccttggatatgaatatgtatctgtagaagatgcatttcaaacggtaaccgctggttaagcggattttatctcttgagaacattttaacaactctttctgactgtcctttcacgaaaaaaggctggatgatatccggccttttttccattctgctttaaacattcaaggccgctttccggcaaacggcgtcgccttcatctaagaaaccggccacaagtcaatttttgaatggtgttcccgtatcaacatattgaaacacatgaagcgacggcaatggacgtcctttaaaatcaaacaatgcctgattgtctacggcgctgccgccaaaccactttcctgcgtcttccgggtcatattcagcagcatagcttgtagcccagcctgatccgtatgtctcccaaagcgctttatttttctcgagccggtgagccggtcctaccggaatccatgccggttcccaatagaaaacgccgattccggcttcacctacgtcgctgaccgcttgaatcacatcacggaccgcgttcgcctgcccttgaacggtgaccggattattcagcgtttggccgtttttcggagctgtatttccgtgtccgtctccgtcttcagccgtatacgtataagatgtctcagcaaccatgacttttttgccgtacgtatctgcgacagatgtcaggacggatgttaaattcttcagcgtgccatgccaaaacggataatacgagcttgcaaacacatcgtagtctacatgatgccgatgaagcgtctcggcaatccaagcgtaccttcctgacgtctccggattggtaaaatgcaaggcgactaggatattcgaatccgtctctcgcaccgcttgactcccggcgttgaataattggctcatcttcgcccaatccgtttcaccggcaaggcccccgtttgtttcgttaccgacctgcaccatgccgatgtcgatgcccgctgctttcatcgctttaaggctttgttttgtatattgataaagcgccgtctttttatcttcaaagtttaggttcgcccatgctttcggcgctttctgtttcgccgggtccgcccagaaatcggaatagtggaaatccgccagcagcttcattccgttggcagtggcccgttttccgatctgaatcgctttttccagatcattattgccccctccgtagccgttgccgttggcatcatagggatcattccatatgcgcacccggacataattgacgcctgcttccttcagcgttttgaatatatcctgtttctttccggattcattgtaaaaggcgacgccgctctcttccaaagcgatgatgctcgaaacatcaaccccttttataaaatccttgcgaagccctgaaaccttttcaacataaaggccgctttttgccgtccctgaatctctggcggcttccgccggaccgcttgttccaaatgcgcccaaaacaaatatcagcaccacaaaaacagccagcacgttcttcatcaatctcgcttctcccctttcataatagacacacaagcaaaaagaaaacgctttcattattcacccggagaaacatccaccttaaagcggatgtcctcccaggcctattcttttgcttttaccgctattctggcctcatatttttccaatgtgacttcgccggccagcgtttctccggtcagcatatctttaactgccgacgccaacacgacgggctgacgtttttccgtgaaattcatgatgaaaatatagtcattttcctcatcctgtctgacttgaacggagacgccaggctgatgtttcacgtcaagagccggttgaatcgctagctctttaatcaatgttccataaaaatcccgatgaaattggctgcttaaacgcgcaccgatataatacgttttcccctgtttgtatggatggctcgtcacagccgtcgtgtccgcataaaagtcgtcctcatagaatccctcgggatctgccgtactgagcttcagcacggtcgcgtaatctttcagctcatacgaccggttttgataacggaccgcatttttatcgcccggatagagtgtatcggtttcaacaggctccatgccaaacatctcttgcagatcttttggccatccgcctaaataggtcagatcagattcgttgacgattccgctaatataggtcatcaccaatgtgcccccgttggcagcaaatgcctttaagcgcgcgattgtttcttcgcttgctaagtaaagcatcggaacgatcagcagccggtacgatgaaaaatcctgttccttcgtaatcacgtcgactggaatatcacgctcccaaaacgcgcggtagtgctcgtgcagggtttggggataccgcttggttttcatcccgaatccttgtgcatcttggagcgcccaatggttttcccaatcgtagagaatcgcgacatccgcaggccggatcgttccggtgacttcagacagcgcttcaagggtttgcccgacttttgccacttctttaaacacgcggttctcggaacaattgtcatggccgacaaccgcaccatgaaatttttccgatgagccgcgggatttccgccattgaaaatagaggatgctgtcagatccgtgtgcgatcatctgcacagaagacaggaggtgcatgcccggccgtttcgctttattaaaatcgtgccaattgacagcgcttggcgtcgattccattaagagaaacggctgctgtttcaggctgcggtacaaatcattgataaagccgactttcatggccaaatctgctgtgctttcccaatcgttgtgccaggcgggatacgcgtcccagctgatcacgtccaggtgcttggcaaacttgctgtagtccagcccttgaaacggaattaaatcatgcgtgtccgccataaaattggtcgtaatcggaatattcggcgtgatttcctttaacggaacgatttcattttgaaaaaaagagatcgtctggtcagtgacgaagcgtcgccagtctaaattcaagccgtgcaccgcattttccccgatcggagacggcgattcaatctgtgaccaatcgttgaaggtgtggctccaaaaaggcgtccaccatgcgtcattcaaagatttaatatcatggttgtacttctttttcagccagtctctgaaggcgtgctgacattgatcacaatggcattctcctccgtattcgttggaaacatgccacatcaaaagggcatgctggctgccgtacctttcagccagcatgcggttgatctctttcgttttttcacggtatacgtatgaagtgaagcaatgattgtgccttccgccgtgcagctgtttgacgcgttcagcattcacgcgcagcacttccggatacttttgcgacagccaagcaggacgggcgccgctcggtgtcgccaatataatccggccgccgttccggtgaatgctctcaaaaatatcatccagccattcaaacgtatagacgccttcctccggctcaagggcgctccatgaaaaaatccccactgaaaatgtattcgtatgggcaagcttcatcagcttgatgtcatctgcaagaatatccggacggtcaagccactgatccggattgtagtctcccccgtgaagcatgtatcttgcttgggtcgtataaatttttggcataatactctccttttttagaccattttctccttcggactatcctttcgttccgcctgccgtcaatcctgacacaaagttcttttgcagcatgataaagatgacggctaccggtatgctgatcaaaatagcgccggcggcaaacgtcgtatagctggctcccatcacctcattgactaaattgtataaaccgatcggcaatgtatacgactccggtgtccgcaatatcgtcgaagacaaaacgaaatccccgagcggcccggtgaatccgttcatggcaacgaccgcgatcatcggtttggatagcggcataataatctgcaggaaaatccttgtattgcttgcgccgtcaatcttagcgctctcatccaaatcgatgggaatggagtccatataccctttcatcaaatacgtgttcatcggtatgagcccgccgatgtacagcaaaatcagcagccaatggctgttcatcattccaagcatctgcgctaaaacgaagagcgcaaccaaagccgaaaattgaggaatcatttgcagcagcaagaataaaactaaagcgtttttccttcctttaaaacgaaaccgtgaaaaagcataagctgtaaaagaaacgctgatgaccgatccgatcatcgtaaagatgctgattttcagcgagtttatataccattgcccgtattggaggctctctttgccggcgaataattctttatagtgatccaatgtcggatttgccggaatgatagaagtgctgaccaaactgttgccgggattaaagctgacccccaccgtccaaagcagagggtatatgataacggctgtcataaaagccaacagagaataggtcagaaggagccgaaagaatcttcttttcttcatacgttaagccccctctttgaaagaatttgtccgtctgaactgccacagtgcaattgagatgacaaagaccgacagcaggatcgtcaatgcggcggctaaagagtactggctcgactgcatcgtcaatttgtaaatccaggacaccaggatgtcggttcctcccgctgttgacccgggaacagccggaccgcctccattgaatagataaataatattgaagttattaaaattaaaagtgaattgcgtaatgataatcggcgccatcgcgattaaaatcagcggcagtgtaatatgcctgaatttcgaaaacgcagacgctccgtcaatcgtcgccgcttcataaaggtcatccggaatcgactgcagaacaccggttgttacaatgaacacatacggaaatccgagccagccctgcataagaataagcgccagcttcgtccaattggcattcgtcatccaaggaatcggatcgatgccgaatgcggcgaggatttgatgattgaaagcaccgaagctgtcattaaaaaggccggcaaacacgagaatggtaacaaaaccgggcacggcccaaggcaagacaagaatcgtccggaaaatttttttaaagcggacttccttctgattgacgacaaccgccaacaaaattcccaacccgacttggagcgtggaagcgacaagcgtccaaacaatggtccaagctaaaacatccaaaaaggtcgaccgccaaatatcaacggtgaaaatttcggaaaacgttttaattcctacccaatcgacaaggcgggcaggcggagaatggtagaggttatagtttgtaaaagctaatgcaaagctgaacaaaatcggaaaaacaacggcaaaaaccaggatgaacagcgatggcccgctgatgagatacggatatccctgagctattaaattatgatattgttccttgagtgaactgagctccttttgttcatcgcgcctctttccgttttggtaggcgtcccgcaaattggcgtaatagacagccagcccaaaacaggtgacaatcacagcaataatgccttttgccaatagaaaaatcgagttgtcgcgcggcacttcggttccaagcgtaaacaggccccacagccccatattcagcaaatcgccaaaaaccgcaaagaacgagacgcctaaaagaaggaataacagaccctttatccattgtttattgtagaattggcccagaccgggaataattgataatagtaaagcttttttgcgatgctgcaccttctccttcacctctttatatggacgtgcttataataaatggcgccaaacttaagacaagtttgacaccaccgcccgcggcttatttgctgccgctgtgcttcgctttgatctgtccttgtatcgtttccgcggcttgatcaagcgcttttttcggttcggcttttccggttgcaattgtttgcagagccgcatccgccggcgtccatacttcattcatctcaggaatattcggtgtcaactctgagtactgagattgctcggcaacggcttgagccgcttcgctttttgtgacggcaggatcatccgccagttctttgactgcgggtacttcttttgtgatctcatatctcttctttgagttttctttattggcgaggaagacgactaattgttcggctagatcggcattcttcgaataagcgcttacattgtagctcttcacgccgacaaaagaactcatatgcttgccgttggacagtttaggcagcttggcaaccccgtaattgatacccgcttttttgaacggttccaggttccacgggcctgaaatgatcgctgctgcttttccttccgtaaacagcgattccagcacattgatgccctgctccccaataattccggcagggaacagcccctcttggtaaaacttctgaatgtactcggcgccttcgactgcacctttgttgttcaagcctaggtcggccggatcataagtgccgtcggcatcgcttttaaaaatgtagccgccgtaccctcccatgacgctctgtgcataataaatctggtcaaacagcgccaggaagccgaattttttgccgtcagccgtttttttggaatactcataccattcatccagcgttttcggcagttctttttcagaaattaaatctttattatagtagagcatcgtcgtttcgaccgctttcggcaggccgtagaccttgccgtttgtcacctgcgatctcatggcaggttccgtatagatcgattggatctctttgtccacctttaattccttgatcaaaccttccgttaccgctgtcccgatttggtctccgggcatcgttaacacatccggacccgttcccgccggtccatccatccgcaagtcttcgatctgctttgcgtaaggcttttcaacgactttgacagatacgccgtgctctttttcaaattgggcgacggcatctttaatgccttcgcttttctctttatcttcccagaccacgagttccttttgcttcgagtctgatgctccattgctgctctctttaggcccgcaggcagttaaagacaaactgagagcaatgacactgctgattccaacatattttttcatattcatcatttgtctcattccttttattggagtgaaagcgctttacaaaaacaatatagcatgtcttaggaaaagtgtaaacaattattttacttacacaggtaaaatgttttacgaaaaaaagcgcggattgtgaacagcagcccgcgcttttttaattggtgcttttcctgaccaccagttcggcaccgatatatagcgtttttacagcttttcttttttgaagtatttgttccaaaagcaattcaatagcgtttttgcaaagctctttaatatcgatatggaatgtcgtcagcgggggagatacgtatttcgctacactgatgttgttgatgctgatgatgctgactctgcccgggatggcgatccctttttcatttaaggcctgaaggcagcctacggcaatcggatccgccgctgtaaaaaaggccgtcggcagcttttctcccaatgtttcaactgctttgtccatcagatggtagccgttttccaccgaaaaacccctccggcaaaaaataaagctttcctccaagagccctttttccttcatatattcgcgaaacgttcgttcccttacgtccatttcgtcttcatctgtattggggttgtggtacgtacctccgataaagccgatcttttcatgccctttctcaatgagaaaatctaccgttttcctcgtcatctgctttaagtccggcctgactgaatcaaagtgattcggatcaggcgtcgaatcgataaatacaccgtgaggcgtcatctgtcttaatcggattaattcatcatctgaaaacgagccgacggcaatgaatccttctatgttttcgggaatggcgtcaatgcctcccgaaattttatacgttgccagttcgacgttgaattgctttgcgagcttctcgatttccagcctcatcgttttaaaatacacgtcttcgagctcttccttatccgtcagccagtacagaaacgcgatgttttttaccagtgtcctgatcgttttcttgcggtagttcaggctttccgccacttcaaattttttctcccgcgtctcatcgggtacggaaaggctttcgtcgttattcaatacgcgggaaaccgttgagatggaataccccgccttttctgcaacatcttttatcgtcgccacgattgtaaaacctccatatgaacacctttattttaaatatcaaattttttagtaaaatattttactaatttaacgttgatttgcgtaaaagtcaagtgctgattgccctatccccgccaataaggattttacatgaaaacgcttcatttgaaaaaacactttttattgcaccaatcgaaaacccgtagtaaactggggttgaacttaattaaattaatttattaagtctggtacgtcaaacgaataggaggatatatgaatactgcagccgctttatcaaacgactttcgttctatttttaagacagaaaagacaccgcgaaccttttttgctccgggaaggatcaacttaatcggcgaacacacggattataatggagggcatgttttccccgcctcgatttcatttggcacctatgcccttggcgtgaagcgcgatgatcaaatgatccgcttctattcaaagaacttccctgacaaaggaataattgaatgcagcttgagcgatttagcctttgaccagtccgacggctgggccaattatccgaagggaatgttccttttgacgaaagcggcaggccatcaaatcgttcacggcgccgatattttgtattacggaaatattccgcacggagcgggcctctcttcttccgcatcgattgagcttgcgacaggcgttttgttaaaagggctttatgatttgcagacagacacgatctccatggtgaagctcggacaaaaagtcgaaaacgaatacattggcgtggggagcggcattatggatcaattcgcgatcggcatggggaaaaaggatcacgcgattttgctagactgccgtacacttgattacacatacgctcccttcgtgttgaaagaacacgatgtgatcatcatcaatacaaacaaacagcggacgctggccgggtctaaatataatgaaaggcgcacccaatgtgaagaggcgctcggcgatctgcaacaggagttgtcgatcgcaagcctgggcgaattgacgatggaaggatttgaagcccatcagcacctcatcagaaatgaaatcaatcaaaaacgcgccaaacatgctgtctacgaaaatgcccggacgctgaaggcgcttgaaaaacttcgcgaaggcgacctcgccggatttggcaagctgatgaatgaatcccatttgtcattaagggatgattatgaagtgacggggctggagcttgatgccattgtccaggcggcctgggaacaagacggtgtccttggcgcccgcatgaccggcgccgggttcggcggctgtgcgattgcgattgtagaaaaagaccggacagacagctttaaagaacgcgtgaatgccgtctaccgcgaaacggttggctatgatgccgctttttatactgcggcaataggcgacggcgccaaagaaatatagaaaggggaatggatatgagcgtgttggttttgggcggtgccggctatatcggttcacacgccgtgtaccaattaatagacagaggcgaaaacgtcgttgtcgttgacaacctcgagaccggccaaagacaggcagtacatcctgatgcgatcttttatgaaggggatgtgcgcgatcgcgatttcctccgcacggttttcgaaaaggaacgtattgaagaagtgatccattttgccgccagttcacttgtcggcgaatcgatgaaagatccgctcaaatattacgacaacaatgtatccggaacacaggttttgcttcaggcgatgctcgagcacgatgtaaaaaaaatcgtattctcctcgacggcggccgtctacggagagcctgaatcgttgccgattacagaagacatgccgacaatgccgacaagcacctacggggaaacgaaactgatcatggaaaagctcatgaagcggactgaagaagcccatgggatcagctttgtgtctctcaggtacttcaatgttgcaggggcaagggagacgggagaaatcggagaagaccaccgtccggaaacacacctagtccccctcatcctgcagaccgctctcggccaaagaccgcatataacgattttcggcgatgactatgatacgcccgacggcacatgcatccgcgactatgttcatgttgaagacctcattgacgctcatctgtcggcattagactatttaagaaaaggcggcaaaagcgatatattcaatctcggcagcagcgaaggattttcggtgaaagaaatgattgatgcggccagaaaggcaaccgggaaagacattaccgccgagatcggcaagcgcagagccggcgacccgagcatcctgattgccggctctcacaaggcaaagcaagttctgggctggaggccttcgcgcacatctgtagcaaagattattgaagatgcatggaagtggcattcctcgcatccaaacggttacaggaaggaagtgtcaacatgattgaacaagacatagccggactcattcaaaaagcgcttgaagcagggtttatcgaaccggctgacgtgaactacgcgcgcaaccaagtgatgaatctgctgggcttggaatcgtttcctgaggaagccactgctgcttccggcgactccatcccagaccttttggaaaaactcgcagcctatgcagtcgaacacggcgtgataaccgacgatctagacgcgaaagacatgctggcggcaaatgtgatgaactgctttgttgcaagaccttctgtcatcaatgcagtgttccagcagaaatacgaacaatcgccgctggcagccaccgaatatttttatcagctcagcaaaaacagcaactatatccagacgaagcgaattgaaaaaaatatttcgtatcagatggatacgccttacggcacaatggatattacgatcaatttgtcaaagccggaaaaagaccctgaacaaatcaaacgggagcgcgccgctgcaaaacaatcgcgcagctatccgatgtgcctgctgtgcaaagaaaacgaggggtatgcgggacgaatcgggtatcctgcccgggcaaaccacaggattattaaagtcccgctcgccggagaaaactggtattttcaatattctccatatgcttactataacgaacacagcattttattttctgagcagcatcggccgatgaaaattgataagcttgcctttcacaggctgcttgcttttactgagctgtttccgcattattttatcggatcgaatgccgatttgccgatcgtcggcgggtctattttaagccatgaccattatcaggccggacgatatgagtttgcgatgacgcgcgcggaaggcgcgttctcctttcaaatcaaacagcatccggccatcgaagcttccgttttaaaatggccgatgtccgtcatccgcttgaaaggaactgcgatcaacagccttgttgaagcggcggaccatatttttcagacttggaaaaactactcggatcaacaagcggatatctcggcttttacagatggcacgccacataacacgattacgcctatcgcaagaaacgtgagcggcgtttatgaaatcgaccttgtgctcagaaacaaccggacatctgccgagcacccatacggcatattccatccgcatgctgacgttcaccatattaagaaagagaatatcggcttaatcgaagtgatgggcctggccgtccttcctccccgcttaaagaccgaattggcggcagtgaaagaattcctgctcggtcagtcagatgccgttgaagcgcatcaccgggaatgggccgaacagctcaaaaccgaatacggagagctgtccgaaccggagcaggctgaatcaattgtacgaaaagaacttggcaagaaatttgtcaaagcccttgaggacgccggagtattcaaagaccgcgaagctttcatgcgctttatccgcacagtcaatcatcaggggtaaggcttcaccggtgttaaaataggcgaaaaaataagcttattttagcaccggatcaaacagctccgccagcagcaatgaaacggctccgtaaagcgtcgcttcatcgccgagcttcgttatcgtcacttctgtctgcctcgcttcggctgttaaagctttctgctgtatcgtttctcgtatcgccggcaatatgaacctcccgcccttcatcactcctcctcccagcacgattttgcccggattgacaagatgaatgaaattggtcagcccgattccgatgatcacaccggtttcctgaaaaagttcgatacatgtttggcagccgttctcggccatttcaaacaaatctttggctgtcaggctgtcagtgctttctttcaaccgctttttcccccgttcggcaattgcttttccgctcacaatcgtctgcaggcagccgcggttgccgcactcgcacttttctccattgatatcaatgatcatatggcccagttcacccgcgatcccttcagctccatggtacagttttccgttgatgacgatccccgcaccgacgccgcggccgatattcacggcagccatgctccctgcgtcatcgcggccgccgaaccacgattcgccaagcgccatcgcccgggcatcgttttcaactcttacggttaagttgaattcttgttccagcacatctttgatggggatattggttaagtttaaaatcggtgcgatgcgcgacattcccgtttcagcatcgaccacaccgtgcattgcaatgccgatcccgatgatcttttcttgctcgacatcggcacgtcccaaaatggcatagacactttcttttaaaacttccatgaacctctcgtttgtcagcggttttttcagcaggctggacgtccgctgcaaaatccctccggctaaatcggttaagacgcactccaccgtctcaggcccggcatcaatgccaatgacataataggcacccgtgttgatgtggagcatggtcggctttcttccgccgctcgaacgaccgagcgtgctttctttaacgagtccttgtccgatgagctctttgacgatgcttgagaccgtgggaggggtgatctttgtttccttggcgatctcagctctcgaaatcggctctgatgttctgattttattaagaatgatcgatttgttcaccgatttcattaattgaaatgtaccgcgctgcatgtgaaatcctccatttacaccatatcgtaggttttattgtaccatggttaattaattaaattaacaaacgaaaacaagataggtgtttccgaaggctttgtacaacattgccacagaaatggtcaaaacataaagggcacctgctccctttacttttttgcttcaggggggctttcaaagcgcttctgcaaaacaaatggtttctaaatggaaaaattcttcgaaaaatttaaaatgaaagtgtttgcataatcaaaataatcgcgttatcatacttgtatacaagtatactcgtataactaggaaggtgagtgtatgagcgaatctaaaggccttttatatccggagaagtggctttctagagcttcaactggtgttcgcgtcgcatgcgagctgagaatgcgcattatttccggtttgattgaaagcggtaccattttatctgaaaataaattggctgcggaattctcggtgagccggtctcccatccgcgaggctttaaaaatactggcatcggaaaaaatcatccgtttggaacggatgggggccgttgtcatcggtttaaccgaaaaagaaataggagaaatttatgatgtgcgcctggtgatggaaacattcgtattcgaacggcttggacaggccaatgtcgacgaactggtaacagacctcagcaaaatattggagatgatgaaagtctccatcaaatacaaagatgccgacgagttctcatttcaagacgtcttatttcacgaaacgattgtccgctccatcaatcattcttacattttgatgatatggaacaatctcaaacctgtgatggaaagctttattcttttatccatgcgggcccgcttaaaagaaaaatacgaagactttgaacgaattctcgataaccatgaactttatattcaagcgatcaaaacgaaagacagggatctgatgcttaaatccctacatcaaaatttcgatgacgtacaaggtaaagttgaagatctatggctgtcgcaacaaatgctggcgaaaggagccgaacaacaaaatgactagttatatgttaggcatagatatcggtacgacaagcacgaaagcggttttattcagtgaaaaaggggacgtgatccaaaaggaaagcatcggctacccgcttcacacgccggacatctcgaccgctgaacaaaacccggatgagatctttcaggccgtcatccagtcaacggcgaaaatcatgcagcagcatcccgacaaacagccgtcattcatttcattcagcagtgcgatgcacagcgtgattgcgatggacgaaaacgacaagccgctcacctcctgcatcacttgggcagataacagaagcgaaggctgggctcataaaatcaaagaagaaatgaacgggcacaatatctacaaacggacgggaacgccgattcacccgatgacgccgctaagcaaaatcacgtggattgtgaacgaacatcctgaaaccgctgccaaagcgaaaaaatatatcggaatcaaagaatatattttcaaaaaactatttgatcaatatgtcgttgatcactcattagcttcggcgatgggaatgatgaatctcaaaaccttggcctgggacgaggaagcacttgcgattgccggcatcacgcccgaccacttatcaaagctcgttccgacaacagcaattttccataattgcaatccggaactggcggcgatgatgggaatcgatccgcaaacgccgtttgtcatcggcgcaagcgacggcgtgctgtccaacctcggcgtcaacgcgattaaaaaaggcgaaatcgccgtcaccatcgggacaagcggcgcgattcgcacgattatcgatgagccgcaaaccgatgaaaaaggcagaatcttttgctatgccttaactgaaaaccattgggtcatcggcgggccagtcaacaacggcgggatcgtccttcgctggatcagagatgaatttgcttcatcagaaatcgaaaccgcaaaacgcctcggcattgatccatatgatgtcttgaccaaaattgccgaacgcgtcagaccgggtgccgacggactgctgttccatccatacctcgcaggcgaacgggcgccgctctggaatccggatgtgcgcggttcattcttcggcctcaccatgtcccataaaaaagaacacatgatccgcgcggcattggaaggggttatttacaatctgtacaccgtcttcctggcgttgacagaatgcatggacggtccagttgcccgaattcaggcgaccggaggcttcgcaaggtctgatgtgtggaggcaaatgatggccgatattttcgaatcggaagtcgtcgtgccggaaagctatgaaagctcttgtctcggagcctgcattttgggactgtacgcgacgggaaaaatcgattcgttcgatgtcgtctccgacatggtcggaagcacgcacagacacgcgccgaaagaagaatcggccaaagaatacagaaaattaatgccgatctttatcaacttatctcgagcactggaaaacgagtatacacaaattgcaaattatcaaagaagcttaaccagcaaaaaataggggaagaattggaggcgttatcatgccattattaatcgtagcaatcgggattgtcgcattattgcttttgattatggggttaaaactgaatacgtttgtttccttgattatcgtatcgttcggtgttgcattggcacttggaatgccgtttgacgacatcgtcaaaacgattgaacaaggccttggcggaacgctcggccatatcgcattgatcttcgggctcggcgccatgctgggcaagctgatcgcggattcagggggcgctcagcgcattgcgatgaccctcgtcaacaaattcggggagaaaaacatccaatgggcggtcgtcatcgcctcctttatcatcggggttgctttattcttcgaagtcggattggttttattgattccaattgtattcgcaatttcaagagaattgaagatttctattttatacctcggaattccgatgacggcggccttatccgtcacacacggcttcctgcctccgcatccgggaccgacggctatcgcgggagaactcggcgccaatatcggggaagtgctgctctacggtatcattgttgcaattccaaccgttcttttggccggacctttatttacgaaactggcgaaaaaaatcgtaccgcaatcatttgagaaaatgggcagcatcgcttcactcggtgaacagaaaacgttcaagcttgaagagacgccagcctttggcatcagcgtcttcacagctatgcttccagtcattatcatgtcgatttcgactattattactctcattcaagaaacaatgggacttgcagacaacagcttcctggcagcgattcgtttaatcgggaatgcctcgacttcgatggtcatctccctgttgttcgcgatttatacgatgggtatcgccagaaagatcccgatcaaacaagtgatggattcctgttcaaccgccattactcaaatcggaatgatgctcttgatcatcgggggcggcggcgcattcaaacaagtcttgatcaacggcggagtaggcgactatgtagctgaattattcaaaggaacggccatgtcgccgatcttgctcgcctgggtcattgccgcgattctgcgaatctctttaggttccgcgacagttgctgcattaagcacgaccggactcgttcttccgatgctcggacaaagcgatgtcaatcttgcactggttgtgcttgcaacaggggcaggaagtgtaatcgcttcccatgtcaacgacgcgggcttctggatgttcaaagagtatttcggcctgagcatgaaagaaacattcgccacctggacactgcttgaaacaattatcgcggtggccggattaggatttactttattgttaagtctatttgtataaaaaagttttagtgaaggagcaggtactacatgtgcaatacaatcggtgtcataggtttgggggtcatggggagcaatatcgccctgaacatggcaagcaaaggcgaacaagtcgccgtctataactacacaagggatttaaccgatcaactcgtccaaaaaacgggaggccaaacagtcaagccatactatgagcttgaagatttcgtacagtctttagaaaagccgcgaaaaatctttcttatggtcacagcaggcaaaccggtcgattctgtcatcgactcgctcgtccctctgcttgaagaaggggacgtcatcatggacggcggcaactcccactatgaagatacagaacgacgatatgacagtttgaaagtgaaaggaatcggctacttgggaatcggcatttccggcggcgaaatcggcgctttaaaaggcccatccattatgccaggcggagaccgggacgtctacgaaaaagccgctccgattctcacaaaaatcgccgcccaagtggatggagatccatgctgtgtctacatcggtccgaaaggcgcgggtcattttgtcaaaatggtgcacaacggcatcgaatacgcagacatgcagctcatcgccgaagcatatacgtttttaagagaaaagcttcttttgccgatagatgaaatcgctgacattttcgacacgtggaatcaaggagagctgaacagctatttaatcgaaatcacggcggagatcctgcggaaaaaggatgagaagacgggcgctccactcatcgacgtcatcctcgacaaaaccggccaaaaaggcacgggcaaatggacgagcctgcaggccgtcgacaacggcattccatcatcgattatcacggaatccctgtttgcccgttacctgtcatcattaaaagacgaacggacagctgcggaaaaagtattggccggacctgcaacagaagaacggcgcctggatcaaaacgtgtggatcgaccgcgtcagacaggcattatatatgggcaaaatctgcgcctatgcacaaggcttcgctcaatacaaaatgacatctgacctgaacggatggaacctgccgttaaaggacatcgccctcatcttccgcggcggctgcatcatccgcgcacaatttttaaatctcatcagcgaggcgttcgacaaacagccggacctgtccaacctgctggtcgcacctgacttcgctgaaaaactaaaagaataccagtccggcttgcggaaggtcgtctgcgaaggcatcagctcaggcatctcattcccgtgcctaagcactgccctttcctattacgacggctaccgcacaggccgctcaaacgcaaacctcctgcaggcccagcgcgattatttcggcgctcacacgtatgagcggacggatatggaaggcgtgtttcatacggactggtattaaaaactgcaccccggatctcggggtgcattcttatttcactcaaatggattttcatactttgttcaacatttcacaaacttatatttcaaattcgtgctatgataaattcaacaacagaaaaggaggattgatgccaaaataaaccagatatccgcttcagggataaaaatttttaacctaacttgtgaaatgtttcacaaactttaccgacttcattcatccctggacatcctgttgtaatcaaattcctattcattcactggagggtttacaatggcaatcgaagaaaagaacatgaaacaaaagcaaaatgcctcaaacatgattgatcagctagtcgaaaaaggcctaaaggcattggaagaattccgcagctttgatcaggagcagattgatgagatcgtcaaacagatggcgcttgccggccttgatcagcacatgcctctcgccaaacttgccgtcgaagaaacgaagcgcggcgtttatgaagataaaatcattaaaaacatgtttgccacagagtatgtctaccatcatatcaaatacgataaaacagtgggcatcatcaatgaaaacgaacacgacggagtcattgaaatcgcggagcctgtcggtgtcatcgccggcgtgacgccggtgaccaaccctacttccaccaccatgttcaagtccctgatatcaattaaaacaagaaatccaatcgtgtttgctttccatccatccgcccaaaaatgcagccgcgaagcggcgagaatccttcgggacgcagccgtcaaagcaggagcacccgacaactgcatccaatggatcgagacgccttctctggatgcaacgcaagccctaatgacccacccgaacgtttccctgatcctcgcaacaggaggcgcaggcatggtgaaatccgcttacagctccggaaaaccggcccttggcgtcggacctggaaacgttccgtgctacatcgagaagtctgccaacctgaagcaagccgtcaatgatctgatcttatccaaaacatttgacaacggcatgatttgcgcatcagagcaggccgtcatcatagacaaaggcatctactcagacgtcaaagccgaaatgacaagaaacaactgctatttcttaaataaaaccgaaaaatcaaaggtcgaaaaattggtcatcaatgaaaatacttgcgcggtaaacgctgatatcgtcggcatgccggcattcaaaattgctgaaatggccggtatcaaagtgccgcaagatacaaaaatcctcatcgccgaattagaaggtgtaggtccggatgacccgctgtccagagaaaaactgagccctgttttagcgtgctacaaagtcagcgggcttgaagaaggattaaaacgcgccgaagagatgctggcgttcgggggaaccggccactcggcggtgattcatacgaacgatcaagaagccgttaaagaattcggcttaaggatgaaggccggccggatcattgtcaatgcaccgtcgtcacaaggagcgatcggcgacatttacaacgcctatatgccttctttaacgctcggctgcggcacatatggcgggaactccgtctcgtcaaacgtaggggccgttcatttaatcaacacgaaaaaagtggcgaaaaggaatgtcaatatgcagtggtttaaagtgcctccaaaaatctattttgaaaaacacgcaacccaatatttagcgaaaatgcctgacatctcaaaagcgtttattgtgactgatccgggaatggtgaaactcggatatgtagaccgcgcccttcactacttaagaaggcgcccggattacgttcattgcgaaattttttctgatgtcgagcctgatccttcaatcgaaacggtgatgaacggcgtcgacatgatggccaaattccagccggatgtcatcatcgccctcggcggaggttcggcaatggatgccgcaaaaggaatgtggatgttctacgagcaccctgatgctgaattctttggcttaaagcaaaaatttctggacatccgcaagcgcatcgtcaaatacccgaaactgggaggaaaagcaaaattcgtcgcaatcccgacgacatcaggcacaggttctgaagtcacttcattctctgtcattacagacaaagaaacgaatacaaagtacccgctggccgattatgaattaacaccggatgtcgcgatcattgacccgcaatttgtcatgaccgtgccgaaacatatcacggccgacacaggaatggacgtattgacacacgcaattgaatcatacgtatcgtgcatggccaacgactatactgacggcttggccatgaaggccatccagctgatcttcgaatatctgccaagagcatacaaaaacggcagcgacgagctggcccgcgaaaaagtgcataatgcatcaacgattgccggaatggcattttccaatgccttcctcggcatcaaccacagcttagcccataagcttggcgccgagtttcagatcgctcatggacgggcaaacgccatccttctgccgcacgtgatccgctataatgcagcgaagccgaaaaagttcacggcatttcctaaatacagccacttcatagccgaccagcgctacgcggagattgccagaacgctcggcctgcctgcaaaaacaactgcagaaggtgttgaaagcctcatccaggagatcatctcgcttgccaaagagcttaaaattccgatgagcattaaacaaaacggcgtggatgccgccgcattcgaaagcaaagtagatctcatggccgagcgcgcctttgaagatcagtgcacgacagccaatcctaagctgccgctcgtttcagagctggctgagatttaccgttccgcgtataaaggagtttagccaaaaaagccgtcattccgacggctttagtttgttgacaaaatcccaaaacgacttttagttttgggattttgtcatcctttcagcgtgattgaaaacccttgcagtctaggaaggccgagcatcggagcgcagcgaatgttggaattcgtgagcaccgacgcgcaggcctgacaacgaatgcgaggatttgtcgacacgctgaagccgtcattccgacggcttttctttattttcaattaggcctctttattctcacttctctatcatttgtgccaatcatactatatgaaaatgaaactccaactcttttctttagctgaaatacttaacaaaaaaataaaggtctttccccttgacaaaaaatatttattatttgataatttgtatataattataataattatagagaaataaagtttacaattttatttctcttaaactacattcaggaggacgatattatgtctctaatcggaaaagaagtacaaccattcgcagcaaaagcttacaaaaacggtgagtttatcgatgttacacacgaagatctgaaaggccaatggagcattttctgcttctatccagcggatttctcatttgtttgcccgactgagcttgaagaccttcaaaaccactacgaagctctaaaagaactaggtgtcgaagtatactctgtttctacagatactcacttcgtacataaaggatggcatgacagctctgagaaaatcggcaaaatcacttacgcgatgatcggcgacccatctcaaacgatctcccgcaattttgaagtgctgaacgaagaagaaggtcttgctgaccgcggaacattcatcatcgatccggacggcgtcatccaagctgttgaaatcaacgcaggcggtatcggccgtgatgcgagcatcctgatcaacaaagtaaaagcggctcaatacgtacgccaaaacccaggcgaagtttgcccggctaaatgggaagaaggttctgaaacactgacaccaagccttgacctagtaggcaaaatctaaggagtgcattcaattggtacttgaagcaaatatcaaagcacaattaaaccaatacatgcagatgattgaaaatgacatcgtccttaaagtcagtgcaggcgatgacagtgtctctaaggatatgctggctcttgtagaagagctggcttccatgtcatcaaaaatcactgttgaaaaggcgcagctcgacagaacgccaagcttcagcgtcaatcgtgccgaagaagatacaggcgtgacattcgccggggttccgctcggtcacgaattcacatctttggtgctggcactcttgcaagtaagcggcagaccgccgaaagtcgatcaaaaaatcatcgatcaaatcaagaacatcagcggcgagtaccgcttcgaatcttatatcagcctcacatgccacaactgcccggatgttgtgcaggcattgaacatgatgagcgtgctcaacccgaacatctctcacacaatgatcgacggtgcggcatacaagtcagaagtcgaaagcaaaaacattatggctgtgccgaccgtatacttgaacggcgaatcctttggaagcggccgaatgacgcttgaagaaattcttgcgaagatgggcagcggcacagatgcgtctgagctttctgataaagaaccgttcgatgtactcgttgtcggaggcgggcctgccggcgccagcgcagcaatctatgcggcgcgcaaaggcatccgtacgggaatcgttgccgaacgcttcggcggccaagtccttgacacgatgagcatcgagaacttcatcagcgtgaagcgcaccgaagggcctaagcttgcggcaagccttgaagaacacgtgaaggattatgatatcgacgtcatgaacctgcaacgagcaaaaggcctcgagaaaaaagaccttttccatctagaactcgaaaacggcgctgttctgaagagcaaaaccgtcattctttcaactggcgcacgctggcgcaatatcggcgtacccggcgaacaagagttcaaaaacaaaggtgtcgcatactgccctcactgtgacggaccattgtttgaaggcaaagacgtcgccgtcatcggcggcggcaactccggcatcgaagcggcgattgaccttgcaggcatcgtcaaccatgtgactgttcttgagtttgcgccggagctgaaagcagacaaagttctgcaaaaacgtctctacagcctccccaacgtgactgtcgtgaaaaacgcccaaacaaaagaaatcacgggcgatgaaaacgtaaacggcattacttacgtagaccgtgaaacaggagaagaaaaacacgtcgagctccaaggcgtcttcgtccaaatcggtcttgtgccgaacacggaatggctgcctgaaaccgtcgaacgcaaccgcatcggcgaaatcgcagtcgacaaacgcggcgaaacaaccatccctggattgttcgctgccggcgactgcacagacagcccgtacaaccaaatcatcatttccatgggatccggagcaaacgctgctttaggcgcgtttgactacctgattcggaattaatctataaaaaacgctatgctgaagttttcagcatagcgtttttctgtattcccgcaaccacggctcattcgattttggcaatggaagcatccctcaagcagcgcacctcggcacggaggcgccctctttgtagtcataaccccttataatagaattcattttctcatcttctttaatttggtactataaatatagtagttttaatattagtcatcatgaatagaggttacttgaaatgagaaaagaacagtcttttatgaactcaactgctttctttatcatcatttgtatgttaggcgggatactttttcttttaacgaagtgacatgaactttagatctatattactgagaagtatacgtataagaagacattagtccacgatgtcatatcaacttatatcagccatctcagcttatcaggtttttccttcatgcagttgaacgtggaagaagcgaagtactttgaattggagacttaatcgcccaagcattacattcgagcattctttcaattgatgaacagcctcagttttgataagcgaaaggccggcgtcaatacaaccggccttatttctgcggcacctcttttaatgaaccaacccatacagttcctgcgctcactttataccactcatcttttccgtcattatcttttgaataggacatttcttttatgcgcagcacatcgccgctgcttctcaatcctagttcgaggtcctcctccagatcagatagccggtaatacacggtatgaatatgaggttcccattcaaatgcattcagctcatgttctaaaggttcgtatattttcaaagagaacgcttctttttcttcttgcttgtcgaaagaaccactgtaaaaatcaatcgcttctttataagcagccacaatttgtgaacggataaaatcaggctcatacaaccaaattttcaagtagaaatcttcattttcagctttcaattgcttatgccattcatgatagacatcgatcatcgcctccaaaagcaagcgtttataccataatggaggagtcactgtttgaagcccgtaaaaaggggatatccataatttaacgtaatctctatgatgatctcttaaatattccatattcaattgaatattgtctgatttccaccattctattcttcgtttcagtcttttccagcctcttatttttttctttgccgaaaaatacatattgacctcccttcgcgtaacaaaaacggcgcaagagaccgcccccttgcacctaacaacacgtcatttacttataataattataatcattaaatgtcgcgatcatatcgttttgcgtcccgctttttccgcgattcgtattaaagtaaagcgtcccgtcatcaaaatcgacagcctctatttcaaaaagcgtgtatgcactgctggtaattctgaaagataaatcgctgcgagtaaacaattccttcgaaaagtcctgaatcgggtttgttttttgctctttaatcatttcattgatatttaaagggtacgtcaatataatgctcacatttgaagcattgccattgctgtccggttttgtaagcggcacatacaatgtcccctggtaaaaggaaattccttgctgaatgaaatgcgaaacatccattgtctgatgattcacaacagctttcgaatagtttaatttaaacgttgcttcatagtcgaattttccggttgtatcattgaatgtcccaataaagaacctttttcccgatcttacgataaatttatccgtcccaaccgagtatgtgataccgccaatcgacaaattcgaaccttgataattcagcacatatgttttagccactttataagtatttttcgttgtatcgacgctgagcttcacgattttattggcatacttagtgccgtcagacatcggcgccacataaacgctgacgcttttatcgcccgcagatgctttgacagccaagtcattggcgtgccctaaatcatagctcgtagtattggtatccgaatttttaagaagtgcaacggttctattgcttgccgtaccgctcattttcacagagaataactgcgtcgtgtgattcgtgttattcaattttgcagcgtagatcacattgttattgcggtcgacgcacatcccctgcatcgccgtgaaataccccgacttagacatggaaacataatcggtatacgtattaaagtagcctgattgcgcatatgcagccgtccccgcaaagctgctgagagctaagataaccgctgctatgaaaacttttggttttttaaacaccatgccatccccccttaaatgatttccatattatatccttgaaggaatattgcgtcaatataagattgatgtccccctcctttctatgcaatatgccctcagaaagcttcctgtttgttaaaatttagattaatttatcataaatatggtactattattttaaaaaagagattcagaggctgaaacaatgaatgaacttgtgtttgaaaagagagaatttactcaagaccatgtgaatgttgtaaaagcaatgcatataaataactatccgattgtttatatcctttataacgagaaaaagaaaccgactgcatatattggacaaacggttcaagctgcacggcgtttgaaaaatcatatagatgatgaaaagcgaaagagtttgaatcgctttattttaatcggccatgagaaatttcatcagtctgcgacatacaatattgaataaatttaattaactattttatcgccgataaccgctaccagctgcaaaacgtaagccagaccaggtctagggaaatgcacaattactatcagaaacccttttataatgaaaatatctttcaagtcatttgggagaagctgagaaaagagaaaattgtgaacgattctctttaaaaccttaggaataaagacatttataagttatctccttataaagagctctcgcctcagcagcttgatattaaaaataagatccttgatttctgtaaagaacgtatacaaaaagaaggaaatcatgtcattgttattgaaggagatgccggcacaggtaaaagtgtcctgttaagctctctgtttaatacgattcaagatttggctaagagtgaagactcttttttgaaagaaacagataattacttgctggtaaatcacagcgaaatgctgaagacttataagagcatcgccaacagcttaccgaatttaaagaaaaagagtttcatgaagccgacaccatttattaatgagaagaccaagacgggagcaacagcggatatcgtattagtagatgaagctcacctgcttctgacaaaggaagattcctataaccatttccgctaccaaaaccagctgtatgaaatcattaagcgaagtaaaatcactgtggtgatctttgacccaaaacaagtcttaaagattaaaagttattggaacgaaagattgctcgaggaaatcattaatcagtatgatgcgaaaaccgtaaaactgacagaccaaatgagaatgaacgccaatccagaaacaatcaagtggattgacagctttgttgaaaagaaagttcttccctttccgactgaagactcctccttcgagcttaaaatatttgaagatgctgctgcgtttaaaacagctattgaacgcaaaaacagtgaagacggtctctcccggattgtctcgacctttgattatttacataaaaaagataaaaagacttacatcgttgatgaagaagggattaacatgccctggaacagcacccaagataaagtgacatgggcggaaaatccgaattctattaaagaagtcggctccatttataccgttcaagggtttgatttaaattacgtcggcgtcgttctcggcccttccgtaagctatgatgaagaaaaagacgaactggtaattgatacttccaaatacaaagatacaggggcattcgtgttacgtacagatttgtctccagaacagaatgaacaaattaaagaacaaatcatcctaaattcaataaatgtcctgatgaagcggggcatacaaggcctctatatttatgcgacagatcctaaattaaaaaagagactactcgagttagaaaggggaaaatggtcatgaacgatatccaaagcctgatcaacgcaatcaacgaattcagagatgaacgaaactggaggcaataccatacccaaaagacctcgccatctcaatttccatcgaagcagcagagctgctcgaagacttccaatggatcagcagtgaagaagcactcaaagcaaataaagaaacatccgtgaagaaatcgcagatattttgatctactctttcatgctgtgcaacgatcttggattggacgtgaaagagattgtggaagagaagattgtgaagaatgggaggaagtatccggttcatcataatggttaagaatctccttttaagtagagagagcttctttcacaattgaagaccgctctctctatctccatgatgcgttggttattatggcatcctgctttgttatcttaccgtaacccctccacttcatatgctttaacaccctttgattctttctgcaccgttcgctggctccctgttatttttgaaaaaatgacatttgtcatccgattttcatgacatcacttactaaaatccgcctccctcaacttatacaatgaaatgagtaaatcaggaggtggcctgtagccatgagcaatgttgtaagcttgacgaatgtgacaaagacattccgccaaaaaacggcggttgatcagatagatttttcaattaaaaaaggagaaattgtagccattctagggccaaacggagccgggaaaacaacaacgatttcaatgatattggggctgttaaaaccgacggctggcaacatcacattattcgattccatgccgcatgaaaaacgggtgcgtgaaaaaatcggcacgatgctccaggaagtcagcgtcatgcctggtttgcgtgcaggtgaaatcatcgaactcatccggagctactatccaaagcctctatcctttcaaaagcttagaacgttgacaggtttgacagacaaggatttaaaaacacaggcagaaaagttgtccggcgggcaaaagcggcgtctaggctttgccttggcacttgccggcgatccagaactgatgatctttgacgaacccacggtcggcatggatatcacttcaagaaaccgcttttggcaaacggttcaatcgctcgcagagcaaggaaaaacgatcattttttctacacactacttacaggaagcagatgatgccgcgcaacgaatcttgctgtttaaagacggcaagatagtagctgatggaacgccgctccaaataaaatcaagaatatcgaagcattcggtttcatttatagttgatccggaacagtcactcgagaagctgtatcagcacccagaaaccgaacagatttttcgtaaaaacaaccgggtttacatcgacacggccaatacggacaaaatactggaactcattttctcagaaaagatcggcgcttatgatattcaaattgagcgcggaaatctcgaagaggcatttcgccagctgacaagcaaaggagacgagtaaaatgaatgtatttcagatgcagtgcagaatggaaatcaaaagaatgcttcgaaaccgctattttgtcttttggtcattggccatgccgattgctttttattatatttttacaaatgtcgtcaatacgaatgctccagaccctgcggcatggaatgcgcattatttaatgtcgatgacaacattcagcgtcatgggctcttcgatcactcggcatccgcatggttcaagaacgcacccaaggctggtcgacgttcatacgcgtaacgcctcttcccgaccacatttattttatcgctcaaatgtcggggcaaagcgtcattcatattctttcgatcacagtaatcttcttagccggcgccttgatcaacggcgtttctttatccccattggaatggttcctgtgcggattgtgggccctgcttggctcgctcccgtttctggcgatcgggacattgatcgggatgatgaaaaaagtggatacagcagccggaatcagcaatgtgctgtatatggggctcgccgtatgcggagggatgtggatgccgcttgaaattatgccaaaaatgatgcagaatatcggccattggctgccgtcctatcattatggcagcggcgcctgggaaatcgctcgaggtcaaatgccaaactggaaaaatattctcttcctattagcctattcaatcgttattatgctactatctaaatatataagaagaaaacaagaagcggtgtgaacaagaatgaaaaaaaacttcagcatgtttccgaaacggtacggcttttttccttatatctttttaatctatttactgctgcccatttcttatttgacaaatcagacctcgggaatcaaacagctgatcggttttggactcgtgctgcttttcttggtgacgtaccgccagcttttttttattccgccgcaaaaaaaattatttacttattggctggccatccagctttcaatcattttaatctacactgtattttatgatatcaacttagtatttttaggctttttttcagcgaactttatcggctattaccgggaaaaaaagacgttccggtgcggccttgccagcctggttgttgtattggtcgccccttttatctatcatctgctgaaagatccatccctgcttaatcggctcttttattttctgccctttcttgtgattatgctcatttcaccatacggcatccgctccatgaaccgccgcatggaactggaacaaaagcttgatgaagcaaatcagcatattaaggaactggtcaagcgcgaggagcgtgtacgaattgcccgcgatctgcacgatacacttggccatactctttcactgctcacattaaaaagccagcttgtccagcgcatcatcgccagcgcccccgaacgggcgcgaaaagaagcaagagaaatggaaaccacatcaagagcagccttaaaacaagtccgggaactcgtgtctgatatgaaaacggcaactattgcagaagagctcatccacatccagcaaatcctgcgggctgcagacatcacattcgaatacatgggaggttccgatttttcaaatatccctcctgtcacacaaaacattgtcagcatgtgtatacgcgaagccgccacaaatatcgtcaaacacagccgcgccacccattgcaccatttccatctctcaaacagatgataaaataagcattaccatcaaagacgacggaatggggatggatcagcaaaaaacaccatttggtaacggcttgcgcggaatgaaggaaagacttgcattaatcgacggcgctctcgacgtttcaacccatgacggcacagttttaagcatcgccgttccaaatgtaaagaaagctgaaggaaaggaagcaatccaatgattcgtttatttattgccgaagaccaaagaatgctgttaagcgcgctgggatccttgcttgatcttgaagaagacatggaagtgatcggccaggcgacaaacggcgaagaagcgctcaccgccattctgaagctagaaccggacgtctgcctcatggatatcgaaatgccggtcaaaagcggactggaagtggccgaagagctcgcaaagcaaggcgcaaaaacgaaaatcatcatcctaacgacgtttgcgcgtcccggctacttcgaacgcgccgtcaaaagcaatgtccacggctacctgctcaaggacggggaaatcgacgatctcgcagacgccatccgaaaatgcacggaaggcaaaagaacctttagtccggaacttaccttcaacgctgtccgcgaaacaaacccgctcaccgaacgcgaacaggacatcttgcgactggcatatatcggaaagacgacaaaagaaatttctgaggagcttttcttgtcgtcagggaccgtccggaattatatttctgagattatgcagaagctggatgcgaaaaaccggatggaagcggcaaggattgcggaggggaaaggatggatttgagtggggtcttgagataagcagccatcatggtacaatggtattttaggagctttgacattggccttatagcttatcaactaactccttttaacattcacactcctgttttaagaggtatttccttagtcgattaattcaccagaatattcttttggttgttcaatgtcgctcttttctctgtatcactcagtgatataccttgtttgattggagtccaatactcatatgcatactcggtatcccattcaatccatttagaaactaccttactaaaatctcgtacctgtgttgacatatcaacggcttatcttatacatactcttaatatgattaagctctgtcttctcctctccttttcgaaatcaatacaaccattttcttcaactatttttattagtccttcttgaaacgattgacaatattcagcttcttcatttataagcttttgattaaaaatactattcagaaatttctctttcctatctgtaataatcaccgtataactaatcgaaaattatttcgctcggaccaaccagggtgccgtcatgatcccgggcgaaagacgaacggtccgtgacgtcaagcacggaccgaccgccaattgtactgaaacgccctgggcttcatccgacatcttacctccggtcaaattcgccgtttgctggctctatcaaaacaccaacgtacagcaaacagatgactcagcggcacaacaagcaacccatacaccgcggccactagtacagcccctatctcatcaggcctttggagcaaaacaacaacgcccacaaggccgaccccaacaagcatttctttggctacacggctccggagaatccgtacccatgactggcctgccacccgcagcggaaagtcacgcttcgcctgcagcagcgcggttatcaatgcactaatcgcagcagcgacagtgaaagcaataactaatgcaatcagcgcaagattcaacaaccatacaacgtacgctgcgaactgcgcgcggagaatcccctcttcggcaacatagacaactttcagttcaccgttgatatctcgatcacgcagtgccttcacgtcaaggccgtgtttccctaacaattcctgcgtagcagttacaccagtgaatacgatgttgctacctgagaccatggaagtcaaagcagaatcgttataagtatcgtagagcgagggcacgacaacaactaggacatcgtccgcaaagtgaagtctttcccctcctcctccttgggctaccggcaaccggaatccgtcgatcggccgcaagaacttgaacttaccgaactgctcatcggaaagctctttcctcgacaaaagctcggcctcttctcgaatcattttgacaagcccttttggaatgctatgataaggcacctttgtaacagcaggctgtggtgcatccatggtcaccatatcaagccaacgctggttcacgtaagagatggccgagtactctccaaaatcggctggcattggcatttcttgagtatatgtgtaggaaaaagctaccttatcaagcgattccgcatcctttaccagtttaccaatcagcggctccatgtggttcatctcgtcaacgtctgtcgcaaacacaatcgcaacttgatctgcgagtttcttccactgagccatttcagcagctatagctgaggaatgtttgtatgcggaccaagcaggtccagccgcagctaccaccaggaggaacgttaacgcctggatcacgatggcagctgaacgcaagcttttaacagcaggttgtctggtggcgatcatggtagcgctaggccatgcggaagctgacatgatcagcgtagccaacagggatacggtaataacagcgacctgcagactgaacagcgcattgaggaaggtaccgacatatatccagccatgaaacaaacctacgtagcaagacgcaaccagtgctacagccaccgccgaaaccagcagcgcccccccgaacccggccaggtcctgaacctgaatccgcgaggtcgggcacccgcccagaacccgaagagcacgcccacgcgctcttaacgacaaccagaacaacgcaagcgccgcaatcagcgcaaatgctgcaagaacagcggcagcaaatcctctttctcgcacaacgaattcaaggcttttaaaaatggacgcatccccgcgaccgaccttcacgccttcacttttcagcgtgtcctcaaactcgctcaagtgagccttttcaccggtcacgagatagaacccatcggggtaggaggtttcaagccggtccttaccgacaatcttgcctgcaccatcgccgccaaaccaagtaaattcgtcgggcagatctctatcgttaagtgctacgtagacctggccatcgccgtcgcttgcaaggtctggcgcaaccttgaccagcccaagattccagcgtgcatcgagcttctccagcttcgcaaacgcttcagtaatagaaagccccgattcgctgaaatcaaggtttaacctgctctcggcaccaatcgcctgaggaaagtctcgatcatataggtcggtgataatcgccgccagtagcgcaagcagagcaaacaacgcgcccgcgacagccactataatacgtttatacacaagctggacctccaagaactatttgaaaattgccatgctaagccccggcgaacacaaccggtatcgccggggactggcgtaattgcctggattaacagataatgttcccccttcatttcattcctcctcatttattcaactatttttgtcaatatttctgctcctcaactcgtttgtctctgcctccaatcaatcctccaagggctcatatgtaaagcctagccagcgcctcttgcttggcgtagttggtctgcatcaggttcatactgcttgacaaaaacggggagccagtcttgccgtaaacagcaggaaacgattacaccgagtgaattgtgtagaagttgagttagcgcttcaccaggtgcactgggaccccaaacccgtcacggcggctgagcaggtcggagattgcgtcatgctcggatcttgaaccatagctaaccatgaccagccctcggttctcgtcatcaggacacggctttcctacttcgaccgtaatgtcatcacccaaagctttaatctcctcgacgaggtcttgatgtctggaaagcgctgcattggcctctgttacgttcggcagctgatcgcacggcggatgagtgtctcttgacactgtgatccatccgtttaggaatgcaattgttccaactgcaagcaataatcctatgacgacaccgataatgatcttcgtggttgatttcatgagttacctcctaagttgccgggatcgttggtcgacaatggttttgacgaactgctggaaccgaccttatgccgagcaccacacgcgttgatcatctcagagtcgtgcgtagacacaataaccgtgcggccacgcgcagcgaagtccgcaaacagatcgataacctttcgccgattggttgagtcaagcgaggcggtcggctcatcgacaaacaagaatgcagcgtccttgtagatggcacgagccagtgcgagtcgctgcttctcgcccccactaaggtggctagccaactcgccttctcgaccctggagacccgtctgctcgagcacctgcgccaaccgctcttggtttcccgtgacacgccgcccaaggatgctcgcctgcatggtgacattgaatgccaccgactcctcatccataatgccgtaatcctgaagaatgaacgccgcatgatcacgccaaaaccgccgccgcgccgcagtaccgtagcttgtgacatcgtgtccgtctatcaagatgcgtccctgattaaccgggagcaatagcccgaggcagtgcaaaagtgtagtctttccacatccgcttggaccaacgagggctgtcatgacccctggcgggcactgaacggtctcaccatcaagcacggtccgcccaccaattgctactgaaatgccctgtgcttcaatcaacatctgtacctcccatcaaattctacgctataaaaagcggcactcatttattccattcctcctcatttacttaactatttttactcttcaagccgattaatcatcacccacctaccacattaataggggaacgtttttttctctcttgtagacagtgtcgtgacatactatctcttcttcgtcacaaacattaattccttttacaactagcaaatttcacttgttgtaccataagtaacctattgactgccggggcacaaagaatttgtttcttgtcaaatttgctgaataacggccggcatcaacactaaacctggaaaagtagaggattgcaccgcataaaataacttactgctaaggctaccaagataaaactacaaaattaaataaacctattgctttccaaaaaatgttagttgcattttatgttttttcctgcagatatgcactatcttttgtggagatgctttggcagtacaccgaaagcatctcctttttatatagatacattaatttaaaaattttaagaataaatactcggggcgcataaaatgccgcgcccctcaaagcggggtattacccctattgaattctcagagtttatgaaactttgcaatcaccggaataaaaaactatcaatcggtaagtgcttctggtaaattgctcccgcatcgacacggtagtgggcgaaaagacaagctaactcgaccggtaatccaaacctaaaatccggtatgtccttaccaaaataaaaacaatgaatatagatttaactctctcgaaaataacggcctgctgaaatctcgatttcatagatagggatgattgccgtcagcaggtgcaagaagtgtaaacaacaaagcccgcgtcatccactataatacgcttatgcaaagcgggatctcccagaacttttctgggtcttgccatgctagccccgttgacagcaaccgttttccctttgattagttggtgcgatagtagtaacgacccttaagaccaggtgagtttatggctccgacataggcattagagtagcggcccgcagccgtatcaatacttctattcgttttatccacttttccatcgatgagcttttgcactgtcgagccgtggacctttgtcgggtggttgtactctgaacggagcccggcgtttacgaatccatacctccatgtaccaccttccgatgggtactggtagtgataacccggattcacccatgcaaatgaaggcaccgtagcgcctcccaccaaagcgatggacattgtcaacacggcgagcgtcgctttaattgtccgagtcaaaggtttcctcttttttttctcatacaaatgatttttcattatttcattcctcctctttcattcgactaataaatttactctataagttagtttgtcaccgcccacataccgtgtcgatgcgggaagagttttttccctcgttggcggtgccatgatcatgactcctctttgtcaccagacatcaattttttcctccatgaccaaccctcgatccgaggtcatttggtcacgacttgtccacttcgacgaaatactgtcacctagcattttgatcacctcctcaataccctaatggctggcaagcaccacagtgtcctttactgcattcggttagtgaccgaatggtgcatgtcagaaacctcctaatctgttaaaagacctgctttttccagtttggattagtcagaaaatgaaagaagaagaacaaaagcaagtcaccaaattcaaatcttatctacctgaactggatgtattatgctgactcctgaagatcatttgatccggttagccagtgagaacgtggaccgtgtggctctatcattcagaaatactccgaatgtggaggaactcgtacaatccgcctatgctgtttaatttatggttatatatatcacgggtgtttcagcttccggaaaattcagacggctatccttaaatctgttcactggttgtaaaaggggagcgtcgtggttttcgcactatcagcgattttcggaaaagcaatctggatgtgttccaaaattgttcacgcaaaacagataaatcgttatgtaagcagataaaatggtaatctcagcgtttcgaaaaagaggtcaagcagatggtggaagaagtcaaagaagcggatgtcaaagatgaaggactgctctctcttttcccgaagacgatccgccgcaaaattcaatatcgtagaaatcggcttgcaaaagccaacgcggcattacaagaactggaagaacgcacacctgaagaaaaatagccaacgctacaaagatcaaatcaattttactgatgattagcgtcccatatcctgtctcaaaaagcctataattcacaagtcggtgttgaaggcatatgatttggcctagaaaagaataacagcagaagcttccggatgatttgggacagtgtcctggataatatagagacaaaacaggtgaaacgccaaacaactactgcggatgccaaacactatagtcctgaaaacatcctgccaaagaaacaaatcaaacaagatacctaaatgagagcaaataaacgaagaatccatatgacaaaagcagtttttatttgggtccggggaccctaacaccaactctctttaactcaaattaactaattttataataattgtaaaacaaaactgattcaagaggtttcctgattttttaaaaattttggtcaaaatgtattagatttgctaatgtataaaactcttagagggtatcagaatggatatttagattattttccctttttgttatataaaaatgaaaacttaaattcccatcttcctttaaatgcttaaccgattcagaaaattgtagactgttttaatgtattcttaatgtagcaaattgttggggattttctatttgcatttgagaggtgtaaaaaaagacaagcctaattgcttgtctcctgagtaattgtgtgtttctcctattcttaaggtaatatggataagttcaaattaaaattttccatcatttatggtaaggctcaccgtagttatttaagaggcaaaaaacagctttgggaaggtctatcccaaggctgttttcattttaactaaaatattgttagcctctattttttatatatagctataatatggaatccctgctattccttcatttattaatttatttaattcctcagcttcataagatttaaccttgtaatatctattttctaaggttgaaatagaaactccactcactttagagataagagccaaatcgaatccttttaaaattaattccacaattacagagtttctaatggtttcaacaggataagtagatttatcttctgagatatcaataatattaaattcccttaataaattacaaaaccatgaattcaaatcttctggtcggaatgagctttcattcaagaaataaaataatcggtcagaattatccatttttttatcctttagcttttccaccaacttaatatttataatgatctcttttcttaaaccatttggtatatttatctgcacatcgtttatagtaattgttctatagtctgttgaaaaatccgccttttttatattacatataatagcccttttagcaggtacaattaaggtaagtttaataaatagcctcaataaaacatagctcatataccgttttcttttttgacctgataagtccgctaaaactcttgaatcaaaataatcatctaaacaactaataattttttttataacatcctgatcaaaaaattccctttcttttgtttcctctaagttaaacttatctgttaaatatttcttatagccctgataatcatacaattcaacaaatatatcggttgaccacgctttactaacaagaaatttataaaatgatttaatactttccaaatgattttccatggaacttaccgtattaatttgtcccaattcattgtaatgacctatacaatcttctacatcattaatattgatttttgttggcttatcggctttatttattttcttaataaaatttacaaatttattaatatgattttcatagcttgcatccatttcgagatattccttactccaacgttctattaaagtcattagctaccccctattttccataaaagttacttttctatcgttatcttttattttatttttttaaaggaatgtacaaacacaattaattgtacgttcctcaactatcaattaattgtagatataggaacactaatcctgtctttagcaacgcaaacatttttatatacaatatagcattctacgtaatgttcgcctttaaagttagtagactcaaatttcttgtgtgtacccttgtctctcacaatttgtcctcttatacagtctcttctgattgcttcctctccacgattaagaactttccaatacacttcataataaagattatcctcatcatctttagacaatgtttcgaattcattttctgttatgaaaaattctaagctcttattcgcctttaacggtaacttatcacgtaagatgtttcttagaaacttatttctaaatccatcttgttttactatacagtcaatttttagatgataacgaatgtcaacatcaaacttatgttcaataaattcttctgtttgtcgaacactcctaccaaataatgcactcttttcaatcacattactctcttgtatttcttcaggtataggaaacgcctttccaaaaatgtcctgtaatttttcatataagtcttcgctatcttctgtcttatctttgattttttcatatgcctttttagcttgattaacgaacgctccacctttattataaaccttttgattactacccaaagcgtaccaatacttttgatccttatttcgagttttcaagtaatagaaaagatcctttaacaaagaaaggtaatcatcaaaagtcgaatctttatagttttcattttcattgaagaaattataaactaatgtatctattaataacccaccaaatttaaaccccttattattcttccaagctctaactatattacaaacatatttataattcgagttcgtctcgtctataacttttatactctcatcaatttctggcatggggtcagttttcttccaagaacccccattatttgaatcgggataatcatatgccccatccgttctctcaaagcatggacatacttcaactgttttgtttatactctcaaaacttacgacaacaacttgtccatcgcctctaactattgtttttgggtatcgtttcttaatttcctgtttaaccttctgcaatagtttcgattgaccatttccctcgtattcatcgtattgattttttagttcctttggtagtacataaagcatgtcaacatcgctgaatgtttttattgctgtatcccttcctaatgaacctactatatgactgttttctatttcctcattatctaagtctcgaaatgatttatttagccttttggtaatttcctttaccctcttcgtttcttcctctattgatgctatttgtaatccatcgacaaattcctcaaacttttctcctaacatagaatccccctataaaacaatgattaatagtatgataaacgcaatgaaaccaattactgctattctgaaggaaatgggaattttgtccttccaagtgaattttttttgctcatctatccattcatactgactttgaaaaaaaagcttataatgagcaacccagtcactcagaaatatctgttttgagatgcttatttgatagaactcattcaataactcattcattcgtattgcttcgttcgattcattgctaaagttctcttgttctgaacttttagcctgataatatatttctcgaagttcattatgaatctgtattaacctatttccaacttctctatatctatctttttcactgttgtattgactaatggttaaagcaatgatgcttgcgattattaaaagtaaggaaatttctgaattatacgggaaacttggtttatatatttgccaaataccaatggcaagtgtaatgaaggctattctccctggcatttttacaactgtatcataggttgaaaaatgctttttagctccatatattacgttatatccattctctgcaagttgtcgtaaaaacaaatttctttccaacttcaagccccctttcaaaatttctttatataaatatggaattaaaataactcatacatctataatataaaaacaattgcaaaggaggtgtatagatgaacaaggacaaattccaaacaacagatagcaaaagtcgtgtaaccttcgtaaatgagttattaaaaagagaagattttgatttacaaaaagtagcggatgttcttgaaatgaactattctacctttactaaactgatgcaagaagacgattatgtttatattaaacgggaaaaccagtattacaaatttgttcgtgacgaaagccagatatttactatttctgaccaaactgattctgagatggattatattaaagcgaatttttcccttctaaagagcataatagaacgatataaacacaaagatgacttcattattgataagcgtattttccgatctacctctaaaacctccagtaaaaacttccgtatgccagacgatctctaccaaaactttgttgctacttgtgaaaacgagttcccccacttgaaaatccaagatattattgctcaacttcttctcgactttacagataaatattccgacaagtaaaaagaaaattgaaaggtaaggcagtgccaatagcaatgcttaaattggaactgccttattttaaaggagcatatattaaaactaatgcttttctattatccaagtaccttctttacttttcctttccaatcatttcgatgaataagccgccattcatgaagattgtttttgataatttccgctttactcattttagacacgctttcccaatcccctttaacaatataagtagcgttgcctacatttgcactttcaaaaacatataattccttatccttaaatccgaatacaacataacctgaaaagccattctgaccaattgcttcaaaatcaggcttatattgaacgattgtttcaagtctttcccaaattaccatctgttttgattttttacttgattcaactatttctttaaaacgttcctttcgttcttcccatggcaattctttactctccaaaaagatccaattgtatcgctttaaatatgaaggtttgtaataggtatctaactgttctgagaaaacttcacaatatcctactaactctaaaataatatttgctccaactgtagctatctccgaatctgtttctttattaaaagtttcatttatcaataaaaataaatcatcaccttttgcttcaattacaatttcaaatcctgttcctggtataatctcttttttataaacttgacggggaatatcaacgaaatctgtcacttcctccgtttgatctctccctctgaactccttacgtgtggaatacatagaaacatagatagtttctttgggaagatctcttcttataatctccttaccttctacattgaaacgagtaaacctgccaactataggcggaaacattgcttgtccagcttcgaaagcaggaaaacctatcttttctattttctctttgttttcattcgtaattttcactcctaatcgaaaaacaccatcaactaacttaatatatttctcaatagatctaatgtaacttttaccttgaatcatttttcaccattctcccttcgataatataaaatctttggctctattctgataaaaaaagacagctctaatctaattagaaactgtctttccttcgtatcttgatgtcagttcgtgttgttaaagttcttggacaatctcttcatcgagtattgttttccgtttttcccaatcgggcataagagtatataacattttataaaagttatcgctgtggtcgttgtatttaaaatgaatcagctcatgcagaacaacgtagtcgatgcaatgtttgggagctttaattagttccgtattcaaaagtattgtatttttatctactaatgctgaaccccatcgtgctttcatcaatcgtaaatctaaagagggcttttctacaccatatttctgcatatataagctcattttgtcgagggactcttgaaaaattttcagagctttttcccgataccaaccatccatcaacttctctttccgcttatagttttgtggattttgaacatataagtaaataaaccctctaaaatactttaccatttcttcgtcttctgttttttcgacacgcaaacggtattgcttccctaaataacgaaaagactccccacttacatactctcgctcactctgtttatgaggtaatacgtcttcgaatgttttcacattctttacaatccaagcacctttacttttcacaaaatcataaataaaatcaatcggtactttgtcatttgctgatacttgaatagtccgatcaggcttaatgtttaaattcacattcttaacgtttttacgttcaagcataaaatcaatacatttgttgccatactggatttgatgtctttccatgttgtcacaacctaataacgtctgatagctaccgtttttatttgttcaattaatttatcaatcgtgtcataatctaactcaacgttatgttctttggaaaagtcatataagagatcatccaaatcttgtgcaatgcgattatggatttgaaggttgttatgccaatcgaccttctgatgctgtttgatgatttcatccatcttcaaggctaattctccaagcaaatcctcaccgtaacttgcacgttcttctttcgtttcacttaaaatgtctttcgtcacaccgtaaaacgcctgtgcatctttattttctttgatgacagtcggataatcttcttttgattcaccgtttctgtaatcgttcataatatctttcatcttgttcaagtattctgcttcagaaatccgcttatccttatattcctgaatcgcctcttgaatccgttcagaaaacttcttatagtaagcagggttttcatcccatttcgcatggacactcttcgttaatcgtgtccgaatggcatccgcttttgctcgtttcgattctaaacgctccaactcttcttcaaaggccttttcatttagaatatcgactgggtttgtaatacggatgacttgctctgctgagatatattgatccatcagcttttgcattttcgcctcatactctttatggtcaattgtatccgaataacgcaattttacactttttcttagctcttggaaaaacttcaagtcctttttatacgtggcaagttcttctggctgtagtgcattatagattcgttcggattccaatgcaatcccaaggttacgaccgaattgacttaatgtatcataaaacgattctctcttctcttcatcttctaacaatacttcatactcttcgacatcttgcttatttttaattgatgagaacagttgcagtaagtcagaatgatgctgacgaagtgaaccgactacgctaatgacatcatgaatggctccttgcagatctttcggatcaaaattctctaaccctgcacctgaatacatttgcagagcttcatctaattttgataacaatccacgataatcaataataagtccgtagtcttttccttcgtatagtctatttaccctggcgattgcttgtaagagcgtatgttctttcattggtttatcaatatataaaatcgaagcccttggagcatcaaaacctgtcagtagtttgtctactacaataagtaaatcaatatcatcaccatgaataaactcatctttaatggcatcttcatagtcttctgctgtcccataccgattcatcattcgttgccaaaaacgttggatcttatcattcgattcttcatctatcgcatcatgaccttctcgttggtctggtggagagataacgactgcacagtttaaatcacccagttcttcaaaggcttctaaataacgaatcgcttccatcttgctattagtcgcaagcatggctttaaactgagaaccttgtgtcttgtaattgcgataaaaatgatcattaatatcaaatgcaaccatactaatgcgttggtcagaagaagcaattcgttcaaaatgactccattttttcatcacttcatctttttgcttatcgttcaaatgacgagtgatcatcgaaagtcggttatcaatcgctgttttattaaccgtttgatcaaccattttcccttcgtacaacagcggaacgatcgctcgatcttttactccatcggcaattgtgtatttatgaatgagctttccaaatttgatcatcgtgcttttttcttttttcatgagaggtgttcctgtaaagcctaagtagcaggcatttgggaacacttttctcattttaatgtgcaattctccatattggcttctgtgcgattcatcaacaagtacaaagatgtctcttgattcaattggctgttgttttgttgatgccgtatcgaatttatgcactaatgtcgtgacgatatcagcattcccatctttaatcagtgaaactaaatggcttccagatgtcgctcgacttgcttttaatctcgtgtgattaaacgttttgtgaatttgcttatccagttctaccctgtctgttacaacaataatttttggatggtagtcatttaactctgataaaatgtaacgggcaagcatcaccattgtgagcgatttcccactaccttgcgtgtgccagataaccccgctctgtcgattcccattttcatcccgctcttgaattgttgttaatatctcttttatcgcaaaatattgctgataacgtgtcaccttttttacatctttatcaaacagtgtaaagaaacatgtcaattcaagcagtcgttcagggtggaataaggaaatgatgtttttgtcttgcatcgttggcaatcggttttcaacggtttgatgtaaccaatgatctaaccattcctcatgctcttctttccacactgaccagaacttcttcggtgttccacatgtcgcatattttgtttcgtttttatttgttgccatcaccatctgtacaaacttaaacagttggggaacatagtcatttttttgatttcgaatcatttgactaatcccttgttccatggaaatcgaagcctttttacactcaataaccgcaaacggaatgccatttacaaacaacacaatgtctggacgaactgtacccctgccgtctacacgttcaacagaaaattcctctacaatgtgaaaaacattattttcaacattctcccaatcaatatattgaatggtaaatgactttttcgagccgtctggaagtaattccgtataagttcttcctaacatcaacgtttcataaatgctttcatttgcctttacaagtccgtttgtgagtggctcatccaaatctcgcatcgcttgttggatgttcgcttcactgaacttgtacgtaacacctttatactgataggaatttaactccttcaatttattttccaataccgttttcagcaaaacgctatagagattctcacgcatcgcctcagctcgttcagcctctatgtactcatatcctaagccttgcaacacctcgatcgcaggctgttgactaatgtaacgttcatcataactttgcggaatcgacatttctccacctccattgttgagaataaaggaaaaggagtaaaggaattataccttcactcggactttccctgttagaagaagttgcataagaccttgtttttgttttctataagtctctaattctttctctaacaaataaatttctttatcactacattctaaaatttttgactgtctttgttgttctctaagtgacgggagtttaattgttaacttgtataattccttaggttggatccgtttagaacctgtaccacttgagatattttctaaattagtatagaagctttctcttgaaaaataataataaaaccagagaccatctacaccttctttaaaatcaaaacaaggtatgtcagatgaagactggaatccatctaactcttttggaatcaatccaaatgcccccttatgaagattctgtttcccataaataaattggccttcttttctgatatattgtgtagttgctccctctttttccaccgtagatatttctcttttacaaacaccttttaaatttaatcgcacagtaatccttttatctaattgcggattttttgcaattaccttgctttcttctaatagttcaccgatttttttcttttcccatttgtcactaaacccaggcaatctcactttaccagtcagcaacttctgcattaacccttttttctgctctttcttctgctcgattagcttttcttttagctcaattgccttatcccaggtagagaggatggaggcgattttttgttgttctgcaaataatggaataccgacaatcatatcttttatttcattactactaagatttgggaaagtagaacccgcagtcttttgtaataactgattaactttataatttaatgtgtaataaataaaacttgtttcagctttatcttttttagctctaatagaagctactcctcgaccaatgcaatattcatcatcagctatattcatccgtcctgttgaacttcctcttacacacaataatatatccccagctttacaaagttttgtaggtttagatgtccattgttttacaactgggtatttattcgtaaattctgttggtccattgattaaaccgattccatccttgatatcattataggaattacctggtggcgactggcccatagtaatgtcagcaatgtcactaagatttccattttcccatttgtattgcttaaatgcttccatgaaattcacctaaaatcctttctatttttcactgtctaactgcttcctttgttccaaaaattgatcaaaatcatctttcttcggttctgctaatcgttgttgatgaaacacttcatattgttcgtttgcaaattgttccgctactttggctttaattttcccagcgttagttaatatttcatgttcattaaactctaaaaatgcatctaatttttctgcccaatccttcatgtacatcggctttttctttttcgcttgtgtttctgcatagtctaaatacattgtcacgatacggtttaaatcgctgagttcttcttgtgttaaataatttttcgccacagtgacatcatgtttacgcactttgtcacctttccaactcgttaagcccatgtttggctttgttgcatccgctcgtttcattatcagttccgaagcagtatgtccatggattgcaaaatggagtttattttgaacggttgcaaagaattctcttgcaattggtgtattcggatcgtaatcaatagatgtagcatagatatctgttattttgtaataaaaacgtctttcggaagcacgaatatcacgaatacgttccaataattcatcaaaataatctgccccaatattccgcatttcttttaagcgttcatcatccatcgtaaaaccttttaccatgtattcatttaaacgctctgttgcccattgacggaattgtgtaccacgatgagatcgaacacgatagccgactgcaatgataacttcaaggttgtaaaaggtcacttcacgttcaacttcacgagaaccctcaacttgaactattcggtttttccgaatagttgcctcctctgttaactcaccttcagcatatatatttttaatatgctcatttattgttggaacacccttttgaaacagctctgccattgccttttgcgtcatccagacggtttcaccttctaaacggacttgaattttcgtatcgccattttcggtttggtacattagaaaattagattcattattcacctaatcacctcttttaattatcatcaagtagagaccattgaaaattcacttaatctcttattcaagtttttaataaccttaagtggagtttcttttagttctataccagttccataaactaaatggttccatgcacctttttcagatttaaccgacacacgtcgattttctgttttaaaacctacaccgatacactgattaaattcctctctacttaaaatcactatctcactattaactaaatcttcaaccccgcaaataaaagcaaacatattgatagattggtcttgttgaatgttgtttacttcatccaaattgaatggaaaatgccacattctgttttgacctttattactttgcttcgatacatacttcgtataaactttatagtcaccataattagttgacaatttataaatacgtcttttttcgctattttcaaaaatagctggggcaaatccgctatttaccaactgtgataaaaatgccccataataaaaatccccctttgctaacatcttaattccccctttgtactgaaaaaactacatttgttacagccctaattccttcaaatatttctccatctccgcttccacttcttgtagctcttgtttgatgtttgcgatattctctttcaccgcatgcatatccactggctcttcttcttcaaatgtgtcaacgtaccgaggaatgtttaggttatagtcgttttcctttatttcatctaaagtggcaacataggagtatttatcaatcgtttcacgcttttcatatgtgtcaacaattttagcgatgtcttgttctcttagctgattttgatttttccctttttcgtagttcccttcggcagatgcatcaataaaaagaacatctttacgagtacgatttttcttgaacacaaggatacaagcagggattccagttccataaaacagaccttctggtaagccaatcaccgcatccagtaagttcatctcaatgatttgttgacgaattttgccttcgcttgcccctcggaaaagaacaccatgtggaagaatcgttgccattcgaccgttttccgctaatgaataaagcatgtgttgaacgaaagcataatctccttttgaacttggtggaacaccccactcaaaacgtctatgtggatctaaacttgcttccattttaaacttgctgtcgtttgttccttctcccgcaaagcccatcgcccacttatcaagagagaatggtggattcgctacaattgcttggaacttcattagctttccatcttctaagtgaagtggatttgctaacgtatcgccccattcaattttcgcatcgtctataccatgcaaatacatattcattaatgctaatgagtgcgtggctccgtttctttcttgtccataaatagctactttcttatttggtacttgatttgctacacgaataagaagtgatcctgatccacacgtcggatcatacaccctatcattttcctgtggtttaacaagacgtgctaacagttccgaagccatagaaggcgtgtaaaattctccgcccttcttacccgcatcagatgcaaaacgttcgatcatgtattgataagcatcaccgatgacatcttcacttcctacaacagaaggctttaatgtcagtttattaaaatcctctaataaagaacggagcattgcatttcgttcttttgccttcccaagaatcgcttcactgttgaagtcaatgttacggaagacacctctcaacttacctgtgttttcgttttccagacgttccaatgctttattaataatttcaccaatttctgcatcattccgtttgctatacaaataatcaaatgtagactgttcatctaacacaaaacgttcccttgataacgcacgttgaatacgttgctcatcaccattataacgcttcgtatactcttctaaatgctctttataagcatcacttaaatacttgatgaacagcattgtcagtatataatccttgtatgtactggaatcgacctttcctctaaatgtgtcggccgcttgccataaaacactgttaatttggtcttttgttactttttcactcattctaattcctcccttatttcaccttgcacaatttgctttgtgatggcgttaaaccatttttccttttcttcaattaatctattgtagagtgttttttcttgctgatgtaacctccacagtttaataacagcttgttgcttgaaaataggtatatcttcaatcggaatcgaatttaatgccgatttatttgtacttggtatacgagttccagcctgcgaacgttccaattcttttttaacactgtctgtatttaagtaccatgctacatattcagatataaatttagactgatccactttaataatggcaaagtaagatgggactaataagcctgattttgtttcatctatatagacagacgtatgaggataatttaatcgaattagtacatcgcctgcttccgtaaagtgttgattatttaacaggtcattgctatggaacacttcgaatggttcatcgttaaagactccctcttcagtaatattttttaaggtaattaagttatatgtggctttcacttcgttccccacttctactttctttctcgttaaaacaagtcctgttcgaatgtctgcaatatctccaagattcatagtacacctccttctaaatttgttaaatcgaatatttaattccgtttgttaaatgaattatataacaaaaacaagttaaaagtaaatacattccagaaaaaaagagccttgttttttaaacaaagctcacacaaataatattagccgttatacaggtagaaatctgccattccttcttgccgtattcgatgactgtcttctatctcccatggttcttcttccaaaaagtcctccaccaatctattaggcgaataatccaatcttgttaaaattgcagattgaatgccttttgtacctttttcttcctgttcacttataacatttatatcttttccaccatataggtaaggactaaagaacaaaatgaattgttcaaatatctcagcgatttgttcaaatgtttcttcataggtttgcaatggttgaaaataaacaccgactttccgatctttaaatatgacttgagagtgtattttttgtcgaattgtttgctccatatttttaaatctctcatattcttttcctcttgaggaatcgaaatttagttcaacaaatgccagtgattttgcgttatttgccgaacaacgataagagatgttgcttcgaccagatccaactgtaagcacgtgatcgtggaggttcgtttttttccgataatgaaagtttaaaaagtacggcaatctcttttgcaatacttcgaacatatctcctctttttctacataggttaatgacactttcctcatgtcattaaccttgataacctcaaaaattcactacgaaaggaagatccccaatgaaagaatcccctactttaaatctccatgaagaaattgaaaaacaattattaattggagcagagctggaaaaatacaatgcccgaaaatttcttaacttactgtccgatatgattgtcaaatatgaatctactatttacgacaaatttaaggaaagcagattaggagcgtgaatgatttatgcgagctgttggttacgttcgagtaagtaccgataaacaattagacaatacttctattggaaaacaaagagaggaaattgaaaaatactgcaaaaataatgatatttccctcgttcacatctttgatgagggggcgaaatcggctgaatcatttaaaaatcgtactgaatttaaagagttgtactcatttgttttagataaaaaaacaaaatagattacgttgttgtttatgattctgatcgtatatcgagggataatttagaatccctttatatttataagcgattaacacaggcgggaataaaccttatctgtatagctgacaatattgatacaagagatccaagagcgaaaattctttaccaaatcatgtcattagttgctgaattagaaagagatatgattattttccgaacaaactctggcatggaaaaaagagcttctgaaggacattttaatggaggcgtaatttatggatatgcatcaaagaataagaaacttaaaattgtgcctgaagaagcaaaagtcataaattatatttttgagaagtatgcgataaatcagtggggttatagaaaaatagcgtcacacctaaatactttaggtatcactactaaaaaaaataatttatggtcaataactgccgtaaaaacgatactaagtaaccccatatatattggcaaagtaaagtggcggaatgaactgagagatggaaaacatgctcccatcatagatatagaattatgggagaaaacacagcaagtaatggatctaaacagttatgtgcaagagaagttgcatcctggaagcttccccttatcaggtttgttaaaatgtccagaatgtggttcagccatggtacaaggaaatagcagtccaaaatacaaatactaccaattctccagaaataagaacagtggtagtaaggcatgttcctcaaaccttgtaaaaaaggattatgctgagcaacatgtatttgatcaattattttgtgatttgcaaaaatacaatgttaaagagccattgattaaaatgattcactcatacgccatgagtgaaattgagccattggaaacaactatcaagacgtatgaagttgagttagaggaattaaaaacgaagagaaaagaacttataaattggaggctaaaagatattatttcagaagagattttaaaagaggaaatggaagatttacgagaggaagaaaaattaataataactcgaattgaaaaattacagcacctcattaaactcagagataaaacctttttaaccaatatcatttcaacttcactacacgatctaaagaactttttcaatattatcgaagatgatgacaaaaaggaattacttcgttctctcattgaagagattcacgtaaatccaggaaaaactactaaggatagaacgatcaaagaagtgatttataagtttgatttaaaatatttgaaatcaattgaactaagagaaggggaacatcttttctcttttttgtgtttcatattataattacaaggaagggaggattattatgcacgaaataaaacgtgtcgcaatttactgtagagtttctaccgaagagcaggcaacggaaggatacagcatatctgcccaattacaaactttacgtcaatatactcagttatatggttgggagattgcagaggaatatgtagatgagggaataagtggaaagaacattagcggtcgccctgcaatgcaaaaacttatttcagatgttgaaaaggataaatttcaagctgttcttgtttggaagatctcacgcctatcacgaaatatgttagatactctcactctattagacaaattcgaagattatggagtaaagttcatctcttactctgaaaactttgatacaggcagtccaattggtcgtttagttgttcaactaatggcttccattgcagaaatggagcgtaatacgttatctgagaacgttaagctcggaatgaaacagagagcattagaaggttcatggaatggaggcgttgtatttggctacgatacaattgaaaaagagcttgtgatcaacaaaaaggaagctgagattgtacaacaaatctatcaactatatgccaatggtaaaggcttaaagtcaatcgcaaactacttaaataaagcaggttacagaactaaacggaattgttatttttcgataaacggtgtagctcaaatcttagacaatgttatctataacgggaagatcagttggttaaaagttgaaaattgggatacaaaacggaggagagggaaaaatccaaatcctatccttgtagaaggacagcatgaagccattatttccgatgaattatggagtatggtacaagcaaggcggaaaagtaaatcatttaaacaaaggcaatctaatgaaccatttttacttagcagtcttttacgttgccccgattgtggtcaaggtatggttcctgccattacaacaaataaacgaaaggatggaacaaagaagaaatatcgttattatgtttgctctaactttcataacaaaggttcatctgcatgtagagcaaattcaataaaagcatatgatgcagaatacgaagtaattaataagattgagaagatcctttccaaccaaaatcagttattctctaaacttcaatctataaatactacttcgattgaatctttaaaccaactcaatagtgaattgaaacaattagaaaatcgcctatcagaaatacaagagtacagaatcgttacttggaagcatttgagcaaaagaccttaccaatagcaatcttgcaagaacgattacagcatgtctctaaagaaaaagcagagttagaacaaaggcacaatgaatcactgggcaattaagctcgaacgatgcaaaagtaataaaaccagaactgattcaaaagcttttagaaaaattccttttagtctataaacaatcatcaagagaaaggcaaaaacagttacttcaacttttgcttaataaaattacagtaaagcatccaattggtcaatcacgaatggtcgatcaaattgaactcgactttgacttttcagaggtcaatatttctaagacctttacacttatccacatgttgtatagagaaacggataatgcaaatggttttccaaagccaatacccgcttccgacaacaaaataccaccatatttacatcattttttgcctctatttatggtacggttcccctcgattaatcctaaaagcccgataaacctgctcgagcaaaatcagtctcatcagctgatgcgggaacgtcatccgtgaaaacgacagcttctcatctgcgcgcttcaggacggcgtcgcttaagccgagcgagccgccgatgacgaaggttgccttgctctttccatatgtggcgagtctatccatattatcggctaattcttccgaacttttcatttttccttcgatcgccagggcgatgacgtgggcgtctgggctgattttggagagaattcgttcgccttctttgtctttgacgattttcatgtcctggtcgcttaggttttccggtgctttttcgtccggaagttcgatgatgtcgacttttgcgtatgccgaaagccgttttatgtattcatcgattccttgttttaaatatttttcttttagttttccgattgctacgattgatatattcacaggtcatccccactttaagaacaagttattcagatgcattatccacaattgtggataaaggttgtgtatttagtgtccgatcattcgttccccactatatatactgcaggcttatcacacaattcacaggttgtggataaactgtgtgtatgttcgatttttctgatttccggggccaattcttcctcatccacatacatgtcaatgaccgtttcaatatgctcttcgcaagacttcataaaagtccctccaatatctgtatcattgggctcttttataaaaaagctccttattcaatataccctatttatgcacatgttagtaggttttagcatgacttcacgcggttatccacaagcttttatattcctctggataactctgttctctccaaataaaaaacaccagccaatctcgctgatgctttaatcttgtttttatactgcttctcttttttcctgaacaactaaagaatgctgatttgtaatatactgcaaatatgaaacgttaagaatgaaagtccaaaacccgttaacctgcttttccgacagcccaataaacgcttttctaaccttaaatgcactatataaatttaccgtccaaaaaaggaggaatgagagctgcgggagaaagctgtgtccggggcgcagcgggagaagcaaaatgctgttgctgtatggcagcaggtcttcactttgaaatgtgattgaataaaaagtccaaaaaggctccaaaattgaaaagacgcttaacagcagcgtcactttaatggcgacatacgggagcttaatttggcatcgttctaaattctttcttcttgagagaaaccaatacgggatgtatatgccggacgttatgatcgttaataacaccgcatataagggttttattttcggaaattcctctaattccttactcatgctgaaacactcttctttccttaaaactgttcttccaggtctttttatccttgtcatctatacttttccactttccatatcaaaatgtactatattgaatccaataaatcaaaatccattgaagtgttaaattgggattttcttaggtatatggattcttttttttgaccggaataaaaaaactatatccttttgcccattccttatttcgtgttcatctgcagaaattcgacaatcaataggacattattcgtcatatttttacctttgtaatatgcaatctgtcattacgcaacataaaggggttctatcgaatcattttgtctttttttcgttatttttcgtatctctcaactaggaataatgacacgctatgttccatgtggaacattggatatgaaaaaagatcaaagctttcacagctttgatcttacagtctcttgctcatatgcaaatctgtcgtctcgaaattcattttttcatatagtcgcttcgcttttttattatgggcgaatacatgcagggacagctttttgactcctaattgctttgcctcctcttctaagacggctaaagcctgctggccgattccctggccgcggtacgcttcataaagcccgaaatcgtaaataaacgcttccttttgagggtggtgcggatcagcgtagatccaaacccagcctgcggcgttcccgctgtcgttcatgattgaccatagataatggttgatcgtttcaatgccgtttggcaaaagggccgcaaactgctcttctgctttctccatagcttccgccactgtccatgtgcccgcttttactttctccatggcgtaatgctggatggaataggtctggtatatcttaaagtcctcttccgtcattggcgtcaaacggatttccggcttttttctcggtttgttcaagtcaattttaattttcgatttcaacatcaaattgtacttcacttccttgtttatagatcatgatgctttgctcagccattcgcttttcggctcggaaagtttattgattctgtgctgaatgtaaatgatattcaaaaggaaggcaaaaatcgatccattcgcaggttctttgcctgaaagcttgtttaatgaagcagtcaccaccagtgcgcagtatatcaaaacacctgcggacagaatcaaaatcacgcggtcgagcaacatatacaggctgtaatgcatgtcaggaaaagcgatttttgctgatattctaattggaatagaaaataaatgataaaatatgatagcttttaacgtggtgtagggaatatcatgataaggcagcaaatcgaagctttttttcctggatagaaaccagtatggtatgtaaacccccagtgtgatcagacatagcacaaaaacggacaagatacttctgctctttacattagacagcgttttcaacgcagcctgcacattgtcgttcatatcattcctccggacactcgttttccaaacaaatgaattgaatgaattttttcatagcagcggcacaccccctcaatatattcttttctcttgttttagacaatatgacttaggtaccaatgtgacaaaagaaccattttttgaagaggttgctgtcttcacgattagctgaaaaatgtgtgacaaccgtttttatgtcataagaatgacacaaaagcaagagcctgactggaaaatcaggctcttttgtctaacgctatatactttttcgaagagaaatccgccagttgatgcctgtgccaatatggtatgttttagcaaatgatccttggttgagggcaatgcccaagcggtctaatgaattgatataaacaaccggcttgcctacaggcatatcggcaaacgaccggccaaatgccaacgtttgctgatagacttttgtgtcttcatgcttgatgacgacttctactggatctccgtattgaacatcaagtgacttgaagagcgtccggctgatattcgtccaaaggtttccaaaccggacatctaaaatatcgatcgttccggttatccaatcattttcgatgtacgcttccatgaccggcagtttgacgatggaatctatagaaacttccggaccgatcctgtcgaagctgagagcgccggctgccagtcttgccccggtgtaggcgtaaatgtcgcgtccatggaatgtatgtgattcgcctgattttggaagcctgttttgcgcttcatcaagatagcgcgcctcggcaattccattttgccggctgatgtgggtgagtgttccgttgtctggtgtgatgatatattgattggaagaggttctgactgcgacgctgcggcgttctgagccgacccctggatcgacgaccgacacgaagacagtgccttcaggccaataagaaacggactgcagcagccgataggaagcttcacaaatgtgaaaaacgggaatgttgtgcgtcaaatcaaaaatccgaattgaactgtcaaccgaataagccacaccgtacatcgcatttaccgccccgtcatcaaggccaaaatcagattgtaatacaagtgcatgctgactcatcctatctccctttccgccctgatctttaaatcctgcattaaatcggccatttgtcagaatattaaagtcatcatatcgtacgcaaaattgaaacgcaatatgatgctttgtccattttttacaaactataatttttgcagggcaaaaacttggaattcacacccaaaaattcgattattcactcagaaaaaatctcatttcactctccaaaaatcacattttttccttttgacgatcattcgttgggcgcttcataataaaaaaacagcccggccgtaccggccagactgtctttatcagcttcctaattgggatcgggtcagctttacttctgttgtcttttcttttccgccccgcaggtatttgatttttaccttgtcgccgacgtttttggtgtaaagctttttacgcagatcaacgatatcgtaaacacggtcaccgttaaattcgacgatgacatcgagctctttcagaccggctctgcctgcaggagataccggctgaacacccatcacaactacgcctgatgttacgtttttcggcagtttaagcgtttcctgccagtggtagcttgcgatatcgccaagtgatttcatctcaattccgagatacggccgtctcacttcaccgtacgtttccaaatcttcgataaccggaatggcaaggttggccggaatgctcagaccgatgccttcgacggctgattcagcgattttcatcgaattaatgccgatgacttttccatcaatattaaacagcccgcctccgctgttacccgggttaatggcagcatccgtctgcagtacttcggcgttccagtccggctgtccgtctccgttggaatcgaccggcacagcgcgttcggttcctgagatgattccttgtgtaacagagcctgaaaactgcaggccgagcgggtttccaatcgcgatgacaggctcgcctgtcttcactttatcagaatctccaaattcggcagctgcttttattttgttgctgttgacttgcaggacggccagatccatcagcttatcgctgccgatcagttttgccggaatccgtgttccgtcattcaggctgatttctatttgggacgccccttcaatgacatggtggtttgtcacaatgtgggatgtgttgccgtcctttttataaataacgcccgagcctgttcccgcttcgctgtcaccatcccatacacctgtcttttggatgttgataacgccgacaacagaatcagaaaccttagagaccatttgcgtgacttcattattcacgttgacggatacattgcggaccgtcccgccctgctgtgctccttggccgccgcgcgcttcgatgacttgcagattatacggcagccatccctgctgcgagagatacggcaaggcaaacactgttaaaagagcgccgatgacggcgccgaccaggcttgaaaacaaaaagcttctccaacttctcaccggcttttcccgaacgaatttttcctcatcatgattaaactccactatattcaaatcctttcaaggaacgatatatgtatatagtgtggatcatctgcctgcagattaatcattcaatcaggaaaatttacaccgctacgagaggcgtcggtttcttaggatcggtatcatataagtcaaacgtttctcctgccgcaaatcctttggcagccagcgtttgctgcacagacattcttgccagctctttcatgttgttgtcctggcttaaatgagccaaataaattctcgatgtctcattgccgattacatcggtcattgcgagtgccgcgtcctcattggatacgtgtccgacgtcgcttagaatccggcgcttgatgttccacggatagcggcccatttgcagcatgccgacatcatgattgctttcaaaaacaaaagcgtttgccgagcggatgatgcctttcattctgtcgctgacatagcccgtatccgtaatcaaagcgagctttcggccattgtaatgaaaaacgtaaaacatcggctctgcggcatcatgggataccccgaacgattcgacatcaagggagccgaatgacttgacggtttccattggaaaaacgaacttttggccgttatccattttgccgatatgcccttccatcgccttccacgttttttcattggcgtaaacgggcagctcatattttcttgccagcacgccaagcccttttatatggtcactgtgctcatgtgtaacaaagatgccgtcgagctgatcaagctttcgatcaatttgcgccatcagcccttccatcgccttcccgctaagtcctgcgtcaactaaaaaagcgtggtcatcggtttccaaatataaagcattaccggtactcccgctcgcaagtacgctaaattgcaggctcatggtttctcactccattatgatttttcctttttctcttgtgattgaagaagcgctccgtcccgtgcatccacgataaattcttcgtgaatggttttatcgtccgttttgcgctccacttcgatccgccaaacgggcacgaaaatttgagcgcttgccagcggatactgcgtgaaatagccaagctcggctgatttaattttgctgtacttcttcaaataatccgggtagtacaaagcttcaaccgcgccgactgcagagatcagattttccgttttgacttctttaatatcctgcagcattgactgcttataagacacgacttcgtttttattattcaggtacagaacgacttcgcccatctcgttgttatcatcattttgccggtcctgaaaaatgtaattcccattataggtttggaagaaaacaatctgttttccggacttatcgaccttccaaagcttgtacttattgccgtcgataatctcttcattcacgatttcccttgcttttgtcttcatatccgttttcggaagcgcaatgggtgtttcaaactccatttctatttctgtcaaagcgttctcttttgcggtattcattaacgccttcggcttttgcccttttaacgatttaatctcgctttgcttaaagactcgcttttgtgcagagattgaggagccttttgacgtctctttagacaaattgccgtatgaaatatggtctgctttcatatcctcctgcagcgttgatttttctaaaatcggaaactgattgttgctgcgcttattaaagtattgaaaggccaaaaagatatcaaggatgaggaagacgataatgaagattgtttttgttctattccactccattttctatgccctccttcaccgctgaatccttctttgataccggctttaccgtaccgtttattttaatgcaccatgtcggcacaagtttgacaagagggtcttgttcctctgatactgagaccatttcataggcggggaaaatttgctcaatcttatcaaagtcatactcttcattgtcttgcaggaactgaatcaattcttctccgctcatgatttctttatcctttttgctgaccggatttgcgtttgcgcccaagacatatgtcgggtgtttatagtccaatatgtcgttgtttgcccagcgaagttcaatcgatgtcgttccgaaaggctggttttggctgttaacgaccggcagctgatccataaacagattaaagttgatctgctgattttcattcaaaccgaaaaattgataatcatccgtccagcttcccgtgtcgtttaaatatttgaagcttttattgatcagctctccattttgataagaagtactcggttccaggttgcggtgctggaacttaatctgtctgttgttcgagtagatctccaaaaggcttgttccatccgtatataccggtctgtttaagttggtttcctgccgcacggtttgcggatcatcaaataaagcttttttaaaacgcgtcgggctgatcgtttctgtaaaatactctttttcagacagcttcagccgattaaccggaagcaagacatctctgcgcgaattgattgcaaaatcctcataaagaggcatctgcgacttttctttttcaatgtctgaaaggatgttgcggtaatttgccgattcaatcaccgcttcaacaaccgtctctttgctgaaggatacaaaatagatcttcttcatgccccgtccttcattgaaaggaagaacgattctgtcaaaagagttgtattcataagaattggcggaccatttgaaaagcggctgcagcacatcgatcggaatgttgtcgctgaagacgagatccaatttggagtctttatttttagcgtatagccagtttttgaactgctgcctgtcaaatttgtccgagatatcctttaacgatttgacttcccatcgtcccatgtcatcccagagctgagaatagagcgtcgtgtcattcagcaaataatgctgtccattctcatgaatgaacatttgctgcggtttgacggcttcatttaacaactttgtctggtttgtaatcggctgtttgtcgctgacctgagcctgtgagtcttcaactttttcgtaattcccctgaaatccccaaatattaaaagtaaaaagaagactgatcaaaaccaaaagggacagtattatcgttttaattgtttcacgcttcatcccaatcatcctcttgttcttctttatacggcagggtaaatgtgatcgttgttccttttccttcgatgctgtcggcccagatgtcgccgctatgggcttgtaccatttcttttgcgatcgcaagaccgagtcccgtaccgccgagtcttcttgttctggctttatctacacggtagaaccgctcgaagatcttctccacgtcttttctcggaatgccgacaccttcgtctttgacactgacataaagaagctcttcttcttcatttacatcaacagagaacgtgatatggcctccttcaggggaatatttcaatgcatttgaaatgatattatccagcacttgcgtaatcttgtccggatcgatttcaacatacaattctctatccggcagattgctgataaactcaacatgctgctctttcgtcatttcaaagcgttcaataatcaatgagaagaaacggataaaatgaatccattctttattgaattgataatctttgctatcaaactttgaaagctgcagcaggtcgttgacaagcctgatcatgcgctctgtttcattctgtgtcacattcaagaagcgcggcgcaatgtttggatcctgccatgccccttccgcaagcgcttctaggtagcttcgcatcgttgtgagcggcgttctgagctcgtgggagacatttgcaacaaactctctccgctcttgatcgatctgctcttgttctgtgacatcgtaaatgaccgcaatcaatccgtcgatctttccgtgttctttttggatgaccgagaaattgacgcggagcacagacgtccgttcttcctgttcaatttcaagaagcagggaatcctgctgttcaaccaaatcttcaaacgtgtattcgtcttcaaggccgagcagcgaagtgatcggcatttcaagagccgtttcacgtgaaacatttagaagctccagcgccggcgtattaagcaaaataatcgcgccatttcggttagtcgcgataactccgtctgtcatatacgcaataacagaagatagtttttttcgttcgccttctgtcatggactgagcttctttcagctctcttgttaaataattaaacgttgtggccagctggccgatttcgtcgtttccgtacttcctgacttttcttgagaaatttcctttcgccagttcaatggcctgttttctcatatctgacagcggatgtgtaatcgttcgcgcgacaaaaatcccgagaaaagcagtgattccaagcgcaataaaagttccagacgctaaaatggtgttgatcgtccggatttgattgtagacattatccatcgatgccacgacgtaaatggccccgattgtctcttgattcgattttttaatcggtgtgaccgaaatccgcactttgctgtcccgctccgggtcgaaaaatttattttcgtatggaatgccgacaagcagcgtccttttgataatgccctctgttgtctttttccccgccacctcccggttataaggattggaggtcgcgatgacttcatagcttttatcaatcagactgacttcgagaatttcgccttctttgctgaaatcatttagaatccgctctgcatcttccttcaaggtagacgaggaagatgtgcttctatccttcgtcatttcctgttccagataatacgataggttgttcacccgctgatcaagagagtcattatatgatttaagaagtgacttctccatctcattgacaaagtagacgccgataatctgcatggcgacgataatcagcagaacgtatattaaggtaaacttaaaatgaatcgagcgaaaaaaacttactttattcatttgtgtattagtcctgttccggatttctcaaatagtagccgacaccgcgccttgtaacgatccagcttgggtgactcggattatcctcgattttttcgcgaaggcgtctaaccgtaacgtcaactgtccggacatccccaaagtagtcgtatccccacacggtttgcagaagatgttcacgcgtcatgacttgcccgatatgttttgcaaggtaatgcagcagttcgaattcccgatgtgtcagctcgattgtctcgtcgcgttttgaaacgacataggcatccggaaaaatgacgagcgatccgatttgaatttcgtttgaagacgattcttcttcggcaggagccgctgtgttctgtcttctcaggttcgctttgacacgcgccagcagttcgcgggtgctgaacggttttgtcacataatcgtcagcgcccagttcaaggccgatgactttatcgatttccgaatcctttgctgtcagcataatgatgggcatatcatattttttgcggacttcacggcacacttccacaccgtctttattcggaagcatgatgtcgagcagaatcatatcagggttgagatcctcaaccatctgaagcgcttcattgccgtcgtatgcgcaatggacttcatagccctcttttttcagattaaactctaaaatatcagcaatcggcttttcatcatctacaactagtatctttttttccattattcattcctcctggttcagagtttggatacagccagcggatggctgtctatgttttatatcaaagtacactgcatgtcatcattaaaaaaacactttctagaaatcgaaatagatttcttatacattataacgtttatgaagcaaaagttaaaaaaatagttcaaaggaaaacgtttggaaattaaatccacgctttatttttccgcttttatcacaacaattaaatttttgtgactttttttactgaaaaatgaaacattttatgcttcaaagccgtctatatagtaacgtcttcttcttcggccgggttaccggcctccctttttttctccttttcattccttcagcatttttatttcattgatttcagctaaaagaaaacgcatctgcttaaaaacagacgcgctttttagagtggctcgggacggaatcgaaccgccgacacacggattttcagtccgttgctctaccaactgagctaccgagccgggtatgtatgtaactttttataaaatggcggtccggacgggactcgaacccgcgacctcctgcgtgacaggcaggcattctaaccaactgaactaccggaccttgcatgattacagtacctgctgcggagaagaatcgtggtctcctccggagcaagcggggatttagcaataacgctaaagtaaatcaatgacccgtacgggattcgaacccgtgttaccgccgtgaaagggcggtgtcttaaccacttgaccaacgggccagggaaatggtgagccatgaaggactcgaaccttcgaccctctgattaaaagtcagatgctctaccaactgagctaatggctcaagattaaatgacacccttaaaataacgacgtccacatctcaggaagctttttcgggatgtctctcgatgtgtacgctgaagcgaattctccgaagcgtattcggacgtgctctaccaactgagctaatggctcgtctcgttgttttcgcaacaacgagatttatattatcatagaacgaacagaagtggcaatatatttttttatttttttctattattttttcccttcgtgatgatactccgccccttcgcggttcagccagtgcatgattccattcggatggaatacagacaacagccggtcagcttcatgaagcggcacccacttggcttcaacaatgttctcgtcaaacgtgatggcatccggacggtcggtgatccgtgctctaaagacgatgaaatatacatgctcgctgctgatcaccgcttcatttacggctaaaatatcaagaggctgaattccatagccagtttcttccttcatttctctcgccgcggcttccgtcagcgattctccagcttccaccttgccgcccggcaatgtccatgattgatttttcttgtttttcaccatcagaatgttgttctcttccgcgaatgaatatacaacatcgacacgttccatccgtttgccctccttgtcattgaaaaacaaagcccctgcggactgcagaggctcttctagaatttagttcggacgataaacgcttctcaccacatttgtttgagagcggtcaggaccgactgagaaaatggaaagcggaatgcctgtcagctgagaaactcgctcaaggtaatggcgggcattttcaggcaggtcgctcaagcttttcgcgcccgtgatatcttcggtccaacccggcatttcttcatagacaggctcacattcagcgagcgcttttaagcttgccgggaactcttccaggatctcgccgcggtatttgtaagcgacacagattttcaatgtttcaataccggtcaatacgtcaattgaatttaatgaaaggtcggtaattccgctgacgcggcgggcatggcggacaaccacgctgtcaaaccagccgacgcggcgcggccgacctgtagttgttccgtattcgcggccgacctcacggatttggtctccgatctcattgttcagctctgttgggaacggaccgtctccgacacgcgttgtgtaagctttcgacacaccaacgacgtgctggatttttgtcggtcctacacctgagccgatcgtcacgccgccggcgacagggtttgaagacgtgacaaacggatatgtcccttggtcgatatcaagcataactccttgcgccccttcgaataagacgcggcggccgtcatcaagtgcgtcgtttaagacgacggacgtatcgcagacatattgtttgatctgctggccgtactcatagtattcgtctaaaatgtcttctattttaaatccttccgcatcatacattttttctagcagacggtttttttcttccaaattgcgggcgagcttttcttcgaaaacgtccctgtccaacagatcggcgatccggattccgacgcgagcggctttatccatataagccgggccgattccttttttcgtcgtgccgattttattggcccctttccgctcttcttcgaccgcatcaagctttaagtgatacggcagaatgacatgggccctgttggagattctcaagttgtccgtgctgacgttccgctcatgaagataagccagctccgttaccaatgctttcggatcaacaaccattccgttgccgatcacacacgttttatccttataaaaaataccggatggaatcaaatgcagtttgtacgttaccccgttgaatttaatcgtatgtcctgcgttatttccgccttggtaccgtgcgattacctctgcattttcggaaaggaaatcggtgattttgccttttccttcgtcaccccactgcgtacctacaacaactactgaagacatatccgtgcacctccgttaaccttttcaaacgatatcaatatcaaacacattcagtttatcagtgtcatcccgtaaagtcaattgtaaatccgaacattaattttaacgttgaacatttttgttcgttattataaagcgaatttcatatattttctttttaatagacagtctgtaagtcaaatcttaaaaaaaccgtttttcttggacaaagatacataaaaaaccgacaacgcaaatattcaataagtaaggagggagatgccgatggagacggtattaatttttgcatcagttttatcgccgatcattttggctttggtcgaattggtgaagaagacggtcaaaatgccgaaaaatttgattccgctcgtttcactcttgataggtttgctgatcggtgccgcagcatatccttttacagaccttgaactggtgctccgtttatggtcaggaggactggccggattaacagcgacgggtttatttgaaatcggtaaaaaccgcaatgcaagaaaaaagaaaaatccctgagaacatgtctcagggatttatgcaccaggcgcaacacccgcgtcatcaaaccggcgttccaggttgacgaacttattatattcttttacaaaagcgagtgagacggtcccgaccgggccgttcctttgttttgcaataatgatttcaatgatgtttttattctcagattctttgtcatagtaatcatcacggtacaggaacgcaacgatatcggcgtcctgctcgatacttcccgattcccggatgtccgacatcatcggacgcttatcctggcgctgttcgacgccccgggaaagctgtgaaagggcgatgaccggaacttcaagctccctcgccagcgctttcagcgcacgggatatttccgatacttcctgctggcggttgtcacttgatctgccgcttccttggatcagctgcaggtagtcgatcaaaatcatgccgaggccgttctcctgctttaaacgtctgcacttggaacggatttcgctgacgcggattcccggtgtgtcatcgatgaaaattccgctgtttgataagcttcccatcgccattgtcagcttgccccaatcctcttccgtcaggtttccggtccggagattctgggcgttgatgttgccttccgcacagagcatccgcatgaccagctgctcggcgcccatctcaaggctgaagatcgcgacgctttcatcggttttcgtcgccacgttttgggcgatgtttaaggcaaaagcggttttgccgactgacggacgggcggctacgatgatcaaatcgtttctttgaaagcccgccgtcatcctgtcaagctcggtaaaacctgtcggaatcccggtgatgtccccttttctgttgtggagctgttcaatattatcgtaggtttgaacgagaacatctttaatattttgaaaggccccggagtttttgcgctgggcgacttccataatcgttttttctgcttcgcttaagaggtcttcgacttcatcctcccttgtatatccgtcttgggcaatcgtcgttgctgtacggatcaagcggcggagaatcgatttttcttccacgatttttgcataatactctatattagccgcagtcggcacagaatttgcaatatccgtcaaataagaaatgccgccaacctcttccaaaaggtccgtgttcgcaagctctgatgtcaccgtcaccaggtctacaggctcgccgcggtctccaagaacaagcatggcgttaaatattttttggtgcgacattctgtaaaaatcatctggaatcaagacttctgacgccaaagttaaagctgatggttctaaaaaaacagcacctaacacggcctgttcggcttcgatattttgcggcggcagcctgtcattcagaagatctgtcatgttaagcaccgtcctcccatttaaaaataacccaacgtctattttaccatttttacagaaaaaaaatagactcttgcagaatcgcatgttgtagaaatattttcatagaaagggagaacagctgtcggaatgtttgcttccctgatctatacgggaaacaaatcagtaaacaagtttcgggaggttgtttttcatgaaggtttatacggtatcaccaaatgccgagacagacgggtggtttttgaaactggaagatacggcgcctgttgagctttatgatacaaggacagaggccgtggaaaaaggagaagagatggcgaaagagaaccgtcctgcgaagcttgtcatctatgaccggcaggacaacaaagaagacgaacggtcttattaaacacctcggccgaggtgtttttttaaagattccacaattaatccacccggctgttccaactgtttttcaagggaatgctgaccatcaaatcggtcgcatgttggtacaaatcccattcttcataggccgcaaatttcatccgcagcgtttgcagcacattgcgcatatctttgtactcttcaaatgtgtaaagcccttttgctctgatctgctgttcatacaatttctttttcagctccgatatcgtcgatttcaagacgatcacctccgctttatttatatcgcttttttctttttcttccaactcacttgtcatatgatgttacaatatatattggagtcaatattcactgttgcgtactctgcgcgctggggtacaatataaaatggaggactttatgaaacctttacaaatttctgccgaaacggcgcaaaaactttcggaaaccttaaatcttcctcttgaacaaatcatgcatttgccgcagcatatcctgcttgcgaaaattgccgaaattcagaagaaagatcaatagtaaccttggatgatggtccgggtttctttttcatgtcacttttccacctggaagcaaaggagaatacagcatgcattacattgacgctcgacgcgcccgtttgaacaatatctttttgattgcaggaatcatatttatcgcttttaatttaagaccggctattacagctgtcgggccattgatcagttcgatccgctcggatatggatttgacgaacggcatggccggcttcttgacgacgctgccgctgttatcgttcgccgtcctgtccccggtcgcccctaagctcggacagaagcttggcaatgagagaaccctctgggtcggattggtcatcttattgatcggaattttgctgcgctcttacggagaatctattacattatttgcaggaaccgcattgatcggagtcggcatcgcaatctgcaatgtgctgctgcccagcctgatcaaacataaatttcctgacaaagcgggaattatgacaagtttctatacaacagccatgtcgatttttgcggcgctcgcatcagggatcagcattccgttgtcgcacggcttagcgtggggatggagcgcgtcgctcatggtttgggcgggcctcgcgtttgttgcgattttgatctgggttccccagctccgctatcatgatacgggaaaccgcacggtcagcttaaaggcagacggccaaacggtctggcgctcgaaaattgcctggcaggtcacattctttatgggcatacagtcgtttttgttttactgcacgatcgcctggctgcctgaaattctccgctcgcacgggatgagcatgtcgcttgccggctggatgctgtcgctgatgcagtttgccagcctcccgtcgacatttttgactccggttctcgccgggcggtttcaaaaccagaaaagcatcgtgctcgccctcggcatcctatacttggcggggatgtcagggctattgtacggaggcagtacagcgatgctgacgctatgggtcattttaatcggaattggacaagggtccagcatcagtttagccttgactttaatcgggctgagaagcgaaaatgccgatcaagccgcggcattatcagggatgtcgcaatccgccggatatttgctggcagcgattggtccaagctttgtcggttttctttacgatcacatgcactcatggaacggaccgattttactgttcatcggcgcgctggtcgctttgatcggtgcaggactcggtgcgggaagaaatcaatatatctatgctaaagcagcataacgaagccggcagataagccggctttttttttggaatataacctgacaaaccagcggccaaataaaccgtgatgccgtatgatcagatttgacaaaaataattcacttattggtctagacaactagagttgtaatgttctatactgatgataacgttttcaagaaaggacttttgactgtgaaaaccaaaccatctcaacgctatatttttaaacatcttcatatttacagtgaaaatggaatgatagaagacggttttcttctgacgaatggagaaaaaatcgaggcttacggaccaatggctgatattccagcttccgcacaaacggcagaacagctgacatttccggagaacttcaaagtgctgccgggcatgatcgatgtccacattcacggggcaaacggcgcagatgtcatggacggaacagccgaggctttgcaaacaatggctgaagccctgccgaaagaaggaacgacaagcttcctggcgacgacgatgacccaagataaagccacgatcgagcatgcgctggcaaacgttcaccggtataaggaagccggcggacggcccggaacagccgaagtattaggcgttcacttagagggcccttttatttcagaaaagcggtgcggcgcccagccgccggatgacattatagcgccggatctttcgttatttaaagaatggcagcgcatctcagggaataacattaaattagtcacacttgcgccagagctggaagggtctttggaactaatttcctttttgaaggaaacaggggtcatcgcatccgcaggccattccgacgccggactcaaagagatggaagccgggattaaggccggcctctcccatgtcacccatttgttcaacggcatgcgggggctgcaccaccgcgagccggggactgccggtagcgctcttctgcatgatgaactgaaggctgaagtcattgccgacggcatccatgttcaccctgccgtcatcaagctggcatttcagcaaaaacagaaagaaggcatcattttaattacggatgccatgcgcgcaaaatgcttgaaaaatggaacctatacattaggcggacaggaggtgttcgtaaaaggcgataaagccgttttacgggatggtacgcttgccggcagcatcttgaagatgaaccaggctgcactgaacatgatggattttacgggatgttcactcgaagatatcgtctacatgacagcagtcaatcctgccagacagcttcatatttatgaccggaaaggcagcatacggagcgggaaagatgccgatttgatcattttaaatgaaaaaaatgaagttgtgatgacgctttgcaaaggcgtgattgctttcagcaaaagggaggtttcaccatgaagatcattgaagctaaagattatcaggacatgagccaatcagccgcccgattcatcatcgagcaagtgaatcgcttatctgcacctgttctcggccttgcaaccggaggaacgcctctcggcacatatcaggttttaagggaagatcatgcgcgtaataaaacgacttacaagcacgtctatactgttaacttagacgagtatgtcggcgtttccccggatcatgaaaacagctatacattctatatgaaaaaacagcttttcgatcacattgacatcccgctcagccacacccatcttccgaacgggatggcttgtgaccaggatgccgaatgcagccgctatgaagcgctgatcgagcggcttggaggcattgatcttcaagtgctcggcctcggcttgaacggccacatcggatttaacgagccgggcaccccattttcatcgaaaacgcatacggttgaactgacacaatcaacgaaagaagccaatgcccgctattttgattcctatgacgccgtcccgtcgcaagcaataacgatgggcatttccacgatcatgaaaagcaagcagatcctgctgctcgtttcaggagagaaaaaagccggcatcttggcgaagctgctcactgaagaaccaaatgaagacacccccgcttccgtcttaaaaacgcaccaagacgtcgtcatcatagcggacagcgatgctttatcaatcgtgaaagaaaggggtatggccttttgatcaaaaaagattcccacattccgatttactatcagattgagaccgaaattaaaaagcttgccgaaacaaaagatttgaaacccggcgacctcattccttctgaaagagagttcgcagaaaaatatgaggtgagcaggatgaccgttcgacaggcggttaacaatctcgtcaatgaaggcattctcgtccggcagcggggaaaagggacatttattgccgagccaaaaattgagcagcctctcaaaggattgacaagcttttccgaggacatgaaatcaaggggcatgaggcccggcacgaaaatgctcggcttcggcgtcatcccgtgcgaccagagcacagcgcgcaaactggagatacgtgaaggggcttccgtctatgaagtcaaacggatccgcctcgccgatgacatcccgatggcttatgaaatctcctatttgcccgccgacttcattaacggcctgaccgaagacattatgagcgcatctttgtacgactatgtcgaaaatacgctctcccttacgatcgaccgggccgcgcaaacactagaaccggcgattgcctctcaggcagagagcgagcctctcgacatagaggaaggcgcaccagtcctgctcattgaacgcttgagctatttggacgacggcagaccgtttgaagtggtcaaatccgtttacagaggcgaccgctataaattcgtcattgatatgaagaggaaagaccaatgaggaagacagagaatacgaacgacaaaagcacagcacttgatgaaatgaatgctttagatatcgtcaccttgatgaatgaggaggatcacacagtccctcgcgccattacgccctgccttcccctgatcgctgaagcggcggagacgattgtcagccgttttgagcaaggcggaagagtgtttaccgcaggcgccggcacaagcggcagaatcgcagttcttgatgccgcggaactgccgccgaccttctctattgacgagagccgttggaccggcctgatcgccggcggatatgacgcaatgtggatgcctcttgaagaaaatgaagatgaccgtgaaaaaatcgtcgctgacctgaaagcgcaatcattctcgaaagatgacgtcttaatcggagtcactgcgagcggttcgaccccttatgtcctcggcgctttatcctatgccaaacagatcggagccgcttctgtttcgatcagctgcaacgcggatacagaagcgggcaaattaagcgatatcgcgattgaggttcaaacaggaccggaaattatccgcggttcaacgcggctgaaagcaggaaccgctcagaaaatgatcttgaacatgctgtcaacagcggcaatggtgaggcttggccgcgtctatcaaaacgagatggtgaatatgaggctgctcaatcaaaaattagccgggcgcgctgtcaccattctgatgaataccaccgggttatcggaggatgaggctctgcaagctttaaaagaaagcggcaatgacatcaaggcagcgatctttatgacgttgacaaacggaacgcttgaagttgcccgccgctgtttatcccatgaaaatggacatttgaaaaaagcgattcaatatcatcgaaaggggttttaactatgttgggatttcttcaaaatatcggccgcgcgctcatgctgccgattgccgttcttcctgctgcgggcctcctgctcgcactgggacgggaagacctgttaaacattccgtttatcgctgcttcaggacaatcaattcttgaccaacttccgattatctttgcgataggcgttgcgatcggattgtcaaaggatggccacggggccgccgctctgtccggagccatcggttattttgtcctgacaggcggcttagcagccatcaataaggacctgaacatgggagttctcggcgggattattgcaggcgttgtcgccgccgtcatgtataaccgctttaaagatgcaaagctgcctgactggctcggtttcttcggcggaaaacgcagtgttccgattatgacagccttctgttccatcattcttgcaggcattttcggcttcgtctggatttatgcacagcaggcaattgacgccattggaggatggatcattcatgcgggggcattaggggtcgggatattcggtcttttaaacaggctgcttttgccgctcggccttcatcacatcttaaacaacatggtctggatggtctttggagaatttgcaggcaaaacgggtgacatgaaccggttctttgccggagatccaagcgccggcgcctttatgacagggttcttcccgatcatgatgttcggtcttcctgcggcgtgtctggcgatgattgccgctgcgaaaaagcatcgccgcaaagcaacggccgggttgctgatcggattggcgttcacatcatttttaaccggaatcacagagccgattgagttcacattcatgttcctgtcgccgcttctcttcggtattcatgccttgttaaccgcaagcgccatgaccgtgaccaatatgctcggcatccatcacggctttaccttttcagccgggacgatcgactatctcttaaactttggaatcgccacaaagccgctgctcttgcttccgcttggtcttgtttacggcattatttatttcatcatcttttatttcttgataacgaagctcaatttgaaaacgcctggacgagaagatgacgatgagcaggaaaacaccgctgtcagccctgacacaggatcgtctaaatacgaaacccttgcggacaaatacatcgaagcgcttggcggaaaagaaaacatcgagacgctgaacaactgcgtgacccgcctccgcctcaaggtccgcgatgcttccaagctggatgaaagcgcgatgaaatccatgggagcgaagggattcgtcaagctcaatcagcacgaggtgcaggtgatcatcggtacagacgtcgaattcttggcgaatgaaatgagaaaacgtacggaataaaagataagccccttctgaggaaggggctttgttactttatgattgctctttcacgtgaactttcagtgttgcttgtacttccggatggagcttcacgggaacattcgtatatcccaatgagcgaatcgcatcgtttaattcgattttgcgtttgtcgacttttaactgatggcctttttgcagcgcatctgcaatttgtttgcttgtcacggagccgaataaacggccgccttctccggacttggctgaaagctccaccgtaatctcctcaagctgttttttcagctctttcgcagatttcagttcttcagccgcttctttcttctcttttttcttctgaccttcaagcgcgctgatattggcggatgtcgcttcaacagccagcccttttttgatcaaaaagttgtgcgcgtatccatccgctacatttttcacttcgccttttttccctttgcctttaacatcctgtaagaaaattaccttcatttctgaatgcctccttcgaaatactcgtcaatcgcttctttcagtcggcggagcgtttcttcaaccgtgatatcggtcagctgtgtcgcagcattggttaaatgaccgccgccctcgagcgcttccataatgatttgaacatttacttcgccgagcgatcttgcgctgatacataccgtgttctcgtctcttctcgccacagcaaatgacgcttcgacatcgctcatagacagaagagaatccgcggcttgtgcaatgataacctggtcaaagtattcgtccgcctcatcgtccggcagcgatgcaatggcgatgccgttttgataaaaaacggtatgctggataagcttcgcccttttaatataatgatcggccgtttcttttaaaaacttttgcaccaatacagtgtcagcgccttttgcgcgcagataagacgccgcatcgaacgtacgggagccggtgcgcagcgagaagctcttcgtatcgacaataatcccggccaaaagagctgttgcttcgatcatgttgatttttaagcgcttcggctggtattcgagcagctctgtcacaagctccgctgtagatgaagcgtacggctccatatagacaagcagcgggtctttaataaactcttcccctcttctatgatgatcgataacgacgatattttcaattttattgaccagcctttcttcaatgacaaaagaaggcttatgcgtatcaacgatcacgagcagcgtgtcgtcttttgcgatctcaagcgcctcttccggcgtaataaacctggaccacagttcttcgtattttttaatctccccgatcagtctttgaacacttgaaccgatctgattggagtcgatcacgacaaagccgtctttgccgtttgcctgtgcgaccttcaaaatcccgatggctgatccgatcgaatccatatcgggaaacttatgacccatgattatcacattgctgctttcagagacaatctccttgagcgcgtgtgaaatgacccgggctctgacgcgcgtccgtttttccataggattcgtcttaccgccgtaaaacttcactttcccgttcggctgcttgattgccacctgatctcctccgcgtcccagcgccaagtcaaggctggattgcgccaaatcgccgagctctttcaacgaggcaacagatgcaccgattccgatgcttaacgtcaaggaaatggtatgaacggatgtcttctcccgaacttcatcaagaatcgaaaactttgatgcttctagctcgcttaaaatatgttcgtttaatacgccgatgaaccgctcagaggaaacccgttttaagaaaatgccgtactcttgggcccactggttcaaaagcgatgttacttcactgtttatcgagcttctggtctggtcatcaagcccttgcgtcacatcgtcgtaattatcgagaaagatgtaggcaagaaccgttctttcattttcgtattgtttttcaatctgcgtctgctctgtgacatcaaagaaataaagcagcttttcttcccgtttgatgaccacattaaatttccgctcattcagcgtaatcgtttctgtgtccacttcctgcttaatcaaagggacgacagattcacaagtatcataaagcgaccggccgacgagcgtattttcattaaagcatgacgccataaaaggattggcccactcgatatagtactgatcgttaaacagcatgatcccgatcggcatttcaagcagcgcctcttctccgacttttttcagacgataagacagcgtcgatatataatcgtccagctcttttctgatttgggagtcggcccgcttcaaaaagtacaaaatgacacccagaatcagaacgccggccgcccctgccacccaattaaaataaatgttgatgaggacagaaatgattgtgacgacgattaaagaatatatgggatatcgaaataacggtttttcataaaaacttggcactcaaatcaactcctcaccattggagaacatcgcggctacgattttttcactctttctctcaagttaaagcctatatcaattatacctaagatgcgaacaaggtacagcaggggcgaaaacaacccgataattaaaaaaagaaccggcaggacagttggcagtttcttggcatggcaaaagtaaaacacaaatgaaaacccttggatgaccaagacaaagcccatgatgagactcgcatttaacagaacagagtaatatacactgccctcttcaacgggagccagcgacagaagaatcgtcaacaaatagatccaaataatgctttgcggaagtctcatatccctgaacggtttcagagacggtatttgtatgatgcgccgaagcaccggctttgcgagcagatgattcaaaaacgcagtgattccggaaaatatcacaatggccgttggatataaatattgcgcctgtttgaattgctcatttaacaattcaatctgcttagccacttctttatcatttccaaactgtttgatactcgattcaaaggttttgaatgtttcattatatgcttgattggccgtctctattaagtttaatccaagaaactgaacgctgatgataagcagcaggacgaacgaaaccatatatgtaacggctgctgcagcaatcgcttgggccggctcttttcttctgtagtaaaagcccatgatcacgcccgcggcacttactggaatagcaaacatcagtccgcctaaggaaccggcaatcaatgaaacgggtaaactgaccaaccccaccgaaatccccggctttagaccgtgcctgatcgtttgaaccattgcaggcagcggcagcgtcaataaaagaatggttccgatgaaaggaatatagaggctgatcatcagcaaaacggcaaaaatactgaccatgatagcgccttctactaaagctcttgtttgtttcacttgttcacctcgtatgttgaaatgtcatgaatcaaaaagagcagcatagacgactgctcttttctaacgtcgcaatttcattttcaaataaagacgatgagatgagcaggtctcggccttctctcattgtttctttattctaacataaggtcaaatcgcaagtaaaacgatcataaggcttgaaagcgagcgaatgttccatgtgaaacagtgtcagtcgagaaaccccgatttttctttatttttctttctcgcctttctgatcagcaacaatataatcaaaactgcgaccagaagcgtcacgcgaagccctccgctcaaaaatagaaaaaagtccttcaacatatccaacacattgatcacctctcactgttgtcacttagatgcaaaaatcccgtattatttgacttcccctttccaaaacggtctaaaacgtccctcagattcttcttaacctttagacggtaatgggcatatgctgactaagaaaaagcaataaaggagaatatgaatgacaacaaaaacattggcttggcatgaaacgttggagttgcatgaactaatcgcggcacagtctgtcggattggtgaagatcaagaaaagcatgaagaaaatcagcgaccctcagttaagacagctttacagcgtgtcagcaaaagcattggagcaaaatttaagagagcttcttccctttttgccaaaagctccagcatttcagcgggaggatgaacgggctgacttgtattttgatgcgggtgatctgttggtgctggcgaaaacgaccgttcgaaactatgcgattgcgatcacggaaacggcgacgcccgagctcaggagagtgcttgttaaacaaatcaatgcggccattaagttgcatgaacaagttttttattttatgtaccaaagaggcttatatcccgcctataacctcgtcgacctgctaaaaggcgacgccatgcatgcgcaaaaagcgatatcgatgagataaaaaagccagcgaggatagaatcctcactggctctgttttttgctattttacgattaaaaccggacacttcactcttttcgccactttatggctgacacttccgagcaccatttcctgcaaagtgttcagccccctgcttccgataatcacgatatcaacatcatgatggttggcgtacgatacaatggccgggcccggatccccgtgctgcatcgtcatttgatagggaacggccgcctgttttaatttattttctatcgacagcagcctgctgcgccgttcgcgttcgagttctgtacggttttcgctatgcaggacttcatgttttgctctcgcataatccaatacataaatcatgtcgacgaccgcttcgtttgacatggaagccagatgaatcgcatgatcggcagctctttcagaatgcttggaaccgtcagcagccagcagtatatgtctatacacccttcatcacccgtttcttagtgatttgacactgaacgatgaggttgatcataggttgctaatttttcgaccagcttccagctggattcatttaatccaatcaagtcaacatctattccttgctctttcattttcaaaacgactttatcgatagccgccacagcggaatcatcccatatatgggcctcagaaaaatcaagaatgacctttttcgtttgctctcccgttttaaaggagtttacgaaatcttgaaccgatgcaaagaaaacttgtcctttgatgatgtacttgaccgcgttttcttctgacttttcttcaatttttagtttggagattttcgctacgaagaagattgcgcttaaaatcacgccggcgaaaaccccttttgataaatcgtgggtggccacaacggtaacgacggttacaatcatgacaatggaatccgtcagcggcacctttcttaacatgctaaacgaagaccagtcaaacgtcccgatcgataccataatcatcacgccagccaaagctgccatcggaatttgtacgacccagtcgcccagcaccatgattaaaaacattaagaagacaccggcaacaaaggtggacaagcggcctcttcctcctgattttacattgatcacagactggccgatcatcgcgcatcccgccatgcctccgaaaaaaccggcgacaatgttggcgatgccctgtccgcggctttccctgtttttgtcgctttccgtatccgtcatatcatcaacaatagaagaggttaataatgactcaagcaagccaacgatggaaagcgcaaaggctgttggaaaaataatggccaatgtctcaaaattgaaaggaatattgggaatcataaaggcaggcaatgattgcttcatttctcccaaatcaccgacagtgcgcagatcaaaatgaccgaaaatggcaaatacagtcatcgcaataatggcaacaagtgcagatggaacggcttttgtaaagcggggaagaacatagataatcaacaacgtaataccggccacaacatacgtcatattcgaaactccaacaaaatgaggaacctgcgccataaagattaaaatggccagcgcatttacgaaacctaccataaccgaccgcggaataaatttcataaagcgcgcaatcttcagcaccccaaatattaattggatgattcccgttaaaatcgtagcagcaaataaataatcaagcccgtgatctctgaccaaagttcccatcaaaagagccatcgccccggtcgcggctgatatcatcgccggacggccgcccgtaaaggaaatgacaacggcgatacaaaaagatgcgtacaaacctaccatcgggtctacacccgcaatgatggagaacgctatggcttcaggaatgagagcaagcgctacgacgatacccgaaaggatatccccccgtacattagaaaaccattcgctatttaattgtttaacattcaaagattcaacacctcgttcgtgatcatttgcttctaactctcatagaagccatctgtttttaacatgtttcactttagcaaacctgtatcaaaatgtctatatggttttttttgccgcggccgtttactccccgcactcccgtggaaataaacacgaagaaattaagaatgtaattttgaaaagagtccaatctaaggattagagggggtttcaacatggcgcaagagctggaaaaacggccggggcatacaagatggtatatttcttctttattaagcagcatgatcattttaaattactttgaccgtgttgccatttcagtcgcagctcctgcgatacaggattcctttcaattgacggcaacccaattaggcatcgtcttttccatctatacctactcatacacgctgatgcagattccggtggggagtctcttggataagtacggcgttgcctgggtgacaagggtcggaatgaccttgtggagttttctaaccattatattggcttttttacagggaaaactgcttctttatattgtcagatttttaatcgggctgacgagtgcttcagcttttcctgccgcatccaaagcaacggccttatggtttccgcctaatgagcgcggccttgccaattccttgtttgactcggcagccaagttcgcgaatgtcatcggcgcgcctctcgtagcctttttagttacgacattcgactggcgagccgcttttttaacgatcggaatcattaatgtactgttcaccgtatttttctggttgtattatgaacagcccgatcggcacaaacgaatctcaaaggaagagctccattatattcaaaagcataatgccgtatcagaggaagatatctcggaacggacgcttattgctttaaaagcgatgctgacaaaccgtaaagtatgggggctgatgatcggatttacgggttacggctatacattcaacctgctcttaacctggctgccgaccttctttaaagaaacatacggaatggacattatgtcctcagggctgtttacagcggttccctggctgatatcgacggtttccggaatcgttgtgggcggatggctcgtcgattttttaattcaaaaggggcattcgaatacaaaggtataccagaccattatcgtaatcggcatgagccttggatttgcctttctgggagctgttttcacgcacaacatcacgattgcgatcatttgcatttccgtcggcttagccggaatatctgcgaccgcgcctatcggctggtcgatatcagccgatattgcaccggttggttccatctctctgctcagttcaatggtcaatttggcaaataacttattcggagggattatcgcggtttcattaacgggctatctggtcgatgtgaccggttcatttacgctcagctttttagtagccggatttgtattactgctcgggctcgtgttctacctcgcagtcctcggcgatataaagcgaattcgtattggcaagcagaaaacctgaatgctgaaggaaacgacccggcttttgataaataaaaaaagaacaagaccgcattgggtcttgttccttttatcggcttactcgcctgctacgtatggaagtaaagccatttgacgagcgcgtttgattgcaacagtcaatttacgttggtatttcgcgcttgttcctgttacacggcgtggtaagattttaccgcgctcagagataaattttctaagaagatctacatctttgtagtcgatgtgcgtaatgccgttggaagtgaaataacacactttacggcgtttcgcacgaccgcctctgcgtcctcctgccatcgttatttccctcctttctgttctggttttattttattcgtccgtcatccattaaaatggcaagtcgtcatcagagatgtcaatcggctttccatcatttgcgaatggatcgtcattgaagctgttgccttgattgcgattctgattgttttgactgccgccgaatggagccggttcattttgtccgccgccaaagtgttggcctccctggcctccgctgtaaccgccggaaccagaaccgccgcctttaggctccagaaattgaacactttcagcttgaacttccgtgacgtatacacgctgtccctgctgattttcatagctgcgcgtttgcaaacgtccatctacacccgcaagacttccttttttaaggaaatttgcaacgttttcggcttgtcttctccagacaacacagttgatgaaatcagcttcacgttcaccctgctgattcgtaaacgtacgattgacagcaagcgtaaaggtggcaacagctgcaccgctaggagtataacgaagctctgggtcctttgtcagtctgccgactaaaacaactcggttaagcatattgagagaccatccttttgctttagagtatataattcaattctgtttattcttcttctttaaccacgatgtggcgaatgatgtcgtcactgattttagctaaacggtcaaattcttgaactgcttcagctccagcttgaacgtttaagatttggtagaatccgtcgcggaaatcgttgatttcgtatgcaagacggcgttttccccaatcttttgtttcagtgatctccgcaccgttagttgttaaaatgttgttaaaacgctcaacaacagcctttttagactcttcatcaacgtctgggcggatgatgtacatgatttcgtactttctcatttgtatttgcacctccttttggactaagcggcccattatattgggcaaggagcaataatcctattactcacaattttatattatatcaaagctcttgtcctatttcaactgcgttatacattgaaacggaaatgaatgacatcgccgtctttaacaatgtattctttcccttcaaggcggacttttccggcctcttttgctgcggtcatgcttcccgcttcaagcagatcgtcgtaggcgaccgtttccgcacggataaatccgcgttcaaagtccgtatggatgatgcccgcacattcaggggctttcattccttttttaaatgtccaagctctgacttcctgttctcccgctgtaaaataagtagcaagtccgaggagggagtaggacgctttaatcagctgatcgagaccggattcttcaatgccgagttcttcaaggaacatcgccttctcttcgccttcaagctctgcaatttcggactcaatctttgcgcagacgacgatgacttccgcattttcagcagctgcaaattcccggaccttctgaacgtactcgttacctgaaggatcagccacttcatcttcgctgacattagctacatataagacaggttttgtcgtcagcagatgaagctgcttcaacaccttttgctgctcttcggagaactcgacagagcgggccggcttttcctgttcaaacgcctcttttaactttgtcaaaatctcaaattcaaacacggcttctttatctttttgcttggccatctttccgacccgcccgatccgcttttccacggtttcaaggtcagccagtatcagctcaaggttaatcgtctcgatatccgaaatcggatctactttcccggacacgtgtgtgatattgtcatcggcaaaacagcggacaacatggcagatcgcatctacttggcggatgtgggacaggaacttgtttccgagcccttctccttttgatgctccttttacaatgcctgcgatatcggtgaattcaaatgcggtaggaacggttttcttcggattgacgagttctgtcagcttttgcagacgctcatcaggcacctctacgatcccgacgtttggatcaatcgtacaaaacgggtagttggccgattctgccccggcctgagtaattgcattaaataaggttgatttcccaacgttaggcaaaccaacaatcccagctgttaaagccattgtttcatctcctctataatgaacatccgtgtgtagtcgtaaatgttaaacctgcaacaattataaggatgattacaataaaagacaagctgacaaaacttgcttttcaatcatacaaactagatgaaaattcatttttcattgagacagaaaaaaagcataaggaggtccgccaagattaactttcggactcctcatgcttaactaatatctttttcagctttctttgaaactctttgcgcgggatcatgacgctgtgtgaacagccctcgcacttgatccggatatccattcccatccgaatgatcttccagcggtttgtcccgcagggatgcggctttttcatttcgaccacgtcattcaggccaaattctttatcggccaacatcgttcacctctttgcttccttgttgtgaccttattgtacaaaaaaccacggtgaaagggcaattcttcacaatcttaactgtatttatttccatttactcaaaatcggatatagtaaaatatttaccaataaatataaattcaataatccgtaaattggatataaaaaagcgattaaatttgaaaatccgattgacgtaaaaggagccatgatcgagagaagcaggatgacgatcacccatctcggccagttcacaaaggacagaaaacggctggacagaccgagaatgctcgagatcgtcgtcgtatagattgcgacgcaaagtacagccgtcataaaaataaaaatcggaaaaggcgcgccctccaaaaccgcgaataaaggaatttcataatgggccagttcaccggcaagctctacaagggtctcattgtacatgtatgaaatagccccaaacaccaggccgcttaatatgctggcaatctttgcttctccgacccccttcatctctttgccgaccgcagataatacagcgacaacagataatatgttcagggaagtgaatgcgatgccggcaggccagttgtattgatgagtcaagttgagcagccacggctgatgatgagctgtttgaaaagaaatcagcgcatacagcagccccgccaccaaaatcgggattaagtagctattaacggacaatatgccattgagcccccacaaaaacaacaaccctgtgcataaacaaaacaagatgacgccagtccaaaacgggatatgaaagatttgcagcgttaccccgcctcctgcaatcatcacaatcgtcgtcgtaaacaaatacaggatgatcagcacatcgtatactttagccagcatcggaccgattaatgtttcgagcacaggcagaaaatgctctgatttttgttcatagctgatcttcatcacaatataggttgacaggctgaacatgatcgtaaacaacaggatagccagtccgctttcatcaccaaaaaactgccatatttcctggccggatgcatatcccgcacctattaagcttcctaaaataagaagcatccacttcatcccggctctccacacgatttgctcaccccaacaatatagtttttaagcttgtttctccgctcatgacactatattgccggtcctctataaaaattcatgaaacccttttcgacttttctcttacaaatgaataaattatattaatataacaaaatagaatatcgtatcctctcttagtaaagtattttttccggctgaccaaatcgactcatccaaagcataaaaaaagagacagctggatatactgtaaacaaccatacatactcaaaaaacacaccaaggcactgctgttaccatgatgacaaggatgtgaagcctatgaatcgaaaaggcggaattttttctcaagaaccaatgaatgaatatatttctcatacggatccgctagctgttaaacaaatagagaaagtcctttccgtctatttaaaggaagccggagaccggcccatcgtgatcgtttgcatcggtacagaccgctcgaccggagattcgctcggtcccctcgtaggaatgaaactctccgcaaagcagctgacacgttttcatgtctatggaacgcttgccgacccggttcacgccgtgaacttaaatgaaaagcttgatcatattcatcagcagcatcaaaatccttttatgatcgcgatcgacgcctgtcttggacgaaccaaaagcgtggggtctttccaaatcggcaaagggcctttgaagccgggagcaggcgttcagaaaagtttgccggaagtcggccacgtgcatattaacggaattgtcaatgtcagcggttttatggagtattttgtcctgcaaaatacaaggctcaatcttgtcatgagcatggcaaatgtgcttgcggacgggctgtcgcatctggaaaagaccggatcgcagcggcgccatgtgtcaccaattgaaagaatgaccggaagaatgtcataaaaaaaccatctgtacatgatcagatggtttttaagcttatgcgtcttcttgagccaataattcgagaatacgctccaagtcttcatttgagtagaattcgatttcgatcctgccttttttcttttgctttttaatggtcaccggtgttccaaaatagtttcgcaaatacgattcccgttccttgatcactgcatctttgacttgtttcggcttctttgtttcacgtggaacatcagcgttcaactgttgaattaacttttccaactggcggacgttcaactgttcggacacgaccttttgaacaagcggctcaagctttttcttgtttttcaatccaagcaatgttcggccatggcccatcgataacgtgccgttgtcgattaacttttgaacgtcttcaggaagtgtcagcagccgcaagtggttggcgatgtgaggcctgctttttccaagccttttcgccagctgttcctgggtcatatcgagatgtttgagcaaagattcataggcttttgcttcttcaagcggagacaggtcttctcgttgaagattttccaatagggcaatctccatcatcagggattccgacagctcgcgcacaatcgcaggaatggtttccaatccggccttttcagcagcccggaaacggcgttctccggccacaatgtcatagcctttaattgactttctgacgatgatgggctgcaaaacaccgtgctgcaaaatggactccttcaaatcttttaacgattggtcatcaaacgtttttcttggctgataagggttgggccgcaagtcttgcagcttgatttcctcaaccgtttcttcggataaatcaacatttgaaaacaatgcattaatcccttttccgagacctttaggcattcgcagccacttcctttgctaattctaaatagacttccgctcctctggaacggggatcatataaaatgatcggctttccatgactcggcgcttcactgagccggacattccgggggataaccgttttgtatactttatcgcggaagtactttttcacttcttcgatgacctgtatgcctaaattcgttcttgcatcaagcattgtcagcaatacgccgtcgatcatcagatccgtatttaaatgtttttgcacgagccggacagagttgagcagctggctcagcccttccagcgcataatactcgcactggaccggaatcacgacggaatcggaagccgtaagcgcattgattgtaagcagccctaatgacggcgggcagtcaataatcatgaaatcatagttttgtttgaccgattccaaagcccttttcagccggacttctcgggagatggtcggaacaagttcaatttccgcccccgcaagctggatcgttgcaggaatgacatccaagttttctacggatgttgttttgatgacatctttcacatctgcatcatctactaatatatcgtacacacattgatcaacatcagccttttcaacgccgataccgcttgttgcgtttccttgcgggtctatgtcgactaacaaaacccttttcccgatgtaagctaagcaagctcccaggttaacagaggttgtcgttttaccaacgccacctttttggtttgtgatcgcaataattttccccacaatgtcacctactttcacattgaacaagtttctctcatttctctattttaacaaaaaaagaatcggctgtttgctttttttgagtttttgttttttgaaagagatctgttttgtttatttttcgacaaaaagaaacagtttttttatcttagaaaaaagagaagaaacgctcaaataaagtgaaagatagttttaattttatatcagtataaaaaatcccccctgtgttggggggatttcaatcaatctgctgcgggcattttccgggtggcgatggcaatcctgttccaggcatttattgtgacagctgccatgatcagttcggctgtttcagcttctgtaaaatgggtcctgacttcgttgtatatttcatccggcaacccgtgctcgccgattcgcgtaacggcttcagtcagcgccaatacagcccgctctttttccgtgaaaaaaggcgcttcccgccacgcattgagcgcatatatccgctgttccgtttccccgttctgtcttgcatccttcgtatgcatatttaagcagaaagcacatccgttcagctgtgaagcccggattttgatcagttcctttaaaatggggtcaatgccagaagaagcctgcgctttttcaagctccagcattcctctgtatccctcaggatttactttttccattagaaatctcgtttccatgtctattcctcctttaagtgtttcacttatataacaagagagaaacggagtttgtgacaaaaaacgttatattttaatgtgcttcagtttatcgggatttgacacgataaacacatttttgacggaatcgccttccggattccaagcaaagcaaaccgcgtaagccgggcggttgtttttcatgatcaaaacgcccttttggtcgttgatatcgactggcataaagcggccggaaaagcttccctttgaaacaactcccgtaaaaaacgcataaatgcggctctttccatagatcggtctcaaagcgctgcgcacttttccgccgccatctgtatacaatacggcatcttcaatcaatttcttggaaaactcctcaaaattacctgttttcgctgattcgataaacagctgggccaattgctgttcttcaaccggctgtgaaaataccgaaatatcctcgtttaatttctgtttcagccggctgtggatttgacgacagttcgcttccgacttcccgataatggacgaaatttccttgtaatgatatccaaatacttctctaaacatcaaaacggctctttctacaggatttaatcggctcataactaccagaaaagcataggataccttttctttctcttcaacgtactcagccgggatttgagctgaaagcgccacctgcggttccggaagccattccccgatatatacctcccgcttcttgcgggcagactgcagttcatttatgcagcggtttgtgattgatttcgttaaatatgcttgaatatggtcaatttgaccgatatctttttcctgaaggtctgcgaacaattcttggatgatgtcctctgcatcttgaaaagacccgagcatacggtaagcaatcgaaaaaagcaatgaatgatattgtcgataatattccatagacgctcccccatagatattttgcctaaaaaaataaaagctctatagggagcttttatttcggtattcgaatcgtaaactgaatatattcttcaaattcctcttcttccgtattcagtttgacgccgctgtcttccaccattgataaggactggcgaatcgtattcatcgcgattctcgcgtccctgctgtacgcttttctctttggtttaggcttgcgtttatcctgctcaagcattttgacgacacggtcttcggtttgttttacatttaaactcttttcaatgacttcatgcagcagcttgacctgaaggtcgggctgtttcaacggtatgagcgctcttgcgtggcgctctgaaatttcttttttcaagatcgcttcctgcacctcttccggaagctttaacagtctgagcttattggcgattgttgactggccctttccaagcctttgtgcaagggcttcctgcgtcaaatcgtgaagctctaaaagccttgcataagcatgcgcctcttcaatcgaagataattcttccctctgaaggttttcgataagagcgacagaagcggtctctgtatctgaaaaatccttaataatagcgggaaccttctcccaatcgagcgtttgaaccgcccgccagcgccgctctccggctatgagttcatattggccttcccgctctgtttttctgacgacaatcggctggataatgccgtgtgtatgaatggttgcagctaattctttaattttttcttctgagaaaatggtgcgcggctgaaaacggttaggaattatatcgcctactggaatctcttgaatttcttctttattcgtatcatgttcagcaatctctgcttcttcttccttgtcgccaagtccgaagagacgagagaatgaatgcttcatgtacctacaccacctttaaacactgccatttttataattctattttctcatgaattttccttctgtgacatcacgaaatttgaagaaaacgaataatttaaccttcaataggagatttattaggtgttccaggctttcttggaaatttcttcggtgtctgcgattgttttttgatgacaatgatgtttctttcgctttcttctattggcagctgaaaagaatgtacggtttcaattttgcctccaagcgttttgatggcttttttgcccgtttcaatttcttcatcagccgaagcggcttttaatgctacgaataaaccgtcttttttcacaagcggaaggcagagctcgctgagaaccgaaaggcgggcgacagcgcgtgccgtcacaacgtcatagctttctctgtggtctttcgatcttccgaatgtttccgcgcggtcatggtaaaaagctgtgttttccagcttcaaagcgtctgacagctgattcaaaaagtgaatccgtttgttcagtgagtcaacgattgtgacgtgaaggtgaggaaagcagattttaatcggaaggcttggaaatccggcacccgctccaacatcacagagagtgttcatctttttgaaatcaacataaaaagaggcggcgatggaatcgtaaaaatgctttaagtacacttcttttttctcggtaatcgaggttaaattcattttttcgttccattcaacaagccattcgtaataagtctcaaattgctccagctggaaggaggaaagggaaatgcctttcttctccaaaccggctgtaaattgctcaatgttcatgccgtcaccctttctattccgcaaccttggcaatccgtccctgctctaaataaacgagcagtatggaaatatcagcaggattgacgccggaaatccgtgaggcctgtgcgacagacagcggtctgacctctttcaatttttggcgcgcttccgttgcaatgcctttgatcgcgtcatagtcgattctgtcaggaatctttttattttccattttctttagtttttcgacctgctgcaaggacttttcaatatatccttcatacttaatttgaatttccacctgttcggcaacgtcgccggcgactttttgttcaggcggcgcaagagcagtgacggtttcataattcatttcaggccgcttcatcaggtcggtcgcgcgaatgccgtctttgagctcgctgccgcccagtgaacggatatattcctgattttcctttgtcggtttgataataacagaatgaaggcgttttttctctgcttcaatggccgcttttttctcttgaaacttttgatatctttcttcagaaatcaagccgatctgatagccgatctcggtcaggcgcaagtctgcattgtcgtgacgcaggagcagcctgtactctgcacgcgaagtcagcaggcggtatggttcgtttgttccttttgtcacaaggtcgtcgatcaatacgccgatataagcgtctgagcggctgagaatgacctcttctttgccaagcgctttccggcccgcattgataccggccataattccctgtccggccgcttcttcatagcctgatgttccgttaatctgtccggctgtgaagagtcccggaatttttttcgtttccaatgtcggccacagctgtgtcggtacgatcgcatcatattcaatcgcataccccgcccgcatcatttgcacattctcaaggccgggaatagttgaaagcatttttcgctgcacatcttctggaaggcttgtcgacaatccctggacatagacttcctgggtgttgcgcccttcaggctcaagaaagatttggtgtctcggcttgtcgttaaagcggacgaccttgtcttcaatagacgggcaatatctcggtcccgttcctttgatcatgccggagtacatcggtgaacgatgcaaattgttgtcaatgatttcgtgcgtttccggacttgtatatgtgagccagcatggaagctggtctgtaatatattccaccgtctcatacgaaaaggcccgcggcacttcatcaccgggctggatttccgttttgctgtagtcaattgaatgactgttgacccgcggcggcgtccctgttttaaaacggacgaggtcaaagccgagctcttcaagatgttcagacagcttgatggacggctgctggttgttcggtccgctggagtatgacagatcgccaagaatgattttccctctcaaaaatgtccccgtcgtcagaacaacggtcttagaacggtactccgcccctgtctgggttataacgccccggcattccccgtcttcaataagaaggcgttcgaccattccttgcagcatggtcaaattcggttcattctcaagtgtctttttcatttcatgctgatattggaatttatcagcctgagcccgaagcgcccgaacggcaggtccttttcctgtatttaaaagcctcatttggatatgcgttttatcaatatttttagccatttccccgccgagcgcgtcaatttcgcggacgacgattccttttgcaggtccgccgacagacgggttacatggcatgaaagcaaccatatcaaggttaatcgttaagacaagcgtttttgcgccttgtctggctgacgccagcgccgcttcaacaccggcgtgtccggcgccgacgacaacgacgtcatattggcctgcttcatagcccatatgctttgttcctcctttattttcctaagcaaaattgagagaagagctggtcgatcagactttcgtgtacagcatcgccaatgatctccccaagaacttcccagcatcttgttaaatcaatttgaaccatatcgatcggcacatcgttttcgatgccctccaatgcgtcagtgatggcgcgcttcgcctcatgcagcagtgaaatatgccttgtattgctgacatatgtcaagtcgccgctctcgatcgcgcctgtgaaaaacagcgattgaatggcttcctccagctcatcaatcccttcctcttttaataaggaagtcgtcacgacaggctgattcccagccaattcccgaacccgatcaagatcaagcttttgctcaagatcggtcttattgacaatgacgatgatgtccattcccttcgttgcttcaaagagcttgatgtcttcatctgaaagggactcgctgtaattgaggacaagcaaaatcaaatctgcttcttttaatacctgtcttgaacgttcaacgccgattcgctcgacgatgtcttcggtctcgcggatcccggctgtatcgacgagacgcagcggcacgcctctgacattcacatattcttcaatgacatcccgcgtcgtgcccggaatatccgttacgatcgcttttgtctcgtggacgagactgtttaaaagcgaggacttgccgacattgggccgcccgatgataactgtcgagatgccttctcttaatattttaccctgctctgaagtcgtcagcagcgcctcgatttcctttttgacctttgtcgctttttcaatcagcatcttgtgcgtcatttcttcaacgtcatcgtattccggatagtcaatattcacttcaacgtgggccaatgtttcaagaatctcggccctcaaccgtttgatcagtgaagacagccttccttccatctgattcatggccacattcattgcccggtctgttttggccctgatgagatccatgacagcttcagcctgggaaagatcgattcttccgttcaaaaaggctcttttcgtaaattctcccggttccgccagacgcgctccctctctcaaaacgagctgaagcacctggttgacagtcacaagtccgccgtggcagttgatttctacaatatcttcccgcgtaaaagttttcggcgctttcagtaccgaaaccatgacttcttccacgactttttccgtttccggatcaacgatatgaccgtagttaatcgtatgtgaatcgacggaactcagcctttttccgcgaggtcctttatacactttatcggcgatcgcaagagcctcagggccgctcatccggacgatcgcaatcgccccttctcccatcggcgttgaaatcgcagcgatggtatccatggctttcacctctctttttcattcctatatctattatccccatttgccgggtcatcttccaaacatcgtatacggatgaaaaacttttattgtaatcaaaatttaaagataacatagtttcaattgaagtggaagtgacttgaaccgttatccacaaccgttctaagccatcattacttactttaacttatccacatgtgaataacaattaaatttcattttcatcaacagcttacgcctgaaaaaatagaacttaaactgattttgctgcatttcatcgattttcaacggcaaaaaaaccgaagccccaattttgggaacttcggttttcatgttattttttatatgagatgacaaggtgccggttatggtcttcaccggtagagtaagtttcgatatgctgcgagtagcccgcaagcgtatcatggatgaccttgcgctcactggaaggcatcggctccaggtgaatgtcttttttctgcctggccgcctggtcagcaagcttcaatgccagctgagcaagtgtttccttccgctttgcgcggtatccttcggcgtcaaccaccgcttggatatatctgtcggaatgacgattgagcacgagctgcgtcagcgtttcaagggcatttaaagtttgtcccctttttccaattaaaagagctgttttgtctcctttcaactgaaaaaccactcgtttagactcctcttctgccgtcacctgggcttgtattcccatattcgaaattacattttccaaatattgttttgcttctttaaccgggtctattttttcccgaatgttcacgactgcagaccgatgaccgaaaatgccgaataatcccttttttccttcatcaactacgtcgacttcgacatcatctgcatgaaggcccagctgttcaagcccggattgcactgcttcatcgacggtacgtccagtagcagtcagttccttcactttttcttacctccggatttttttcctccggctgccgcttcctgtctctcagcctttagatcaggccctttgataaagaaggtttgagcaatcatgaataagttaccgactacccagtacagggaaagagccgccgggaaactgatcgcaaatacaacgatcatgatcggcatcagccaaagcatcatcgccatctgcggattttgctgcgctgttcccgccatcatcagcttttgctgaatgaatgtgaacacaccggcgagaatcggcaaaatgaaatacggatcacgctccccaaggtcaaaccataaaaagctgtgttctgcgatttcccgcgttctcataatggcatgatagaatccgattaaaatcggcatttgaattaagatcgggaaacatccggcaagcgggttaaccccgtgcttctgcatgagagccatcgtttcctgttgaagcttctgctgcgttttttgatctttagaactgtatttttcacgaagtttttgcatttcaggctggagagcctgcatcgctttcgaactcttcgtctgcttgatcatcagcggcaaaattaaaagtctgattaagatcgtgacgatgataatcgctagtccgaagttttcattcgttaaatttgctacatacgtgatcagctgtgacaacgggtatacgatatacgtgttccaaaacccttcgctttctgcagtgatcggctggttgatttccgtacatccagctaaaagcacgataacgccgatcatactgaacaataataaaattcgcctcttcaacaacatttcctcctaaatcttcattcttcaaccggtattattcggttatgaccattaaaaagacatactttctcgtattttatcatctttctcccccgaatgggcgacgacatttttctggagctaaaggaagcgcttaaaaatgaggggccataacttcttttaacccggactatgatggctgattcggttttttccggtagacaaacgactttctgaaaagatgctgcaaactttttttcgtctcttcatatgataattcagctgcaggctttcttgcgatgataatgtagtcattttcttgttttaatagattccgctcttcctggatgacctggcgaatcagccgctttacccggttgcgcacgactgcgtttccgattttcttgctgaccgacagtcccacccgaaactctttcgcttcaggctggtgaagcacatataaaacatattgccggtttgccatcgattttccctttttaaatactttttgaaaatcttcatttttctttaatcgatttcgctttttcatatcttctttcactccgataacaagctggcaaatgggcctggtcattcctctatgtaaaaaagaccactgacattattcagtggcctaagctgataatacttttcttcctttgcggcgacgacgtgctaatacaagacgtccatttttagaactcatacggctgcgaaagccatgaactttgctgcgcttacggttatttggttgaaatgttcttttcatgtatgacacctccctcgaggaatagctgttaaagacagtctaatttattatattgggatgagcagttcattgtcaacttcgctcacacatttcttttttgcaccataataggataacacatatcaattttctt

SEQ ID NO: 2 - DNA, 1341 bp, Bacillus licheniformis
atgaaaaacatatcggatctttggaatcaagctttggggcagatcgaaaaaaaattgagcaagcccagctttgaaacatggatgaaatcgacaaaggcccattcattgcagggcgatacgctgatcatcaccgcaccgaacgagttcgccagagactggcttgaatcaagatacctgcacctgatcgccgatacgatctatgatctgacaggagaagaattgagcattaaatttgtcattcctcagaatcaaaatgaagaagattttatgccaaagtctccaatcaaaaaaatgtcgaaagaagaaccggctgattttccgcaaaacatgctgaatcccaaatatacatttgatacgttcgttatcggttcaggaaaccgattcgcccacgcagcgtctttggcagtggctgaagccccggcgaaagcttacaatccgctgtttatttacgggggagtcggacttggaaagactcacttaatgcatgcgatcgggcactatgtcatcgatcacaatccatctgcaaaagtggtttatttgtcatctgagaaatttacaaatgagttcattaactcgatccgtgacaataaagctgtcgattttcgcaatcgctatcgaaatgttgacgttcttttaatagacgatattcaatttttagccggaaaagaacagacgcaagaggaatttttccatacgtttaatacgctgcatgaagaaacaaagcagattgtcatttccagcgaccggcctccaaaagagatcccaacgcttgaagaccgtttgcgctcccgttttgaatggggattgatcactgacatcacgcctcctgatctggaaacaagaattgcgattttaagaaagaaagcaaaagcagaaggacttgatatcccgaatgaagtcatgctttatattgccaatcagatcgacagcaatatcagggagctggaaggggcattaatcagggttgtcgcatattcttccttgatcaataaagacattaacgccgatctggctgctgaagctttgaaagatatcattccttcttcaaagccgaaagtcattacgatcaaagacatccaaagaatcgtcggccagcagtttaatatcaagctggaggatttcaaggcgaagaaacggacaaaatcggtggcttttccgcggcagatcgctatgtatctatcaagagaaatgacagattcttctcttccgaagatcggcgaagaatttggcggacgcgaccacacgacggtcatccatgcccatgagaaaatatcaaaactgctgagcgatgatgaacagcttcagcagcagattaaagaaattaaagagcagctgagataa

SEQ ID NO: 3 - DNA, 1137 bp, Bacillus licheniformis
atgaagtttacaattcaaaaagaccgcctggtcgaaagtgtccaagatgtgttaaaagccgtttcttcaagaacgacgattccgatcttaaccggtattaaaatcgtggcctctgatgaaggggtctctctgacaggcagcgattccgatatttcgattgaatcgtttatcccgaaagaagacggcgatttagagatcgtgacaattgaacagcccggcagcattgtgcttcaagcccgttttttcagtgaaattgtcaaaaagctgccgatgtcaacagtggaaatcgaggttcaaaatcaatacttaacgatcatccgctccggcaaagcagagtttaacttaaacggtttggatgcaagcgaatatccgcttttgccgcaaattgaagagcatcacgcttttcaaattccgaccgatctgctgaaaaacctgatccgccaaaccgtttttgcagtgtccacctcagaaacacgcccaatcttgacaggtgtaaactggaatgtcactggcggtgaattaatatgcactgcaacggatagtcatcgtcttgcgctaaggaaagctaagctcgacattaacgaagacagttcatacaatgtcgtcatcccaggaaaaagcttaaccgagctcagcaaaatccttgatgaccatcaggagcttgttgatattgtgattaccgaaacacaagtgctgtttaaaacaaaaaacgttctgtttttctccaggcttcttgacggaaactatccggatacgaaccgcctgattcctcaggaaagcaaaacgaacttgattgtcaatactaaggaatttctccaggcgatcgacagggcttcgcttttggcgagagaaggacgaaacaacgtggtgaaactttccgcagccgccaatgagtcgatcgaaatttcttcaaactctccggaaatcggaaaggttgttgaaacggtgaatgccgagcagatcgaaggggaagacttaaagatatcctttagtccgaaatatatgctggatgcccttaaagttcttgaaggagaggacattcatgtaagcttcacaggcgctatgaggccttttctgatccgtacgccgaatgacgattcgatcgtccaattaattcttcctgtccggacgtattaa

SEQ ID NO: 4 - DNA, 177 bp, Bacillus licheniformis
atgacaaagacggtggctattgatacagagatgattaccctcggccagtttttgaaattggcggatgtcattcagtccggaggaatggcaaaatggtttttatcggaatatgaagtactcgtcaatgacgagccggataaccgccgcggacgaaactgtatgtcggagatgtggtga

SEQ ID NO: 5 - DNA, 1113 bp, Bacillus licheniformis
ttgtatatccaaaatcttacattatcgtcttaccgtaattatgagcgccttgaccttcaatttgagaacaaagtgaacgtgattatcggagagaacgctcaaggaaaaacaaatttgatggaagcgatctatgtgcttgcgatggcgaaatcccatcggacgtcaaatgataaagaactcatacgatgggatgaagactatgctaaaatagaaggcagggtcattaaaaaaaacggttctgttcccattcagcttgtgatttccaaaaaaggaaaaaaaggtaaagtgaatcatattgaacagcagaagctgagccagtatgtcggggctgtcaacacgattatgttcgcgccggaggatttaaatctcgtaaaaggaagtcctcaggtcagaagaaggtttctcgacatggaaatcggccaagtatcacctgtctatcttcatgacctttctctttaccaaaaaatcctttcacaacggaatcatttcttgaagcagcttcaaacgagaaagcaaaccgatcaaacgatgcttgacgtgctgacggaacagcttacggaattcgcggcaaaggttgtgatgaaacggcttcagtttgtcgatcagcttgaaaaatgggctcagcccattcattccggaatttcaagaggtctggaagagctgacgttaaagtatcatacgtctcttcacgtatcagattcgcccgatttgtcgaaaatgatcaatagttatcaagaaacgttttctaaattaagagataaagaaatagaacggggggtatctctttcaggtccccacagggatgatgttcttttctatgtcaatggccgtgatgtgcagacttacggatcgcagggccagcagcgcacgactgcattgtcgcttaaattggctgaaatcgacttgattcaggaagagataggagaatacccgattctgcttttggatgatgttttatcagagctggacgactatcggcagtctcacttgctccacaccattcaaggccgcgttcaaacattcgtaacaacgacaagcgttgatggaattgatcataaaaccttaaacgaagcggaaatctttcgtgttgaaaatggcacgctatcggactga

SEQ ID NO: 6 - DNA, 243 bp, Bacillus licheniformis
ttgtatatccacttaggtgacgattttgtcgtctcaacgcgtgaaattgtggctatttttgattacaaggcaaagacatcgccgattgttgaggagtttttaagcaagcaaaaacagcggattgtctcttctaacagcacgccgaagtcaattgttgtcacattacaatcgatttatttttctcctttagcctcaggcacgttgaaaaaacgggcgcaatccaagccggaaatcgattcataa

SEQ ID NO: 7 - DNA, 1920 bp, Bacillus licheniformis
gtggcaatggaacagcaaaataattacgatgaaaatcagatacaggttctagagggattggaagccgttcggaaaagacccggaatgtacatcgggtcgacaagcggcaaaggtctgcaccatttagtatgggaaattgtcgataacagcatcgatgaagcattggccggttactgcactgaaatcaatgtcgcaattgaaaaagacaacagcatcacagtaaaagacaacggacggggtatcccggtcggtattcatgagaagatgggtcgtcccgctgtggaagtcatcatgactgtcctgcacgccggaggaaagtttgacggaagcggatataaagtttcgggcggtttgcacggcgtcggtgcttctgttgttaacgccctttcaaccgagctggatgtaacggtttacagagatggaaaaatccattatcaggaatttgaacgtggcgttccgaaagctgatttgaaagtcattggagatacggaagtgacgggaacgaccacacacttcaagcctgatccggaaatattcacggaaacgactgaatacgactatgatacgctcgccactcgtgtccgcgaactcgctttcttgacaaaaggcgtcaaaatcacgatcgaagacaagcgagaaggaaaagaacgcaagaatgaatactgctatgaaggcggtattaaaagctatgttgaacacttgaaccgttcgcgggaagttattcatgaagagccggtctatattgaaggatccaaagacggcattacagtcgaggtggctcttcaatacaatgacagctatacaagcaacatttattcatttgctaacaacattcatacgtatgaaggcggaacccatgaagccggctttaagaccggtttgacgagggtcatcaatgattacgcgagaagaaacggcgtattcaaagaaagcgatccgaacttaagcggagaagacgtccgggaaggtttgacagcgattatttcaatcaagcacccggatcctcaatttgaagggcagacgaaaacaaagctcggcaactcagaagcgcgtacgataacagatgcgctattttcagaagcgcttgaaaagtttctgctagaaaacccggattcagcgaaaaaaatcgttgaaaaaggggttatggccgccagagcacggatggctgcaaagaaagcacgcgaattgacgcgcagaaaaagcgcccttgaagtgtccaatctgccggggaaacttgctgactgttcttctaaagacccgacgatttccgaactttacatcgttgagggtgactctgcgggcggatcggcaaaacagggccgcgaccgtcatttccaagcaattttgcctttgagagggaaaattttgaacgtcgaaaaagcccgcctggacaaaatattgtccaacaatgaggttcgttctatgatcaccgcccttggcaccggaatcggggaagatttcaaccttgaaaaagcccgctaccacaaagtcgtgattatgacggatgccgacgtcgatggtgcacacatcagaacattgctgctgacctttttctaccgctacatgagacagattatcgaacaaggatatgtctacatcgctcagccgcctctttacaaagtacagcaggggaaacgcgttgagtatgcgtacaatgaccagcagctcgaagaaattttaaaagagcttccgcaaaatcctaagccaggcctgcagcgctacaaaggtttgggcgagatgaatgcgacacagctttgggaaacgacgatggatccagaaacgcggacattgcttcaagtaacgctcaaagatgcgattgatgcggatgaaacctttgaaatgctgatgggcgacaaggttgaaccgcgccgcaacttcatcgaagagaatgcccgatatgtaaagaatttggatatttaa

SEQ ID NO: 8 - DNA, 2469 bp, Bacillus licheniformis
atgagtgaacaacataagccccaagttcaggaagtcaatatcagtcaggaaatgcgcacatcttttttagattacgcaatgagtgttattgtttcccgcgctcttccggacgtaagagacggtctgaagccggtgcacagaagaatattgtatgcgatgaacgaccttgggatgacaagtgataagccgtataaaaaatccgcgcgtattgtcggcgaagttatcggtaagtaccaccctcacggtgattctgctgtttacgaagccatggtcagaatggcgcaggattttaactatcggtacatgctcgttcaaggccatggaaacttcggttctgttgacggcgactcggctgcggccatgcgttacacagaagcgagaatgtctaaaatatcaatggaaattctgcgcgacatcaataaagacacaatcgattaccaggacaactatgacggttcggaaaaagagccggttgttatgcctgcgagatttccgaacttgcttgtcaacggagcggccggtattgctgtaggtatggccacaaacatcccgccgcatcagctcggtgaagtcattgacggtgttttggcggtcagcaaaaaccctgatatcacgcttccggaattgatggagatcattcctggacccgacttccctacagcagggctgatcttgggaagaagcggtatccgaaaggcctatgaaacaggccggggatcaattacgcttcgagccaaagctcaaatcgaagaaacatcttccggcaaaccggtaatcattattacggaaataccgtaccaagtgaataaagcaaggctgatcgaaaaaatcgccgatctagtgcgcgataagaaaatcgacggcattacggatctccgcgatgaatcagaccgaaacggaatgcgcatcgtcattgaactgagaagggatgcaaatgccaatgtactgttaaataacttgtacaagcagaccgctcttcaaacatcattcggcattaatcttttggcgcttgttgacggccagccgaaagtattgagcttgaagcagtgtctggagcattatctcgaccatcaaaaagtcgtgatcagaaggcgtactgcattcgagcttcgcaaagcggaagcgcgggcccatattcttgagggcttgagagtggcgcttgatcaccttgatgaagttatttccctaattagaaattcgcaaacggctgaaatcgcaaaaaacggattgattgagaagttttctttgactgaaaaacaggcccaggcgattttggacatgcgtctccagcgtttaacagggctggaacgcgaaaaaatcgaagaggaatatcaaagccttgttgagctgattgcagagctaaaagcaatcttagcagacgaagagaaagttcttgaaatcattcgggaagagctcacagaagttaaagagcgctttaatgatgagcgccgtactgaaatcgtgacatcgggccttgagacgattgaggatgaagatctcatcacgcgcgagaatatcgttgtgactttaactcataacggatatatcaaacgtctgccttcttccacttaccgcagccaaaaacggggcgggaaaggcattcagggcatgggtacaaatgaagacgacttcgttgaacacctgatttcaacatccacccatgacaccattctcttcttctcgaataaagggaaggtgtaccgtgcgaaaggatatgagatccctgaattcggacggacagcgaagggaattccgattattaacctgcttgaagtggaaaaaggagaatggatcaacgcgattattccggtaggcgaatttgatgacgagtcttatttgttcttcacgacaaaacacggaatatcaaaacgcacaccgctttctcaattcgcgaatatccgcaataatggattgatcgccttaagcctccgcgatgaggatgaattgatcgctgtccgcctgacggatggaaataaacaaattattatcggcacgaagaacggtctgctcatccgtttccctgaaacagatgtaaggcaaatgggaagaacagcagccggcgttaagggcatcaatctgacagatgacgatgttgttgtcggcatggagattttggaagaggattcacacgtgctaatcgtaactgaaaagggctacggaaaactgacgcccgcttcagaatacagggtgcaaagccgcggaggaaaagggctgaaaacctgcaaaatcacagaaaataacggatctcttgtgacagtgaaagcaacgacaggagaagaagatttaatgatcatcacagcaagcggcgtgatcattcggatggatattaaagatatctccacgaccggacgcgtcactcaaggtgtgcgacttatccgcttaggtgaacaagagcatgtcgcgactgtcgctttagttgaaaaagatgaagagaacgattcagaagaacaggaagcggatgaatcataa

SEQ ID NO: 9 - DNA, 978 bp, Bacillus licheniformis
atgcaagataaaggatggaaggatttaaagctattttattcggtcgaaacagcccagcattttcttgaaatggtatataaaaatcaaggaatggaagatgccaaaaaaaattcctataaaaacggagagcggtttattttttttcttaaacatgcggaagccttttacaagcaagccaaaatcgctacgttggaaatcaaaccgattttattattttacggcatggcacagctattgaaagcctgcctgttaatgacagatccttcctatccaagccatacttcagtgctcgcccatggcgtgaccactagaaaacgaaaaaaacaaaattaccgcttttatgaagatgaagtaaaaatccaaaggaacggcctatgtatgcacgtcatcaggtcccttttccaattatccggattggaagatgaacgattcaatatgaagcagcttttggcgagaattccggagatcaataaagtactggcatttcaaagaaaaccgaatccaatagtaaaagcagccgtcgaagaccggctcatttggctgccaagcgagacgcccgatgcttacaatatgtcgtcaaagcgtttcatcgaacatgtcgaataccatttaaactggtctttctgccgtgaagaaaaagaggggatcattttttccgccgctcaaaaagaatgccgtcccagcacttcgactaccttgctttatgatttggaacatggcgcatattattttccggctgaacgggatcgctttttaaagctcccggaaatattggtgcattacttggttgcttacaatgtaagcatgattgccaggtatgaaacacaatggtggtatgaccttcttcttcaaagtgccagcgatgattatgtcatcatccaacagtttttacatatagtcgagtcaaagttcccttattatatcgctgaattgcttattcgaaaaaaagaaaacaacaaaaaagaccagcttatataa

SEQ ID NO: 10 - DNA, 1467 bp, Bacillus licheniformis
atgtgggaaagcaaattttcaaaagaaggcttaacatttgatgatgtattgctcgttccggctaaatcggaggtacttccgcgcgacgtcgatttatcggtagagcttacaccgtctctcaagctgaatgttccaattattagtgcaggcatggatacagttacagaagctcaaatggccatcgcgatggcaaggcagggcggactgggtattatccacaaaaacatgtcaattgaacagcaggctgagcaggttgacaaagtcaaacgttcagagcgcggcgtcattacaaatccgtttttcctgacaccagagcaccaagtttttgatgcagagcatttgatgggcaaatacagaatttccggtgttccgattgttgacaatgaagaggatcagaagctggttggaatcattacaaaccgtgatctgcgatttatttctgattactccatgaaaatcagcgatgttatgacaaaagaagagcttgttacggctcctgttggtacaaccctggatgaagcagaaaaaattcttcaaaaatacaagatcgaaaaactccctcttttagatgatcaaggtgttttaaaagggctaattacgattaaagacattgaaaaagtaatcgaattcccgaattcagcgaaagatgttcacggccgcctattggttggagcagcggttggtgtaacaggcgacacaatgacacgcgtcagaaagcttgtggaagccaatgtcgatgtgatcgtcgttgataccgcgcacggccattcacaaggagtattggataccgttaagaaaatccgcgacacttatcctgaattaaatatcattgccggtaacgtcgcaactgccgaaggaacaaaagcgcttatcgaagctggagcaaatgtagttaaagtcggtatcggaccggggtcaatttgtacaacccgcgtagtagccggtgtcggtgttccgcaagtgacagcgatttacgattgtgcgactgaagcaagaaaacacggcgctgcgattattgcagacggcggcatcaagtattccggagatattgtcaaagccttggctgccggcggtcatgccgtcatgctaggaagccttcttgccggaacatctgaaagcccgggcgagactgaaatctatcaaggcagacgctttaaagtttatcgcggcatgggttctgtagctgcgatggaaaaaggaagcaaagaccgctacttccaagaggaaaacaaaaaattcgttcctgaaggcattgaaggccgtacgccttataaaggccctgttgctgataccgtttatcagcttgtcggcggcttgaaatccggcatgggctactgcggaacgaaagatttgcacgcattgagggaagatgcgcagttcatccgcatgacaggagcaggcctgcgggaaagccatcctcacgatgtgcaaattaccaaagaatcgcctaactataccatttcctaa

SEQ ID NO: 11 - DNA, 1326 bp, Bacillus licheniformis
ttgaaaagcaagagattaaagcagctgatcatgttaatcgttgcttttgccgtgactgtaggtgcattttctcctatgtcaactgcaaaagctgcaaatgatccaatcaatgtagacgcgaaagcagcaatcctggtggaagcttcatcggggaaaattttgtacagtaaaaatgccgaccagcgtcttcctgttgccagcatggcaaaaatgatgacggagtatcttctgttggaagcgattcacgaaggcaaagtgaaatgggatcagaagtacacgcctgacgattatgtatacgagatttcccaagatcgttcactatccaatgttcctcttcgtaaagacggatcatacactgtaaaagagctttatcaggcgactgcaatttactctgcaaacgcggcggctattgcactttctgaaattgttgccggttctgaatcgaagtttgtagagttaatgaacaaaaaagccaaagagcttggaatgaaagatttcaaatttgtgaatgccacaggtttggaaaacaaggatcttcacggcaaacatccgagcggaacaaatgccaatgaagaaaatgaagtgtctgcgagagacatggcgctccttgccgatcatttagtgagcgattatccagagatcctcgatacggcgagcattgccaaaacgaagttcagaaaaggcacagacgatgaaatggatatgccgaactggaactttatgctgaaaggccttgttcagcaatatgaaggtgtggacgggctgaaaaccgggtcaaccgactcagccggatcatgctttacggctactgctgaaagaaacggcatgagagtgatttccgtcgttctgaatgcgaaaggcgaccttcatacggcgcgatttaaagaaacgaaaaaaatgctcgattatgcatttgaaaacttcactatgaaagagttttacgcaaaaggcgcacaagtgaaaggcaacgaaacagtcacagtcgacaaagggaaagaaactgaagtcggcatcgtcacagaaaaagccttttcaatgcctgtgaagaacggtgaagaaaagaattacaaagcgaaagtgacgctgaacaaagacgagctgaccgcacctgttaaaaaaggtgagaaagtcggtaccttgacggcctcctataagggagaagaaaaggactacggatttctcggcagcgatgtatcaggtgtaaacctggtgacaaaagaagatgatgagaaagcaaactggtttattttaacgatgagaagcatcggcggcttttttgccggtatatggaacagcattgttgaaatggtaaccggctggttttaa

SEQ ID NO: 12 - DNA, 885 bp, Bacillus licheniformis
atggctcaaacaggtactgatcgcgtaaaacgcggtatggcagaaatgcagaagggcggcgtcattatggacgttgtcaatgctgaacaagcaaaaatcgcagaagaagcaggagccgtcgcagtcatggcgctggagcgcgttccggctgatatccgtgcggcaggcggagttgcccgcatggcagatccgactattgtcgaagaagtgatgaacgctgtttcaatcccggttatggcaaaagcacgcatcgggcatatcgttgaagcgcgtgttcttgaagcgcttggcgttgactatattgatgaaagtgaagttttgactcctgcagatgaagaatttcatttaaataaaaacgaatttaccgttccatttgtatgcggatgccgcgacctaggagaagcgacgcgccggatcgctgaaggagcttcaatgcttcgtacaaaaggcgaacctggtacgggcaatattgtggaagctgtccgccatatgagaaaggtgaatgctcaagtgcgcaaagtagtcggcatgagcgatgacgaactgatgacagaagcgaaaaacctcggcgctccttatgagctgctgaaggaaattaaagccgaaggacgccttccggttgtcaactttgctgccggcggtgtagcaacacctgctgatgctgctctaatgatgcagcttggcgctgacggcgtattcgtagggtccggtattttcaaatccgacaaccctgcaaaattcgcgaaagcaatcgtagaagcgacgacgcatttcacggattacaagctgattgccgagctttcaaaagagcttggaactgcgatgaaagggattgaaatctcaaatctgctgccagaacagcgtatgcaagagcgcggctggtaa

SEQ ID NO: 13 - DNA, 591 bp, Bacillus licheniformis
atgctgacaattggtgtacttggacttcagggagcagtaagagaacacattcgctcaattgaagcatgcggagcggccggaaaagtcatcaagtggccggaagagttaaaggaaatcgacggtttgattttgccaggaggcgaaagcacgacgatgaggcgcctcatcgatacgtatcagtttatgaagcctcttcaggaatttgccgcatccggaaagccggtatttggaacttgtgctgggctgattatcctggcgaagaacattgccggaactaacgatgcccatctcggggttctggatgtaacggtagagcggaattcctttggaagacaggtggacagctttgaagcagacttaaccgttaaaggacttgagggaccgtttacaggcgtatttatccgcgctccgcacattttggaagcgggcgcagatgtagaagtgctttcggaacacaacggaagaatcgtcgctgccaaacaaggaaatcttctcggctgttctttccaccctgagctgacggatgatcacagaatgacgaaattatttgtcgagatggtggaaaagcataaacgggaagccgtcgtataa

SEQ ID NO: 14 - DNA, 1278 bp, Bacillus licheniformis
atgcttgatgtcaaactgctgcgggcaaattttgaagaaatcaaacaaaagcttgcccacaggggagaagatttatcagattttgatcaatttgaggaattggatacaaagagaagagaattgatcgtcaaagtggaagagctgaaagggaagcgcaatgaggtatctcagcaggttgccgctttaaagcgcgagaaaaaagatgctgaccacctcattaaagaaatgcgcgaagtcggtgaagacattaaaaaacttgatgaagagctgagaacggtcgagtcttcgcttgataaaatcatgttgtctatcccgaacatcccccacgagtctgttccggtcggtgagactgaagacgacaacgtggaagttcgcaaatggggcgaactccctgagttttcgtttgagccgaagcctcattgggatattgccgatcaattggatattctcgattttgaacgggccggcaaggtaacgggaagccgtttcgttttctataaagggctcggcgccagacttgaacgcgcattgtataactttatgcttgatctccacgtagacgagtacggctatacggaagtcatcccgccgtacatggtgaaccgcgcaagcatgacaggcaccggacagctgccgaagtttgaggaagatgcttttaagatcagggaagaagattatttcttaattccgacggcggaagtgccgattacgaacctgcatcgcgatgaaattttgtcagctgacgagctgccgatcaattatgcggcgttcagtgcgtgcttccgttcagaagcaggctctgccggacgtgatacgcgcggtttgattcgccagcaccaatttaacaaggttgaactggtgaaatttgtgaagcctgaggattcatatgaagagcttgaaaaactgacaaatcaagcggagaaggttcttcagctgcttgagcttccttatcgggtgatgagcatgtgtacgggcgatctggggtttaccgctgcgaaaaaatacgatattgaagtatggattccaagccaaaacacatatcgcgaaatttcatcatgcagcaactttgaagctttccaggccagacgggcgaatatcagattcagaagggaagcaaaaggcaagccagagcatgtccatacgctaaacggatccggcttggcagtcggcagaacggttgccgcattattggaaaattatcagcaggaggacggaagcgtcatcatccctaaagcgcttcgtccatacatggggaacagagacgttattcaaccataa

SEQ ID NO: 15 - DNA, 1131 bp, Bacillus licheniformis
atgaaaatcgtaatcgcacctgattcatttaaagaaagcatgacatcgcttgaggcggctagaagcattgaaaaaggctttaaagagattctgcctgacgccgaatacgtcaatattccggttgccgacggaggcgaaggaaccgttcaggctctggttgacgctaccggaggagatattgtatatcaaacggtcactggccctctcgggaagcccgtaaaggcagcttacggcctgcttggtgacggaaaaacggctgtcatcgaaatggctgaagcgtcaggccttcacctcgttccacctgaacagcggaatcccctgttaacgacaacgagaggaaccggagagctgattctggatgctgcggaaaaaggagtgtcccagatcatcatcggactcggcggaagcgcgacaaatgacggcggcgcgggaatggcttcagcacttggcgtgaagtttctaaaccgcgctggagaagagattgaaaatgggggcggtgcactagctgagattgccaaaatcgatgtgagcggccttgatccaaaattaaagcatatccaattcgaagccgcctgtgatgttgataatcctcttacaggtcctcgcggtgcctccgctgtatttgggccgcaaaaaggagcgaacagtgaaatgacggcccacttggatcaaaacttaaaacattatgctgcagctgtcaaagcagagctgggatgcgaaatcgattcactcccgggagccggagcggccggaggattgggagctggcctgtgcgcctttttaaaagcggaattaaaaagcggtgttgacattgttttagatactttgtctttttctgaacgcattaaaggggccgatcttgtaattacaggcgagggaaaaatagacggccaaacggtcagcggaaaaacgccggccggcgtcgcaaaacgcgcctgcagcgaaaatattccggttattgcatttgccggatcgctcggtgaaggctgcgagcttgtttatgatatcggcatttccgctctcttttcgatcgtgcccggcatcagctccttggagaacgctcttgccgatggaagttcaaatcttacgcgctgtgcgcgaaatgtagccgccgtctggtcactcgaataa

SEQ ID NO: 16 - DNA, 1269 bp, Bacillus licheniformis
atggatattcaaatcaatgcaataggcgccttatgcgcattagtcatatcaatctttctcattctgaaaaaagtcccgccggcttacggcatgatgatcggcgcattggccggaggcttaatcggcggcgcagatttaatagagacgacggatctcatgatagcaggtgctaaaaacatgattcccgcggtgctccgcatcttggcggcaggcgtgctcgccggcgttctgattcaatccggctccgcagcggtgattgcggaaaccattgtcaatcagatcggagaaaaaagggcgcttcttgccttaacattggcaacagccatcttaacaacggtcggcgtattcgttgatgtcgccgtcatcacagtcgctccgatcgctctggcgatcgcgaggcggacctttatcagcaaagcggccattctgttggcgatgatcggcgggggaaaagcgggcaatatcatgtcgccaaaccctaatgccattgccgcttcagatgcctttcacgtccctttgacatccgtgatggccgccgggatcatccccgctattttcggattgggcgccacttacttgctggcaaaacgcctttcaaataaaggaacaaaagtagctgcaaatgagattgagacccaaacggcacaacaactgccggcattttgggcggcggtcagcggccctgtggtctctatcctgttgctcgccttaaggcctgcggcaggaattacgattgatccgattatcgctctgccggctggaggcctcgtcactgcgatcgcatcggggcaagcaggcaaactgagggattttgccgcttcaggactgtcaaagatgtcaggcgttgccgtgatgctgctcggaactggaacccttgcaggcatcatcgccaactccaaactcaattctttaatcaccgacacccttgtcggcttgggtctgccgtcgtttctcttagctccaatctcgggcatgctgatgtcaatggcaaccgcctcgacaaccgccggcaccgctgtcgccagcagtgtattcggcccgacattgcttgatcttggcgtcgccggcctcgcaggtgcggcgatgattcacgccggagcaacggtgctcgaccatctgcctcacggaagcttttttcatacgacgggaggcagcgtattcatggccatgaaagaacgattaaagctgattccatatgagtcggtcatcggcttaatcctaacgattatctcgactttgatttttggaatttttcaattctttatttaa

SEQ ID NO: 17 - DNA, 1119 bp, Bacillus licheniformis
atgaattacctatcaaaagaattggcggaggaaattgtcgaaagaaccatgtcgattattcggcacaacattaatatgatggatgaaaacggggttatcatcgcttcaggagaccgttcgagaatcggtgatgaacacgcaggagcgaaggacgcacttgcagctgaaaaggttatcagcatcacgcccgaagaatgctcggctttaacgggaacgaagcccggcgtaaaccttcccatcgtatttcatgatgaaataatcggcgtcattggaatcacggggccgccttctgaagtcagccgttacggagaacttgtcaaaatggcagcggagctaacagtcgaacaggcatttttaacaaaacagctgacatgggatcaaaggctccgcgaagaaacggtcatccaaatgattcaggggactgatctagcatcccttgacttctttgaacgtgcagagcgattaaacataccgcttgacggccagcgtacttgtcttgtgtttgagctcccatcggctgatatgaagccggcgtttattaaaaaacttgaaaagcatttaaccgcgaaagatttgtacgccaatatttctttaaaagaggtcgcagttattctggcaggcgcccccactaaaagcaggtctgatctcttttcagcttggaacggctggctcagccaatggaaaacagtcagaggcgcgcttggcgagcaggctgaccagcttcagcagctgccattttcctatcaaagtgcaaaacaaacgctcaagattgctgaaaacaattgtagtttatacgattatcgagagtttgcgattcctgttttattatcaaaaatagagcatccggatcaggagattcactttcaaaacatctgggatcgcctttcccaagcagatcaaaaaggcgaattaactcataccctcctctgctacatagaagaaaacggcgaaatcggggaaacttcatcaagactctttattcaccgcaacaccttaaactaccggctcagaaagattgaattggcaacggggtgtaatccaaaacggtttgacgacctattcaaactgtatacagccattactcttttttcacccttttgtgcaaatgaacaattttaa

SEQ ID NO: 18 - DNA, 423 bp, Bacillus licheniformis
ttgtggaaacattttataagccgtttgcctcaagattacacgctgaacagacctattgaaacaggaaagcttcagaaagcagaagaactcctcggcgtctcttttcctgatgaactggtcagccttttaaaaatgacaaacggcattaatgatactttcggggatcatctcatttggcctgcggacagaataatagaagagaatctagacatgagatgtaccgactgttttaagccgtttgattgtttgctctttatagcaggtgcgggcaatggcgatttatttgcttattctattttaaacggctccatacggaaaaatgatatttatgtttggaatcatatagacgacagccgaatatgggtcgcaccttctttaaaatcattcataaaaggctggatcgacggaacaatcaccatttaa

SEQ ID NO: 19 - DNA, 642 bp, Bacillus licheniformis
atgagtgtatatgatattccgaaagatgctatcattactgttgcaggaacggtaggagtggggaaatccacattgacaaaagagcttgcaaaaaggctcggatttaaaacctctcttgaagaggtcgtgaataacccttatttggaggctttttaccaagactttgaacgctggagctttcacctgcagattttcttcttggcagagcgcttcaaagaacaaaaatacatttacgaatcgggcggcggatttgttcaggaccgttcaatttatgaagatacaggcattttcgccaaaatgcacgccgataaaggcacaatgtcaaaagtcgactataagacgtatacgagcctgtttgaagcgatggtcatgacgccttacttcccccgccccgacgttttagtctatttagagggcgatttggaaacgattctcgaccgcatccaaaaacgcggacgggaaatggaactgttaaccgacagatcgtattgggaagaaatgtacactaggtatgaaaactggatcagcggatttaacgcctgtccggttgtcagagtcaatattgatgaatacgacctgttcaacaactcagcctctctcgatccaatcattgaaaaaatcagtgaagccattcaaagataa

SEQ ID NO: 20 - DNA, 624 bp, Bacillus licheniformis
atgaatacagcccctttcattgctgtcgaaggccccatcggcgcgggaaaaacaaccttggccagcatgctctccgaaaagctctcactctctttggtcaaagaaatcgtcgaagaaaacccttttcttgataaattttatgatgaaaaagatgaatggagctttcagcttgagatgtttttcctctgcaatcgctataagcagcttgaagataccgagaaaaagtatttgcatcatcacatgcccgttgtttcggactatcatatttataaaaacctcatttttgccgaacggacgctggaaggcaaaaaacttgagaaatacagaaaaatttatcagctgcttacagaagatctgccgaaaccaaacgtcatcatttacataagagcgagtcttccaactttattggaacggatcaaaaaacgcggacggccgtttgaacaagaaatggacaagcaatacctggaacagcttatcaatgattatgaggcggccattaagcaatttaaagaatccgatccgccaatacccgtcattgaaattaacggagatcaggaagacttcgtaatctcagaagccgttttcaatcgaattgccgatcaagtaaaggagtatatagaatga

SEQ ID NO: 21 - DNA, 1320 bp, Bacillus licheniformis
atgagaaaggaggcgtttcccattcagatttatgtcgtgaaaagaggcgataccctttaccaaatcgcgaatcgttaccgaacaacagttaatgaaattgtcgcgacgaatgaaattccgaacccgaatcggcttgttgtcggacaaaccatcgtgatcccgatcgccggcgagttttatgaggtcagacagggagatacattagcatcaatcggagcacgctttaatatttctccggctgaactggcgaggatcaaccgcattcaggttagcgccgttttaccggtcggactgctgctttacatcccccctcggccaagacggaacattgaaacaaacgcctatatcgaacctcggggagaaagcgtaagccccgctttgcagcaggcggcaagagaggcttcgccatacttgacctatctgggcgctttcagcttccaggcgaagcgggacggcacactcgaagaaccgccgctgaacaacttaaaagaaattgccgacagacatcggactacgatgatgatgattgtcaccaatctcgaaaatgaagctttcagcgacgaactcggcaggatcattctgacggaccagaatgtaaaaaacagattgctcgataacatcgttgcagcggccagaagatacggttttaaagacatccattttgacttcgaatacttaaggcccgaagatagagaagcctataatcagtttttacgggatgcccgggcccgcttcaggcaggaaggctggctcatctcaaccgcgcttgctccgaaaacgagagcggatcagcccggacaatggtatgaagcccatgattaccgggcccacggcgaaattgtcgatttcgtcgtgctgatgacatatgagtggggctacagcggagggcccccgatggcggtatcgccgatcgggcccgtccgggacgtgatcgaatacgcactcacggaaatgcccgccagcaaaatcgtcatgggacagaacttgtacggctatgactggacgctcccctatacgccaggcggaccgctggccagagcaatcagcccccagcgggcgattgagatcgcgagcgagaacaatgcggcgatacagtacgatgaaacagctcaggctccaaacttccgctatacggacaatgccggcaaacagcatgaagtatggtttgaagacgcccgctcgattcaggcaaagtttgatctgattagggaattgaatttaaggggaatcagctattggaagctcggcctgtccttcccgcaaaactggctcttgatagccgatcaatttaatgttgttaaagagacgttcccaagttaa

SEQ ID NO: 22 - DNA, 543 bp, Bacillus licheniformis
ttgtccaattcagctctcattatagtcgacatcattaatgattttcaattcgatatgggtaacgttctttccaaaaagaccagaaatatcaccgagcatcttctggcattaaaagaacacgcagccaaaatgaaatggcctatcatatacattaatgaccattttggaatttggcaagcggatattgctgccattatcaagaaatgcaaaaacggcaggagcgaatatatcatcgaccggcttgcaccgaatgacagcgattattttttaatcaaaccaaagcactcagccttttacggcactgctcttgaaacattgctgcatgaacttcatgtcgatcatttgatcatcactgggatcgcaggcaatatctgcgtattatttacggcaaacgatgcttatatgcgggagtacgagattacgattccgcgcgattgcatcgcctcaaacaatgaaaaagacaacaaatacgccttgacgatgatggaaaatgttctgttcgccaatatcacgacggctaaggcgattacctccgaaacttag

SEQ ID NO: 23 - DNA, 591 bp, Bacillus licheniformis
atgagagctgaattggacaatgcgattgtctcctttcagattttatattcctttaactataagttagcctattcagtttggcgaaaaacattgaaagagtgcatgcggatgacacaagacgagttttatatgaaagaagcggtcaatgaagcgagaaaagccgaagaaaaaggcgaagtgccgattggtgctgtactcgttctggatggggaaattatcgcccgcgcccataatctgagggaaaccgagcaaaggtcggttgcccacgcggagatgctcgtcattgaagaggcatgccggaagctggggacctggcggctggagagagctgttctttacgttacccttgagccatgtccgatgtgtgccggagcggccgttctttccagaatcgacaaaaaggtgttcggagcgtctgatccgaaaggcggctgtgcagggactttgatgaatctcctgcaggaggagagattcaatcatcaggctgaagtcgtgagcggcgtaatggaagaagaatgcggcaggatgctgagcgattttttcagaaagctccgcgcgaaaaagaaagcagaaaagcaaagcgagctgtga

SEQ ID NO: 24 - DNA, 1614 bp, Bacillus licheniformis
atgcccttttacaaaagaaattttcgcacgcttatctgttttccggaccgaggggaacgggaaaaacaagcgccgcaaaaactgtttgccaaagctgtcaactgtgagcgcgctccggtcagtgaaccgtgtaacgaatgctccgcgtgcaaaggcattacaaacggttcgatttcagatgtgatcgaaattgacgccgcttctaacaacggtgtagatgaaatacgcgacatccgcgacaaggtgaaatttgccccgtctgccgtcacgtataaagtatatatcatagatgaagtacatatgctttctatcggcgcattcaacgcccttctaaaaacgcttgaagagccgccggagcattgtatctttattctcgcaacaacagagcctcataaaattcctttaacgattatttctagatgtcagcgatttgattttaagaggattacctcgcaggcaattgtcggacgaatgaaaaaaatcgtcgaagctgaacagttaaaggtgcaggacggagccttagacatcatcgccagtgccgcggacggcggcatgagggatgcgctgagcctgctcgatcaggccgtatcattcagcggagaagagctgacggtggatgatgcgctgctgataacaggcgccgtgtcacagcactatattggaaagctcgcctcaacccttcacgaaaaaaatgtttccggtgctttggaaacattgaacgaactccttcagcaggggaaagatccggcaaaattaatcgaggatatgattttctacttcagggatatgcttctttatcaaacggcgcccgatttagaaggcgttcttgaaaaggtgaaggtggacgaagagttccaaaccctatcccggcaaattcccgcatcagacctttacgaaatgatcgatatattaaataaaagccatcaggaaatgaaatggacgaatcatccgcgtatcttctttgaagttgcggttgtgaagctctgcctgggaccaaaagcaggggcatccgcggccgcccagccggaagtggacaatctcgtcaacaaggttcggcagcttgaacaggagattgagaggcttaaaacacaaggtgtgcaggtctcttctgctcccgcccaggctaaagaagcgtcccgtccgcaaaaaagcataaaaagcgcgtataaagcgcctgtcggccgcattcatgaaatattaaaggatgccacaagaccggatctcgaaaaattaaagggctgctggggacaattgcttgcccagctgaaacagcagaataaagtatcacatgcggcccttttaaatgacagcgaaccggtggctgcatcttcaaaagcatttgtcctcgcattcaaatacgaaattcactgtaaaatggtagctgaagacaacaacggagtcaggacgaatctggaacaaattttggacggaatgctcggcggaaggatagatatagttggcgttcccgaagcccaatggggtaaaataagagaagaatttttgcaggatcaccagccggaagattctgaagcaaacgaaccgaaagaagaagatccgctcgtagcagaagctaaaaaactgttcggagcggaactgattgaaattaaagaataa

SEQ ID NO: 25 - DNA, 330 bp, Bacillus licheniformis
ttgagtatgcgcggtggaatgggtaacatgcagaaaatgatgaagcaaatgcaaaaaatgcaaaaggatatgcaaaaggcacaggaggagctggctgaaaaagtactcgaaggtactgcaggcggtggaatggtgaccgttaaggtgaacggccaaaaagaagtcatcgacgtcatcatcaaagaggaagtcgtagaccctgaagatgttgaaatgcttcaagatcttgttcttgcagcgacaaacgatgctttgaaaaaagttgacgaagtaacaaatgaaacgatgggtaagtttacaaaaggaatgaacatgccgggtttattctag

SEQ ID NO: 26 - DNA, 597 bp, Bacillus licheniformis
atgcagtatcctgaaccaatatcaaagctgattgacagctttatgaaattgccaggaatcggacccaagacggcggtccgtctggctttttttgttcttagtatgaaagaagacgtcgtgttagattttgcaaaagcattggtaaacgcaaagcgcaatttgacatattgctcggtctgcggacatataacagatcaagatccttgctatatttgtgaagatacgagaagagacaaatcggtcatatgtgttgttcaggatcccaaagatgtcattgctatggagaaaatgaaggagtacaacggactgtaccatgttttgcatggagcgatttctccgatggacggcatcggtccggaagatattaaaatacccgaattgctgaagcggttgcaggatgatcaggtgactgaagtcattctcgcgacaaacccgaatatagaaggagaagcaacggccatgtacatttcaaggcttttaaagccgtctggtatcaagctgtcacgaattgcccatggacttccggtcggaggcgatttggagtatgcagatgaagtcactctttctaaagcgcttgaaggcagacgtgaaatgtag

SEQ ID NO: 27 - DNA, 225 bp, Bacillus licheniformis
atgggttttcttcggaaaaagaagcttagaaaagaatttgataacaagctggttgaacagctgatccatcaaaaggaagaatggaacaggcaaaagcggctgattgaaaacagcctagagccttccccagaagttctttacgaattaaaggttgccgaggcaaagtactttttttatttgcgggaagcaaaaaaaagaaatttaaggatcggcagctggaagtag

SEQ ID NO: 28 - DNA, 267 bp, Bacillus licheniformis
atgggatctgttatctttatcggggcaattgtagctttggttgccctgttgtttttttcaaaagcatcatttaagcctttgcgattaatcggaagaatagcggttagatttgtagtcggcgctttgtttttgttctgtgtgaatctgtttggcgagagcgtgggcattcacgtgccgattaatattgtaacaaccggagtgagcggattattgggggttcccggtgtagcagctcttattgtcattaaacaatttatcgcaatataa

SEQ ID NO: 29 - DNA, 207 bp, Bacillus licheniformis
atggaggtggaatggatgagtaagtctaatcatggggaaacgtgtatcatttgcgaggaaaataaaaccgaaggaattcatctttatacgaaatttttatgttcggattgtgagaaaaagattgtatctacatcaacatcagaccccgaatactctgattatgtcaaaaaattaaagagtctccgtacgccgccattatattcttag

SEQ ID NO: 30 - DNA, 618 bp, Bacillus licheniformis
atgaaaccgattcttcattttatgattcgtgcaactgctgcaagtgcattgtccgtgctcctttggtttacaagcttcttcgcgtttaaccagacttttctgctgtcctccgcttacgcagccggagcctggattgccgtttatcttggcgggaaatggtacggaacctatttatttttaaaagaaaaccagcttacaaggcgggaatatgcctatataaaacagaatctgcgggaagctaagctgaaaattgcccggttaagaaaagccttatttgcagttaaaaacattcaaactattaaacagaatctagaaattcttcggatcgtcagaaaaatttacagcatcacaaagaacgaaccaaagcgtttttatcaggttgaacgcttttattatcaaagccttgattcaattgttgaactgacggaaaagcatgcgtttttggcgtcacagccaaagcgcaatgcgaatcttgaagtttctttaagcgaaacgcgtatgatgatcgataagctcgccaagcaattggaagacgacctttatgacttgctgaaaacagacattgaccacttggagtttgaactggacgtcgcgaagcattcaatgaaaaaaagctga

SEQ ID NO: 31 - DNA, 1194 bp, Bacillus licheniformis
atgagcgaatataaaccatcgttacacaaaactggcgcacagcttgaatttgatgatttgctttccgatccttttggacaaggagaagcgcctgtttccggcgtggaggaaaaactccgcgggcagcaagtgaatctggttgatacgttatctgaagaaaaacgccggcaggcatttcaactggccgaacagattgacccgaaaaaccataacagcattactctgtatggaacgcaagctcaatccaaactcttgaacttctcacatgagatgctcgagcacgtccaaaagaaagatgtcggtgaaattgggcaggttttaagcgacctcatgaaaaagcttgaacaggtcagccccgatgaattgaaaactgaaaaaaggaacttcttttcccgtttgtttggaagagtatcccattctgttcaagaagtgttatcaaggtatcaaaaaaccggcgctcaaatagatagaatcagcgtaaaacttgagcattccaaaagcgcgctgatcaatgataataagatgctcgaacgcctttatgaaaaaaataaagaatattatgaggcactgaatgtctatattgcagccggtcagctgaagcttgaagaattaaatcataaaaccattcccgaattaaaagagaaatcgaaaactgaacatcaccatatggcggttcaggaagtaaacgatatgattcagtttgccgaccggctggaaaagcgggtttacgatttaacgttgagcaggcaaattacgctgcagagcgccccgcaaatccgtttgattcagcacacaaatcaagtgctggcggaaaagattcaatcttcgattatgacagcaatccctctttggaaaaaccaggttgctattgcgctcaccctgttgaggcagcgccgagcagtagaggctcaaaaacaggtgtcggccacaacaaacgaactgctcttgaaaaatgccgagatgctgaaggccaatacgatcgaaacggcaaaggaaaatgaacgaggctttattgatattgaaacattgaaacaagtgcaggacaatctgatcggtacacttgaggagacgcttaaaattcaagaggaaggccgttcaaagcggctgcaggcagaagaagaaataagggcaatggaagatggtctcaaggctaagctgctggacatgaaagaaaaccaaaaccgtagatcataa

SEQ ID NO: 32 - DNA, 1443 bp, Bacillus licheniformis
atgaagacacctttatatacagcattggtgaaccatgctgaaggacatcattattcttttcacgttccgggacatcacaatggagatgtcttttttgatgaagcaaaaactttttttgaaacgattctcaaagtggatctaactgaactgacaggactggatgatttacatgagccatctggcgtcatcaaggaagcacaggatttagtttcgcggctttacggagcggaagaaagcttttttctcgtcaatggttcgaccgttgggaatctggctatgatcctggctgtttgtcagccgggtgatacgatactcgttcagcgtaactgccataagtctgtatttcatgcgattgaactttcaggcgcccatccggtttttttgacaccggaaattgatgaggcgatggctgttcccacacatatactgtacgaaacagttgaagatgcaatttcacaatatccgcacgcaaaagggatcgtgttgacatatccaaattactacggccatgcagttgatctgaagccgatcatagaaaaggcccaccaacacgatatttccgttttagtcgacgaggctcacggcgcccattttgtgctgggccatccatttccccagtcgtcgttgaaagcgggcgctgatgccgtcgtccagtccgcgcataaaacgctcccggcgatgacgatggggtcctatctgcatcttaacagcggcaggatcaacagggacagactggcatactatctgtccgtgcttcaaagcagcagtccttcctacccaattatggcatctttggatatagctagggcatacgccgaagatatcttgaaaacaaatcgaacagccgatattgagaaagagctcatcaatatgagagaagtcttttctcaaataaacggagctgatattgtcgagccggctgatgcccgtatccggcaagatccgcttaagctgtgtatcagatcagcgtacggccactccggttttgaactgaaatccatatttgaagcaaacggcatccatcctgaattggcagatgaaaggcaagtcctgttgatcctgccgcttgaaggaaaaaatatgcccgcgccggaactgatcagcacaatcagtaaagacatgaaagatacagcagttcgaaatgatcttcctgccggaatcggaatcccttctgaaaaagtcacggctttgccttaccggaaaagcaagttgtctgccttcaaaaaagaatcggtgccttttaccgaagcagcgggcagaataagcgccgaatcggtcacaccttatcctccgggcattccgttgatcatggcgggtgagagaataacaaaagagacgatcagccggctgacgcggctcgtcgatctgaatgtacacattcagggcagcaatcagctcaaacaaaagcaattaactgtatatatagaagaggagaaatcatga

SEQ ID NO: 33 - DNA, 639 bp, Bacillus licheniformis
atgaacggtttatttattacttttgaagggcctgaaggtgcggggaaaacgacaatccttcaggctgcggcagaccaattgacgaaaaacggccattctgttcttgcgacaagggagccgggcggcattgaaatatcagaacgaattcgcgaggttattttaaatccaagccatacagcaatggatcccaaaacagaggccttgttgtatgcggccgcaagaaggcagcacctagtcgaaaaagtaaaaccggcgcttgaagaagggaaaatcgtcttatgcgaccggttcatcgacagctcgcttgcttatcaggggtatgccaggggactcggcattgatgaagtattttctgttaatcaattcgcgatcggcagcctgatgccgaatgtgacgatttatttcgacattgacccggaagagggaatcaaacgaatcgatttaaatgatgcaagagagaaaaaccggcttgatttggaaaaactccactttcatcagcttgttcaaaaaggctacgaagaagttatgaaccggttccccggacgatttcggattgtggatgccagccaaagtgttgaacttgtgttaaaaagggtaaataacatcattgaggaagcattaaaagaaaatcagttgtga

SEQ ID NO: 34 - DNA, 330 bp, Bacillus licheniformis
atgaagttaattatcgctgttgttcaagaccaagacagcaaccggcttttaaaggctttgaccgatcacaattttcgcgtgaccaaactggcgtcgaccggcggctttctgaaatcgggaaacacaaccttcatgttgggtgtagatgatattcgagtagacaaagctttaagcttgataaaagaaaacggaagcaagcgggatcagctgattgcccctgtttctccaatgggcggaaatgctgattcatatgttccttatcctgttgaggttgaagtgggcggagcaaccgtttttgtactgccgatcgagcaattccatcaattttaa

SEQ ID NO: 35 - DNA, 309 bp, Bacillus licheniformis
atgaaaataagtcaagaactgcgtacaatgatagagaaacagcagactccgcctgcaagaggagaaaatgtttctgcttcatttaaagagaagatgaatatacaaagcggcaagcttcgagttgaacagctgacaatgcttttaacagatattgaagcgttcggaaaacgcctctcaaaatcgagaaacttcaaagatttggccaggttcaaaggcttgatcaaacgatttgtaaaagagaccgatgaaaacgtctggacggtggagattcaagaagcttcgatctgtacggaaacagccggacattaa

SEQ ID NO: 36 - DNA, 990 bp, Bacillus licheniformis
atggctacaacctggacagaaatgcagaagcttcagccacgggttatgaagcttttgcaaaatagtatagaaagaaatcggcttgcccacgcctatttatttgaagggcgcaaagggacgggcaaattagacgcggcaacccttctggcaaaaagctttttttgccttgaagatggagcagagccatgtgagtcatgcaggaactgccagcggattgaatctggaaaccatccggacgtacacgtcgtccatccggacggcctttccattaaaaagggacaaatccaggcgcttcaggaagagttttctaagaccggtttggaatcgcataaaaagctgtatattatttcccatgcggatcaaatgacggtcaatgcggcgaacagccttctaaagtttttagaggaaccgagcagcgatacaatcgctgttcttttaacggaacagccgcaaaaattgctcgatacgatcatatcgagatgccaggttttatcctttcagtcgctgcagcccgaatcgattgaaaaggaactggtcaaacaagaggtctcaccgaatattgcagcccttttgtcgaatatgaccaacaatttatcggaagcgctcgaattgagtcgaaatgatcagtttgcagagtcgcgagcgaaagtgataaaattgtatgaagtcttacaccagcgaaaaggacatgcttttttctatattcaagatcagtggatgccctttttcaaggagaaagaccaccaagaaatgggtcttgatatgcttttatttatatatcgcgacgtgttgtccattcagttgggacatgaagataaaatactatttcaggacttattccaatcattaaaacagcatgcgctgcaaacaacacaacaaagagtgacaaaccagatacttgctgttttagaagcaaaaaaacggctttattccaatgtgaatgctcaaggattaatggagcacttggttttaatgctgcaggagggataa

SEQ ID NO: 37 - DNA, 828 bp, Bacillus licheniformis
ttgtacaacgttattggtgtccgctttaaaaaagcgggcaaaatatattatttcgatccgaacggatttcagatagataaagacagctgtgtgatcgtcgaaacggttcgcggtgttgaatacgggcaggttgtcattgccaacaagaaagtagacgagaacgatgtcgtgctgcctttaagaaaagtgatcagagttgcggatgaacgcgaccgcctgatcgttgaggagaatcaagaagctgcgctgtccgcctttgatgtctgccagaaaaaggttaacgagcacggccttgagatgaaactggtcgatgtggaattcacttttgaccgcaacaaagtcattttttattttacggctgatggaagagtcgattttagagaactcgtcaaagatttggcatcgatctttaaaacgagaatcgagctgagacaaatcggcgtcagagatgaagcgaagatgctcggcggtatcggaccgtgtggaagaatgctttgctgttccacgtttttaggtgattttgagcccgtttctattaaaatggcaaaggatcaaaatctgtcgctgaatccgacgaagatttccggactatgcggacggctgatgtgctgtctaaagtatgaaaacgatgaatacgaaacagccaaagaacagcttccggatatcggggaagtgatcgccacgtccagcggcccggcaaaagtcgtcgggttgaatattctcgaacgcattctccaggttgaactgacagactgcgacaaagttgttgaatatacgtgggatgagctgttgcaagaaggtgtcgtatctgcacaaaccacagattaa

SEQ ID NO: 38 - DNA, 363 bp, Bacillus licheniformis
ttggataaaaaagaattgtttgatacagtgataagtttagaagaacaaatcgggtccctttaccgccagcttggagatctcaagcagcatatcggggaaatgattgaagaaaacaatcatttacagcttgaaaacgagcatttgcgcaagaggctggaagagacggatcaaaggctaaaaagcgtaaaatccgatgaaaaagagataaaagcagaaaagacagggcatgctgatattggagagggccatgataatttggctcgcctgtatcaggagggcttccatatttgcaacatccattacggaagtgttcgcaaagaaggagactgtctgttctgcctctcgtttttaaataaaaaataa

SEQ ID NO: 39 - DNA, 744 bp, Bacillus licheniformis
atgattcaattaaaagatgatgaacgactggattatttactggcggaagatatgaaaatcgtgcaaagcccgacagtttttgcattttccttagatgctgttctgctgtcgaaatttgcttacgttccgatacaaaaaggaaacatcattgatttgtgcacagggaacgggattgttccgctgcttctcagcacccgcacaaaagccgccatcaccggggtggaaattcaggaaaggctgtatgacatggccctccgcagcgtggaatacaacaacctgcaaaaacagattcatcttatcagggacgacctgaaaaatatgccgcaggtgctcggatacaataaggccgatgtcgtcacatgcaatcctccttatttcaagacgccgcaaaaaacggagcaaaacctaaatgaacatttggccattgccagacatgaaatctactgcacgcttgaagatgttattcgcgtcagcagcaagctattaaagcagggcggcaaactcgctctcgttcaccggccggggaggctgctcgaaatctttgaattgatgaaggcctttcaaatcgagccgaagcgggtccaatttgtttacccgaaaaaaagcaaagaagccaacaccattttagtagaaggaataaaagacggccgacctgacctgaaaattttgcctcctttgtttgtgtatgatgaacaagatcaatatacacatgaaataaggaagattttatatggagacgaatag

SEQ ID NO: 40 - DNA, 294 bp, Bacillus licheniformis
atggagacgaatagccattacttttacgtgctttcgtgccgggacggcagcttgtacgcaggctatacaaacaatatcgaaaagcgcctgaaaacgcataatgacgggaagggcgccaagtatacgagggcaaggctgccggttaaactccattatgcagagtgcttttcaacgaaacgagaagcgatgcaggccgagtactatttcaaaaaattatcgagaaaaaacaaagaacgttatatagaagaaaaaagacgggagggtgttgattatcaaccggcaaaagagttttga

SEQ ID NO: 41 - DNA, 831 bp, Bacillus licheniformis
atgttatatctcgtaccgactcccatcggcaatttagaggatatgacatttcgggcggtttctgtgttaaaagaggcggacattatcgcggcggaggatacgaggcagacgaagaaattgtgccatgtgtatgaaattgagacacagcttgtcagctaccatgaacacaataaagaaagcagcggacataaaattttggaatggctgaaagaaggaaaaaacgtcgcattggtcagtgacgccggaatgccgacaatatctgaccccggggctgaaatcgtccgcgattttatcgaaatgggcggctatgtcgtacccctgcccggtgcaaatgcggctttgaccgcactgattgcctcaggcattgcgccgcagccgtttttctttttcggctttttggaccgcagcaaacgggaaaggaaaaaacagctcgaggctttgaagaacagacaggaaacgatgattttttacgagtcgccgcatcggctgaaagaaaccttggcggccatcagagaggtattcggcaatcggcaaatcgcattgacaagggaactcacgaaaaaattcgaagaatttatcagaggttcgatcgaagaagcactcacatggtctgaacaggaacaggtgcgcggagagttttgccttgtgatcgaaggaagccgtgaagaaacgattgaagaggcggtctggtgggagcatctttcagaaaaagaacatgtcgagcattatatcagcgaaggatatccttcaaaagaagccattaaaaaaaccgcggttgaccgcggcgttccgaaacggaaaatttatgacgcttaccatattcaaaactaa

SEQ ID NO: 42 - DNA, 285 bp, Bacillus licheniformis
atgaaatctacaggtattgtacgtaaagttgatgaactaggacgcgtggtgattccaatcgaacttcgccgtacgcttggaatcgcagaaaaagacgctcttgaaatctatgtagatgacgaaaaaatcatcttgaaaaaatataaaccaaacatgacttgccaagttacaggtgaggtttctgatgacaaccttaaacttgcaggcggtaaattggttcttagccctgaaggcgctgagcaaatcattaacgaaattcaagcacaacttcaatctcaaaaataa

SEQ ID NO: 43 - DNA, 1989 bp, Bacillus licheniformis
atgccgcaagaaaaaaatacgttttacatcactacacccatttattacccaagtgggaagctacatattggacatgcctacacgaccgttgcaggtgatgcgatggctcgttataaaagactgagaggctttgatgtcagatacttaactggtacagatgagcacggacaaaaaattcagcaaacggcggagaaggaaaacatcactccgcaggaattggtcgatcgtgcggcagaagacattcagcagctttggaaaaagctcgacatatccaatgacgacttcattcggacgacagaggaacgtcataaaaaagtgatcgaaaaggtatttcagaagctgcttgacaatggtgacatatatcttgatgaatatgagggctggtacagcatccctgacgaaacgttttacaccgaaacccagctcgttgatgtcgagcgaaacgagaaaggcgaagttatcggagggaaaagtcctgacagcggccaccccgttgagctaatcaaagaggaatcttacttcttccgcatgggaaaatacgcggatcggcttctcgctttctatgaagaaaatcctgaattcatccagcctgaatcccggaaaaatgaaatgatcaacaactttatcaaaccgggtcttgaagatttggctgtttcccggacgacgttcgactgggggataaaagtgcccggcaatccgaagcatgtcatctatgtttggatagatgcgctgtttaattacattacggcacttggctttaatacggaaaacgatgaaaattatcaaaaatattggccggcagacgttcatcttgtcggtaaggagatcgtccgcttccataccatttactggccgattatgctgatggcattggaccttccgctgccgaaaaaggtttttgcccacgggtggctgctgatgaaagatggaaaaatgtctaaatcaaaaggcaatgtggttgacccggtcacattaatcgacagatacggactagatgcattgcgttattatcttctccgcgaagtgccgttcggttctgacggcgtatttacaccggaaggatttgtcgagcggattaactatgatttagcgaatgatttaggcaacctgctgaacagaacggtcgccatggtcaacaaatactttgacggccggattcagtcgtatgaaggcccggttaccgcttttgacgaaccgttgtcatcattctcgcaaaagacaattgaagcgtacgagcaggcgatcgaaaatatggagttttccgttgcgctttcatcattgtggcagtttgtcagcagaacgaataaatacatcgacgagacagccccttgggtactggcaaaagataaggataaagaaaaagagcttcaatcggtcatgtaccatttggcggagtcattgcgcatcactgctgtattgctgcagccgttcttaacgcagacgcctgaaaagattttcgcacagcttggcgttacggatgcgtcactgaaaacctgggacagcattcaaagcttcggccagctgaaatctgtgacagttcaaaaaggagaaccattgttcccgcgtcttgaggcggaagacgaagtcgcttatatcaaatcaaaaatgcagggaacggctccaaaagaagaaccaaagcaagaggaaaaagcacatgaacggcttccggaaatcacgatagacgattttatgagcacagagctcagagtggctgaagtcattcatgctgaacccgtcaaaaaagcggatcgtctgttaaaactccagcttgatttaggctttgaaaaacgccaagtcgtttcaggaattgccaagcactacaaacctgaagagcttgtcggccggaaagtcatttgtgtaacaaatttaaaaccggtcaaactaagaggagaactttctcaaggcatgatattggctggagaggacaacggcgttctctcgcttgcggcggtagacagttcattagcaaacggaacgcgaatcaaataa

SEQ ID NO: 44 - DNA, 768 bp, Bacillus licheniformis
atgttatttgatacacatgctcatttaaacgccgagcaatttaacgaggatttggaagaagtcattgctcgggcaaaggaagaaaaagtggagcacattgtcgtggtaggattcgatcgtccgacgatcaagcgtgcgatggaattgattgaagaatacgattttatttatgcagccatcgggtggcatccggttgacgcaattgatatgaccgatgaagatttggcttggatcaaagacctgtccgcccatgagaaagttgtggcgatcggagaaatgggacttgattatcattgggataagtcgccgaaggacgttcaaaaagaggtgttcagaaaacagatcgctttggcaaaagaagtcggcttgccaatcgtgattcacaaccgtgatgcaacggaggatgtcgtttctattttgcgggaagaaggggccgaggaagtcggcgggatcatgcactgttatacaggaagcgctgaaattgcacaagagtgcatcgatatgaatttctacctatctttcggcggacccgtcacatttaaaaacgccaaaaaaccgaaggaagtggtcaaacaaataccaaatgaccggcttttaattgagacggactgcccgtatttaacgccgcatccatacagaggaaagcggaatgaacctagctatgtcaaacttgtcgccgaacagattgccgaattaaaaggaatgacttatgaagaaatagcggccgtcaccacagaaaatgcaaaaaaacttttcggcatcagctga

SEQ ID NO: 45 - DNA, 1197 bp, Bacillus licheniformis
atgaaaaagctgttttccgtaaagcttagcaaaagcagatggattctgattgctgctggactgcttgtcgcagggagcggaactgcttacggagcacatgagctcgctaaacagcaagtcaccatttcgataaacgggaaaaagcaggatgttcgcacgaatgctaaaaccgtaggtgaactgctgaaaagcttagacatcgagacgaggaaagaagatcacatctctcccgctgaagatacaaaattaacggcgaacatgaatgttgaatatgttgccgcaaaacctgttcatttcacggtcgacggacaggaaaaggaaatctggacaacagcgggtacagtcggcaaacttctgaaagacttaaatttagagttggcggaacacgatcaaattgacccctcagttgataaagaaataacgaaagatatgaagctgactttgcaaagggcttttaaagtaaccgtaaaggatgccggtaaagataaagacctatggacgacttcgactacggtcgctgactttttaaaacatcataagatcagcataaaaggcgatgatgaagttaagcctgcgcttgataaaaagctgacgaaagatcaggcgattcacattactcgtatcaaaaaagtcaccgatgtagtggaagagaacatcccttttgaagtccggaaaaaagaggacgattcacttgaaaaggggaaagaaaaagttgtacaggacggtaaacatggcaagcttaaaaagcactatgccgttgttatgaaaaacggcaaggaagtttccagagaactgattaaagaggaaacggcagccgaaagcaaagccaaaatcatcgctgtcggtacaaagcaagccgcagtggctaaagtcagcgcgaatgtatcgcgcggaaatcaatcctcaggaaaggaattttatgtatcctctacagcttatacagcaagctgcaacggatgctcaggccacactgcgaccggcgttaatttgaaaaataatcccggcgctaaagtgatcgctgtcgatccgagcgttattccgctgggttccaaagtacatgtagaaggatatggctatgcggttgcggccgatacaggctcagccatcaaaggccgaaaaatcgatgtattctttccgaataagtctacagcttaccgctggggaaacaaaagagttaaaatcaaggtgttgaactaa

SEQ ID NO: 46 - DNA, 561 bp, Bacillus licheniformis
atgaagattaaagaaatcatcgttgtcgaaggccgtgatgacaccgctaaaatcaaatcggctgttgatgcagatacgatcgaaacgaacggatctgccataggggaagacgtcatcaaacggattcggctcgcccaggaaacgcgcggggttattattttaaccgatcccgatttcccgggggaaaaaatcagaaaaacgattgcagaaaaggtccccggctgcaagcatgcatttttgcccaagcatttggcaaagcctaaaaataaacgcggaatcggtgtcgaacacgcttcgcttgaagcgatccgcgaatgcttaatgaccgttcaggaggaaatggaagcgacggaacctgagattgaggcccgggatttaatcgaagccggcctgatcggaggcccgctggcaaaacaaaggcgggagcggctcggcgaaatattgaatatcggctatacaaatgggaaacagcttcaaaagcggctgcaaatgtttcagatcaaaaagagtgattatttaagcgcactggatgctgtgctgcgggaggaagaacatgaataa

SEQ ID NO: 47 - DNA, 879 bp, Bacillus licheniformis
atgaataaagatatcgccaccccaattaggactaaggaaattctcaataaatacggattttcattcaaaaaaagcctggggcagaacttcttgattgacacgaacatattggacagaattgtcgaccatgccggtgtgacggagcgtacaggcgtgattgaaatcggtccggggatcggggcattgaccgagcagctggcaaagcgtgcgaagaaagtaacggcctttgagatcgaccaacggcttctgccgattttagaagatacgctttctccgtatgataatgtgactgtcattcaccaggatgtcctgaaggccgatgtccgagcggtaatggacgaacagtttcaagactgcgatgaggtgatggttgtcgccaacctcccgtattacgtcacgactccgatcatcatgaagcttttagaagaaaatctgccgctgaaaggaatcgtcgtcatgcttcaaaaagaggtggcggaccgaatggctgcaaaaccttcttcaaaggaatacgggtccctttccatcgcggtgcagttttatacggaggccaaaacggtcatgaatgtaccaaagaccgtatttgtccctcagcctaacgtagattccgcggtcatcaggctgacgctgaggaaagagccggctgtggccgttcaagatgctgcctttttctttcaagtcgtaaaagcaagctttgcacagcgtcgaaaaacgcttttcaacaacctcgtcaacaatctgccgaatggcaaagagaataaatcaaaaattgaaagagcgcttcaggattcacatatcgacggaaaacgacgcggagagtcgcttagcattgaagagttcgccgtcttatctgaccgcttgagagaagtccttctttaa

SEQ ID NO: 48 - DNA, 900 bp, Bacillus licheniformis
atgtgtggagtgaaaagcatgcaatttaaaataggcgatatggtcgtcagaaaatcttatcgaagagatattttatttcgaattataagaattgatcaatcggcaaatggagaacctgtagccgttttgcacggagatgaggtcagattaatcgctgacgcgcatttgggggatcttgagattgtccgcgaggctgagtggcagatgagaaagcgggaagaagaaacgagaatgaaggaatccctcgatcttctccgccaggattacaaactccttcacgataaacatgagtaccgcgccacaaaccaatataacaatcaacagcagtactttcatatgcccggaagagtccttcatttagacggggattcggcttatttgaaaaagtgtctggcgctctacgaaaagatcggggttcctgtatacggcattcattgctatgaaaagaaaatgtcatcagtcatcgaggaactgatcgatgaataccgcccggatcttctcgtcattaccggacacgatgcctattctaagcagaagggcgatattaacaatctggatgcctacaggcattcaaaagattttatcgaaaccgttcaaaaagcgagaagaaaaattccccatcttgatcagctcgtcatttttgccggcgcatgccagtcccattttgaatcactgatcagagccggtgcaaatttcgcaagctctccgtccagagtcaacatccatgcgcttgatccggtctatatagtcgcaaaaatcagcttcactccgtttatggaccgcattaacgtctgggaagtgctcagaaataccttgacgagagaaaaggggctcggaggtattgagacgcggggcgtattgcgtattggaatgccatataaaacaaaagcaaacgattaa

SEQ ID NO: 49 - DNA, 261 bp, Bacillus licheniformis
atggcgaaaacgttgtccgatattaaaagatcgcttgatggacatttgggaaaaaggctgacgttaaaagcaaacggtggccgccgaaaaacgattgagcgttcgggcattttagctgagacgtacccttctgtttttgtgatacaactagaccaagacgagaattcgtttgaaagagtttcatacagttatgcggatattcttactgagacggttgaattgaggttttccgatgataaaaccagctcagtagccctttaa

SEQ ID NO: 50 - DNA, 186 bp, Bacillus licheniformis
atgggcagacgtcgaagcatcatgtcagaggaattcaaaaatgaattggctaaagatcttggattttacgatacggtaaagaccgagggctggggcggaattcgggccagagacgccggcaacatggtgaaaagggccatcgaattagccgaacagcatatggctcaaaatcagcaaaatcattaa

SEQ ID NO: 51 - DNA, 879 bp, Bacillus licheniformis
gtgaatggattgcgtattttagagaaggcgccggctaaaattaatttgtcgctcgacgttcgccacaaacgtccagatgggtatcatgaagtagagatggtcatgacgacgattgatttggcggatcgggtcgaattaacagagctggcagaagataaagtaacggtttcttcgcataaccgctttgttcccgacgatcagcgaaaccttgcttatcaggctgcaatgctcatgaaagaacgctacggcattaaaaaaggggtttccatttttattacgaaagtgattcccgttgctgcgggccttgcaggaggaagcagcgatgcggctgccgtcttcagaggattgaaccggctgtgggatttgaagctttcgatgaatgaactggctgagcttggcgctgagatcggatctgatgtctccttttgcgtacatggaggaacggctcttgcaacgggaaggggagagaaaatccgtcatatcgagactccgccgcactgctgggtagtgctggcaaagccgacgatcggcgtatcaactgcagaagtgtacaagcagctgaaagtcgacgagattgaacatccggatgttcaaggtatgattgctgcgattgaagagaagaattttcaaaaaatgtgtgacaagctcggcaatgtactcgaatctgttacattgaacatgcaccccgaagtcgcgatgatcaaaaatcaaatgaagcggttcggcgccgatgctgtgctgatgagcgggagcggccccactgtgttcggacttgttcaatacgaatcaaaagtgcaaagaatctataacggattaagagggttttgcgatcaggtttatgcggtgcggatgatcggagaacaaaatgaacttgattaa

SEQ ID NO: 52 - DNA, 834 bp, Bacillus licheniformis
atgaagtttcgtcgaagcggcagattggtggatctgacaaattatttgttgacccatccgcatgtcttagtgccattaaccttcttttcagaacggtatcaatctgctaaatcatccattagtgaagatttaaccatcattaagcagaccttcgagcagcagggaatcggaacgcttcagaccgtgccgggagcagccggcggcgttaaatacattccaaaggtaaaacgcgatgaagcggaggaatttgtaaagtcgctcggtgagtcattgatcgattcggaacggatattgcccggcggatatttgtatttaaccgatatccttggaaagccctctgtattaacgaaggccggcaaaatttttgcttccgctttttcagacagggagatcgatgtcgtgatgacggtggcgacaaaaggcattcctttggcatatgcggtagccagctaccttgatgtgccgacagtggtcgtcagaaaagacaataaggtaactgaagggtcaacggtcagcatcaactatgtgtccggatcatccaaccgcattcagacgatgtctcttgcaaaacgaagcttgcagacgggctcgcacgttttgatcatagacgactttatgaaagcgggaggaacgatcaacggcatgatcaatcttctcgatgaattcaatgcccatgtagcgggcatcggtgttcttgtggaagctcagggagtcaaggagcggctggtcgatgagtatatgtcccttttgactctttctgaaatcgatatgaaggaaaaaaaggtggaaatacaaaacggaaattttcagcgtttttttgcagaaaatgaatag

SEQ ID NO: 53 - DNA, 378 bp, Bacillus licheniformis
atgacaaaggttgttcagacaaaagaagcaccggcggcgatcggaccgtattcacaaggaattgttgtcaacaatatgttttacagttcggggcaaattccgctgaccccgtcgggtgaaatggtgactggagacatcacagaacagacgcaccaggttttccgcaatttaaaagccgtgctgaaagaagcgggcgcctctctggagactgtcgtcaaagcaaccgtgtttctggcggatatgaatcaattcacagaggtgaatgaagtttacggacagtacttcgatacccacaaaccggcgagatcatgcgttgaggtggcgaggctgccgaaagacgcgcttgttgaaatagaagtcatcgcattagtgaaatag

SEQ ID NO: 54 - DNA, 294 bp, Bacillus licheniformis
gtggaagttaccgacgtaagattacgccgcgtgaataccgatggtcgcatgagagcgattgcatccatcacgctggatcacgaatttgtagtgcatgatattcgtgtaattgatggaaacaatggtcttttcgttgcgatgccaagtaagcgtacacctgatggagaatttcgtgatatcgctcatccaatcaactcaagcacccgcggaaaaattcaggacgcggtgttaaatgaatatcatcgtttgggtgacgttgaggaaatagaatatgaagaaattggagcttcttaa

SEQ ID NO: 55 - DNA, 1371 bp, Bacillus licheniformis
atggataagcggtttgcagttgtgttagcagctggtcaaggaacaagaatgaaatcaaagctatataaagttcttcatcctgtttgcggaaaacctatggtcgagcatgttgtcgatgaagctcgcaagctatcattagaaaaacttgtcacaatagttggacatggtgcggaagatgtcaaaaaacagctcggggaaaaaagcgaatatgccctgcaggctgaacagctcggcacggcccatgccgtcaagcaggccaagtcgattcttggaagcgaaaaaggaacaacaatcgtcatctgcggagataccccgcttttaactgccgaaacgatggaagccatgctcacggagcatcagaaaaaagcagcaaaggtgacgattttaaccgctgtagcggaagatccgacaggctacggacgcattattcgcaatgaaaacggcgatgttgcaaagattgtcgaacacaaagatgcaacagaagaggaaaggcttgtcaaagaaatcaacacaggcacctactgttttgacaacgaagctctttttcaaacgatcgagcaggtttccaatgacaacgtacagggggaatattatcttccggatgtcattgagatcttgaaaaatcaaggtgaaactgtagccgcttatcagactgtcaacttccaggaaacgctcggagtcaatgacagagtcgccctatcacaagcggaaatctatatgaagcagcggatcaataaacgccacatgcagaacggcgtcagcttaatcgatcccgacaacacatacatttcaccggaagccgtgatcggcagggataccgtgatttatcccggcaccgtcattaaagggcgggttgttatcggtgaagacgcggtcatcggacagaacagcgaactggaaaacagtacggtcggcagcagaacggtcattaagcagtccgttatcgtggacagtgaagtcggcgacgatgttacaatcggaccgtttgctcatatcaggcccgactcaaagatcggcaatgaggtaaggatcgggaatttcgtcgaagtgaaaaaatcggaatttggtgatcgcagcaaagcatctcatttaagctacataggggacgcggaaatcggaacggatgtcaatctcggctgcgggtcgattaccgtaaattatgatgggaaacataagtttaaaacgaaaattgaaaatggggcatttatcggctgcaactccaatttggtcgctccggtgacaatcggcgaaggcgcatacgtagctgcgggttcaacgattaccgacgatgtgccaggccgggctttgtctattgccagagcaagacaagtcaataaggaagactacgctgagaacatacacaaaaaataa

SEQ ID NO: 56 - DNA, 951 bp, Bacillus licheniformis
atgtctaaatatgaagacgacaatttgaagattttttctttaaactcaaatccgggtcttgcgaaggaaatcgcggatatcgtcggagttgagctgggaaagagttctgttaaacgctttagcgacggtgaagtccaaattaacattgaagaaagcatccgcggctgcgactgctatgtcatccaatcgactagcgcgccggtgaacgagcatatcatggagcttttgatcatggtggatgcgctgaaacgcgcgtcggcgaaaacgattaatatcgtgatgccttactacggctatgcccgtcaggaccgtaaagcgcgttcccgcgagccgatcacagccaaactcgtggcaaatctgctggaaaccgccggagctacccgtgtgattgcacttgaccttcacgcgccgcaaatccaaggtttctttgatataccgatcgatcatttaatgggtgttccgattttaggaaattattttgaagagaaaaatttcaaggatatcgtgattgtgtcccctgaccacggcggtgtgacccgtgcccgcaaattggcggaccgcttgaaagcgccgattgcgattatcgacaaacgccgacctaagccgaatgtagccgaggttatgaatatcatcgggcatatcgaaggaaaaacagccattttaattgatgatattattgatactgcaggaacgattacgctggcggccaatgcgctcgttgaaagcggcgcagaggaagtgtatgcatgctgtacacatccggttctttccggtccggcgatcgaaagaatcgacaattccaaaattaaagagctcgttgtgaccaacagcattgagcttcctgaagaaaagaaaatcgcgaaattcaagcagctttctgtcgcaccgcttctggcagaagcaattattcgtgtgcatgagaaacaatctgtcagcttcctgttcgattaa

SEQ ID NO: 57 - DNA, 627 bp, Bacillus licheniformis
atggcaattttaaaagcggaagaaagaacggattccagacggtcttctttaagaagaattcggcaatccgggtatgtgccgggtgtcatttacggaagaaatctggagaacaaatccgttgcgttagacagtatcgagcttttaaaaatcttgcgcgctgagggcaaaaatacgattatcaacttggatataaacggtgaccaacactctgttatggtgactgagctgcagacggatccgttaaaagattcaatcgtacatgccgattttaaagtggttgatatggaagcggaaatggaggcgacggttcctgtaaaccttacgggtgaagcagagggcatcaaacagggcggtgttcttcagcagccgctttacgagctgtctgtcacagcaaagccgaagaacattccgcagacgatcgaggttgatatttccagtctcgaagtcaatgatgttctaaccgtcggcgatattccgaccaaaggcgattattcatacaaccatgagcctgatgaagttgttgcatccattcttcctcctcaaaagcaggaagaaacagaagccgaatcagctgctcaagacgttgaggaaccagaaaaaggcactgaagaggaaaaagaagaataa

SEQ ID NO: 58 - DNA, 567 bp, Bacillus licheniformis
atgcttgtgtttgcaggattgggcaatccgggtaaaacatatgaaaatacgagacacaatgtaggttttatgacgattgacgagctctcgaaagagtggaacattccgcttgataaaacaaagttcaacggacaatacggaatcgggtttgtttccggcaaaaaggttctacttgttaagccgcttacatatatgaatttatcgggagaatgtttgaggccgcttttggactattacgagatccctgttgacaatttgaaagtgatttacgatgatttggatcttccgaccggaagaatccgtctgaggacgaaaggaagcgcaggaggccataacggcatcaaatcgacgattcagcatctgggaacaagtgagtttaaccggatcagaatcggaataggccgtccggtaaacggcatgaaagtcgtcgattatgtgcttggcgcttttacagatgaagaagagccggcgataaaagaggccgtcagacaatcggccaaggcctgtgaagcttctttggaaaaaccttttttagaagtcatgaatgaatttaacgcaaaggtataa

SEQ ID NO: 59 - DNA, 231 bp, Bacillus licheniformis
atggctttacattattattgccggcattgcggcgttaaagtcggaagtcttgaccattcttatgtaaacagtgaacagttaggctttaaccacttaacaaatgatgaaagaaacgatatgatttcttatatggataatggggatttacacgtgaagacgatatgtgaagattgtcaagaagcgcttgagcgaaacccggattatcaccaatatcattcatttattcaatag

SEQ ID NO: 60 - DNA, 3534 bp, Bacillus licheniformis
ttgaacaatattcaatcctatataacaaaaagcgatgattttaaatccatcgtcaacggcttgaacgaagggctgaaggaacagctgcttgcggggctctccggatctgcccggtcgttatttacagccgctcttacaaaagaaacgagacggccggtatttttaattacgcataacctttatcaggctcaaaaaattacagatgatttaacagggctgataaaagatcagcctgtccttttatatcctgtcaacgaattgatttcttctgaaatagcggtggcaagccctgagctgcgctcgcaaaggcttgatgtcttaaataggcttgcaagcggtgaaacgcctatcgttgttgctccggcagcagccgtcagaagaatgctgcctcctgtcgaagtatggcaaaacagtcagattcacattgagacggggcgcgacattgacacggaacagctgctccagaagctcgttcaaatggggtatgagcgtacagatatggtggcggcgccaggcgaattcagcatacgcgggggcattatcgatgtctactctttgactgaagaaaatcctgtccggattgaattgtttgatacagaagttgactcgattcgtatattcaatacggatgatcagcgctcactggaaacgcgcgatgaagtaacgatcggccctgcgaaggaactgatcgtgcgggatgaagacaggcaaagggcgcttgaacaaatcgatcaaggccttgccaacagccttaaaaagctgaagctcgataaacaaaaggaaattctcgaccaaaatatcgcggaagacaaagagcggctcaaggaagggcatatcggccaggaaatggtcaaatacctttcttatttctatgagaagcctgctagtttactagattatttcccgaaaaataccttgcttatactagatgaaatcagccgtattcatgaaatggaagaccagctgcaaaaggaagaggcagaatggattacgagcctgcttgaagaagggaaaatccttcatgatacatcgatgtcatttccttttcacagcctcatttcaaaacagtcccgcccgattttgtattactcgctgtttttaaggcatgtgcagcacaccagtccgcaaaacatcgtcaatgtttcaagcaagcaaatgcagagctttcacggacaaatgaatgtgctcaaaaatgagatcgaacggtttaaaaaatcgaaatatacgacggtttttctcggagacagcaaagagcgcgtcgaaaaactagcatctgtactgtccgactatgacatcgaagccgcacaggccgaccaggatgcagcgctcgcccaaggccagatttacattatggaaggcggtcttcaatccggttttgagcttccgatgatcaagctggccgttatcacggaggaagagctgtttaaaaagcgtgtcaaaaagcaggcgcgcaaacaaaaactgaccaatgccgaacggattaaaagctactcggagcttcagatcggcgattatgtcgttcatgtaaaccacggtatcggaaagtatttagggattgaaacgttggagatcaacggcattcataaggactacctgaatattcactaccagggaagcgacaagctttacgtaccggttgaccaaattgatcaggtgcaaaaatacgtcggttccgaaggtaaagagccgaagctttataaactcgggggaagcgaatggaaacgggttaagaaaaaggttgaaagctctgttcaggatatcgccgatgacttgatcaagctctatgccgaaagagaagcaagcaaaggctacgcgttttcacccgaccatgaaatgcagcgtgaatttgaagccgcatttccttatcaggagacagaggatcagctgagatcgatccatgagattaaaagagacatggaaaaagaaagaccgatggaccggctcctttgcggcgatgtgggctacggcaaaaccgaagtggcgatccgcgccgcttttaaggcgattgcagacggaaaacaggtcgcgatccttgtgccgactacgatcctagcacagcagcactatgaaacgatattggagcgctttcaggactacccgattaatatcggtttgctcagccggttccggacgagaaaagaagcaaatgaaacgatcaagggcttgaaaaacggaacggtagacatcgtgatcggcactcacaggctgttgtccaaggatgtcgtatacaaagatcttggtctgcttatcatcgatgaagaacaaaggttcggtgtcacacataaggaaaaaattaaacgcattaaagcgaatgtcgacgttttgacgttaacggcaactccgatacctcgaacccttcatatgtccatgcttggtgtcagagatttgtcagtcattgaaacgcctccggaaaaccgcttcccggtacagacgtacgttgtcgaatacaacggggccttggtcagggaagcgatagaacgcgagctggccagaggcggtcaggtttacttcctgtacaaccgggtggaggatattgaaagaaaagcagaagaaatctcgatgcttgtacctgacgccaaggtgacgtacgcccatggaaagatgacagaaaacgaactcgaatcggtcatgctgaacttcttagagggagaatcggatgtactagtcagcacgacgattattgagacgggcgttgatattccaaacgtcaatactttgatcgtatttgacgcagacaagatggggctttcccagctgtaccagctgaggggccgcgtcggccgctcaaaccgtgtagcttacgcttattttacgtaccggaaggacaaagtcctaacggaagtggctgaaaaaaggcttcaggcgattaaagaatttacagaactcgggtcaggatttaaaatcgcgatgcgcgatttgacgatccgcggcgccggaaaccttttaggtgcgcagcagcacgggttcatcgattctgtcggtttcgatttatattcgcaaatgctcaaggaagcaatagaggcgcgcaagggagatgcaccgcaagctgaaaagtttgagccggaaatcgatttggagcttgacgcatatattccgcagacgtatgtgacagacggcaagcaaaaaatagatatgtataaacggtttagagcgatttcaaccattgaagaaaagagcgagcttcaagacgagatgatcgaccgcttcggcgaatatccgaaagaagtagaatatttattcgccatcgctgaggcgaaggtatatgccatcaaggaacgcgtcgagctgatcaaacaggataaagacgccgtcagactgacaattgacgaaaaagctagtgccgaaattgacggtcaaaaactgtttgaactcggcagcaagtacggcagacagatcggccttggaatggaagggaagaaattgaaaatctcgattcaagtgaaaaaccgaaaaccggaggaatggctggaaacgcttctcgacatattgaagggccttcaaaacgttaaaaagcaaacgatcgcttcatcataa

SEQ ID NO: 61 - DNA, 537 bp, Bacillus licheniformis
atgaaagcaactggtatcgtacgtcgaattgatgatttaggccgggtcgtgatcccgaaggaaatccgcagaactttgcgcattcgtgaaggagaccctttggaaatatttgtggaccgggatggggaggttattttaaaaaagtattctccgatcagcgagctcggcgactttgcaaaagagtatgcagatgcgctttatgacagcatgggccattccgtgctgatttgcgaccgggatgtgtatatcgcagtatccggggggtctaaaaaagactatttaaacaaatcgatcagcgacatggtcgaaaaggcgatggatcagcgcacttctgttttggacggagacgcgaagacgattcagcttattgatggtattgacgaagaggttgcttcttataccgtcggcccgattgttgcaaacggcgacccgatcggagcggttgtcattttttcaaaagaccagtcaatcggcgaagtggaacataaagcggttgaaactgccgccggctttttggcccggcaaatggaacaatag

SEQ ID NO: 62 - DNA, 1593 bp, Bacillus licheniformis
atggggtttttaaagggccaaagacaattgctttggcaaggcgcctttgtactttcattggcggggatattatcaaagatattaagcgctgtatatagagtgccttttcaaaatatagttggagatgtcggtttttatatttttcagcaggtgtacccgatgatcggaatatctgtcatgcttgccacctccgggttcccggtcatcatttcaaagttgctgaatgattacgggtccgcaaaccgggcaaagattctccgcgtgtctatgctttttttatcggcagtcggccttggcttttttcttctcttgtttgccggagccggagccatcgcagggtttatgggcgatcccgaccttgccggggtgatccgcgccgtgtcgttttcttatttgctgctaccgttcgtatctttgttgagaggctattttcaaggaagcgaacggatgctgccgaccgcactttctcaaattggagaacagacactccgggtcggggcgattcttgttttgacatggtggctcgtcaaaagcggcttttccttatatgacgccggtgcaggggcggcctttggctcccttgtcggcggccttgcggcgtttttcattctcgccgtgttttgggccaagcgtgaaaagaaagccactgccgcccggatggaggccggtacgggtgatattttgaaacagctgtgtctgtattcggttacgatttgtaccgccggcctcatgctgattctcatccagctcgtcgacgcattgcacttgtattcattgctggccggacaaggaatgggcgaacttcaggcgaaacatacaaaaggagtgtatgacagggggcagccgcttttgcagctgggaaccgtttttgctgcgagcattgcgacggctcttgtcccgtcccttacgaaagcgaagaaaaagggagaaactgcagtgctggaggaaaagatccggtattcgctaaaaatgagctttgtcatcggcactggagcagccgccggtctgatttgtattttggagccggtcaatgtcatgctgtttaaaaacagcgatggaacggctgcgctccaaattttcagcgcgtcgattctctttgcatcgctggcgatgacgatgaccgctgttttgcaaggactcggcaatacatgtcttccggctgtttccgtctgctgcggctttttggtgaaagccgtattgaacgagctcctgatccccggtttcggcatttccggcgccgcttttgcgactatgatgtcattcgccgctgttgcggggctcaatttttttcagctgaaaagaaaaggctggattaagctgtcggaatacaggatagcgggtgttttgttgtcggctgtgatcatgtcggccgctctggcggtgtggctttttgcatttgaagcggccataccacataaaagcagatggatctcagcggcggaaagtcttagcgccgttttcgtcggcggcgttgtctttttgtccggtatcttcacattgcgcgtgttttcagaaaaagaacttgagcttgtgccttttggcagcaagctcctgacattaaaacgagaaaggggcggcaggcatggccggtaa

SEQ ID NO: 63 - DNA, 1470 bp, Bacillus licheniformis
atggccggtaaaatcacggtagtcggccttggggcaggcgatatgaatcaattaaccctcggtgtatataaacggctcacacaagcggaggttctttatgtcaggacgaaagaccatccattaatagaagacctgaaaaaagaaatagcggagattcatttttttgatgaggtctatgaaaagcatgatcaattcgaagatgtttacgaggagatcgtagagcggctttttgaggaggcgaagcagggggatgtgctctatgccgttccaggccatccgttcgtcgctgaaaaaacggtccagcttttgcttgagaggcgtggggctcatcaggccgatgtcgtcgtcgagggaggccacagctttattgatgcgacgttaaatgctttgcagatcgatccgattgacgggtttcagtttgtcgatgccgtccggttttcagccgacgaagtcgagctccgtcatcatttgattatttgccaggtatatgatcaaatgacggcttcagaggtcaaactgacgttaatggaaaagcttcctgatgactatgaagtcgtcattgtaacagcggccggaagcagcatgcaagacattcggacagtgcctctttacgaattggacagaagcgtgggcatcaataatttaacgagcgtctatgtgccgcctgtcaaagacgaagagattctccaccaggaattttcgatgttccgcagtgtcatcagaaagctgcgcggaccggacggttgcccttgggaccgaaaacaaacccatgagtcgctcaaaaagtacttaatcgaggaatgctatgaggtgctagaggcgattgatgaagaagatcccgaccacttagtagaggagcttggcgatgtgatgctccaagttcttctgcatgcgcagatcggcgaggatgacggcctttttacaattgacgatgtgattcgcggcatcaccgcaaaaatgatcagaaggcatccgcacgtcttcggagaggtctctgttcgtgatgaggccgacgtcatggtaaactgggaagagatcaagaagcaggagaaacaagcggacgataaatccctcctcgacgatattccaaagccgcttcctgctttgtcaaaagcgaacaagcttcagaaaaaggcggcaaagaccgggttcgactggtcgaatgtccaggatatttgggataaagtccaggaggaaatgaaagaattttcttcagaaatttccgaagccgaacagcacagcaaaaaaatgaaagaagagttcggcgaccttttattcgcgctcgtcaatatcggccggttttataaaattgaaccggaagaagccctcgcgatgacaaacgccaagttttacagaaggttcacatatattgaacaatctgcaaagcgcatgggcaaggatctggaaagtatgacgcttgaagaaatggacgaactgtggaatgaagcgaaaggcattgaaaggagctga

SEQ ID NO: 64 - DNA, 264 bp, Bacillus licheniformis
atgagactcgacaaatttctcaaagtatcaaggctgattaaaagacggacgcttgcaaaagaagtggctgaccagggaagaatttcgatcaatggccagcaggccaaagcaagctctgttgtcaaagcgggggacgagcttgcggtgcgtttcggccaaaaacttgtaaccgtcaaagtcaatgaattgaaggatacgacaaaaaaagaagaagccgctgatatgtataccgttctcaaagaggagaagctgggaggagaatag

SEQ ID NO: 65 - DNA, 309 bp, Bacillus licheniformis
atgaatgtatattatgatcagcacaacccttccggcggggcatctggtcctgaacataatgtgacgatgaagggccgcaagcttctggatatatccggtgtcaagcaggtcgagagctttgacaacgaggaatttttacttgagacggtaatgggcatgcttgcagtcagaggcgaaaacctgcagatgaagaatctcgatgtggaaaaaggcgttgtctccatcaagggaagagtgcttgatctcgtctatttggatgagcagcagggggagaaagctaaaggattttttagcaagttgtttaaatga

SEQ ID NO: 66 - DNA, 627 bp, Bacillus licheniformis
atgacgctgaccacacagttctatacgatgctggccatggccggaatgggggcatggcttggcgcttcccttgacacctatacccgttttgtcgttcgctcgaaaacagcaaggtggctgttgtttctccatgactttttgttttgggtagtacaaggcctcctttttttctatgttttgctgagcgtgaatgaaggggaattccgaatttatatctttctggcggtcatgcttggttttgccgcttatcagagcctttttaagcaggtctatatcaagcttttggaatggatgatttccttttttatattcatctccaggctggtctcaaagatgatgcggatgatggtgtttcggcctgttgtatggacgtttcaagccattttagccatcattctctttacaatgagaaatatctatgttctttttcgtttttttgcggtatgtttatataagatattaaaatttgcaggatacccgatttattttatactatatcaatgctgcaggcttcttcccgccccggttcggggattgttgagacgctttttgcaaaaaggagcaggatttttcgaaaaggggaagaaactattcataacaattaaggcaaaacttttaaaaaaatga

SEQ ID NO: 67 - DNA, 378 bp, Bacillus licheniformis
atgaatgatcctacaagacgcaacatatcgcaaatacagaacgaatacaaagagcagatggagcgaaaacagcagcagctgaaaagaaaaagacgcggtctatacagacggttgatggttttcggcgccgttgtgctgctgtcggcgattgtgattgtcagctcgctctggtcgcagacttcggatatcagcgcgaagcaagagaagaaagctgagcttttgaaacaattggaacagctggaagcaaaaaaatcggatttgaaagatgagattgtgaaattaaaggacgaggactacgttgcagagcttgccagaaaggattactacctctcaaaggatggcgaaatcatcttcaagtttgaagataagagcaagtag

SEQ ID NO: 68 - DNA, 399 bp, Bacillus licheniformis
atgtcgattgaagttggcagcaagttgcaagggaaagtaacaggtattacaaatttcggagcgtttgttgaactgcctggaggatcaacaggtcttgttcatatcagcgaagtagccgataactacgtgaaggacattaatgatcatctgaaggtcggtgatcaagtagaagttaaagttattaatgttgagaaagatgggaaaatcggcttatcgatcaaaaaggctgtagaccgtcctcaatcatcaagacctgcgagacctaaaaatgatttccgctctaaagaaacgtttgaacagaaaatgaataagtttttaaaagacagtgaagatcgcttatcgtctctaaaacgcaacacggaatcaaaacgtggagggcgcggagcaagaagaggttaa

SEQ ID NO: 69 - DNA, 2490 bp, Bacillus licheniformis
atggaaaaagcggaaagaagagtgaacagcccaatagctggacctgctgttcaaaaattgtattcatggtttggcagcatgacgaagcttatgatgcagcatttatattccctctttttttataaagggctgatctatatggtcatcggttttttattgggacgagccttcattctgtcagaggtcattccctttgctcttccatttttcggagcgatgcttttaatcaaaaaagataaagctttccttgcatgcctggcgcttcttgccggagctctgagcatatcgcctcagcattcgctgttcgtgcttgcggctctgtttgcatttgcgatatgttcaaaaatgacgtcccttattataaaagaccgtgtcagaacgctgcctgtcgtcgtctttttggcgatggctgtgacaagatgcggattcgtatatgccgaatacggaacggtttcaggttatcactatattatggctttcgttgaagccggattatcgtttatcctcacattgatttttctgcaaagcctgccgattgtcacatcaaagcgggcgaaacagtcgctgaaaattgaagagatcatttgttttatgattttaatcgcttccgttctcacgggcttgacaggcgtttcatttcaaggcatgcaggctgaactgatattggcccgttatgtcgtgctcgctttcgcgttcatcggaggcgcaagcatcggctgtacagtcggggttgtgaccgggctgattctcagcctctcaaacatcggcaatttatatcagatgagcctgctggctttctcaggccttctcggcggtttgctaaaagaaggaaaaaagttcggcgcagcggtcggcttattgattggatctctattgatttctctgtacggagaaggttcggctgaattagtgccgacgctttatgaatctctgattgcaatcggcctgttccttttaacccctcagtcgattacgaaaaaagtggccaagtatatacctggaacgactgagcacgcccaggaacagcagcagtatgcaaggaaaatccgcgatgtcaccgcccaaaaagtcgatcagttttcgaacgtttttcacgctttatccgaaagcttcgctaccttttatcattcagctccggacgatgaaggaaaagaaaaagagatcgatctgtttttgagcacggtgacagaacattcctgtcagtcatgctataagaaaaacaagtgctgggttcagaactttgataaaacatatgatttgatgaaacgggttatgcaggaaacggaagaaaagcaatattttaaaaaccgcaagctgaaaaaggagtttcatcagcactgctccaaatcaaagcaagtagaagcgctgattgaagacgagctgactcattttagggcgaaccagacattaaaacaaaaggtgcatgacagcagacgtctcgttgcagagcagcttctcggcgtttctcaggttatggcggacttttctcgggaaataaaaagggaaagggagcagcattttattcaagaagagcaaattcgggatgcgctgcagcacttcggcatcgagattcagcaagtcgaaatatacagccttgagcagggaaacatcgatattgaaatgagtatcccgtattgcaacggccatggagagtgtgaaaaaatcatcgctccgatgctgtccgatattttggaagaacaaattatcgtcaaagcagaacagtgcgccggccatccgaatggatattgtcatgttgccttcggttcggcgaagtcatacagggtggtgacaggagccgcgcatgcagcaaaaggcggagggcttgtctccggcgacagctacaatatgatggagctcggcaccggcaaatatgccgccgccattagcgatggtatgggaaatggcgcaagggcccattttgaaagcaatgagacgatcaagctgctggaaaagattcttcagtcgggcatcgacgaaaaagtggcgattaaaacgattaacagcattctttcattaaggacaacagatgaaatttattcgacattggatttatcggtcatcgatcttcaggatgcgagctgcaagtttttgaaaatcggctccaccccgagctttattaaaagaggcgatcaaattataaaagtgcaggccagcaatctgccgatcggcatcattacagaattcgatgtcgatgttgtcagcgagcaattaaaagcgggagaccttttgatcatgatgagcgacggaatctttgaagggccgagacatgtggaaaatcatgatctgtggatgaagcgcaaattgaaatcgctgaaaaccgaggagccgcaggaaatcgccgacttaatcatggaagaagtgatccggacaaggtcgggtctgattgaggacgacatgacggtgattgtcatcaagctggaccataatacgccaaagtgggcctccattccggcgccggcttttttccaaaagaatcaagagatttcttag

SEQ ID NO: 70 - DNA, 738 bp, Bacillus licheniformis
atgaaaaaggggcatttgaatcaaatcctgcttttgacggacggctgttcaaaccgcggcgaagacccgcaggccatggctgcctttgcgaaagagcagggaattaccgtgaatgtgattgggattatggacgagcatgaaatggatcaggaggcgatgaaagaagtcgaagggatcgctctcgcaggcggaggagttcaccaggtggtttacacgtcgcagctgtcgcagaccgttcaaatggtgacaaaaaaggcgatgacgcaaacccttcaaggcgtggtcaacagtgagctcaaacaaattctcggcaagcataccgaaatggatgaactgcctcctgataaacgcggtgaagtcatggaagtcgttgacgagcttggtgagaccgtgcatcttcatgtactggttcttgtcgatacaagcgcaagcatgaatccgaagcttccgaccgttaaagaagcgttgatagatctttccatcagtctcaattcaagaatcggcgaaaacgaatttgcgatgcttatatttcccgggaaaaaacaagaggtcgaacttgtgctcgattggaccccgaagtttgaatctctttcttcaatattttccaagctttcagccggtggcattacaccgacaggacccgcaatacgagaggcgattcagcattttaacaaaatcggctcaagaaggagaatgttagaagacgatgaaaaacgcttcgacgagtttggcggctag

SEQ ID NO: 71 - DNA, 1035 bp, Bacillus licheniformis
atgaaaaacgcttcgacgagtttggcggctagtctaaagccgggtgcagccgttgttggaaagtggaacaatcattcctacaagatcatcagacagcttggaaaaggggcaaatggggttgtttatctggccgattcaagaaagggccgggttgcattaaaagtgagcgatgacagcctgtccattacctcggaagtgaatgttctgaaatctttctcaaaggcccaggcaaaagcaatggggccttctttttttgatgtggatgacatgatggttacaggcaccggcaaaaaactttcattttatgtcatggaatatattgaaggtccgcttcttttaagatatgtaaacgaaaaaggcgaggaatggactccggtgctgatcagccagcttctctcaagcctgtcggcgattcatcgcgaaggatgggtgtttggagatttaaagcccgagaatttaatcgtgacgggtcctccgccgcaaatccgctgcattgatgtgggcgggacgacaaaagagggccgggcaattaaggaatatacggagttttttgacagaggctattgggaattcggcactcgtaaggctgagccgtcgtatgacctgttttcagtcgccatgattatggtgaactgtgcggtgaaaaaagaattcaagaagacagcaaggcctcaggagcagctcatgtcagtcattgacggacatccgtttttaaaacggtataaaccggttcttgcttctgctttaaaaggaagctatcgaacagctgatgaaatgaagggagatcttctggaaatcggccggccgccacgaatgcaaagcagccgccagtcgagaacagcccgttcctcatcggcatctgccccgtcgcaaggcctgcggcataagcgggggacgcctcagcagcaaaggttaaggagcgggcgcagaaagcaaagaaacccttctaaatccggcggtgtttttgaaacgctgttgatcgtcgtaagcgttcttgccctttactttgcgtatatcgttctcttttttatttag

SEQ ID NO: 72 - DNA, 1431 bp, Bacillus licheniformis
gtgaaaagtattgaagatttcatgaaaaaatacgaactgtcatttgatggagtgacgctgattgcaggtgtctccggcggacctgattcgatggcgcttttgcatgctctgcaccatacggttcccgcttctgcaacgctgattgccgcacacgtcgatcatatgttcagaggcgaagagtccgagcgtgatatgcggttcgttcaggactactgcgaggcggaaggcatacaatgcgaggcggtgcaaatcgatgtcctggcatttgccgctgaaaacaatctgaataaacaggctgctgcgagagaatgccggtatgcgttttttcaagagttaatgaaaaggcaccgggccgaatacctggttctgggtcatcatggagatgatcaggtggagacgatgctgatgaagatggcaaaaggcactgtcggaatcgggcttgccggaattcagccaaagcgccgttttgacagcggctggctgctcaggccgtttctgaagctgtcaaaggatgatcttttggcttactgcaaagagaatcgaataccgtttagaaccgatccgagcaacagtgaggatgattacaccaggaaccggttcaggcaccatgttctcccttttctgaagaaagagtcggaagatgtccataaaaggtttcaatccgtcagtgaattcctgacagaagacgaattatacttacaggcattaacgaaagacaaaatgaatacagtaatcacaagcaagtcaagttcaggcgtggaaatcagcatcgaacgacttcttgcgctccctatgcctttacaaagaaggggagttcatctaatattaaactatctttatgaaaacgttccatcagcgttttcagcccatcatattcaagtgtttctggattggatttcacaagacggaccatccggttcccttgattttccgaatgggttaaaagtcgcaaaatcttatcatacatgtttgtttacatttcagcgtttacaatgtgaaaatgtttcctatcattatgaaataagcggggcaggcgaagaagaactgatacttcccggcggctcctcccttcatgtgagcggacccggttcaacccggaagctgcaaggaaatgatgtttttgcaacaagtcccaagcaggttcagtttcccctttacgtacggacaaggcaaaacggagaccgagtcaaacttaaagggatgaacggctcaaaaaaggttaaagatatatttattgatgaaaaagtgcctctttcaaaaagagacagctggcccattgtaacagacgcggttggaaacattatctggatacctggtctgaaaaaaaccatttttgaggaacttgatgttacaaacaacgatcgcattgtattacaatatagacagcatgaaaagtgtagggggctagcaaagaatgaaacaggatattga

SEQ ID NO: 73 - DNA, 540 bp, Bacillus licheniformis
atgaaacaggatattgaaaatatcttgatctcggaagaagagatccaaaagaaagtcaaggagctgggcgcgactctgacagaagagtacagcggcaagtttccgctggcaatcggtgtgttaaaaggagccatgccgtttatggctgatcttttaaagcatattgatacatatctggaaatggatttcatggatgtatcaagctacggcagttccacggtttcttccggagaggtgaaaatcataaaggatttggacacatctgtagagggccgtgacatcttaattattgaggatatcatcgacagtgggctgaccttgagttatcttgtagagcttttccgataccgcaaagcaaaatcgattaagatcgtaacccttcttgataaaccaagcggacgaaaagcggatatcaaagcggattacgtcggctttgaagttcccgatgctttcgttgtcggatacggtctcgattatgctgaacgctatcgtaatcttccgtacatcggagtgctgaaacctgcggtttatgagagctga

SEQ ID NO: 74 - DNA, 1920 bp, Bacillus licheniformis
atgaatcgggtcttccgtaataccattttttatttacttattttattagttgtgatcggagttgtgagctacttccaaaccgcaaatccgaaaacagaaaatatgacgtatagtgactttgtttcaaacctagaaaacgggaaggttgaaaatgtctccatccagcctgtcaggggtgtgtacgaggttcgggggcagctgacgacctatgaaaaagatcagtatttcctgacccatgttcctgaaggaaaaggggcagatcaaatcattgatcaagtgaaaaaaacgaagatacaaatagaacctgcgcaagaagcaaatggatggatgacgttctttaccaccatcatcccttttgttattatcttcattcttttcttcttcctgcttaatcaggctcaaggcggcggcagccgtgttatgaactttggaaaaagcaaggcgaagctctatacagaagaaaagaaacgcgtcaaattcaaagatgtggcaggagcggatgaagaaaagcaagagcttgtggaagtcgttgatttcctcaaggatccccgcaaatttgccgagctcggtgcaagaattccgaaaggcgtgcttttggtcggacctccgggtaccggtaaaacattgctggcgaaagcatgtgccggtgaagcaggggtgcctttcttcagcatcagcggatctgacttcgttgaaatgttcgtcggggttggtgcatcacgtgttcgcgacttgtttgaaaacgccaagaaaaatgcgccgtgtctgattttcatcgatgagattgatgctgtcggacgccagcggggagcaggccttggcggaggtcacgatgaacgtgaacagacgctcaaccagcttcttgttgaaatggacggattcagcgccaatgaaggaatcatcatcatcgctgcgacaaaccgcgccgatattttagaccctgcattgctgcgcccgggacgttttgaccgtcaaattactgttgaccgcccggatgtcaaaggccgtgaagctgtacttcaagtacacgcaagaaacaagcctcttgatgaatccgtaaacctaaaagcgatcgcgatgcggacgccagggttctcgggtgcagaccttgaaaaccttttaaatgaagcggctcttgtggcggcgcgtcaagataagaaaaagatcgatatgcgagacatcgatgaagcgacagaccgcgtcatcgccggacctgcaaagaaaagcagggtgatctcgaaaaaagaacgcaatatcgtggcttatcacgaggcgggacacaccgttatcggacttgtcttggatgaggcggatatggtgcataaagtaacgattgtaccgcgcggccaagcaggcggatatgccgtcatgcttcctaaggaagaccgttatttccaaaccaaacccgaacttctcgataagattgtcggcttgcttggaggccgtgtagctgaggaaatcatcttcggcgaggtcagcacgggcgcccataatgacttccagcgcgctacaggcattgccagacgaatggtaaccgaattcggtatgtctgaaaagctcggtcctcttcaattcggacaatcgcaaggcgggcaagtattcttgggtcgagatttcaacaatgaccaaaactacagcgacgcgattgcgtatgaaatcgataaagaaatccagcgcttcattaaggaatgttatgaacgtgcaaaaacaatccttactgaaaatcgcgacaaacttgagctgatcgctcaaacattgctggaagttgaaacgctcgacgctgagcaaatcaagcatttgtctgagcacggaagacttcctgatcgaacatactctgatgatcaggagaagacagatgatgtgaaagtcaacatcaataaacgagatgacgaagagaaaaacgaggatgaaaaagagtaa

SEQ ID NO: 75 - DNA, 789 bp, Bacillus licheniformis
gtggtgatcagaatgttgcttgttatagatgtaggaaatacaaacaccgtccttggcatctaccacgaaggagagcttgaatatcattggcggattgagacaagccgccataaaacggaagacgaattcggcatgcttcttcgttctttatttgattatgtcggactgatgtttgaccagatcgaggggattattatttcatcagttgtaccaccgatcatgttctccctcgaaagaatgtgtatcaaatattttcagatcgagcctcagattgtcggtccgggaatgaaaacaggattaaacataaaatacgataatccgaaagaagtcggagcagaccgcattgtaaacgcagtagccgctattcatctctatggcagccccttgattgtcgttgattttggaaccgctacgacgtactgttacattaatgagcgcaaggaatatatgggtggtgcgatcgcgccgggcatcacgatttcaactgaagcgctttattcaagagctgccaagcttcccagaattgaaattgcacggcctgatcatatagtcggcaaaagtacggtcagcgcgatgcagtccggaattctttacggctatgtcggacaggttgaaggcattgtcaaacggatgaaatggcagtccaagaaaaatccgaaagtcatagcgacgggcggccttgcttccttgattgcagacgaatcggactgcatcgatattgttgacccgttccttacgttgaaggggctagagctcatttatgaacggaatcgtgttgaaagtgtatag

SEQ ID NO: 76 - DNA, 870 bp, Bacillus licheniformis
atggattatttagtgaaagccattgcatatgacggcaaagtgagggcatatgcagcgaatacaacagaaacgattcatgaagcccaaagaaggcataacacatggcctaccgcttccgccgctttaggaagaacgatgacggcggctgtcatgctcggcgccatgctgaaaggcgaagacaagctcaccgttaagattgaaggaggcggaccgatcggcgcgattgtcgctgacggaaatgcaaaaggagacgtcaggggatacgtgtccaatccgcacgttcatttcgacttaaatgaacacggcaaacttgacgtcagaagagccgtcggtacgtcaggaacgctaagcgtagtaaaagatctcggtctccgcgatttatttacaggccaggttgagatcgtttccggagaaatcggcgaggattttacttattatctcgtgtcctctgaacaggttccttcttcggtgggtgtaggggtgctcgtcaaccccgacaatacgattttagctgcaggcggatttatcctgcagctgctgccgggaacggacgacgaaaccatcacgaagcttgaaacaaacctttcacaagtggagccaatttcaaagctgattcagaaaggtttgacacctgaggaagtgctggctgcggtattgggagaagaaccggaagtactggaaaccgttcctgtccgatttacatgcaattgttcaaaagaacgtttcgcaagaggcatcatcggtcttggcaaggatgaaattcaacagatgattgatgaagatggccaagccgaggctcaatgccatttttgcaatgaaacgtatctgtttacaaaggaagagcttgaagcgcttcgagatgaaatataa

SEQ ID NO: 77 - DNA, 888 bp, Bacillus licheniformis
ttgaaatcgagaacactttggccgattattttaggtgcgatcttcgtcaattgcattgtgatcgcgtatgttctgacgaaagcgcagaccgcttcttcatcgtcagctcaagaagtcattgcccatatcggaaaaaacggcatcacgcgtgaagaatggctgagcgaaatggaagagcgctacggaaaatcaacccttgaagatatgatcaacgaccgcgtagttacccaaatgccgaaaaaaacaagatcaaagtgtctgatgatgcatgaaagagaatttctgctgattaaagctgtatacaattccttctccgaagacgaaaacacaacagaaaaagaatggaaagagcagatcaagcataatattcttcttgaagagctcctgacaaaagacattgtcatttctgacagcgaattgaagtcattctataacaaaaataaggacttatataaattcgatgattcttatcgcctcaagcatatcgttgtcaaagataaagatgaagcagaacaagttcttaaagaactgaaggaagggtccagttttgaagcggccgcagccgaacactcgactgaccggtatacggctccttacggcggcgacctcggtttcgtcaatgatcagcatgaaaacgttccggccgaatatttggagaaagctgaacaactaaaggaaaatcaatgggtggatgaaccgattaaaacaagccagggctatgcgattatccagctcaaagaaaagctcccggggcaagctttcacttacagcgaagtgaaaaatcaaatcagaaggcagatcgcgatggatcaattaggcgacaaagcttctgtcaagacgctctggaaagatgcgaaactgtcttggttttatgacgataaaaaataa

SEQ ID NO: 78 - DNA, 921 bp, Bacillus licheniformis
atggttcgcgttgcaaactctgtttatgacttaatcggaaatacacctgtcgttaaattaaatcgactagttgatgaagacagtgctgaagtatatgtgaaactggagtatatgaaccctggaagcagcgtaaaagaccggattgcgcttgctatgatagaagacgctgaagagaaaggccttctgaaagaaggagatacactgattgaaccgacaagcggaaatacaggaatcggacttgccatggtcgctgcagcgaaaggcatcaaagcgattcttgttatgcctgatacaatgagttctgagcgccgcaaccttctgcgtgcatatggagctgagcttgtgctgactccaggtgctgagggaatgaaaggcgcgattaaaaaagcggaagaactggctgaggaacacggctattttatgcctcagcaatttaacaatcctgcgaacgcagaagttcaccgccgcacgacgggaaaagaaatcgctgaacaattcggagacggtttagatgctttcattgcaggtatcggaaccggcggaacgataacgggtgccggagaagttctgaaagaaaaaaatccgtccatcaagattttcgcggtggaaccgactgattctcctgttctttccggaggaaaaccagggccgcacaaaattcagggaatcggagcgggattcgttccgaaaatcttgaatacggaaatttacgatgaaatcatcacagtgaaaaacgaagaagcctttgaatttgcccgtaagcggcgagagaggaaggaattctcggaggatttcttcaggcgcagccatctgtgctgctcttcagttgctaaaaagcttggaaaaggcaaaaaagttctcgctgtgcttcctagtaacggagagagatacttaagcacgcctctttaccaatttgaatag

SEQ ID NO: 79 - DNA, 1431 bp, Bacillus licheniformis
atgagacaacgaaggcctgtagccagagcgttcccattttccaatcaacagtttttgcagcaatatgaaagcctatcgaaaggaaaagaataccacgttctgctggaaagcgcgagaggcggagaatacagcatagccggactcgaccctgtcgcaatagcgaaagggaaagacggtatcacgacgattcaatataaaggggacgtcatattcaaagagggggatccgtttctgcagttttctcaatggtttgaaacgctgaaaacggagacagttgcagattttcccgactttcagggcggggctgtcggttttcttagctatgactatgcccggtatattgagaaattcaaaatcctgtctattgatgatctgcaaacgccggatttattctttctcgtatttgatgatatagccgtctatgaccatgagcagcagcagctttgggtgattacccacactgatgaagaaacgccggccgctgcggaagagaaattggacaggcttgagcaaatgtggaagacggaacatccgaaggccgctggaggtcatcagccgaatgataacaaaggcccggcattcgcggcctcatttacagaagccggcttttctcaggctgttgagaaagtgaagcaatacatcgcaagcggtgacgtatttcaggtgaatctttctgttcgccagtcggagcgcctttctgcgcctccttatgaggtgtataagatgttaagagaaatcaacccttcgccgtacatggcctacttggaaaccccggattttcaaatcatctgcgggtcgcctgaactgctcattaagaaaaagggcaccaggcttgaaacaaggccgattgccggaacgcgatcccgcggggcggatgaagcggaggatgaagcgctcgcgaacgaattgatcatgaatgaaaaagagcgcgccgaacatgtgatgctcgttgatttagagcgtaatgacctcggcagggtctccaagtacggttcggtccgggtcgatgaattcatggtgattgagaagtattcccacgtcatgcatattgtctcaaatgtgtgcggtgaactaagggatgaatgcgatgccgttgatgtcatccatgccgtgtttcccggaggtacgatcaccggagcgccgaaagtcagaacgatggaaattattgaggagcttgagccaacgagacgggggctttatactggttctatagggtggttcggatataatcaggatatgcactttaatatcgtcatccgaacgatttatgtgaaagcgggccaggcgttcatgcagtcgggagcgggaatcgtcatcgattcaaatcctaggcatgaatataaagagtcaattaaaaaggccctggcgatgaaaaaggcgctgcagttgagtgaagaagagaaaaaagagcagaggagagctgagatatga

SEQ ID NO: 80 - DNA, 585 bp, Bacillus licheniformis
atgattctaatgatcgacaattacgattcgtttacgtacaacttggttcagtatttaggcgagcttggcgaggagttggtcgtcaagcggaacgatgagatcacccttcaggaaatagaggacatgtcgcctgactttttgatgatttctcccgggccttgcagtccggatgaggccgggatcagccttgaagcgatccgccattttgccgggaagataccgattttcggggtttgcctcggacaccagtcgatcgcccaggttttcggcggcgatgtcgtcagggcagagcggctaatgcatgggaaaacttccgagatttcgcacgacgggctgacggtttttaaaggcctggaacatccgctcacggccacgaggtatcattctttgatcgtcaaaccggatacactgcccgattgttttgagacatcggcttggacggaagaaggggagattatggccatcaggcataaagaactgccggttgaaggcgttcagttccatccagagtcgattatgaccgcttacggaaaagagatgctgaagaattttattgagacttaccgaaagaaagtgaacgcatga

SEQ ID NO: 81 - DNA, 861 bp, Bacillus licheniformis
atgatcatttacctgaacggtcaatatgtaaaggaggaggaagcaagactttctccttttgaccatggttttttatacggagtcggggtattcgaaacgttccggctttatgaagggaagcccttccttttagactggcatatggacagattgaacaacgctttggaacagctgaaaattgagcttgagctgacaaaaagcgaagtgcttgtcattcttgacaggctgcttcagttgaatcagccgcagaatctggatgcgagggtccggctaaatatatccgccggtcccggcggccccggcctttttcctgattcatacaaaaatcccggcgtcatggtgatgatgaatccttttcagcctgcatccgttccggctgaaaaggagggcgtcatcttgcaggtccgccgcaatacgccagagggtccgttccgcttgaaatcgcatcactttttaaataatttgtacggaaaaagggagctcggacatgacgcggccaaagaagggatttttcttaccgaaggcggagctgtagctgaaggaattatttccaacgttttttggcggaaaggcagctgtgtgtatacaccttctcttgataccggcatattaggcggtgtcacacgccgctacgtcatcgagcgccttgcagatatgggaatcgaagtcatagagggggtataccccttggaagagcttctctttgcggacgaagcatggatgaccaattccgttcaggaaatcgttccattccggagaatcggcagcactgaatttccgggaaaggatggaaatttgtcgaaacgtctgcaagaggcatacactaatgataggaaagcagcaaaagaatatttgagttaa

SEQ ID NO: 82 - DNA, 858 bp, Bacillus licheniformis
atggcgcttcaaacagcggtgcgttcaaagcaactgatcgcaaagcaatacacgttgtcttatgaagataaaacattgatcatgggaattttaaatgtgacgcccgattctttttcagacggcggaaaatataacagcatcgatcgcgccgtcattcatgcaaaacaaatgatcgaagacggcgcccatatccttgatatcggaggagaatcgacgaggccgggggcggaaaaggtttctcttgatgaagagctgtcaagagtcatacctgtaattgaaaaacttgttcaggaaatcgacgtcccgatttccgttgacacttataaagcgcaagtggcagatgaagccattaaggccggtgcagccatcatcaatgatgtctggggagcaaaagcagatcctgacatggcccgagttgcggccgctcataatgtgccgattatcttgatgcataaccgcgaggaacggaattataaggatttgatcccggacatgctgtctgatttgatggaatgtgtgagcattgcaaaatcagcaggcgttcaggatcatcacatcgtacttgatcccggcatcggctttgccaaaacgtatcatgacaatttggcggtcatgaatcagctcgagaagttcagcgaaccgggatacccggttttattggggacgtcacgaaaaaaatttatcggccgagtcctggatctgccgcctgaagaaagagcggaaggcacgggggcgacagtatgcctcggtattcaaaaggggtgcgatatcgtcagggtgcatgacgtcaagcaaatctccaggatggcaaaaatgatggatgccatgattgataaaggaggcgtttatcatcgataa

SEQ ID NO: 83 - DNA, 384 bp, Bacillus licheniformis
ttgataaaggaggcgtttatcatcgataaagtgcatgtagagggcatggagttttacggatatcacggtgttttcaaagaagaaaacaaactcggccagagattccgcgttgatctgacagcatttctagatttaagcgaagccgggaaaacggataatattgaggccaccattaattatgcagagctgtataagctgtgcaaagaggttgtggagggagagccggtcaaccttgtggagaccctcgcggaaacgattgccgcacaagtgctggagaattttgaagcggttcaggaatgtacggttaaagtcgtcaagcctgatcctcctatacctgggcactataaatcggtggccatcgagatgacgagaaagcgaaaatga

SEQ ID NO: 84 - DNA, 501 bp, Bacillus licheniformis
atgaacaacacggcatatatagcgctcggctcgaatatcggccggcgggaagaatatttaaaaaaagctgtctctctcctccatcaacatccgtctgtagaggtgacagacatctcgtcaatttacgaaactgatcctgtcggttatacagaccaagatctatttttaaacatggctgcagctgttaaaacatctctttcaccgtttgaattgctcgatttgactcagcgtattgaaaaagaactcggccgcaaacgcgacattagatgggggccgaggactgcagaccttgacattttgttgtataatcgtgaaaatattgagacagagcaacttatcgttcctcatcctagaatgcatgaacgtttgtttgtactcatcccgctgctggagatttatccggatcttgagggagctgtcaatcatgcaaaaaatcaagaaggtgtaagagtatggaagcagaaatctggggtagacgaattcgtgcatatcgaaagctga

SEQ ID NO: 85 - DNA, 210 bp, Bacillus licheniformis
atggaagcagaaatctggggtagacgaattcgtgcatatcgaaagctgaagggttatactcaagaagggtttgccaaagcattgggtatatccgtttctgtgcttggtgaagtagaacgcgggaatcgtatgccgacggagagcatgctcagggatgtagccaatactttaaatataacagtggaggaactatctccatcagaagaataa

SEQ ID NO: 86 - DNA, 1002 bp, Bacillus licheniformis
atgtttaaaatcggtgatatagaattaaaaaacagggttgtgctcgcgccgatggccggtgtctgcaactcagccttccgcttgacggttaaggaattcggagcgggtttggtctgcgccgaaatggtcagcgataaggcgatcctttacaataatgcgaaaacgatgggaatgctttatatcgatgaacgtgaaaaaccgctcagcctgcagatcttcggcggagaaaaagaaacgcttgtcgaagcggcgaagtttgttgaccaaaacacaactgcggatattattgatataaacatgggatgtccagtgccaaagatcacaaaatgtgatgcaggagccaaatggctgcttgatccgaataaaatttatgaaatggtttcagctgtcgtggaggctgttgacaagcctgtgaccgtgaaaatgagaatgggttgggacgaagaccatatctttgctgttgagaatgcgagagctgtagaacgagcaggcggaaaagcggtcgctcttcacggacggacccgcgtgcaaatgtacgaaggaacggcgaactgggatattatcaaagaagtgaagcagtccgtttcaatccctgtaatcggaaacggtgatgtcaaaactccgcaagatgcaaaacgcatgcttgatgaaacaggggtggacggcgtcatgatcggccgtgcagcgctgggtaacccgtggatgatttaccgtacggttcactatttggaaacaggcgaattgaaagatgagccgaaagtgcgtgagaaaatttctgtctgcaaacttcaccttgaccgattaatcgggctgaaaggcgaaaatgttgcggttcgcgaaatgagaaagcacgcagcctggtatctaaaaggcataagaggaaacgcaaaggtccggaatgaaatcaaccattgcgaaacgagagatgagctcgttcagcttttagacgcgtttacgattgaagccgaggcaaaagagcttcaggatgcaaaagtaggataa

SEQ ID NO: 87 - DNA, 1500 bp, Bacillus licheniformis
atgagccatgaagagcataaccatgaagaattaaacgaccagctgcaagtcagacgcgataaaatgaatcagttgagagaaagcggaaaagatcctttcggacagcgttttgatcgcacccatcaatcaactgatctcattgagtcgtataatgaattctcaaaagaagaattagaggaaaaagcaattgaagtaacgattgccggccggatgatgacaaagcgcggaaaagggaaagcgggattcgcgcatattcaggatttaaagggccagattcagatctatgtcagaaaagacagtgtcggtgaagagcagtacgaatggtttaaaagctctgacctcggggacatcgtcggcgttacaggcgtcatgtttaaaacgaatgtaggcgaattgtctgtaaaagcaacatcttttgatttattgacaaaagctcttcgtccgcttccggacaaatatcatggattaaaggacatcgagcagcgctaccgtcagcgttatttggatttgatcgtaaatccggaaagcaaaaatacgtttattacacgaagcaaaatcattcaatccatgagaagatacttagatgaccacggatacttagaagttgaaacgcctacgatgcacgcgattccgggtggcgcatctgcccgtccgttcattacacatcataatgcgctggatatgccgctttacatgaggatcgctatcgagctccatttgaaaaggctgatcgtcggcgggttggaaaaagtctatgaaatcggacgtgtattccgaaatgaaggggtctccacacggcacaatcctgaatttacgatgatcgaactttacgaagcttatgctgactataaggatattatgagattgacggaaaatctcattgctcatattgcacaagaagtgctcggcactacgaccgttcaatatggagattatgaagtcgacctcaagcctgaatggaagagactccatatggtcgatgctgttaaagaagccaccggtgtagacttctggaaagaagtatcggtagaagaagcaagagcatatgccaaagaacacggaattgaaatttctgaaggcatgtcagttggacatatcattaatgaattcttcgagcaaaaagttgaagaaacgttgattcagcctacttttatatacggacaccctgtggagatttctcctctggctaagaaaaatcctgaagaccctcgatttacggaccgttttgagctgtttatcgtgggccgtgagcacgcgaatgcatttactgaattaaatgatcctatcgaccaaaaagaacgctttgaagcgcaattaaaagaacgtgaagaaggaaacgatgaagcgcatatgatggatgaagactttgtcgaagcgctggagtacggaatgcctcctaccggcggccttggaatcggcatcgacagactgattatgcttttgacgaattctccttcaatcagggacgttttactattcccgcaaatgagacatcgttag

SEQ ID NO: 88 - DNA, 465 bp, Bacillus licheniformis
gtggggaaaaatatttctgacataatcgaacagtatttgaaacaaatattagaacagaacgggaaagaaatattagagattaaacggagcgaaatagccgataaatttcagtgtgttccttctcagatcaattacgtaatcaatacgcgttttacgagcgagcgcggatatattgtcgaaagcaaaagaggcggcggcggttatatccgaattattaaaattaaaatgaacgacaaaattgatttgattaacaatattatgaatcaaatctatacaaggctctcccaggctgcttcagatgacatcattttaaggctgttagaaaatggtgtcattacagaaagcgaagcgaaattgatggtgagtgtcatggaccgttctgttttatatattgatttgcctgaacgagacgaattaagagcaagaatgatgaaagccatgcttacgtcacttaaatttaagtaa

SEQ ID NO: 89 - DNA, 555 bp, Bacillus licheniformis
gtgatatgtcaagagtgtaaagaaagaccggcaacttttcactttacgaaagttattaatggtgaaaaaaaagaaatgcacatctgtgaacaatgtgcgaaagagaacagcgagtcatattctatgaatgaaagtggcggattttccatccataatttattatccggactgcttaattttgactcgtcttttacaaacagcagcgaggcgcagctttttcaacagccggatcaggttttgcgatgcaaaaaatgcaatatgacgttcccggaatttcgaaaaaccggccggtttggatgttcggaatgttataaaaccttccactcctatatcactccggttttaagaaaagttcacagcgggaacacggtccacgcgggtaaaataccaaagcggatcggcggtaatctgcatgtaagaagacaaattgaagcattaaaaaaagagctgaaagaattaattcagcaggaggaatttgaaaaagcagccaacatcagagatcagatcagatcgcttgaacaaaacctgaatgcaaacaaggaggaggaggactga

SEQ ID NO: 90 - DNA, 1092 bp, Bacillus licheniformis
atgtcactgcagcattttattcagaatgctttaagcaattggatgcggcaagaaggccctgagagtgacatcgtgcttagcagccggatccgtcttgcgcgcaatttggataaagtccgttttccaacgcttttttcaaatgaagaggcttcagcgattatagcattgtttgaagaacagttcacaggctatgaagtgcccggtatcgggaagtttgagcttgtgaaaatggatcaggtccagcctttggaaaaaagggttcttgtggaaaaacatctgatcagtccgcatttgacggaagcttcctttggcgcatgccttctttctgaaaatgaagaagtgagtattatgctgaatgaggaagatcatattcgcattcaatgtctatttccgggatttcagctgtcagaagcattgaaagcagcaaatcaggtggacgattggattgaagaccggatcgactacgctttttccgaacaaagaggctacttgaccagctgccctacaaatgtcggaacagggcttagagcttctgtcatgatgcaccttcctgctttagtgttaactaggcaaataaacagaattattccggcaattaatcaattagggcttgttgttagaggaatttacggtgaaggcagcgaagcattagggaatatctttcaaatttccaaccaaattaccctcggtaaatcggaacacgacattgtcgaagatctgaacagtgtcgttgctcagctgatcgaacaagagcgttcagcaagaaaggcgctttatcagacttcgcaaatcgaacttgaagaccgcgtctacagatcttacggcgtactgtccaattgccggatgatcgagtcgaaagaaacagcaagatgtctttcagacgttcgtcttggaattgacctggggataataaaaggtctttccagcaatatacttaatgagctgatgatcctgacacagcctggatttctccagcaatattccggaggagccttaaggccaaacgagagggacatcaggcgggctgctcttatcagggagcgcttgaaattagaaaacaacggcaatagacaggaggatgaaacgatatga

SEQ ID NO: 91 - DNA, 2433 bp, Bacillus licheniformis
atgatgtttggaagattcacagaaagagcacaaaaagtattggcgcttgctcaagaagaagctctgcgtctgggccataataacattggaacagaacatattctcctcggccttgtccgcgagggagaaggaattgctgcgaaagcgctgcaggcgttaggactcagccctgacaagattcaaaaagaagttgaaagcctcatcggccgcggacaagaaatgtcacaatcgatccattacacaccgagagccaagaaagtgaccgaattggcgatggatgaagcgagaaagcttggccactcctacgttggaactgaacacatcctccttggcttaatccgcgaaggggaaggtgttgcggcaagggtgctgaataatttaggcgtcagcttaaacaaagcgagacagcaagtattgcagctgttgggcagcaatgagagcggaggcgctgcttcaggcgccaacagtagcgccaacacaccaactttagacagtcttgcccgggatctcacggcgattgcaaaagaagacagccttgatcccgtgatcggcagaagcaaagaaattcaacgcgtgattgaagtgttgagccgcagaacgaaaaataaccctgtgttaatcggggagcctggtgtcggtaagactgcgattgccgaaggcctggcccagcagatcatcaataacgaagtaccggagattttacgcgacaagcgcgtcatgacacttgatatgggaacggttgtcgccggcacgaaatatcgcggtgaatttgaagaccgcctgaaaaaagtgatggacgaaattcgtcaagcgggaaatatcatcctcttcatcgatgagctgcatactctcatcggagccggaggagcggaaggggccatcgatgcctccaatatccttaaaccgtcgctggcgcgcggagagctgcaatgcatcggggcgacaacccttgatgaataccgcaaatacattgaaaaagatgctgcactagaacggcgttttcagccgattcaggttgaccagccgtctcctgaagaaagcattcaaatattgaaagggctcagagaccgctatgaagcccatcaccgcgtatcgattacggatgaagcgatcgaagcggcagtaaagctgtcagaccgctacatttcggaccgttttctgcctgacaaggcgatcgacttaatcgatgaagccggctcaaaggttagactgcgttcattcacaacgcctcctaacttaaaagagcttgaacaaaagcttgatgaggtaaggaaagaaaaagatgccgctgttcaaagccaggaattcgaaaaagcagcgtctttacgtgatacggagcagcgcttgcgtgaacaggtcgaagaaaccaagaaaacctggaaagaaaagcaaggtcaagaaaattccgaagtgaccgtcgacgatattgcaatggttgtatcaagctggaccggagtgccggtttccaaaattgcgcagaccgaaacagacaaattgctgaacatggagagcattcttcattcccgcgttatcggccaggatgaggctgtcgttgcagttgcaaaagcagtcagacgcgcgcgtgccggcttaaaagatccaaaacgtcctatcggttcgtttattttccttggcccaacaggcgtagggaaaacggagcttgcccgtgcacttgccgagtccattttcggcgatgaagaagcaatgattcgcatcgatatgtccgagtacatggaaaaacattcaacatcaagactcgtcggttcacctcctggatatgtcggctatgatgaaggcggacagctcactgaaaaagtgagaagaaaaccgtattccgtcgtcttgcttgatgaaatcgagaaagctcacccagatgtcttcaatattttgctgcaggtgcttgaagacggccgcctgactgattcaaaagggcgcacggttgactttaggaatacgattttgatcatgacatcaaacgtcggtgcgagcgaactgagaagaaataaatacgtcgggtttaatgtccaggatgaaacccagaattataaagatatgaaagacaaagtcatgggtgaactaaaacgcgcctttagacctgaatttatcaaccggattgatgagatcatcgtcttccactctttggagaaaaaacatttgaaagatattgtatccctcatgtcagaccaattgaccaagcgtctgaaagaacaggatctttcaattgagctgactgaagcggctaaagaaaaaatcgccgatgaaggcgtggatctcgaatacggagcgcgtcctctcagaagagcaatccaaaaacacgtggaagaccggctgtcagaagagctcctaaaaggccatattcaaaaaggccagcatattgttttggatgtagaagacggagaatttgtcgtaaaaaccgaagctaaaacgaactaa

SEQ ID NO: 92 - DNA, 1284 bp, Bacillus licheniformis
atggtggaagaaacgataaaaaaacccgccgccaacagaagaaccgctttttcacattccgttcaaacggtgcaaaagccttcacctctcacttcaattgaaacaacagaagagccgcgaattaaaacgaaacttggcgaattcaaccgcgtcttgggaaacggcatcgtcaaaggttcacttgttttaatcggaggcgaccccggcatcgggaaatcaaccttgctgcttcaagtatctgcccagctcgctgattcaaaagaaaatgtcctgtacatctcaggcgaagaatcggtcaagcagacaaagctgagagcagaccgtctaggtatcaacagtcccactcttcacgttttatctgaaaccgatatggagtatattacgtcttctatagaagagatgaacccatcattcgtagtggttgattcgattcaaaccgtttaccaaagtgatatcacatccgctccgggcagcgtctcccaggtcagggaatgcaccgctgagctgatgagaattgcaaaaacgaaagggattccaatatttatcgtcgggcatgtcacaaaagaaggttcgattgccggaccgagacttctggaacatatggtcgacaccgtcctttactttgaaggtgagcggcatcatacatttcggattttaagagccgtcaaaaaccggtttggatcaacgaatgaaatgggaatctttgaaatgagggaagagggcctgacagaggtgctgaatccgtcagaaatctttctcgaagagcgctcggcgggagcggccggatcgagtgtcgtggcctcaatggaaggcacgaggccagtcttagtagagattcaggcgctgatttcccccacgagctttgggaatccgcgccggatggcaaccgggattgatcataaccgcgtctcattgctaatggcagttttagaaaaaagggttggactgctgctgcaaaatcaagacgcctatttaaaagtcgccggaggcgtcaagctggacgagccagcgattgacctcgccgttgcagtgagcatcgcctcaagcttcagagacaccccgcctcatccgacggattgttttatcggagaagtcggattgacaggggaggtccgcagagtatcaaggatagaacagagggtgcaggaagcggcgaagcttggttttaaaagaatgattattccttctgcaaatgtagaaggatggacaaagccgaaaggaatcgaagtcgtcggcgttgaaaatgtagctgaggcccttcgagcttcattaggaggatcataa

SEQ ID NO: 93 - DNA, 1077 bp, Bacillus licheniformis
atggacaaagacaaaaaaggagcgaaacaggatctttcagaaatattgcagtttgtcgcccccggcacgcctcttcgcgaaggaatcgaaaacgtccttcgggccaaaacaggcggattaatcgtggtcggcttcaacgataaagtgaaagaagtggttgacggagggttccacataaattcttctttctctccggctcatctgtacgagctggctaaaatggacggggcgatcattctcagcgattcagggcaaaaaattctatatgccaatacacagctcatgcctgaggcgacgattccctcctctgagacgggcatgagacacagaacagccgagcgtgtggccaagcagaccggctgtctgatcatcgcgatttctgaaagacggaatgtgattacgctctatcaggaaaatatgaaatatatactcaaagatatcggctttatcttaacaaaagccaatcaggcgattcagacgctcgaaaaatacaaactcattttggaccatgcgatttccaatttgaacgcgctggaatttgaagagcttgttacatttggggatgtcatctccgttctgcatcgatatgaaatggtgctcagaatcaaaaacgaaattaatatgtatattaaagagcttggaacagaaggccatctcatcagactccaggttagcgaactgatcaccgatatggagcaggaagcggcgctgttcgtcaaagattatgtgaaagaaaaaatcaaagacccgtttgttctgctgaaacagcttcaggatatgtcgagtttcgaattgctggatgatgcgattctccttaagcttttaggctattcagcaactacgaacatggaagaatacgtttttccgagaggctacaggcttctccacaaaattccccgcctcccgatgccgatcgtcgaaaatgttgtcgaagcattcggccatttaaagctcattatcgaagcggatgtaaaagatttggatgaagtggaaggaattggggctgttcgtgcccaaaagataaagaaagggttaaagagacttcaggagaaacattatactgacaggcagctgtga

SEQ ID NO: 94 - DNA, 1089 bp, Bacillus licheniformis
atgttaaaacgaatagttcaagcgttctttgcgattttgggaggcgttatcggtatttttctcataccggaattgtttgtactgttaaatgtacaggacatacctttagtaacaaacccgtatgcgtctgcttgtttaggagctatcatcttttttcttctgggcatctggtgtgcggatcacgtcatcaactgggtgaaacagattgaggattccttgatcaaagcacctgtctcagacttgttgttcggctctttgggattaatcttcggacttatgctcgcttatcttatcgtcaacgtcattccgttaaaagacatcccttatcagttaatcagcacggtcattccgattgtgttggccgcatttctcggctatctcggattccgtgtgggtttcaagaaaaaggatgaaatgctgacactttttacatcgagaaagaaaaaaggttctgctgaggaagagcgtccggaagaagacaaaaagctgaaaattttagacacaagtgttattatagatgggagaattgctgatatttgtcagaccggatttcttgaaggcgtcattgtgattcctcagtttgtgcttgaggaactgcagcatatcgccgactcttcagacgtcctcaaacgaaacagagggcggagaggactggatattttaaaccgtatccagaaagagcttgatattaaagttgaaatttatgaaggcgattttgaagacatccaagaggtcgacagcaagctcgtcaaactggcgaagctgacctcgggcgttgtcgtcacaaacgatttcaatttgaacaaagtatgcgagctccaaaaggttgccgtattgaacatcaacgaccttgccaacgccgtcaagcctgtcgtgcttccgggagaagaaatgaaggtgcaggtcatcaaagacggaaaagaacataatcagggcgtggcttatctggacgacggcacgatgattgtcgttgaagaagggcgaaattatattggcaaacatatcgacgtgctcgtgaccagcgtgctgcagacagcggcaggcagaatgatattcgccaagccgaaactgctggaaaaggcgctttga

SEQ ID NO: 95 - DNA, 696 bp, Bacillus licheniformis
atgaattatgaagtcgtcattcctgccgccggacaaggtaaacgaatgaatgccgggaaaaacaaactgtttatcgaggcgaaaggaatacctgtgattattcatacattaaaggtgtttgaaaaccatgatgcctgcaaaaggatcattcttgtcatcaatgaacaggaattcggtgaattcaacacccttttaaaaacctatcattttaagactccgatcgagatggtgccgggcggaagagaacgccagcaaagcgtttttgcgggcattaaagcggccggcaaagaggaaacggtcctcgtccatgacggagcaagaccttttattaaacgggaatatatcgaacagcttgtcgagaaagcaaaggaaacaggggcagccatcgttgccgttcctgttaaagacacgatcaaacgcgttcaagacggtgagatagccggaacgattgaacgttcaagcttgtgggccgctcaaaccccacaagcttttcgtctttctattctgatgaatgctcaccttgaggctgaagcaaaaggtttcctcggtacggacgacgccagtcttgtcgaggaagccggaggtacggttgcaatcattcaaggggattatcaaaacatcaaactgacgaccccggatgacttgcttgtcgcagaagcgatattagaagcggaaaagaggaatgaacatgtttag

SEQ ID NO: 96 - DNA, 477 bp, Bacillus licheniformis
atgtttagaataggccaaggatttgacgtccatcaactagtggaaggcaggccgctcataatcgggggaattacgattccttacgaaaaaggccttctcggacattcagatgcagatgtgcttttgcacacgattgcggatgcatgtctcggtgccgtcggcgagggcgatatcggaaaacactttccggataccgatcctgaattcaaagatgccgactccttcaaactccttcgccacgtctggatgatcgtgaaggaaaaaggctatacgctagggaacctggattgtacaatcatcgcccaaaagcctaaaatggcgccgtatatcgaagacatgagagccagaattgccgaagggctagaggcggaaatttcccaaattaacgtaaaagcgaccacaaccgaaaagctcggatttacgggaagagccgaaggaatcgccgcccaggcttccgttctgctccaaaaggtataa

SEQ ID NO: 97 - DNA, 1458 bp, Bacillus licheniformis
atgggaaacgaagttcgggttcgttatgcgccgagcccaacaggccatttacatatcggaaatgccagaaccgctctttttaattatttgtttgcccggagccaaggcggaaaattcatcatccgcattgaagatacggaccgcaagcgcaacattgaaggcggggagcaaagccagctgaactatttaaaatggctgggcatcgactgggatgaaagcgtggatgtcggaggagaatacggaccataccgccaatccgaaagaaacgacatttacaaaacatattacgaggagcttcttgaaaaagggctagcctacaaatgctactgcacggaagaagagcttgagaaagagcgtgaggaacaggctgcccgcggagaaatgccgcgctactccggcaagtgccgcaatttaacaaaagaagagcaggaaaagctcgaagctgaaggaagacagccgagcatccgctttaaagtgcctcaaggtgaagtcatccgctttgatgacatcgtcaaaggagaaatttcttttgaaacagacggaatcggcgacttcgtcatcgtgaagaaagacggaacgcctacttacaactttgccgtagcggtcgatgactatttaatgaaaatgacgcatgtcctgcgcggcgaagaccacatttccaatacgccaaagcagatcatgatttacaacgcccttggctgggatatcccggcatttggacatatgacattaatcgtcaatgaaagccgcaaaaaactgagcaaacgtgatgagtccatcattcagtttatcgagcagtacgaagagctcggctatttgccggaagcattgtttaacttcatcactcttctaggctggtcgccggtcggagaagaagaactgtttacaaaagaacagtttattgagatatttgatgtaaaccgtttgtcaaaatcaccagcggtgtttgatacgcataaactgaaatgggtcaacaaccagtatgtgaaaaaacttgatcttgatcaggtcatcgaattgaccgtgccgcatttgcaaaaagcgggcaaggtttcagaagagctttcaggcagcgaacaggaatgggtgcgcaagctgatttccctatatcaggaacagctgagctacggcgctgaaatcgtcgagttaacagagttgttctttaaagacgatatccagtataatcgtgaagcaagaacagttttagaagaagagcaggttccggaagtgcttcgcgtatttgccgaaaagcttgagcagcttgactcgtttacggcagatgagatcaaggcatccatcaaagccgttcaaaaagaaacaggacataaagggaaaaagctgtttatgccgatccgcgtagcgacgacaggccagacccacggtcctgaactgcctcagtccattgaattattggggaaagacaccgttttaaaacggctgcataacattattcaataa

SEQ ID NO: 98 - DNA, 651 bp, Bacillus licheniformis
gtgttctttaaaatgctgaaagaagatgtagatgtcgtatttgaccaagatccggctgcgagaagctacattgaagtcatcttaacttattcaggtttgcatgctatatgggcacatcgaattgcacatgctttatataaaagaaaaaggtttttcatcgccagagcgatctctcaaatcgcccgcttctttacgggaatcgaaattcacccgggtgccaagatcggcaggagatttttcattgatcacggcatgggggttgtgatcggcgaaacctgtgagatcggaaacaatgtcacggtttttcagggcgtgacgcttgggggaacaggaaaagaaaaaggcaaaaggcatccgacaatcgaggacgatgccctgatctcaacaggggctaaagtgcttggatccattacagtcggaagaggggcgaaaatcggtgcaggctccgtcgtcctgcacgatgtgcctgaatgctccaccgttgtcggcatcccgggccgggtcgtcgtacaaaacggaaagaaaatcagacgcgacttgaatcaccaggatttgccggatccggtggctgaccgcttcagagaattggaaaacgaaatcaggcagctgaaacaagagctccggagaaaagaaagggaagatgagctgtga

SEQ ID NO: 99 - DNA, 1404 bp, Bacillus licheniformis
gtgacactaacattgtataatactctcacacgaaaaaaagagccgtttgtgcctcttgaagaaggcaaggtcaaaatgtatgtgtgcggtccgacagtatataactacatccatatcggaaacgcaaggccggctatcgtgtttgacactgtcagaaagtatttagagtataaaggctatgaagtccaatatgtctccaattttacagatgtcgatgacaaattaattaaagcggcaaatgaacttggagaggaagtgccggtcatcgccgaacgctttattaaggcatacttcgaagatgtcggttcactgggctgcacaaaagctgactgccatccgcgcgtcactgaaaacatggatgagatcatcgactttattcagacgctgatcgataagggctatgcctatgaggcggacggagatgtttattataaaacaagatcgtttgaaggctatggaaagctgtcgcatcaatcggtcgatgagctgagatcaggcgcccgaattcaagtgggcgaaaagaaagaagatgcgctcgattttacactatggaaagcggctaaagataacgaaatctcctgggatagcccttggggaaaaggccgtcccggctggcatatcgagtgctctgcgatggcgagaaaatatctgggcgattcgatcgacattcacgccggcggtcaggatctggccttcccgcatcatgaaaacgaaattgcccaatcggaagcattaacagggaagcctttcgcgaaatattggcttcataacggctacattaatatcgataatgagaaaatgtcaaaatcgctcggcaactttgttcttgtgcatgacattattaaagagcatgacccccaagtgctgcggtttttcatgctgtctgttcattacagacatccgataaactattcggtcgaacttctcgagaacacaaaaaacgcttttggacgtctaaaaacagcttatagcaatttgcagcatcgcctaaaaagcagtacaaatttaacagagggcgattcagaatggcttgaaaaaatcgaagagcagcgaaaagccttccaaacggctatggatgatgatttcaatacagcgaatgccatttccgtcctgtttgacctggccaaacatgccaactactatttgcaggaaaagaatactgcagaacatgtcattcaggcgtttatacagctgtttgacgagatctgctcagtgctcggcttctccctcaaggaacaggaacttttggataaagacattgaagaactgatcgagaagcggaatgaggcccggagaaaccgcgactttgcaacatctgatcagattcgcgaccagttgaaaagcatgaatattatcttggaggacactccgcagggcacgcgctggaaaagaggagaatcataa

SEQ ID NO: 100 - DNA, 417 bp, Bacillus licheniformis
atgaatttggaaaccattaaagacgccaaacagctgaatggtttggcgcttgcttacatgggtgatgccgttttggaggtatatgtgaggcatcacctcttaaagcaaggcatgacaaggcccaatgatctgcaccggcagtcgaggcgatatgtctccgccaagtcgcaggcaagcatgctgtttgcgcttgaggagcaggaatttttcaccgaggaagaacaggctgtgctgagaagagggcggaatgccaaatccggaacggtaccgaaaaacacggatgtccaaacatatcgttacagtacggcttttgaggcggtcatcgggtatctttttcttgagaacagggaagataggcttaatgaactcatcaaagcagcgctggaaaaacgggatggcagggaggaagtaaaatga

SEQ ID NO: 101 - DNA, 750 bp, Bacillus licheniformis
atgagtcagcagcatgattacgtcataggaaaaaacgcggtcatcgaaacattaaagtccggccgggaattgtataagctgtggatggcggaaaacacagtgaagggacaggctcagcaagtcgtcgatctcgccgccaaaaatggcgtcacgattcattatgtcccaagaaaaaaactcgatcaaatggtttccggacagcatcaaggcgtcgtcgcccaggtagcggcttacgagtatgccgagctggatgatctttttcaaaaggccgaagacagaaatgaacagccgtttatccttgtattagacgaaattgaggatccgcacaacctgggctctattatgcgcaccgcagacgcggtcggggctcacggcatcgtcattccgaaaaggcgcgcggtcggccttacaacgactgtcgccaaagcctcgacaggagccatcgaacatattccggtcgtcaaggtgaccaatctgtcgcggaccctggaagaaatgaagggacggggcatttgggtcgtcggtaccgatgcgtctggacaacaggactacaggtcgctggacggaaatatgccgcttgcgcttgtcatcggcagcgaaggaaaaggcatgggaaggcttgttaaagagaaatgtgattttctcattcgcctgccgatggcgggaaaggtcacatccctgaacgcctcagttgcagccggcctgctgatgtatgaagtgtaccggaaacgaagccctctgggagaatag

SEQ ID NO: 102 - DNA, 513 bp, Bacillus licheniformis
atggacatcctgttggtcgacggttataacatgattggggcttggcctcagctgaaagatttaaaagaaaacagttttgaagaagcaagggacctgttgattcagaagatggcggaatatcaatcgtatacagggtttcgggtaatcgttgtctttgatgcgcatctcgttaaaggaatcgagaaaaagaaggtcaatcatcgcgtagaagtgatattcacaagggaaaatgaaacggctgatgaacggatcgagaaactggtgtcagacttgaatagtattcagacgcagatccatgttgccacatccgattacacagagcagtgggcgatttttggccagggggccctgcgcaaatcggccagagagctgctcagggaggtcgaagcgatcgaaaggcaaattgaaaacagggtgaaacaaatcacctcagagcgtcccgcagggaaaattccattgtcagaagacgtcttgaggatcttcgaaaaatggcggcgtggcgacttggattag

SEQ ID NO: 103 - DNA, 672 bp, Bacillus licheniformis
gtgaacttacaaaacaaccagggaaaattcagcaaagaacagttcagcaaagaacgtttttgccagttggaagacgagcaggtcattgaaatggttcatgtcggagacagtgatgcgttagattacttgattacaaagtaccgtaattttgtaagggcaaaagcaagatcctacttcttaatcggggctgatcgggaagatatcgttcaggaaggcatgattggactctacaaatctatccgtgattttagagaggacaagctgacttcattcaaagcttttgcagaattatgcattacccgccaaattattaccgctatcaaaacagctactcgccagaaacatattccgctcaattcttatgtgtcgctggacaagcccatttatgacgaggaatcagaccggacgcttctcgacgtgatttcaggggccaaggtcatgaatcctgaagagctgatcatcaatcaggaagaattcgatgatatcgagctgaaaatgggagaattgcttagtgatttagaaagaaaagttcttgcgctctatctcgacggaagatcctatcaggaaatatccgaagaattaaaccgccatgtaaaatcgatcgataatgcgctccagcgtgtcaaaaggaagcttgaaaagtacctggagctccgcgaaatcagcttgtag

SEQ ID NO: 104 - DNA, 180 bp, Bacillus licheniformis
atgggtattatcaaatttttaaagaatgtcggaaaagaaatgaaaaaggtcacctggcctaaaggaaaagaactaacgcgctatacgatcactgttatcaccaccgttatctttttcgccatcttttttgcactcatcgattcgggtattacgcaattaattcgtttaatagttgaataa

SEQ ID NO: 105 - DNA, 561 bp, Bacillus licheniformis
atggaaaagaaatggtatgtggttcatacgtactccggctatgaaaataaagtaaaggcgaatttggaaaagcgggtagaatcgatggggatgcaagataagatattccgcgtcgttgtacctgaagaggaagaaaccgatattaaaaacggcaagaaaaaagtcgttaaaaagaaagtcttccctggttatgtacttgtcgaacttgtcatgacggatgattcctggtatgttgttcgaaatacgcctggtgtgaccgggtttgtcggttcagccggatcaggttcaaagccgactgcactgcttccgggcgaagcggaaaaaatcctgaagcggatggggcttgaagaaagaaaaacagaaatcgactttgaattaaaagaaaccgtcaagttatcgacggcccgtttgctgatttcacagggacgatcgaagagatcgaccacgacaaaaataaagtcaaagtttttgttaatatgttcggaagagagaccccggttgagctcgaatttactcaagttgacaaattgtaatggaaaagcgcttgaaatcactatataa

SEQ ID NO: 106 - DNA, 426 bp, Bacillus licheniformis
gtggctaaaaaagtagttaaagttgtaaaattgcaaattcctgctggaaaagcgaatccagctccgccagttggtcctgcgttaggtcaagccggtgttaacatcatgggattctgtaaggagtttaacgctcgtacatctgaccaagctggtctgatcattcctgtagaaatttcggtttacgaagaccgttcatttacatttatcacaaaaactccgcctgctgctgtattgcttaaaaaagcggctggaattgagtcaggttctggtgagcctaaccgtaataaagtcgcaaccgttaaacgcgataaagtacgtgaaatcgccgaaacaaaaatgcctgacttaaatgcggcagatgttgaagcggctatgcgtatggttgaaggaactgcccgcagtatgggtattgtgatcgaagactaa

SEQ ID NO: 107 - DNA, 699 bp, Bacillus licheniformis
atggctaaaaaaggtaaaaaatacgtcgaagctgccaagcttgtagatcgtacaaaagcttacgacgtaaacgaagcgattgagcttgtgaaaaaaacaaacacagctaaattcgatgctactgttgaagcggcatttcgtttaggtgttgaccctcgtaaaaacgaccagcaaatccgcggtgcagttgtacttccaaacggaacaggcaaaactcagcgcgttcttgttttcgctaaaggtgaaaaagcgaaagaagcagaagctgctggtgcagactacgtaggcgatgcagattacatcaacaaaattcagcaaggctggtttgattttgatgtgatcgttgcgactcctgacatgatgggtgaagtcggtaaaatcggacgcgtgcttggaccaaaaggtcttatgccaaaccctaaaacaggaacggttacatttgaagttgaaaaagcagtcaacgaaatcaaagcgggtaaagttgaataccgcgttgataaagcaggaaacatccacgttccaatcggaaaagtgtctttcgaagaaggcaagcttgtagagaacttcgcgacaatgtacgacacaattttgaaagcgaagcctgctgctgctaaaggtgtatacgtgaaaaacgtttctgttacatctacaatgggacctggaatcaaagtggacccttcaactttcaacgtaaaataa

SEQ ID NO: 108 - DNA, 525 bp, Bacillus licheniformis
atgaatcttacaggaggtgtaaccatgagcagcgcaattgaaacaaaaaaagttgttgttgaagaaattacttctaaactgaaagaaagtaaatcaacgatcatcgttgactatcgcggccttaacgtagctgaagtaacagaacttcgtaaacagcttcgcgaagctaacgttgagttcaaagtgtacaaaaacacgatgactcgccgtgcggttgaacaagctgaacttgatggtttgaacgatttcttaacaggaccgaatgcgattgcattcagcactgaagatgttgtcgctccagctaaagttcttaacgagtttgctaaaaagcacgaagctcttgaaatcaaagcgggcgtaatcgaaggcaaagtgtccacagttgaagaagtgaaagctcttgctgaacttccatctcgcgaaggcttgctttctatgttgcttagcgtacttcaagctccagttcgcaatcttgctcttgcaactaaagctgttgcagaacaaaaggaagaacaaggcgcttaa

SEQ ID NO: 109 - DNA, 387 bp, Bacillus licheniformis
atggaggaattacaaatggctttaaatatcgaagaaatcattgcttccgttaaagaagcaactgtacttgaactgaacgacttagtaaaagcaatcgaagaagaattcggcgtaactgctgctgctcctgtagctgtagctggcggagctgctgcaggcggtgctgctgaagaaaaaactgaatttgatcttgttcttgctggtgcaggagatcaaaaaatcaaagttatcaaagttgttcgtgaaatcactggtcttggcttgaaagaagctaaagaacttgttgacaacactccaaaacctcttaaagaaggtattgcgaaagaagaagctgaagagcttaaagctaaacttgaagaagttggcgcttctgtagaagttaagtaa

SEQ ID NO: 110 - DNA, 606 bp, Bacillus licheniformis
atgactgaccattattattcggaaaaaccttcagcaaaaagcagcagatcaatgtgggcatttcgcttgagaaaccggacgtttacttttatcagcgacagcggagttttttcaaaaagagaagtggactttggctcaaggctgctgattgaagctttccgggaaccggatgcagaaggtgattttttggatgtaggctgcggctatggcccgattggtctttcgcttgctgcggatttcgaagatcgaatggttcacatgatcgatgttaatgaaagagctgtcgaactttcgaaggaaaacgcgttaaataatcagatcgacaacataaagatctaccagagtgatctgtttgccaacgtcgaacctgcaaaaaaattcgcttctattattactaatccccccatacgcgccgggaaaaaaactgtgcacgccatctttgaaaaaagcgctgaacatttgcggccttcaggagagctgtgggtcgtcattcagaaaaaacaaggcgggccttctgccattgaaaaattaaaagaactttttgcggacgttgaagtcgttcaaaaaaagaaagcgtactatatcatcaaagcaaaaaaagtttga

SEQ ID NO: 111 - DNA, 3582 bp, Bacillus licheniformis
ttgacaggtcaactagttcagtatggacgacaccgccagcgcagaagctatgcacgcattagcgaagtgttagaattaccaaatctcattgaaattcaaacctcttcttatcagtggtttcttgatgagggtcttagagagatgtttcaagacatatcgccaattgaggatttcactggtaacctctctctggaatttatcgactacagcttgggcgagcctaagtatccggtagaagaatcaaaagagcgggatgtgacctattcagctccgctgcgggttaaagtccgcttaatcaacaaagaaaccggcgaagtaaaggatcaggatgtcttcatgggcgatttccctattatgacagacactggaaccttcattatcaacggtgcagaacgggtcatcgtatctcagctcgttcgttctccaagtgtatattttagtggtaaagtagacaaaaacggtaagaaaggttttaccgcgactgtcattccaaaccgtggcgcatggttagaatacgagactgatgcgaaagatgttgtttacgtacgcatcgatcgcacacgtaagttgccggttacggttcttttgcgtgctcttggcttcggatctgaccaagagatcattgatctcatcggtgaaaacgagtatctgcgcaatacgcttgataaagataatacggaaaacaccgataaagcgcttcttgaaatctacgagcgtcttcgtccaggggagccgcctaccgtagaaaacgcaaaaagcctgcttgattcaaggttctttgatccgaaaagatatgaccttgcgagtgtaggacgttataaaattaataaaaagcttcacatcaaaaaccgactttttaatcagcggcttgctgaaacgctagtcgaccctgaaacaggcgaaatccttgccgaaaaaggagcgattttagacagaagaacgcttgataaagttctgccgtaccttgaaaacggaatcggttttaaaaagctttatccgaacggcggagttgtcgaagacgaagtaacgcttcagtctatcaaaatctatgctccgacagaccaagaaggggagcagacaatcaatgtgattggaaatgcttatatcgaagaaggcgttaagaatattacaccttctgatattatcgcttccatcagctatttctttaacctgcttcacggagtgggcgataccgacgatatcgaccatctaggaaaccgccgtctccgttcagtgggagagcttctgcaaaaccaattccgtattggtttaagcagaatggagcgcgttgttcgtgaaagaatgtctattcaagatacaaacacgatcacgccgcagcagctgatcaatattcgccctgtcatcgcatcaatcaaagagtttttcggaagctcgcagctttctcagtttatggatcagacgaatccgcttgctgagctgacgcataagcgccgtctgtcagcgctcggaccgggcggtttgactcgtgagcgcgccggaatggaagtccgtgacgttcactattcacactacggccggatgtgtccgattgaaacccctgagggtccaaacatcggcttgatcaactcgctttcttcattcgcgaaagtgaaccgtttcggcttcatcgaaacgccgtatcgccgcgtcgatcctgaaactggaaaagtaacgccgagaatcgattacttgacagctgatgaagaagacaactatgtcgttgcccaggcaaacgcacgcctgaatgatgacggttcttttgtggatgacagcatcgtcgcccgtttcagaggggagaacaccgttgttccgaaagaccgcgtcgactatatggacgtttcgcctaaacaggttgtctctgccgcgactgcatgtattcctttcttggaaaacgatgactcaaaccgcgcccttatgggagcgaacatgcaacgtcaggccgtacctcttatgcagcctgaatcgccgatcgtcggaaccgggatggaatatgtatctgcgaaagactccggtgccgctgttatttgccgccaccctggaatcgttgaacgggtggaagcgaagaacatctgggtgcgccgctatgaagaagtcgacggccagaaagtcaaagggaaccttgataaatacagcctgctgaagtttgtccgttccaaccagggaacttgctacaaccagcgtccgatcgtaagcgtcggtgatgaggttgaaaaaggtgaaattttagctgacggtccgtccatggaaaaaggtgagcttgcccttggacgcaacgtcatggtcggctttatgacatgggatggctacaactatgaggatgccatcatcatgagcgaacgccttgtaaaagacgacgtatacacgtctattcatattgaagaatacgaatcagaggcccgggatacaaaactcggacctgaagaaatcactcgcgatattccgaacgtcggtgaggacgctcttcgcaatctcgatgaacgcggaattatccgtgtcggtgctgaagtaaaagacggagatcttcttgttggtaaagtaacccctaaaggtgttacagagcttacggcggaagaacgcctgcttcatgccatcttcggggaaaaagcgcgtgaagtgcgtgatacgtcgctgcgtgtacctcacggaggcggcggtatcatccttgatgtaaaagtgttcaaccgcgaagacggagacgaactgcctccgggcgttaaccagctcgtccgcgtctacatcgttcagaagcgtaaaatttctgaaggggacaaaatggccggacgccacggtaacaaaggtgttatttcgaaaattcttccggaggaagatatgccgtatctgcctgacggaacgccgattgacatcatgttaaacccgctgggcgtaccatcgcgtatgaacatcgggcaggtgttggagctgcaccttggtatggctgcacgccgcctcggtctgcatgtcgcgtcacctgtatttgacggtgcccgcgaagaagatgtgtgggaaacccttgaagaagccggcatgtcaagagacgcaaaaaccgtcctttacgacggccgaactggggagccgtttgacaaccgggtttctgtcggcatcatgtacatgatcaaactggcacacatggttgacgacaaattgcacgcacgttcaaccggtccttactcactcgttacccagcagcctctcggaggtaaagcgcagttcggcggacagcgttttggagagatggaagtttgggcgcttgaagcttatggtgcagcatatacgctacaagagatcctgactgttaaatcggatgatgtcgtaggccgtgtgaaaacatatgaagccatcgtaaaaggcgacaatgttccagaacctggtgttccggaatcgttcaaagtattgatcaaagagcttcaaagcttaggtatggacgtcaaaattctatcaagcgacgaagaagaaatcgaaatgagagacttggaagacgacgaagacgcgaaacaaaacgaagggctttctctgccgaatgatgaagagtccgaagagttggtttctgctgacgcagaacgcgatgtcgttacaaaagaataa

SEQ ID NO: 112 - DNA, 3600 bp, Bacillus licheniformis
ttgctggatgtgaacaattttgagtatatgaacatcggtctcgcttcacctgacaaaatccgttcatggtcttacggagaagtgaaaaagcctgaaacaatcaactatcgtactttgaaacctgaaaaagatggtctattctgcgagcgcattttcggtcctcaaaaggactgggaatgccactgcggaaagtacaagcgggttcgttataaaggcgtagtctgcgaccgttgtggagttgaagtaacccgggctaaagtccgtcgtgagagaatggggcatatcgagctggcagccccggtttctcacatctggtattttaaaggaattccgagccgtatgggtcttgtgctggatatgtctccgcgcgcattggaagaagtcatttactttgcttcttacgtcgtaacagatccggccaatacaccgctcgagaaaaaacagcttctttctgaaaaagagtatcgggcgtacctcgataaatacggaaataaattccaagcgtcaatgggtgctgaagcgattcataagctccttcaagatatcgacctcgataaagaagtggatatgctgaaagaagagcttaaaacgtcacaaggacagcgccgcacacgtgcgatcaaacgtctggaagtattggaagccttccgcaattccggaaataagccgtcatggatgatcctcgacgttcttccggtcattccgcctgagctgcgaccaatggtacagcttgacggtggacgttttgcaacttccgatctgaacgatttgtatcgccgcgtaatcaaccgtaacaatcgtttaaaacgtcttctggaccttggagcgccaagcattatcgttcaaaacgaaaagcgcatgcttcaggaagccgtggacgcattgatcgataacggacgcagaggacgtcctgttacaggtccaggaaacagaccgttaaaatccctttctcacatgctgaaaggtaaacaaggccgtttccgtcaaaaccttctcggtaaacgtgttgactactcaggacgttcggttatcgtcgtaggtccgaacctgaaaatgtatcaatgcggtcttccgaaagaaatggcgctggaactgttcaagccattcgtcatgaaagagcttgttgaaaagggccttgcccacaatattaagagcgcgaagcgtaaaattgagcgcgttcagccggaagtctgggatgtccttgaatcagttatcaaagaacaccctgtgcttctcaaccgtgcacctacgcttcacagattaggtattcaagcgtttgaaccaacgcttgttgaaggccgtgccatccgtcttcatccgcttgtatgtacggcatacaacgctgactttgacggtgaccaaatggcggttcacgttcctttatcagcagaagcgcaagctgaggcgcgcatccttatgcttgctgcgcaaaacatcctgaaccctaaagacggaaaaccggttgttacaccgtctcaggatatggtacttggaaactactatctgacgctagaacgccctggtgcagtcggcgaaggtatgattttcaaagatacggatgaagcgctgcttgcttaccaaaacggatatgttcatttgcatacgagagtagccgtcgcggttaactcattgaaaaatgaaacgtttaccgaagaacagcgttccaagctgctcattacaactgtcggaaaactgatcttcaacgaaattcttccgccgtcgttcccatacatgaacgaaccgacgaagagcaacattgaagaaaaaacgcctgaccgtttcttcttggattacggtgcagatgttaaagaagccattaagaaccaagaaatcaacccgccgttcaaaaaaggcattttgggtaaaatcattgcggagatcttcaaaaggttccatattacagaaacatcaaaaatgcttgaccgcatgaaaaacctcggctttaaatactctacaaaagccggaattacggtcggtgtttccgatatcgtcgtattggacgacaaacaggaaatccttgaagaagcgcaaggaaaagtcgataacgtgatgaagcagttcagacgcggtctgattactgaagaagagcgttatgaacgggtcatttccatctggagtgcagctaaggatacgatccaaggcaagctgatgaaatccttggatgaaatcaacccgatttacatgatgagtgattccggagcccggggtaacgcatcaaactttacgcagcttgcgggtatgcgcggtctgatggccaacccggccggacggatcatcgaacttccgatcaagtcaagtttccgtgaaggtttaacggtactcgagtactttatctctactcacggtgcgcgtaaaggtcttgcggatacggcccttaagacagccgactcaggttacctgacacgccgtctcgtagacgtagcccaagacgtcatcattcgtgagactgactgcggcacagaccgaggcattcttgccaaagccatcacggaaggcacagaagtgatcgagcgtcttgaagagcgtcttgtcggccgattcgcgagaaagcctgttaaacatccggaaacaggtgaagtgctcgtgaatgaaaacgagctgatcgacgaagataaagcgattgaaattgtcgaagcaggcattgaagaagtgtggatccgctccgcatttacatgtaatacgtcacatggtgtatgtaaacgatgctacggccgcaacctggcaacaggaaccgatgtcgaagtcggagaagcagtcggaatcatcgctgcccagtccattggtgagccgggtacacagttaacgatgcgtaccttccatacgggcggggttgccggagacgatattacacaaggtttgccgcgtatccaggaattgtttgaagcgcgaaaccctaaaggtcaagcgacgatctctgaaattgacggtgtcgtggccgaaatcaatgaggttcgcgataaacagcaggaaatcgtcgttcagggcgaagtcgaaagccgttcatatacggcgccttacaacgcgcgcttgaaagtcactgaaggagagaagatttctcgtggtcaagtgctgacagaaggttcggttgatccgaaagagcttctgaaagtcactgacatcaccacggtccaagaatacctgcttcatgaagtgcagaaggtttatcgtatgcagggggttgaaatcggagataagcacgtcgaggttatggttcgccagatgcttcgcaaagtgcgcgtcatcgatgccggcgacacggaagtgctgccaggcacgctgctcgatattcaccagtttacagaagcaaacaaaaaagttctgcttgaaggcaaacgccctgcaactggccgtccggtgcttctcggtatcaccaaagcatcgcttgaaacggattccttcctgtctgccgcgtcattccaggaaacaacacgtgtcctgacagatgcagcgatcaaaggaaaacgtgatgagcttctcggcctgaaagagaatgttatcatcggtaagcttgttcctgctggaacgggtatgctgaactatcgtaaagtgaagccggtattgcaagtccaatcatctgatgaaatggttccggctgaataa

SEQ ID NO: 113 - DNA, 249 bp, Bacillus licheniformis
atgtcttatgataaagtatcacaggctcaatctattattatcggtacgaagcagacagtcaaagcactgaagcgcaattctgttaaggaagtcgtcgtagcaaaggacgctgatccttgtctgacgtcaggtgttatcaatctggcaaatgaacaaggggttccagtctcaatggcagagtccatgaaaaagctcggcaaagcctgcggaattgaagtcggagctgcagctgttgccattattcaataa

SEQ ID NO: 114 - DNA, 417 bp, Bacillus licheniformis
atgcctacaattaatcagctagtccgcaaaggacgcgtaagcaaagttgaaacttctaagtctccagcacttaacaaaggatacaacagcttcaagaaagagcacactaacgtatcttcaccacaaaaacgcggagtatgtacccgtgttggtacaatgacaccgaagaagccgaactcagcgcttcgtaaatatgcccgtgttcgcttaactaacggaatcgaggttacagcctacattcctggtatcggacacaacctgcaagagcacagtgtcgtattgatccgcggtggacgtgtaaaagacttaccgggggtacgctaccacatcgtgcgtggcgcacttgatactgccggagttgaaaaccgtgcacaaggccgttctaaatacggtacaaaacgtcctaagaaaaaataa

SEQ ID NO: 115 - DNA, 471 bp, Bacillus licheniformis
atgccacgtaaaggtcctgtagcaaaaagagacgttttacctgatccgctttacaactctaaactggttactcgtttgatcaacaaaatgatgatcgacggtaaaaaaggtaaagctcaaacaatcctatacaagtcattcgatattattaaagaacgtaccggcaacgatgcaatggaggttttcgaacaagcattgaagaacatcatgccagtgcttgaagttaaagcacgccgcgtaggtggtgcgaactaccaagtacctgtagaggttcgtcctgaacgccgtacgactcttggacttcgctggttagtaaactacgctcgtcttcgcggagaaaaaacgatggaagagcgtttagctaacgaaatccttgatgcagctaacaacactggtgctgctgttaagaaacgtgaagatactcataagatggctgaagcaaacaaagcgttcgctcactatcgctggtaa

SEQ ID NO: 116 - DNA, 2079 bp, Bacillus licheniformis
atggcaagagagttctccttagaaaaaactcgtaatatcggaatcatggctcacatcgatgccggtaaaacgacaacaactgaacgtatcttgttctacacaggccgtatccataaaattggtgaaactcacgaaggggcttcccaaatggactggatggagcaggaacaagaacgcggtatcacaatcacatctgctgcaacaactgcacagtggaaaggctaccgcgtaaacatcatcgacacaccaggacacgtagacttcacagttgaggttgaacgttccctgcgcgtacttgatggtgccgttgccgttcttgacgcacaatcaggcgttgagccgcaaactgaaacagtttggcgtcaggcgacaacttacggagtacctcgtatcgtatttgtcaacaagatggacaaaacgggtgcggacttcctttactctgtaggaactcttagagaccgtcttgaggcgaacgctcacgcgatccaattaccgattggcgccgaagacaattttgaagggatcatcgaccttgtagaaaacgttgcgtactactatgaagatgaccttggaacacgctctgaagcgcgtgaaatccctgctgagtacaaagacaaagctgaagagcttcgcgctagcttgattgaagctgttgctgagcttgatgaagagcttatgatgaagtacttggaaggtgaagaaatcacagttgacgagctgaaagcagcaatccgcaaaggaacttgtaacgttgagttctatccggttctatgtggttcagctttcaaaaacaaaggtgttcaattagtgcttgacgcagttcttgactacctgccagctccaactgacgtaccagcaatcaaaggtactctgcctgattctgatgaagaggttactcgtgagtcttctgacgatgcacctttctcagcgcttgcatttaaagttatgactgacccttacgttggtaaattgacgttcttccgtgtgtactcaggaacacttgattccggttcatacgtaagaaactcaacaaaaggcaaacgtgagcgcgtcggccgtatcctgcaaatgcacgccaacagccgtgaagaaatctctactgtgtacgcaggggatatcgctgctgctgtaggtttgaaagacacgactacaggggacacgctttgcgacgagaaaaaccttgttatcctggaatcaatggaattccctgagcctgttatccacgttgcaatcgagcctaaatctaaggctgaccaagacaaaatgtctactgcactggctaaattggctgaagaggatccaacattccgtgcgcatactgaccctgaaacaggtcaaacgatcatcggcggtatgggtgagcttcaccttgatatcatcgttgaccgtatgaaacgcgaatttaaagttgaagccaacgtcggtgctcctcaagttgcgtatcgtgaaacattccgtgcgagcgcgcaagttgaaggtaaattcgtacgtcagtctggtggacgcggacagttcggacacgtttggatcgaattctctccaaacgaagaaggaaaaggctttgagttcgaaaacgcaatcgtcggtggtgtcgttcctcgtgaatacattccggctgttcaagcaggacttgaagatgcacttcaaaacggtgtagtcgcaggttaccctgttatcgacatcaaagcgaaactttttgacggttcttaccacgatgtcgactctaacgaaatggcgtttaaaatcgctgcttccatggcgcttaaaaacgcggcaagcaagtgtaacccagttattcttgagccgatctccaaagttgaagtcgttatcccagaagaatacatgggagacatcatgggcgacattacgtcacgccgcggtcgcgtagaaggtatggaaggacgcggaaacgctcaggtcgttcgcgcgatggttccactttctgaaatgttcggttacgctacggctctccgttcaaacacacaaggacgcggtacgttcacaatggtctttgaccactatgaagaagtgcctaagagcatcgctgatgagatcatcaaaaaaaatcaaggtgaataa

SEQ ID NO: 117 - DNA, 1191 bp, Bacillus licheniformis
atggctaaagaaaaattcgaccgttccaaatcacatgccaacattggtacaattggacacgttgaccatggtaaaactacattaacagctgctatcactactgtgcttcataagaaatctggtaaaggtactgctatggcatacgaccaaatcgacggtgctccagaagagcgcgagcgcggtatcacaatttctactgcacacgttgagtacgaaactgacaaccgtcactatgcacacgttgactgcccaggacacgctgactatgttaaaaacatgatcactggtgctgcgcaaatggacggtgcgatccttgttgtttctgctgctgacggcccaatgccacaaactcgtgagcacatccttctttctcgtaacgtaggtgtgccttacatcgtagtattcttgaacaaatgcgacatggtagacgacgaagagcttcttgagctagttgaaatggaagttcgcgatcttctttctgagtatgagttccctggtgacgatgtaccagttatcaaaggttctgctcttaaagctcttgaaggagatgctcagtacgaagaaaaaatctttgaactgatggctgctgttgacgagtacatcccaactccagagcgtgaaactgacaagccattcatgatgcctgttgaggacgtattctcaatcacaggtcgtggaacagttgctactggacgcgtagagcgcggacaagttaaagtcggtgacgaagttgaaatcatcggtcttcaagaagaaaacaagaaaacaactgttacaggtgttgaaatgttccgcaagcttcttgactatgcagaagctggagacaacatcggtgcacttcttcgcggtgtatctcgtgaagaaatccaacgcggtcaagtacttgctcaaccaggtacaatcactccgcacaaaaaattcaaagctgaagtttacgttctttctaaagaagagggtggacgtcacactccattcttctctaactaccgccctcagttctacttccgtacaactgacgtaactggtatcattcagcttccagaaggcgtagaaatggttatgcctggagacaacatcgaaatgactgttgaattgatttcaacaatcgcgatcgaagacggaactcgcttctctatccgtgaaggcggacgtacagttggttctggcgttgtttcttcaatcatcgaataa

SEQ ID NO: 118 - DNA, 309 bp, Bacillus licheniformis
atggcaaaacaaaaaattcgtattcgtttaaaagcgtatgatcatagaatccttgatcaatctgctgagaagattgttgaaacggctaaacgttccggagccagcgtttctggtccgattccgttgccaactgagaaatcagtttacacaatccttcgtgcggtgcacaaatacaaagattctcgtgagcaattcgaaatgcgtacacataaacgtttgatcgacattgtgaacccaacaccacaaactgttgatgctctaatgcgattagatttaccatctggtgtcgatatcgaaattaaactttaa

SEQ ID NO: 119 - DNA, 630 bp, Bacillus licheniformis
atgaccaaaggaatcttaggaagaaaaattggtatgacgcaagttttcgcagaaaacggtgatcttattccggtaactgttatcgaagctgctcctaacgttgtgcttcagaagaaaacttctgaaaacgacggctatgaagcgattcagatcggttttgacgacaagcgtgaaaagcttgccaacaaaccagaaaaaggacacgttgcaaaagcggaaactgctcctaagcgcttcgttaaggaattacgcggagtggatatggatgcgtatgaagttggtcaggaagtcaaagttgatattttctctaacggagaaatcgtagatgtaacaggaacatcgaaaggtaaaggtttccaaggcgctatcaaacgccacggacaatctcgcggaccaatgtctcacggttcacgctaccaccgccgtcctggttcaatgggaccggtagaccctaaccgtgtattcaaaggaaagctgttgcctggacgtatgggcggagagcaaatcactgttcaaaaccttgaaatcgtaaaagtagatgcagagcgcaaccttcttttagttaaaggtaacgttcctggtgccaaaaaatcactagtcactgttaaaagtgctgttaaatctaaataa

SEQ ID NO: 120 - DNA, 624 bp, Bacillus licheniformis
atgccaaaagtagctttatataaccaaaacggttctactgctggtgatatcgaattaaacgactctgtatttggaatcgagccaaatgagagcgtagtattcgacgctattcttatgcaaagagcttccttgcgtcaaggaactcataaagtaaaaaatcgttcggaagtacgtggcggaggtcgcaaaccttggcgtcaaaaaggtaccggccgtgctcgtcaaggatctatccgttcaccgcaatggcgcggaggtggtatcgtattcggtcctacaccacgcagctatgcatataaattaccgaaaaaagttcgccgcttggctatcaaatcagcattgtcttctaaagtgaatgacaacaacttgatcgttcttgaagatcttaatcttgatgcggttaaaacaaaagaaatggcagctatccttaaaggtctgtctatcgagaagaaagctttaatcgtaactgcggatgcaaacgagacagttgaactatctgctcgcaaccttccaggagttactgttgttgaagctaacggaatcaacgtcctcgatgttgtcggtcacgagaagcttgtgatgacgaaagcagcggttgaaaaagtagaggaggtgcttgcataa

SEQ ID NO: 121 - DNA, 288 bp, Bacillus licheniformis
atgaaagatcctcgtgatgttctaaagcgccccgtcattactgaacgttctgctgatttaatgactgaaaaaaaatatacgtttgaagttgacgtaaaagccaacaaaacagaagtgaaagacgctgttgaacaaatctttggagtgaaagttgaaaaagtcaacatcatgaactacaaagggaaattcaaacgtgtcggccgctactctggtatgacaaacaaacgcagaaaagcgattgttaagcttactgaagacagcaaagaaatcgaaatttttgaagcttaa

SEQ ID NO: 122 - DNA, 834 bp, Bacillus licheniformis
atggcgattaaaaagtacaaaccgacctctaacggacgtcgcggcatgacttcttctgatttcgcggaaatcactacagatcagccggaaaaatccttgcttgccccgcttcacaaaaaaggcggacgcaacaaccaaggtaaattaactgtacgtcatcaaggcggcggacataaacgccaataccgtattatcgacttcaagcgcgataaagatggtatacctggacgcgttgctacagttgagtacgatccaaaccgttcagctaacattgctctaattaactatgtagacggagaaaaacgctacatcctagctcctaaggggcttcaagtaggcactgaaatcatgtcaggtccagaagctgacattaaagtaggtaacgcacttccactgatcaacatccctgttggtacagttgtgcacaacattgaattaaaacctggaaaaggcggacagcttgtacgttcagctggtacatctgctcaagttcttggtaaagaaggtaaatacgttcttgtacgtcttaactccggtgaagttcgcatgattctttctgcttgccgcgcaacaatcggtcaagtgggtaacgaacagcatgaactgatcaacatcggtaaagccggacgttctcgctggaaaggcgttcgccctacagttcgcggttctgttatgaaccctaacgatcacccgcacggtggtggtgaaggacgcgctccaatcggacgtaaatcacctatgtctccatggggtaaaccaactcttggattcaaaactcgtaagaaaaagaacaaatcagataaattcatcgtacgtcgtcgtaaaaataaataa

SEQ ID NO: 123 - DNA, 279 bp, Bacillus licheniformis
atggctcgcagcttaaaaaaaggaccatttgtcgatgatcatctaatgacaaaaatcgagaaattaaatgaagcggataagaaacaagttgtgaaaacttggtctcgccgttctactattttcccgcaatttatcggtcacacaatcgcagtctatgatggacgcaaacatgtgcctgtttacatctctgaagatatggtaggtcacaagttgggtgaattcgcaccgactcgcacttacaaaggtcatgctagtgatgacaagaaaacaagacgctaa

SEQ ID NO: 124 - DNA, 345 bp, Bacillus licheniformis
atgcaacaagctaaagctgtcgcaagaacagtccgtattgctcctcgtaaggcacgtctagtaatggacctgattcgaggcaagcaagtaggtgaagcagtatcgatcttaaaccatacgccaaaagctgcttccccgattattgaaaaagttttaaaatctgctatcgccaacgctgagcacaactacgaaatggatgcaaacaacctggttgttactcaagcttacgtgaacgaaggccctacgttaaaaagattccgtccgcgcgctatgggacgtgcaagccaaatcaacaaacgtacgagccacattactatcgttgtatcagaaaagaaggagggataa

SEQ ID NO: 125 - DNA, 657 bp, Bacillus licheniformis
gtgggtcaaaaggtaaatccagtcggtcttcgtattggggttatacgtgattgggaatctaagtggtacgctggcaaagattacgctgacttccttcacgaagatctgaaaatccgtgaatttattaatcaacgcctgtctgacgcttcagtttctaaagtagaaatcgagcgtgcggcaaaccgtgtaaatattacgatccacacagctaagcctggtatggttatcggtaaaggcggttccgaagtcgaagcgcttcgcaaagcccttaacagccttactggcaagcgtgtacacattaacattcttgaaatcaaaagagctgatcttgatgctcagctagttgctgataacattgctcgtcaattggaaaaccgtatctctttccgtcgtgcgcaaaagcaacaaatccaacgcacaatgcgcgctggtgcacaaggaattaaaacaatggtttccggtcgtcttggcggcgctgacatcgctcgttctgaatactacagtgaaggaactgttccattgcacacacttcgtgcagacatcgactatgctacatctgaagctgacacaacttacggtaagcttggtgtaaaagtctggatctatcgtggagaggttcttcctactaagaagaaaactgaggaaggaggaaaataa

SEQ ID NO: 126 - DNA, 435 bp, Bacillus licheniformis
atgttaatgccaaaacgcgttaaatatcgcagagagcatcgcggaaaaatgcgcggccgtgcgaaaggcggcactgaagtgcatttcggtgaatacggtatccaagctcaagaatcttcttggatcacaaaccgccaaatcgaagcagcacgtattgcgatgactcgttacatgaaacgtggcggtaaagtttggatcaaaattttcccttctaagccttatacagctaagcctctagaggttcggatgggttccggtaaaggtgctcctgaaggatgggtagctgttgtaaaaccgggcaaagttttatttgaaatttctggtgtgtctgaggaagtcgctcgcgaagctcttcgtcttgcatctcacaaattgccaattaaaacgaagttcgtaaaacgtgaagaaattggtggtgaatcaaatgaaagctaa

SEQ ID NO: 127 - DNA, 225 bp, Bacillus licheniformis
gtgaagaaattggtggtgaatcaaatgaaagctaatgaaattcgtgaccttaccactgctgaaattgaacaaaaagtaaagtctcttaaagaagaacttttcaatcttcgctttcaattagcgacaggacaacttgaaaacactgctcgcattcgtgaagtgcgcaagtcaatcgcgcgcatgaaaactgtgattcgggaaagagaaattgctgccaacaaataa

SEQ ID NO: 128 - DNA, 264 bp, Bacillus licheniformis
atgagcgaacgcaatcagcgcaaagtctaccaaggacgtgttgtttctgacaaaatggataaaaccattactgttgttgtagaaacatacaaaaagcattcactctacggtaaacgcgtaaagtactctaaaaaattcaaagcacatgatgaaaataaccaagctaaaatcggagacatcgtaaagatcatggaaactcgtccattatctgcgactaaacgttttcgtctagttgaagttgtcgaagaagctgttattatctaa

SEQ ID NO: 129 - DNA, 132 bp, Bacillus licheniformis
atgattcaacaagagactcgtttaaaagtagctgataactctggtgcccgtgaagtgttaacaatcaaggtgcttggtggttctggacgcaaaacagctaacattggtgatgtcattgtttgcacgggttaa

SEQ ID NO: 130 - DNA, 312 bp, Bacillus licheniformis
atgcatgttaaaaaaggcgataaagtaatggttatctctggtaaagacaaagggaagcaaggtgtaattcttgcagctttccctaaaaaagaccgcgtaatcgttgagggtgtcaacatggtgaagaagcactcaaagccgactcaagcaaaccctcaaggcggaattttaaatcaagaggcgccaattcatgtgtcaaacgtaatgccgctcgatcctaaaacaggtgaagtgactcgcgtaggatacaaagtagaaaatggcaaaaaagttcgtattgcaaaaaaatctgggcaagttctagataactag

SEQ ID NO: 131 - DNA, 540 bp, Bacillus licheniformis
atgaaccgccttaaagaaaagtacaataaagaaattacacctgcattaatgaaaaagttcgaatacaaatctgtgatgcaagtgcctaaaatcgaaaaaatcgtaatcaacatgggtgttggtgacgctgttcaaaacgctaaagctatcgatagcgctgttgaagaactaacgtttatcgctggtcagaaacctgtcgttactcgtgcgaagaaatctattgctggattccgtcttcgtgaaggaatgccaatcggtgcgaaagtaactcttcgcggagagcgcatgtacgatttccttgataaactaatttctgtttctttaccgcgtgtacgtgacttccgcggaatttcaaaaaaatcttttgacggtcgcggaaactacacactaggaatcaaagaacagctgatcttccctgaaattgactatgataaggtaactaaagttcgcggtatggatatcgttattgtaacgactgccaacactgatgaagaagctcgtgaactgttaactcaattaggtatgccattccagaaataa

SEQ ID NO: 132 - DNA, 186 bp, Bacillus licheniformis
gtggctaaaaagtcaatgattgcgaaacaaaaacgcacaccgaagtttaaagtacaagagtacactcgctgcgaacgctgcggccgtccgcactctgttattcgtaaatttaaactttgccgtatttgtttccgtgaacttgcatataaaggacaaattcctggcgttaaaaaagccagctggtaa

SEQ ID NO: 133 - DNA, 399 bp, Bacillus licheniformis
atggttatgacagatccgattgcagatatgctgactcgtattcgtaatgcaaacatggtacgtcatgagaagctcgaaattcctgcttctaagttgaaaagagagatcgctgaaatcttgaaaagagaaggtttcatccgtgacgtagaattcattgaagataacaaacaaggcatcatccgtgttttcttgaaatacggacaaaacaacgagcgtgtcatcactggccttaaaagaatcagcaaaccaggtctgcgcgtttacgctaagtcaaacgaagtgcctcgcgtgcttaacggacttggaatcgcaattctttctacatcacaaggtgtgttaacggataaagaagcccgcgctaaacaggctggcggagaagtattagcatacgtttggtaa

SEQ ID NO: 134 - DNA, 552 bp, Bacillus licheniformis
atggaggtgtttggtatgtctcgtgtaggtaagaagctacttgagattccttcaggcgttacagttactctgaacgacaacactgtaaccgtgaaaggaccaaaaggagaattaactcgtacgtttcatcctgatatgaagattaaaattgaggacaatgtacttactgtagaacgtccttcagataataaagaacaccgtgcgctgcatggcacaactcgcagcatcatcggaaacatggttgaaggtgtatctaaaggttttgaaagaggtttggaattagtcggtgtcggttaccgtgcttctaaatccggaaacaaacttgttttgaacgttggatactctcaccctgtagaaatcgttcctgaaaacggaattgaaatcgaagttccatctcaaacaaaagtggttgtaaaaggtacagataaagaacgtgttggagctactgctgcaaacattcgcgctgtacgttctccagagccttacaaaggcaaagggatccgctatgaaggagaaatggttcgtcgtaaagaaggtaaatctgctaagtaa

SEQ ID NO: 135 - DNA, 372 bp, Bacillus licheniformis
gtgacccagatgattacgaaaacaagcaagaatgctgcacgtcttaaaagacacgctcgtgttcgtgcgaagctttcaggaacccctgaaagacctcgtctaaatgttttccgttcaaacaaacatatttacgcacaagtgatcgatgacgtgaacggtgttacacttgtgagtgcatctactcttgataaagactttaacgctgaaaatggcagcgatacggctgcggctgcaaaagttggagagcttgttgcaaagcgcgcttctgaaaaaggtatcacaaatgtcgtgttcgaccgtggcggttacctttatcatggacgtgtaaaagcattggctgatgctgcacgcgaagctggattagaattttaa

SEQ ID NO: 136 - DNA, 507 bp, Bacillus licheniformis
atgaatatgcgtcgtattgacccaagcaaattagagttagaagaacgcttagttaccgttaaccgcgtagcgaaagttgttaaaggtggtcgtcgtttccgtttcgcagctctagtcgttgtcggtgacaaaaacggtcacgttggtttcggaactggtaaagcacaagaagttccggaagcgattcgcaaagctgttgaagatgcgaaaaagaatttgatcgaagtaccaatggttggaactacaattccacacgaaatcatcggacgtttcggtgcaggaaacatcttgttaaaacctgcttctgaaggtacgggagtcatcgctggaggcccagtacgtgcggtacttgagcttgcaggtgtatctgatatcctttctaagtctttaggttctaacacaccgatcaacatgatccgtgcaacagtccaaggtttaagcgagctgaaacgcgctgaggacgttgcgaagcttcgtggaaaatctgtagaagaactgttaggataa

SEQ ID NO: 137 - DNA, 180 bp, Bacillus licheniformis
atggctaaattagaaattaccctcaaacgcagtgtaatcggacgcccggaagatcagcgcattactgtaagaacgcttggtttaaagaaaacaaaccaaactgtcgttcatgaagacaacgctgcaatccgcggtatgattaacaaagtatctcatttagtttctgttaaagaactttaa

SEQ ID NO: 138 - DNA, 441 bp, Bacillus licheniformis
atgaaacttcatgaattaaagcccgcagaaggttcacgtaaaacgcgcaaccgcgtaggtcgtggtattggttctggtaacggtaaaacagctggtaaaggtcataaaggtcaaaacgctcgttctggcggcggtgtacgtcctggattcgagggtggacaaatgcctttattccaacgtcttcctaaacgcggtttcacaaacatcaaccgcaaggaattcgctgtggtcaacctagacaaactcaacagctttgcagaagggacggaagttactcctgaacttcttttagaaacaggtgtaatcagcaagttgaaatctggagtgaaaattcttggcgacggtaaattagaaaagaaattaactgttaaagccaataaattctccgcttctgctaaacaagcaattgaggctgctggcggtacagctgaggtgatctaa

SEQ ID NO: 139 - DNA, 1296 bp, Bacillus licheniformis
ttgtttaagacaatctccaattttatgcgtgtgaaggatattcggaataagattatcttcactcttttaatgcttatcgtctttcgtctcggttcgttcattcctgtgccgcacgtaaacacagaagttttaaaggcacaggatcaaatgagcgtatttgggattctaaacacatttggcggcggtgcattgttcaacttctccattcttgcgatgggaatcatgccttacatcacagcttctatcatcatccagctcctgcagatggatgttgtgccgaagtttaccgaatggtctaagcagggggaagttggtcgccgaaaactagctcagttcacaaggtacttcacgatcgttcttggatttatccaggctttaggtatgtcttacgggtttaacaacatggccggcggcgcgttgattacagacccgggagtcggtacttatttgcttattgcgattgtactaactgctggaactgcttttttaatgtggctgggagaacaaattacgtctcatggagttggtaacggaatatccattatcatcttcgccggtatcgttgccggtattccgcagacgattaatcagatctacgctcagcagtttgtagatgctggagatcagttattcttgcaaatcataaaggttgtcgttatattggttgcgattttagcgattgtcgttggcgttattttcatccaacaggcggttagaaaaatctcaattcaatatgcgaaaggttcaggccgttcaccggttcctggcggccagtctacacacttgccgctgaaggttaacccggcgggagttattccggttatctttgccgtagcatttatcaccactccgcggaccgtggcaacattctttggctccaatgacgtcacgaattggattcaaaaaacgtttgattacacgcatccggtcggaatgggagtttatgcagcattgatcatcgcctttacctatttctatgcatttgtgcaggttaaccctgagcaaatggccgataatcttaaaaaacaaggtggctatattccgggagttcgtccaggaaaaatgactcaagatagaattacgagcattttgtatcgacttacatttgtaggctccatattcttggccgtgattgccattcttcctgtcttgttcgttaatattgctgggctgccttcttctgcacaaattggtggaacaagtttgctgattgtcatcggggttgcacttgaaacaatgaagcagcttgaaagccagctggtaaaacgaaactatcgtggatttatgaagcactag

SEQ ID NO: 140 - DNA, 654 bp, Bacillus licheniformis
atgaacttagtcttaatgggactgcctggagccggtaaagggacacaggctgaacggattgttgaagattttgggatacctcatatctcaacaggagacatgttccgcgctgcgatgaaagaagaaacggatctgggactcgaagccaaatcatacattgataaaggtgagcttgttccggatgaagtgacaattggtattgtcagggagagacttggcaagaatgattgtgacggaggttttcttctggacggatttccgagaacagtcgctcaagctgaagcacttgaggaaattcttaaaggacttggcaagtcgattgaccatgtcatcaacattcaagtcgataaagatgcattgatggaacgtctgacaggacgcagaatctgcaaaaactgcggtgcaacttatcatttagtctttaatccgcctgcaaaagaaaatgtatgcgacaagtgtggaggagagctttatcagcgtgaagacgataatgaagctaccgtatccacgcggttagaggtcaacatgaagcaaacccagcctttactcgatttctatgaagataaaggatatctcgtaaacattgacgggcagaagcacatcaatgaagtttacgctgatataaaggagcttctcggaggccgggacaaatga

SEQ ID NO: 141 - DNA, 747 bp, Bacillus licheniformis
atgattatttgtaaaactccccgagaaatcgaaatcatgcgggaggccggacgaattgtcgctttaactcatcaggagctaaaaaagcacattaaacccggcatctcgacaaaagaattggatcaaattgccgaacgttttattacaaagcaaggtgcaatcccatcttttaaagggtataatggttttcgcgggagcatttgcgtttcggtcaacgaagaactcgtgcacggtattccgggaaaacgagtccttcgcgacggggacatcatcagcatcgatatcggtgcgaagctaaacggttatcatggtgactccgcttggacttatccagtgggtacgatcagcgatgatgatcagaagctgctggatgtgacagaggagtctttatatagaggcttgaaggaagcaaaaccgggagaacgtttgtcgaatatttcccacgcaatacaaacgtatgtcgaaagcgaacaattttcagtcgtcagggaatatgtaggacacggggtagggcaggatctgcatgaggatccgcaaattcctcactacggtccgccgaacaaaggcccgcgtttaaagcctggcatggtcttggccattgagccgatggtcaatgcaggtacacgctatgtcaaaacattggctgacaactggacggttgtaactgtggacgggaagaagtgtgctcactttgaacacacgattgccattacggatgccggttttgagatactgacaaaagcctag

SEQ ID NO: 142 - DNA, 330 bp, Bacillus licheniformis
atgtatcggaaaacacctgaaattggacagttcgtacgcatgacaagaggccgcgaaatgaaccaatacgcagttgttattgatatagtcgatcatcatcatgtgctggtagcagacggagaaaagcgtaaatttcattctcctaagaaaaagaatatcaatcatttaaccttttatgattgcgtatctccggaagttcagaacagtataaacgaaacagggcgtgtgacaaacggaaaattgagattttctcttttgaaatttgtcagagagcaagttactgatttgaagaagggagaacacttgaatggcgaaagacgatgtaattga

SEQ ID NO: 143 - DNA, 219 bp, Bacillus licheniformis
atggcgaaagacgatgtaattgaagtggaaggtactgtagtcgaaacgctgccaaacgcaatgttcaaagttgaacttgagaatggccacacggttttggctcacgtatctggtaaaatccgcatgcacttcattcgcattttacctggagacaaagttacggtagaattatctccatatgacttaactcgtggtagaattacgtaccgttacaaataa

SEQ ID NO: 144 - DNA, 114 bp, Bacillus licheniformis
atgaaagtgagaccatcagttaaaccgatctgtgaaaaatgcaaggtcattcgcagaaaaggaaaagtaatggtgatctgtgaaaatccaaagcataaacaaaaacaaggataa

SEQ ID NO: 145 - DNA, 366 bp, Bacillus licheniformis
atggctcgtattgctggtgtagatatcccacgtgataaacgtgttgttatttcattaacatacatctttggaatcggtcgtacaacggctcagcaaatcttaaaagaagctggagtttctgaagatactcgcgttcgtgatttgactgaagaagaacttggtaaaatccgtgacgtgatcgacaaattgaaagtagaaggtgaccttcgccgtgaagtgtctcttaacatcaaacgtctgatcgaaatcggaagctaccgcggaattcgtcatcgtcgcggattgcctgttcgcggtcaaaatactaaaaataacgcgcgtactcgtaaaggtccgcgtcgtactgtacctaacaagaaaaaataa

SEQ ID NO: 146 - DNA, 396 bp, Bacillus licheniformis
atggctgctgcacgtaaaacaaacacgcgtaaacgtcgcgtgaaaaagaatattgaatctggaattgctcatatccgttcaactttcaacaacacgattgttactatcacagatgttcatggcaatgctctttcttggtcaagtgccggagctttaggatttaaaggttctaaaaaatccactccattcgctgcacaaatggctgctgaaacagctgctaaaggttctatcgaacatggacttaaaactcttgaagttactgtaaaaggaccaggttccggccgtgaagctgcaattcgtgcacttcaagctgctggactagaagttacagcgatcagagacgtaacgcctgttcctcataacggatgccgtccgccaaaacgtcgccgcgtgtaa

SEQ ID NO: 147 - DNA, 945 bp, Bacillus licheniformis
atgatcgagattgaaaaaccaaaaatcgaaacggttgaaatcagcgacgatgccaagtatggtaaatttgtcgtagagccacttgagcgtggatatggtacaactttgggtaactccttacgtcgtatccttttatcctcactccctggtgccgctgtaacatcgatccaaatagatggtgtactgcatgaattctcgacgatcgaaggcgttgttgaagatgttacaacgattatcttaaacattaaaaaacttgcactgaaaatctactctgaagaagagaagacgcttgagattgatgttcagggtgaaggagttgtaacagctgctgatattacccacgacagtgatgttgagattttgaatcctgatcttcacattgcgactcttggccaaaatgcgagttttcgagttcgcttaactgctcaaagaggtcgcgggtatacaccagctgacgcgaataaaagagacgatcagccgattggcgtcatcccgattgattccatctttacacctgtttctcgcgtatcttatcaagttgagaatactcgtgtgggtcagattacaaactatgacaaacttacgcttgacgtatggacagatggaagcactggaccaaaagaagctattgcacttggttcaaagattttgactgaacaccttaatatttttgtcggtttgaccgacgaagctcagcacgctgaaatcatggtagaaaaagaagaggatcaaaaagaaaaagttcttgaaatgactattgaagaactcgatctttcagtccgttcttacaactgcttgaagcgtgcaggaatcaatacagttcaagaacttgcgaacaaaactgaagaagatatgatgaaagttcgcaacctgggccgcaagtcgcttgaagaagtaaaagcgaaacttgaagaacttggacttggccttcgcaaagacgattga

SEQ ID NO: 148 - DNA, 363 bp, Bacillus licheniformis
atgtcatacagaaaactaggacgcactagtgcacagcgtaaagcaatgctgcgtgatcttacaacagacttgatcatcaacgagagaattgaaacaacagaagctcgcgcgaaagaacttcgctctgttgtagaaaaaatgattacacttggcaagcgcggagatttacacgcacgccgccaagcagctgcatacatccgcaatgaggttgcagatgcagagaaaaaccaagatgcacttcaaaaacttttctctgatgtagcacctcgttatgaagagcgccaaggcggatacacacgtattatgaagcttggtcctcgccgtggtgacggagcaccaatggctatcatcgaattggtttaa

SEQ ID NO: 149 - DNA, 846 bp, Bacillus licheniformis
atgaatcaagagcgattaatcgctgcagaagatatcacgtttcgctaccagaaagatgcagacaggcctgcgcttgatcacgtatctttccatgtgtcgaaaggagaatggcttgcgatcgtcggtcacaacggttcaggaaagtcgacgctcgcccgtgctttaaacggactgattctgcctgatgaaggatcgattaaagtaggcggtatcaagctgacggaagagacggtctgggatgtccgaaaaaaggtcggcatggtgtttcaaaatccggataaccaatttgtcgggacaaccgtccgcgatgatgtggcttttggtttagaaaacagcggagttccaagagaagacatggtggaaagggtggattgggccgttcaacaggtgaacatgcaagaatttctcgatcaagagccgcaccatctctcgggaggacaaaagcagcgtgttgcgattgcgggagtgcttgctgcccggcctgacatcatgattctcgacgaagcgacttccatgctcgacccgatggggcgggaagaagtgctggatacggtcagaaggctgaaagaccaaggaatggttacggtcatttcgattacccatgacttaaacgaagccgcgaaggccgaccggatcatcgtcatgaacagcggtagaaaatttgccgaaggcacgccgcaggaagtctttcgtctgaatcaagatctgattaaaatcgggcttgatttgccattttcttttcagctcacccaaatgctgaaggaaagcggtctggctctgaaaggcgatcatctgacacaagaaggattggtgaatgagctatggacattgaaatcaaagatgtag

SEQ ID NO: 150 - DNA, 870 bp, Bacillus licheniformis
atggacattgaaatcaaagatgtagagcaccgataccagatgaaaacgccttttgaacgcctggcgatctatgatgtcaacgctgtgattaaagaaggaagctatgtcgccgtaatcggccatacaggatcgggaaaatcgactttgcttcagcacctgaacgggcttttaaaaccgacaaaaggacagatacgcctcggcgaggacgttcttgaagcaggcaaaaagaataaacatctaaaagctttgcggaaaaaggtcggcattgtctttcagtttcctgaacatcagctgtttgaagaaacaattttaaaggatatcgcattcggtccgatcaactttggcatgagccgggaaaaggcggaagaaaaagcgagggaaatgctgaagctggtaggtttgggtgcagagctgtccgacaggtctccgtttgaactaagcggagggcaaatgcgccgcgtggccattgcgggagtgctggcgatggagcctgaggttcttgtcctcgatgaaccgacggcagggcttgacccaagaggccgcaaggagatcatggacatgttctacagcctccataagcagaggaacctgacgacaattctcgtcacccacagtatggaagacgcggcagcgtatgcagatgaactgattgtgatgcataaagggacggtcaaagcaaaagggacgccgcgggagcttttttcaaggaaagacgacattgccgctttagggcttgatttgccggaaacgattaaattccaaaaacgccttgaagagacgctggggattacgttcaaagcgccgattttgacgattgaagaagcagcctccgaagttaaagctctttttcaggaggaaaatgccctatga

SEQ ID NO: 151 - DNA, 798 bp, Bacillus licheniformis
atgatggacaatatcattatcggcaaatacgtacccgggaaatcggtcattcatcggctcgatccgcgtacaaagctgttaaccattttcctttttgtctttatcgtttttttcgcgaataatacggaaacatatgcattgctcggcctgtttacggttgcagccgccgctttgtcaggcgttccggtgcgattccttataaaaggaatgaagccggtgttctggattgtgctgtttacgtttctgcttcatatttttatgacaagggaaggaccggttctcgccgatctcggcctgtttaaaatttatgaacaggggcttgttcaagggatttttatttctctgcgctttgtttacctcatcatgatcacaacgattttaacattgacgacgactccaatcgaagtgaccgatggtttggagcatttgctcggtccgtttaaaaaattgaagcttcccgtccatgaactcgctctcatgatgtccatctccctcagatttataccgactttgatcgaagagacggataagatcatgaaagcgcaaatggcaagaggcgtcgattttgcgaacggcccggtcaaagaacgcgtcaaagcgatcgttcctctccttgtcccgctttttgtcagtgcctttaaaagagctgaagagcttgcaaccgcgatggaggcgcgaggatacaggggaggagaaggccgtacaaaatacaggcagctgacatggaaatggaaggatacttccgtgctcctcattttagctgttcttggcgttttgctaattttattgcggacttag

SEQ ID NO: 152 - DNA, 744 bp, Bacillus licheniformis
atgagaatgaagtgcacgatttcatatgacggacaccttttttacggctaccaagtgcagcctgggcaaagaacgattcaggatgagcttgaaaaagcgctgcaaacgctccataaagcgaaggagcgtattcctgtcgtttcatccgggcgcaccgacagcggcgtccacgcagtcggacagacgattcattttgacagtccgctatccattcctgaggcgaaatggccgtatgcattgaatgccctgctgcccgatgatatatcggtccgcaaggcggaagctgtcaatgatcaatttcatgcgaggttttctgcgaaaagaaaagaataccggtatatgatatacaggggcagacatccggacgtttttaaacgctactatgcataccatgttccttatgaccttgatatggagaaagttaaggaagcctcccgctatctggtcggaacccatgacttcacaagcttttgtgcgaccaaaaccgaagtgaaggataaagtcagaacggtccatgaactggaatggtctgacacaggggacggactgcagatgagaattgtgggaagcggatttttgtataacatggttagaatcattgccggtacgcttcttgatgtaggaaccggcaaattttcccctggtgacattgaaaagatgattcttgccaaaaaccgcgatgccgcagggcgcactgcaccggcacacggcttatatttatggcgtgttatctatgacaactaa

SEQ ID NO: 153 - DNA, 438 bp, Bacillus licheniformis
atgcgtacaacacctatggctaacgcaagtaatattgaacgcaagtggttagttgttgatgctgctggcaagacgctaggacgtctttctactgaagttgcatctatccttcgcggaaaacataaaccaacttacacaccacacgttgacactggagatcatgtgatcatcatcaacgctgaaaaaatcgagttaactggtaaaaagttaacggacaaaatctactaccgtcacactcaacatccaggcggtttaaaatcaagaactgctcttgaaatgcgtacaaactaccctgagaaaatgcttgaacttgcgatcaaaggcatgcttccaaaaggttctctaggtcgtcaaatgttcaaaaaattgaatgtataccgtggttctgagcatccacaccaagcacaaaaacctgaagtttacgaacttcgcggttaa

SEQ ID NO: 154 - DNA, 393 bp, Bacillus licheniformis
ttggcacaggttcaatattacggtactggccgtcgtaaaagctctgtagcgcgcgtgcgtttagttccaggagaaggccgtatcatcgtgaataatcgtgaaatcagcgagcacatcccatctgcagctctaatcgaagatatcaaacaaccattaactttgactgaaacagctggtacttatgacgttttagtaaacgtacatggaggcggcttctccggtcaagctggagcaatccgtcacggtatcgcccgcgctttgcttgaagcagatccggaataccgttcaactctaaaacgtgccggtctactgactcgtgacgcacgtatgaaagagcgtaaaaaatacggacttaaaggcgcacgccgtgcacctcagttctcaaaacgttaa

SEQ ID NO: 155 - DNA, 459 bp, Bacillus licheniformis
gtgaaaggattgtttcaatataattgggaagttcgacatgcatggtttaagtggtgcctcagccagccgcaagaggagctggtcaagaagcgttcaggcggaatgggaagcattaagaaaaatctgtttcatattgtagatgtggaagtaagctggatctacgccattttagaaaaaccggatattcaacctgattactctcattaccagacgattcagcagatcgctcggttttccgacctgcaccgctcagaaatagaaagtgtaatttttaattattccagcgccttcgaacatctgccggttaaagcggcttggtcagacgaagtctgtacgcaaggcgatattttaaggcatttaatcgcacacgagatccaccatatcggccaaatctccgtctggacgagggaatcgggctctgctccagtatccgcttcatatatagggcggaaaatataa

SEQ ID NO: 156 - DNA, 444 bp, Bacillus licheniformis
atggggacggtcgtatcttttaacaatgaaaaacaaaagaagcagatcaatttggaaaaacagcttctgcgcgaactgtctttggaaaaaatgctgaattctgcagaggaatgctttgctcctctttttcactttttttctaagcatacggatatcttatatgacggctgcatcgactttgccattgaggcatatttgctgggagccgagtacgggaagttcggctatcacggagaacccgttcatcgagcgatgatccgctcagaaaaagaagaaaaacagctactgcacgagctttatgaatatgctgtcagctggtctgaggcttttaatgttcaagctgcttatgaaccgctctattatgcctgcgaatacttcatccaaagctggtggaaggaaggcttcagccagcgggaaagacgctttaagcttcggctcagataa

SEQ ID NO: 157 - DNA, 714 bp, Bacillus licheniformis
atgaagaaaaaaataaaatggctcgggtttttactcggctttgtcgttttattatgtttatttcaatatcaattcaacaatgatgattcttggcggtcatggaatcttccgctgagcggcaaaatcatttatattgatcctggacacgggggcgccgatggaggggcatcaagcggtgaactccttgaaaaagacgtggctcttgaagtatccctaagaatcagggactatctccaggagcagggcgccttggtgatgctgacgcgggaggacgatcatgatctcgctcctgaagaaacgaggggactcagcagaagaaaagctgaagacttgcggaagagggtcgatatgatcaacaattctgaagccgatctttacctcagcatccatttgaatgcgattccttccgcgcgatggagcggtgcgcaaagcttctattacgggcaatatgaagagaatgaacgggccgccaagtttattcaggatgaattaagacataatcttgaaaacacgacgcggaaggcaaagcggatacacggaatttatttgatgcaaaatgttaaaaagcccggggcccttgtcgaaatcgggtttttgtctaacccggaagaggcaaaacagctggccaagcccaaatatcaggacaaaatcgcagcatccgtttataaaggcgtattgcgctactttacagaagacagagaccctcctgaataa

SEQ ID NO: 158 - DNA, 1059 bp, Bacillus licheniformis
ttgcgagaagacgatgtaaaaaagatagtcggcgatttggacgagccatttcttcacaagccgctcagagagctggatgccgtaaaagaaattaaaataaaacccgaaaaacggcacgtcagcgtaaaggtggcgctcgcaaaaacgggatctgccgaacaaatgcagcttcagcaggaaatcgtcatacggttgaaagaagccggtgcagagacggtcggcctgcgttttgaggagctgcccgaagaagtcgtaatgagttatcaagagtctgccaaagggcaggatcaatctctgctgaatagtgaaaaacagcctgtgtttttagctgtggcaagcggcaaaggcggcgtcggcaagtcgacggtgtcggtcaatttggctgtgtccctggcgcgaatcggaaagaaagtcggattaatcgacgccgatatttacggtttcagtgttccggatatgatgggaatcactgtacggccgacgatcgaaggagaaaaggtcgtgccggttgaaagattcggggtcaaagtgatttcgatgggattctttgtagaagacaatgcccctgtcatttggagaggccccatgcttggaaaaatgctgaataacttcttccatgaggttgaatggggggatgtcgattatattatcttagacctgccgccgggaacaggcgatgtagcgcttgatgttcactcaatgcttccaagctgcaaagaggtgatcgtgtcgacgccgcaccctactgccgcgtttgtcgctgcaagagcgggcgcgatggccttgaagaccgatcatgaaatcgtggggatcgttgaaaatatggcttattacgaaagcgtcaaaacaggcgagaaagaatatgtattcggcaaaggcggaggcgaaaagctcgcagaggaactaggcgttccaattctgggcaaaattccgctgaagcagccggattgggatgacagcgaatttgcgccgtccgtttatgatgaaagccacccgaccggcgccatttatttggatatcgccaaaaaaatcgacgaaagcattggcgcaaaagcttaa

SEQ ID NO: 159 - DNA, 582 bp, Bacillus licheniformis
atgttcaagaccgcaatgctatcgataagctgttttctgtttctatctgtaacagcttgtgctcccacggaccaagcagctgagatggactatgatcaaaccaaaaaaatggttgtcgatatattaaagacagatgacggaaaaaaagcgattcaagaaatattaaatgatgacaaattaaatgaaacacttgtaatggatgaaaaaactgtcaaagaaaccgttgaaaaaacaatgacctccaaaaaaggagctgaattttggaaaaaagtctttgaagatccaaaattcgctgaaggctttgccaaaacacttcaaaatgaacatgaaaaagtgctgaaaaaactgatgaaagatcctgagtaccaaaaaatgctgatgcaggtcatgcaggatcctgaaatggccaaaaaatacggtgaacttgtcagaagccaggaattccgaagccacctgcaggaagtcatatctgacactctgacaagccctctttacagaaagcagtttgaagaggaactgaaaaaagctgctgctgaaagcatgaaagaagaaatgaaaggcggcgaagaaaaacaaagctga

SEQ ID NO: 160 - DNA, 600 bp, Bacillus licheniformis
atgaaaagccgtaatctcgtccgatttttcttttccgtattgggtgtcggagctttgactacaagtattgtcggttttgccatagagtggggaagatataaggagctgtttctttccttcgaggtattggagattctgtctgttcttttctggtttatcggggttggcatgatctttagcgtgattgctcaaatgggatttgtgattttcttaacgattcaccgctttgcactggaaattttcagatctcattctttgtggaattcgattcagctgtttttgattatatttgtcgcgtttgacttggtttacttgcgctttctgttttttgaaaaagatggaggctccatcattccgtacatttggctgccgctctttattttggcggtaggcattgcggccgcttatgcaaagcaaaaacagtcctctaaaaaaacgttcgtttccgcattatttctaatgtttgtttttactgtgatggagtggttcccggcgttaagggtcaatgaagaggactggctctatttaatgctgcttcctttattagcctgcaacgcttttcagcttttaatgctgccaaaatttcaggcacgcgcttag

SEQ ID NO: 161 - DNA, 765 bp, Bacillus licheniformis
gtgaaccatttttatgtgtggcatatcaaacggattaagcagctaatcattattatgatagccgcttttgcgacagcaagttttttttatgtgcaaaacctgctccctcttcctgtgttttctacagaaggcggagcaaaagcggtatatagaggagattcagatacaaatgaagtagcccttacatttaatatcagctggggagatcaaaaggcaatgcccattttagacacattaaaagcaaacggtattaaagacgcgaccttttttctatcagcttcatgggcagagcgccacccggatgtcgtagaaagaatccgtaaagatggtcaccagatcgggagtatgggctatgcttataaaaactattcgcaaatgaagaaaagcgagatcaaaaaagacttagcaaaagcacgacactcctttcaaaaactcgggcttgacgaccttacgcttttaagaccgccgaccggccagtttaataaagacgtactcgatgttgctaaacagtacggctacaccgttgttcattatagtattaactcggatgactggacgaacccgggggttcaaaagatcgtccaaaacgtaaatggaacggtaaacgccggtgacatcgtgctctttcacgcttcagattccgccaaacaaacaaaagaagccctgccagagatcgtgcaccatctcagaagcaaggggctcaaaaacgtaacagtcagcgaattaatcgcaaatacggatgcaaaatcttcagaagtaaagtag

SEQ ID NO: 162 - DNA, 1170 bp, Bacillus licheniformis
atggcaagaacatacagaacgcgaataaagaaaagaaaaaagcagaaaacaaaaagaaggcttatcatattttcctttttggttgtttgtggattaatttatcttgcacttccaagcggtatgcgagatcaccaggaaaaccaattgcaagcaactgaaaaaaaggcacagcctgaagcaaagaaaaagccaacacaaaatgaaacaaaaaagagcaaaatcgtcacaaaaaatgataatgctcaattggatcaatatttgaaaagcattggattcagcggcacagcattgatcgtagaagatggaaaagtggtgacaagcaaagggtatttatatgcaaaccgcgaggaaatggttcccaatacaccagataccgtcttttatgtggggtcatcacaaaaagcgattattgcaacggcaattttacagctggaggaaaaaggattgctatctgtaaatgaccctgtttctaagtatcttcccaattttccaaacggctcaaagatcaccctttatcatttcttgacgcacacatccggaattaggggtcacaaagaaggccgcggatatatttcgccggaagatttaattaaagatatcgaaaaacggggtgtaaaatacccaacagggaaatgggattatagagactccaattactcggttctggcatacattgtttccatggtaagcggtgaaccagtcgaccaatacatcaaaaagcatatttttaaacctgccggtatgaaacatgcaggcttttataaaacatttgctaaagagtcaaatccatcgacaggatataaattaaacctgcaaaaaaagctttatacgcctgacatgccggatttatcacagctttacggggccggtgatatttatatgaccgcttatgacatgtatttgtttgataaagcactttacgaaagaaaaatcatttccaatgaaagttttatgaaaatgtttacgccgaataaagcaacatacggcatgggcttttatgtgtctccaggaagctattcaagccacggtgtcatgcccggctacaacatattaaacagtttcagtctgacagggagcagatacgtcattctattttcaaacatccaaaacaacattaagtcttttggcagtgtgaataatcggatcttctctattttaaatggattttga

SEQ ID NO: 163 - DNA, 165 bp, Bacillus licheniformis
atgaaaaaaagcggtttttctaagcgggcgattcttgtgaaagaaataaaaaacggttatgtgaaagcattttgcttccaaaaacaacagatcagaatgtttaaaatagagtccattttgtccgtgttcccatataaaaaaagaaattcagcccattatgcttaa

SEQ ID NO: 164 - DNA, 978 bp, Bacillus licheniformis
atgcttcagacaatcaataaaacacttggtaagattatgcctttgctgacgcctttaagcgttgtcagcggagtactgcttgcagattatttaaatgggctggcgagtcttgtgccgtggatttttgcgtttatgacgtttgccggcagcctgggagcaaattttcagtcgctgaaaacagcggtggctcatcccttgccgatgtttctcgctttatttgttttgcacatatttatgcctgttttggcatggagcacggggcatcttgtgtttagcggggattcattgacgattacagggcttacccttggtgttgtcattccgacgggtattacgagcatgatttgggctgcaatgtataaaggtaacatcggtttaaccctgtcaattattttagtggacacgattctttcgccttttattgttccattcagtctttccatcttggccggggcgcatgttgaaatggatgtcatcggcatgatgaaggggttagttggaatgattgtgattccttctttattgggaatgctcgtcaatcaattttcaacgccggagcggacagtgcgattaagcgcaaattgtgctccgttttcgaaagtcgggttagccgccgtagtggcgattaacagctcggtggtcgctccttaccttaaaaacgtcgatttaaagtttttaacgatagccgttacggtctttttggtggcatttacaggctacctgacagcttggctgataggacggctgatgaagcggccccaggaggaaatcgtggctttaatttttactggaggaatgcggaatattagcgcgggcgctgtgttggccactagcttttttccgcctcaagtggcggtgcccgttgtcattggcatgctgttccaacagattctggccgcgctgtttgggcatttgcttgcaagaagcgagctgaaaaaagcgcatcatttggacaaaaagacgagtctgccctcatag

SEQ ID NO: 165 - DNA, 414 bp, Bacillus licheniformis
atgaaaaccaatagagtaagtgtaatgatctggactttaatctccgcttttctgttttgttctatgatagtcgcagcttcactttctccgctcgctcattcaggccctcatgctaatgagtttggcactttggggatgtgggcggcaatcggaaccgttttgctcttttatatgctgcccctcgctgtttatatggccgggtttgatgcaatgaagtttgtaatggctgttctttgcggaattgggttaatcatcacgctgactatgagtccagtgtttgtgttgattggcgctattggcggaaatgcttctgcattactgggtgtcgcaggtctttgcgttctgttagcgattgtgaatgtgatttggctagtggttgcttttcgccggacgtcagcaagtgcctctttctga

SEQ ID NO: 166 - DNA, 870 bp, Bacillus licheniformis
atggatttttatcttgtggatgtgtttgcagaaacaaaatatacaggaaaccagctcgctgtttttaaagcagaaaagaacctatcaagtgatgaaatgcaaaaaatagccagggaaatcaatttttccgagactacttttatattgggaaaacagggaaacggcgggtacgatgtccgaatcttcaccccggaaaaagaaattccgtttgcaggacatccaacgctgggcacagcgtttatcattaagaatgaaatcgaaactgaaccatcttctaatgtcattttaaatgtaacagcaggcgcaataccggtgacgtttgaaaaaggtgctgatcaaatcatttggatgaagcaaaatccgcccgtgtttaaccgaacctttgataaagaaatgatggcgggggtaattggaatcgacacatctgatatggattcgaatttcccgatacaggaggtttctacagggcttccagcggttatcgtaccgttaaactcgttaaatgcagttaaaaaatgcaaaatcaacaaggatcggtttgaagctttcatgaaagaaacagaagcaagtctgctcgtttttactaccgaaacatatcatgaacaaaaccacatcaatgcacgagtattttgcgactgtttcagcgttcctgaagatccggcaacaggaagcgcaatcgggggtctcgcagggtatttactgcatcacggctattttaatcaacactacctcagcataagggctgaacaaggatttgaaataaaccgcccttccctgcttcatcttgaagcccaaataacggaaaacagcacagaaattcacgtcgggggaaacgtccacctgatcgctaaaggaagttggcaaatttga

SEQ ID NO: 167 - DNA, 1230 bp, Bacillus licheniformis
atgggaaaaaaagcaatctggctgcttgctggaatgtttgtcttcagtacactaaccgcagcagctgcctttccggacaaagaaaaaaaagcaaaggtctcaccgggtattgaagtgctcatgaacaaaaaaagcatattaaaaggaaaaagggtcggtctcattacaaatccaaccggtgtcaattcgacattaacaagcagcatcgatttgcttcaccaagcccccggtattgagctgaccgctctctatggtccagagcacggtgtaagaggagacgctcaagccggtgacaaggttgactcttatattgatgaaaaaaccggtctccccgtctacagcctctacggagatacgagaaagccgacaccggagatgttgaaaaacgttgacgtcctgctatttgatatccaagatgtcggaacacggttttacacttacatttacactatggcatatgcgatggaagcggcaaaagaaaatgatattccattcatcgtccttgaccgcccaaacccgcaaaacggcttaaaagttgaagggcctgtcctagatccggattattcttcatttgtcggaatgtatcccgtccctctaagtcacggaatgacggcaggagaattggcaaagctgtttaatgatgaatttaacatcggagccgacctaaccgtcataaaaatgaaaggctggaagcggcagatgttctttgaagacaccggtcttcctttcgtcctgccttccccgaacatgccgacgccggatacgagcatcgtctacccgggcacaggtttaattgaaggaaccaacatgtcagagggaaggggcacgacaaagccatttgaattgattggtgcgccttacatgaaaagtacggagctcgccgaaaaattaaacggtctgaagctgcctggcgtcagattcagagccgcctccttcaatccgacattttcaaagcatcagaataaactgtgccacggggtggagctttacgtgaccaacaggtccgcttttaagcctgtaaataccggtattgcgatcatcaaaaccgtccatgacctctacccggacgactttgagttcctcccttcaggcaatttcaaccgtctgatcgggaacggatgggtcaaaacaatgattgagcaaggcgcttcaattgatgaaatcgccaaaaaatacgaagcagagcaaaaacggtttatgaatatcagaaagaagtatttgctttattag

SEQ ID NO: 168 - DNA, 1932 bp, Bacillus licheniformis
atgaaaagatttcttcaatgcgcgttgattgcattgctgttatcgtctctcgctttgcagccggccgctcgcgaagcagaagcaaaacagcgtccggaacaaaacatcaaacaaatggtcagcagcatgtcgcttgaagagaaaatcgggcaaatgctgatgcctgactttagaaactggaagaaaaaaggggaatcgagcgccaaaggattaacagaaatgaatgacgaagttgctggaatcattgaaaaataccggctcgggggcgtcattctttttgctgaaaacgtcacaggcacagagcagactgtacggttaacggacggcctgcaacaagcgagccctgacattccgctctttatcacgatcgatcaggaaggcgggattgtcacgagactcgaatcaggcacaaacctggccggcaatatggcagtcggagcatcgagaagcagcaaaaacgccttcagatcaggaaaaatcatcggaaaagaattatcatcactgggcattaacgtgaatttcagtcctgtacttgatgtcaacaacaatcccgacaaccctgtcatcggcgtccgttctttcagttccaagcctgagctgacttcaaagctcggcatccagatgatgaagggccttcaggacgagcaaatgatcgccacagcaaagcactttcccggacacggcgatacagcggttgacagtcattacggattgccgcttgttccgcataatgaaaaaaggctgagaagtgttgaacttgcgccatttcaaaaggcgatcgatgcaggtattgacatgatcatgacagcgcatgtccagttccccgcctttgacgatactacctataaaagcaaaaaagacggcgaggacatcatggtgcctgctacgctttccaaaaaagtcatgacagaccttctccgcaaagatctcagctttaagggcgttgttgtaacagacgctttaaatatgaaagccatttctgataatttcggacaggaggaagccgtcgtcatggctgttaaagcaggagtcgacatcgcactcatgcccgcgcaagtcacatcgcttgagaccgaaaaaaatctggcgcgtgtattcgaagctcttctgacagccgttaaaaatggggatatccccatggaacaaatcgatcagtcggtggagcgaatccttcaattaaaaatagaccgaggcatcatagatcacaccggctccgaaccgcttcagaaaaaaatcaaatacgccttgaaaacggtcggcagcagcaaacacatgaaatacgaaaagaaaatggcaagggatagcgccactatccttaaaaacgacaaaagcaccctgccgtttaaaccgaaaaaaggggacaccgtcctcattctcgctccatatgaagagcaaacagcagcaatcgcaaagaccatcagcaaaataaggaaaaacatcaaggtagtcgaataccgctttgcagaaaaaacgtttgaggaagagattcaaaagaaaattgacgaagccgattatgtcatcacaggatcatacgtcatcaaaaacgatccggttgtgaacgacggtgtcattgatgacagcattcaagactcaagcaagtgggcaaccgcttttccgcgcgccgccatgaaatacgcgcaggccaacggaaaaaaattcgtcttaatgagcctgagaaacccttatgacacggcaaattttgaagaagccgaagccgtgattgcggtatacggctttaaaggctatgcaaacggacgcttcaggcagccgaatatcccggccggagtggaagccattttcggaaaggcaaagcctaaaggaacattgcccgtagacattccttcagtcacgcgccccggggaaaccctttacccgtatggctacggattgaatattaaaaacggcaagccgcttcacaaaggagggtcatga

SEQ ID NO: 169 - DNA, 1347 bp, Bacillus licheniformis
atgatcagtgcggccgcgtccctattgctgctgacatgcttttttccgcttccgtccacagcacagactgccatcgggaacgagacaaaacagcggctgacatatcctgttttaacgaaagcgaaaacgcctgaagaagccggtttttcttcgaaaaagcttaaagctgtggaccgtctgatcgaacaggatgtcaaagcgggctttcccggcgctgcccttattttgattaaagacggaaaaatcatcaaaaaagaagtctacggctacaagcagaaatacaacggcctcatagcgctcaaacatccaaaaaaaatgaaagcaaacacgatgttcgacctagcctccaatacaaaaatgtatgccgtcaattttgccttgcagcatttagtgagcaccggaaagcttgacttgaacaaaaacatttctcaatatctccctgatttcaaagatcacccggaagacgatgtaaagggaaaaaaccggctccgcgtgattgatttgcttcatcataacgcaggcttccctgcaagctggaattattacgacccgaaatcagccggacacctctactctcaatcacggagcaaaacgcttgaatatcttgtgaaaacccccttggcatatgaacccggcacaaagcaaatttacagtgacatcgactatatgctcctcgggctgatcattgaaaaaatcacaaacgagcgtttagatacctttgttgaaaaccggttttaccggcctctcggattgcggcatactttgtttaatccgctccaaaagggctttaaacggtcgcattttgcagctacggaacgattgggaaacaccagagacggcaccatttcgttcccaaacatcagaacttacacacttcagggggaagtccacgatgaaaaagcattctattcaatggaaggcgtttctgggcatgccggcctgttttccaccgttgacgacgcagcagtgctccttcaagtcatgctgaacggcggcggttacggaagacagcatctattcagcagttctgtcatttcacaatttacagagccgtcaaaaacaaatcccacatatggactaggatggcggctcaacggcaataccgatatggagtggatgttcggcaagcacgccagcagcaaagcatatggccataccggctggacgggaacggttactatcattgatcccgtgtatcaaatcggcattgtgttgttaaccaataaaaagcactctcctgttatcaaccctaaagaaaacccgaatcaattcgaaggtgatgaatttgcaaccggaaagtacggcagcgtcattacagctgtttacgaggcgttacatcaccaatag

SEQ ID NO: 170 - DNA, 1368 bp, Bacillus licheniformis
atgagcgatgagaaaaaatatgccgggctggcaagactgattttacaacacatcggcggcccgtctaacgtcgcagatcatacccactgtatgacgcgcctgcgcatcacgcctgtcaacagtcaaaaaaccgacatcgactcgatcaaagcgcttgaaggcgtgatcggcgtagttgaggaggaaacgcttcagattatcctcggcacaggcgttgtacagcacgtatcagacgagttcgggaagctgcttaaatccgcagaacacgttgacttaaaagaatccgcagccaaacataaagcggagatttccaagaaaaacgcgacgcctttcaagctgtttctccggcgaatcgcaagcatttttataccgctgatccccgctttggtcgcctcaggcttgattaccggaatcaccaaagccgttatccaggctggctggctcgcggaaacctcacaaaccgcgattattttaacggtaataggctcaggtctatttacgtatttgggtatcctggtggggatcaatacggcgaaagaattcggcggctcccccgcactcggcggattagccggtattttaatcattaaccccgccgttggtgaaatttcacttttcggtgaagcgcttttgccgggacgcggcggtttaatcggcattttattcgcagctgcatttatcgcttttctcgaaaaacgggtcaggcgccttgtacctcactcactcgacatcatcatcacacctacagtctcccttcttatcacaggaatcgtcacctacgttgtcttcatgcctgtcggcggcttgatttccgacgccattacgtcaggtcttctcgccatcttagatcttgggggcattatcgccggctttgtactgggcgccaccttccttccgctcgtcgtaaccggacttcatcaaggactgacacccgttcatatggaattaatcaattcaatcggcgatgacccgctgctgccgattttggccatggggggcgcaggacaagtaggcgccgcttttgcgatctatttcaaaacgaaaaaagcaaagctaaaaagagccattgccggcggactgccgtcaggcctgctcggcatcggcgaaccgctcatattcggtgtaacccttccgctcggacgtccgtttttaaccgcgtgcctcggggccggagtaggcggagcatttcaagcgtatttcaaaattgcgaccgtatcgataggcgtatcagggctccctttgtcgtttttggttcatacccaccaagttcttttgtatattctcggtttgtttatttcctatgctgccggctttgtcttaacatactcctttggtttcaaggacgatatggcagttgaatttgattaa

SEQ ID NO: 171 - DNA, 849 bp, Bacillus licheniformis
atggctgcaggaggattggaaatcattcagaatatgcttcacaaattgccgcaatctgaacgaaagcttgccgaatacattttgaaaaacccccacgagatcgtaaacggcaccattcaggaggtgagctcttcggcaaagacaagcggggcggcggcgatacggctctgcaaatctttggggctgaaaggctttcaagatttaaaaatgagagtcgccggtgatttaatgaagccgtctgatcagggataccgggatatcgaaccgcaggagccgctccattcaatcgttcaaaaaacaaccagcaattcgattcaggcgattcgcgatacctttgaaaacattgaccacgaagaacttcaaaaagcgattcaaatattgatcaacgcagaaacggttcatttttgcgggatcggggcttcaggaatcgtcgcacaagacgcccagcagaaatttttgcgcatcaataaaaaggccaccgcttttagtgatatgcatcttgttgcgacattaatcgccaatgccggcgagaatgacgttctgtttgctatatcccattcaggagaaacacaggaaatcgccaatgcagtcaggctcgccaaaaaacatggtattaaaaccattgggctgacgcggttgggacagtctgctgtcgcttcattaagcgatatcgccctgtatacgtcatgctcaaatgaagcgccgtttcgcagcgccgccacctcctctcgtttaactcagctttacatgattgacttactgtttttaggcatggccgcagagcgctacgaggacatcattcagtatattgatcaaacaaaagcggccatccgcatgatgggaatttag

SEQ ID NO: 172 - DNA, 915 bp, Bacillus licheniformis
atggaaaacagccatttaggttccttaacgaccgaacgccgcaatgaaagatccaagcgcattcaccaggcagaaacgatcgatatgttgaaaatcatgaatgatgaagataaaacggtagccgaagctgtacaagaagtcttgcccgatgttaagaccgccgttgactacgccgtcgggtcgttaaagaaagggggacggatcatctacatcggtgccggtacaagcgggaggctcggcgtacttgatgcagctgaatgcccgccgacattcagcatatctcccgagtcggtcataggcatcattgcagggggagaaaaagctttgtacaatgccgtcgaaggcgctgaagatcatgaggcttttggcagacgggatttagaagccgttaacctctcaaacaatgataccgtaatcggaatcgccgccagcggccgaactccgtacgtcctaggcgccctgaagtatgccaagaaaacaggtgccaaggccatatcgctgacatgcaatgaaaactcggcgatcagccaggcggcagatcacagcatagaagtagtcgtcggccctgaagtcattgccggatcgacgagaatgaaagccgcaaccgctcataaaatgattttaaacatgatctcaacggcggccatgatcaaaatggggaaagtctatgaaaacctcatggtagatgtaaaagtaagcaatgacaaattaaaggagcgggcgatccgcatcatccaaacggtcacaggtatgccaaatgaaacagcggcgcaagcattggaaatgtccaataaccaagtcaaaaccgccatcatcatgctgaaaacaaacgaagatgcagccgctgcagaaaaactgctggagaaatcagaaggcgatattgaaaaggccctatccatttatgaaaaatcttaa

SEQ ID NO: 173 - DNA, 453 bp, Bacillus licheniformis
atgatactggtaagttcatgtctggccggagtggaatgccgctataacggttcgcacagctatgtcgaaaaaatcaataagctcgttgaagaaaaaaaagcggtgatggcttgtcccgagctgctcggcggatttcaaacaccaagggaaccggccgaaattataggcgggacgggagaagacgttttagacggcaaagcggtgatcaagacacaatcgggaaatgacgtaacagacctatatgtaaaaggggcatatcaaacattggagatggcaaggcaaatcaaggctgatacgatcgtgctgaaggaaaacagcccgtcttgcggcagcagccatatatacgatggaagtttctcaagcaaaaaaatagccggcaacggccttacggcggcacttctgaaaaaagaaggcttccgtgtgatttccgaacatcaaatagacgagctgtag

SEQ ID NO: 174 - DNA, 915 bp, Bacillus licheniformis
atgttaaaacagcagatttcaatgatcggcgtgccgatggatcttggacagctgaggcggggagtcgatatgggaccgagcgcgattcgctgtgcaggtgttaatgaacggctggaatgtctttgtcaggatattgaagacctcggcgatatgacgatcgggcaaagagaggatgagaaagaaggcggggagccggcatctgaagagctaagaaatttgaaagcgattacaaaagcgagtgtaaaacttgctgagactgtcgataatatcgtagcttctggcgcttttccgctcgtgctgggcggtgaccacagcattgcgatcggaacgcttgccggccttgcgaagcattatcaaaacctgggtgtgatctggtatgacgcccatgccgatttaaatacaaaagaaacgtctccctcaggcaacattcacggcatgccgctcgccatcagcctgggaatcggccacgaagggctgaccgccatctatggaaaagaagctaaaattaaagcggagaacatcgtcatcatcggtgcgaggtcacttgatgacggggaaaaagaattgattcgcgacaaagggatcaaagtatatacgatgcatgaaatcgaccgcctcggcatgacaagggtgatggaagaaacgatagactatttgcgaggcaggacggacggtgtccatctgtcactcgatttggacgcgcttgatccgaacgatgcaccgggtgtcggaactccggtagcaggaggcatcagctacagggaaagccatctggctatggaaatgcttgaggaatcgaagctgattacgtccgccgagtttgtcgaagtaaacccgatattggatgagaaaaacaggacggcggaagcggctgtagccttaatgggatcgctgtttggcgaaaagctgctttag

SEQ ID NO: 175 - DNA, 564 bp, Bacillus licheniformis
atggaaacaatgattaaaaaaagaatcaaacaggtgaaaaaaggcgatcgtaacgcatttgcagacatcgtggatatttacaaagacaaaatttatcagctttgctaccgtatgctcggcaatgcgcatgaggcggaagatattgcgcaggaagcgtttatcagagcatacgtgaatatcgacagttttgatatcaaccggaaattttccacatggctttatcgaatcgcaaccaatttgaccatcgatcgtatccgtaaaaaaaagccggactattacttggatgcagaggtggcagggactgaaggactgacaatgtattcccaggttgcggcggatgttgcgcttccagaggatgaagtggtttctttggagctgcacagcaccatccaggaaaaaatcttaaggcttcccgataaatacaggacggtcatcgtattaaagtacattgatgagctttcactcattgagatcagtgaaatcctcaatattcccgtaggtacggtgaaaacgaggatacacaggggcagagaggctctcagaaaacaattaagggatctttaa

SEQ ID NO: 176 - DNA, 621 bp, Bacillus licheniformis
atgagctgtccggagcatattgttcagcttatgcataaataccttgacggagacatacttccggaagatgaaacgcgtttaaaagagcacctccaatcatgcgaaggctgcaaaaagcaccttcatgaaatggaaaaatccatcgctcttgtccagagcacgtcgcatcttacagctccggcgaactttacagccaatgtgctggcgaatctgccgaaagaaaagcggacggcatcgatcaacaggtggcttaaagcccatccgtttttagtggcggcggctttatttgcaattttgatgggcggcagctttttctccagctggaaaaacgatcacgatttcagcgtatccagccagcctaatcttgtggtgaaaaacaacacggtcatcgtgcctgaaggggaagttgtcaaaggcgatgtgaccgtgaaaaacggaaagctgattatagagggcaaagtcgacggcgatgtcacgattgtaaacggtgaaaaatatacggcttcagcaggacaagtcaccggtcagatccatgagatcaacgaggtgttcgactggatctggtataagatcaaatcgaccggaaaatcggtttttggtgtgaaggagtctaaagagtag

SEQ ID NO: 177 - DNA, 849 bp, Bacillus licheniformis
atgactgaattcttggaggacgaggaaatggcttttgaggatatccctttcttgcagtacctcggcgatgccgttgatattctccttgtttggtacgtaatatataaattaatgatggtcatccgcgggacaaaggcggttcagcttttaaagggaatcgtggtcattgttctcgtcaggctggccagtcaatatttaggattaagcaccctgcagtggctggttgaccaggcgatcacatgggggttcctggcgattattatcatcttccagcctgaattgaggagagcgctggaacagctggggcgggggcgctttttttcgaggagcggaacacctgaggaagagcagcagcagaaaacgattgatgcgattacaaaagcgattaaatatatggcgaaacgccggattggcgcgcttctgacaattgaacgggagacgggaatgggcgattacatagaaacggggatccctttgaatgcaaaggtcagctctgagctattgatcaacatctttattccgaacactccgcttcatgacggagccgtgattatgaaaaacgatgaggttgctgcagctgcctgctaccttccgctttctgaaagcccttttatttcaaaagagcttggaacgaggcacagagcagcagtgggaatcagtgaagtgaccgacagtctgacggttgttgtatccgaagagacgggcggcatcagcgtcgccaaaaacggagaccttcaccgtgatttatcggaagaggcattgaaaaatatgcttgaagcggaatttaagaaaaattcgcgggaaacttcctcaaatcgctggtattggagggcgaagaaaaatggataa

SEQ ID NO: 178 - DNA, 1317 bp, Bacillus licheniformis
atggataagttcttaaacaatccctgggctgtcaaagttgtcgcgttattgttcgcgtttcttctttactttgcggtccacagcgctcaggcgccgactccgaagaaaccaggtgaatcgtttttcccgacatcgacaacagacgaagcgacgctcaccgatataccggtcaaatcgttttatgatgatgaaaactacgtcgtaacaggcgtgccgcagacggtgaatgtcacgattaaaggcccgaccggaaccgtcaagaaggtcagacaagtgaaggattttgagatttatgccgacatgcaaaacctgaaaacaggcaggcataaagtcgagctgaaggccagaaatgttgccgacggcctcactctgaccatcaatccatcggtgacaaccgtgacgatcgaagaaaaaacgacgaaggaattcccggtcgaggttgatttttataataaaaacaaaatgaaagacggctacacgccggagctgccgatcatcaacccgaaaaacgtcagcgtcaccggctcaaaagccgtgatcgacagaatccagaacatcaaggcgacgatcaatttagagggcgtcgaccagacggttgaaaaagaagccaagcttacagtatacgacaaggacggaaatgtcctgccggttgaagtcagcccttccgtcgttaaaatcaccgttccggtgacgagcccgagcaaaaagattccggtcaaagttgaccggaaaggcagccttccggacggcatcagcatttccagcctcgatataagtccgggagaggtgaccgtctacgggccgcaaaatgttcttgattcgttagaatttgtcgaggccgacgagattgatttaagtaaaataaaggatgatactgaattggaagccggcattaaagtgccggacggcgctaaaaaggtgtcacccgaaaaagtgaaaatcaaggtgaaagttgacaaggaagaagagaaaaaactgaaaaacgtttcaattaaaaccgcggggctgaatgacagccgggatcttgaatttctcgatccgaagtcaggcaagctggatatcacggcaaagggctcgacagccgcgatcgaaaaactccagccttccgacgtcgagctctatgtcaatgtggcggatctcgatgacggcgagcacaatgtaaagctggaagtaaacggtccgcagaacatgacatggtcgctgccgcggcaaagcattcgagtgaaaatctcatctcaaacaacccaaaacgaaaaaaacaatggtcaggatgaagaagaagagaatcattctgaaaaggattcacaaccttcatga

SEQ ID NO: 179 - DNA, 1347 bp, Bacillus licheniformis
atgggcaagtattttggtacagacggtgtaagaggcgtggcaaacagtgaacttacacctgagctggcctttaaagtcggacgctttggcggatatgtcctaacaaaagataaggagcgtcccaaggttctgatcggccgtgacacgcgcatttcagggcatatgctggaaggggcccttgtagcaggccttctttcgataggagcagaagtcatgcgtctcggcgtgatttcgacgcccggagtcgcatatttgacgaaggctatggacgcggaggcgggtgtgatgatttccgcttcccacaaccctgtccaggacaacggaattaagtttttcggcggcgacggctttaagctttccgatgaacaggagcttgaaatcgagcgtctgatggatcagccggaagatcacctgccaaggcctgtaggcgctgatctgggcatggtgaacgactactttgaaggcggacagaaatatttgcagtttcttaagcagtctgctgatgaagacttcacaggcattcatgtcgcgcttgactgtgcgcacggggcgacatcttcgctggcgacccacctgtttgccgatcttgacgcagatgtatcgacgatggggacttctccgaacggattaaacatcaatgacggagtcggatcaacccaccctgaagccctggcagaatttgtgaaggaaaagggagctgacgtcggcatggcgtttgacggggatggcgaccgcttaatcgctgtcgacgaaaaagggaatatcgtagacggcgatcaaatcatgtacatatgcgcgaagtacttgaagagcgaggggcgcctgacggacaataccgttgtctccacggtgatgagcaacctcggtttctacaaagcgcttgaagcggaaggcattaaaagcgttcagacagcggtcggcgaccgctatgtagtggaggcgatgaaaaagggcggatttaccctcggcggagaacagtcgggacacctgattttccttgattacaatacgacaggcgacggactgctttctgcgatcatgctgatgaacacgattaaaatgacaggcaagccgctgtctgagcttgcggcagagatgcagaagtttccgcagctcctcttgaatgtgaaagtaaccgataaacataaagtaacggaaaacgaaaaggtaaaagcggtcatcgaagaagttgagaaggaaatgaacggtgacggccgcatccttgtgcgcccatccggcaccgagccgcttgtccgtgtcatggctgaagcgaaaacgaaggagctttgcgagaagtacgtaggccgcattgcagatgtcgtgaaagctgaaatgggagcagagtaa

SEQ ID NO: 180 - DNA, 1803 bp, Bacillus licheniformis
atgtgtggtattgtaggttatattggccagcttgatgcaaaggaaattttacttaaaggtttggagaagctggagtatcgcggctacgattcagctggaatcgctgtagcgaacgaagacggcgtacacgtgtttaaagaaaaaggacggatcgccgatcttcgcgcagccgttgatgcaaacgtgaagtcacaagcgggaatcggacacacgcgctgggcgactcacggagaaccgagccgtctaaacgctcatccgcatcaaagcgcatcaggccgttttacacttgttcataacggcgtcatcgaaaactatgttcaactgacgcgcgaatatttacacgatgtaacccttaaaagcgatacggatacagaggttgtcgttcaagtgatcgagcaattcgtcaataacggccttgacacagaagaagcgttccgccaaacgctcatgctgctcaaaggctcttatgcgattgcattattcgatcatgaaaacaaagaaacaatctatgttgcgaaaaataaaagcccgcttcttgtcggccttggagacaatttcaatgttgtcgcgtctgatgcgatggcgatgcttcaagtgacaaacgaatacgtggagcttatggataaagaaatggtgattgtcacagacaaaaaagtcgtgatcaaaaacctcgacggagaattgatgtcacgtgcctcatatattgcagagcttgatgcgagcgatatcgaaaaaggcacataccctcactacatgttaaaagaaatcgatgaacagccgcttgtcatgcggaaaatcattcagacgtaccaagatgaaaacggcaagctctccattcctggagacatttcaaacgctgttgctgaagccgaccgcgtctatatcattgcctgcggaactagctaccatgcaggtcttgtcggcaagcaatttattgaaacatgggcgaaagttccggctgaagtccatgtcgcaagcgaattctcttacaatatgccattgctttctgagaagccgctgtttatctttatttctcaaagcggagaaacggctgacagccgcgcggttctcgtacaggtgaaaaagctcggacacaaagcgctgacattgaccaacgtaccgggatccacgctttcccgtgaagcggactatacgcttttactgaatgccggccctgaaatcgcggtagcgtcaacaaaagcatatacggcgcaaatcgccgttctcgcaattttggcagccgtgactgcggaaagccgcggcaaagaactcggctttgatcttgtcaaagagctcggcattatcggaaacgcgatggaagccctttgcgaccaaaaagacgaaatggaaatgatcgcccgtgaatacttgaccgtaacacgcaatgcatttttcatcggccgcggcctcgactatttcgtctgcctcgaaggatccctgaagctgaaagagatttcttacattcaagctgaaggcttcgccggcggcgaattgaagcacggtacgatcgcattgatcgaagacggcacaccggtcatcgcccttgcgacacaggagcacgtcaacttaagcatccgcggaaacgtcaaagaagtgacagcccgcggcgccaacccttgcgtgatctccctgaaaggcctggaagaagcagacgaccgcttcgtcctgcctgaagtgcatccggagctcgcaccgctcgtctccgtcatcccgctgcagctgatcgcatactacgcagcgctgcaccgcggctgtgacgttgataagccacggaacctggcgaagagtgtgacggtggagtag

SEQ ID NO: 181 - DNA, 324 bp, Bacillus licheniformis
atgaacaatgaaacgtacattgaagttaacagaacatcgcagcttatgaataaaatgagaaaatttacagtgctgattgatggtgtcgaggctggaaaaatcaaagatggcgggagactgcgaattgatttggagcctggcgaacatgagatccaagtgaaaattgattggtgtgtaagccaagctttgaggtttactttagatgaaggagaagtgttaaagtttagatgcggaagtccggttcgtgggtggaagatgttcttcggacttttttatgtattggccgatccagagaaatactcgtttattgaactggaagaatag

SEQ ID NO: 182 - DNA, 609 bp, Bacillus licheniformis
atgttcaacttaattcttaaagatattatcttgcagaaaaaaacattggcggcttcgtttttggtattatgtgtttatttaatgttagatatttctccaatctgggttggggttgtatttagtatagttatatcgatgtatgccttttcaatagatgaaaagtcttctatacatatgcttctcaattctttgccttatacacggaaagagattgtcagttcaaagtatattgtcgtcgttctctttacatctatggtggctgcagccatatttatcgtacacttcatcattcaccgggaatttacgatctggaaagacatcttgctaatggttgccattgtgatgacagctgcttcattcatgctgccattctgttataaattcaaaagcaactatctcgtgattgcttctattgctgcatttggcttatatatgctaacgattaactttctcgtccaaaatttgaacgatcaaattagagagttcattcacatgcttctaaccttacaaaatacttttctctatctgatcgttgccatatcaattattacgctgtatgggtgttcatggcttctgtcgattcggatttatagaaataaagtgttttaa

SEQ ID NO: 183 - DNA, 882 bp, Bacillus licheniformis
atggacaatgtaattgaactccggcatgttcataaatcgttcgatggtttccagctcaaggacttttcgatgagcgtaaaaaaaggttttatcaccggatttatcggcggaaatggcgtgggaaaatcgacaacgattaaactgatcatgaacttattgcagcctgacagcggaacaattacggtatttggcatgaattacaaggagcatgagaaagaaatcaaacaacgtattggctttgtatttgattccaacatattttatgaacatttaacgttagctaaaatgaaagatattgtgaaaagatcctatgtcaattgggatgaacaagtatttaatgattatgtgaacacatttaacttgccgctcacaaaaaaaatcaagacgttctcaaaagggatgataatgaaagcatcattaaccgttgctttgtcccatcatgcggaattaattattatggatgaaccgacgtccggactcgacccgattttccgccgggagctgttggaaatcttgcatcagctcatgcaagatggggataagacgatctttttttcgactcatattacaactgatttagataagattgcagattatatcacgttcattgataaaggagagcacatctttacaaaggacttttacgaaattgaggaacaatatgcaattgtaaaaggcggaatggagttgttagaccgggagaccgaacaggaatttatagcggttcgaaaatcaactcatggatttgaagcattgactgcgaataaatcacgaacagaaaaaatctttggggacatggcgttaatagaaaaaccgacccttgaagatattatgttctatacgaagaaaggagccaaagaacatgttcaacttaattcttaa

SEQ ID NO: 184 - DNA, 378 bp, Bacillus licheniformis
atgaaaattataatttcaaatagttcaaagcaacccatttatgaacaaatttacacccaaattaaggatcaaattcttgcgaatgaattgaaacccggacagccgctgccttctatgcgccaattggcaaaggacatgaatgtcagtcttattacgtcaaagcgcgcttatgaagaactggagaagaatgggttcatttattccgtagtcgggaaaggctcttttgtatcagatcagaatgacgaaataatgaaagaaggaaaaatgaaagccatcgaagagcaattgtcggcagtgataaaaaacagcaaagacataggcgttacccttacagaattaaaagacttgcttaccattttatatcaggaggaagaatga

SEQ ID NO: 185 - DNA, 249 bp, Bacillus licheniformis
ttgcaatggctgaaggagcctgatcgtcattttaagccccatgaagggattgatatgaacacaatcggggtgtgtgtcagcccaatctcggacaaattgaaaatgacgcaatcgccggcttcccaatatctcgcgatccttttaagagccggcctgattaaggcggagcgaatcggaaagtatacgtactgcaaaagagatgaagaggccattggaaagcttgctgactttcttaaaacagagatatga

SEQ ID NO: 186 - DNA, 1173 bp, Bacillus licheniformis
atgtttagcacttggaaaatttatcttttagcaatcatcagttttttggtagggacctcagagtacatcatttccggtattttggatcagatcgcccacacactcgggataactttagctgcagcggggcagctcattacgatcttttcactggtgtatgctgttttcaccccggtcctgatggcgttgacggcaagtatggataggcgcaagttaatgatgtatgctctcggtttgtttgtgataggaaatattttggcttttaccctgcctggttatggttggtttgttgcagcgcgtgtcgttatggctttgggggcaggcatggttgtggtcacggccttaacgattgccgccaagatcgcaccggcgggtaagcagggcagtgcaattgctacagtcgtcatggggtttaccgcttctttgattataggtgttccactcggaagaatgacggcagaagcattagggtggaagtctgtatttgggggaattgctttattgggattcatcgcaatgattgttctattcttaacattgccgcatactgaaggcgataagcccgtccctttgcttcagcagctttcccttttaaagaaacggaaagtagcgatggggttatcggtcacttttttctggctcggaggatattccgttgcatatacttatctgtctccttaccttctgaccgtttcagggatcagcggcaatttgctcagcggcgttttgcttatatttggaatcgccagcttggttggatcgaagtttggcggatatagcactgataaatggggagttccttttacgctcgttggcgggatggcgctgcatatcatcgcactgattttgctgtcgcttgtcacccattcctatgtcggagtactgttgattctcatattatggtcgttcgccgcatggtctaccggcccgacgcagcaatatcacttagcgacgcttgaacccgaattgtcaggtgtattgctcggcatcaatcaatcgatgatgcaattcgccatggccgcaggtgcaggaatcggagggatttttgtagaaaaagtgtcgctggcttctattacgtggtttggggcattgggggttatgattgcgattgttgttgttttgacgaccttcagttcacggaaagcagcacatgtaagagaaatcagttcataa

SEQ ID NO: 187 - DNA, 405 bp, Bacillus licheniformis
atgaactttcaactcgaggaagccatcgaaatcctggagcgcacaccacaaacattgagtcagctgctgaccggattatcaaacccctggatcagctgcgatgaaggcgaagacacttggaacgcctttgatgtagtcggccatctgattgagggagaaaaaaacaactggttgccccgaatcaaaatgatcgtgacaaaaggagcaacggaaacttttccgccgttcgaccgcttcagccagttgaatcaaaacgacgggaaaacgattgaacagctgcttaacgaatttgctgaaatcagacgggcgaatctgaaaacattgcggcagattcttgatcctgaaaccgacttcgaacaaacggggatgcacccggagtttggaatcgtcaagcttagagaatag

SEQ ID NO: 188 - DNA, 1737 bp, Bacillus licheniformis
atgaaaacagaaaacaacaatagcatgaaaccgtttttctcaatgattctcacatccggcgtacccaggctggctttaagcgccggtttgaccgcaagcctcgtcacgactttggtcggcttgtccattccgctgttgacaagggaaatggttgacggcttttccgccaattcgatcaatctggccttatcgggaatccttgcgctcgtttttatcgttcaagcggtctgcgacgggttttcgacctattttctttcttacgccgggcagaaagtggtcgcttccctgcgggagcgcatgtggttcaagctgctgcgccttcctgtccgctactttgacgaaaagacgagcggcgaaaccgtcagccgagttgtcaatgataccggcattgttgaaagcttgatttccgaccattttccgcagtttgtttccggaatcatcaccattgtcggatctgtggtcattctgctgatcatggattggaaaatgacgcttcttatgctgatctccgttccgatcacgaccttcatcatgatcccgctcggcatgaaaatgcagcgcatttccaaaacaatgcaggatgaaacagcttccttcaccggacatgtccagcagacattaagcgaaatcagattgatgaaagcatcaaacgccgagcatacagaaaaaatgaaagggttatcaggcatttcaaagctctttcaatacggcctcaaggaagctcggatattcgcgctcgtctccccgttcatgcaccttgtcattatgattgtgatcgtcgccatcatcggctacggcggcatccgcgtctctgaagggacgatgtcggcaggctcgctgatcgcctttttgctttatctgtttcaaatcattttcccgatcacatcgttcacaatgtttttcactcagctgcaaaaagcaaaaggggcaacagagcggatcatcgagattatgcattctgaagaggaagaaggccaggaagggcttgagatggacatctccaatctgccgatacatgtcgagaatgtaactttcacttacgccggtggcgagccggtcttacgcggggtatctttcgacgtcgatcccgggcagatgattgcgtttgtcggtccgagcggcggcggaaaaaccacgatgttcggcctcttggaacgattttacgaaccggactcaggagccattaacatcggggaaacaccgatcagcaagctgtcgatgaaatcgtggcgcagccagatcggctacgtatctcaagacagcccgatgatgtccggcaccatccgtgagaacttatgctacggcttggatcacgccgacagcattgatgatcaagaactgtggaaagtcgcggaaatggcgtatgccgatacatttattaaacaattccctgagcagcttgatacagaagtcggcgaacgcggcgtcaagctgtccggcggacagagacagcggatcgccatcgcccgcgccttcctgcgcgacccgaaaattttaatgatggacgaagcgacggccagcctcgacagccaatcagaagccatcgtccagcaggcgcttgcccgcctcatggaaggccgcaccaccttcgtcatcgcccaccggctatcgacaatcgtgaacgcggaccaaattatgtttatcgaaaaaggcgagattacagggcggggacggcaccatgagctgattgcttcgcatgcgctgtatcgggagtttgctgagcggcagttgacgtga

SEQ ID NO: 189 - DNA, 645 bp, Bacillus licheniformis
atgacaataaatattaaagtatattccgattatgtctgtccattctgttttctcggaaaagaccagctcgaaaaagcgatcgaaggcaaagatgtggaagtcgagtggctgccattcgaactgaggccgcgcccatcggagcagcttgatccgttaaacgacccggccaaattggcgatgtgggacggcgccattaagccgcgaatcgaggcttggggcgtcaatatgaagctgccgaacgtctctccgcatccttatacagatctggctcatgaaggctatcacttcgcaaaagaacacggtaaagggaaagcgtacaatgaccgggtttacaaagcgttttttcaggaagagcaggatatcggcgacatcgacgtattaacgtcgctggccaaagaagccggactggatgaacatgcttttaaagaagctttaagcgcaagaacatatcaggacgtgcagcggaaggcgctccaacacgcttacgaagaagccggcatcacggccgttccgacttttatcatcggcaatgagcggattgccggagccgcggcgaaggaagtgtttgaacaggcgatcgaaaaagaaagcagacaaaaacctgttgacggcttgcagtgcgatcttgacggaaacaactgctaa

SEQ ID NO: 190 - DNA, 420 bp, Bacillus licheniformis
ttgacacttcatcattttattgcagccgatcgggagcttccgctggggagcttccgagaccaaacagaagaaggtttgattagcatcgttaagcttgatccaggatacgaaatggtcaaaacaaaactcagcaagccgtttgtatatgaggcaaccggctgtttacatagacccggaaatgacataagggcgctattcagctatatcaattcaaatattcccgagggtgaagatatagaagtttactcttgctgggacggtgaggaagacaaagaaaaagacgaccgcttagactttttcattgatatagagaaccttcagctgggcaagcatgtcaagctggataaaaagaaatacatcgatgaaattgccggcctgttttatttcgaggagcggcagctggtcaagattcgcaaataa

SEQ ID NO: 191 - DNA, 525 bp, Bacillus licheniformis
atgtccgatcacaaagcggtacacagcgttcaagcgaaagcggaggggaaaactctggtcatggagcggagtttcgaggcgccacgggagctggtgtttaaggctttttctgggtcagtgcatttggaaagctggtgggggccgaaaggatggcagactgccaacagcaggtttgagtttcagccggatggcgtatggctttactgtatggaatgcagagatcaaaaccaaggcgaattctatggccggaaatcttgcggcaaggctgtttttcaagagattgcggcgccggaaaagatcgtgtacacggatatgtttacagacgaggaagggaatgttgttcccggcatgccggagattttgaatgaggtttattttcaagagcgcgacgtggggacaaaactgattacacgctcacatttttcttctccgaaagagcttcaacagctgctggataaggggatggtcgaaggcttttcttcacagctggagcgccttgaagactacctgaaagccattcgctaa

SEQ ID NO: 192 - DNA, 891 bp, Bacillus licheniformis
atgcgtacagagcaggaaatcatcgatttggtgctgaaggtcgcacgggaggacagccgtgtcagagcggtcggcatgaacggctcgcggacgaacccaaacgtcccgcggacgaacccaaacgtcccgaaggacccttttcgcgattatgatattgtctatgttgtaacagatatgcagtcttttctcgatgagccgggctgggtggacgtttttggagagcggatcatcatgcagacgccggaagcgatggagctgtttccgaatgagcttggcaaccgcttttcgtatttgatgttatttacagacggcagccgcattgatttgattcttgtgccgcttgaagaaaagctggaatatagcagggaagacggcttgaccgtgatcctgttggataaggatcaggatctgcccgtcatcccgccgccgacggatcgggaatattgggtgcaaaaaccgtccccgcaatgcttcgccgactgctgcaatgaattttggtggacatcgacatatgtggccaaaggcttgtggcggcaggaaattctttatgcactcgatcatttaaatctcgtcagggccatgctgttgaaaatgctcgaatggaaggtcggctttgaaacgggcttttcgctgagcataggcaaaaatgcaaaatttttggatcgctatgttgatcaaaatacgtgggaaaggcttttggagacgtatccgccagctgattataagcgggtatggaacagtttgtttaagatgtgggagctgtttgaagagacagcagcagcagttgctgaacatctgaatgaacaataccttttcgcagaagcggagaaagtcagacagtatctgaggcgcgttcagcagctgaaacctgatgcaaaggaaattgactaa

SEQ ID NO: 193 - DNA, 948 bp, Bacillus licheniformis
atgttcagtattaaaaaaatgctgcagaaccattatggaatcgacagtgtgaacatttctcccgagcaaggcgggtggacagcacttgcttatcaagtaaccgacggtgaagcggctttctttttaaaagtgtatgataaaaatagggcatcgacagcgaaatgggcagctttaatcgatgattacatccctgttctggggtggctgggggatcacaccgctctcaacgggaggctgcctgtgccgcttttgacaacagctggagaatacaagtgtgaagatgacgatgcggtgtatatgctttatgaatacattgccggtgaaaccattggagatcagccgctcggcaaagggtgcgtggagaagctcgccggaatcatagcggagctgcaccgatatgatgagacgatcccggtgaagacagaaggaattaaagaaaaatatgatatttcgtttttagatgagatgacacaatggcttgatcacctgccttgtgagctggcgacactcattcaaccctacagcggagcaatccgcgatatgatggagtcagccttatccctggcggatgatttgaaatgcagcggcagaagattggctttgtgccatacagatgttcatggctggaatttgatgaaaacgggcggggaattgattctgatcgattgggagggcttgaaactggcccctgttgaagcggatctgatgttctttgctaaccagccgtatgctcaagagtttttgcgcgtttactgcgagactcataaaggatttgaaatcgatcagaacgctttgcggttttatcagatcaggcgaagactggaggacatatgggagtttacagagcagctggcgtttgacattcagacagagaaagaaaaggcagagacgatgagcttgctgaaaaacgagcttgaagccataaaagacagcaagaccggctactaa

SEQ ID NO: 194 - DNA, 720 bp, Bacillus licheniformis
gtgaaaaattatcgtactttattttttgatgtggatgatacactattagacttcggtgcggcagaaaagtcagcattgcgaatgctttttgaggagcagcaaattcgtttgacagctgaaatagaagcgaattataaacgaatcaatcaaggtttatggagggtgttcgaaaaaggggagatggaccgcgaccaagtggtgaacacacgcttttcccttttattcaaagaatatggtcttgaggctgacggcgttttgcttgagaagaagtatcgcagcttccttgaagaagggcatcagctgatagacggcgcttttgaattaatcaaaagcctgcgggatcaatatgatttatatatcgtgacgaacggtgtttcaaaaacgcagtataagcgcctgcaagcttcaggattgtacccgatgtttaaagggatttttgtttcagaagacaccggttttcaaaagccgatgaaagaatactttgattacgtttttgaacggattcctcatttttctgtcgatcaggggctgatcatcggggattcattgacagcggacatagaaggggggcggctggccggattggatacatgctggatgaatccgggcatgatagcaaatgacactggtattgtaccaacctatcaaatacaaaaacttgatgagttgtattatattttaaacattgaaaaagaatcggccgccggccattgtttataa

SEQ ID NO: 195 - DNA, 1371 bp, Bacillus licheniformis
gtggcgaacaaagaattgaagagaggcctgggcgcgcgccacatccaaatgattgcgcttggcggcactatcggcgtcggtttatttatgggatcttccagcacgataaagtggacaggaccttccgtcctgcttgcttatgccatttgcggaatttttatcttttttattatgcgtgcaatgggggaaatgctatatgtagagccaagcaccggttcatttgcgacattcggccatcaatatatacacccgttggccggatatatgaccgcgtggagcaactggtttcagtgggtgattgtcgggatgtccgagatcatcgccgtcggggagtacatgaagtactggtttccggatcttcccgcttggataccgggcattatcgcaatggcgattctcggaggagcaaaccttgtctctgttaaatcatttggtgagtttgaattttggtttgcgatgattaaaatcgttacgattgtattaatgattgcagcggggttcgggattattttcttcggattcggcaacggcggacaagcgatcgggttttcaaacctttggtcgcacggcggtttctttacaggcggattctcaggattcttctttgcgctgtcgctggtcatcgccgcttatcaaggggtcgaactgataggaattacggcgggggaggcaaaagatccgcaaaacacgctgagacacgcgatccaaagtattatttggcgtattttaattttctatattggcgccatcttcgtgattgtcacagtctatccttgggatgagctgaatgcaatcggtagtccgtttgtatccacttttgcgaaagtcggaattacggcggcagccggcattattaacttcgtcgtcatgacggcggcaatgtccggctgcaacagcggaattttcagtgcgggccgcatgctttatacattgggagtaaacggccaagcgccaaaattctttacgaagatttccagaaatggcgtgccgttatacgggacgattgccgtcttgatcggtttggcaatcggcgtcgttttaaattatattgcgccgcctaatatttttgtgtatgtatacagtgcgagcgtgctcccggggatgattccgtggtttgtcattctgctcagccatatcggattcagaaaagcaaaaggagctgaaattgacaaacatccgttcaaaatgcctttcgccccagtgacgaactatttgacgattggtttccttcttatggtattggtgggcatgtggttcaacaatgacacacgcgtgtctctgattgtcggggttattttccttgcggttgttgccgccagctattatgtgtttggaattggcaagcgtgcctcagctgatgggaataaataa

SEQ ID NO: 196 - DNA, 1299 bp, Bacillus licheniformis
gtgttagcaattttaggttttttcatgatgcttgtgtttatggtattgatcatgacaaaacggctttctgttctgacggcattagtcttgacaccgatagtgtttgcgctgatcgccggattcggattcagcgatgtcggcgacatgatgatttcggggattcagcaagtcgcgccaaccgccgttatgattatgtttgcaattttatatttcgggattatgattgatactggcctgtttgacccaatggtcacaaaaatattaaaaatggtcaaaggcgatccgttaaaaatcgtcgtcggcactgcggtgctcacgatgctggtcgcattggacggagacggatcaacaacatatatgattacaacgagcgcgatgctcccgctctatttgctgcttggcatccgcccgattatattagcgggaatcgcaggagtcggcatggggattatgaatacgattccatggggaggcgcaacaccgcgggcagcgagtgcgctcggggttgacccggctgaattgaccggcccgatgatacctgtcatcgtaagcggcatgctttgtatgatcggagttgcgtatatgctcggaaaagcggagcgaaaacgcctcggcgtgattgaactcaaacatccggctggtgccaatgaaacggccgccgctgcggaggatgagtggaagcgtccgaagctttggtggttcaacttattgttgacgctttcattgatagggcttctcatatcaggaaaagtaagcttgaccgttctgtttattatcgcgttctgcatcgcattgattgtcaattatccaaacctcgatcatcagagacagcgaatttcggcgcattcgagcaatgtattggctatcggttcaatgatatttgccgcaggggtctttaccggaatactaacaggcacaaaaatggtagatgaaatggcgatttcgcttgcgtctatgattcctgaacaaatgggcggctttattccgatgatagtagccttaacaagcggcattttcacttttctgatgccgaatgacgcttatttttacggagtgctcccgattttatcagaaaccgctgtcgcatacggtgttaataaggtcgaaattgcaagagcctccatcatcggccagccgattcacatgctgagcccgcttgtgccttcaacacatttgcttgttgggcttgtcggggtttccatcgacgatcatcaaaaatttgcgataatgtgggcggtgctcgctgtcatcgtgatgacaggatgcgcgcttctcatcggatccatatcaatttattga

SEQ ID NO: 197 - DNA, 918 bp, Bacillus licheniformis
atgtcgggggatgaaagacaatcgtccgccccgcgtcccccgggagggccggttgaaatcgtcgtacccgctgagccttcgggcggctgggatttaacggctcaggcgatacaatccgtccttaaacaaaaacaagtgataaaaagcgaagtgaagatcgtctataaacccggaagcggcggtgacaaaggctggaagtatataaatagcagcgatacgtacaccatcggcatgacatccagcttaatgctgagcaattacattctcggacagagcaaactgaaaacagacgatttcaccccgctggcgattcttgcaaaagaatggcagacgatcgctcttccaaaaggatcggaaataaagagcggaaaggatttgctgaatgagatcaaaaagaaccccggcaaggtaaaaatcggtttttcccccggacttggcaatgatgaccagctgtcattcgtcagggcggccgatatgtacggagttgacccttttaacattcaatatttacagtatgaaagcagcgaagagctcattcaggcgcttatcagacatgaaattgacgccgcatcgatgactctatcagaagctaaaacatatgaaagaagcggcagcatcacacttggggctgttacttcagacaaaaggcttcccgcatatccgcatgtaccgacgtggagagagcagggcatcccgtttgtattttcccattggagaggtgtattaggcccgaaaaatatgaccaaagaagaaatttcctactgggatcaagtgtttaaaaagatcacatcctcaccggaatggaagcagaaaataaatgaacaggaatgggaaagctattatttaaacagcaaggagacgcaacgattccttgaggagcaatcagcattttatcaaaacatcatggctggggattaa

SEQ ID NO: 198 - DNA, 681 bp, Bacillus licheniformis
ttgattgatatcgtgatcgcggaggatgatttccgtgtagcgcaaattcatgaaagattgatcgaacagcttgatggattcaacattatcggtaaagcggccaatgccaaagaaacaatggaaattctcgaggtccgaaaggccgacttgctgctgttggatatttacatgccggatgagatgggcacaacattgattcctgtcattcgaaaacggtttccggaagtggatatcatgatcatcacagcagcaaccgaaacatgtcatttacaggaatcgctccgggcgggaattgtgcactatttgattaagcctgtgactgccgaaaaattcaaacaggtgctgcttcaatataagaaaaaaaggcaaacactgctttctcagccacaggtcagccaatcaatgattgaccaaatcttcggagacttctccagcggatcccgtcaggctgaggatttgccgacaggtatcaattcgattacactgcaaaaaatcagggatgttctgcgagacgcagctaaaggaatgacagccgaaaaactcggtgaaaaaatgggggcttcacgtacaacagcccgccgctatgccgaatatctcgtgtcaaaagaagaagcgcgcgctgagctggaatacggaattatcggcagaccggagagaaaatactatttggcggatgaataa

SEQ ID NO: 199 - DNA, 1617 bp, Bacillus licheniformis
gtgcctgtggtcaaaaaacgggtcaatttttctctgcaaacaaaaattatgggcttgattgcagcactgcttatcttagtaatcggcttgctgacagtcacgtttgccgttcagcaaacaaaagaaggaagaaaacagtccgaacagcttgccgttcagactgcaaaaaccatttcttatatgcctccggtaaaagagctctttcaaaagaagcgcgggcataagggagaggcgcaagaggtcattgaacaaatgaaagaacagaccggtgcctatactatttatgtcctcaacgaaaagggagagatcaaaatcgcctcggaaaagagaggtcaaacgaagctgacaagaagcagaaaaatcttgttcggcggctctcacatctctaaaacaaaaaacgatggccgcatggtgatcagaggaagtgcgccgattatccaggaacaaagtggttacagcaaggtcatcggcagtgtgtctgttgattttctgttaaacgagacagaacaacgtattaaagagaatgtgagaaaattgagcttcatggctgttctcgttttgctcataggatttgcgggtgccgccgctcttgccaaaagcattagaaaagatacgcttggccttgaaccccaagagattgcatctctttaccgtgaacgaaatgcgatgctgcgtgcgattaaagaagggatcattgccaccaaccgtgaaggagtcgtcacaatgatgaacgtatcggcagcggaaatgcttaggcttcccgaacctgtggtcaaccggccaattgatgacatcctgcccggagccggaataatgtctgtccttcagcagcggcagatgttgctgaatcaggaggtctgcgtcaacgatcaagtgtttattttaaatacaaaaatgatgctccaaaacggtcaaacttacggaattgtcgtaagtttccgtcaaaaaaccgagttaaaaaggctcattgacacgctgacagaggtgcaaaaatactctgaagatctccgcgcgcaaacacatgaattctcaaataagctttatgtgatcctaggcctgcttgagctaggtgagtatgaagcagcgatcgacctgattaaagaggaatacgccattcaaaatgaacagcacgacattttattcaaaaacattcattctcagcaggtgcaggctatcctgttgggcaaaatgggaaaggcttcggagaaaaaagttaagttgtccattgatgaaaacagcacgcttgagccgcttcctgagcatatcgggatgtctcatctcattacgatcatcgggaatttaattgataacgctttcgaagccgtagctgagcaaaatgtgcggcttgtttcatttttcatcactgacatcggccgcgatattgtcatagaagtggctgacacaggatgcggcgtagcgcctgataagatgaaagccatctttgaacgaggatattcttcaaaggggatgaagagaggctacgggctggccaacgtaaaggaatctgtacgtgaacttggcggttggattgaagtggccaatcaaaaaggcggcggagcggtatttaccgtttttataccgaaggagaagcaaacacgagagggggaatccatttga

SEQ ID NO: 200 - DNA, 897 bp, Bacillus licheniformis
atgaatctccatgcactgcgattgttctattcggtcgctgaaacaggcagtgtcactcaagccgccaaacagttaagtatcagccagcccgccgtcacctcgcaaattaagaaattagaacgcgagatcgactgcaccttattcgttcctaaaggcagagggatcctgctgacacagtccggcgcagagcttgcaaaacaggccaagcggctgttttcacttgaaaaagaaattgaatcgtacgtggagcagttaagggaagggtcaattggaaaactgcgtattgcctccaccttcctccccgccaattatttgctgccaagatggctcagccgatttaaacagcaatttccgaaaacggaagttgaaatcacgacaacgaattttcaaaaagcttgtgaacagctgatcaactacgaagcggacattggcctgatcggcgggacaacggaattcggccccttcttaaaaggaacgctgcttttggaagatgacatgttattcgtagtcaatcaaaaacataaattcgcctcaaaacacgtggcattagaggagattgtaaaagaacctttcgtctttcgcgaggaaggaagtttttcgcgggaaaaattgatttcgctgtgcaacctgcataacgcgggaaaaccaaatatgggtgtacaaataaacggattaaacgaaacaatcagaacggttatggaaggatacggtgtaacattcgtatccgctcttgaagtaaacgaatatatcgcccgcggagacatcgcaaaggttcatgttgataaagccgtaataaagaacccgatttcgctatgtgtaaggacggaagaccatctatctccatctgcccttaactttattcaaatgatcgattcgaccgatgaatatcctctataa

SEQ ID NO: 201 - DNA, 1218 bp, Bacillus licheniformis
atgagtacgcttatcttaaataaaacagcttatagcaagtctccgtatgatgtatggctgaagggactggatgaaccggtggcgatgctgacctcaaccgatcgtgcggatgaatgcaggaattatgatgtgatcgaagcatttgacgattatccggttaatggatgcatcgaaatgcgcgctttggagctgaatgaaacgtatcactttaaaacgattattgcatcctcggaatttgatatgctgagggcggggaagctgaggtcgcttttggggataaaagggcagtcttacaaaagtgctctgctgttccgcaacaaaatattaatgaaagagcaagtaagaaaagccggtgtgaaggttccagattttaagaaaatcgactcggcggccgacttatatacgtttgttcaaactttcggttttcctgtggtcgttaagcctatttacggatcggggtctgttgatacaaccgttttaaggaatcggcaggacgtgtggaatgttcttgcgaaaggtcttcccgatcatctggaagttgagtcgtttatcgaaggggatatgtatcatatagacggcctcatccttgatgaagaaattgtcctcagctggccgtcgcgttatatcaacgggtgtctagcgtttcaagatcatcagtttttaggcagcctccagcttgaattgaaaaatccgcttacccggcggttgactgattttgttcaaaaagcgcttgctgcccttcctgttccgaataccacaacattccatgctgaagtgtttcatacaccagatgatgaactggtgttttgtgaagtggccagtagaaccggcggcgctatggtccgtgaagcaactgtgcagactttcggttttgatatcaatgaagtgtgtgttaaagcgcaatgcggcctggaatttcatataccggaggtggacaacaatccggaccgcctaagcggctggctgttgattccgccgaaagacggcgtgctgaaagaaatcaagcctgcgccagccgcagactggatagcgaaacaaaatatatccgctcaagccggagacaggttccacggctcgtcttccagtgtagacgcaattgcaagctgtttaattatcggacgcacagaagccgaattgagaggccgtatcagccggcttgcaacgtggttccatgatcataccgtatgggaaaagaattcggatgtttgcgcaatttaa

SEQ ID NO: 202 - DNA, 1227 bp, Bacillus licheniformis
atgtttgcgcaatttaaagcattcagccgccttcatccgttgatccgatttttgctgataggcacgcttgtcacgaaggcggctaagtcgatgacaaccccgtttttggcgctctatctccatatgaaaacgggagccgattttggaaccatcgggcttgtcatcggtttaggctatttttcaagcactgtaggaggggtagtcggaggagcgctttcagataaaatcggcagaaaaaaagtgatgctttcatccattttcatctggagctttgtattcattctttttggacttgttcatgatttcatgtggtttttattgctgaatattttaagctggctttgccattcgtgttttgaacctgtgtcaaaggctttgatggctgagttatcagaacgggagatgagattccgcattttctctttgcggtatttggccatcaatgttggagctgctgtcggccctttactgggcgcttattttggtcttgccaaaaccggaacgccgtttatcatcacagggctggtctattttggctatgccatacttttgagcttgatgatgattcggctgaccacggtgaaagagacaaaaatcgctcctgaaaaagtccaggcaggttcagttttgaagacgttaaagcaagacaaggctcttcgattatacatagccggcggcatcctttttttgttcagctattcgcaaatggaaagcactttgctgcagtatttaaataacgactttgcaaacggagttaaaatattttcgactttaatcacgttaaacgcggtgacggtcatccttttacaagtgccgctcacccgtttatttgagaggtataaatccttaacaacaatatcaattggaaccgttttttgcattttggggaatatcggtttttctatcgcaaatggctggattgtttttatgctttcgatgtttgttctgacaatcggcgaaattttatgttttccttcaatgaatgtccttttggacgagctggctccggatcatatgaagggcgcgtattacggcatgcaaaacttatacaacatcggtgagtttttagggccttggctggggggaatgatgcttgccttgtacgggggaaaagccgtctttcttattgctgcgtgttcagtctttttggctttaggcgcttaccatgtgggaaggagaaagtttttatctgcacagcattatggtgtatcgcctttttcttattga

SEQ ID NO: 203 - DNA, 249 bp, Bacillus licheniformis
atggacacaacattgggctacctccgtgagtcactgtcgaatcaccttgaacacggcataggacaaaacatttacagaaaaatcgtttccgggcgatatgccaatgaggaagagtttgtcgagcacttggaggagcgggaaatggaatttctgaatcaagtgcttgaacatgagatgaaatatgcgctgaatgaacaggaccataaacggacaagagaattaaacgaagtgtatgaactgctgttttga

SEQ ID NO: 204 - DNA, 192 bp, Bacillus licheniformis
atgggtgcaatagagcggaacggatacacgtttgaaccggaatacagcgtgaccagacaaaacggtgcgatccatgtataccggcgcggccggtttgtcgaggagattccctttgagtttcacggggagtttccagagcatgatttaattgaagagcttgtcaatcattattgttatgaaaataaaatataa

SEQ ID NO: 205 - DNA, 273 bp, Bacillus licheniformis
atgaccatgaagcaaaagaatctgatctcaggtctcgccgttgtcgccggagtcaccgcatatatgctcaaagacgaaacaaacagacaaaaactgaaatcgtacttgcaaaacgtcaaagaaaagatcccttacttttcggaaaaacacaacgtagattcattcccggttgaaaaagcaggacacccgtctccgcatgatatcgaagataacaaaatggtatcggaaggatccatgtaccctgttcaatactacgacgaaaagaaaaaatag

SEQ ID NO: 206 - DNA, 1878 bp, Bacillus licheniformis
atggctcatgaaagcttcgaagatgaagaagttgcgaagcttctgaatgagaaattcgtctccattaaagtggaccgcgaggagcggcctgatgtggattcgatttatatgacgatctgccagatgatgacggggcagggcggctggccgctgaatgtgtttttaacccctgatcagaagccgttttatgcgggtacatattttccgaagacgagccgttttaaccgtccggggtttgttgaggtggtgaagcagctttccgataccttcgcgaaaaaccgggagcatgttgaagatattgccgaaaaagcggccaacaacctgagaatcaaagcgaaaagcgatgccggcgattcgctcggcgaagacatattgaggcggacgtatcagcagctgatcaacagctttgatgcggcgtacggcggtttcggcagcgcgccgaaatttccaatcccccatatgctgacatttctgcttcgctatcatcaatacagcggcgaggagaacgcgctgtacagcgtgatgaaaacgttggacagcatggcgaacggcggcatttacgaccatgtcggctacgggtttgcccgctattcgacagatgacgaatggcttgttccccactttgaaaaaatgctttacgataatgctttattgctgatcgcatatactgaagcctatcaaatcacgaaaaacgaacggtataaacagatttccgagcagatcatcacatttgtccgccgcgaaatgaccgatgagaaaggcgctttttattcagcgcttgatgccgacacggaaggcgtagagggcaaatattatgtgtggtcaaaagaagaagtccttgaaacgcttggagatgaacttggcgaattgtattgcgcggtctacaacatcacgcaagaagggaattttgaaggccataatattccaaacttgatctacaccaggctggaagacatcaaggatgaattcgcgctgacagatgaagagcttcagaacaagcttgaagaagcgagaacaaagctttttgaaaaacgtcaggaaagaacgtatcctcatgtcgacgataaagtgctgacttcttggaacgctctgatgatcgcgggtcttgccaaagcggcgaaagtctacaatgcgcccgaatacctggagatggcgcgagctgcagccgagtttatcgagaataaattgattcaagacggtcgcatcatggtccgctaccgtgacggcgaggtgaaaaataaaggatttatcgatgactacgccttcctgctgtgggcctacatcgaattgtatgaagcatcacttgatttaaccgatttgcgaaaagccaaaaagctcgaagcagacatgaaggggctgttctgggatgaagagcacggcggtttttattttacgggaagcgatgccgaggctttgatcgtgcgggataaagaagtatacgacggcgccctcccgtccggaaacggcgtcctggccgtgcagctgtcccggctgggcaggctgactggcgacttgtcgctccatgatcaagcggcaaaaatgtttgctgccttccatggagacgtctctgcttatccgagcggccatacaaactttctccaaggtttgctgagccaattcatgccgcaaaaggaaatcgttgtgctcggaaaacggaatgatccggacagacagaagatcgtaagcgctttgcagcaggccttccagccgaattatgccgtcctcgccgcagaatcgcctgacgatttcaaagggattgccgactttgcggccgaatacaaagcagtcgataacaaaacgactgtctatatttgtgaaaatttcgcctgcaggcagccgacgacgaatatagacgaagcgctcgatcagctggtttaa

SEQ ID NO: 207 - DNA, 162 bp, Bacillus licheniformis
atgccaaacaaaagtaaacccaatagattaatcgctgagaagtcaccgtacttactccaacatgctcataaccctgtggactggttcccttggggagaagaagcatttgacaaagcgaaaagcgagaacaagcctgtactcgtatctattgggtatagctag

SEQ ID NO: 208 - DNA, 1920 bp, Bacillus licheniformis
atgagtgaaagtttaataaaagttcaattcaaagaaggaaatacgaaggaatttccgaaggggataacaataaaacgtattgcagaatccattagtacaactttaagaaagcacgctgttgtagcaaaggttgatgaaaaattcgtggatttaagctatacccttgacaaggatgttaaactcgatatttttactctagattcgaaagaaggtttgtcggtgttaagacatacatccacccatatattggcacacgctgtgaaaaggctttacagtagtgtaagtttgggtattggaccagtaattgaagatgagtttttctatgatttgaaacttgaacacagtttgtctcccgaggatttactagcaattgaacgtgagatggaaaagattattaaggagaatatagaaattaaacgaattgttgtctcttatgaggaagctgaaaagttatttgaagaaaataatgaaccattaaagcttgaaatattaagaggaattccaaaaggccaagaaataactctttaccaacagggagaatttattgatctttgtcgcggtccacaccttccatcaactggtttcattaaagcatttaaattaactcgtgtatctggagcttattggagaggaaatcgccaaaaagaagttcttcaacgagtttatggagtagcttttaaaaagaaagacgatttaaatgaatatctatattttttagaacaagcagcaaaacatgatcatcgacagttaggaaaacaattagatttatttatgttctcagaggaagcaccgggaatgcccttttacctacctaaaggacaaattgttagaaaagaattggagaaattatcccgtgaacttcaaaataatgcatcgtacgatgaggtccatacaccgtttatgatgaattatcgattatgggagaaatccggtcattgggatcattaccaagaaaatatgtacttttctgaggtcgataatacaaagtttgcaatcaaaccaatgaattgtcctggacatatgctaatctttaaaaataatctttactcctatcgagatctacctattcgattggcggaatatggacaagttcatcgacatgaatttagtggttcattaaacggattgcttcgggtacgcacattttgtcaggatgacgctcacatctttgttcgagaagatcaaattgaaagtgaaattaagaaggtatttcatttaattgaccaagtgtatcgtactattggttttgagtattcagtggaactgtctactcggccagatgattcattaggaaataatcacctatgggaggtttctgagggatcattaaaaaatgtgcttgacgatttagcaatcaaatatcaagttaatgaaggtgatggggctttttacggaccaaaaattgatttccatattaaagatgctttaaaacggagtcatcagtgcggaacaatccaacttgattttcagatgcctgaaaaatttgatttgacttatattaatcataataacgaaaaagttcgtcctgttgttatccaccgtgctatttttggttctattgatcgtttttttggaattttaatagagcattttgcgggtgtttttcctgtttggcttgcccctattcaagttcaaattattcctatttcacatattcacctggagtattgtttagggattaagtcggaactcaaacaacacgggataagagtacaaattaacgagagtaatcaaaagttagggtacaaaattagggaagcacaggttcaaaaaatcccctatacattagtagtaggagacaatgaaattaaagaaaacggagtaaatgtaagaaagtatggagaggaacaacaaaaaaatgtttcaattgaaagctttaaaaaaaatattttgcagcaaataaagacacgtagtgtctag

SEQ ID NO: 209 - DNA, 675 bp, Bacillus licheniformis
atgactcttttaaaaaaacaatatgaaatgtttaagtgtgtaacagatgagaattatctgaaagaatacaaaaaacagaatcactttgattgggttaattttgatttttttaggaagttacattttaataaacgggcgattaggtttaatcatgtatttcctaaaactaaagaaaaaacaagggaatgggaaaagtttgttaagaacttctgcaatcaacataattataccggtcaaagagttgaagaagatgcagactcttttgtaaactttctttcgaaaaaaaaaggaaacgaaagctatatagctcagctggctaaacacgaattaaatatatacctagttacaattggaaaagggaatggttttgtagatgcattctgttatccaattacatgttttaacataaccagcacagagactaaaaaacataattacttgtatataaaaggaaaacaaggggttagagtattcaagatagaacaaagtgtagcaatatggattgaaaattataagaatttattatgtattaaagaagcaactaatctaacacataattctttaaatactcaagaaaaaaatcagttaaaaattgctatagataactttaaaaaattaggtctgttggacatatggaagagagaaagtattaatgaaaagtctaaacaacattaa

SEQ ID NO: 210 - DNA, 1191 bp, Bacillus licheniformis
atgaaaagtctaaacaacattaaaaataaaattgtcatagttggaacagttgatagcctaggtgcagccattgtatggacagggttaccactttatgcatattcgattacgggatcttttttatatacatcatcattattttttacttcagcaatagcccgtatattagcaaccttttttggaggctatttagcagatgtatcatcgagtaaaagaataatgctaagatgtttaagtattaattggtttttttattcactattatttttgggattatcactcggtttaacttggattatattccctatcatgttgatttcacaatgtttcagtaccatatcgatcatgaatcaaaacctttggtttaattcactttgctcaaaagagaccctggcttccgaaataagtggtagaaactcatggtttttgattagtaaaacagttggtttctcattaggaccactcatgtatcattggcttaatgcatactcattaattatcaatctattaactatattgattgcaataacattaatattaacaataaaagatttaggttatgtaaataataaaaagaaaaaagagagcattttttcttcgttcaaagaagtttataaaaatcaattattaaaaaggctaaatataatagaaattttaaatggtttaacttttcctgttttaacaagcttatcgatatatattcttgaaaagaatttaaatgcttcttctcttataatttctttgttttggttgataggaggagtaggagcgattacggctaacttgatgctttcgagacttaaattatttaaattacagtatattcatcaatttataataagttttgttctcgtagttggtggattgttgttaatgacgatagctagctattcttttgtctatttaataggattttctttatttactttaggtacccctataataaataatttattaaggtcaaaagtgtttattttcgccccaagtcatatgaaaggaaaagtaacatcagttataacgtcttcatcagatttaggcactattatagccttatcattgtcttggattgttgttgaaaaattcggggtattaatttttatgtcttttgttattttaacaagtgtaagtcgaatatgcctttttttctacactctacataaagtagaaaataaagttgatgtggagggataa

SEQ ID NO: 211 - DNA, 819 bp, Bacillus licheniformis
ttgtccaattgtattggtgttgggttgagttttcgtcaaaatttttttaaggatttagatgtaattaagcaggatgttgattttttagagattatttctgaaaggtatttcgataaaaagaatgaagaggaattgaatactattagaaattattttcccttaattccacacggactttctctttcaataggaacttatgaacctttatctaaaaaaaaggaaaaacaaatatccaatttgttggcagaattacaaattaatagctatacagatcatttagcaatgagtagtgtaaaagatatcgaattactcgatttttttccagtaatgtataaagaagaaacttttgagtttttaataaacaaatatgatcaattgaaaaaaggaagattaaaaaatttgtatttagaaaatataacttatacctttaattggcataacaatgatttttcagagttggatttttggtataaattgcttaatgaaacaaacataggtatgttgctagatgtatcaaatttatatataaatagtataaatcataaatacgatccatatgctttttttgataagctacctaaagataaaataaattatttacacgtagctggatttatcagaaataagtatggatttttaatagattctcattctgaacctgttcataaagaagtatggaaactagccgagtatattattaaaaaagctcctgtcaagggggtcatattagaaagagatttaaattatcaaaattatcatgatgtgaaaaatgatataaaaattattaaatcactagtatataaatatcaaactaactaa

SEQ ID NO: 212 - DNA, 943 bp, Bacillus licheniformis
ttgacagccattaatttaattatttttgcggtattgattgctttaacggcgttttttgttgcaacggaatttgcgatcgtaaaagtgcgggcaactaaaattgaccggcttatacttgaagggaaaaaaggagcggtatccgccaaaaaagtagttacccatttagatgaatatttatcggcttgccaactgggcataaccgttacagcgctgggtattggatgggttggagagtcgacattcgaagtgatccttcatccgatctttgcttatttcaatgtgagcgagcaagtcacacatatcttaatctgaaaaaaaggattgaataaacattaagtaatcaacaaaagaagttgaatcaaagacaaactttcctgtgatattttcttgttgatctcttcgcctctctttacctctgcaataaccgttatggtttggagggatttgatggggctggaaagctgaaaatcggcgagttggcggaaggaactaaggtaacgaagagaacaattgattattatacaaagctgggtttgttaatctgctgacgaaaatgcaaaaagagcgaattcacattgctatcttattggatgagtatggaggtacgtcgggtttagtaacagttgaagatatccttgaagaaatcgtgggagaaattagagatgaatttgatgttgatgaaattccggatattcgaaagttaaaggatggtcactttataataaactcaaagctgctaattgaagatgtcaacgatcttttggatatcaatttatctcatgaggaagtggacacaataggcggctggttcatgactcaaaacatggatgcagaagctggttctgaactagaagctgatggttatatttttaaagtgcaaaaaatagatgggcggcagattcattttcttgaagttaaaagagaaaaaaattcaaatcaataa

SEQ ID NO: 213 - DNA, 1197 bp, Bacillus licheniformis
gtgagtctgtcgcagattttcggcggtgcggggctggctgccgggattacggtaggcgccctgttagcaaagcaaatgcttgggacggatgcgttttcaggagtcccttctgccttatttactttaggatcggcaggagccgctttcggcgtcgggagactttctcagcgttacgggcgccgcacgggcttaaccgccggctttatggtcggcgggatcggcgcaatcggggtcgttgctgcggccgtgatcaacagcatcatattgttgttcgtttccctgcttatttacggagcgggcacagcgacaaacttgcaggcgcggtatgccggcactgacttggctgataaaaagcagcgggctaaagcgatcagcgtcacaatggtgatgacaacatttggagcggttgcgggccccaatttggtggatgtcatggggaaatttgcttcgatcatcggcgttccgccacttgcgggaccgtttattttatcggcggcagcttttattctggcagggcttgtgctttatattttgcttcggccggatccgttggagatcgccaaaaaaatcgaaacctatagacaagaaaataaattagcagacgaatcgaagtctgccggtgcttcggacgatcaaaaggggattacaattggtgccgctgttatggtgcttacccaaattgtgatggttgcgattatgaccatgacgcccgttcatatgcagcaccacggacacagcttgggagatgtcgggatcgtgataggttttcatatcggttcaatgtatcttccgtcacttgtcacagggattcttgttgataaaattggccggacagccataagcatcgcctcaggggtgaccctgctgctcgctggtgcagtggcggcgctggctcccagcgattcgctcgttttattgatcgttgccctttcgctgcttggattgggatggaactttggattaatcagcggaactgcacaaattatcgattcgaccgagccttcaacacgtgcgaaagtgcagggaacgcttgatgttttgatcgcattggcgggggcttccggcggggctctttccggaatggttgtcgctcattcaagctatgccgtgttatccttggcgggcgggctgttatccttggctctgattccagccgtcatttggccgcgaagaaaaacaaatactcaaaaagggtag

SEQ ID NO: 214 - DNA, 633 bp, Bacillus licheniformis
gtgaaaaatcaaaaagtgctggatgccgggtgcggagaaggatatttaagcagaatgctggccgcccgcgaagcagttgtaacggcggttgactattcgacaagaatgcttgagatcgccaaggaaagaacgccggacggattgcacattcattatcggcacggcaattgtgaggacttgcattttttagatgagcaaagctttgatatcatcatatcgaatatggtcatccaagacctcgcaaatgatgaaaaagcgtttcaggaaatgcacaggttattaaaagatggaggatgctttattttttcaatattacacccttgtttcgtcaccccggaaagcggatgggaaagaaccaaagacggccaaaagctccattggaacgttgatcggtatttttacgaaggcgcatatgagcagccgctgggcggcgaggagaaaatgtttctttttcacagaacactgacaagctatatcaatacgatcatcaaagccggctttcaattagaagcggtcgaggaaccgagaccgtcaaaagagatgctgaaaaaatacccttcatttgaagaagatctcaggtgccccgatttcatcgtttttaaattaagaaagcccggcggcgatgtccgatag

SEQ ID NO: 215 - DNA, 447 bp, Bacillus licheniformis
ttggaacgcatttggctatttcttttacctgggatcgatcattctattggccgctgtctggggatcgctcccgaaaaggtgcctgcacattacaacgcactcggtgaagtggatcgctgggggtcaaaatgggagcttttcatattgccgggaatcggattaattatccttctgttcatgcagttcctagaaaagcaccctgagattcacaatcatccaaagcgcctgaatgaaacaaacgctgaacacttctacctgctcagccgaaagttgatcaaccgcttaaaaaatgcatgcttaatcattttttctctcatattaattgaatccgtgtcaatcgctttagactggggaagcggatttggcgggtggtttcttccgattgccttactcggcactgtcatgcttgtggccataggtttaatacagcaaaggaaaatcaaataa

SEQ ID NO: 216 - DNA, 1446 bp, Bacillus licheniformis
ttggaaatagatgtgcagaaattgctttttgaattcattggaggtctcgggatctttcttctcggtattaagtttatgggagaaggacttcaaaaatcagccggagataagctgagagacatattagatcgttttacaagcaaccctctgatgggtgttttggcaggtatgattgtcacggttttaattcaaagcagttccggcacgaccgttatcactgtcggtcttgtcagcgccggctttatgaccctccgccaggcgatcggcgtcattatgggtgcgaacatcggaacgacggccacagcctttattatcggctttgacgttggggcatatgcgcttccgatcatcgccattggttcatttttgctgtttttcttaaagagcaaaaaatttcagaacatcggacaaattctgtttggatttggtgcgcttttctacggcttggaattaatgagcagcgggatgaagccgctccggacggttgaagcttttcatgatttaacagtcagcatgagtgcgaatcctattctcggcgtgctcgtcggcacccttttcaccgttctcgtccaaagctcaagtgcaacgatcgggatcctgcaagggctgtttgccgattcattaatagatctaaacggcgctctgcctgtattattcggagacaatatcggtacgacgattaccgctgtactggcatctcttggcgcctcagtggcagccaaacgggccgcggccgttcacgtattgttcaacctgattggaacagcgattttcctgatcttgctgaagccgttcacagctttgattttaatgcttcaatcctctttagggctggaccctaagatggtgattgcgtttgcccacgggatctttaatacgtcgaatacgctgattcagcttccgtttgtcggcatattggctttgatcgttacgaagctgattccaggcaaagattcggttgtggactataaagcaacacatcttgatccgctgttcattcagcagtctccttcaattgcgctgggacaggcgaaagaagaagtattgcgcatgggtgaatttgcggtaaagggacttgaggaaacaaaagagttttttaatacaaaacaggcaaaacatgcgcaaagcgcttttcaaatagaagatgcgatcaacaatttggacaggaagataaccgattacttgatcgaattgtccgccactacgctttctgaacaagaatctgaagaacatcatatgttaatggatactgtcagagacattgaaagaatcggcgatcactttgaaaacttggttgagcttggtgagtaccagcaatccaacagggtgaaaatttccgaagcggcaatggctgatttaacggaaatgcttgacctgaccatttccactgttaagagtccatcaccgctcttggggaaaataacgaagatgccgcaagacgcgtag

SEQ ID NO: 217 - DNA, 261 bp, Bacillus licheniformis
atgcataaatacagaagaagaaacacaacggcctttacggttatgtcatatttcacatttttcgcgggagtctttttatttggtatcgggctatacaatgcggacaatctgcagctcaatgaaaaaggctattacatagccgtgatgattttagtggcggtcggcgcgattttgacccagaaagtgacgagagacaatgccgaggacaatgaaatcattgcggagcaggagagaagacagaatttgtctagcggcgagtaa

SEQ ID NO: 218 - DNA, 972 bp, Bacillus licheniformis
atgagaaacgaaaaacaattatttcaaaaagctgaacatacagccaaacttcttgagtctcacaaaagtgacgaagagctgcttacataccttgcaaatcaagaatctgttacattaaatcagctaaaaatctatttttcaaatccaagttttacattaacgtatttgattaaagggattttttttagcagtatgactgctgtcattatggcggcctttttatctggtcagatctcctccctcaaccatggtctttcaaggctattttcattcttcttcatgttctatctgatcttctcttttctttggatcgtcaagatgctgatctcctcgcgaaaaggaccgatgcaaacaatcctgcacttccaaaaaagagcggaatattccagaatcacgggtatgattgatttcattttagatgaacgctttaaaaaggaattcaattagaaagcagaggaacattcacctctgctttgattctctatcattcaaactaaataagaaggagaccaagacatgcaaacagacaaacaactattcgaagaaacaaaacaaaccgctgaaactctattgttatcgaaagctgaaaacgatgaagagctgatggcatacctcgaaaaacaagatttatccacgttaaaccggctgaaagtttatttttcaggtcctacgctaaaaatcagccacgtgatcaaagcttcgctcgccagttccatattcgcctccattgtaactactgtatgttcgggtcaagccaattccattttacccgacgtttcaaaaggttattttccggctttgttatcgatattacttatcatgagctccatctgggtgttcggcacgatcactaaatctcaaagaaacaaagaacaaaactttttacactttagaaaaaaaacgaaccatacaaaaattattggaatgattgatttcgttttggaaaataaatataaaagtatttcaaattaa

SEQ ID NO: 219 - DNA, 420 bp, Bacillus licheniformis
ttgagggaagagacaaaatgcgcactgatcatcgatgaaagcctgccgctcgggctaatcgccaatacagctgccatcctgggggcggccctcggcaaaaacaaacccgatctgattggagaaactgtaacagacggctcgggaatcgaccatttaggtatcgtcaaaatcccaatccccattttaaaaggcaatgccgagctgcttcatcaattaagtcaaaagctgctgaccgacgaattcaacgatattctgacggttgatttcaccgatgtagcgcaaagcattcatacatatgaagcatatattgaggcatttcaaagcaccgcagcttccgattaccgctattttggaatcggcatttgcggggataagaaaaaagttgcgcggctgacaggaagcttggggctgttgagataa

SEQ ID NO: 220 - DNA, 909 bp, Bacillus licheniformis
atgaagacaagacgcgaaaccgccggacacctcgcagctgtgatcacgatcatcatctggggtactacttttgtctcaacaaaggtgctgctcgaggatttcccgcccgtagatatattgttttaccgttttctcatcgggttgattgtgctgatcatggtgcatccgcatgtgctgactttccggagctggaggcaagaagcgctgtttgcgggagcaggtttatgcggagtgacgctttactttctgttggaaaacatcgcgcttactcttacctacgcctcaaacgccggcatgatcgtcgcggttattccgatgatcaccgcggtattggcgcattttctcctttcgggcgaaaagctggagccccgctttttcattgggttcgccgccgctttcactggacttgcgctcattttctttaatggacaaatgatgcttaaattgaatccgctcggcgacattctcgctgctgcctccgcattcgtctgggcggcatatgcgattttgatgaaaaaaatcagcacattcggttaccatacaatccaatgcacacagcggatctttctgtacggtttgctattcatggttcccgctctgttcctgtttgatttccgcttcgacgcaagccctttttcctcccccgtcaattggttgaacatcctattcttaggcgcgggcgcatctgcgctttgctttgtgacatggaactggtcggtcggtgtgcttggagcggtaaaaacgagcgcttatatctatatggtgcccgtcatcactattgcggcatccgttatcattctgcaagaaaaactgacatgggttgctttttgcggaggagcgctcacattggccggcctttatatttctgaaacaaaaccaaaaccgcagctgaaggaggaacaaatttga

SEQ ID NO: 221 - DNA, 796 bp, Bacillus licheniformis
atgcgaaatgaaacccgcacgcttttcctcgaccctgatctaaatgttgaagcctaccgctttaaaggcattatccagaagtttccgaatcacttccacgagtattttgtgattggttttattgagaaggggcagcgctatttgctttgcaagggagaagaatacatcattaatcaaggcgctctcgtgcttttcaatccttatgacacgcacagttgcgagcagattgacggaaaggcgctcgattaccgctgcattaacgtgatgcctgatgttatgagaggatttgtgaaggagatcactggggccgacagcctcccatatttcacggagaatgtcttgttccgccatgagctgaacgccagcttgaaggagctacacattcaaatattgcaaaaagaaaaagccttgaaaaaagaggagctttgtcacgtttcttgaaaatgcacctgaaccgtccgacgaagtcaaagcggtgtgcagttatttggaatcccattaccaggaaaacattacgcttgaacatttaagcaggctgacaggctggagcaagtatcacctcctgcggtcgtttacgaagcagaaaggaatttccccctacagctacttggaaaccgttcgtatcaatcatgcgaagaagctgttggaagaaggcgtaaaaccaatcgatgcggctttccaaacaggcttcagtgatcagagccatatgacgaaatttttcaagcggcaggtcgggctgacgccgaaacaatatatgaaaatttttgaatatgacaggcaggagatcaaaggatga

SEQ ID NO: 222 - DNA, 414 bp, Bacillus licheniformis
gtgaaaaagaaatggattgcatcaattgccttcacgatgatgctgggcatcggaatcacgatttactgtctgttttttgaacatagcaaactgagcgaactgacttcagacggggaatgggagctctcgtattctaaagaaaggggagatcaatattggaatggctatgtttcgaagaaaacgagtgaagatgcggagttaaagagagtcgtgttttttgtgaatggaaaagagacggttgattacgaaaaggatgagcaagaggaaggcggaacacattctgatatagtcaatgttgtctggttaggtgatgccccagaaaaaagtgagcaatttgaagctgtcgtggaaaggaaccagaatggtgaatatcataaggagaggattaaactgacagcaaaaaacgggttataa

SEQ ID NO: 223 - DNA, 468 bp, Bacillus licheniformis
atggataaagaatacataaccgaactgatctcatccaaattaagattaatccgggcggaaagcggctatacgcaggagaaaatggcgaacgtgctcgggatgtcgaagaaaacgctcgtgcaaatcgaaaagggcaggtcggctgcgggctgggcgcatgttgtcgcggtatgcgcgctttttcggaacagtgaagtgctgcaggccgtcctcggggatgagccccttgaggtggtggagactgttgctcaccgaagcatcgacagaccaaaagggaagacgcttggcggaaaggtgtggtggcgggacattgagaaaaaaggagagtttcgccttcagcaaaacttgatttctcaccattaccgcatcttggattcgtatgacgacctatggttcagcacgtttgaaaagcaggatgcagttgcgcgtttggacgagctgttaaatgagcaggacggggtggaatga

SEQ ID NO: 224 - DNA, 618 bp, Bacillus licheniformis
gtgtttacagaaaaggatcagagcctgctcgcttctcttgcaccgcttatcggccggcatcttcagcaattcagacaccatctgccaaaaaaagacgtgtttcacatgaaacatgtcggaggcattctgattttgtcggaagacctgcagctcttgtcatgcaatcgagcggccctccattggctgaacatcttgcgcggctgggaaagcatcggcagcgaagccgtgccgagacccgtccgagccgtctgcacgcgcgcagcggctgaaactacagctccggcaaaaacggtcatctcgattccaggccattcctgcctatccattaaagcgagccgtttagacggatttggaccgtcaggccagatcgccgtttcatttgagcctgcttcacccgcagaaaccattccgctgatagcggaagcctacagcctgtccgaccgggaaaaagacatcgcttaccgggtcatccgcggactatcaacaaaagccatcggagacgaattgcatatatcggcttacactgttcaagaccacttgaaatcgttttttttgaagacgggcgcaggaaaccggagggagctgatgtggaagctgcttgatgatgtgctggagtga

SEQ ID NO: 225 - DNA, 1056 bp, Bacillus licheniformis
atgcagcctgaagatattgtcagaagcggtccaaaccaatacgtttgcagagaggggatcgtgaaagaactgccgtcatttgcgaatgcattcgaacgtcctgtcatcatttcaggggttaaatcgtttaaagcttttacacgttatacgacacctccagccgattggaaagtcgttcagcatacgggctgcagttccctaaataagattaaaaaagcagcagaggaagcagaatcagcagacgtcatcataggaataggcgggggaaccgtcttagatacagcgaaggcagccgccgatttgctgaacattgaagtcatgacgattccgacgatcccgggaacatgtgcggcaagcacgccgttaagcgtcatctatgacgatgaaggtaacttttcgggcgtccaatatcagaagcgctccagctatttgacactggtcgatccgctgctgcttctctcttcaccggtcgcttatgtgaaaagcggaatcggcgatacgcttgcgaaatggtatgaggcagaagcgatcatcagaaatacggccgattcgctttctatcatggttcagacagggctgaggcagtctgtctatattcgggatattttgttgacagaaagcctgaaagccatagagagccttgaaaaaggcgaatcctccccagctttcacaaatgtcctcgaagcggtcattgcgctggcaggcacagtaggcggatatgcgggccgctacggcagaatggccggggcccatgccattcacaacggcttgacgttcatccccgaaacccatcgtgtgctgcacggccaaaaggtagcctacgggatactggtgcagcttgctttagaagggcggacagatgaaatagccgaactgattcccttttatgaagggctcggttttccgagaagacttagcgatttgggcattttagaaaatattgaagcggccaaacggatcatcgccgcccatgccgcgcgtccggatgaatctttatgtttgatgggatcttttcatgaagcggatgtgattgcggcgatagagtcgcttgaataa

SEQ ID NO: 226 - DNA, 1707 bp, Bacillus licheniformis
gtgaaaagcccaagatggaacaatatcacaatcggcggcaaatacggcattattttctttgtgatgttaacagcgtttttaacatccgttttgattacatatggtctgttaaaagatacgagccagacggttcaggatacgaaatcgaaaaatgaaacggccgttcagtcggcaaagctgatgtccctatatcaaaataaatatttgcacattccggagtacatcataaacgcccaggatgaaaagctgaccgattatatgaagtacagccaggaatttgccgatacggccaaaaagctgaaaaaagagctgcattcggatgagcagcttgacatgttcgatcaaatcattgaaaacaatcattcactggatgagtactttttcagcgaaattgttcccaacgtgcagcaaatcaacaccgagaaatttttaacccttcagaaaaaagcgaacaagctcaaagaggagacgatgacgttaggcgaaagcttgaaagaaaacgctgtcaaaaccaatgttgagtcaattggacaagcccaatccaatatgacgaaaaccatttatattttaggcgtctcaattctgatttcggcgattgtgtcggcgggactcctgatcattgtcagccggcagatcaagaaaaatctgaagcgtgttgtggcagcaagcgaagaaattgcaaagggtcatttgaactttgaagcccttgattacaaaggaaaagatgaaatcggccagctttcgcaagcggtgaatcatatgggcggaagcctgcgtgagatgatcgtcgaagtatcagggatcgcagccgaagtcgacaagcaatgtcttacgtttacgagcgtctcggctgatgtcagagaaggaagcgaacagatcgctgtcaccgttgaagaattggcaaacggggccacgaatcaggcaaatgaagcagctaatatttccgagcagacacaggagctcaccgggcaaattcagcacgctcatgaaagcggcgaaacgctggcccggttttcaaaagaagtgcttcacgtgtctgtcgacggcgacaaacagatggctcaatcattggagcaaatgaatgtcatcaatcatgtaatggaagcatccgtagaaaaagtcagtgtgctggaggaacagacacagtcaatccacaagcttgtcgaaatgataacaggtatggccgaacaaacgaatttgctcgcattaaacgcgtccatagaagcggcaagggccggcgacgccggaaaagggtttgccgttgtagccggcgaggtgaaaagactggctgaagaagtgaaaagctctgtcggcagcatcaccgaaatcgtcacggcgattcaaaccgaaacatcttccatggccggtgatttaaaaaccggtttttcagaagttcataaaggaaaaaaccagattgagacttccggccgatacttttcagagattaaaaataaagtgacggatatggctggccgtgtatcggacatttcggaggcattatcgcatttcagacgttcaagcgaggagattaacggctcggtcgagcatatcgcggcgatttccgaagaaagcgcggccggttctgaagaaatttcagcgtccgtacatgagcaaagcggctcgattgaaaagatggacgaaagcgcaaggcttctgggagagatggttgaacggatgaatgtgatgatcaaacggtttaagctctga

SEQ ID NO: 227 - DNA, 1065 bp, Bacillus licheniformis
atgttgtcgatatatgtgaaaagagggctgttggcacttgcgctgttcagtctcctcacagctgttgccgggtgctcattcaattctgctgaaaaaagcgccaaccgtgaagaaaaagtaaagctgattgccgactccgacaaattgtacgtcggttttgccatcgatacgctgaaggaagaacgctggtacaaagataaagaagcgttcgagaaagaagttaaaaacctcgggggggaagtcaagacgcttgccgctaacggaaataaagaagttcagattcagcaggccgagctcttgatcagcgaaggcgtcgacgtgcttgttgttgtaccggcagatgcggatgccgcggcggagatcgtgaaaaaggcgcacagcgccggtgtaaaagtgatttcgtatgaccggctgattcgaaacgcggatgttgattattacgtttcatttgataacgaaaaggtcggggaactgcaggcggaagcgattgtaaaaaaagcgaagaaaggaaacttcgtatatatcggcggatcgtctcttgacaacaatgcggtcttattccggaacggcgccatgaaagtgctcgaaccgttgaagcggcagggtaaagtcaagctcgtgcttgacgaatatacgaaagactggctaccagaagaagcgaaaaagaacatgaaaaaagcattgaacaagacgagagatatcgacgccgtgatcgccgccaatgacggtacggctggcggggtgatcgaggcgcttcaggaggcgggcctggccgggaaaattccggtgtccggacaggacgcggaaattcaaggcgtccgacgaattgtgaacggtacgcagacgatgaccgtttacaaaccgattcccgcgcttgccaaaaaaagcgctgaaatggctgttcaagcggcgaaaggcgaagcgattcaaaccgatacaaccgtcgaaaacggcaaagccaaagtaccggcgattttacttgagccgtatgccgttacgaaaggcaatatcaatgagactgtgatcaaagacggccatctgtccaaaaaagatattaataaataa

SEQ ID NO: 228 - DNA, 768 bp, Bacillus licheniformis
atgaaaaaaagcatatcatctctcatgatcggattattggctgtcgtgttgggcgcctgctcttcaaatcatgatgatcagcaatcccaggccagcgatcaagcgaaaaccgcacaaagcgggcagcaggatcaggaaaagcaaataaaagcaatgcagaaaaagcttgatcagcaaaaggttgatgacacaaaaacagtggctgtcgtaaacgatgaaaagatcacaggcaaggactataacagcgtattatcaaccgctcaaatgcaatatcagcaaacaggacaggacccgacttcaaaagatgcggcgcagcaaatcaaaaagcaggcgatcgacagcctgatcggacaggcattaattacgcaggaagcggacaaaaaaggctacaaagcatctgagaaagaaattgaaaaacagctggacgaaagcaaaaagcagtataaaaacgagcaagattttgaggaagcggtcaaaaaagcaggcttaaacatgaacacgctgaaaagcgacattgccgacagcatcaaaacagagaaatatattgacaaagaactgccgacagatcaggttacagacaaagaaatcaaagactattatgatcaatttgccgcacagcaaaaagacagcggacagaaaaacacacctgcgtttgacgatgtcaaacagcaaatccaagatatgctcaaacagcaaaaaagacaggaaaaactcggacagcaggtcgaaaagcttaagaaaagcgccgatgtgaaagtggaaatttaa

SEQ ID NO: 229 - DNA, 765 bp, Bacillus licheniformis
atgtttgaagatgagagactgaatcgcttgatttacctttatacccctctttatgctgaggattttccgatcattctgttctggattccaaaaagcggctgcacgacgctgaatcgctggttctttttccaaaacggtctgcttgaagatgtcaatcgaagatgcgccggagaagttcaccactacagaaatgcgatctatacgcagaagccgaattatgtgaaggatcttctgacggatttaagagagggtaaaaaggacacttacaaggttgtacgcaacccttttcggagagcagtcagttcctttctggcagcgatttgctccccgaattttatttgtctgttcaacagtgatataaacacagggctttctttcacgcaatttttgcatcatctaaaagatctcgggacggatatcaatgccattgaccgacaccttggtccccagtatatcgaaggagaagaagagtttgtcaccaattatatttacctcgagcaattcagcgcacaaatcagagagattgaaaacaaatacaaattattgaaatctccgttatcacagctgtcacaatcaccgcaccatctgtcagacattatgattaaaaaagggaagtttgctgacaccgttttgactatgtcaaccttcgactgggcgtttccgacttttgagagcttttacaatgacgaaacaaaagaattggtgcacgacatttttgcgaaggactttgaagtgtacggctttgattcgaagcatatcaagtaa

SEQ ID NO: 230 - DNA, 888 bp, Bacillus licheniformis
atgcagattcgcatgactgaatatcaggttcccgaccccgaatcggggccgtacgggatcacagtatgtgcaaacgggcgcatttggtttactgaacaaaaggggaaccggattggtatgctcacagagtccggggatatcaccgaatatacgattccgacggagagcgcaggcgcctcgattattacgtccgggattgacggcgagctttggtttacagagtataaagcggggaaaatcggcaaaatcacgcctcaagggaaaataaccgagtatgctcttccaccgggtgctgccccgtttggaatcgctgcaggctgtgacgacgccatgtggtatacagatatggccggacatcaaatcggcaggctgtcctcttcaggcgaaataacagaatacaaactgcccaaaccaggagccttcccgtcatttattacaaggggagcagacggcgcgctctggtttacacaaaaccaaagcggctccatcgggcgaataacggcagatggagacatcagcgagtatccgctgccccaagaacaatccggcccggtcgggatcactgccggcccggacggggctttatggtttacagaaataaacgcaaatcaaattgggagaataacggtctcaggaaagatcagcgaataccagcttccgacagcgcatgcacgcccgcacgcgattgccgcaggcggtgacggagcactgtggtttacggaatggggcgcgggtcaaatcggccgcattacagtcgacggggatattacggaatatccaatcccgacggcagattctgaaccgcacgggatagcggccggatcagcccattcgatctggtttgcagaagagtgcggccgtattgggaaaatctctatccaaaattaa

SEQ ID NO: 231 - DNA, 381 bp, Bacillus licheniformis
atggaacatgtgaaagcccttgccatcaaaggcatcatgacgattgtgattctgtaccttgttctagggctcgggtttagttttagttttgaaaacaccctattcatcacgattgttcttggcgcagtatcctatttgctgggtgatttgtttattctgccgaaaaccaacaacatcacggccactttagccgatttaggcgtcgcttttcttgtcgtttggctgatggctcttgcgatgggaacggctgccaacaccgctgcattggccgcgttttttgcagctgtcgctatggcgatcggtgaatacattttccatttttacttgatgaataaaggccttggctcgcccaaccgcagaatggaaacgagaacggaataa

SEQ ID NO: 232 - DNA, 1455 bp, Bacillus licheniformis
atggaacagtcaaacaccaatcgccagaactttcaaagaaaaatgcaaacgagacaccttatcatgctttccttaggaggcgttatcggcacgggccttttcttaagttccggttatacgatctcacaggctggtcctgccggaacgattctagcctacttggccggggctctgatcgtctaccttgtcatgctctgcctcggcgaattatcggtcgccatgcctgtcaccggatcgtttcatatgtacgcctccagattcatcgggccgggcaccggattcaccgtcgcctggctatactggctgacctgggctgtcgcgctcggttcggaatttaccgctgccgggttattaatgcagcgctggttccccgatacttcagtctggatgtggagcgcggtattcgctgcactgattttcgcgctcaatgctgtctcagtgagatttttcgccgaatccgaattttggttttcaagcattaaagtgcttgccattatattgtttattatattaggaggagcggcgatattcggcatcatcccgatacaaaatgcagacgctgcaccgcttctttcaaactttgcaggagaaggcggtctctttccaaacggcttccttccaatttttatggcgatgctctccgtgaattttgcgttttcgggtacggagctgatcggaattgccgccggagaaagcgccgaaccggaaaagaacattccaaaagcgatcaagacaacactctggagactggtgcttttcttcatcggaacgattttcgtgctttcgtgcctcattccggttaaagaagccggtgtgatcaaaagcccatttgtcgacgtctttgaccgcatcggtgttccatatgcggccgacatcatgaactttgtaattctgacggctctgctttccgcggccaactcaggcttgtatgcatgctcccggatgctctggtcactgtcaaaagaaaaaactttgcaccccgtatttcaaaagctgacttcacggggaatcccgttgaacgcgctgatcttcagcatgctcggcggcattctgtcgctgctctccagcgtgtttgcgcctgattccgtctacatcgttcttgtgtcgatttcagggtttgccgttgttgctgtctggatgagcattgcggcttcgcagttcatgttccgcagacgctttttggctgagggaaacaccgcagacgacttaaaataccggacaccgctttatccggccgtaccgattgccgcttttctgctatgcctggcatcctgcattggcattgcctttgatccgaaccaaaggatcgcccttttttgcggtgtgccgtttatggcgttatgctataccatctattatgcaacaaaccgaaaaaatagctggaatccgtctgagcccgttaagaatgcaagtttgcatgtttcattttctgaatacgaggaaaagaaaaactaa

SEQ ID NO: 233 - DNA, 948 bp, Bacillus licheniformis
atgacaaatccgatccgaacttctttacaacaattttctgtcattatacttgacggcgcgatggccaccgagcttgaacggtacggctgtgatttgaacgatagcctgtggtctgcgaaaattctcatcgaaaaccccgagcttatcaaacaagtccatctggattatttccgtgcgggcgccgattgcgcgattacagccagctatcagtcgacggttgagggtttcacaaaacgcggccttagcgaacaagaagcgctccacctcatccgggagtctgtccgtcttgctgcagaagcacgcgatgaattctgggcggctccggaaaaccgcgaaggccggcctaaaccgtttgtagcagcttcagtaggcccttacggcgcctttttagcggatggttccgaatatcagggaaattatggcgtcacagaagatgaattggccgattttcacaggcggagaatgggcgctttaatcgaagcaggcgccgatattttggcatgtgagacaataccgtgcctttcagaagcaaaagctatcgttcatttattaaaagagttcccggatacacatgcgtggatcagtttcagcgctaaagacggacgccatatcagcgacggtacgaaagccggcgaatgcgcgaagtggctcgatcagcatgaccaggttgcggcagtaggagtaaactgtacgcggctggagcatgtctcttcgctcatcggcggcatcaaaaagcatacagctaaaccgattatcgtctatccaaattccggtgaacagtatgacccggaaacgaaaacatggcatggcgcggcatgtaaagcttctttcggagaaagcgcccgcagctggtataaccaaggggcacagctgatcggcggctgctgcagaacaacgcctgaggacatcaaagccgtcgccgcctgggcgagaaagctggaggtataa

SEQ ID NO: 234 - DNA, 741 bp, Bacillus licheniformis
atgaaaaaactgattatcaatgctgatgattttggatattcaagaggtgtgaactacggaattattgatgcctataagctcggaattttaacatcagcgacctttatgacgaatatgccgggcgctggtcacgcggcccggctggctcgcgaatcgcccggacttgggatcggcgtacatttggtgctgacctgcggaaggccgcttttgtctgaccaccggacgattgtcgattcaaagggaagttttcgcaatctcgcattttatcaaggtgcttttacaatagatgccgatgaagtataccgcgagtggaaaacgcagattgaaacatgcatcaacatgggcttgaaacccgatcatttggacagccaccatcacatcaatgcttatccgggcatctctgacgtatttttgtcgctcgccaaggagtatcgcctgcctgtcagacgtaatatggagagcgccataataacggaaaaaggagtgaaaacgacagactctttctcacctgtccttgaagcggccttaaagggtgaagaagccgtctctgaactgtttgaaaaacataataccgtggaggtcatgacccacccggcatacctcgataaggagcttttgacgaactcttcatatacttatccaagagtcgatgaacttgagtttttaaccgatccggacgttgtcatccgcttgaacaagcttgcggatgtccagcttgtatcatttaggaatttgacataa

SEQ ID NO: 235 - DNA, 1374 bp, Bacillus licheniformis
atgaaacatatacttcagctgcttggaaagtctttgctgattccgattaccgttcttccgatcgccgggctgctgctgcggctttctgcggaggatatgctggatataccgctttttcaagcgtcaggcgtgattttgaacaatatggatgtcctgatcgcgatcggcatcgccatgggctttgcccgttcaaaagataaagggattcctgcgctgacaggatatttggcgataaccgtgttaaaagaggggatcggcatcttgaatccggaccttgatatgagcgtcttcggcggggtgctcgccggcctgatggcggctttcatttataatcaatttcaacatgcaagactgccaagcatgttttctttttttggcggagagaagtttccgattacaatgatcgtattggtgacgattccggtggcagggtttttttcggtcgtctggccttacgcagaggcggcgatcgacgcttttagccagtcgcttgttggtcttggcgctttcggtgtttttgtgttcggatttctgaaccggtttttgcttccgttcggacttcaccatgtcatgaatacgtatatatattttgggcttgggcgctatgagacggcatccggagaagcggtgacaggggaaattacacggtttttgaatggagacccgacagccggctactttctcggcgggttttttatcacgatgatgttcggcattccggcgatcgctttggcaatagcgcatgcagccagaacgagaaaaaaagaaacgaaagcactcatgtcttccggagcagccacatcgctgatcaccgggattacggaaccggttgaattcacgtttttatttacttcgcctttattgtattttcttcactcggtctatacgggacttgccggagcggtgctctgtttgctggggattcgtcacggcttctcatggggagcgggcgccatcgattatttgctgaatcttaatttgtcagacggcggattattgatcataccggtgggcgttgcttttttcgcgctctattatgttacgttttactttgtgattataaagcgaaacgttccggtgatcggaagggagcaggaaacacctgaaggagaccggctgcagcagtctatggcggcaggtattctcaagtatatgggcggccgtgagaatgtcgtcacttgtgaaaactgtattacccgtttgcgactgaaattaaaagacacgtcattggcggatgaagcccaattaaagcgattgggggcgcacggtgtgatcataattgatcggcatcatattcaaattgtgattggaacggatgcggggactgtaaaaaaagacttgcagaacttgatcgacgaatctgctccggattaa

SEQ ID NO: 236 - DNA, 777 bp, Bacillus licheniformis
atgaaaaaagatgagtattattcaatcggtgttttctcagaaatgacagggacatccattcggacgctccattattacgatgaaatcggcctgttgaaacctgaaaaagagacgggaaccggccgccgtctctacacagacagagatgcgaaagatttgcagaagatcatatgttttaagtttctggggtacagccttgaacaaattcgcgctttcatgaaggatgcatgcttcgatgctggtctgattgaggcgctgcaggagcagaaaagggtgctggaggagaggaaggagcatattgaaacagggctgaaagcgatcgacaggacgatcggtcttctggaagaggaagaggaaatcgacagttctgttttcatgagcctgctgaacagcatccagacggagaaggagcagcgcgaatggcttgaacagcaggtgtctaaaagttttgccgatgatgtattcggcaaatcagaggaagagatggccaaattggatcaagagtatgttcgtttatctaaggaagccaagcggctcatgggaaaaccggttgatgaccccgaggtgcaggacatggcagaccggtatatgaagacgagtttggagtttgtcggagagggcgtgctgtcggctttaggacagatggagacaatagaatcgcggcagctggcagagaaatttccttcaccatttacaaaagaagaagaagagtggctgcagcgggtgttcgaatattatatgattcacaacgatttctgtcccgaaagcggcggatga

SEQ ID NO: 237 - DNA, 723 bp, Bacillus licheniformis
atggaaactgtgaaagaaattttggttgtctacgggcgaatcattaccatccttccgcttttattggttgtcacattgttcatgggaaaacgctcaatcggagaaatgcctgtgtttgattttttaatcattattacattgggtgccgttgtcggagcggacatagccgatccgaagattgaacatttgcataccgccgctgcggtggctgcgattgccctattgcaaagactcgcttcaaatctcatgatcaaataccgaacgctgggacgtctaattacatttgaaccgaccatcgtcatcaaaaacggaacgtttatcgtcggcaatctgaaacgaatcaaatattcagtggataatattctgcaaatgcttcgggaaaaagacgttttcaatgtcagcgacgtagaaatggcgtttgtagaggcgaacggaaatttaacggtatacaaaaagccaaataaaatggaaatcacagctgaagatatgggaattcaaaaaagcagcggcgaattttcatatccggtcatcgttgacggaaaagtgtacacgtctgtccttcagcaattgaatgtaacagaaagctggctcaaaaaccagctgaagaagaaagggcttgaacgaatggatgaaatctttttcgcttcggttaatcaaaaccatgaactgcatgtttcgctcgataatcaaacgacgaaaattgagccggagcttttgcattaa

SEQ ID NO: 238 - DNA, 711 bp, Bacillus licheniformis
atgaaattaagcagcaaactcatccttggattaacggtttcatcactcgccggcaagtttcttgaaaagttgctgattcaagataatgtcagccccaatatcacggcgtcatttaatcaagaagcagatattccggacattgatgcgtcctcttacatccatcatttcgcctcggtcatcggcagtgtggtcatcgggcgcaacgttttcatcgggcctttctcttcgatcagaggagacgtgggattaaaaatcttcatcagccatgactgcaatatccaggacggagttgtcttgcacggattgaaaaactatgaatacaacagccctgttactgaacattccgtttttaaggaccgtgaatcgtattccatttacataggcgagaaagtgtcactcgccccgcaatgtcaaatttacggccccgttcgaattgacaaaaatgtttttgtcgggatgcaaagccttgtttttgatgcctatatccaggaggatacggtgatcgaaccgggagcaaaaataatcggtgttacaatccccccaaaacgatttgtctcggcgggtcgtgtgatttcaaaccaggaagatgccaaccggctgccagaaataaccgattcctatccatatcatgatctcaactccaaaatgacatccgtcaaccttgaattggcaaaaggctacaaaaaggaagaaagacaatggaaactgtga

SEQ ID NO: 239 - DNA, 399 bp, Bacillus licheniformis
atgaatatgaaaagaagccggataggccggcttgcgctgacattcgcagcgatggcggcggggcttgcttcaagaaagacggccgatatgctgccggacatcgtgaatgtatatttaggggatgcgctgtgggcgctgatgattttcttcggcgcaggctttctgttcaaaaacgcgaagacggcttccgcggcgctgattgcgctggtgttttgttttatgattgaatgcagccagctgtatcacgctccatggattgacaatatcagagccgctccgctcggagggctcattctcggttatggatttctgtggagcgatttattggcttatgtgctcggcgtttccgcaggcgccgcgggcgaaatgctgttccgcaaacgaaaaagacagccgtaa

SEQ ID NO: 240 - DNA, 1431 bp, Bacillus licheniformis
atgcagcaattccttcaagaagtcattggtgtcacaaatgattttctttggtcaaaactattgattattatgcttcttgcttcgggactgttttttacttttaaatctaagttctttcaagttcgcttgctgaaagacatgttccgtgttttaaaggaaggaacgcccgacaaaaacggaatttcgccttttcaggctttttgcatcagcatggccgcgagagtaggaacaggaaatattacggggattgcgatcgccattgccttgggcggacccggcgctatcttttggatgtggatcatcgccatcatcggttcggcgtcaagctttgtcgaaagcacgctggcgcaaatttataaaataaaggataaagacggcttccgcggcggccctgcttactatatggaaaagggcttgaaaaaacgctggatgggcgcggtttttgccgtcttgatcacattgtccttcgggatcgtttttaacgcggtccagtccaatacaataacggtcgcttttgaaaactcgttcgggacagaccgtctcacactgggaattatcatcacgattgttttcggcatcattacattcgggggaatcaaacggatcgccaagctgtccgaatatatcgtcgtatgcctggccgtcttatatatcggcgtcgccgttttcgtcatgctgatgaatattacgaaactgccggacgtcatctctttgattatcggtcatgcgtttggccttgaacaagcggcgggcggagccatcggcgcggccctgatgaacgggatcaaacgcggcctcttctcgaatgaagccgggatgggcagcgcgccgaatgccgcagccgcagccactacgagccaccctgtcaaacagggccttgtccaggctttaggagtctttacgagcactttggtgatttgttcaagcacggcttttatcattttgttttccgatgcgtataaagagccggggcttagcggaatcgagttgacgcaagcgtcgctcagcacgcacatcggagcatgggcctcaggctttctcgccattatggtgttcctgttttctttcagcaccttgatcggaaactactactacggcgagacgaatatcgaattcctgcacacgaacaaagcatggctcttcatttaccggatctgtgtgcttgcgatggtcatcttcggatcggtatcaaaagtccagcttgtgtgggacctcgccgatttgttcatgggcctgatggtcatcgtcaacctgattgcgattttcctgctgtcaaaagtggcatttgccgccttgaaagactatgtgaaacagcgcaaagcgggcaaagacccggtcttttataaagatgtcattaaaaaccatgaaggcatcgaatgctgggagcactccggcaccgaacaaaaatccgaaagcaaaaatgcgatataa

SEQ ID NO: 241 - DNA, 984 bp, Bacillus licheniformis
atgaatgaagtattggaagaacgctatgacgcccgcttctggcaatcccgccttgaagatttggtcgaacattaccgtcctttttcctcaagcggacgcaacgccgaatacattcccgctttaggaaaaatcgactctaaccagctcggcatctgtgtgatcggctctgatcaaacgatgatcaaagcaggaaattcggacgtatcattcacactccagagcatctcgaaggtgatcagctttatcgcagcgtgtttgacgaaagggatttcttacgtattagaccgtgttgatgtagaaccgacgggagacgcgttcaattcaatcatccgccttgaaatgcacaagccgggaaagccgtttaacccgatgatcaacgccggagcgctgaccgtttcgtcgatccttcccggtgaatcggcactgggaaaaatagagtcgcttcatgacgtcattgaaaaaatgattggaaaacggcttgagatcaatgaggaagtctttcggtcagagtggcagaccgcccatcggaacagagcattggcccattatttaaaggaaaccggcttcctcgaagcagacgttgaagaaacgcttgaagtctatctgaaacaatgctctatggaaggaagcactgaagacatcgccttgatcggcatgattcttgcaaatgacggataccatcctttccgccgtgaacatgtcattccgaaggatgtcgcgcggctgacaaaagctttaatgctgacgtgcggaatgtataatgcatcaggaaaattcgcggcctttgtcggcattccggcaaaaagcggcgtctccggcggaatcatgtgcgcggtgcccgccagcgtgaaaagagaacagccttttcagcacggatgcggcatcggcatctatggtccggcgattgacgattacggaaacagcatgacgggcggaatgcttttaaaacatatagcccgtgaatgggatctcagtattttttaa

SEQ ID NO: 242 - DNA, 1329 bp, Bacillus licheniformis
atgatgggtggaaatcggggaagcgtgatgacaaaagcggcccggcttgttaaaaaagacggctatatcttaatggtgatgatgttaactgtgccgctggcaggagagctgaagttttatccgctgaacgagaccttcagggtcagcttcggggttccgactttcttctttcttttgctgctgctgcggaatgtgccggctgtgctgtccggctttttaacgggggcggcagtcgtcggatttcgtgtgctgcttgatggatttgggccggggcagatcgattggctgtcatccttttactaccattatccgacttttttcttttatttcacatatgcgtttctattctacttggcaaaagtgaaacgatttcaatttcgcccgctctacatcgggtttctcggcttcggaatcgaactgattgccgatggagccgaactggccgttcaatatatgatgttcgagtctaccgtcaccccgggaaaaatccgcgacatgatggcgattgctttttcccacagctttattgtgctgagcttttttaatgtcatgaagctgtatgaaacgcaatcgcgggaaaagcagatccgcgaacaaaatgagcacatgctgatgatcgtttcaaacttatatgaagaaaccgttcatttgaaaaagacgttgaagaatactgaagagattacaaacgagtcctatcagctgtacaggctcttaaatagacagagcgataacaattcctccgtccggcagatcagccagaaagtgctgcgcctcgccggtgaaatccatgaggtcaaaaaagacaatcagcgcattttcgccggactttcaaaattaatttccaaagaaagcttcagagactacatggctgcagaggatctggtccggcttgtgaccggcataaatcgaaagtatgctgaatcgctcgaaaaagacattgactttcattattcgatagacggagaacatccgaaataccatgtgtataccgtattatccgtaattaataatattatggcgaacgcggtggaagcgattcaaaagcagggctccatcagactcagcctctataggcgcggcgatgacatgctggaatgccgcgtggaagatgacggaccgggcattcccgagaaagtcggagatgtggtgtttgagccgggatacacgtcaaaatatgatgaattcggaactccttcaaccggaatcggtctgtcttatgtgaaggaaactgtcgaggagcttggagggagcattcgattccggaatgatgcaagcggtgttgtgtttacgatcagacttccggttcaacaattgattcagaaagggtga

SEQ ID NO: 243 - DNA, 936 bp, Bacillus licheniformis
gtgcgtttttttattgcagatgatgaccgtgctgtgcgatcgattttaaaacaaatcattgaagacgaagatttgggtgaagtggccggagaagcggaagacggctgcgatttggaaggacacgtcctgaatttgcagcaaattgatattttatttgtcgatcttttaatgccgctccgcgacggaattgaaacggttcgtcatttgcacggcgttttctcagggaagatcatcatgatctcccaggtggaatcaaaggaaatgatcggtgaagcctattccctggggatcgaatattatatacataaaccgattaaccgcattgaaatcttgaatgtcattcaaaaagtcaaggagcgcatcgagctggaacggtcgatccatgacatacaatcttcgctgaaccggcttgtgagcctcggcggcggggggaaaaacggctttagggaaaaaagcattcaggaaacgggcgaatttctcctgtctgaactcggaatcgtcggggagagcggatcccaggatttaatcgccatccttcagtatttgtttgatgatgaacagacctcattatatgaaaaggactttccgccgctcaaacagatttttcatcagattgccgtgcaaaagctcggaccggctgcttcacccgcagagatcaacagggaggttaaagcgtctgagcagcggatacggcgggcggtcagccattcgctaaaccattttgcatcactcggtttaacagacttttcaaatccgcggtttgaaagctatgcgtcccggttttttgactttaccgtcatcagcaaaaaaatgaaagaactgcagaaagactctgccgccgtcttgccctccgcccgcgtcaacacgaaaaaattcattcaggttttctttttggaagccaagcggttgagtgaaagcgctggaaaaagaggttaa

SEQ ID NO: 244 - DNA, 537 bp, Bacillus licheniformis
atggaaaccctttatacagaaagattgactttgagaaagatggaattggaggatgcagatgtcctctgtcaatactggtcagacccggaagtcacaaaatatatgaatatcgcgccttttacagacgtctcacaagcgcgggacatgatccaaatgatcaatgatttaagccttgaagggcaggcaaaccgcttttcgattattgcaaaggaaacgggtgaagtcatcgggacatgcggctttaatatgatcgaccaggaaaacggcagagctgaaatcggctatgacttaggaagaaatcattggggaaaaggctttgcttccgaagctgtcaaaaaactgatcgactacggctttacaagcttgaacctcaaccgaatcgaagcgaaggtagagcccgaaaacacgccttcaatcaaacttctcaactcgttatcctttcaaaaggaaggactgttaagagaatacgagaaagcaaaaggaagactgattgacgtatacatgttttcactgctgaaaagagaatacgctgggtaa

SEQ ID NO: 245 - DNA, 1800 bp, Bacillus licheniformis
atgagcagttctttctttattccctttttggttagtcaaattctattgtctctgtttttttctctcatcatactcataaaaaaactgctgaaggctcaaatcactgtaggcacccactatcatcttagcgtgatttctcttttggcattgatcgctccttttctcccctttcattatctaaaaagcaatcattttgactggattctgaatttaggaggagctagctcaacgctatctcacacccgttccacagataagacggcggaagcaattggccaacatgcaaactgggtgcaggatttttcgatgtcgattgaacaatcgtccttcaaaatgatagattcagcctttttcgcagtctggatattgggcattgctgttatgcttatcgctactctttatagcaatcgaaaaatcggcaaaataaaaaagagcctgcaaatggttaacaacaaagagctattaaccctttttcgtacatgtaaagaggaaatacgctttcatcaaaaagtgattttaggctgttccccattgataaaatcccccataacatttggggttgtccgtccatatattatcttgccaaaggatatttcaatgttttctgccgacgagatgaaatgtgttttgcttcatgaactgtaccattgtaaacgaaaagatatgctcatcaactattttctttgcctgtccaaaatcgtctattggtttaatcctctcgtgtggtatttatcaaaggaagcaaaaacagagatggagatttcttgcgactttgccgtattaaaaacgcttgataaaaaattgcatctcaaatatggcgaggtgattttaaaattcacttcacttaagcaaagaacgtcatctttggtagccgcttctgaattcagcagctcatacaaacatatcaaaaggcggattgtcacagttgtcaacttcaaggcggcatcacctttgctaaaggtgaaaagcgccttagtgttcgcccttgttcttgggatcattctagccggcactccttctgtatctatattgactatgcaaagagatacgcactttttatctggtgcaaatgtagaatacgaagatgacagcaccttttttgatggcttctcaggaggttttgtcctgtttgattctaacaggaaaaagtatacaatatacaataggaaagaaagcaccgccagattcgcacctgcttctacatacaaggtgttcagcgcattgctcgcactggaatccgggatcatcacgaagaacaattctcaaatgacgtgggacggaactcaatatccgtataaagaatggaatcaagaccaggatttattctctgcgatgagcagctccgcaacatggtattttcaaaaactggaccggcaaattggagaggatcatttgcgtcgctatctcaaatctatccattatggaaatgaggatttctcaggtccggcgaattattggctggatggctctcttcaaatttcccctcttgaacaggttaatatgttaaaaaagttttatgataacgaatttgattttaaacagtctaatattcaaactgtgaaagattcgatacgtttagaagaatcaaatggcagaattctatccggtaaaaccgggacttcagttatcaacggagaacttcatgccggctggtttgtcggatatgtagaaactgccgaaaatacttttttctttgctgttcatattcaaggtgaaaaacgggctgccggaagcactgctgccgagattgcactttccatcttggataaaaaagggatttatccatccgcttcccgataa

SEQ ID NO: 246 - DNA, 387 bp, Bacillus licheniformis
atgaaaaaaatacctcaaatctctgatgcggaattagaagtgatgaaagtcatctggaagcattcttcgatcaataccaatgaggtgattaaagagttgtccaaaaccagtacatggagccctaaaaccatccaaaccatgctgctgcgcctcattaaaaaaggagcattaaaccaccataaagaaggccgggttttcgtttatacgccaaatatagacgaaaatgattatatagaagtgaaaagtcacagttttttaaaccggttttacaatggcactcttaattcgatggtattaaactttttggagaatgatcagctgtcaggtgaagaaattaatgagttgtatcaaatactagaagaacataagaacagaaagaaggaatga

SEQ ID NO: 247 - DNA, 924 bp, Bacillus licheniformis
atgaaattatggttcagtactttaaaactgaaaaaagttgcagctgtgttgcttttctcttgcgtcgcacttgcaggatgcggcagcaatcactcgaatgcctcacattctgccgagaaagatgaaaagacggagatgaaagatgattttgcaaaactcgaggagcaatttgatgcaaaactcgggatctttgcattagatactggtacaaaccgaacggtaacgtatcggccggatgagcgcttcgcttttgcatcgacgattaaggctttaaccgtaggcgtgcttttacaacagaaatcaatagaagatctgaaccagagaataacatatacacgtgatgatcttgtaaactacaacccgattacggaaaagcatgttgatacgggaatgacgcttaaagagcttgcggatgcttcgcttcgatatagtgacaatacggcacagaacctcattcttaaacaaattggcggacctgaaagtttgaaaaaggaactgaggaagattggtgatgaggttacaaatcctgaacgattcgaaccggagttaaatgaagtgaatccgggagaaactcaggataccagtacagcaagagcacttgcgacaagccttcaagcttttgctcttgaagataaacttccaagtgaaaaacgcgagcttttaatcgattggatgaaacgaaataccaccggggacgccttaatccgcgccggtgtgccggaaggctgggaagtggctgataaaactggagcgggatcatatggaacccggaacgacattgccatcatttggccgccaaaaggagatcctgtagttctcgcagtattatccagccgggataaaaaggatgccaagtatgatgataagcttattgcagaggcaacaaaagtggtagtgaaagccttaaacatggaaagcaaataa

SEQ ID NO: 248 - DNA, 1752 bp, Bacillus licheniformis
atgacacatgaaggaccgctggaggaatggatgaaaaaactgagcgaggaaagcctcaaggacaatacgtttgaccgccgccgctttattcaaggggccggcaaaatagccgggctttcgctcggacttgcgatcgcgcaatcgatgggggcaatggaagtcaatgcagcaccgaggttctccgaatatccgtttacacttggcgttgcatcgggagatccgctttctgacagcgtcgtattgtggacaaggctggcgcccgatccgctaaacgggggcgggatgccaaatgaagctgtatccgtgaaatgggagctcgcagaagacgaacgcttccgccgtgtcgtcaaacggggaaccgaaaaagcaacacctcaccttgcacattcggtacatgccgaggtatccgggctgaaaccgaatcatgtatactattaccgctttaaatgcggcaaccagctgagtcctgtcggcaagacaaagacgcttccggcgcccggggcagatgttgctaaattcacattcgcttttgcttcatgccagcagtacgaacacggctattataccgcctatcagcatatggcaaaggaaaagctcgatcttgtttttcatctcggcgactatatttatgagtacggtccgaatgaatatgtttcgaaaacaggaaatgtcagaacacacagcggtcctgaaatcatgtcactgctcgattaccgaaaccgtcatgcccaataccgttcagatgcaaacctgaaagctgcgcatgccgccttcccgtgggttgtcacatgggacgaccatgaagtggagaacaactatgcgaatgtcatcccggaaaaaggccagtcagttgaagcgtttattaaacggcgcgccgccgcataccaagcttattacgagcatatgccgctccgccgccaatccttgccgaacggtcctgatatgcaattgtaccggaatttttcctacggcaatttagctgacattagcgtgctggatacccgtcagtatcgcgatgaccaggctaacggcgatggcaataagccgccttctgatgaatcgaatgatccgaagcggacgctgcttggagcggagcaggaggcttggctgtttgacaatctgagtcgctccgaggcgcactggaacattatcgcacagcagattttctttgcgcagtggaactttgggacaagcgcggcgccgatttacagcatggattcgtgggacggatatcccgctcagcgcaagcgggtgatcgacttcatcaaatctcaaaaactgaacaacatcgtcgtccttaccggtgatgtgcatgccagctgggcaaataatctgctcgttgattttgacaatccgaaatcggacatctttggcgtggagttcgtcgggacgtcgattacatcgggaggaaacggcgctgataaaagagcggatacggataagattttatcgaacaatcctcatataaagtttttcaatgattaccgcggctatgtgcgctgtacggtcaccccggaagaatggcggacagattaccgcgtcgtcccgtatgtgacagagccgggtgcggcggtttcgacaagagcttcctatgtttatcataaagactacacagggctgaaacggaccgcttccaacattgtgcctggaggcgtgaagaagtcaaacgaagtagaagaagaccgtttcctcgcacatacaagggcccatcagaagcaagtgaagcaaaaggagaaaaaagtaacccagtaa

SEQ ID NO: 249 - DNA, 213 bp, Bacillus licheniformis
atgctttcaaatatcggtattcctggtctcatcttggttctggtaattgcgctgatcattttcgggccttcaaagctcccggaaatcggccgggcttttggaaaaacgctgaccgaattcaaaagcgcgacaaagtctttagtctctgccgatgacaatgagatcggacaggggtctgatgcgaagaagcaaagcgatccatcggcacgatga

SEQ ID NO: 250 - DNA, 735 bp, Bacillus licheniformis
gtgaaaaaaagggaaacacatttgattgcccatcttgaagagctgcgccagcgaatcattaaaacgcttcttacgtttattctgtttctcatcaccggcttcttgtttgttcaggacatctatgactggctgatcagagaccttgatgaaaagcttgctgtactggggccgggggatattctttgggtttatatgatgattgcgggggtgctggcgatcgcagccaccataccggtggctgcttttcagacatggcggtttgtggcgcctgcgctgaccgaccacgaacggaggacggcattattttatattccggggctgttcattttttttattttggggattgtattcggttattttgtactctttccgctcgttcttcagtttttgatcggcctgtccgccggccattttcaaacgatgtttacggcggagcattattttcgctttatgatgaacctcacactgccattcgggtttttgtttgaaatgcccctcatcgtgatgtttttaacgagcctcgggattttaaatccggccaagctcagtaaaatgagaaaaatttcttattttgcgctgattgtcgtatcggttgtgatcacgccgcccgatttcatctcagatgtgctggtgatcgtcccgctccttgtattatacgaattgagcatctctttatcggcatttatctaccggaaaaaaaccgccgcacaacaaggggctgaggcccaaggctga

SEQ ID NO: 251 - DNA, 966 bp, Bacillus licheniformis
atgagtcaattacggaaggcgccggaaggcatattgggttttccggtggcgcccttcaacagggaaggaaaactggaggaagaagcactttacgaaaacatccgctttttattggatgaagggcttgaggcggtttttatcgcttgcggctcaggagagtttcaatctctcagcacaaaggaatatgagcaaatggtcgaaatcgccgtttcggctgcggacgggaaggtgcctgtttacacaggagtgggcggcaacttaagcaccgctttggaatgggcgcggatttccgaggaaaaaggggccgacggctatctgattctcccgccgtacttgatacacggagagcaggaaggcctctatcaatacacgaaaacaatcattgaaagcacggatttaaacgcaatcatttatcagcgagacaatgcggttttgacgcttgaacagattcagcggctgaccgatctcgagcagcttgtcggacttaaagacggcataggggatatggcgttgaatatcagtttgtcatatacgataggtgacaggctgggctggctcaacggaatgccgatggctgaagtcacgatgccggcctatgctccgattggctttacatcatattcttcggcgatatccaattatattccccatatttccagaatgttttacgaggcattattaaacggcaatgaccggcttgtcaaagagatttatgagcaagtcatcataccgatcaacgagatccgcaaacttcggaaaggctatgccgtgtccttgatcaaagccggcatggaaatcatggggcttcatgtgaaaaacacggcgagaccgccgatcgttccggtggaaaaagaacattgccggcagcctcgaaaacattctgaaaaacgcgatggcgcgttatccgaaaacgaccgctgccctataaacaaaaaggaggaacttgaagatgtctgttgcagctga

SEQ ID NO: 252 - DNA, 1467 bp, Bacillus licheniformis
atgtctgttgcagctgaaagtaaaacgtatttcaactttatcaacggccgctgggtgaaggctgaatcgggcgggatggaacagagcttgaatccggcagatacacgggatatcgtcgggcttgtgcaaaaatcttcgattgaggatgtagaccgggcagttgaagcggccaagcaggccaaaaaggcgtggagaaagctgtcgggcgcggagcgcggtcaattcctttacaaggccgctgacatcatggaacagcgcctcgatgaaattgccgaatgtgcgacgcgtgaaatgggcaaaacactgcctgaagcaaaaggcgaaacagcgcggggaatcgcgattctcagatactatgccggagaggggctgcggaaaacaggtgatgtgattccgtcgaccgattcatccgcttttatgtacacagacagggtgccgctcggcgtcgtcggcgtcatctcaccgtggaatttccctgttgccatcccgatttggaaaatggcgcctgctcttatttatggaaatacggttgtcattaagccggctacggaaaccgcagtcacctgccttaaggttatatcgtgctttgaagaagcagggattccctcaggcgtggtcaatgcggtgacaggaccgggatcatcggccggccaaaggcttgccgagcacccggatgtgaacggaattacgttcacaggatcgaatcaaacaggaaaaatcatcggccggacggcgtttgaaagaggggcgaagtaccagcttgagatgggcggcaaaaacccggtgatcgtagcggatgacgccgaccttgatattgcggttgaagcggtcatcagcggagcgttcaggtcgacaggccaaaagtgtacagcgacaagccgcgtcatcgtcttaaatggtgtttatgaccgttttaaagaaaagctgcttcaacagacaaaagagattacaatcggcgacagcttaaaagaagatgtctggatggggccgattgcgaacaaacagcagcttgacaactgcctgtcctatattgcaaaaggaaagcaagaaggcgcggacctcattttcggcggtgagaggctggcagatggaaaatacgaaaacggctattatatcaggccggccatttttgacaacgtcacttccggcatgacgattgcccaagaagaaattttcggcccggtcatcgctttaatcaaggcggatacacttgaggaagcgttggagacggcaaatgacgtcaaatttggcctgagcgcctccatttttacgcaaaacattaggcggatgctgtcattcacagatgaaatcgaagcggggctcattcgcgtcaacgccgaaagcgccggtgtcgaactgcaggcgccattcggaggcgttaaacaatcgagctcgcattcacgggaacagggggaggcagccaaagaattttttacagccgtgaaaaccgtatttgtcaaaccgtaa

SEQ ID NO: 253 - DNA, 1377 bp, Bacillus licheniformis
atgaaaaaaaatcgtgcagcctcccccgataccgcggggaaaagaagttctgtccgctggtttgtcgtgtctatgctgtttctcgtcacatccattaattatgccgaccgtgcgacactttcgatcgtcggcgattctgtgcagcatgagcttgggctgagttcggtggcgatggggtatgtcttttccgcatttggctgggcgtatgttgtcggccaaatccccggaggctggctgctcgaccgttttgggtcgaaaatcgtcatcgccgccagcatcttcttttggtcattgtttacccttttgcagggtgcgcttggctttttcgccgcgggaacggccgtaatccttttatttgcgctcagatttctcgtcggtctgtcagaagccccgtccttccccggcaacggccgggtggtggcttcctggtttccaagttctgaacgcggaacagcttcggcgatcttcaactcggcgcagtacttcgcactcgtcattttttcaccgctgatggggtggctcgcccactctttcagctggcatacggtttttgtcattatgggtgcactggggatcgcgatgtcgttcatttggctgaaaacgatttacgaaccgaaaaaacacccgagaataaacgccgccgaactggcgtacatcgaagaaggcggcgcgcttgtctcgatggatgagggaaagaacgcggaaaaaaaagaaaaggagtcgcaatggccttatattaagcagcttttaagaagccggatgctgctcggggtgtatatcgctcaatactgcatcacaacgctgacctatttctttctgacatggtttccggtctatcttgttcaggcgcgcggcatgtcgatccttgaagcgggttttgtcgcatcgcttcctgcaatctgcggatttttaggaggattgctgggcgggttcgtgtcagacttccttttgaaaaagggctgctccataacggttgccagaaaaacgccgatcatcctcggcatgctgatgtcctgctcaatgatcatatgcaactatgcagattcgtcctggctggtcgtttccatcatgtcgcttgcctttttcggaaaaggattcggcgcgctgggctgggcggttgtgtcagatacctcgccaaaggagtgtgccggcttgagcggcggcatcttcaacacctttggaaacattgcgtccatcacgacgcccatcatcatcggatatatcgtgaatgcgacaggctcatttaacggagcgcttgtgtttgtcggagccaacgcgattgccgcggtattaagctatttgtttctcgtcgggccgatcaagcgcatcgaactgcagaaagagaaagaccctgcggacaccactttatccatgtga

SEQ ID NO: 254 - DNA, 1368 bp, Bacillus licheniformis
atgaatacaaacatccatcagcatgtaaaagaggagaaagcatcgcaaacaccgtctattgccgacatgcgggttatacccgtggcagggcgggacagcatgcttttgaatttgagcggagctcacggcccctttttcacacggaatatcgtgattttaaaggattcatcaggcgctctcggcgtcggcgaagtgccgggcggcgagcggatccgccagacgctggagcaggcgaagccgctcgtcatcgatcagccgctcggcgctgttcaatcgattttgcagtccgtcaggcgccggtttaaagacagggatgccggaggacgcggggtgcagacctttgaccagcggacgacgatacacgctgtgaccgcattggaagcagctttgctcgatttgctcggaaaatttctcggcgtccctgtggcggcgctcttgggggaaggccagcagcgggataaagtgaagatgctcggctatttgttttacatcggggaccgaaagcgcacgacgcttccctatatcagtgaacaagaggcaaatgacgactggttccatctccgccgtgaagaagcgttgactcccgaggcgatcgtccgtcttgcggaggcagcccgagaacgatacggatttcacgattttaaattaaaaggcggcgtcctttccggagaagaagaaatcgaggcggcatccgctttagcgaagcggtttcctaaggcgagaatcacccttgacccgaatggggcgtggtcattggaggaagcgattgcgctttgtaagggaaagcgggatgtacttgcctacgcggaagacccttgcggagcggaagccggatactcaggccgggaaatcatggccgaattccgccgtgcgacaggcattccgacagcgacgaatatgattgcgacagactggcggcaaatggggcatgcgatacagctgcacgccgttgatataccgctggcagatccgcatttttggacgatgcagggatccgtccgcgttgctcaaatgtgccatgaatgggggctgatatggggctctcactccaataaccattttgacgtctcactggccatgttcacccacgttgccgcagcagctccgggcgatatcacggcgattgatacgcattggatatggcaggatggacagcgtctcacaaaacagcctttttcaattgctgacggatatgtccaagttcctgatcagcctgggctcggcattgaaatcgacatggaacgggtggaaaaagcaaatgaactatatgagaaaatgacagcaggcgagcgcaatgatgccgctgccatgcagtttttgattgaaaattggcgtttcgaccctaaacgtccttgtcttgttcgataa

SEQ ID NO: 255 - DNA, 714 bp, Bacillus licheniformis
gtggaagaagatatggaaacattgcaggtcgaatcagtcaatcgcaagactttggcaaaacaggttgttgaacgaatcgtccatttattatcaagcggccagttgaaaccgggggacaaactgccgacggagattgagctcatggaaaagctgaatgtcagcagacccgttctccgcgaagctttaatatcgctcgaaacgctcggaattatcaaaagaaaaacccgggacggcacatattttaatgataaaatcggcattcagccgttttctgtcatgctggctttggcagtcgataatttgccggccattattgaagcgaggatggcgctggagctcgggcttgtcacgatcgccgcagaaaagatcaatgacagtcagctcgaaaggcttcaggaaacgatcgatattatagcaaacagcacggataatcattatggagaagcggataaggaatttcaccggattatcgctttgagcgcgaacaacccggtgcttgaagggatgattcaatcgctcttgatcacacacgccaaaatcgacagccagattccatatagggaaagggaccggactgtcgaatatcatacgaatattttgaaagcccttcaacaaagggacccatatcaagcctatcaccatatgtatgagcatttaaaatttgtacgtgacaaaatactgaatggtcttcgtgatgaaaaaaacaatcattaa

SEQ ID NO: 256 - DNA, 1527 bp, Bacillus licheniformis
atgcttgtcaatcaaactgaaaccccgttgtacattaaggtgaacgaaaaagacaatgccgcaatcatcgccaatgccggcggactgccgcaagggacggtgtttccttgcgggcttaagctgcaagagcggattcctcaagggcataaagtggctttaacagacatcacacagggcggtgccgttattcgctacggcgaaattatcggctatgccgtcaaaccgatcgaaaaaggcgggtggatttccgagtcgcatatcatgcttccggaagctccgccgctcgatgaactgcccatcgccaacaaagttccaaaacccgctccccttcttgaggggtatacatttgaaggataccggaatgaagacgggagcgtcggcacgagaaacgtgcttggcattatgacaagcgttcaatgcgtcgcaggcgttctcgattacgcagtgaaacgaattaaagaggaactgctcccaaaatatccgaacgttgacggtgtcgctgcattaaatcatcagtacggctgcggcgtggcgattaatgcgccggaagccaaaatcccgatccgaacgattcaaaatatcgccaggcaccctaatttcggcggtgaagcgatggtgatcggactcggctgcgagaagctccttccgacgaagatagagccggaaggagacgctgaaaacattctttcactgcaggaacggcaagggtttcagcaaatgatacaatcgattatggaaatggccgaagagcgcttaaaaaggctgaatgaacggaagcggatgacatgtcccgcttcagacctggtgatcggcctacagtgcggaggcagcgacgccttttcaggagtgaccgcaaaccctgcgtccggatatgcggccgacttacttgtccgggcaggggccacggttttattttcggaagtcaccgaagtccgcgatgccgttcatctcctaacaccgcgcgctgtcaatgaagaagtcggccgcgccctgattcgggaaatggcttggtatgaccgctatctggaaagaggcgaatcagaccgaagcgccaatccgtcgccgggaaacaaaaaaggcggactggcaaacgtggtcgagaaatcgctcgggtcgatcgcgaagtcgggaagcagcccgatcagtgccgtacttgcgcccggtgaaagggctgtacagaaaggactcatttttgcggcgacacctgcaagcgattttgtatgcggcaccctgcaattggcttctggcatgcatttgcaggtatttacaaccggaaggggaacgccgtacggccttgaaatggctccggttttgaaagtggcgacccggcagtcattatcagaagattggcacgacttgatcgacgtcaatgccggaaggatcgctacaggcgaagcttcaatagaggaagtcggctgggaaatcttccggacgatacttgacgtcgcaagcggaaggaaaacatgggcggaacattggggactctccaatgacttgtgtttattcaacccagcgcctgtgacttga

SEQ ID NO: 257 - DNA, 606 bp, Bacillus licheniformis
ttggcttttgacggagaagagggcgttcgcttgtttcagcaaggcaattatgatgcgattctgctcgacatcatgcttcctaagctgaatggaatggattttctgaaaatgatccgtgaacagagcaaagttccggttttaatgatttccgcaaaagacggggatgtcgataaagcgctggggctgggctttggtgcggatgattatattgccaagccgttttcgatgatcgaactgaccgcaagaataaaagccgccattcggcgggcaacgcaatattccgtcagtgaaccggcaaatcaaaaaatattacgtgttcacgagcttacggttgatatagaaaatgtatccgtacaaaaaaatggtgaaccgcttcagctgacatcgacggaatggaaaatgctgactttgtttgtgacaaaccctaaaaaagtgtttacaaaagaacaaatctatcgttcggtttggaatgatgattattttggcgatcaaaatattattaacgttcatatgaggcgcttgagagaaaagatagaggatgatccttcctccccgcaatatattaaaacgctttggggcatcggctataaattagcagagttttag

SEQ ID NO: 258 - DNA, 936 bp, Bacillus licheniformis
atgacaatgttatggattggcattctgataattttggcgtctctcaatatcgttcaatataaaatgaaaagacaacgggatcgaaacttgaagtacatcacggaaaagctcagtgtgatgctaaatgagcatgaggctgatcaaattttattaggaacggctgataaagtactgcgggctctgctcgtgcaaattaacctgtttgttgaggagcatcagcacataacagcccgttttgcaaaaacggagcagtcaatgaaacgaatgctgaccaatatgtcccatgatctgaaaactccgctgaccgtcgtgctcgggtatatcgaggcgatccaaaatgattcagacatggcggaagaggagcgtgaaagactgctggagaagctttatcaaaaaacaggcgaaatcattcagctgatgaattctttctttgacttggccaagctggaatcggaagataagcaaatactgctcactaaaatacatatcaacgaaatatgcagaaaaaacattctccaacactatgatgccgttcaggcaaaaggttttaaagctgtcatcgacatcccggataccccggtttatgcacatggaaatgaagaagcgcttgaccggattttgcaaaaccttttatcaaatgcgattcaatatggtgcagacggaaagctgatcggattgtcccttacatatgatgagacgtggattgtcattacggtatgggaccgtgggaaaggaattagtgagtacgatcagcagcgggtgtttgaaagactgtatacccttgaggaatcgagaaataaagcgttccagggaagcgggctcggtttaacaattacaaaaaggctcattgagaaaatgggagggaacatctctctccaaagcaagccgcatgaacggacagtgttttccattacgttaaaacgaatgacctattag

SEQ ID NO: 259 - DNA, 924 bp, Bacillus licheniformis
ttgacttacatcgtacaaacaagcgggcttaccaagacattcaaaggtcaagaagttgtttcaaatgtaagcatgcatatacgaaagggagaaatatacggttttctcggcccgaacggagccggaaaaacgaccatcatgaagatgctgacgagcctcgtgaaaccgacaagcggcgaaatcaatatccttgggcataagctgacaaatcgatcatacgagattctcgggaaaataggcagcatgatcgaatacccgattttttatgaaaatctgacagccaaagaaaatttaaatctgcattgtgagtatatgggatatcacaataaagccaagattcaggaagtgctggacatggtgaatttaaaaaatatcgacagcaaacctgtcaaaacattttccctcggtatgaagcagcgtcttggaatcgcgcgggccattctcaccaaaccctacttgctcatcttggatgagccgattaatggccttgatcccatcggaattaaagaaatcagaaacttatttcaagtattgagcaaagagtatggcatgacattgctcatctcaagccacatcttgaacgaagtagagcaaattgcagatacaatcggagtgattcgggacggcaggcttgttgaagaagtatcgatggaaagcgtaaggggacggaacacagagtacattgaactcgtgacgccgaaccaattgcatgcttgctttgtgcttgaacatgagctgcagattgctaattttaaaatactaaatgataaaacgatccgaatttatgatgccgaagcttctcaaacagccatttctaaagctctgattttgaatgatgtagaaattgaatccatgaataaaaagcatacttcgcttgaggactacttcctcagcttaatcaacggcaatgcggtcaacgcataa

SEQ ID NO: 260 - DNA, 684 bp, Bacillus licheniformis
ttgctgaatttgatgagaattgaaatgaaaaagctgaagctgggatggtatatacgcggagccgtctttgccaatttcatcatttttggttttctgtggatggtgacctgcacagaaggcaaggagacgttccaaacgattgatgaaacttttctattgatcggcacttttgttagagccgtttttatcgtattcggcgctgtgctgatctcaaaattagtgatttcagagtttaaaaacaagacaatactggtgatgttcacgtatccgatcaatcgaaagaaactgctggctgctaaactgctgatcgcaggcgggctgaccttcgttacgatattgatatcaaacgcatgcgttgcagttggtttttttctgctgaactcaatctatgggatcatccccggcgaattaacagcttctatcgcgtctcagcaggctctgaaaatgatcgtttttgcttttggcgccgcaggaacgagtttagtacccatcttttttggaatgagaaagtactccactgcggcaacgatcatctcatctgttgtaatcatcatgccgatcagttccacaggccctggcttttctatttcttcaattgtgtatatacctttatctcttgccgcagtcggtctgtttttttcctttttggctgtaaggcgtattgaaaaaatagatgttttttaa

SEQ ID NO: 261 - DNA, 555 bp, Bacillus licheniformis
atggctgatgccgcatccatgctgctagttataggaattttcgtgaggtctgtgtttattgtctttgccggcgtgctgattgccaaactggtcatcggagagtataaaaacagaaccatcacggtcatgtttacatatccagtcagcagaaaaaaactaatggcagcaaaactgctgcttactggcggattgacctttttgacaatgatcgtgtccgaactgattcttgcatttattttctcgcagctcaatgatgtctatcaattcagcccggaaaaattgacgatgcatgacgtagggaatgagattggcagtatgctcatttatgctgcttcctctacaggactgagttttattccattatactttgggatgcgcaaacaatcagttcctgccaccattgtgacatcctgtatcttgaccacgttgatcggtcagcaaagcgatgaatttccacttgcttccatcatttacattccgatttcattggctctagtcggaattgccattgcgttttggtcgatacgaaaaattgaccaggaagacgtattataa

SEQ ID NO: 262 - DNA, 1080 bp, Bacillus licheniformis
atggaatttgaaattcgctacatctccttttacgtcatccaggtcgacggcaaggatgagcaggccaacaagcaatataaacattttcagacgctggatacagaggaatttgaaaacagcgagctgaaggatttcttagacggggaattgaaaaaaatcgtcaagcggaaagccgaacgccatccgaaatcggagcaggtgccgacgaaaatcggccgcttcatcacagagccggggcatgagcttgattctaatccgaactacaatctgtttcacaaaacaaaactggcggagacaaaggaagaattcaatgaactgagcgaacagttcgtccgcacatacctcgacacgagcgccgtcaggggaggcgtgtttttagtggcgacagccgtaccgcgcaaatacttcgatgatacatttgtctttgtcatgaagtgcgactttgaaccgaaggtcgctacgatcgccgatgaatcgtcgctgattcgcaaggtcgaaatggcgattacgacgaaaaacatgaaatcgattcagtacccgcacatgcctgaagagggcatgacagaggaaagcgaagtgaaaatccaccaggcctcgcacgcccgctactttgaagacttcttaaaattcgtcgagtacggcgagtcgatgccggaaatcatgaagtcacaagtgatgaacatggtgcaggagcacgtgtacgaagcatttgaagacaaaagcgaagaactccagcagtttgaacacgacctcgaaatctgggaagcgagcgaaaagcgggagattcaggaacgtcttgacacccaccaagtcatcgaagcctcagcccaaatcgttgagcacatgcctgaggcagagctgaaaatgaagctgggagaaaccgagattaaaggattgctggccgagttcggagactcgatccacctcgccaaagtaaacggccgctatgtggcgctcattgaagccgaaacgatttcgtttgaaaagggcagctctccggtcgagttttataaacctgagggtctgcatgaggtgattgagcggatacggaataaaattgacagggaagatgagaaataa

SEQ ID NO: 263 - DNA, 1185 bp, Bacillus licheniformis
atgcgtctcaatagtcaatacatccgtacacagctgatggtccagaatatattgaaaagaaatgcggctgatacaactttaaaaaatgtctcttccgatatcactgccgttgcgaagaaggccagcagtcaagcagggagagcatcgaaagaaagtttgagtaagctgaactactcaaaggacagtattgtgaatcatgccggagctttcaggcgggcatacgaagcagcaaatgatcgaactgtcacagatacagggaaagaaacgaagattaatgcccaaaacccctatgtgtcagaaagtgacatcaggaaaaaaatcttagatgaaaaatacagcaaaataaatgcaatgaacaaaacgaaacccgaccctttaggctacattaaggataaatacaaaaaccccaattccccttatttcagaaatgacttgtcggcagcagaaagacaggctgcatatgacaatgaaactgagtggctgttcaaaggaaaggcgcaaagctataatatgcaggatgccgcgtttcgaaatgtgacttttaatggggaagtagagacggagaatgagaaagtatatcagcgcagccaagtcaacaaacagcttcaagcgctgctggatcaatatcatattgccattccagcggatgcggcgctcacctttacgattacaccgattgattatcaagtaaaggtaagcggaacagatgatgagcaactcatccatcaaattgaacaaatattgcaatcaggagaaaacagcaaacagttatttctgcatatcatgaaaagcttgagcagcgattcggcacaatattccaaagaagcgcaccaaaaatatcagacggttcgcgagatatatgaggtgacagggtatcacctgaaagatttggaagtggttgatggccgatatgtaacaccttccggccgtgatttattagaagtgtataaagaagagctggagaaggatcccgtcctcaagaaaacggctcatctcgcaatcgctcattatggagcagagctgaacaggcttgcggaagccgaatatgattctgttccggatttcatcttgtctattgactacagcaacgggtcattgcgggatacagggcaaaagaagagctatggaaccggggatacggcttggctaagagaattaaagcgccgaacgggtgtgaatgattag

SEQ ID NO: 264 - DNA, 912 bp, Bacillus licheniformis
atgacaactgtaaatgagcaaattgaacatacattaaaacttgcggaaaaacacggccttcggctgaaacgaaagcatgcggaaatcaacgagtccggcatggattttcaagtcgtttttgcagaagatgaagcaggtaagagttgggtgttgagaaaaccgcggcgcgacgatgtgattgaaagggcagtgtatgaagggaaagtgctgaagctgctgcaaaaccgtcttcccgcggctgtgccggattggcgcattcatactcccgaactgattgcatatccggagcttccgggtgtgcctgccgcagtcattgacatggacatcaagaattacgtatggaacatggagcatgagcctccggctgaagcgtttaccaggtcattggcgaaaacgctcgcgctattgcacggcatcgatcataaggacgcagaagaagcgggcatgcatgtgatgaatccggatgacgtcaggcagacaaaagcagagcatatggagcggatcaaaagtgagctcggggttagcgccgagctctgggaaagatggcaaaagtggctgtctgacgactcgtattggcctgaacatacggtgtttatccacggcgacttgcaccctccgcatattttgattgaccagcatcagagcataactgggctgttggattggacagaagcaaaaatcgccgacccggctaaagactttctgttataccagacgattttaggagaagccgaaaccgcacggctcatctcttattacgaagaagaaggaggacgcgtctggccgcggatgaaagagcatattaaagaaatgcaggccgcctacggcatcgaaatcggcatgtttgcccttcaaacgaaacaagaagagcacttgaaaatggcgctggacgcgcttggcgtcacacaataa

SEQ ID NO: 265 - DNA, 420 bp, Bacillus licheniformis
atgaatcaccatcggattgaagcgaatctattggaccatgctttcacgaaatatttgcggtcttcaaagaaattagacgaagaaacgattccgaaaagtatcacgagcggcaaagggtttattttgcgtatcatttacagacacggaacatgtacgataaaggaaattttacaggaggtcgcgctgtctccatcagcaacgacaacagctctgaaccatttggagaaagagggtcttgtgatcagatcgagaaataacgatgaccggcgcaccgtctggatcgaactgtcgcaagaaggaacgaggatcgccgcacaaatggtggaaaaccgccaggccttgatcgacaagctcttcggcaaattgtcagaggaagaaaaaaaggctttttttgctgtgattgaaaaagtgatgatgtaa

SEQ ID NO: 266 - DNA, 1512 bp, Bacillus licheniformis
ttgagtacacttcagcaattaatcaatcatcatatggaaacgtcagatgggttggaagcattgtccggaggagatcgaacgtttacgttcaaagcgtatcaccaacgggtgaaccagctggctcattatctgctggaggagggtgttcaaaaaggagaccacatcgcggttttatgtaaaaataatcatcattttcccgtcattttgctggcgtctcttaaaatcggagcgacagtcgtgccgttaagctggcagctgacatcgtatgaattaaaaggaatcttgaacaactgccggccgaaggtgatgttttatgacttggaatttgccgatatactaacgccgctccgcgaacagcttcagttctgcctgatgattgaagcgggtgcgggaatgaacacgactgaacagtttgagagcttatttaaaaacaggccgctgaaggtggaagctgagcaggtgacagagcatgatttggctttaatgctgttcacctcgggcacgacgggaaacccgaaaggctgcatggtcaaccacggcagtctggccgcatacttgacagaggtgaacgtgaaatcgaagcagctgaaaggcacgcgctttttagcgagccacccgctctatcatatgagctcgctcaaccatgtttttcaggcggcttttgaaggaattgccctttatttcttatgggatcccgaaccgtttgaaatcctgcaggagatcgagaagaaacgcattcatatgatgatggcgtttccttccgtctacacctacatgctggaggaaatgaaaagacatccattcgacctgtcatctgtgaaaatgcttgtttccggcggcaccaaggtgccggcgcggctgattaaggagtacaatgaccatggaatcatgatggtgcaggggtacggcagcacagaagcatggacggtcagcgtatggcggcctgacatgggctgggataaagtcacttcagccggcaagccgattccgcaagtcagcataaaaatcgaagaccctgatacacatgaagagctgccgacgggagaagtcggagaagtcgtcgtcaaaagcccgtatgtttttgaagggtattaccaaaatccttccgccacgcaaaaggtgctgaaagacggctggttctatatgggggactccggcaaactcgatgaagacggatttttatatattaccggccggtataaagacgtcattgtctacggaggcgacaacatttatccggaccaagtggaagaaatcatcgatcaagtgcccggagtagttgaatctgccgtcatcggcgtcccggatgaaatgtacggcgaggttccgagggcgtatgtggtgaaaaatgaaagcgccggcctcaagaaggaggacattatcgcgtattgcaaagagcgcctgtccgactataaaattcctgaaatcgtctttatcgacagccttccgaaaaacaggctcggcaaaatcgtcaaaaaagatctgcgtgaactggcagtcaaagggcagtga

SEQ ID NO: 267 - DNA, 1215 bp, Bacillus licheniformis
ttgaaatcgaaatggagtgcaatggtggttattgccggtcttttattgctggccggatgcggtgcactgaaggaggctgatcccccgcgcggcagatcagcgcaaaaaacggaagcctcgttttctgaagctgaacagcgatttgcgctcgccttgtttcaagacatgataaaagaagaagggagccggaaaaacatcttcctctcgccttacagtattcagcaggcacttttgatgacggcaaacggtgccgcgggagacagcagaaaggaactgctcagcactttacatctcagccaggcggatatggcatcgatcaacgggatatcaaaatctgttaatcgttctcttgaaacgctgcctcacggtgaattttcatcagctaattcgatatggaccaaaagggagctgaaagaaagctttcaagacgcgatcaaaggccttggcgacgcctatcagcttcaaattgatcctaatcgggcaacagaggaaatcaacagctgggtcaaaaagaaaacgaaagaccgcatcgatcagatcgttgataaagtctcgtcgaatacgattgcctacatcatcaatgccgtctattttaaagaaagctggaagcacccatttgatcctcacatgacagcggaacagccattttattcagcggacggctccgcaaaaaaacaccccatgatgacgcagacaaaccgctttccttatctggaaaacgaacattttcaagccgtcaagctgccatttcaagacgaaggcctgtcactagccgtttttctgccgaaaaaagcggcaaatctagaacagcttctgactggcatgacgcatgatcaatggcgcgccttgcaaaagggctggacgatgaaacaggtggagctcaagctgccgcgcttctcatttcaaacagactacatgttaaatgaaccgcttaaacgccttggaatgaaaaacgtgtttagcagcgcgaatttttcaaatatgtttaccgggcatggcgccgctcaaattaataaagtcagacataaaacatttatcaaagtggatgaagcgggcactgaagcatccgcggcaacggcggttgaaatcatcgaatcagcccccgtccctgaagtgaccatgactgcagaccacccgttttattttgcgatcgttgatgaagcatccggaatgattctctttttgggcagtgtggcagagccgaaagatgattaa

SEQ ID NO: 268 - DNA, 828 bp, Bacillus licheniformis
atgaaaaaaagtttgtttctgttcgtgttcagtttgtttttgatggcgattccagcattttcggcttcggcgaatgtttacgaagatgagtatgaacccaacaattctttcgctgaggcttacgatgtagggttgtggaaatacaagacgatttcggcgacgattcacagcgaaagcgataaagattattacaaattttacgcgacaaagggagaacagcttgccattcacctaaagaacatcccggcaaatacagattatgatctatatttatttaaagatgcttacggctatcccgcagtaggatcttctgaaagaatgggaaaccaaaatgaaatcatccgcttggatgttcccgagacaggccgatacattgcggtcgtcatgtctaaagacggttcatatgacggctggggattttacagacttgaatttatcgacagaatgaagagcggtgcttatacggcgaatttgtctccgtcatccatctcaagcccgggacagggagtcgtttctccggttgccgccgtcaatcttgccaatgcctcggccattcccgaaggagcgactgtgaaaagcgtttctgccgagggaacgatatatccaagtctcggacacacctacagagaagtcctgaacaaggaagaaggcgtttggcacacatcggtttcaggcggcacactgtttccggatctaaagcctgaacttgcgcttcccgtcaaaacgacatggaatgtgagatactattcgctcgcttggagcagttcaacttggagatcgccgcagctgaagatcaattatcaatacgattcaacatacggctggtaa

SEQ ID NO: 269 - DNA, 828 bp, Bacillus licheniformis
atgaatattagagacagggtaaaactttcgctttattccgagcagctgatgaagccggccgccgcgaatgtgccggcaaagactaaaggctccaaaaggatgcccgccagccaaacagacactctctccatcagcaaacaggctgaatcagcccaaaaaaatgcaccgtcattacggtcacaaatgaacggcgttcaatttgagatctataatctttatgtggacaggcagcgtttgaacagccagatcgaaggggcgctgcgggagagcggaatttccctttccgaaagcgaacatctgacattgcatgttgacggacataaccggattacagttgaaggcatcgaagacgaacaaaaaagaacccgtatcgaagctgttttaaacgacagcgataaacggttcggtgcgcgtctgttgggccacgcagaactgatcggtgaacaaaacggaacgccgctggataaacaggcttacgaaaaatggcatgtgaatgagtttttgaaaacggtcgccgggctgtctttggctgatgtcagtttggatgaaagaggagagcttgaaggcggaaatgagaagctcacccgagtgattgaatcagccaaagacccgaaaagcgacttggagaagagttttcaaaacattctgaagaagctgaagaatgtcctggcgaaagggccggacaccattctggacaggtcggcttctttcggctatgccggcggaacgcttatcgatctcaatgtatcaaaaggattctccgcgggccagctgaacgagtggctggatgatccgtttcttagagaagtcctgctgaacaatttttaa

SEQ ID NO: 270 - DNA, 753 bp, Bacillus licheniformis
atgaaaatgaaagtaaaggaagtggccgatttagtcggcatcagtgtgcgcacactgcatcattatgatgaaatcgggttattagctccgtcggagacaaccgaagccggatatcggctgtattcagatgacgatctggaaaagctgcagcaaatcttatttttcagagagcttgacttccctttaaaaaagattaaaagcattcttgagaacccttcatttgacaagaatgaggcgcttcagctccaccgcaaagcgctgctggagaaaaggagccggcttgaccaaatgattgcgacaatcgataaaacgatccaatttgcgaaaggagaaatcaacatgacaaacgaggaaaaattcgcgggttttgatttcagtcaaaacccgtatgaggaagaagcgcgggaacgctggggagatgaagccgtcgacagatcgaaggcctatatcgaatcgatgtccgaaggtgaacgaaaaaaaatggaacagcaatatgacgccatttacagaaaaatcgccgctctcagagaaggcgcccccgactcagaggaagcacaggcggctataaaggaatggtacgactttctgaacaataacaccggccacagctattcgctggaagctttcaaaggtctaggacaaatgtatgtggctgacaagcgctttacgaaaaacatcgatcaatacggcgccggcttggcgaagttcatgtgcgacgccatgacggtgtttgctgacagaaatcaggaataa

SEQ ID NO: 271 - DNA, 180 bp, Bacillus licheniformis
ttgaatacataccttaccgggattttatttgttttgagcggaattcttttattaaatctagcggttttatcagggataaacggtgtattgtgggggctggttcttgggggcagcatcattttcaatctaataggtgttgtactgctcatgagatatataaatgaaaaaagccatacttaa

SEQ ID NO: 272 - DNA, 345 bp, Bacillus licheniformis
atgaaaaaaacggcggaaaactatctaccgcttacgcaggctacatattacatattattgtcattaactcaaccattacacggctacggcattatgcaaagggttgagagcatgagcgagggagaggtcaaactagggcctggcactctttatggtgcattaagcaaactcgaaaagcaggggttgattaaaaaggaaggcgaaaccggcgataatcggagaaagcagtatattttaacgaatgaaggatgggcggttgttgaactcgaatttaaacgtctgtctaaattggtggcgatcagtcaatctatttttcaaaaagagggagatacaagcaatgagtaa

SEQ ID NO: 273 - DNA, 516 bp, Bacillus licheniformis
atgagtaaaaaaagaaagcgtaaattccgtttttttcttgcctggcaagaccggaaggaagaggactggctgaatgaaatggccaaacaagggtggatgttaaagtcattctttttatttatctatacatttgaaaagacaaaaccaagcaatacagtatatcggctcgactataagacaacatcaaaccttgatcaagaagaatatattcatatttacgaagatgcaggctggaagcatgtgacacagtttttaaattggcattactttgcggctgatccgagtcaagttcaaacaaatgtgatttatacagaccgtgaatctgaagcggaaaaatataatggcttactaaaagtgttatatgctgcacttgccagtgtatttctcagctcgggacttccgattcttatcataggcatcccgggatatttttattggatagcagcattcaatctctttgttttgtgcctgttgatcgtgtgtatattaaaggttcgtagaaaaacaagaatttga

SEQ ID NO: 274 - DNA, 162 bp, Bacillus licheniformis
atggtgattgcaacggacgatttggaaacgacatgtccaaattgcaatggaagcggaagagaagagccggagccttgtccaaaatgttcgggaaaaggcgtgattttgacggcgcagggcagcacattgctccattttataaaaaaacatctcaacgaataa

SEQ ID NO: 275 - DNA, 945 bp, Bacillus licheniformis
ttgagtcgagcagagaagagtacagctgagcagagcggccatattcaacacggtgttcgaaaagcggccggggtcgtttttatggtctttgggacgatgtgttttgcttcaaaatccatttttgtcaaatgggcttatgaacaaggtgcacagccggaagcggtgctgttgtaccggcaattatttgcggcgccgctgttttggctgatttttattgtgtatcgctcaaagcttccggctaagcctgaaaaagcggagatttttaaagcttgtgcggccggattgctttgtttttttctatcgccattgcttgattttatcggccttcacggtgtttctgcaaccgttgaacggatgattgtgatgagctaccccatgttcgtattgatcataaccgcctttgtaaataaaaaaatggtctcgggtaaaacgtttgctgccatcttgcttgtgaatgccgggctgtttttggctgtcggcggatgggatgtgcaagcattggaagcgaacctgtcaggggcttttttgatcctattgtccgctgtcgcttatgcggcctatcttgttgtggcgggaggacttgtccgtcaaatcggagggattcgaatgaatgcctatggaatgtcggcagcaagtcttgcgatggccggttatgcgctgcttcgctcgctgagagaacaaccgggaatcgtgctttcttatcctcccgcaatgtatggtttttttatgatcattgcggcggtgacgacggtcattccttttttattcatgctggaaggcatgaagcggataggagcggaacgaggggccgtcatttccatgatcggccccgtcctcaccatcttcggaggtgttttgtttttaaacgaacgtttaactcccgttcagtggctggggtgcttgctagtgcacctgacggttagtctgctggaataccggaaatag

SEQ ID NO: 276 - DNA, 393 bp, Bacillus licheniformis
ttgcaatacgctcgtttttgggttagagcgggtgcatggttgatcgattgcgtattggcggtcgggttacacttttcatccgcatggatattcggcgacggatctcatgaagttgctgcagccgccctgctggtatacgttttgtatccgcttctgatgccgctgacaaagctccagggcacgattggaaaagcaatttttagaattcgtatcgtttctgatgatacgggccgacggattaagctttggcaggctttcgtgcgctacatcgtctcatgggtgcatatctttttcggtctgctgtatttaaccgtcgttttttcaggaacgaaacaagcggtccacgatttcgcggctagaacatatgtcatgaaaacgtccgacactgagtaa

SEQ ID NO: 277 - DNA, 1068 bp, Bacillus licheniformis
gtgggaaaagtaaaaagaaatatgccttgcccctgcggcagcgggctgaaatataaaaaatgctgcggcaaagcagagggagcgtttccggctgtcgcggtgcaagaattgaaacaaatccagaaagacgtcatggaattcgcttttacggaacataaagacacaatcgatcaatttctcaatcagtattcttttctgtcagacctggatcagtctgcgcaaaagatatgtgtttttaacctgggcgtgtggggagtatttgcccgcccgctggcagatggaggattgacgatttttgaagactttttacagaaaaaaggatcttcgattctcagatcgcagacaaaggaagccgttcaatcgtggaaagacctctcccctgcgttgctgcgtgtgaaacatataacagatggcggcattcgctttgaggatgctgtaacgaatgaagagctgaccgtgaggatgaatgtgaaacgggaagggccttttgtaggcgagtacgtgctcggctttccgatcaagatcggaagccataccgagttcttcttgcaattcaccatctatcctgcaaaaatggcggatgctctcaaagacaggctaagcgaggctttgaaccgttttacagaagaaggcgggacgaaagagcagctgatgagagaggatttccatcatgtgttaatgcatctttgccggcaggaagagagtacaccgtctgaacaagtgtccgaagacatcgaatgggccaatgagatggaaaaagaaacagcgctcgtttttgagaaaggtatgcttgacgaaggacattctgaaccatttgtgtcctgggcggtcggcctttggaaatcgtattgtgccaaaaaagcaccggtcatcaaaaaaacagaagcctttgcagctgctttggagtattttatcaatacgatctccaaatcggaaaaatcgatatcccaagcaaagcttgcaaaaaaatacggcgtcagcgcttcgaccgtatcgaatcgttttaaagatattgaagccgtcctgcaggatgaacttgaccatcatcttgagcttatgccatcttaa

SEQ ID NO: 278 - DNA, 717 bp, Bacillus licheniformis
atgagtacaattctactggaaacaaggcatcttcaaaaaaagttcggaagatcgcaagcggtctcagacgtctcattgtcagttgaaaagaacagtatttacggattgcttggaccgaatggagcaggaaaatcaacgactttaaaacttttaaccggaatcttaaacccaactgccggggatattttgtttgaggggcggcaatggaaaaggtccgtattaaaagacatcggttctttaatagaatccccgcctctgtatgataatttaacagcctacgagaatgccaaggtgcatgccgcattattgggccttccagatgcgagaataacagaggtgcttaaaactgttgatatgcatcataccggaaagaaaaaggcggggcagttttctatggggatgaggcagaggctggggatcgccatcgctcttttaaatcgccctaaactactcatacttgatgagcctactaacggtcttgatccgatcggtatacaagagttgagggaactcatcaggtcatttcccgaacaggggatgacggtcattttatcaagccacattttatcggaagtcgagcagatcgcagaccatatcgggattatcagcggagggtatctcggatatcaggggaaaatcaataagggagacgatcttgagcggctttttatggatgttgtcaaatcaacgcgggagaaagagggcggagaaaagtga

SEQ ID NO: 279 - DNA, 759 bp, Bacillus licheniformis
gtgatcggatattatgtaaaagcggaaaacctgaagtttaaaagaacattttcgagaaaaatgatcttcattgtgcctttgattaatatttgcttcgcctttttaatgaatccgggattttttgtagcaggtacgtataattggtggtctgtcatcttaatgccggtcatgatcgccttgctttgtgcacaatcacaccagaaagaaaagaaagcgtcgaattataacggcattttttcttctcctgtagatttgcatcagatttggtatgcaaaaataagcgtcattgcgctctattctttagcatctcaagctgtttttttaggattcatggttgggatgcagtttgtcattcctcaattttcgagcattcatttgacagtcattgccgcgaatctgctgctttggctcacgacactatgggagatccccgtctgtttatggatagcgcgaaagtacgggtttatatctgccgttttgttcaatatgctgggcactatcatattgggcatcatgtcggcatcaagccctttttggtggctgaatccttggagctggccgatcagggtcatgtgcccgacaattggcatccatccaaacggtgtgcctcttgagaatggcgatcctttaacgagctgggcagtcgttcctccggctgttgttctatctgttctgttatttgctattttggcgcgtctgactaggcggtctttttctcctgccgttgatcgcaaatcgataaaacgggaggcggtttaa

SEQ ID NO: 280 - DNA, 771 bp, Bacillus licheniformis
ttgttgttatttttcagatgcctggcggctgattttcaaaaaacaaagcgtacgtcttttatttggcttcacttgagtgttccggttatctgtgcgggtgtttttctgctttatttctataacagacagcccgatccatatcaattatatcgcacgtattttgaagccattgcgattgcattgccgcttctgattggaattgtgtgcggaatgacggcttccttagaggagcaggcaggccgttttcaagtgctgttgggcggcacggctcccaaattaacggcttatttaagcaaagtcacgctgcttctgatcatgaacatttttgcggtattcttggctattggactctacttattggggctcagagctctttttcatgtgccgaacctgccaagctccctttttttagaggctggggcatggctggcagccggaagtgtcacactttatttcatatactttttgatcagctgtacattcggaatgggggcttcgattttagcaggcggggcaggccttttgatgacagcgctgatgaacacgggattgggcgatgtcatttggaaatataatccctgggcatggggaatcaggctgacagggtataaggggattgaccgatttgtccaaattgatccgtctctccgctctgttctagatggggaaatcaagcagggggctttcatcatggtgtttgctataatagctgtattcgctctaagcatcatttggtttatccgctgggaaggaagaaaagcttttgaataa

SEQ ID NO: 281 - DNA, 663 bp, Bacillus licheniformis
gtggcgaaaattttggcagtagatgatgagaaagatattcttgtactcatacaaaatattttgcgccgcgatcagcatcaagttcatacgctaagtcaagttaacaccgaatctctcgacgtgttttcagggtatgatttaattttgcttgatgtgatgatgccggggatggacgggtttgaattatgcgagaaaatccggccgctggtagattgtccgatcctgtttctcaccgctaagacggaggaagaggccatcgttaaaggcctcctgactgggggagacgactatatttcaaaacccttcggcgttcttgagctcagtgcaagagtaaatgcacacctgagaagggaaagaagagagaaatacgagactaaacgggtgatttccggttttttatttcactttgacagcaaagaagtatttattcatgatcaaaagctgaatttaacaaaaaatgaatttaaaatatgtgagctattggctcagcataaaggacgaacctttacaagagaagaaatttatgatcatgtatacgggctggaaggcaatgctttatattcgacgataaccgaatttatccgcacgattcggaaaaaatgcaaagaacacaatagagatccgatcaaaacggtatggggcgtaggatacagatgggaataa

SEQ ID NO: 282 - DNA, 1371 bp, Bacillus licheniformis
atgggaataatccgcaaaaaaaagacactgcgcagagaactgatcaaatatatgctcactttgagcttcagcctgatcgcgatcacggctttatatgttttggtcaatatgataggaatgaatgcagggctgttttatcctgccaactacaatgaaatcgaagctgaaaagcttaagcccaggcttcaatcggctgaacagataacggaagacatgataccggatacaatgctgtacgccatactggacaaaaagtcgaaacaaaagacagcgggaaacatgaaagagacgaatctttcgattgtacggaaaaagatagagagcaggccttatgtcagctttagtcaaaaaggctatatgattatcgaacgcaaagacgagtattgtgtattggagtatcctttgcgcgctgagtttcggtctccactgctgagacggtttctcccgaactatgagctgacaagcatatgcatcatcgttcttcttttaattacggtcgtttttacggtgacaacccgatttgcaaacagattaaaagaacattttcaaactttaaacaccattgccgagcaaattaaaaaacagaatttaaattttactccggagttctcgaatattaaggaatttgatcatgtaatcagttccctgatggacatgaggaatgccctccaagcctccctacgggcgcagtggcatttagagaaaacgaaaaaagaacagatcggcgcattggctcatgatattaaaattccagtgaccatcatcaaaggaaatgcggagttgctgagcttatctccgcaaaatcaagagcagtcggaatatatcagatacatccttgacgcggggcaaaaaatcgaacagtacattgaccaattaatccatctctcaaaaactgaggaagcattacataccgagtacagagaaggcgctgtgaaaacgctagtcgaaagtgttctccatgagactgaagcatatatagggaacaaatcgattgacattgtgttgaaggagcagaaccttgaaggaaaaaaagcagtgtttgacaaacagctgcttcaccgagcgttgatgaacatcatgacgaacgccgcagatcacacaccagaaggcgggagaatcgattttgaagctgtgtgtacggctgatcaattgattttcacaatcactgacagcggaaaagggttttctcaagacggcctgcagaaagctgccgagcttttctatatggaagataaagcccggacatcgaatggtcattacgggatgggacttacctttgcacttcgtgttgttaagcttcatcaaggcgatttggcgattaaaaacagcgaagcaggaggcggacaggtacaagtgaccatccccctctga

SEQ ID NO: 283 - DNA, 885 bp, Bacillus licheniformis
atggatttcaaaacgttaaagacgtttcataaaatcgtggcttgcggaagctttaaccgcgcggctgaagaactgaattatgcgcagtccacggtcacaatgcaaatcaaaaagctcgaggaagacctcggcattcgtttgctcgagagggggaaaacattccgtctgactgaagccggcaggcttttttttgaagaaagcagacatattgtcaaggatatagatcaccttcaacatcatatggccgacttattgcttggcgaagggggaaatatccgccttggagcggtcgaaccgatcgcgagctgtgaattgccccagattttggggagatttttagcggattatccgaagatccgggtttccgttgatatcgccaactcgtcggcattgggggaacggctggttcaaggaagcctggatcttgccgtctgttcgactccggcaatgggaacagatctttattttgaaccgctttatgctgaagaactcgtagtgctgctccctgagggacaccccgccggaaacaatgaacgcattcatctgaaagatattagggagcaccgcctgctgattacggccaacaattgcacctaccggaagaaagtcgaaatcgcgtttcaagagctgccggggagccaaatgaacacgatggagatcggaagcatgacagctttgaaaaactatgttgccgcaggactcggcgttgccctgattccgaaaagcatcgtttcccctcctcctcccggaacgattgtccggtttatcgacgatgacccgatcagcgtaaccttcggcatcctttgcaaaaccgcggcgtttccgctgaaacaggctgatgcaaagctgtaccaatatttgaaacaggaacttggagaaccgtaa

SEQ ID NO: 284 - DNA, 396 bp, Bacillus licheniformis
atgccatttgtcaggatggatcttttaaaaggaagatcaaaggaagagcttcgccggatcagcagatcagttcaccaggcgatgacggaggcgatcgatgttccggaagacgattattttcaggtcatcacccagcacgatgaggaagagttctttttcgatcctagctatatgaacatcaaacggacgaaggatttgatttatattcacatcacaatgaaagagagaccgatcgaaaaaaagctggctctgtaccaacgcattgcagagcgtttgcaaaaaaacgccggcatccgccaagaggacgtcatgatcattgcagccgaaaacgtgaaagagaactggtcgtttgggaatggaacagcacagcttgcatcagttgaaagggagcgttga

SEQ ID NO: 285 - DNA, 741 bp, Bacillus licheniformis
atggaaatgaaaaataaaacagcccttgtcacaggaggcggcacagggatcggcagagcggtatcgctctctttggcaaaccgaggggcagcggttgttgtcaactattcgcgttccaaagcggaggctgaagagacggttggaatgattgaaagtcaaggcggccgcgcgctcgcggtgaaagccgatgtttctaagatcagtgaagttcaagacatgtttgatcgggcggtgggcgagttcggtaccgtcgatctgctcgtcaacaatgcaagcatcaccaggcatatcgagcttgatgacttggaaggggcttctgaagaagtctgggatgaactgtatgcggtaaatgtcaaagggatgtttaattgtgcgagagcggcggcaccttttatgaagcgaaataaacaaggcgccatcgtaaatgtcggcagcatcgccgggcttaccggttcaggctcttcgttaccctatgccgtatcaaaagcggcggtccacggtctgacgaaatcattggcgcatgcgcttgctcctgatattagagtcagctgtgtggcaccgggcgcggtatcaacgagatggtgggaggggaatgaagagaaaatgaagcggctcagccaaaagctcccgcttgagcggatagcggaaccggaagatatcgccttgctcatttgtgcgctgctcgaacaagaaacagttacaggccaaatcttaacggctgactgcggtcaaacattatag

SEQ ID NO: 286 - DNA, 2085 bp, Bacillus licheniformis
atgaggcgtttacaatcgttagaagccattgaaaaagtaaaaaacggggattatcatgttttgcgggatgccgaatggctgaagtatctcgttttaactgaagagcaaaatatcaacctggagcggatttcttcgctagagaacatgcctcagaatcccgtttttctttatgttgaacagacgctctctattttggagaaagctgacattcctgagctggaaaaagaaatcattgaagaggttctcatatggagtgaagcggctaagtgcggccagcctcataaaagaaaggaatggcgtgaaaaaggttttcagcttgcgatccataatatcgggtcggcgcagatttatgctgatcgaagacaggcgtacatgccggaacggcaggatattgaagaactcatccatattttgattgtgacgcatggactcgtcggacagtatatccgcggggaaacaaggtatcgccaattcactcctcttatcgattggattgaaacatctgaacttcagcacatcgatatcaggcgggttctatacgtgctgaacaaatgtatcattgaagcggtatcgccggcgctttgggattcgatagaacgagacgtgaaccgggtaatcggccaaatctgcacaggagaaagaaataaagactggccgtttgcggaaaggatcagaaaactgcggggacaagcgctcgattccggtgaagacagcagccggtacgagcggtttttgagggagcattcggcggaagatacgctgagacgcttctttcagcggattgatttatggtatgtggaatccgccttgtcatcattcagttttgaagagtttgtcaaaatctttctgctcgtgcttcgttctgtcaaccctttatcagtcaagcacatcagctttgagccgctgatgaaggacatgtaccgtgattaccagggtgtgaggcatataaatgtttataaaaaacgaattatcgaagcgtgcttaaaagagatgtcgatcagcgatttgctttacggcgaggtgcctgtaaatgaacacgtttcgcttgctgttcagccgtttgatcaggcttctgagattgtcggcgtcacgttttcattttcgcaggcaggactgaagctgattgaattttgccaggaagcggagaaatcgcctttatatgaacgggcgatcgtgctgctttatgatttttttgagtttcgcaaggattcgtttgaccggctgcaaaatgaagcggcttatctgtctgatatgaacggtgctgaagattataaaaagaagattgccgattatgccgttggagaaagaatgctcgacatcggagccggaggcggcgtgatgcttgatttgctgacagaccagcatccagaagcagaggtcatcggaatcgacctttccgtcaatgtcattgaggagctccaaaaaagaaaagtgcgcgaacataagccctggcatgtgaaacaggctgatgcattggacctgcctgagtactttgagcaggaaagcgtcgacaccatcgtattctcatcgatattgcacgaattgttttcatacattccgtatgaagggaaaaaatttaatcatctcgtcattgcccaagcgttaaaaagctcctttgacattctgaagccgggaggcagaatcatcatcagggacggaatcatgaccgaaaacaaagaggaaacgcggcggatacggtttaaagacccggatggaatggatttcttgaagcggtatgtccatgattttaaagggagaaaggtgcaaatgcttgaggctgagaaggacgcggctgtactgtttgtgaatgatgcaatggaattcctctatacatatacatggggagaagaagcctatccgcatgaagtgcaggagcagttcggctattttacgccgtctgaattccgccgctgtatcgagaaagaattaggggaacgtgcgaacattctggtgttcgaacactatgtgcaggaaggatatgaagaacacctttaccctaaaatcgagctgacagaccggctcggccggcgtgtgccgctgccggacagcacttgttttattgtaattgaaaaaaagcacctctag

SEQ ID NO: 287 - DNA, 1077 bp, Bacillus licheniformis
atgcgaagtaaaaagttttttctgatgatgcttttgatgattgtagcagtcgtgtcaacagcctgcggaggcagcaaaagcgcgagcggagagaaagaagatacgaaaaaagcagataatgcagaagttaaaatcctaagctccgaatatacgcttcctgatgattcatcaacaaacctgcacgaaaatgaacttatactaaagatcaatgtttccgtgaaaaatacagggaaagaaccattaatggttgataaaagccaattcagcctttacgaaggcgactcaaaaatgtcggacgtcagcgtatatgatgaaagaaacaaaaggcttcgctcttcgacgctgaattctgacaaagaagtcgacggaaatatctattacatcgttgaaaaaggcaaaaagtttcagcttgaatacacacctgacatgtacggtgaaaataaagccgatcctgtcaaattcgagatcgacggcggcagcgacgaattactgaaaacggccaaaaaacttgaagatccggcaaaagctttgctagcttacacagacgtaacgattttcggcaaagacaataataactttgataaactggtcgacgaaaacaaacgtgaagtcgttaccgattaccttgaaggcgctcaaaaatctatcgttcgctctttaggatattatgatgaagaagatgtggataaaaagaaattgaataaactgatcagcgccatccaaaacgcctatcaagaaaaatctcaagtcaaagcagttacaaaatcaatttcaggcgatgaagcaactgttgaggcaaccgttacgccaatcgataatacagatgtccaaaagaaagtgaagaaaagactggaagactatgtgaaagacagcggcaaagacttcatgtccagagatgaattgatcaatcctgcgattgacatcatgagtgaagaaatcaaaaaagcagaggcgacttcaagtgagaaaaccgttgaagtcaaacttgaaaaatcaaaaaatgacaaatggaaaattgatgctgataattacaagaccgaacaatacttctcaagcttccttaaaagcaacaactaa

SEQ ID NO: 288 - DNA, 1401 bp, Bacillus licheniformis
atgagcaatggcaccccacagaaaacaaaactgcacttcccacatacttatgctttgatttttttcattatcattttagctgcactggcttcatacttcattccatcaggagaatttaagcgggttgaagaagacggccaaacggttatcgtacaagggagctacaagcagactgacgcaggtccggtcggttttttcgagatgtttaaagccataccggagggcatgattcaatcggcggatattattttttatatctttttaataggcggagcttttggcatcatccatcagaccggtatgattcgcgccggtgtccatgtgctcgtgcagcgcttgaagaaacgcggcttcctcctgatccccgtcaccatgttcgtcttttccatcggaggcgcaacgatcggtttgtctgaagagacgattatttttattccgatcggaatcgctgttgcgagagcgcttggctatgattcaatgacagggctggcgatgatttctctaggcgcggctgcagggttcaccggcggcatgttgaatccgttcacagtcggaattgcacagacaattgcggaagtcccggtgtttagcgccttcggttatagactggccgtttatgccgccatgctcggtttctccattttttatgtcatgcgttatgctcaacaagtcaaagcgcacccgaataccggtttgatgtatggaagcgaaacagagataaatgaagagacagccgcaggacacgctgatctttccttcaccggaagacacggcctcgtcctgctgattacagcattgggcttcggcatcaatatgttcggtgtttttcaatggggatggtttttaagcgagctgtcggccggctttctcatcatcggctttgccgccggtcttgcgggaggacgcggcatcaacaacaccttccattcgtttgtcgacggcatgaaacaggttgtatacggagcgctgatcgtcggcttcgcccgtgccatcgtcatcgtattggaaaacggacatattatcgatacgatcatcaacagccttgcttcagcaatcagctcgcttccgaatgaaatcagcgccatcggcatgttcgccgtacaaatcgcgattaacacgtttattccatccggaagcggacaggcagccacaacgatgccgcttatggcgcctctggccgatttattgggattcgaacgtcagattgccgtattcgcttatcaatacggagatgggatcaccaactcaatcatcccgacctccggcgtattgctggcttcactgtcaatcgcaggcgtcccttatgaacgctgggtcaagtttgtctggaagctgatcgcaggctggattatcatcggcgccgctgcgattgttatcgctatgataattggtattaagtaa

SEQ ID NO: 289 - DNA, 1176 bp, Bacillus licheniformis
atgaaaaaacaaattgagaaagagatcgaaaatattcgtgaagagctgctgcatatcagccagtatataggcaatcatcctgaactggggcacgaagaattcaaagcttcaaagattctgtccgaggagctgaaaaaacacggttttcaggtggaattaggcacatgcggccttgcgacggcgtttacggccgagtttgacagcggccgtcccggtccttccattggatttatggctgaatatgatgcattgcctgaccttggccatgcctgcgggcacaatttgatcggcacgatggcggtcggcgccgcaatcggcgtcagcaaagtgattgcatcgtgcggaggaaaagtgtatgtttacggaactcctgcggaggagacgaaaggcggaaaagtaaccatggccgaacaaggggtttttgatcacttggacgccgctatgatggttcatccgtattgcaggcatgaaaaaagcgggacatcgctggcgatggatgcgatccaattcgaattcttcggaaaggcttcgcatgcggcgggagcacctcacgaaggaatcaatgcgctcgatgccgtcattcagacattcaacggcattaatgcgctcagacagcacattctccctgatgcccggattcacgggattattccggagggagggaaagcggcgaatgttgtgccggattacgcggttgcccagttttacgtcagaggaacggaacgcgcttatgtcaatgaactgctcgataaagtgaaaaattgtgcaaaagcggccgcacttgcgaccggagcccggcttgagagctctttttatgagctgtcttacgatgatttgaaaacaaatgaaacgctgtcagacgcttttacacaaaacatgatcgagttgggcgtcgatccggattcgattcatgaaaaagcggacggaggaggttcggttgatatggggaatgtcagccagatcgcgccttccattcatccttatgtgcaaatttgcgatgagccgtatgcgtgccacacacccgagtttcgtgaagcggccatgagcagccgggggttcgaaggcttgatgctcggcgcaaaatctatggcattcaccgcatatgatgtgctcatcaatgaagagctgctgaaaaaaataaaggaagaattcaaccttttaaaggcgctggcctaa

SEQ ID NO: 290 - DNA, 453 bp, Bacillus licheniformis
atgaacattcggagattgcatccagaacatgagccgccgcttgatttgctgttgacggcagacccttccgaaaaactggttaacgattacctcgaacggggacagtgctatacagccgaaatcgaccgccggattgccggtgtctatgtgctgctgccgacgaggcctgaaacggcagagctcgtcaatatcgccgtcaaagaagatctgcagggaaaaggaatcggcagacaattggttatgcatgcgattgaaacagcgaaagctcaaggatttaagacgattgaaatcggaaccgggaattcaagcatcggtcagctggcgctctatcaaaaatgcggatttagaatcaccggcatcgaccggaactttttcctgagacattacgagaagccgatatacgaaaacggcatgcgctgcatcgatatgatccgcttatcgctcgacctgtaa

SEQ ID NO: 291 - DNA, 1500 bp, Bacillus licheniformis
atgaatatatctgactatgtaaagcatgacgcggttgctttatctaagcttatcaaacatggggaagtaacggtcaacgaattaatcgacgctgctttttcccgtcttgaagaagtcaatccagaactgaatgcagtcattcggacaagaaaagagcaggtcaaaattgaatccaaacagcttgacatcagacaccagccgtttgccggggtgccgattcttttaaaggacatttcccaagcgttgaaaggggagcctctcacagccggcgccaagctgctttcatcttataaaccaaagcgcgattcgaatttcgtcgcgaaattgcgcggcgccggttttttatttctcggacagacgaatacacccgaatacggattaaaaaatatttctgagcctgaattgtatgggccgtcgcgaaatccttggaacactgattattcacccgggggttcaagcggcggttctgcggctgcggtggcggccggaatcgttccacttgcaggggcaagcgacgggggaggctccatccggataccggcttcctttaccggactattcggtctgaaaccgacccggggcagaacgcctgtaggaccgggcgccggacggcagtggcagggggcatcgatcgattttgtgctgtcccgtacggtcagggacagcgcggcgctcctggatattctgcaaaccattcagcctgaagccgcttttcaaacgcctttatttccaggtcagtatgaagaggatatgaaaaaagggctggagcgccctttgaaaatcgcattatctgtagaatcacccgtcggaacgcctgtcagcgatgaagccaaacaagccgtccgccgcaccgttcgatggctggaagcgcagggacaccatgtcgaagagcagacgaacggcgttgacggaatccggttaatggagaactactacttaatgaacagcggtgaaatttccgcgatgattcttggaatggaaaaaacgcttggaagagcgatcactgttcaggacgttgaaattgtcacatgggtgctgaatgaagcaggcaaaaaagtgtcggcagccgaatttacagcaagccttgcttcctgggatcgagcagctgcacaaatggcggcgtttcatgagacctatgatctgtatgtgaccccggcaacggcttaccccgctccaaaggtcggcgagctcacccataccgaaaaagaagccgaagcgctcctgaaagtaagtgagctggaaaaaatcgagcagcagtcgctgatttatcaaatgtttttgaaaagcttgacatatacaccattcacacagcttgccaacttaaccggacagcctgcaatgagcgtcccggtccatctgacaaatgaaggtttgccgctgggtgttcaagtgacggctccgaaaggaaaggaacattggctgctgcgcaccgcccatttattagagcaatcagacttatggatcggaatgaaaggaaatccaatgctcggcagtctgtaa

SEQ ID NO: 292 - DNA, 1836 bp, Bacillus licheniformis
ttggaaaaagtggcagaaaaaagaccaaagcgctgtgaggtgccggaggaactgacttggaatcttactgatttattttcttcttatgaaacttgggaagacgcacttgtgaaaattgaggaagatctcgcatccatcggctcatttaaaggaaggctgcatgaaggagccggcgtattgctggattgtttatcgctgcgggagatactgctgaagcgcctagtccgggccgccgcctatactcacctcagaaagtccgaagatttgacaaaccccgtcaaccaagctgatgcttcaaggatggccgcgctgcaagcaaaaataaacgccgggctttcatttatccaatcggaaattcttgaattccccgaaaatcaagtggagacgtacataaaaaacgagaaaggactggagcctttcagcaaaatgctgacggagataatggaactcaagccgtataaacttgctcccgaaacagaggaagcgctagccgttttaggcgaaatacatgatgccccgtacaaaattttcgggatggcgaagcttgcggatatgcaattttccccgattcaggaccgaaacggcaatacactcgccaattcgttcgcgttatatgaaggaaaatacatgttctctcctgatacgcatattcgcagaaccgcattcgactcctttaccaataccctgcaaacatacaaaaacaccatcgccgccatctatgaaacagaggtcaaaaaacaggtcagcatgtcaaggctgcgcggatatgaatccgtcacccatatgcttcttcagccgcaaagcgtcacgctcgaaatgtaccgcaaccagcttgatgtgattaaaaacgaacttgcacctcatatgcgcaagtatgccgccttgaaaaaacgcgtattagacctcgacgaaatgcgcttctgcgatttgcaggctccgctcgatcacgacttcagtccaaagacgacttacgaacaggccggccggatgatcttggacgctttacaagtgatggggccggagtacacggaagtcatggaaaccgccttgactgagcggtgggttgatctcgctgacaatatcggcaaatcaacgggcgcgttttgttcaagtccgtacggagcgcatcctttcattttgatgacatggacggatacgatgcgggatgcctttacccttgcccatgaactcggtcatgccggccatttttactttgccaaccgagagcagcgcatcatgaatgtcagaccgtctctatatttcattgaagcgccttctacaatgaacgaaatgcttctcgctcagcatttgttttccaaaacaaatgatccgaaaatgaagcgctgggtcatcaaccagctgatgggcacgtattaccacaatttcgtcacccatctgcttgagggggaatatcagcggagagtctatgagctcgccgaacaggggcacgcacttaccgcttccgtactgtctgagcaaactagcgccgtgctctccgaattctggggcagcggagttaaggttgatgaaggagcaagcttaacatggatgcgtcagccacactattacatggggttatacccttacacctattctgccgggctgacagcatcgacgatcgtctcgcaacagatcaaagaagaaggccgccctgccgtagacagatggctgaacgttttaaaagcaggcggtaccatgaagccgctggacttgttgaaacacgccggtgtcgacatgtcgacagaccagccgatccgccgggctgtgacgtatgtcggaacattggttgacgagcttgaaaaactgtacgataaaaaagaagaccggcctgattaa

SEQ ID NO: 293 - DNA, 270 bp, Bacillus licheniformis
atgtttggttttatttggtcattgatcattggcggaattttgggctggctggccggcctcattatcagacgtgatgtacccggaggaatcattggaaatattattgcgggatttatcggttcatggctcggctcgatgattttggggcgctggggtccggtggtcggcgggtttaatatcataccggccttgatcggggcgatcattttgatcttcatcgtcagcctcgtcatgagaagcatgggcggtcgaaatcgcaatgctcaataa

SEQ ID NO: 294 - DNA, 1716 bp, Bacillus licheniformis
atgaaacagtcattaaaggcattaaaaggctttcgggcattcgccgaagaaaaaatgaaagagtggaacgttcctggagccgcggttgcagtcattaaggaagacgagatcatcatggcggaagggtttggattcagggataaagaacggaaattaaaggtcaacccggaaacggtatttgcgatcggttccgcctccaaggcatttacaacggcggcgatggcggtattggctgatgaagggaaaatggagtgggataagccggtaagggaatatctccctgagtttaagatgcacgatccggtagcaactgaacggatgactccccgtgatcttgcgtgccatcgttctggtctcccaagacacgaaatgatgtggtacaattcctccttttcaagggaggagcttttcagacggatccgctaccttgagccgaatcaggattttcgatcaaagtggcagtatcagaacctgatgtatatgacggctggttatcttgctggaagaatagcggggacgacatgggaggatcttgttcatgagcggcttttcaaacctttgcatatgacatccagcagcttttcggtcgaagatatgcaaaagctttccgattttgcctttccatatcaagagaacaacggaacggttgaaaaaataccttttcgtaatatcgatgcgatcgggccggctgggtcgattaattccaatgccgtggatatggcaaattggctgcttcttcagcttggcagcgagaaattcaacggggttttatcagatggaagccttcatgaactgcatacgccttgcatttcctgcgactccattattaaagcgaaggagcttccggtctgcagctatggactcggctggtttgtggaaccgtaccgcggtcgccatatgattcatcatggcggaaatatcgacggcttttcatcgcttgtcgctttcatgccttatgaaaagatcggcattgtcattttgacaaatatgaacggcagctttcttccaaatgttctggcgtacaacatttttgaccgcttgcttggattggaagagatcgattggagcggccggctgaaaggcgaagcggaaaaaataatgaaagccgctttaggagtggatcgaaccgcggatcttaccaaaattgaaggaacgaatccttctcatgccctgaaggactacacaggtgtatatgagcatcccggctacggcgaaatcaaaatagagcttaaagacggcgtgttacaggcgctcttcaattcgtttgtgatgcctttgaagcattatcattacaatatattcgagatgaaaatgccgctcacggagatggcgatgctcgcatcattcgacaccgatatacacggacatatcagccgcctttccataccgtttgaaatggcggaaggcgctagagaaatcgaatttgtcaggaagccggatcagcaattgtacgaccctgaatttcttgcttctttaacagggaagtatgcattgggagacggaacagatgtcgttgtgtctctcagaaacaaccggacgctctgggtttcattgcccggtcagcctgattacgaacttgaaccttaccgtgagttgacatttcaaataaaaaatctgccgggattcagcgtccgatttgaagccggcgattccggacaggtaacaggtttgcgcttcatccagccgaatggagaatttcctgctgtccggaaatag

SEQ ID NO: 295 - DNA, 1323 bp, Bacillus licheniformis
atgacgacagctgacgaaagaaaggtcattgaacagcagtttaaacaaagaatggatgaggaagagctgctgaattgcatgcgctgcggcttctgtctgccgtcatgccccacctacatcgaatccggttttcaagaaagccattctccgcgcggacgcatcgcgctcatgaaagcggtcgtcgatgggacgatcgagcctgatgaggatgtcgaacggtcactcgagctttgcctcggctgccgcgcgtgtgaacctgtttgtccgtcaggcgtaaactacggacgcttgcttgaagaagcgagagatattattcagcagaacaaaaagcacgcctttccggttaaagtgcttcgccgcgcagtattcaaagggcttttcccccatccaaacagaatcagggcgctgaccggaatgctcggcttgtatcagcgttccggcatgcaaaacgtgattcgcaaatccggcttgctccggcttttgccggaccacctcgcgaagatggaggcggttttgccgaaggttcctaatatgaaacagctgaaaaaacggccgcacctgctccctgcgatcggggagagaaaaaaacgggccgcctttttctcaggctgtctcatggatacgctgtttttggatacgaatatggcaaccattgagctgctgcggctggctggctgcgagatcataattcccgaacagcagacctgctgcggcgccctccacggacacagcagcgaaaagtctgaggccatcctgctcgcaaaacgaaatattcaggcattcgaggattcaaacgcggactttatcataacaaatgcaggcggatgcggagcttttttaaaggaatatgatcatctcctgaaagatgactccgaatggcgggaacgggcagcatctttcacaggaaaattgaaagacttttcttccgtcttgttggaactgaacttcgatcagcaatcccttgaactgccggagcaaatcgtcacataccaagattcgtgccatttgcgaaatgtcatgaaaacgtccgctgagccgagacgccttattcgcagcatcaagggcattgaattcaaggaaatgaaaaatgccgaaagctgctgtggatcagccggcatttataacattgtcgaatccgaaatgtcgatgaaaattctcgatactaaaatggaagcagcagcagcgacccgggccgctacgatcgttacggctaatcccggatgtctgctgcaaatgaagctcggcattgaacgagcaggacttacagaccgagtgagagccgttcatctggcggatttattactggaagccgtccagaagtga

SEQ ID NO: 296 - DNA, 1413 bp, Bacillus licheniformis
atgatttcctcacaagtgagatccaagctgattgagattgtcggctctgccaattatgacgattcgaacgccggacggctcgtctattcctatgatgcgacaccacagtttcaatcgatgcctgacgcggtcattgccccgcgcagcaaggaagaagtatcgcgaatcgtgaaaatctgcaacacgcaccgcattccgattgtgccgagaggttcaggtacaaacctatgtgccggcacatgcccgactgaaggggggattgtcctcctgtttaagcatatgaatcaaattttagaaatcgatgaagaaaatttaacgataaccgtccagcccggtgtgatcacacttgacttaattcacgccgctgaagaaaaaggattattttatccgcccgatccgagctcaatgaagatctcgacaatcggcgggaatattaacgaaaactcaggcggcctccgcggcttgaaatacggagtgacccgcgattatgtcatggcgctggaaatcgttcttgcaaacggggacatcatccgcaccggcggcaagctggccaaagatgttgccggctatgatttgacgcgtctgttcgtcggttctgaaggaacgctcggcgtcatcactgaagcaacattaaaactcatcccggcacccgaaacaaaaaaaaccgtcctcgctctctatcaagatatcgactctgcagcacaaactgtttcaaatatcattgcacataaaatcattccgacgacactcgaatttctcgaccaacctacgattcaggtgatcgaagacttcgcgaaaatcggccttcccgtccatgccaaagcggttctcctgatcgaacaggacggcaccgaagatgcagttcgccgtgatatcgccgtgattgaagagatttgcaaaaaaggaaatgctgtgtccgttcaaactgcgcaaacagaagctgaagcggaaaatcttcgggaggcccgccgcaccgccctttcggctttagcgcggttaaagccgacgaccattctggaggatgctacggtaccgcgttctgaaattgctgaaatggtaaaagcgattaattcgatcgccgaaaagcaccaaatatcgatttgtacattcgggcacgcaggcgacggcaaccttcatccgacctgtacgacagatgtcagaaacagtgaagaaatgaaacgggtcgaacaggcttttgaagacatctttaaaaaagcggttgaactgggaggaacaattaccggagaacatggggtcggcgaaatgaaagccccctatttggaactgaagctgggcaatgcgggaatcgccgccatgaaggcggtaaaacaggcattggatccaaacaacatcatgaatcccgggaagatatttgcgaaagactcccgcaagcgagtggtggtgacaagatga

SEQ ID NO: 297 - DNA, 303 bp, Bacillus licheniformis
atgaagatcgcacttgtatgttcagccggaatgtctacgagtatattggtaaaaaaaatgcgggaagaagcggaaaaccgttcattgaaggcggaaattaatgcgtatgctgaggcagatttgccaagcgatctggatgaaattgatgtgatactgattggtccgcaggtccggtatttaaaagggcaaatgacagagcgtgccaagccgtatcatacacccgtggccgtcattgaccaaatggcttatggaatgatggacggggcaaaagtgcttaatcaagcaatcagccttgcaacctga

SEQ ID NO: 298 - DNA, 333 bp, Bacillus licheniformis
atggcagatacacttcaattggaacaggtctcatttgaaatcatccttcacgccggaaatgcgcgttcttctgcaatggaagcgttgcagcttgtgaaacatcacgaatgcgaaaccggttatcaaaagatacaagaagcagaatcggagctgaaccaagcgcatcaggcacaaacccgcctcctgcaaaaagaagcacagggcgcaggcctttcacccaatctattattaatccatgctcaggaccatttaatgacagccataactgtaaaagatttggcgaaagaaatgattgatttatatcaagagcttgggaaaggaagagaaaaatga

SEQ ID NO: 299 - DNA, 1287 bp, Bacillus licheniformis
atgaaacaaaataaaatgatggcattcatcgaatcaaacatcatgccgatcgccggaaggatcggttcccaaaggcacctgattgcaatacgcgacggattcatcgccattatgcctcttatcatcatcggttccctcgccatcctggtcaataattttccaataccggcgtttcaaaactttatgaccggtcttttcggcgagggatggacggctgtcggcggagcgatatggaatggctcttttgctctgttgagccttttagccgttgcggctgtcagcttcaagctggccgagtcatatcacacagatggtctgtctgccgcattaatcggggttggcgcattcgccgtgcttacaccgaccactgaagactttggcttctcaatgacttggctgggagcccaaggtctgttcgtcggcttaatcgtggctttgctgtcgacagaagtcttccggctgttttccaaaaatgagaaattgaaaatcaaaatgcctgaaggagtgcctgacggcgtcacaaaatccttgaatgctctattgccggctgccgtcatcttatccactgccgggctatgtaacgctctgatcgttcacttttcggggcaaagcatccatgagcttgttttcagcacgattcaagagccgcttcaaggcctttccaacacggttgggtcagccttgatttttactttcttgaatcatttgctctggttctttggattgcatggaacaaacatcctcgggccgatcatggaatccgtctacctcccgctcattcaggaaaatcagcacttattctcgcaaggaatgagcgcttttgaagtgccgtatattgtgacaaagcctttcttcgattcttacgtatttatggggggatcgggaacaacattggctctgcttgccgccattttaattgccgtgaaatcgaagcactacaaaacgataggaaaggtgtctctcgcacccggcctttttaacatcaatgaacccgttctgttcggccttcctattgtattaaacccgatcatgttcattccgtttatcttgattccattaattttgacgattacatcatatatcgctttggcttccggtctcgtcccgaaaactgtggcgatccttccgtggacgacgcctccgattgtcagcggatatcttgtcaccggaggatcagtccgaggggtctttttgcaaatcttcaacctggtgctggccaccctgctctacctcccgtttataaaagcggctcaacgttccgccttgcaccagacagaaaatgaataa

SEQ ID NO: 300 - DNA, 1335 bp, Bacillus licheniformis
atggcgctgaaagtagttgttataggcggaggttccagctacacaccagaaatcattgaaggcatcatcaaacggcatcatcaatttccagtgaatgagattgtactggttgatatcgaggagggcaaagaaaagcttcgcatcgtctcagaactcgcgaagcgaatgatcagacatgcgggggttcccatcgaactgagccatacaatagatcgggcaaaagcattgaaaggcgccgatttcgtaacggttcaaatcagagtcggcggactgaaggcgagagctttagacgaaaaaattccgctcagccacggcctgatcggccaggaaacaaacggggcgggcggcatgtttaaagctttgcgcacaattccctttatgctggatatcgcccgcgatattcatgagatttgtcccgaagcatggctgattaactttaccaatccggcgggcatcgtgacggaagctttgctgaagcacggacctcatcaaaaggtcgtcggggtatgcaatattccttacaacatgaaaaatagcatcgcagaaattttcggcgtggatgtaaacctcgtcatgattgaattcgcgggcatcaatcattttgttttcggaaaaagagtttggatcgacgggatcgaccggacagaagagacgattgagcttctgttgaatgatcacttcggctactcgccttccaatattgcggcgctgccgtggaatcgccaatttttgcggtctttgcgaatgcttccgagcccttatcatcagtactattatcaacatgaagatgcgctcgcaaaagatatcgaagcgtacaataacaaagggacgcgcgcagaaaccgtcatggaagtggagcggcagctgtttgagagatacaaagacgccaagatccatgaaaagcctaaagaactggaaagccgcggcggagcttactatagtgaatcagcctgctcattaatgaactcgctttatcatcattcaatggatattcagaccgtgaacacactgaataaaggaagcataccagaccttccagatgatgcggtgatcgaagtcaacagtgtcattacaaaaagcggaccgattcccctgaccgtcggaaaactgcccgatgccatcagcgggccgatcatcttgatgaaaaaatttgaacaattagtgattgaagctgcggtcaccggcgactacgatacggcatacttagccatgatcaccaatccattggtctcttctgatcacaaagctcaaaaggtgctcgatgaaatgctcgaggctcataaacgttatctcccgcaattttttgaggaggtccgtgcacatgaaacaaaataa

SEQ ID NO: 301 - DNA, 729 bp, Bacillus licheniformis
atggcgaaacaaccacagctccacagtcaaattaaacaagatattgtagataagattgaaagcggttattatccgccgggcagcctgttgccgacggagtccgagttttgcaaaatttatgatgtcagccggacgacgctgcggaccgcgctgaatcatttgcttatggaaggggctatttaccgaaagcagggaaaagggacatttgtcgccaaaggaaaagtaaagcagatcttaagctccagcagcctccgctatgcagaacaattgaaggctcaaggctttaaaccgaaaatcaaggttgttgatttgcaaaaaataaagccgtccgaaaaactccaaacccgtctcggaatcgacgctgaacaaatggtctatcaagtaaaaagaatccgctatgcagacgatgaagaaatccagtttgaaacagcctatatcagaacggatctcgtacccgaagtaacggaagaaatggcgaatatctcactttaccagtgcatcagcaggcagggaaacaacattaaaagaacagaggagcaaatcaagattgtgatttctgatgaggagattgcacaccatttaaatattacacaaggcacgccttgcttccagatatcgacgcaaacatttttggcgtctgaagaggttgtcgagtattctatggcctattttcgcggtgaccgcgttgagttcttcattgaacgcgattatggacaaagggggaaatga

SEQ ID NO: 302 - DNA, 735 bp, Bacillus licheniformis
gtgaaatctctaatcataaatgcagatgattttggattttcaaggggagtcaaccttggcattattgaagctttccagcacggggtcctcacatcgactaccctcatggtcaatatgcaagaagcggatcatgccgtcgaactcgcacggcaaaatccagaactcggagtcgggatccacttgacattgacggccgggcgtccgattcttggcggactgcatacgataacagatgaagaagggaattttcgcaagcttttgtattaccaaggttttttcgacattgatcttgaggaagtatatcgagagtggaaagcgcaaatagagaaggctttgtcctgcggtttaaatccgacacatatcgacagccatcatcatattcatacatacggaaatctccctgaggtgtttgtagaggttgcgaaagagtatgatctgccttgcagaaaggtcaatcatgaccatccttcactgtggaagggtgtaaggtctaacgatgcttttgagctgaaagtcgaccgattgaaggatctatcgagcttctttaatgattatcaagacgcagctgtgattgaagtgatgtgccatccggcttatgtcgataaatgtctgcttgaaaaatcgtccttccattatcctcgggcatatgaactttcactgctgacggaaccttctctcaaagccgctttacaacactgtccggatattcgcctcacgtcttacgccggtctatga

SEQ ID NO: 303 - DNA, 1788 bp, Bacillus licheniformis
gtgttgatcaacaaaagcaaaaagtttttcgttttttctttcatttttgttatgatgctgagcctctcatttgtgaatggggaagttgcaaaagccgattccggaaaaaactataaaatcatcggctactatccatcatggggtgcttatggaagggattttcaagtttgggatatggacgtttcgaaagtcagccacattaattatgcctttgctgatatttgctgggagggaaggcatggaaaccctgatccgacaggccccaatcctcaaacgtggtcatgccaggatgaaaacggagtgatcgacgcgccaaatggaacaatcgtgatgggcgatccctggattgacgcacaaaagtcaaatcccggggatgtctgggatgaaccgatccgcggcaactttaaacaattgttgaagctgaaaaagagccaccctcatttgaaaacgttcatatcggtcggggggtggacttggtctaaccgcttttcagatgtcgcggcagatcctgcggcaagggagaatttcgccgcttcggccgttgagtttttaaggaaatacgggtttgacggggtcgatcttgactgggaatatccggtcagcggaggattgccggggaacagcacacgtccggaagataaaagaaactacacgctgctcctgcaagaggtgcgcaaaaaacttgacgctgcagaagcaaaagacggcaaggaatacttgctgacgatcgcatccggcgcaagtcccgattatgtaagcaacactgagctcgataaaatcgctcaaaccgtggattggattaacattatgacctatgactttaatggcggatggcaaagcataagcgcccataatgcaccgctgttctatgatccaaaagcgaaagaagcaggcgttccaaacgctgagacctacaatattgaaaacactgtgaaacgctacaaggaagccggtgtcaagggtgacaaattagtgcttggaacaccgttctacggaaggggctggagcggttgtgaaccaggggggcacggagaatatcagaaatgcggaccggctaaagaagggacatgggaaaagggcgtattcgatttttcagatcttgaaaggaactatgtgaatcaaaacggctataaaaggtattggaacgatcaagcaaaagtgccgtttttgtataatgcggaaaatggcaatttcatcacttatgatgatgaacaatcattcggccacaaaacggattttattaaagcaaacggattaagcggagcaatgttctgggatttcagcggcgattccaatcggacgcttctcaataaattggcagccgatttagattttgcaccggacggaggcaatccggagccgccttcatcggcacctgtgaatgtgcgtgtaaccggaaaaactgctacaagtgtcagcctggcgtgggatgcgccgagcagcggagcaaacattgcggaatatgtcgtgtcatttgaaaaccggtcgatatctgtaaaagaaacatcagcggaaataggcggcttgaagccgggtacggcctactcatttactgtttcagcaaaggatgcggatggaaagctccatgccggaccaacggtagaggtcacgacgaattctgaccaagcctgttcatatgacgaatggaaagagacgagcgcatacacaggcggagagcgggttgcatttaacggaaaagtgtatgaagcgaaatggtggacgaaaggcgaccggcctgatcaatccggtgaatggggcgtatggcggctgatcggaggctgcgaataa

SEQ ID NO: 304 - DNA, 2082 bp, Bacillus licheniformis
atgaagaaagccgcttcatcttttttatcttgtatgctgctcctcgcgctttttatcccgaaccggcagatttccgcagagacttcaagcgaaagaccggactgccgtccggaagggctatgggactcgggcgttgaacatgtgccgtattgcgatgtatacgacaaggacggccgtgaaaagctggccaatcagttagaccggagaatcatcggttactttacgagctggcgtacgggaaaaggaaatcaagatcgttatttagtaagcgatatcccctggaagtacttgagccacattaattatgcgtttgcccacatcggggaagatcatcggatttcagtcggagaagaggcagatgagaacaacccgtccatcgggatgacttggccggagcatcccgatgtaaaaatggatcaaaccttgccgtataaggggcattttaaccttatccatcaatataaagatagatacccggatgtgaaggttttggccgctgtcggcggttgggccgaaaccggcggctatgtcgacaaggacggaaagcgaattccaagcggcggcttttactcgatgacaacgaatggagatggatctgtaaaccacaagggtattcacacctttgcggaatcggtcgttgcgtttctcagaaaatatgagatcgatggaatcgatattgactatgagtaccctacatcgatgcaggatgcagggaatccggcagattggaacatcgccaatccgcggcgcaacgggttaaataaaagctttgaggcattgatgaaaacattaagagaaaagcttgatcaagcgtccgctgaagatggaaagtactacatgctgaccattgcagcaccatcctcggcatatttactgagggggatggaaacgtttaagccgcttcgatatgtcgattatgtcaatatcatgtcctacgatcttcatggagcctggaatgagtttgtcggaccgaacgcttctttattcgataacggcgaagatgccgaactcaagcagtccaacatttatactacgccggaatacgaagggatcggatatttaaatacggactgggcttaccattattttagaggggcagtagaatcgggacgaatcaatatcggtgtgccttattatacgagaggctggaaaaatgtgaccggcggagcaaatgggctgtggggaagagccaaaagcgcagattgccctcagggactcaggcaatgcggtgacggagcaaccggaatcgataatatttggcacgataaagatgagcaggggaatgaaattggagcaggggcaaacccgatgtggcacgccaaaaaccttgaaaagggcattgctggttcttatctggaaaggtatggattgagcaaggctgatttgacaggcgtttataaaaggcattatgacgcagggctggcagcgccttggctttggaatccagaaaagaaagtatttctatcgacagaggatgaggaatcgatcaaaacgaaggcggattatgtcattgataaaggaatcgggggtgtcatgttttgggatttgagcggtgattatgactggtatcccgaacgaaacggcagtaaaggagaatacggtatcggcaataccttaacgagaacgatgtatcataaattctcggatacaacaccatacgataatcgactcagcacatcacctttgcctgatgaatcactagatgcagaagtagagttgacgaactttccgttaggagatcaaaattacccgatccacccggtgatgaagctgatcaacaacagcgatgtcacgattacgggaggttcttttatcgaatttgatgcgccgacatccacttcccctcggtttagaagctggagcggcgatcatgttgaagtgatttctaaagggcatacgggaccgaacattggcggactgacagtagatttccaccgcatcagagtgactctatcaatctggaaaaccattaaacctggtgaggaagcggagtttcagcttgtctattatttgccgatcagcggtccttcaaatttcacgatatcaatagatggcaaaaagtacaggcttaaaggaaattaa

SEQ ID NO: 305 - DNA, 951 bp, Bacillus licheniformis
ttggttagtaaaaagagtgttaaacgaggtttgatcacaggtctcattggtatttctatttattctttaggtatgcacccggcccaagccgcgccatcgcctcatactcctgtttcaagcgatccttcatacaaagcggaaacatcggttacttatgacccaaacattaagagcgatcaatacggcttgtattcaaaagcgtttacaggcaccggcaaagtgaatgaaacaaaggaaaaagcggaaaaaaagtcacccgccaaagctccttacagcattaaatcggtgattggttctgatgatcggacaagggtcaccaacacaaccgcatatccgtacagagcgatcgttcatatttcaagcagcatcggttcatgcaccggatggatgatcggtccgaaaaccgtcgcaacagccggacactgcatctatgacacatcaagcggttcatttgccggtacagccactgtttcgccgggacggaacgggacaagctatccttacggctcagttaaatcgacgcgctactttattccgtcaggatggagaagcggaaacaccaattacgattacggcgcaatcgaactaagcgaaccgatcggcaatactgtcggatacttcggatactcgtacactacttcatcacttgttgggacaactgttaccatcagcggctacccaggcgataaaacagcaggcacacaatggcagcattcaggaccgattgccatctccgaaacgtataaattgcagtacgcaatggacacgtacggaggacaaagcggttcaccggtattcgaacaaagcagctccagaacgaactgcagcggtccgtgctcgcttgccgtacacacaaatggagtatacggcggctcctcgtacaacagaggcacccggattacaaaagaggtgttcgacaatttgaccaactggaaaaacagcgcacaataa

SEQ ID NO: 306 - DNA, 774 bp, Bacillus licheniformis
ttgtatagtgatttaaaaggaaaaacagcaattgtgaccggctcttcaaaaggtataggcaaggcggttgcagaacggtttggaaaagaaaagatgaatgtggttgtcaattatcacagcgatcccggaggcgcacgggaagccgtcgacaatattcaagcagcgggcggaaacgcccttgcgatagaagctgacgtgtcttccgaagaggacgtgaaaaagctgattaattcagcagttgaacactttggttcacttgatgttatggtcaataattcaggatttaacggcgcgggcgcctttccgcacgaacttgagcttgatgagtggcagaaagtgatcgacgttaatttaaccggtgcgtttctctgcgcacgcgaagccttaaaatatatggcggaccgccgcatgaaaggaagcatactcaatatatccagcgttcatcagcaaattccgagaccgaaaaatgttcactactccgcttcaaaaggcggaatgaagctgttaacagaaacgcttgccctagactatgcggacaaaggaatccgcgtcaatgcgattgcgccgggaacgattgcgaccgaaagcaatgaagacttggagggaagccgcaagtcggaacagctgaaaaagatacccatgaacgaatttggcgagcctgaacaagtggcttccgcagcggcatggcttgtgtcgcaagaagccgcctatgtaacgggcgcgactttattcgttgacggcggcatgacgctgtatccatcacagctggaatag

SEQ ID NO: 307 - DNA, 819 bp, Bacillus licheniformis
atgcaaaacaatatcgttcacattgccttcggcgagtctgccggcggcagtataaacatgatgctcaaacagtcgggaggaacccatgaaaagagtctgatcgttctgcctgaattattttccatcggaccgcttcaaaagctggaagccaaagaaggcagggtcaatcgttatgaatggttgaaaacatatctgaatgaccgatttcacgagtctggaaagagatacagccgttttgaagtggcggtttctgcattgtccggcattcctgagcaagcctctgtctttatatggacaggagatcatgcacacgaacagactggactgaggtttgtacaccatatcctccgacaaatgaacctggctgttttccatttgaatacgacgaagttcttcccccatacccggagttctggtgaattgaatgatgaaaacctgagattcatttatgaacaaggggatcaggcggctgtgacagccgctgaaggacggcgccttgcagaggaatggacagcgctgtctcagcagacaagcgtgttgcgggtatgggaagacggtagaatcaaaagcgtgaaggaggatttttttgattcgttcataatcgaaaaactggctcagcttcaaaaaaaccgttcagccaacacctttatcaactgtctcagcttgatcggcgaagtcattggccatctggaggagaacatcggagatgaatttatcgagtaccgcattttagagctgatccgcaaaggtatttttgagatgaaaggcacaacaaaaggaatgagatattttaatgtcaggttaaaaaatgtcatgtaa

SEQ ID NO: 308 - DNA, 1398 bp, Bacillus licheniformis
ttggttcgtgaacagttaaaacaaaaagcgcaatccatcagtaaggttcccccacattatcagctcatgatcgaagattacggagagaagtacgaaaaagagaggcgggtttttttcgcttggcaggacattgaagagccggagcgggacatatcggtggagttagatcatcaaggccgcttaatcagtttgacaaaagagtatgaaccggtggtggaggaagctcttcctgatgaaaggctgctgcaaatcgcccttcagtttacagaacagcattacccgaatgcgccttatgaatttgttttccatgaaaagaaggtaacagaacaattcgttcgttttacgtatgttcagactgtccttgatcttccgctgccgcagacgggcttttatgtccgggtcgccaagaacggagaggtgattgagtttcgctataacggcgggacgagctctttctccattccaaagcagatagctgataagcaatcggtaacagccgattatcttgaacatgttcaattcgaattggcggttgaaaaaatccgcagtgaactttatgaagggggagatgatctcccgcatcttatttacgaagcagacttgccgtttttcagctatcccgccgatatcacggaaaaacgccagatgaagcctgcggctgatgacgaggaagaagaagacacattgccgctccctgtgctgcctgaggctgaccgtcatgctgatatcgatgacatgatcggctttaccccttcgatgcgaaaaatccgcgaaaccgatttgggagagtcaattggaacagtgtggcgcctgggagacgaccctgagccgagagatcggagtatagccggctactttgaaacatggaaccaaaatacgttgaaaatcgtgaaagacaaaaactcggggaagctcaaaggaatcgcttcttttatcaaatcggaaggaccccctgtcttgagcggggaagactgcttgaaacgggcgctgcaatttttgtacaggctttatcccgacgctgatcggctttttcgaatgcatccggcggaaaatgacggggacaggtcaaacgcattttttcaatttgatcttcaatacaaaggggtgccgttaaggcttggctctgccaatatcagcatcaatcggacaaccggcagggtcgtcggttatcacggcccggaaatcgagccggaaacgctgatcgatctgagtccttcgccatccatttcagaggaggaagcgaaagccgtttttgcagcggcatttgatgtgaagctgcagtgggaaagggactacagtcgggaaaaggatgacttctacaggcttgtctaccggccggtatacccttactttatcgatgcccatgacggaaaggcgtttatgagcaaaaacatataa

SEQ ID NO: 309 - DNA, 852 bp, Bacillus licheniformis
ttgtcagtattaaaaagccctgaatgggtatacaaacgattaatggaaaaaacggaccaaacagttattgtcgacgtgaggtttcatttgacaaaaccggacgaaggccgaaaagcgtatacgaaaggccatgtgcccggagccgttttcattgatttaaaagaagatctgtcgcgcaacccggaagagcacggcggcagacacccgcttcaagaccctgaccttctggccgcgaagcttggaaaaatcggcattgaccggcaaacagatgtcgttgtttatgatgacagcggcggcatgtttgcagcgcgcttttggtggcagcttcactatctcgggcatgacagcgtctatatcatggatgggggactgtccaactggatcaaagcgggctacgaggtgaacgccgaggatcctcgtcctagcgagcgcgaatttaagccggcgctcagagaaaacgaactgctcgatgccaaagaagtactgaagcgaatcggcagagaaggctccattctgatcgatgcgcgcgatccttcaagatacaccggggaaaccgagcctctcgatcatcgggccggccatattcccggcgctaaaaactttttttggaaaggcaatctaaccgaaggcggattatggaaaagcaaagaacagctcagacagcattacgctgctttggacccgggcagtgaaatcgtcgtctattgcggatcgggcgtatcagcctgcccgaatgtactcggcttaaaagaagccggatttgaaaatgtgaagctgtatgccggcagctggagcgattggatcagctacccagaccatccgatctccactggagccgaggacgatatttga

SEQ ID NO: 310 - DNA, 429 bp, Bacillus licheniformis
atggcagtcgttcaggcttcttctaaagatatcagtcttttggcaagacttttgagagcggaggctgaaggcgagggcgtgcaaggtatgcttatggtcggaaatgtcggaatcaatcgcatcagggcaaactgttccgactttgtgggacttcgcaccattccgcaaatgatccatcagccgcatgcctttgaagccgtgacgcacggttatttctatcaaagggcgcgggaaagcgaaaggcgtttggcacgcagggcggtcaacggggagcggctttggccggcaaagttcagtttgtggtatttcagaccggcgggggcgtgtcccgcacagtggtacaatcagccgcatgtcggccgctttaaatcgcattgtttttacgagccgacagcggaagagtgtgagaatgtctataatacgttctaa

SEQ ID NO: 311 - DNA, 993 bp, Bacillus licheniformis
ttgatgcagctcagcattcttgaccaggttcctatatcaaaaggctcggatgcgcattcagctctaaagcattctgcagagctggcggaacttgcggatcaatgggggtacaaaaggtattggtttgccgagcatcacagcacacgggggcttgccagcaccgctccagaaatcatgatcgcacacattgcggcaaagacggcgaatattcgcgtcggttcgggcggcgttctgctgccccaatacagtccctttaaagtggctgaaaactttcggcagcttgaagccctttatcccgggagaattgacctggggatcggccgctctccgggaggcacaactaaaacgaggctggcgctgacagacggggttcataaaagcctgcacgaattcccgagacagttacaagacttggttagctttctgactgattccgtgccttccggacatgattacttcggaattaaagcctcccctttgacggattcgcccccggaggtgtggcttttaggcctgggagaaaacagcgcaaaattggccggtagcatgggagcgggatacgtattcggccatttcatctctcccgcgagaggaaagaacgcctttcaatcataccgtgaaagctttcggccttcccctttctttaaacgcccccaatcattggccgccgttttcgtcgtttgtgcggagtccgatgaaaaagccgaggagctctgcttgagccaagatttatggcttctccgggttgaaaaagggctggacagccttgtcccaagcattgaagaggcgaaatcggccgcttacacagctgccgataaaaagaagcttgcccaaaaccgcagccgtatggtgatcgggtctcctcaaacagtcaaaagaaaactgctcgagctttctgaacgatatcaaacagatgagtttatgattttaactaacgtctaccggtttgaagataagaagcagtcttacgaaagactggcagaattattttga

SEQ ID NO: 312 - DNA, 1359 bp, Bacillus licheniformis
gtgaagaaaaaggtttatacttttggtttagcgtcgattctcggaacagctagtctatttaccccctttatgaacaacacggcatcggcagaaacatctcagcaaaaacaagaaattcagcaaaagcgttctgaagtgaattcaggcatcgagagcaagcggaaagaaatcgccaagctgcaagacgagcagaaaaagcttgaaggtaaaatccaagagcttgataaaaaagcacttgaaacaagcaacaaaatcgaagacaaagaaaaagaaaacaaaaaaacgaaaaaagaagtggaagctctgaaaaaagaaatcaaagaaaccgaaaaacggattgaagagcgttcaaaagtgattaaaaatcgcgtgcgcagcctgcaggaaaacggcggatcccaaaactatttgaatgtccttctgggcgcacaaagcttcggagattttatcactcgtgcaactgctgtttcaacaattgttgatgcggacaaagacctgcttgacgagcaggagaaagataaaaacaagcttgaaaaagcaatgtctgatttaaatacaaaactggacgaaatccaaaaaacactagccgatttaaaaacgcttaaatcggatcttgataaacagctgaaagaacaggcaaacctttctaagcagctgcaaacgaagcaagcggcagcagaatcagaactgagcgatctgaaaaaagaagcgggctctctgacaaaagaagaagccgctcttgaacaaaagcttaaagaagaaagagctgcggcggctgcagcagcaaaagcgaaagaagaatctgcgacggctgaaaagtctgattcaggatcttcatcaagctcaaattcaggttcagtcagcaaatctgacggatcgtccaacagcggttcttcaagcagcaagaaaagcagcagcccgtcaagaaactactcttccggttctgttgtaagcagcaatggaaacgcgattgaagctgccatcagcacaggttcaagcattgtcggcagatctccgtacaaatggggaggcggacgttcacaagctgatatcgacaaccgccgcttcgactgctcatcattcgtacgctgggcttatgcatcagcaggcgtagagcttggattcggtgcgacaacaagcacgcttgtcggcaagggacgagctgtcagcgcgtctgaaatgaagcgcggagacttggtcttctttgacacatacaaaacgaacggccacgtgggcatttatcttggcaatggcacattcctgaacgataacagctcacgcggggtatccgtcgattctatgagcaacccgtactggaagaaagctttcaacggagttgtaagacgggtcgttgaataa

SEQ ID NO: 313 - DNA, 813 bp, Bacillus licheniformis
atgaacctctccctgtataaacaaatgctgagaacaaacatgaaaggaatcatgagctacggggtaggctccgcattttatatccttttgatactgggcatttatccaagcatcgcgggcaatgcggaggatattgagaaaatgatcaaatcgatgccggaaggctttctcaatgcttttgggtttgaaaacggacttgggaatcttgaagattttatatctggagaatattacggattaatctttatcgtgatcttatcgatcttctctgtcatgctgtcgacaaagcttttggcaaagcgggtggatcaagggtcaatggcctatattctgtctgcgccgacaacgcgcggaaaagtggctttcacccaagcagccgtcttaacgacaggtcttttgatcattatggccgtgacgacagcggccggactggccggctaccatttgatgctgggcggtgattacgattttaatgtgtcaaggttcctcgttctgaacctgcttggctttctgctcttctttgcagtcggcggcatttcgttcctcttttcggccatttcaaatgatgaaaaaagagccctcggactttccggaggcatcacgttcttattcttcagcttcgacttgctaggcaaattaagcgaaaaaacagaatggctgaggagcctgtcggttttctctttattcagaccgggcgatattgtgaacggaagcaccgacatcgctcaagtgtctcttgttctcgccgcagtcggttttgccgccttcgcactcagcattctcatttttaaaaagcgcgacttgccgctgtaa

SEQ ID NO: 314 - DNA, 888 bp, Bacillus licheniformis
atgcttacagttgaacggctcacgaagaagttttccaatggcaaaggtatctttgatctttcttttcatgttcaaaaaggtgaagtttttgggtttttagggccgaacggagccggaaaatcgacgaccatccgacatatcatggggtttatgaagcctgatcaaggcgacattaaagtaaacggaatggatgttttgaagcagcagggcgatattcagcggcatatcggctatctccccggagagattgcatttatcgaaggaatgacgggaaaacaatttctcgatttcatggcagacatgcacggcttaaaagatacagccaagcgcaatgatcttattgaacggctccagttcgatgttcatactccgatcagaaaaatgtcaaaaggaatgaagcaaaaggtcgggattgtcgccgcctttatgcacagccccgaagtgattattcttgatgaaccgacatcaggcctcgatccgctgatgcaaaaagtatttattgaaatcgtcctcgaagaaaaagcgaaaggaacgacgtttttaatgtcttcccacagctttccggaaatcgaaagaacctgtgacagagcagccattataaaagacggcatcatcattgccgtcaaggatattcatgaactgcagtcgatgcagcgaaaagtatttgaagtcacatttgaaaacacgggcgacattcccgccttcatgaattcaagtctgcaaattgagtcccggacggacaaccgcgtcaaagtggccgttttagggaaccatgatcaatttattaaagaaaccgccaaatatcacattcggcacattgatgcttcatcacaaagcttggaagaaatttttatgaactactataacagaaaggggacagcgcaatga

SEQ ID NO: 315 - DNA, 588 bp, Bacillus licheniformis
atgaacggatttgaaaaaagggctttgctgattaaggagaagatcaaaaagacggctttggatatgctcaaaacatgggagccaaagcgcatccggataaccgatatcgcaaaagaggcaaacgtttcgcaggtgacgatttataattactttggaagcaaagaagcgctcctgaaagaggtttttaaagattatatcgatcagtccatcagcgagtttgaagaatatatgaacaaagatatttctgttaaagaaaaaattgaattgatgattttgcaaaaaagggcagccaataatcaaaaattcgctttaacggtcatcaaagaggtgatgatcgaagacagtgaaattatggattatgtgaagcagcaatacgatgaaaaaatcattccccttatgctccaaatgattgaagaaggtcatcggacaggcgaaatctcttccaaaatcaccgcggaaagctttctcatctttatgaatatgatcattgaacattcaaaaacattgggtaaagcctttgaaaaaaacaggaagtttacagaggaaatgctgcacattttcttctatggcttgtgcggcagaccgtag

SEQ ID NO: 316 - DNA, 1896 bp, Bacillus licheniformis
atgaagcactcctttttcttttttatgttcattgccttttttctcgtcactggtttttctgaagcaggcaaatccttttcgatcgagcgggctgatatacgcgcaacagtaaaagaaaacggcgatttaagtgtagaggaagtttacagatacgattttaaaggttcttttgaaggggcgacaagatcgttcagcgaagaaaccgcgagccgcctgaagaattttaaagcctatctccttcccgaccaccggagaaaaggcggtcaagccatcccgttaaagacaaagaaggaagacgggacttattttgcttattcggcatcaaaggatgaaacgaaaaatgtgatgtttcgctatgtgatcgaagatgccgcacaaaagtttgaagatacgtcgattttgatccattcattttaccaaaaggcaaataccgatttcggccgcgtaaagattgaagtgcgcctgcctgattcggtaaaggcacgggatattcatgcgtttttgcgtgaaaaaggaaacggaaagattacgaaggtgaacgattcatcggtcacctatgagacaggactctatcgcgcaggcacgggctccgagctgaggatatattttccgcaaagcgccttgaaggaggcggtccggcacccttcttaccagacaaaggatgagctgctgaaggaggagagagacgaggcgaaacgctacgctgagcgggatgaacgaattgccggcgctgaaaggatgattttgattttttcggggattgtggggttcatggtcatcatggctgtcatgctttcgtttttgaagaagagacgccgcgccatgctttcgtttgaagaactcgagtcctttgatcccgtgcttgtcgcatttctttacaaaaaaggccgtttcacagaccgcgatctcctggccggcctgctttcgctttatcagcggggattggtcactatgcagaaggtgcaggctgaagagaggtttctcgacgatcctaaggcgcctgatgacacatatgaatttgaattctccggaagcaaggcagatttgccaaagcctgatcagctcttaatcgaaaaactttttgagcagacgggcagcgatacctatatgttcaggctggattccctcagcgggccgactgaggaggaatgcaagcacaaggagcagctgggaaaatatgaacgaaagaggatcattcttcaaaacgtggttcaaaaatggacggaaagcgtcagacaagcgcctgaattcagggaactgtttcaagaaaaccgctggctgagaatgctgtcgctttcactgctttcagtccataccgggctcctgctctttattctgtatgcagatgtggtacatcaggccggattcatggcggcttgcgtcatatttggttttgcactgtcggcaggcattgttcttgcgaagtcaaagctgtatacgattctgtttttggccggattgtttttggcgtctgtttttaccgacagcgttcataccattttgtattacggcatatgcgtcgggctgtctattttattaattgccttcattccggccgtgaaagaaagcaggtatgcctccatctgccgaagatcgattctttcctggaggaaccatctgagaaaagaagatttgttctcagggagaagcctgtcacaaaacgaaaaaacgatgatctttgcaattgtgcttgaagtggaggatgaatctgccgtgtggctcaatcaatcagcaaacaggcttgattacgcttcccctgtactgggtatggctgcagccggctgtttgcattatccgttttacagctggcagctgccggattcgcagcagcacgccggtgcatatgatgcaggcggttccggagcgggcggaggcgacggggcaggagctttttaa

SEQ ID NO: 317 - DNA, 483 bp, Bacillus licheniformis
atgggtaaaacgatcatcaacaagccttttacggccgcccctgaagatgaagtcgttgtatttgtgatcgggatgagagtaaacaagtggcatgctgttcataaatggtggccggtttttaccgccatgccccctatgataaaggagctttatcaaaacaaaaacctcggctttttagcaatggaatcattcatcaatttcaggacgatttgtcttattcaatattggcgttctttcgaagatttgacagcatatgcaaagggtgataaacatatggcggcttggcgccgtttttatcagaaaacagccgcatcaggcgctgtcggcatctatcatgaaacgtattcggttccaaaagggcgctatgaggctttttaccataacatgccggtgttcggcttggcaaaagcgtacggacatcaacctgtcacccgcggaaccaaaactgctgaacagcgaatgcggggaactgaaataatctga

SEQ ID NO: 318 - DNA, 564 bp, Bacillus licheniformis
atgacaaaaagaaatcacacgacttacgcgctgcttggattgattacggccggctaccgaacgggttacgaaatgaaacgaatgatcgaccaaagtttgaatcatttttggaaaatcagctacgggcaaatttatcccgcactgcgtcaattaacggaagcaggctgggccgcggcttctccggcgctctcggacaaaaagcaggacagaaaagagtacatgattaccgctgaaggtcaaaaagcgctgcagagctggcttgaagaaccgatcaatgacatcgcttcagaaaaaaacgagtttttgctgaagctgtttttcagcaaggaagaatcgcgggagaaaaccgctttgaaagtgaaggagtaccaacaaaagcttgaagaacggcttgaagcatataaagcaatcgagcagtcaattctttcgtgcagctcccattcaaaggacagagagtactggcttttcacgttggattatggaaaacgcaccacctcggccggaattgaatggtgtgaggccacaatcaatcggctgaatggaaaggaagggaccaatgggtaa

SEQ ID NO: 319 - DNA, 603 bp, Bacillus licheniformis
ttggctatttctttagagaaaggtcagcggattgatttaacaaaaggaaaagcggggctttcgaagattttagtcggtctcggctgggatccggtagcgtccggaagcggcggtttttttggaaagctgtttgggggaggaaccccgaatattgattgtgacgcatccgtgctgatgctggaaaacggaagagtcacagagaacaagaacgtcatttatttcggaaacttgaggagcagatgcggcagcatcgaacataccggagataatctgacaggcgaaggcagcggagatgatgaacaaatcattgtagatttgcaaaaagttccttcgcatattcataagcttgtctttgtcgtgaatatatacgattgcgtgaaacgaagccagcatttcggaatgatcgaaaatgcctttatacgcatcgtcaacatgaatgatcgcagtgagatggtcaagtacaatctgcgggacgattattctgggcggacaagcctgattgcgggcgaaatttaccgtgacggcgccgagtggaaattcaccgctgtcggagaaggcacaaacgatacgagcattacggaaatcgttaaacgctacgcctga

SEQ ID NO: 320 - DNA, 582 bp, Bacillus licheniformis
atggcaatttcattagcaaaaggacaaaaaatcgatttaacaaaaacaaatcccggattgtcgaaagttgtcgtcggccttggctgggatgtcaatcaatatgacggcggtgctgattttgacctggatgctagcgtgttcctgctcaacgcagaaggcaagtgctcttctgaaaaggactttattttctataatcagaccgagggcgcaggcggagctgtcatacatacaggcgacaatcggacaggggaaggcgaaggagacgatgagcaggtaaaaatcaatttgaatgcagtgccggccgatattcaaaagatttcttttgtgattacgattcatgaagcggaggctcgccgccaaaatttcggacaggtgtcaaatgcttacgttcgcgtgatcaatgaagactcgaacgaagagttaatccgctatgatctgggtgaagatttctcgattgaaacagcgctgatcacgggagagctgtaccgccacggaggggaatggaagttctcagcgatcggctcaggctatcaaggcgggctggcgaggatcgccaccgatttcggcctgcaggtcggctga

SEQ ID NO: 321 - DNA, 579 bp, Bacillus licheniformis
atggcgattcaattatctaaaggacaaaggatcgatttaacgaaaacgaaccccggtttgacgaaagcgctgatcggtttaggctgggatacaaacaaatataccggcggcgccgattttgacttggacgcgtcggcttttcttgtcgatcagaacgatcgatgcatcaatgatcacgacttcgttttttacaacaacctcgagcatccaagcggcgccgtgattcatacgggcgacaaccggacaggagaaggtgaaggcgatgacgagcaaatcatcgtcgatttctcaaaaatccccgctcatgttgaaaagatcggcatcacggtgacgattcacgaggcggaaagccgcagccagaactttggacaagtctcaaatgcgtttgtccggctcgtagatgaatcaacaaatgaagagctgcttcgctttgacttgggagaggatttttcaattgagacagcggttgttgtttgcgaattgtaccgtcacggaggagattggaaattcaatgccatcggcagcgggttttccggcggattggcatcgctttgccgcaactacggcctgcaagtctag

SEQ ID NO: 322 - DNA, 774 bp, Bacillus licheniformis
gtggatttatttcatcatattatgtcaatttacgcctcatttttcgattgggaaatgtgggtggaagtattaacggaccctgtttcctgggggctgatcggctcgctggtcgtgctggaggggcttttatctgcggataacgccctcgttctcgccgtcatggtgaagcaccttccggaaaaacaacgcaaaaaagcgttgacatacggtttaatcggggcctacttctttagatttctattcattggactcggtatgatcctgattaaattctggtggatcaaactgctcggagccgcatatctggcatggctcgtcatcaagcacttcttcatcggtgagggcgatgatgaagcaaacgccatcaaaaaagacagctggatggtacgcgttttcggggtcttctgggcgactgtcatttcggtagagctcatggaccttgcattttcggtcgacagcatcctggcggcatttgccgtatctgaaaaggtatgggtgcttctgatcggcggcatgctcggcatcttgatgatgagaaccgttgcgaaattcttcttgacgctgattgacaaagtgcctgaacttgaaacaacggcctttgttttaatcggaatcatcgcactgaaaatggctgcgagtgtatggcatattgaaatgccgcacagcgtcttctttatcattctgattattgcttttgccgcaacatttatcattcactatatgaacaagcaaaaagctgtaaaagagcaaacggcggcttcaaaggaagaataa

SEQ ID NO: 323 - DNA, 1182 bp, Bacillus licheniformis
gtgcaatactttgattttttatccgcctctcaaaaagaagatgtctttttcaaactgccgggtacggttacaaaggactctccgaagcgcattctcgagtatgcgcttggagctgcgctctatgttccggggaaccgaaaagatatagcagatgtcatcatcaataacaagtatccagaactgtgctcggtcgttttttgccttgaagattcgatcggcgattgtgaggttctacaggctgaaaacaatcttgtcagtcaggccgatatgatttatcaggcgcaaaaactgcagaacatcaacagcgatgtgctgccgctgatgtttatccgagtgcgggaacctgagcagatgctcgaattgggcaacaagctcggccgcgcgcttcacttgtttgccggattcgtatttccgaagttttcgatgttgaatgcagagcactaccttgatactttaacgaagctgtcgcaagaatccggcattgtgctatacggaatgccgatctttgagacacctgatctgctggcgatggaaacgagggcaaaggcgctgcaggaattaaaatcaacgcttggcttttatcaggatatcattctgaatatcagaatcggggcgactgatttgtgcggtctctacggcttaagaagaaaaccggaaacgccgatttacgacattttggtcatctctgatttcatcaaagatatcgtcaattatttcggcttgcaattcgtgatttcggggcctgtctgggagtactttggagatgcttcgcgaacggttccgccttttgcgccgaattgggctgaggcgggggaatcttcgcttgtgatcaatcggtatatggacggattgatcaatgaaacgcttcttgacctggccaacggcattcacggaaaaagcgtgattcatccgtcacaaataaaagcggtccaaagcctgcatgttatatcaatggaggattatctggatgccttaagcatcgtcgaaagtgccgacggcacccgcggcgttgtaaaaagttctttctcaaataaaatgatcgaaatcaagccgtaccttagctgggccaaaaaaatattattaaaggctgaaatctacggggtatatcatgaaaaccgcagctatacggatatacttagagcgtccaaaccgttttcaaaccttggatcgttcgggagttag

SEQ ID NO: 324 - DNA, 1605 bp, Bacillus licheniformis
atgaatcaagagattaatattcaaaacgccctggtcaatgatgatgaatggaagcagatcatcaagaagccgctcccggagagaaccccgtatgaaaaaaacagtcatttgacgataagccgtctggcgggacggattcttggaactccgcacgatgaaacggattactacatatatctccatgagctgtatgcgtccggtgatgtgcatgtgttaagcgagacgcttgataagaccatttctccggaaaggtttcaggccatacagcggatccatatggtgaaccagaaagaaaaaggactttccgtcaatcggtttgccgcttttcttgacggggagcagctgattcctaagcaccctgatcccgctatgcaccggcatttaaggaaggcgcttatcgaagtgctgcagctgtttcagtcctttcatgaaaaaggattgaacgatccggattttcgccgggtcctccttgaccttgtcaaatggatgggcaaccatttggagaagtggctgaaaggggccgactgcgaaacggcgatgccgaaagtggtttggtacggggacaccaccaaaagccaacggtattttttatactatttgatgcttgtcggatgcgatgtgctgctgtttcatccggagggaaaagacgaatttcgccagcttgatcccgagcaaaagctttcttttgtcttcacatacccggacacgtctgcattagagccgttcccgactgaaaagccccagcgcaaagcaacggtggcgtaccgttccgcgaaggagctggatactgtcctgcacaatgaggattcgctaatgtacaaaccttggcagttcagggagcatactccggcctctgtgactttgaagacaacatatgatgaactgtttttaattgcgaaggaacgagcctttatcagacctaattttcaggcgtctaaatcaacggttaacattccgaatttattcgcgatggtcatgggcgtctccagcaatgaaaaagagtactgggaccgtctgcagacactgacggagtataaggagtcgcatacgatccggcgcttcccgtttacaaaggaagagacgtcgaattatcaattccattacagcgatgcgcttgatcaaacggggatgatcgatccaggccgtttaatggagagcaatatatggcgctacaagcatctgcctgagggagtacagcgaggcattgcccaagcggtttccaggatgtgcaaaagcccgaagatgctggctttgaacaatgaaaagacagccgatgtacagctgtatttgtttacccaagcggtacagcttccggcagcgctattgaatatgattcagacatttgactattcacagaccgtgccgaagctgatcttgtatcacacggaacagacggggacactcacccggtcggacgcggccgccttgcttttgttaaatgaaatcggcattgacattatcatctataatccgccgggccataagtgtattgaccactatatcgacaggcagcactttgatacccattggcttgatgaaatgtccttcaaccaggagtttaaagagccgtcaatcgtccggaagttcatcaataaaatcttttaa

SEQ ID NO: 325 - DNA, 1095 bp, Bacillus licheniformis
atggcaaatccaaatgaaacaagcatcgtcaatattagcaaagaggaagagatcacggttgaaaaagcggaggacatccgtgcgaaactccgccaggagccggatgtgcaagctctggcccgacaaattgacgtgaaaaaccaagtggagcttttagaattcggtaaggagcccgctcttgaaatatccaagttctctgaccgcattctttccatgatgagaacgaacagtgtgacagattcaggcgcgatgttgacgcagctcggaaaaatcatggaccgctttgacaagaatgactttgaagaacaaaaaggcttgctctctaaattatttaagcgcggcaacagcatgatcgagaaaatatttaaaaaatatcaaacgctcggcggtgaaatcgaaaaaatcaatgtcgaaatttcaaaatataaagatgaaatgacaaaatcgaccgtgacgcttgatgaaatgtatgaaagcaaccttaaatactatgtggagctggaaaaatacgtcgtagccggccagatgaaaatagaagaattgcagcggctcatccccgaatatgaagcgaaagcggccagcggaaaccagatggcgcagatggagcttgatacgcttcgaaacggcattcaagcgctggaagaacgggtgtatgatctcgatatggcgcggatggtcgcaattcaaacggcgccgcaaatccgcctgctccagcgcggcaacacaaagctgatcggaaaaatcaactcggcattcatcattacgattccgattttcaaaaacggcatcatccaggccgttaccgccaagcgccaaaaacttgtcgccgattcaatgagcgaactcgaccgccgcaccaacgaaatgctgaagcgcaacgcggaaaatatttcaagccagtccgtcgaaatcgccagaatgtccggaagaccgagcatcgatattgaaacgatcgaacaatcttggaatacgattgtcaaaggcatgcaggagacgaagcagattgaagatgagaacaaacgcctgcgcgaagaaggggcaaaacgcatattggaacttcaggacaatatgaaaaaagccgctttaaacggttaa

SEQ ID NO: 326 - DNA, 702 bp, Bacillus licheniformis
atggccgctttatggctggcattcggcggcggtttcctgtcgtttatttctccttgctgcctgcctttgtatccatcatttatttcctacatcaccgggatttcggtcggcgatttgaaaaaccggcatgcaaagcatatcaaacaatcggtgatgattcacgcagcggcttttttggccggtttttctgtgattttttacatattgggtttctctgccagctcggttggtctgctgtttttgcaataccataacttaatccgcatgctgggcgggatatttttcgtcgtcatgggactgttcttactcggcgttttccggccggcttttatgatgaaggagcggcgcttttcgattagaaagggaaaaataggcctgctgaattcaatgctggtcggaatgatttttgcggcgggctggacgccgtgcatcgggcctatattcggaacgatcgcatacgcaaattttcagaaccctgattttgggagcgcattcatgatgatcaccgcatattctttaggctttgccattccttttttgctcatggcgttttttatcggaaacatcaggccgcttatgaaatattcgaatatgctcatgaagatcggaggcgcgctgatgatcgtcatcggcatcctgctttatacggacaacatgatatggattaacatctggtattcgaatttgacgaatctcttttga

SEQ ID NO: 327 - DNA, 687 bp, Bacillus licheniformis
atggaatggaaaaatccttggaacaaaaagcagctggtctgcttgtttttgatcgcatttgcagccgtgccgattttcattgaatatttattaaagaatgctttggatctgcttttaggcgaaggcatgctttcagccatgttgatgagtatcgcaatggcggccgtttttattctaagcttgtactatatcgccttaaagccggaccgtctgtcttggcgggaaatcggaatctcccggttcgcccctgcatacttgattcaaatagcgggatggacggtttttttaatcgtgatgacgtttgccgttatggaaatcctgatttggttcggcgcaggctacgaaaatacaaaaacaaaaacgatcactgccgatccttcatggttgagcattgcaatgtctttcgcttctgcctgcatcgtttctcccatctacgaagaattgttttaccgcggttttctttaccgctggttccgcgctgaattcggggttgtatgggcacttgttgcaagcagcgccctctttatgatcgctcatatccccacatacaacaccctggccgttaactttggaacagggctcgtgtttgcctggacatacgaaaaaacacgatcgattatacctgcgatgatcatccatagtttatttaacgcgattttgctgtttttcacaatcttactcacataa

SEQ ID NO: 328 - DNA, 738 bp, Bacillus licheniformis
gtgaaagaggaactgacaaccgggcgggtggcgaagatgatggggatatccgtaaggacgctccgctactacgatcaaatcggtttattaaaaccgggctctacactgccgaatgggcgaaggcaatattcgaaggaagatttgttagagctcgaaaaaattatgatcttgaaatctgctcaattttcattggagcatatcaagacgttaatgaatcaattggatacaattagtatcatcgaaatgcataaaaggcgccttaattcggagatcgaacagctgacgaagagcctggagcatacaaatactttgctgaacatgtatcaaatcgaaggaagcttgagctgggaagaccttctcaagctcgtcagacagccccggcataaaccatggaaggaatcattctctgaagaggaggctgagattttagcagaaaggcttccgaaggcggagagtgacgatttcatcacaaagcaatggctctctatcatcaagcggattaagctgtgtttaaaacaagaggtgccgcctgaatctgaatggggaaagcaaattgcggaggatatcatatgcctgtctgatcattcgtttaagggacatgaggatttagccgatcgattctgggaggttcgcaagtctgaggagccaaacgggctttatccgcttgacagcgggattatggaatttgcggagagagcgattgaatctgcatttcatgattcaggaggatcagggtga

SEQ ID NO: 329 - DNA, 1206 bp, Bacillus licheniformis
ttgaaattggcggatttgaggaagagcggacacgcgccttccttgttgtcatcttttttatatttcgatgtcagctttatgatttgggtgttgctgggggcgcttggtgtttatgttacggctgattttgatttatcgccttcacaggtcggattgattgtcgccatacctactttggccggatcgtttttccggattgcgctcggcattttaaccgaccgtttcggaccgaaaaagacggctgttggcggaatgctggtgacgatgattccgttgttatggggatggcagttcggttcatcggtcgccgagctgtatatcatcggaattttactcggtgtggcaggcgcaagcttttccgcttcccttcctatggcgagccgctggtatccgccgcacttgcaaggtcttgccatggggatcgccggggcgggaaacagcggaacactgcttgctacgctattcggccctcgccttgcggagcaagtgggctggaacggcgtcatgggactggcgctgattcctttaaccctcgtgttattcagctatttccttatggctaaagaacctccgaatcagccggctcctaaaccgctcaaagactattttgccgttttcaaagaaagggacacttggtatttttgccttctctacagcgtgacattcgggggttttgtcggcctgtccaactttttaagctacttttttgcatcccagtatgccgttccggcggtaagagccggcgaatttgtcacgcttgtcgttgcatccggaagctgcctccgccctgtcggcggattgattgccgataaaatcggcggcgtgcgtttgcttcaattcctctttatcggagtggctctgtgcatgttctcggtcagtatgctcccgtctctaggcgttgtcacagccgcattatttatcggcatgggctgcctcggaatggggaacggcgcgatattccagtttgtaccgcagcgatttcaacaagagatcgggatggtgacggggatcgtcggcgctgcggggggaatcggcggattcttccttccgaatatcctcggaacgctgaagcaaattacaggtacgtattcaagcgggttcctaacctttaccgttattgcatttttagcgctcggtctgcttttgtttgctcaggccggatggaaaaaacagtggaaagccgaggagaaatcaatccgaatttaa

SEQ ID NO: 330 - DNA, 960 bp, Bacillus licheniformis
atgagaaaccaaaaagtcaatcgtacagttttgatcggtgcgggttttgttggaagcagctatgcatttacgttaattaaccaaggtatcacagacgaacttgtgatcattgatttaaataaagacaaagcaatgggcgatgttatggatctcaaccacggtaaagcatttgctccgcatcctgtgaaaacatggtacggcacatatgatgactgcaaagaagctgatattgtctgcgtatgcgccggagcgaaccaaaagccgggtgaaacccgccttgatctagtcgaaaagaacttgaaaatttttaaaggaatcatcggagaagtcatggccagcggttttgacggcatcttcctcgtcgctacaaaccctgtcgacatcttgacttatgcgacttggaaattcagcggccttccaaaagaacgcgtcatcggaagcggcacaacgcttgacactgcccgtttccgctacttgctcagcgagtatttcggtgtcgctgcccacaatgcgcacggctatatcattggtgaacacggagatacggagctgcctgtctggagccatgcgaatatcggcggagttcccgtcagcgacttgctgaaaagaaatgagaaatacaaagcggaagatctagatgaactgtttgacaatgtaaaaaacgccgcttaccacattattgagaaaaaaggcgcgacatactacggagttgccatgagcctcgcacgtattacgaaagcgatttatcgaaatgaagaagcaattttgaccgtgagcgctcatcttgatggtgaatttggagaaaatgatgtttatatcggagttccggcggttgtcggccgatgcggagcgagggaaattgttgagctcgatctgaacgaaaaggaaaaacaacaattcaagcatagcgcaggtgtgttaaaagcaattttaaaaccgcattttgaactgcaggcgtaa

SEQ ID NO: 331 - DNA, 1629 bp, Bacillus licheniformis
atgaaaatgtggcagcagatatacgatccgtttggaaatctgtttatcagcgcttttgccgccatactgccgattcttttctttcttcttgcactgaccgtgttgaagatgaaaggaatcattgcgtcatttttgacgctggcggtcagctttattgtagcggtgttcttctttcacatgccggctgcgaaagctgtctccgccgttttacttggaattgctaacggcctttggccgatcggatatattgtcctgatggctgtatggctttacaaaatttctgtcaaaaccggaaagtttaaagtgatcagagcgagcattgccggaatttcgtccgaccagcggcttcagctattgctgatcgggttcagttttaacgcctttttggaaggtgcggcaggcttcggtgtgccgattgcgatcagcgccgttcttcttgtcgagcttggttttaaacctttgaaagcggcatccctatgtttaatagcgaatgcggcatccggagcctttggagccatcggaattccggttatcacaggagcgcagatgggaggcttaacaccggttgagctttccagaacgctcgctttgatgctgccggtcatcgctttctttgtcccgttcctgctcgttttcatattggacgggtttaaaggaataagggaaacgctgccggctcttctcgtattaagcggaagctatacggcggtgcagactttaacaatgattagtttggggccggagcttgccgacattttggccgctttaatcagcatgggagcgctggcgctgtttttgaaaaagtggcagccgcgccacatatacagggaaaccgggaatgaacatgtgcccgctgaaaaatatcgtgcagcagacattatgaacgcttggtcaccgttttatattttgaccgccgtcattgcggtgtggagcctgcccggttttaaggggctttttcaggaaggcggattcctgaagcaaacgacaattttattcaacatgccttttcttcaccgggaagtgctgaaaacgccgccgatatctccggaacaggcaccgcttgatgctgtgatgaagcttgacttcatttcagcgacgggtacggcgatcctgatcgcggtgatcatcacgattgtgatgagccgaaacatcagtttccgcggaggactttccagtctgaaagagacggtcaaggaactgtggcttcccgttctcaccatttgctttgtgatgggttttgcaaacttggccaattatgccggattgagttcaaccatcggactggcgctcgccaaagcgggggatatctttccgttcgtcagtcccgtattgggctggatcggtgtctttatcacaggttcagtcgtcagcaacaacgcattattcggccacctgcaagcagtcaccggagcgcaaatcgggacaagttcggctttgctgcttgccgcaaataccgcgggaggcgtgatggccaagctgatctcaccgcagtcgattgcgattgcaacagccgcggttaaagagacagggcaggaatcaaagcttttcagccaaaccgttaaatacagcctggttctgcttttcatcatttgcatttggacgtttgcgctatcaaagcttggcatataa

SEQ ID NO: 332 - DNA, 642 bp, Bacillus licheniformis
atgttgaacatcttcctgagctatgtgtttttgggtttgtcattggccgcaccagtcggacctgtgaatgccgcgcagatcgacagaggcatgaaaggcggattctttcatgcctggctgtttggccttggcgctgtaacggcggatgtcctatatatggctttaatctactttggagttgcgcaatttttgacagcgccattcttaaaaacgtttttatggctgtttggtttttttgttttgacctatacggggatcgagagcctggtcaaggcgaaggaagtatcgctgatgagaggtgcgggagagaaagggtcataccgcaaatcttttttgtcggggctggtaatctccctttcaaacccgctgagcatcatgttctggctcggcatttacggaagcattttggcgaaaacggtagaggcgtacgaatcataccagctgctgatctgcagttcaggcattttaatcggactttttctgtgggacttggccatgtcttttctagccgggacattcagaacatttttaagcccgcggatgatccagggaacgacttggctcgcgggcatcagtctgatcgtatttggatgctacttcggctatcagggaattctcgaactgctgcaggcggggcgctga

SEQ ID NO: 333 - DNA, 1335 bp, Bacillus licheniformis
atgaaacgacaagcgaaaaaaggagatttaaaatggtggcagctgtccatgatcggggtcggctgcacaattggaacggggtttttcctcggctcaagcatcgcgattaagaaaagcggcttttccgtattagccgcctttcttcttgctgcccttggcacttttcttgtttttcagcagctggcgaaattaacggcagatcatcctgttgaagggtctttttgttcttacgccagagaggccttcggcaattgggcggggtttagcaatggctgggtctactggtcatcggaaatgctgatcatcgggagccagttgacagcgatttccctgtttacgcgccattggtttaacgagattccgctgtgggtgttcgcctctatttatgcgattctcggattgatcgtcattttcacagggcgcagcagctttgaaaaaacggaaaacatattggccgtgttgaaaacggcggccattttaatgtttatcatcatcgctgtcttggcattgtgcgggctgctgcctggaaaaacgcctgaagtgcagttccctgaccgggttcacgaattgtttcctttcggctttatgggattgtggacggggttgatttatacattttacgcttatggaggaatcgaagtcatgggtctgatggcgattcacttaaaagacccgaaggattcatcaaagtcaggcagcctgatgctcataacccttgctgtggtctacgtcgtatcgatcgggctggccatgctccttgtaccacgcggaacattcaccgaacagaacagcccgtttattacgtcattaaaagactttcatctcgatttgatcatggatattttcaacggcatttttattattgccggtttttcaacgctgaccgcttccctgttcgccgtcaccacactgatgggaacaatggcgaaaaacggggatgcaccggcctgctttgccaaaaaagaaaaggcgaaagtatcgtggccggcactcggcctgacagtgctcgttctcgctgcttccatcgtcttgtcgctcattttgccgaagcagctttatgaacacatgacgacggccgccagcttgatgctgctctataactggatgtttatcctgctttccagcaaaaagctcacaaaaccgaaaatgaaagggaatgtccagattgtcacagcgctcgtcctgattttgttcgccgtttcgggtacgttatttgaaaaaaacagcagacccggtttttttgtgagccttctctttcttgccgttattgctgctgtgacgatgctcatgaaaaaaaagtgggcggatcaggaagagaaaaacgggcagacatga

SEQ ID NO: 334 - DNA, 819 bp, Bacillus licheniformis
atgactttacaagaaaaaatcatgcaggaactgaatgtaaagccttctatcgaaccgaaacaggaaattgaaaaaagggtcggttttttaaaaagctatttgaaaaaaacgggtgccaaaggctttgttttaggcatcagcggaggacaggactccacattggcgggcaggctggcccagctggctgttgaagaattgagggaagaaggcattcaggcggaatttattgcggtccgcttgccttacggtgttcagcaggatgaagatgacgcccagctggcgctgaaatttatccagccggacaagtcttttgcttttgacattgcttcaactgtaggttcatttgctgctcaatatcagtcagtcacgggagaggcgcttgccgattttcacaaaggcaatgtaaaagcgagagtccggatgatcacccaatatgcgatcggaggtcaaaatcagctgctggtaattgggacagatcatgctgcagaagctgttaccggattttttacgaaatacggagacgggggcgcagaccttttgccgcttacaggactgacaaagcgccagggcagaagcctgctggaagagctgggagcgccggagcggctttatacgaagtccccgaccgccgatttgcttgatgaaaaacctcagcaatccgatgaaacagagctcggcctgacatatgataacatcgacgactaccttgaaggaaaagccgtctccagcgaggtggcagaggccatcgaaaaacgctacaaggcatccgagcacaaacgccaagtccctgcttcaatgtttgacgactggtggaaataa

SEQ ID NO: 335 - DNA, 534 bp, Bacillus licheniformis
atgaatgccgcaataagagataagaatattgtgctgatcgggtttatgggcgtcggaaaaacaaccatcggccagcttgtgtcaaagaaattaggccgtgactttatcgatatcgaccacgagatcgaaaaagactttcaaatgaccattccggagatgtttcagcaaaaaggggaagcgtttttcagacagacggaaaaagaatatatttttcagatgtgcgaacatacaatgggcaacatcgtatccttagggggcggcgcttttcagcaggaggaaatcagaaagaagtgcctcgaacactgctttgtcatctttcttgatttaagatgggagaattggaagcagcggatggatctcttgattgaaaacaggccggttcttcataaccgcacaattgaagaaatgaaacagctgttcaatgaaagaaagagcatttatgcatttcaccatttaaaagtggaaaccgataaccggtctgccgaagaaacggccgactatattgtggagatgctaaagcttggtcaatcttaa

SEQ ID NO: 336 - DNA, 771 bp, Bacillus licheniformis
atgaaacagcgaattgaagaagaactgaaaaacattgaagcaacatatggcgtcaaaatcctctatgccgttgaatctggcagcagggcatggggccttccttcacaggacagcgattacgacgtcagatttatttatgtccatcaaaaagactggtatctgtcaattgatgcaaagcgcgatgtgattgaactgccgattgacgattctctcgatatcagcggctgggagctgacaaaagcgttaaggctgttccggaaatcaaatcctccgcttctcgaatggctctcttcgggaaccgtttattatgaagcctattcgctggcagaaaaaatgaggcggctcaaaagccgcgccttttctccagtctcctgtatgtaccattatctcaatatggcgtcgggaaatttccgagactacctgacgcgtgaagaagtgaaaatcaaaaaatatttttatgtactccgcccgattctggcttgccagtggatcgaaagccgccggacggttcctccgattgaatttcaggttttgcttgacgaacttacggaagacggaccgctgaaaacagaaatccatcagctgcttgaaaggaaaaagaaaggggaggagttcaatcttgaacctcaaaaccccattctccacgaatttattgagcgtgaacttgagcggcttcagacagttgccaaagcatataaaacggatcatgaagatctgacgcaggagcttgaccgtctgtttagagaaacgctagacgaggtgtgggcataa

SEQ ID NO: 337 - DNA, 918 bp, Bacillus licheniformis
atggaagtgataacaagagactttttcctattcttatctaaaagcagcatcctgaatcgcctggcgagaaattgggggagttccgtcgcgaccggaaaaattatcggaggaaaagattttgaagcttcaattccgattattaaggggcttaacgaacaagggctgactgtgacagtcgatcacttgggcgaatttgtgaacagcagggaagtcgcaagggagcgcacgcaggaatgcattcgggccattcagctgattgctcaggaacagcttaattcacatgtttcattaaagatgacgtcattgggactcgatattgaccttgaccttgtcagggataatatgaacagtattctggaatgtgccgagcagcaccaagtgatggtcacaatcgatatggaggatgaagtgcgctgccaaaagacgcttgacctctttaaggagttcaggcagaaatacgagtatgtcagcaccgtcctgcaggcttatttgtaccggaccgaacaggatttggaggagctcaattcattaaatccgtttttccgtcttgtgaagggagcttataaagaatcgccgaaagtggctttccctgacaaaaaggatgtggatgagaattacaaaaagctcattaaaaagcagctgctgagcggccattacacagctatcgcaactcatgacgacaagatgattgatttcgccaaagaaattgcgaatgagcatcaaatcggcaaagaccgcttcgaatttcaaatgctgtacgggatgcgcagcaaaactcagctggaactggtgaaggaaggctacaatatgcgcgtgtatcttccttacggagacgactggtacggatactttatgagacggcttgctgagcggcctgccaacatcgcttttgcgtttaaaggcatgacgaagaaataa

SEQ ID NO: 338 - DNA, 1551 bp, Bacillus licheniformis
atgacaacaccttacaaacacgaaccatttacaaatttcgggatcgaagaaaaccggaaggcattcgaaaaagctctggaaacggtaaataacgaatggctgggtcagtcctatcctcttgttatcgatggagaaaggtatgaaacggaaaacaagatcgtatcgatcaaccctgcaaacaaagaagaagttgtaggcacggtatccaaggctactcaggatcatgcggaaaaggccattcaggcggctgcgaaagcgtttgaaacttggagatacacagatcctgaagaaagagcggctgttttattccgcgcggttgccaaagtgcgccgcaaaaagcatgagttctctgcgcttttagtcaaagaagcaggaaaaccttggaatgaagcggatgcggatacggcagaagcgatcgattttatggaatactatgcgcggcaaatgattgagcttgcgaaaggaaagccggttaacagccgtgaaggcgaacgaaatcaatatgtgtacacaccgactggtgttacggttgttattccgccttggaacttcctgttcgcgatcatggccggaacgacagttgcgccgatcgtgacaggaaacacagttgtactgaagcctgcaagcgcagcgcctgtcattgccgcaaagtttgttgaagtgcttgaagaaagcggacttccaaaaggagtagtcaacttcgtccctggaagcggagctgaagtcggggattatttggtggaccatccgaaaacaagcatcattacgtttaccggttcaagggaagtcggaacgcgcatttttgagcgtgcagcgaaggttcagcctggtcagacccacttaaaacaagtgatcgctgagatgggcggaaaagatacggtcgtcgttgatgaagactgtgatattgaattggctgcacaatcaattttcacatctgccttcggctttgcaggccaaaaatgttcagcaggttcacgggctgtcgtgcatgaaaaggtatatgacgaagtattgaagcgcgtgattgaaattacggagtccaagaaagtcggagagcccgacagcgcggacgtttacatgggacctgtcatcgatcaggcatcctttaacaaaatcatggactatatcgaaatcggaaaagaagaaggccgcttagtcagcggaggaaaaggcgatgattcaaaaggctacttcatcgaaccgacgatctttgccgatttagatccgaaagcccggttaatgcaggaagaaattttcggacctgttgttgctttctcaaaagtaagcagctttgatgaggcgctggaagttgccaacaacaccgaatacggcctgacaggcgcggtcattactaaaaaccgcgatcatatcaacagggcaaaacaagaattccatgtcggaaatctgtatttcaaccgcaactgtacaggggcgatcgtcggctaccatccgtttggcggtttcaaaatgtcgggaaccgactctaaagcgggcggacctgattatcttgcgcttcacatgcaggcgaaaacgatcagcgaaatgttttaa

SEQ ID NO: 339 - DNA, 1449 bp, Bacillus licheniformis
ttgatcatttccatcgtgatttacatggtagggatgctttatattgggtattacgcttacaaacggacagcaaacctctcagactatatgcttggcggacgaacgctcgggcctgctgtcacggcgctcagcgccggcgcatcagacatgagcggctggcttttgatggggctgccgggcgccatgtttgcaacaggcctgagcggttcgtggattgtcatcggactcgtactcggcgcttgggcgaactggatatttgtagcgccgcgtctaaggtcatacaccgaagtagcgggcaattcaatcactatccctgcatttttagaaaaccgttttcatgacaaatcaaagatcctgcgaatattttccggagtcgtcattattaccttttttacgttttatgtatcatctggaatggtttccgggggcgttttatttaacagcatatttaatttggattaccatgcagggctgtggatcatttcaggcgttgtcgtggcctacacgcttttcggcgggtttttggcagtcagctggacggactttgtccaaggcatcattatgtttgtcgcgttaattcttgttccgattgtgacggtcattcagacgggaggacctggagaagccttcagcgagatccagtcgatcgatccaaacctcctcaatatttttaaaggtacgagcgtcctcggcatcatctccttgttctcatggggcctcggctattttggacagcctcatattatcgtgcgctttatggcgatatcctccatcaaggaaacgaagaaagcgcgccggatcggcatgggttggatgatcttttcaagtgcgggcgcactgctgaccggattgctcggtattgcgtattactcgaagaacgggcttcacttggatgatccggagaccatcttcattcaattgggtaacatcctgtttcaccctctaatcacaggatttttaatctcggcgattttggcagcggttatgagtacaatttcctcccagctgcttgtgacatcaagttctctaactgaagatttatacaaaacactatttaagcgctctgcatctgataaagaactcgtctttttcggacggctttcggttttggcggtttccattgtcggactctgtctcgcctggacaaaaaacaatacgattctcggtcttgtcagctatgcttgggcgggtttcggagcgtcgttcggccccgtggtcatcttaagtttgttttggaagaggatgacaaaatggggggcgcttgccggaatggttgccggagcgcttaccgtcatcatttgggcggaagccgggctttccgatgttctttatgaaatgattccgggctttgccgccagcttgctgtttgtgtttgtcgtcagtctattgacgtcaaaaccggagcagcaggtgcttgatgaattcgagcaatacaaacaaacgctgtaa

SEQ ID NO: 340 - DNA, 1245 bp, Bacillus licheniformis
atggaagagctattagaacaagttgtttctctttcaaacattaatgagatcattgactttatcagcggggagctgaaaaagccggtcatactggaaagcgcagattttttcttattagcttacaactcctattatattaaccattttgatgcagcaaaccagcaaacgattttctccaaaaaatgtccgctgccgatctttgaaaagttcgtcgaagaaggcattattgatcaattgaaaacgattccgactccttttcgggtaaaacagattgaagaaatcggcttaaaccagcgggttgtcgtcagcgccaagcataaagacgaaataatgggctatatctgggtgcaggagattgaagacaacctgtctgatgaagagcttgatttcttatatcaagcttcctttcatgtcgggaagatcatttataagaaaaaacgcctcaaacaagaaaaagaagaacaggcggaagagctttacaaaaaggcaattaacgatcagtttcaaacggaaaaagagctgaaggccgccgccgataaagcgaacgtcgtcctgccggccgtgtttaccgtcatggtgcttcaagtcgttgacggggaggatgaactgctcgaagatctaaaggaaacgatccggtcttatttaaacctgaaagacaacatcagtcacgtactggaggatcattcgaatatcgcaatcattgtcggcagtgtgtcgcgcaagcgttccgcgctggccgctgcctcagaactgatcaaccgtctgttgacccatctgcgctcgcaaatgctgccccttattttgatcggggtcggcaatgagtacagcagcctgctctccctcggcaaaagctacagagaggcgctccaagtgacgaaagcagcggagatcacgggaagccaagaacacattccctatgaatatcaaaagctcgggcttttcaaatatcttgaccaaatcgccgcaaaaaacgatcatctgcaatatgtaaacccggaccttcagctgctgaaagaaaaagataaagaaagccacaccgaatttttaagaacgcttgaaatctatctcgtcaacaattgcaaggtcaagccatccgcagaacagctgtttatccaccaaaacacgctcaactaccgaattaaacaaatattggaaatgacatcgattgatctcaatgattttaatacaagatgtcagttgtttatcgatttaatgctgatgaagaaagcaggctacaaatcgtaa

SEQ ID NO: 341 - DNA, 846 bp, Bacillus licheniformis
atgtttcgcacattcattttaatgttgtttacgtttttcttttttcatcttcatgcatccggcaatctgacaaaatatattaatatgaaatacgcttacctttcatacatcgctattattcttctggccattttgacagctgtgcaattctacatttatatgaaaagctcggatgaaaaaggatgtaaccatgaatgcggatgcggccatgaccacgatcatgaaaaagataagccttttctgcaaagaatgttcatttatttcgtgttcttcttccctttatgcaccggactttttctgccggcagcgacgcttgattccaatatcgtcaagtcgaagggcttctcgttcaaagcgatcgaacagccggagcattatgcccaaacccagtacctgcgccccgacacaagcatctactacggccaggatgggtatgatgaattgatgaataaagcgctgaaaaagtataaagaaaaacagcatattacattaaaagatgatgattttttgaagggcatggaaacgatctatcattatccgggagaattccttgaccgaacgctcgaattcgacggctttgcttttaaaggggaagcgatcagtgacaaacagctgtttgtcctccgcttcggcatcattcattgcatcgccgactccggcgtctatggcatgctggtcgagttccctgaaaatatggatattaaagacgaccagtggcttcatgtaaaaggaacgctgtcttccgaatactatcagcctttcaaatctacaattcccgtgctgaaagtgaaggattggtctgcaataaaagagccgaaagatccttacgtttatcggacatattaa

SEQ ID NO: 342 - DNA, 912 bp, Bacillus licheniformis
atggatttgcgcggaggtttttttgtggcttcacaatcctttctgcagctgaactcaatatttatcagtatattaatagaagcgattccgttcgtcttgatcggggtttttatatcaggtttgattcaaatgtttgtgacggaggagatgatggcgaaaatcattccgaaaaaccgatttctcgccgttttgtcaggaacatttgccggggtattgtttccggcttgcgagtgcggcatcgttccgattgcccgcaggctgcttttaaagggagtgccgcttcatgcggcggtcgccttcatgctgacggccccgatcatcaatccgattgtattattctcgacattcatcgctttcggaaacaaatgggatgtcgtgttctaccggggcgggttggcgattgcggtgtctctcattgccgggctgatcatctcttatcaatttaaagggaatcagctgatcgaaaacgggacgcacggacatcaccaccatgtccatgagagccagtctttcctgcaaaagctcggcgggacgctccgccatgcagttgacgagtttttctcagtcggaaaatatttgatcatcggcgcatttgtcgcagcagcgatgcagacgtatattaaaacatcgactcttttggcgatcgggcagaatgatgtatcttcctccctcgttatgatggggctgtcatttgtgctgtccctttgttcagaggtcgacgcttttatcgcttcttctttcagcagtacgttttccctcggctccctcatcgcctttctcgtattcggagcgatggtggacatcaaaaatctgctgatgatgctcggcatcttcaaaaagcgctttgtgtttgtcttaatcccctacatcgccgttattgtcttagccggatcactgttggtaaaggggtga

SEQ ID NO: 343 - DNA, 957 bp, Bacillus licheniformis
atgcagcagccttatgatatgccgcttgaacagctttatcagtataaacctgaacggacggcaccggccgattttaaagagttctggaagggttcattggaggaattggcaaatgaaaaagcgggaccgcagcttgaaccgcatgaatatccggctgacggggtaaaagtctactggcttacatacagaagcatcgggggagcgcgaattaaaggctggtacgcagtacccgaccgccaagggcctcatcctgcgatcgtcaaataccacggctataacgcaagctatgacggagacattcacgatattgtcaattgggctcttcacggctatgcggcattcggtatgctggtccgcggacagaacagcagtgaagatacagagatctctcatcacggacatgtacccggctggatgacaaaaggaatcctcgatccgaaaacatattactacagaggggtctatttagatgccgtacgagcagtcgaagtggtcagcggttttgctgaagtcgatgaaaagcggatcggggtgatcggggcaagccaaggaggcgggctggccgtcgcggtttcggcgctgtccgatattccaaaagcagccgtgtcagaatacccttatttaagcaattttcaacgagcgatcgatacagcgatcgaccagccatatctcgaaatcaactcctttttcagaagaaacaccagtccggatattgagcaggcggccatgcataccctgtcttatttcgatgtcatgaaccttgcccaattggtcaaagcgaccgtactcatgtcgatcggactggttgacaccatcactccgccatccaccgtctttgcggcttacaatcacttggaaacggataaagaaataaaagtgtaccgttattttggacacgaatacatcccgccgttccaaaccgaaaagctggcgtttctgagaaagcatctgaaataa

SEQ ID NO: 344 - DNA, 423 bp, Bacillus licheniformis
gtgaatacggaacaaaccatagaagtgatgaatcagaactggacggatatttactaccatctgcacatgaaacatgatgatcaattgtctcaccaagcggttcggatgcttcagcatatcgaaaaaaaccgctttgtgaccattggccatttagcaagattgttggatgtctctcataatacggcatcagaacatgtgaaaagactaatacaaaaagggcttgtacagaaaaacagggacagcagcgatgaacgcaaagtctacgtcacgttaacgcctgaaggtgaagaagcagtgaaacggcatacgagacttaatccgaaaaaactgcaaaaggtgctggagcaattaaatgaggaagaagtcgaaatggttaaaacagcattttccttgttaagccgggaggcaaaatcatgtttttaa

SEQ ID NO: 345 - DNA, 306 bp, Bacillus licheniformis
ttgattgccattataaccgagattgcacgaaaatcgcctgaaatgggcggaatgattgcggctttgccgcttgtcagtctgctgagtttattttggctgagtgtacaaggggaatctttaaagcatttaagccaatttgcgaaaggcgtgctatgggggtttccagccacagcggttcttcttttgatcgtggttttgagtttaaaagcatcattcccggttatcatttctgttgtatttggaatatgcggatggggcgggtgtttaatgctgcaaaaggctctcatccatgcaatattcgggtga

SEQ ID NO: 346 - DNA, 441 bp, Bacillus licheniformis
ttgatttcacatgctccgcatcctgaccggctgccggcacaccctgcttatattgaacccgttaactgtcaaatatacagcggaagcgcatctcaaacgggattgatttacctgtctgacaaagcaggaaaccccgttgaaaaatccggccgagaaggtctgtatatctctttggtcaaccaggaagcgcatcgtttaaagggctatttatattactttcaaaatggagaatatcaagagttcatgatcagtcaaactaaagctcaagcattctcctacgaactcgctcctgaaaccgtccagacttatccgataaacttaaaaatactcgggagcaattatttccgatttctgtcgacatccatcccgccggacggagcataccgggacgctccttttccggcgaggatgatttactactccaggctttatacgtggtag

SEQ ID NO: 347 - DNA, 684 bp, Bacillus licheniformis
ttgggctctattcaatgggagtatatttttaatgcagaattggctgcgaaatcgtttccttatgtgatgcaaggcatatggaatacgcttttcatttcttttgcgagcatgtttgccggtttaattctcggttttttcatcgcgcttgggcgcatgtccgggctcgctttgcttcgttggccggcaagaatctatatctcgtttatgagaggcgttccgatccttgtcatactatttatcctttatttcggttttccttatatcggaatccaatttacggctttggctgctgccttaatcggcttcagcatcaacagcgccgcatacattgccgagattatccgctcggccctgtcgtccgttgacagagggcagtgggacgctgcaaaatcggtcggattctcctactggcagacgatgcgccacgtgattgtccctcaatcggttaggattgcgctcccgcctcttgcgaacgtgatgcttgatctcgttaaagcgtcttccctggccgccatgatcaccgtgcctgaattgtttcagcaggcaaaaatcgtcggcggacgggaattcgactatatgacgatgtacattttagttgccttgatttactgggccatttgctcggggatcgctttgctccaggatttcctggaaaagcggacagaggtttatatcaaaaaataa

SEQ ID NO: 348 - DNA, 876 bp, Bacillus licheniformis
gtgaataaattgcatacgtataagcgcattacattgttgataactgtgttggcgcttgctcttataacagctgcatgcagcacagctcaaaataaggctgaaaacaaaaaaacggcctgggatgagataaaggaaaaagggaagatcgtggtagcgacttcaggaaccctttaccccacttcatatcatgacactgattccggcaaggacaagctgaccggctacgaagttgaagtcatccgtgaagcggctgaacggctcgacctggatgtcgaatttaaagaaatgggctttgacggcatgctgactgcggtggggagcggacaagtagacgctgccgccaacgatattacgatgacagacgaccgcaaagaaaagtttttgttctctacgccttataaatattcattcggaacggctatcgtccgcaaaaaagacttatcaggcatccacacgcttgaggacttaaaaggaaagaaagccgctggtgcagctacgacagtttacatggatatcgcacgcaaatacggagcagaggaagtcatttacgacaacgcgacaaatgatcaatttttaaaggatgtagcgaatggaagaaccgacgtcatcttaaacgactactaccttcaaaagctcgcgctcgccgcaatgcctgatctggatctgacaattcatcccgatcttaaatactatccgcatcagcaaggcatgatcatgaaaaaaggaaacactgaacttaaaaaacaattcgacaaaacgattgatgaaatgctgaaggacggcacaatcaaaaagatttcgaaaaagtttttcggcggtgccgatgtttcgaaaaagcaggatatcgactatatcgatgtcgatgtgaataaatag

SEQ ID NO: 349 - DNA, 552 bp, Bacillus licheniformis
atgaaaaatattttaatcatcaacgggcatgaagcctatccccatgcaagaggacagctcaatcacactatttttacagcgatggcggacaagctgagcgaaaaatatgaagtgaaaaaaacagtggtggcagacggctatcaaatcccggaggaacacgagaaattcaagtgggctgatgccgttatttatcagacgcctgtttactggttcagcgttcctgctttatttaaaaaatatattgatgaaatttatgagtacgggcttttttatcaagggtctgaagactacggaagaggcggactgtttaccgataaaaagtatatgttttcaaccacatggaacgcgccgaaggatgtattctccaaggcggggacattcttcgaaggtaaaagccttgatgaagcgctgtttcatttgcacaaaatgcaggaattcatcggcatgaagcctttaaaaacattctctgtccatgatgtaatcagcaatccgcaagtggatcaatatttagctgatctggacgcccatttaaaagaagtattttcgatttaa

SEQ ID NO: 350 - DNA, 726 bp, Bacillus licheniformis
atgtttttaaaaaagctgactttacttcgggaaggagttccttcttatgcaaaatatccattttcaattcctgctattcaacatttaaaagaactgacgtttcaaaaaaacgtaacattttttgtcggggaaaacggatcgggcaaatcgacgctgcttgaagcaatcgcagataaatgcgaatttaacacagccggcgggggaagaaataacacatatgaagtgtacggctccggatcggctcttggagactatatcagattgtcgtggcttcccaaagtaacaaacggcttttttctgcgcgctgaatctttctatcattttgccactcatattgatgaagtggatatcacgggatttcgaagctacggaggcagatctcttcacgagcagtcgcacggcgaatcttttttatcgcttttcaagcatcgttttaaagaaaaggggatttatcttctagatgagcctgaagcggccttatctccggcaagacagctggcattcttgaaaatcattcatgatttgacgaaatccagccaggctcagtttatcatcgcttcccactcccccattttattagggtatccggaagccgaaatctttagttttgatggtgaacaaatcgctgaagtgaactatgaggatacggatcattacactttaaccaagtattttcttcagcaccgggaaaagcttttggcggagctgtttttagatgacgtttga

SEQ ID NO: 351 - DNA, 1437 bp, Bacillus licheniformis
atgattcatcagcgactacgcccatttccagatcatttcctatggggatcagcatctgcagcctaccagatcgaaggagcctggaatgaagacggcaaggggctttcggtttgggatgtgttcacaaagattcccggaaaaacgtttaaaggaagcaatggagacattgcggtcgaccattaccaccgttttaaagaagatgttgctttaatggctgagatggggttaaaagcataccgcttttcagtcagctggccgaggatttttccgcagggcaggggagaagccaatgaatcgggtttgagattttacgatgacttgattaatgagctccttgctcatgatattgaacctgttttgacgctttatcattgggatcttccccaggctttaatggatgaatacggcggctttgaatccagaagaattatagaggatttcaatgcgtattgcgttacgctctataagcggtatggaggcagggttaaatattgggtgtcccttaacgagcaaaattacaactttaatcacggctttatcacagcgatgcatcccccgggtgtgaaggatagaaaacgcttctatgaggctaaccatattgcatttctagcgaatgcaaaggcaatcgattcttttcgccggtatgttcccgatggaaaaatcggaccgagttttgcttattcgcctgcatatcccctctccagccgtccggatgatatcctcgccttcgagaatgccgaggaatttacaaactattggtggcttgatatgtactgccggggaacatatccggacatccctttaaagtatctgaaggaaaaaggctgggcgccgacaattgaagatggggatatggagcttttagcaaaaggaaaacccgattttgtcggtgtgaattattatcaaaccatcacatatgaaatgaatcctcttgacggggtatcggaaggaaagatgaatacgaccggccaaaagggaagcaatcaggaaacaggcatgccgggtttatacaaaacaaaaaggaaccctcatcttgagacatcgaattgggattgggccattgacccgatcggtctaagaatcggacttcgcaggatttccagccgctatgggcttccgcttttcataacggaaaacgggctgggggaattcgataaggttgaaaatgacggcacgattcatgatgactacagaattgcctacttgcgtgcgcaccttgaacaatgcagacaggctttaaacgacggagtcgatttaatcggctactgcagctggtcatttacagatttattgagctggctgaacggctaccagaaaagatacggtttcgtttatattaaccgtgatgaagagaatgtaaaggacttgaagagaattaaaaaagacagcttttactggtaccaaaacgtcattcagacaaacggggaagagctttag

SEQ ID NO: 352 - DNA, 399 bp, Bacillus licheniformis
ttgatcaaaaagtgggaagcacaagaaatgacgatgtcataccatcagtttaccgtttatcagaaaggcggaaagccgcccgttatggattggacagacgaggatattaaaagaggatatacaacgggagagcacgcggtctcgtttgaagctctcgaaaacacggcatcttcagtagaagtccgtttgaatgcccaaaaacaggtgccctccttcaacaggcgcgtcaccgttcctttcgaagtgctttatgacggggtagaaattgcaagcgtcctatccaagaaattgacatgcgatattccgcaaggcgcctatcagctgacatgctatacaataatgcctgatcacagcggcactgcacagatcacctatcttctcgattttaaacaggcttga

SEQ ID NO: 353 - DNA, 447 bp, Bacillus licheniformis
atggacaagattaaatctttgctgatcaccttgctcgccgtcgccgtcgtgatcatcggtattgtatctggcgactttttcacttcagaacaccagccttcgggccggcaaaacggctcaaactacgatgaagtgctgatttttccttcggaccgctatcctgaaacaggcgcacacattcgaaaggctatcaaaaaagggcactccgaaatctgtacgatcgacagggacggagccgccgaacgccgaaaggattcattgaaagatgttccttccaaatcaggctatgaccgcgacgagtggccgatggccatgtgcgaagaaggcggaacaggtgcttctgtcgagtatatcagcccgtctgataaccgtggagcaggatcttgggtgggcaatcaggtaagcgattatccggacgggacgaaagtacttttcaagattaattaa

SEQ ID NO: 354 - DNA, 804 bp, Bacillus licheniformis
gtgaaaacattgataagatggctgtttgaccgcccgctcaaaaaaggaaccgtcttggaggggagatatcgaatcaaccgtgtgctcgggatgggcaactacggcatcacatatcttgccgaagaacttggaagatccggtttccgcgtcatcaagcagcagagaaaaacaaaagcatggacatcagccggccggcggtctttcaaccgcgaggctgaaattttgcgggaattggatctgcctgccgcgccccgtctatatgaggtgcttcgagcggccggcgagcggtttatcgtaatggagtatattgaaggaaaaacgtttgaagatttgctcttttatgatgggcgtgtctttgatgaacagcaaacgatcagcatattgaaggaggtgcttcacagcgtttcacttcttcacagccgggggattattcaccgggacttgaggatcccaaatttgattgtgaatcgaggaacgatccgcatcatagatttcggactggcatgccgcctgactgagagagaacgcgttgataaccggcacccggaaaaaaagctgatgcgtgcagtttcagtcaaaagtgacttttatgcgttagggcattttgcattgtttctcctgtactccggttttaccccgtccgacgaggaagaaaaatgctgggaagaagagctcagcatatcgtctgggcttaaatctgttctgcggaagatgctgcagattgatctcccgtatgagcgtgcagaagacattatcggcgatttgatttcctgtacggcggaaaagaagaagctgccgttttaa

SEQ ID NO: 355 - DNA, 1683 bp, Bacillus licheniformis
ttggggacgaaaattaatcttctcgtgttagccgttattctgatcttttcgtcagcactcgggattttcattatcaaagagctttcaaaagagttagaacagatggcgacagagaaagccaaaagcgatttgaaattgagctaccgttatttgaatgaatctcttgaaggtgattgggaagtcaaagaagacaggctctacaaaggttcgacccttatcaacggaaatgaagaactcgtcgaccaaatcggcaatgatacgaaagacactgtcaccatctttcaatatgacacgcgcgtatctacaaatgtgacggtagacggaaaacgcgctgtcggaacgaaagtgtcttcggaggtagcaaatgcggttttaaaagaaggaaaaaacttttatggaaaagcagatgtagcgggaaaaacatatcaaacggcatatatgccgatcaaagacaagagcggtgaagttatcggcatcttttatacaggggccgaccaggatatgatcacaagcactcttcaatcgttcctgaaaatttttgctatcgttctgactgcttcaatcatcatctccattttgcttgtcctcattttcaccaaaaggataggcggaaggctcagaatgctgactcatgcttttgaacaggcgggcagcggcaatttgacaaccgagatccaggatgattcgacagatgaactgggcgacttgtcacatcatttcaatcaaatgaatgacagcctaaaccggctgatgcaaaaaatttcacagtcgtcgcacagtgtagctgccgcttctgatcagctgacatctggagctgaagaaacaagcctcgcttctgagaaaatcaccgaagccgtccagcatatcgcaagttcatcggaaatgcagacatcggggatagcaggcagcaaacaagccgttgaacaagtttccgccgatattcaaaacatatcagaaaacgctgcgatcctgaatgaaaagagccaatacgcccgcaaaaaagcaaaacagggggcaaaagatatctccgaaacgatgcggcaaattcacacgatgcatcaatcggtccatgaaagcggagaaatcattgaaatgcttaaaatacaagatcatatgaaatcggcagcatttcaaaagcgatcacggagattgccgatcaaaccaacctgctcgctttgaacgcttcaatagaagctgcaagagcaggagaacacggaaaaggattcgccgtcgttgcggaagaagttcgccgtcttgccgaacagtcgcagcaatcagccaatcagatctcccacctcatttcagggattcaatcagaaatcgcaaccacaaccgattcaatcatgacagtgaaaacggaagcggtcaacggcgtcaaaatgatcgaaaagaacaaaaggacatttgaatctattgacggcttaatggaagagttcagcgtaagaatttccgacttgtcttccgacgcccggcatatatcgcaaagcattcaaaacatcacaacatcatttacagcaatctcaaaagaagttcaggaaacatctgattattcacaacaagtcgcaggtctgacagaagagcagtttgcggctatggaagaagtcaccgcctctgcaaatgaactctccaaactggctgaagatttgcatcagctcatcggtgaagtcaaaatgaaatagcagg

SEQ ID NO: 356 - DNA, 741 bp, Bacillus licheniformis
atgaaagtctacgaagcggaaaccctaatttcagctatgaagcaaagatctgatgaatataaaaatttgagagaacagctcgtcagcttaaaaaaagcgttaaacagcgtcgcagaacttgatgagtttcaaggaaaaggcgccgatgccattaaagcgttttacagagacctatcaggagtcgtagacggctggctggatttaaccgatatgcagattcagtttctgaatggtgtatcttctgctgccgaaaatgccggactttcagaggatacgttcgttgatgttcaatttcttgaacaggagcttgcaaatgtccacattcactctcaaaacatggtctccgcacagcagcaagagctgtcgaatattttaggacagatagatgatttaatatcgctacagccgttctcatccgatgaaatcaaacagcagcttgacgctgcaaaccaaaacagaaaagacacaatcaaggctgtcgaagatcttgatggactgctcaaaagagaatactcggcctctgaacatattcagcaaatgatccagaccgactattccgccttaatcgacgcaacaggaaaagggaaaaatgcgtctccgttaaactacaattcacatatctatcaaaacagtgaagtctataaaatgaaacatcgcatgcatcaagaggcaagaagctacatcgcaaataaacaaaaacagtatgaaacaggaaaagccgaaaaagcagaggaactttag

SEQ ID NO: 357 - DNA, 2055 bp, Bacillus licheniformis
ttgaatgaagaaggttaccggcttggaattgatattggaggaacttttaccgatcttacattgttaaatccggcggacggaagcatgaccgcagttaaaacgccgaccgttcccgaagatccggcccgaggaatcatcaacggcttggctctcttgaaaactcggggtgtccagccttcagaaattcatcactttgtacacggcatgacaatcggtttgaacacattattacaacgcaaaggggctgatattgctttattcgtaaccgaaggtttccgtgatattctttcgcttcagcgtctccggcttccggtaccctacgattttagatctagaatgccggagcccctcattcctcggaaaaacgtgtttcccattcaagaaagaatgctttatgacggctctgaaaagctgccgcttcatatggaagatatcgatgaggcggttggacaagctttaagaaaaggcttaaaaggaatcgttgtttcttttttgcacagctatcggaatccgctccatgaacgccaggctgccgaacggatcaggcaaatagcgcccgagcttgaggtggcaacgtctgcggagctttggccgcaaatgagagaatacgaacgaacggttatgtccgtcgcgaatctatacatcaaaccgaatatccatcactactttggaacgctgaaagagaggcttgtccaggaaggaatatcggcgcagccgtttatcacccagtccaacggaggactgatggacattgaatcggctgccgaggcacctgtcaaaacgcttttttccggaccggcagcgggggtcataggatccatcagaacggcggaagccgccggcgaggccaatatcatcacctttgatgtcggaggaaccagcgcagatatttcgattgttgaaaaaggagagccgacctttacccagtcaaatcaaatctcgggatttccgattgcgattccatctgtagcaatgtattcgatcggtgccggcggaggatcggtggcatggattgacagcggcggtctcttgaaagtagggccggagtcagttggctctgatccggggccggcctgttacggaaaaggaacaaaggccgcacttacagatgcgtttcttatatgtcattatttaaacccaaacaggtttgcagcaggaaatatgaaactgtaccgggaaagagccgaaaaagcgctcctcccggttgccgagtatttaggcacagatgtggagcaagccgcggataagatgattcaagttgcgcttgccaatatgtacacggaactaagcaatgtcatggagcaacacgggtttgacccgcgtgaattcagccttatggcttttggaggcgcaggcccggttactgctaattttttggctgaggaaattcaggccaaaaatgtgctgatcccgccgcatccgggaactctatcggctttgggcgcactgacggctgattttatctacgatgctgtatgttcaagacaggtgctgcttgagcaaataaaaacggctgagttaaaagtggagtttatgaggctgcaagaacaggcggaaacatggctgcggaaacaacgggcggacatggtgactgaagcctctcttctttacttgcttgatgcccgttataaaggtcaggcgtatgaaattgagctccctgtttcaccggaatggctggaaggcgaaagtacgagtgaaatcgcagactcctttcatctcttacatgggaagcaatatggacacagcgatgggaaagcaagcattgaattgatgaatatgcgcgtccgcattataggcaagacgccgaaaccgccaggcggaaaaggatgtcaaagtaatctgcccgaagctgaacctgtcagccaaagaaagatcatcatgaaaggcggtacatatcaagcctccgtataccgccgtccagatttaaggagcgggcagagaatagatgggccggccattgttgagcaggacgatacaacgacgctgattttgccaaattggagcgggaaaaccgatcatgccggaaatttgatcattgaacggaaggagagctga

SEQ ID NO: 358 - DNA, 1995 bp, Bacillus licheniformis
atgcgcacagatcctgcccggctggaaatgatgagaagctactttaacgcgatagccgcgggaatggggcacgttattgaacggacgtcctttaccacatttgtaaaagaatcggctgatttcgctactgcgcttgcgacgccggaaggggagtttttcgtttatccgaaaacggtcggcgtcacgatttttttagggctttcattaaaacgggtcatcgaagaaagcggcccatttgaaccgggagatattatcctcacaaacgatccttatacaacggacggattggcgacccacttgcctgatattcatgtggtgaagccgattttcttggagggcgagataatcagttacgcgtggtgctttgtccattgcagcgatgtcggcggccttgtcccggcaagcatttcgccgaccgcgacagacatccatcaggaaggcctgagaataccgccggcaaggatttacaaaaaggggagagaaaatcgcgatatattgaaggttttgcgggcaaacagcagggttcccgacttaaatgaaggggatattcatgcgatggtggccgcggtcaatacggcggagaatcgattgacagaaatggtcggaaagtttggaaaagaagcggtccaacaaggaatggatgatttgctcgaacaagccgcgatgagagccggacgggtaatcagcaggattccggaaggttcatacagtttttcagattatcttgatgacgatatggtttctgacgttccgatccgcttggctgttacggcaaacgtctcgggaggggagatcacattggacttttcagactgtgatcctcaggtgaagaccgcatttaaccttgtcaccaatggaagcaaacattcatttctatatcagggcctgatcaactatatcataagtgaagacccgtatattccgattaacggggggctgacacggccgatccaagttatcgctccaaagggtacgctggttcatccggaatatcctgcggcggtcggcattcgtcattcgatcacgatgagactttataatgctgtactgggcgcattggcaaaggcgcttccgaaagccgtgcctgcagcaggcgccggtcagtcagcgattgtcgtactgtcggttcccgatgaatcaactggcagcaggaagatgtcggtggtcgaaccgatgggaggcggaggaggcggccagcatgacatggacggagcagatggaattgaccatgcctccggatttttgaaaaatacgccgattgaaagccttgaacagcacatcgacatccatgttcgccgctatgaattgatcaaaaatacagccggagccggttttcacaggggaggccatgcaatcgggctggagtttgaagcggcggcaccagaatcaattgtgaccgcaagagggatggagaggatgcgttttcatccgtgggggctcgccgggggaacggcaggagcgctcgggcgggtgcgcctttatcctgatcagcctcaggagaaaacgatgtcgaagatcgatgttctaaagctcaataaaggggatgttatcagcattcattcaccaggcggcggaggctggggaaatcccttccgccgggaagctgaatcgattttaggagaagttgaagcgggcttgctgagcccggaagcggcatatcatcaatacggcgttgctgtaaaagaaaacggcgctggctccttcattattgatctggaagaaacagctgaaatcagaaaaaagaaagcaggcgaacatcggaaacaatgggatttcggaatcgccagagaagaatacgaacggtgctggacagaagaagccagcagcacattggcccggcttctgcgacagcttccggctcatcaaaggtcacatgttaaacatttagtccatcgttatttctcaaaagaacataacggtccgatcagtaaaagcgaagttgcggccgctgtggaaaaactggctggaaaaaataacacgggaatggtgagatga

SEQ ID NO: 359 - DNA, 1089 bp, Bacillus licheniformis
atgacaatgaaaagtaaaatttctgctttatttattctgtctcttgcagcggtgctcctcctttcgggatgcggcggaaacggaagtcaggaaagcaaacaatcagatacagtcgttatcggcgtctatgggggcgattgggaaaaacatatcaagccgagcctcgaatcttttgaaaaagaaacaggactgaaggtcaaagttgtcgcagggacagactctgagtggttcacaaaactcaaggcatcgaatggcagaaatgctccctatgatctcttaattctgcagccggacacgattcacagagcgcagtcggcgggattgctggcaccgatcgatcaggaaaaggttccgaatgtccgcgatctgtaccactctgttcagaaacgcttcaccgatgatggaaagcagtatgcggccggtttcagtatgggacagcttggaattgtctaccgaaaggatcttgtaccacaggagcctaagcgctggacggatctttggaacagcagctataaaggtcatgtcgccatatcatcgccggcttattcggcggggcttcagttttttgtaggattaatcaatgcccagggcggcctggagtcaaacgggaaagacgtggataaagcgttcaacagcttggctgatttaaagaacaacataacggcctatcccgataatccaggctcgatacaaacgcttctggaacgtggggatgcatgggttgttccgttttgggacggccgcgctttttctttgcaggatgcaggtcttgacctgggatttgcatatcccgaggaaggtgcagtcgcagcagttgcaagctgggctttaatgaaaggaagtcctaatcaggataatgcgtacaagctgttaaatcatctgctcagtccagaagtgcaaggagattttgccgatagaacgttttacggcatggccaataaaaaagtgaaatacagcgataaattaaaagggaagatcaaagtaggggaggattattacaggaatttaaaatgggttgactatgaagtcgcggcaaaagatctaggcgattggacaaatcgctggaatcaagtacttggcggaaaatag

SEQ ID NO: 360 - DNA, 1119 bp, Bacillus licheniformis
atgagcgcaattcagattaggcatgtcagccggcatttcggaaacaccatcgcattggaagacgtacagcttgaagtcaaagaaggggagtttttctccctccttggtccgagcggctgcggaaagtcaacgctcctgaatattattgccgggttccttgaaccgacgtcaggttttgtatatataggaggacgagatgtaactgatttgccgccatacgaccgacatatcggaatggtttttcaggattatgctttattcccgcatctcagcgtttttgacaatgttgcatacggcttgaaagtccgaaaatggccccgccgcaagattgaagaacgggtgatggaatgcctcgctcttgtcaggcttgaagcgtttgctaatcgcatgccccatcagctgagcgggggtcagcagcagcgggtggcgattgcccgggcattggccgttcagccgtctgtgcttttgctagacgagccgctgagcaacctggatgcgaaacttcgaaaagaaatgcagacggagctgcgcagcatccaaaagcgcgtcggcattacaacgattttagtgacgcacgaccaggaggaggctttaagcttatcggacaggattggaattctcggatgcgggaggcttcagcagctcggcactccgttggacgtgtaccgcacgcctgccaatcaatttgtggccgaatttatcggacaggtcaatttactgaaagcgcgtgcgtcgaagatacagccttcatcgggcggctatggatacgaaacggtcgatttcgaagtgtatgaaggcgttccgctgacatttgaaatcaaccaggaactctcaaaaaaaacttctgtattgttcatggtgcggcctgagaggatctcagtctccttcgagaagcaaaagaacaggctgattgaaatgcctgcaacaattaccgaagtcagttacgccgggcatgatctcaggctgaaagccgctgttttcaaaggagaatggatcattcaggcgcccgatcctcaattccctagattgccgaaggcgggagatcaagtgtatctttctttggagccgggcgattttgttccgctggatgttaaggaggatgcagatgagggctgttga

SEQ ID NO: 361 - DNA, 867 bp, Bacillus licheniformis
atgagggctgttgaacaaaaacggttttattggtttttgctagttcctgtccttttatttctcggtgtttttcttgttttgccgcttgttctgctgctgttattaagtttcagagacgtggacgctatgatgaatacgctcgatacgtatagtttttctcaatatgtcgaggtgttctcttcagacgtttatttgaaaacaatcggtataacaatttggacggcgttgaagaccactgttttatgccttgtgatggcgtatccggcggcatatttactcgttaaggcgccaaccggcaggctgcgggctttgttttacattttgcttgtttcccctttattgaccagtgttgtcattcggacgttttcctggattgtgctgctttcgcaaaacgggatcgtcaacgaggcgcttatcagtatgaagatgattgaaaagcccctgccgcttttatggaatatgaacgcagtcatcattgcatatgtccaggttatgctgccgtttgcagtactgccgcttgccagttctttaagcgaagtgaaacctgatcttaaatttgcttcgatgagccttggagcgggcaggctgcggacattttttttcgttaccttgccgatgacggttccgggattgctgacaggagcaatgatcgtgttttcgctttctgccggaagctatattacgcctcttctcgtcgggggaaggatgcagccgctcctgccgttgtccatctatcagcaggtcatgcaagtctttcatcttcctcttgcagccgcaatgtcgattactttattagccgttgtcagcgtggttattggaatccttggcattttccaaaagcgttgggaggcgagaataaatgggtag

SEQ ID NO: 362 - DNA, 792 bp, Bacillus licheniformis
atgcgcaggggaaaatggattgatgcgtgtgtttggacagcgggtttattggtatacttctttttggcgctgcccgtcttcgtgatcatactgtcggcattcagcccggacgaatatccgaagttcccgccatcaggcatctcgctgcgctggtttgccggagttttcagcagcagcggctggatggaatcgatttgggtcagctttatgctgcttctcgttgtaacgcatcttgcggtgatccttggaacagttgcagcctatgcattggcgcggctgaactttccgggaaaacaggcgattcaggcttttgttttatcgccgttgatgattccccaaatcgcattaggcgtatcatttctctatttattgacaatgattggggtaaacggcacgtttgccgggctggccgccgggcatatgctgatcagccttccgtatgtcgttcggacggtcggagtcagcatggcaaacgtggatcagaagcttgaactggcatccatgaatctcggcgcaggtccctggcataccttttttcatgtcatcttgccgcttattaaaccgggaatcattgcgggagccgtttttgcctctgtaacgtcattcggagaaatatcaatcagtctgtttgtttcttcaccggctgtcacgcctgtaccggttcgtacattcagctatattgaccagacatttgatccgagcgttcatgcgatttcggttatttttatcacggtttcagtgattgcgctgatcatcatcgaacggacgatcgggctctcaaaaaccatgtag

SEQ ID NO: 363 - DNA, 10743 bp, Bacillus licheniformis
atgggaaacacattttacccgctgacacatgctcaaaggcgaatttggtacacggaaaagttctatcccggtacaagtgtttcaaatttgagcggctttggaaaattaaaatctgcatccggaatcgattccgggttattgactgaagcgattcgcaagtttgttcgtacgaatgacacgatgcgattcaggctgatgtttgaaggagaggatgagccgaagcagtatatagcggaagacgaacctttccaaattgaatattttgatgcttcagaaagcggaggagcagacggcgttcttaaatggggacaagctgaggcgcgccggcccctgcctttgtatgacagtccgctgtttaaatttgccgttgttcgcattagtgaagaagaaagctggttttttgcaaaagttcatcatatcatttccgacggcatttctatgacgatcctaggcaaccggattacagatatttatttgaagcttgccaaaggggaaaccgaccttgaacctgtacagtcatcatttacggaacatatccagagcgaattggagtatgaaaattcgaagcgtttccagaaggataaagcatattggaacgcacaatatgaagcgattccggagcccgtatcgttaaaagcgagcgatacgtatcagatccaattggatgcagcccgcttttcaaaagagatttcccctgacctgtataaaaaaattcaaacgtattgtaatgaacacaacatcagtgtactctccctgttcctatccattctgcacatctatatgcaccgggtaaccggacaaaaagacgtcgttctcggaacatttatgggtaaccggacaaatgcaaaagaaaaacagatgctcgggatgtttgtgtcgacgattccgatgaaagcctccattgaagtacaccaagactttagtgcatttgtgcaggaaagaatgaaggaccagctgaaaatcattcggcatcaaaagtatccgtacaatctgctgattaatgatttgcgggaaagacagccgcatgtcagcaaattgttcgccgtctcactggaatatcaggttatgcaatggcagcaaaaagaaacggtgtcgtttcttaccgagccgattttcagcggcagtgaagtaaacgatatttccattcatgtgaaagagagatgggataccgggacgcttgcgattgattttgattacagggaggagctttttacttcggaagaaatggccgtgttatatgaacggctgatgacgctgcttgaagatgccctgctgtctccgcaaaaaacaatcgctgaactggagattgttcccgcttttgaaaaagagcggctgttaaagcgtgcatcaagccaaaccattgcatatgacaagaacatgaccctgcacggtttatttgaacaaaaagcagccgatcatcccgaaaaaacagcggttgtatatgaaggacaaaaactttcgtaccgggagttgaatgaacaatcgagccgcttggcaatggcgcttcggagaagaggcatcgggcctgatgctccggctgcgatagtgatggagcggtcagagcgggtcatcacggcgatgatgggcgttttgaaagccggcggagcttatgtaccgatcgatcctggatttccggaagaaagaatccgttttatgctggaggattcaaaggcgaaagcggttatcacagacagcgggctgacttttgaaacggctgaaacggtgcagttcagcgaagcgctttctgaatcgcgggaaaacggctatccgtcttcagcggcaggcgccgggcaccttgcatacatcatttatacttccggtacaacgggccgtccaaaaggcgtcatgattgaacacaggcaggtccaccaccttgtcagaggacttcaacaggccgttggtacatacgatcaggatgatttgaaactggcgcttctggctccatttcattttgatgcttccgttcagcagatttttacgtctctattgctcgggcaaacgttgtacatcgtaccgaaaaagacggtttccgacggacgcgctttatcggattattaccgccggcatcaaatcgatgtgacagacggtacaccggcacatttgcagcttttggctgcggctgatgatctttcaggcgtcaaattgaggcatatgcttgttggaggagaggctttatcaagggttgcgacggaaaggctgcttcagttatttgcagaaacagctgaatccgtgcctgctgttacgaatgtttacggaccgacggaaacttgtgtggatgcctcttcttttacgattacaaaccgcacagatcttcaatacgatacggcctatgtaccgattggccggccgataggaaataaccgtttttatattttggatgaaaacggcgcactccttcctgatggcgtcgaaggggaattgtatattgcaggagacggagtcgggcgaggctatttgaacttgcctgacatgaccagagacaggttcttgaaagacccgtttgtatccggaggtctcatgtatcgaacaggggatactgcacgttggcttcctgacggtacagttgattttatcggccgaagagacgatcaagtgaaaatccgcggcttccggatcgagcttggcgagatagagtcggtgctgcaaggagcccctgctgtcgaaaaagcagttgtcctcgcgcggcatgaaaccggcggcagccttgaggtttgcgcttatgtcgttccgaaacaaggcggaaagattcacattcagggactgagggagcacttatccaaacacctgcctgattatatgatcccttcctgctttgtcgagcttaatgaaataccgctgacggcaagcggaaaagtcgaccggaaagcgctgcttcgccatgaggtgtctgtcagcgggactgcagaatatgcggcgccgagaaatgaatgtgaagaaaaaatggtgggtatatggcaggaagtgctcggagctgaacaagtcggaatccacgaccagttttttgatctgggcggccactctctcaaagcgatgaccatgctggcaaaaattcataaagctttcggagtcgaagttccgttgcaagtcctatttgaaaagccgacagtagcggcgctgagcggctttgtttctgaagccgagaaagacggattcgcggtaattgaaccggcgccggaaagtgacgattatcctctttcattggcgcagcagcgaatctatatcgtcagccagctggagggtgtcggctacaatatgccggccgcggcgatgcttgaaggcactcttgactctgggcgccttgaagctgcttttcaaaaactgattgataggcatgaggcgctgcgtacttcgtttacagttgtggatggcgagccgaggcagaccgttcatcaaagggttcagttcaagattgagaaggttaaggcggaaggcaagccgatcgaacaaatcgcgaaatcatttgtccgccgctttgatctcgccaaagctccgctgatgagagcgggtctcgtcagccttgcagacggcagacatctgctgttgttcgatatgcatcatctcgtatctgacggcgtgtcgatttcgatcatattgaatgaactggccgcgctgtataacggggaggaattgccggagctgcgtttgcattacaaagattatgccttctggcaaagggcgcaggcacaagaaggctttcaaaaagaagaggcctattgggaaagcatgtttgccggcgagcttcccgtactgcagctgatgacggacgagccgaggccgcctgttcaaagctttgaaggagacagggtatccgcagtcctgccaaaagacctgaaagaaaaattagccgtgctggcagagcaaaacggcgcgacattgtacatggtcatgctgtctgcgtacaacatgcttcttgcaaagtactccgggcaggaagatgtgatcgtcgggacgccggcggccggccgcagacattccgatctggaaggaatcatcggcatgtttgtcaatacgctggcgatccgttcaaaagtggacccgggcagaacgttcgcagacttcctgaatgatgtaaagaaaacggtaatcgatgcttttgagcatcaggattatccgtttgagcggcttgcggagaagtttggcgcatcgcgcgatttaagccgtcatcccatctttgacacgatgtttattttgcagaatgcatgggaagacattccgctgctcggcgatttgcacctctcgatttatgaaacgaacttcaatattgcaaaattcgacttgacgctgcaggcaaaagaagagcagggagaattgatactcgatttggattacagcacgaagctgtttaaaaaagatacggctgaaaggatgctgaaagcatacttgaaccttctggaggacatggcggctgatccgatgctcaggatcggcgagtacagccttttgacagaagaagaaacgaatcgccagctcgtcgcgttcaaccccgcgacaagcgattatccgcgggagaaaacgatcgttcagctattcgaggaacaggctgcagaaagaggcggttatcccgccctgcaatttgaagacaaagtatggtcatatgatgagctcaatcggaaagcgaaccaattggcaaggcgcctccgcgaaagtggcgtgcaagccggcacgacggcggccattcttacggccaggtcggctgaaatggtcatcggcattctcgctgtgctgaaagccggcggggcttatgtgccgatcgatcccgatcatccggaaaagcgtgtgcaacatttcttcaaggacagcggagcggcggttcttttaacgcaaaaggcgatgaagccgctcgctgaggcggcggaatttggcggcgacatcctatttgttgaggatgaaaacctttatatgggagatgcgtctgatttgcgccttccgatttctccggaagcaatggcaaatctaacgtacacatctggaacgacagggacgccgaagggcaatatggtctctcaccggaatattttgcgtactgtaaaaaacgcgaattacttggaagtgatggaatccgatatcgttctttcgatttcaaattatgtgttcgacgcctttatgtttgatgtgttcggttcattgctgaacggcgccaagctggtgatagctccaaaagacacgattcttgatatgagccggctcgcacatgtactcgaaaaagaaaagattacgattttaatgatcacgaccgcattattcaatctgctgacagacatgcggccggacagtttgaagggactccgcagggttctgttcggcggcgaacgtgcatctgtcgatcatgtcagaagagccctgaagacagttggcagagggcggctgcttcatatgtacggtccgtctgagagcacggtctttacaacctaccatccagtcaatgaagtgccggacgatgcgcaggctataccgatcggaaagcctgtcagcaatacggaggttctgattcttgattcattcggcaatgtacagccggcaggggttgcgggagaattatgcgtcggcggagacggccttgtccgcggctattttaaccgccctgaactgacggctgaaaagtttacggcgcatccgttcaaaaccggcgaaaagatttaccggacgggtgatatggcgagatggcttgccgacggatgcctcgaatttatcggtcggattgatcatcaggtcaaaattcgcggacagagaatcgagctgggcgaaatcgagcatcatctcctaacgcatgacatggttcaggaagccgctgttcttgctgttgacaccggggcgggagatcaaatgatctgtgcatactttacggctgatcaggagctttcgagccaagagcttcgccgacatgcggcagaaggtctgccaggctatatgatcccgtctgtgtttatgcagcttgatgagcttccgctcacaggcaatggaaagatcgacagaagggcgctgcctgaaccggatatcgcgcaggccgcgcaaaaggaatatacggcgccaaggagcggcacagaagcgcagcttgccgatctttggcaggaggtgctcaatgtaccgaaaatcggtgtgcatgacaatttttttgaactcggcggacactctttactcggaatgacgctcatcgcccgcatccagcaagagatgaatgttgacctgcagctgaaagacttgttccaggcgccgacaatcgaaagcctggcccaggcggcggcaaaatctgagaaaaaatctgccgtttatattgaagcggcgccggaccgggaaacgtaccccgtttcgtcggcgcaaaaacggctgtacgttcttcagcagattgaaggcgctgagaaaagctataacatgccggccgttctccaacttgaaggaaagcttgacctgaagcgcctggagtctgccgcgcaaatgctgatcaagcgccatgaagcgttccgcacgacgtttgaaatcaggaacggcgaacctgttcagcggatttgggaagctgcggaattgaccattgatgtcatcgatgcagatgaacaagaagcggaaaagctgattaaagagttcatcaggccgtttgatttaacaaaggctccgttatttagaatgagcatcatacgtgtcacggaagaaaaacatcttttgcttgtcgatatgcatcatatcatttcagacggcgcttccgtcagcgtgctgatcgatgagatgacaaggctttatgcgggagaggcgcttgaaccgctgaggattcagtataaagactatgctgtatggcagcagcacttgctcactgaacggcacaaaatgcaggaggaatactggctcaaggagcttgacggcgaactgcctgttttgacgctcccgacagactatccgcgtccttctgttcaaacgtttgaaggaagccgtatcagcttttctctgaaaccggagcttgtccagcagctcagaagactggccaaggaaacggaaagcactttatacatggtgctcgctgcctcatacagtacgtttttatcgaaactgagtggacagagcgaggtcattttcggctctccggctgccgggaggccgcatgcagatttgagccgtatcatcggcatgtttgtcaatacgcttgcgataagaacgcgtcctgaaggagacaagccgttttctgcattccttgaggaagtaaaagaaacgacgctcggcgcatttgagcatcaagattacccgtttgaagaactgatcgagaagctgaacatccagcgcgacatgagccgaaacccgttatttgatgccgtcttttcaatgcaaaatgccgatttgaaagacttgtcaatggaaggagtcacacttaaaccgtatgattttgcccatcagactgcgaaatttgatctgacgttgacagcggcggaagaagacggacttctcgtttttgaaatggaatacaatacagatctctttaagcgcgaatcgatcaaacgctggagcgggtactgggtcaacctgctcgaagcggttgccgaaaccccggatgcaagtctttcagacctttcgcttctggatgaagcggaaaaacggcggatcgtccaaaagtggaatgagacgaagctcgctgtgccgcaggacaaaacggtccatgagctgttcgaagcgcaagtcctccgcactcctgaccgcggggcagcggtgtacaacggcgtgaagtggacgtacaaagagctgaacgcgcgcgccaaccgtctggcccgcctgctgattgaaaaaggagccggtcctgagcagcgggtcggaatcatggtgaagccttcgctggaaatggcggccggcgtacttgcgattttgaaagcgggagcggcctatgtaccgatcgatcccggctatccggccgagcggatcggatacgtactgaaagacagcggtgcagaactgcttctgacgcaaacaaacttagccgtacctgaagaattcagcggtgaaacgcttcttctcgattcgatgctgagcgaagaaatcacaaatgatgatgaagtgaacccgcaggcaggtacacagccaaacaacctggcatacttgatttacacatcgggcacgacaggccagccgaaaggcgtcatggtcgaacatcaatcgctcgtgaacttgtgctattggcataacgatgcattcgcggtcaccgaacaggacaaaagcgcgaaatatgccggcttcggctttgacgcttccgtctgggagatgttcccgtactggatcgccggagcggagcttcatatcattgatgaagcgatccggatggacattacgcgtttgaatgaatatttcgaagagaacggaataacgatcacgttcctgccgacacagctgtgcgaacagttcatggagctcgacaaccagtcgctgcgcgtgctgcttacgggcggagacaagctgaagcggatcgaaaaacggaactacacgctcgtcaacaactatgggccgacggaaaacacagtcgttgcgacgagcacagcaatcgatcctgatgaaggcatgctttcgatcggaaagccgattgctaatacgcgggcgtatgtgcttggacaaaacaacgaagttcagcctgtcggcgtcgctggcgagctgtgcatcgccggccgcgggcttgcgcgcggctatctgaacaagccggaggaaacggcgaagcgttttacggaagacccgtttgtgccgggcgagcgcatgtaccggacaggggatgcggtcaaatggctggaagacgggcggcttgagtacatcggccggatcgaccagcaggtgaaaatccgcggcttccggatcgagctttctgaaattgaagtccagctcgcgcggctctctgaagttcaggaagcagtcgtcaccgacatcgaagacgcctacggcaacaaagcgctgtgcggctatgtcgttgcggacgaacagcttgatacagaaagcctcgcccgtaagctggggcagacgcttccggactacatggtaccggcgtattgggtgcagcttgatgagcttccggttacggcgaacggaaaagtcgaccgaagggcgctgcctcagcctgacgtcgaagcgcagacagccgaatacaaagcgccgcgcacagaaacggaacagctgttggcggacatttggcaggatgttctcggcatagaccgaatcggagtcacggacaatttcttcgcgctcggcggggactcgatcaaaggaattcaaatggcaagccgccttcagcagcacggttggaagctggagatgaaggacttgtttcagcacccgacgatcggggagctcagtgcttatgttcaagcggctgacgatcagccgatcgatcagaaccctgtcgaaggcgaagtcacactgacgccgatccagcgctggttctttgagcgcaaatttacgaacgagcatcattggaaccaatcagttatgcttcacgccccttcagggtttgacccggaagcggcaggcaaggctttaaccaagatgatcgaacaccatgatgcacttcgcatggtttatcagcgaaatggagacgggattgttcagtacaacagagggctggaagaaacagcggttcgtcctgaagtcatccgcttcaatgaatcgggtgctgaacttgaagctgccgtgttaaaggaatcaaaccggattcaaagcagtatcaatttaaccgaaggcccgcttttgaaagcggcgatctttgagacggatcaaggcgatcatcttctcatcgtcattcatcatctcgttgtggacggaatttcatggagaatcctccttgaggatttcgccgccgggtacgcccaagctgaaaaaggggagccgatcattcttcaagaaaagacgcactcttttgctgaatatgcggctcgcctgaaagaatacgcaaggtcaaaagctttcgcgaaagaaatcggctattggcaggaagtcgagaaggcggagacggcatcgctccctaaagatgatgaagcagaggacaaacggatgcaccatacgaaaacggctgagttttctctctcgaaagaagaaacagaacagttgatgacaaaagttcatgaagcatataacacggaaatgaacgacattttgcttacggcgttgggcttggcgctgaaagagtggaccgggcaggaagactttatcatctgcttggagggacacggccgggaggacatcatggaaggcttgaatatttcccggacggtcggctggtttacaagccagttcccggcgctgattcaactgcgccattccgaagatatcggctatcaaatcaaacagatcaaagaagagttgcgccacattccgaataaaggaatcggctatggcatttatcgctatttgaccgaagaaggcaaaaaggcgcagccgatcaagcatgatatcagctttaactatttgggccagtttgcagagatggcggattcgggtctgttcacgagatcagctttgccgtccggcgatccgctcagcccggaaacggaaaaaccgaatgcgctagacatcgtcggctatatcgaaaacggcattttgacaatgtcaattgcctatcattcactcgaatacaaagaaagcaccgtcgccgctgtcgccgcaagctttaaaacttatttgctgcaattgatcgatcattgcttagagctggatggaggcgaactgaccccgagcgatcttggagatgacgaactaacgcttgaagaattagataaactgatggaaattttctaa

SEQ ID NO: 364 - DNA, 10767 bp, Bacillus licheniformis
atggggaaacaaaagattcaaaaggtgtatcctttgacaccgatgcaggaaggaatgctgtaccacgcaatgcttgatccggaatcttcctcttacttcacacagctggagcttgtcatagacggggaatttgatttggggatctttgaaaaaagcgtgaatcagctcgtgcgttcatacgatattctcagaacggtttttgttcatcagcaattgcaaaaaccgcgccaggttgtcctggctgaacggcaggcaatagtggaatttgaggatcttgcggacttggatgaggaaaggcaaaaaacccgcattgaccggtataaacaagaggtacaggcggccgggtttaatttggcgaaagacatgctgtttaaaacggcggtctttcggcttgaccggaaaaaataccatctcgtctggagcaaccatcatatcgtgatggacggctggagcatggggatattgatgaaacgcctttttcaaaactatgaagcgtttcgagcaaaccggacggttccgcttgatcagggaaaaccgtatgcggactatattaaatggctcggccggcaggataaggatgaagcggcatcctactgggaacaccgcctttcgggtttagaaagcccgagcgtcattcccggcggaaaaacgcggccggattcaggatcgtaccggaacgaggagttcacgtttgtttgggacaaagacatggtggatgctcttcaaaaggcggcaaaccgctatcatgtcacagctcccaatctttttcaggcgatttggggaacagtgcttgctaaatataacagatccgaagatgtggtgttcggcacggttgtgtccgggcgcccgtcggaaattgacggaatcgaacatatggcagggctgttcatcaacacgatccccgtccgtttaagggtcgatcaaaacgcatcgtttgccgagttgttcaaacaagcacagcagcatgcaattgacgcggagcggtacgactatctcccgctatatgagattcagaagcaatcggcattggacggccgcttgatcagccaccttgtcgcgtttgagaactatccgcttgataaagagctggaaagcggaacgatccatgagcggctcggcttttccatcaaggctgccggagcttttgaacaaacgaattacgactttaatttgatcgtttatccgggagcggagtggacgatcaaattgaaatacaacggcgaagcttttgacgcggctttcattgagcaggccgcagggcatttaacgagacttgcagaagaggcgattgcaaatcccgaatcaaaagcaggcagcgccgacatgttatcaaaacaggagcaacaaacgctgctcgcttttaatcaaacgaaaaccggttatccaagagaaaagacgattccggagctgtttgaagaacaggttgaagcgtctcctgacaaaacggctgttgccgctgacggaagaagcctgacttaccgcaggctgaatgagaaagccaatcagctcgcgagaaggctgaaagcaagaggcttgatgcacggaaatgccgccgccattatgatggagcggtcgcttgaagcagccgtcagcatgctggcggtactgaaagcaggaggcgtgtacgtaccgatcgatcccggatatcctgaagagcggattcgcttcttgctcgaagacagcggagcaaagatcgtccttacaaaagacagcccgcagatttcgctggaagggtatgaggtactcgccgcaaatgcggtggatgcagaaaaagaagatgccgccaaccttgtacatgccaacaaacccggagatcttgcctattacatttatacatccggatcgacgggcaagccgaagggcgtgatggtcgaacaccgcaatatcgtccgccttgtcaaaaatgcgggctacatcccgctgaagagcgacgtgaagatggcgcagacgggggctgtcagctttgacgccagtacatttgaagtgttcggcgcactgctaaacgggggaaccctttatcccgtcccgaaagagacgctccttgatggaaagcggttcagagtgttcctggaagagaccggaatcacaacaatgtggctgacttcgcctctttttaatcagctcgcccagcaggatccgggaatgtttgcaaccctaaatgatctgattatcggcggagatgcccttgttcctggaatcgtcaacagagttaaacgcgaatcgccggaactctcgctttggaatggatacggacctactgaaaatacaacattttcgacgtgttttttcatcgatcaagcatatgagagaacgatcccgattggaaagccgatcggaaattcaaccgcctatatcgttgatgaacacggcgcgcttcagccgatcggcgtgcccggcgagctgtgtgtcggcggagacggggtggcccgcggctacttgaaccagcctgagctgacagatgaaaagtttgtcggcgatccttttgccgaagggaagcggatgtaccgcacgggcgacttggcaaaatggcttcccgacgggaatatcgaatttctcgggcggatcgatcatcaagtgaaggttcgcggcttccggatcgaattaggcgaggttgaagcggctttggcccgccttgagggaatttcagaagcggctgctgtcattcgggaaaacaataccggagaaaccgagatttgcgcctactacactgcagttggcgcgaggccggccgcacagctgcggacagagctgtcccggtcgcttccggagtatatgattccggctcatttgatcgaactcgacagcatgccgctgacagccaacggaaaggttgacaaacggcagctgccggctcctatcgctgaagagactgacagattcgaagcgccgaaaaatgaaacggagaaaattctggcggcaatctgggaagagattctcggcatcaagcagccgggaatcgatgacaacttcttttccatcggcggacactcgctgaaggcgatgatgctgacagccaaaatacaagagcagctccaaaaagaagtgccgatcaaagtattgtttgaaaaaccgacgatcagagagctggccgaatttcttcaaggggaaacgaaagagaaaaccgctccgattgcgccggcgccgtcccgtgcgaattatccggtgtcatccgcccaacggcgcatgtacatcctcaatcagctcgaagaagcaagcacgagctacaatgtgccggcggttctgcttctggaaggcgaattggataaggagcgtctggaagacgcgtttcgggccttgatcagccgccatgaaacattgcggacatcgttcgaattaatcgatggagaaatcgttcaaaccatccatcaagacgcagtttttcacctgacggaatcagtggcggatgaagcggaagccgaagcggcgatcagagggtttatccggccgtttcagctgaataaggcgccgctcgtccgggcggaactcgtaaagcttgaagaaaagcgccatctgctgatgatcgatatgcaccacattattacggacggaagctccaccggcatattgattcgcgacctggccagcttctaccacggtgaagaggcgcctgctcctaagctccactataaggatttcgctgtgtggcaaaacgggccggagcatcaggagaaattgaaagaacaggaacagtattggctcgatattttcaaaggcgagctgcctgttctcgatctgccgtacgattttccgcggccttcaaaacgcagctttgaaggcgaccgtgtcgtctttggaatcaatcgaaaactgacggcagacgttcaaaagctgctttctgaagccgatgcgacactttatatgttcctgttggccgcgtttaatattttgctgtccaagtatgcgtctcaggaagatttaatcgtcggatcgcctgtggccggcagaacccatccggatctgcacaacattccgggcatgtttgtcaatacgctggcgctccggaatcgtcccgaaggggaaaaaacgtttaaggaatttttgcaggaagtcaaagagacaagtcttcagggctttgccaagcaggactatccgcttgaagaactgattgaaaaactgccattgccgcgggatacaagccggaatccgctgttcagcgtctttttcaacatgcagaacatggaaatcccgacgctgaaactcggagatttgcagatttcgtcttactcggtgcgccatcgcacagcgaagtttgatctgtcgcttgaggccgtggagcatgatggggaaatcggtttgagctttgactatgccgtatccttatttaaagaagaaacgatcaggcgctggagcggccacttcttaaatgtgattaaaacaatctgcgaaaatcccggcattaagctccgggacatcgaactgctttcagacaaagagcgcggacttctcctggaagaagtgaggcgcagccgggcagaacgcctagaggagcggccgtttcatgtacggtttgaagaaaaggcggccgaaatgcctgatcagccggctgttgtctgcggggaaacaatcctcacataccgcgggctagatgaaagagcaaatcaaattgcaaatgtgctgcgaagtgaaggcatcggaaaagacgacgttgtcggcattatgctggatcgttctgcagaggtcgccgcggcaattctcggcgtaatgaaatcagggggcgcttttttgccgattgatccggaaatgccgacgagcaggattcaatatatgctggaagacagcaaagcccgctggctcttaacagaacattcccatcaagctgctctcgcagattggtataacgggagattgatagatgtgagaaacgacacgctgatggcaagcaaaaaacgaccgcatctaatccatgacggggcgagtctggcgtacatcatctatacatccggaacgacgggtcagccgaaaggcgttcagctggaacaccgcaatctggcaaactatgtttcctggtttatcagtgaggcgcgcctgtcagcttcggataaaacgatgcttttgtcttcctatgcgttcgatctcggctacacgagccttttcccggtgctgctcgccggaggagagctccatatcgtccggaaagaaacgtatacagaaccggagacatttattcattatatcggtgaacaagggatcacatatatcaagctgacgccgtcgctgttccatacggtcgttcagccgcaaagcttcgctttggcaaaggggcttcagtcattgagactgattgtactagggggagaaaaaatcaatccgaaagatgtcgaacggttccattcccgctatccggacacccggttcatcaatcattacgggccgacggaaacgacgatcggtgccatcgctaaaccggtcgaaccgggcatgatccggcaattcgccgagcgcccgacgattggacggccgatttcgggcgccggagcactggtattggacgcttcccgccggcttgttcccgcgggagcggcaggcgagctgtatattacgggaagcgggcttgcaagaggatatgtgaacaaccgggaacttacggctgcgaagtttatcgaaaatccttacacaccgggcacattcatgtaccggacgggggatctcgtccgccgtcttccgaatggggagattgaatttttagggcggacggatgatcaggtgaaaatccgcggctacagaatcgaattgaaagaaattgaagaggccttcattggacttgaacatatagagagagcggtcgttctttcatttacggctgactcagggctagacgaactgtgcgcttatattcaagcgaaacgacagctgccggtttccgaaatgagagagcgtctttctgagcggcttccgtcgtacatgatcccgtcatatttcgtaacggtggataaaatgccgcttgcggcgaacggaaaagtggaccgcagcgcgctgccggagccgcaaggtctaagtggtcaaagcgattcatatagagcgccgtcaaccgaatttgaaaaagccctctgcggcatttgggaggaggtgcttggcgttcggccggtcggacttgacgacaatttcttcgatcttggcggacattcattaaaaggaatgatgctgacagcggaaatccaatccaagctcggaaaaaaagtaccgttaaaaacgttgttcgattgtccgacagccggcttgctcgcccgcagtatcgaagccgatggacaggcagaacaaagcgggattcagcctgccgaaaaacgcgactggtatcccgtttcatccgctcagcaacggatgtatgccctccatcatattgaaaagaacggaacgggctacaacatgccgtctgttctcatgctggaaggcgtacttgatacggatcgcttaagacgggcattcgcagacttggtgaaccgccatgaatcattgcggaccgcattcgttgaaatcgatggccgcaccgttcaaattgtgcatgaaaaagcggacattgacttaaaggttattcatattcatgaagaggacgcagaagcacagatcaaccgctttatcagaccatttgatctcagcaccgctccgctgatcagagccgagctgctctccatcagctctgcgcgccatctgcttttgattgatacgcatcatattattgcggacggcgtttccagaagccttttcgtcaaagaaattgcacagctttataaaggcgcttcgctccctgaaccgaagctgcattataaagattatgcggtgtggcagcaacaacctgaccagcaagaaaacattcggaaacaggaagacttctggctccggcagtttaaggaaaccgttccggaactcagccttccgctcgactttccgcgtcctcctgtccaaagctttgccggggaccgggttcactttaaagtatcaaaaggcaccgcccttaaaatccgccgtttgatggcgaaaacgaacacgacgctgaatattgtaatgctcgccgtttttaatctgtttttaagccgtcttgccggccaaaaggatattgtcgtcggctcagcggcagcgggcagaacgaatgctgatttgaaagacgtgccggggatgttcgtcaactcgttggcgctgaaaaaccatgtacctgatcaagcatcattcagcgggtttttggaagaggtgaaaaacaacagcctcgcagccctcgaccatcaggactatccgtttgaagagctgattgccaagcttgatttgccgcgcgatatgagccggaatccgctgttcaatgtcatgctgacaacggaagatcctgataaagaaacgctcgatttagacggtctgataatcaagccgtatgagacttcacatgccgctgccaagttcgacctgacactgggggcttttgaaaaagatgatgaaatcggtcttcagttcgaatatgcaacagatttatttaaaaaacaaacgattgaacgctggagcggatatttgcttaacctgctcgaagcgattgccgaaaacccggatgcaagcctttcagacctttcgcttctggatgaagccgataaacggcggatcttgtacgaatggaacgaaacagttctcgacgtgccgcagaacaaaacagtccatgagctgttcgaagcgcaagtcctccgcacgcctgaccgcggggcagcggtgtacaacggcgtgcagtggacgtacaaagagctgaatgcgcgcgccaaccgtctggcccggctgctgatcgaaaaaggggccggccctgaacagcgggttgggatcatggtgaagccttcgctggaaatggcggccggcgtgctcgcgattttgaaagcgggagcggcctatgtaccgatcgaccccggctatccggccgagcggatcggatacgtactgaaagacagcggtgcagaactgcttctgacgcaaagcggattaacgatgccggacgcatttaccggagaagtgatcgatttgaatagagaagcctccattctggccggcgagctttatcccgaggatgacatcaatccaagcgcagaggctcagtctgacaacctggcatacttgatttacacatcgggcacgacaggccagccgaaaggcgtcatggtcgaacatcaatcgctcgtgaacttgtgctattggcataacgatgcattcacggtcaccgaacaggacaaaagcgcgaaatatgccggcttcggctttgacgcttccgtctgggagatgttcccgtactggatcgccggagcggagcttcatatcatcgatgaagcgatccggatggacattacgcgtttgaatgaatatttcgaagagaacgggattacgatcacgttcctgccgacacagttgtgcgaacagttcatggagctcgacaaccagtcgctgcgcgtgctgcttactggcggagacaagctgaagcggatcgaaaaacggaactacacgctcgtcaacaactatgggccgacggaaaacacagtcgttgcgacgagcacagcaatcgatcctgatgaaggcatgctttcgatcggaaagccgattgccaatacgcgggcgtatgtgcttggacaaaacaacgaagttcagcctgtcggcgtcgctggcgagctgtgcatcgccggccgcgggcttgcgcgcggctatctgaacaagccggaggaaacggcgaagcgttttacggaagacccgtttgtgccgggcgagcgcatgtaccggacaggggatgcggtcaaatggctggaagacgggcggcttgagtacatcggccggatcgaccagcaggtgaaaatccgcggcttccggatcgagctttctgaaattgaagtccagctcgcgcggctctctgaagttcaggaagcagtcgtcaccgacatcgaagacgcctacggcaacaaagcgctgtgcggctatgtcgttgcggacgaacagcttgatacagaaagcctcgcccgtaagctggggcagacgcttccggactacatggtaccggcgtattgggtgcagcttgatgagcttccggttacggcgaacggaaaagtcgaccgaagggcgctgcctcagcctgacgtcgaagcgcagacagctgaatacaaagcgccgcgcacagaaacggaacagctgttggcagacatttggcaggatgttctcggcatagaccgaatcggagtcacggacaatttcttcgcgctcggcggggactcgatcaaaggaattcaaatggcaagccggcttcagcagcacgggtggaagctggagatgaaggacttgtttcagcacccgacgatcggggagctcagttcttatgttcaagccgctgacgctaaaccgatcgatcaaggccctgtcgaaggcgaagtcacactgacgccgatccagcgctggttcttcgaacggaaatttacgaacgagcatcactggaatcagtcggtcatgcttcacgccccttcagggtttgacccggagctcgtcgaacagacattggcggcattgacagagcatcatgatgcacttcgcatggtgtatcaaaagaataacggccgcctcattcaatataaccgcgggccggatgaccgttcgttcgcctttcgagtggttgacctgcgatatgtcaccgacattgaaacggaaatagccgctcaagcaaaccgccttcaggcaagccttgatcttgaaaacgggccgcttgtaaaggctgaacagtatcagactgcggaaggcgaccatttgctgatcgtcattcaccatttggtgatcgacggcgtgtcatggcggattctgctggaagactttgcatcaggctattcgcaggccgcacagcagcatgatgttgttttccctgataaaaccaattcgtttaaagactgggccgaagcgcttgaggcttatgcgcaaaccgaacgcttccttaaaacggccgattattggcgcagacttgaacaagagcgtatttgtgagctgccgaaagatcgtgctgccgcagaaagaaaagcggaaaacacctctgctgttaagtttgaattaagcgaagcggagactcgtctgctgctgacgaaagtgcatgagccgtatggaacggatatcaacgatatcctgctttccgctctcagcctgacgatcagggaatggacgaacggctccaatatttgcatcaatatggaaggccacggcagggaggaaatcattccagggatgaacatttcgagaacgacggggtggtttaccgcacaatatccagttgttttaaaaagccaagcagcggcagggttgcctgagaccattaaaaacgtcaaagaaaccctccggcgcattcctgacaaaggaatcggctacggcatccttcgctacttaacagaccggaaaaaagccggtgcaattttctcgatcaagcctgacatcagctttaactacctgggacagatcgacagggaggtgcagaccggcttctttgggccttctccttatgatatgggaagacaggtctctgaaaggtctgaagcactctatgcactgagcttcagcggcatcatcagcaaggaaaaattcatcttgtcatgttcattcaatacagaggaatatgacaggcagaccatacaggagctcatggacagattcaaagctttcctgacagcattgatcgaccattgtacagctaaagaagaacgcgaatttacaccgagtgatttttctgccggcgatcttgagatggaagaaatgggcgacctgtttgacgttcttgaagaaaacttgaaataa

SEQ ID NO: 365 - DNA, 3849 bp, Bacillus licheniformis
ttgagccagtttaaaaaagaacatgtccaagacatatactatttgtcaccgatgcaggaagggatgctgtttcatacgctgctgcatccggggcaaggcttttatattgaacaaatcagcatgcaggtgaaaggctcttttcaaaaggatgtattggaaaaaagcatgaatgtcatcatcggcaggtatgatatattccgaaccgttttcgttcatgaaaaaatgaaacgtccggttcaagtcgttttaaaggaaaggtcatttcaggcagaagaaattgatctatcaggactttctgaagcagaacaaaatgagagaattgaagattataaacgaaaagataaagaaaaaggatttaacctctcaaaagacattccgatgagaacggcggtttttaagaaggggcaggatcgttacgaatgggtgtggagctatcatcatattctgcttgacggatggtgcttcggcattgtcgtacaggagctgttcgaagtatacaacgcgctccgtgaaaacaggccatacagcctcgggcctgtcagaccttacaaagaatatattaaatggctcgaaagccaggacaaacaaaaatcgctggtctactgggaacatcatttagccggattcgaagggcagacgacattcagcgaacagcggaaaaacccggagcaagccggcaatcagccggaagaactgctgtttacacttccaaaagaagatacagaagcgttcacacagctagcaaaagcgcatcataccacgttgagcacggcgcttcaggcggtgtggtcggtgctgctcagccgctatcagcgatcccgcgatctgatcttcggtacagttgtttcaggccgccccgctgacattcaaggtgtcgagcacatggtcggtttgtttatcaatgtcgtcccgaaacgggcgacctttggcccgcaaacgacctttacggagctggtcgctgatttgcagaagcaggcgctcgaagctgaaccgcatcaatatgtgccgctctatgaaattcaaagtcatatagcagcgccgaacttaatcgaccatattatcgtttttgaaaattacccgctgcaagaagccaataaacagcagaaagaaaaaaatctcggcttcacaatggacgagatcagcgtttttgaaaaatcgaattatgatctgaatttgcttgcttcaccgggtgaagaaatgatgctgaaacttgcatacaaccggaatatattcgaaccatctttcatcttgcggttaaaagaacagcttttgacagccattcgcgaggtcatcagagatccggagcagccgcttgacgacatttgtgtcgtttccaaaaaggaaaaagagcgacttctccatgaatttaacggtcaagtccaacggaagcaaatcggcctgacgattccccaatggtttgagcaatacgctgaagcgctcccggaaaagcccgcggtatcagcggccgggcggacgctgacatatcgggaattgaacgaaaaggcgaacaaggtcgcgcaccttttgcgcaaaaagaacgtcggccgcggcgagcccgtcgcccttttgttccgccgttcgccggaaatggtcatcgcgatactcgccgtcttaaaagcagggggcgcctatctgccgattgacccggaatatcctgaagcacggattcagtatatgctggaagacagcggggctgtttgcatgctgacacaggaagagcttgccggccgggcggcgtcgctttcttttcataagcatacgatcctgatcgacgatcctgctgtgtctgcagaaagcgggagaaacctcgaaatcgccgccgagccggacgaccttgcttatattatgtatacgtctggcacaacgggaaaaccgaaaggcaatctgacgacacatgccaatattacaagggttgtaaaagagacaaactacatcagcctttccgagaaagacaccttgctgtccctttcaaactatgcgtttgacggcttcacatttgatctgtacggcgcgctgttaaacggagcaaagctggtggtggccgatcaggcgacgattctccatatcggcaagctgacagaagcgattcagaaggaaaacatcacagtcatgtttgtgacaacggcgctgttcaacttgctggttgatgcgggaacagggtggatgaaagggattcgcaaagtcctgttcggcggagagcgctcatctgtcagccatgtcaagaaagcatttgctgccatgggaccggacaggatcatccatgtatacgggccgacggaaacgaccgtcttcgcgacgttctatccggtcaaccgtatggaagacagcgcggtttccattccgatcggcaagccgataaacgaaacgaatgcatacatcctgacggaaaataaccggcttcagccgattggagcggtgggtgaattgtgtctgagcggtacaggagtatcgcgcggctatttgaacaggccggaactgactgcggaaaaattcgcgccgcatccgtttaacagcggtgaaacgatgtacaggacgggagatctggcccgctggctgccggacggcaatatcgacttcatcgggcggatcgatgatcaagtgaaaatccgcggacaccggattgagctcggtgaaatcgaagagcagctgatgcgctgccaaggcgtaaaggaagccgttgtaaccgccaggaaaagcgggaacggggatgcggcgctcaccgcttatgtcgtcccggtgcagggaactgaggttgcaaacgaggaggttcgccgccaattggcgcggaggctaccggcttacatggtgccggctgcgtatatcatgcttgaagagctgccgcttaccgctaacggaaaagtcaaccgacgccttctccctgaagccgatggccggccgaattcaacagagcgccgtgcaccccgcaatgctacggaagaaaagcttgcagtgatttggtctgaggttctcggcagacagcagatcggaatagacgagaacttttttgaaatcgggggacattcattgaaagccatggccgtcgcctcccggatgctgaaagatctcgcaatcgatgttccggtgaatgtgttgtttgaaatgcccacaatcgagggcctcgcggcttatatcgaccaaggcggccatgtggatgaagtgaaaaaaaccgtcttcaatcaggcaagcacccgccatttgttcgctttcccgcctgtcctcggatacggcatcatgtacggcaagctggccgaacaaatgccggaatacaggattcacgcgttcgactttatagaaagcgatgaccgcgctgtgcgctatgcagaagccatctccgaccttcagcctgaagggccgctgacattgatcggctattcagccggctgcggacttgcctttgaagtggcgcaagcgctcgaaaagaacggacggaaggtcgaaaagctgctgatgatcgactcatatatgaagaacgatgtcagcgatttagaagggcggtcaattgaagccgatacggccgccttgatggaagccaacaaggacaatgaatatatgaaaatcaagacggttgccgatggcatcgctaaaaagatgacagcctattattcttactttgtcaatcttgtccatcaaggaacggtcagctcggagattcatttgatcaaatcagagcacgcaaaaccgctcccggcatggctttcgttgtggaaagaaggaacggagtcttcatatgatgaatatcaaggcgctggaagacatgatgaaatgcttgcggacggctttgttaaaagcaacgcagatctcatcagacagattttgggcgaacgtgccgctgtaatcggaggtgcatga

SEQ ID NO: 366 - DNA, 741 bp, Bacillus licheniformis
atgaacgagatcattaagcagtttggagcgccggcaagcggtatgcagttgatctgtttcccgtttgccgggggatattcggcatcattcagaccgcttcacgaacatttaaaaacagattttgatatgctggcgatcgaaccgcctggacacggcacaaatcgaatggcgcttgtcgacaatttggaaaagctcgccgatttgtatatagcggcgcttaagccgcggctttcctctcaattcgtgctgttcggccacagtatgggcggcatggttgtttacaggctggcgcaaaagcttgaacaagaagggatctttccggcagccgctgtgatatcagcgatacagccgccccatattcagcggcaaaaggtgtctcaccaaaaggatgacgcatttctcgaccatctcattcagcttggcggaatacccaaagaactggcagagcacagggaaatgatgaactttttcctgccttcgttcagagcggactacagagcgcttgagacgttctgccataccgatcatacgccgcttagatcgcctgtgcatattctgaacggagaccgcgatgagaaatgcatgagggatgcgcttggctggaaaaagtgggcgaatacgatcgatttccactatttcaaaggcggacatatgtatcttttatcagaaacggaacaagtagccgccaagttgaaaacgattgccgcggccagccgcagtacggctgttccgacaatgtaa

SEQ ID NO: 367 - DNA, 912 bp, Bacillus licheniformis
ttgaacaaatctgcttatgcggcagctttgctctatgcttttatcattggattttcctttttctttgtcaaattggctctcactgcagcgagtccggtcgacattctggcccatcgctttacggtcgcttttttggctgcgcttattccccttctgctcggatgggtgaagatcgccatcagcataaaagacgcactgaaagtgctgcctttagcattattttaccctgtcatgttttttgcttttcaagttttcgggctcgtctacacgtcttcgtctgaagccggaatcattcaagcggcgatcccgattttcaccatgatattcgccgcttattttttaaatgagcggtttacgaaacggcaattcttttttaccgtcttgtcagcggcgggggtggcctgcatctttatgatgaaaagtgcaggcaccggaagttccgatttaagaggggcggcgctgattttgctttcggcgctttcatcggcgggctacagcgtgctcgccagaaagatgacgcgaaccttcagctcgcttgaattaacatatgtcacaacgggagcgggatttctttttttcaacggcatcgccggaatcagccatatgtcagacggcacgctgagcggattttttgcccccttcactgatccggtgtttgttctttcggtattgtatttaggcgtgttgtcatcgtttgcgacatcatttttatcaaattatgcactgtcaaaaatagaagctgcgaaaatcagcatgtttaatcacttggcgacactggtgacgattttggcggggattatatggctgggagaatcactcgaatggtttcacttcgccggaacggggatgatcattgccggaattattggggcgacgatggttcggcgggaaaatcggctgaaaaaaagctga

SEQ ID NO: 368 - DNA, 1350 bp, Bacillus licheniformis
atgcacaaatatgtcgcactgatgaacgaattggaggatatgatcgaagacaaatcctttcaggaaggggacaggctgccttccatccgcgcgctggccatacgtttcaaggtaagcaaaagcacggtcatcagggcgttgaacgagctggaaagacggcacctcatctattcagtgccgaaaagcggctattacgtcgtgaaaaaaacgaatcagcggcccaactccggaaaggctgtaatcgatttcgcagcatccgctcctgatccggatgtttttccatacatcgattttcagcattgcatcaataaagccatcgatacatacaaaaacgatctgtttatttatgggacgccgaaaggtctgccgtcgttaatccaagccgttcagaaagagctcgcaaacagccaggtgtttgcaaaagaggaacacatatttattacatcaggcgtccagcaggccctcgccttgctcgcttcaatgccttttccaaaccggaagcggaaagttctgatcgaacagccgagctatcatttattgattaaataccttgaagttcacggcatccccgcggtcggcatcgagagaaccgccgaaggcatcgatatggacgagctggagcgcatctttcaaaccgaagatatcaaatttttttatacgatgccgagattccacaatccgctcgggacatcctacacggaacgggaaaaaacggccatcgtcaagctggcggagaaatatgacgtctatattgccgaggatgattttttaggagatttggagaatgataaaaaggcggatccgttacattactatgacatttcttcccacgttatttatttgaaaagtttctcaaagattatttttccgggtctgcgggtcggagccgccgtgctgcccgattctctgacaattgtgttcaaccggtacaaacagctgctcgacattgacagttccatgctgtctcaggccgctttggagatctatttgaagagcgggatgtttgaaaagcataagcaaaagatccgttcttcctatcaaaaaagatcatgccttctgcatgatctgctaaaagaatgttccgcgtctctaggggatgtgtttgaatttcatcctcccgcacagccggctatccacacccatattgaattggaccggacgatcccggcatcccgtctgattaaaagcctacaaaaacgggacgtcctgctcgaaccggtcaacgctcattatatgccggcttttccaaaaagaaatctattgaaaatcaatacgtccaatgtgaaggaagaggacatccgcagcggcatcgagcggttgcggcaagcggtggaaaccgcttatttttag

SEQ ID NO: 369 - DNA, 681 bp, Bacillus licheniformis
atgaagatttacgccgtttatatggatcagctgccggaagccggtcaatttaaccgaatgatggccatggtgtctgaagaaaagcgaaaaaaagtgggcagatacagatatcccgaagatgccagccggacgctgatcggagaagtgctggcgaggcacatcatcagcgaaacgtttcatttgccgaatgagcagatccgttttacagaaggaaggtacggcaaaccggctgctgaaggtctgaacgactttcatttcaacatttcccactccggaaaatggatcgtgtgcggagccggcgcgcagccgatcggagtggatgtcgaaaagatcaagccgatcaatttcgacattgccaaacggtttttttcaccttccgagcacgatgatctcatggaaaaggacgaatcagaacgcctgtcgtatttctatcatttgtggacgatgaaagaaagctttattaaacaggcgggaaaaggcctgtctctgccgcttgattccttctccgtcaaactgaacgaacaggggcgagcttcggtggaaactccccccggctatccgccttgctatatacaagcctatgaaattgaccccggctataaaatggcggtgtgttccgccgcacctgaatttcccggccggattgtgatgaaaagctgcgctgaactgtcaatgctttaa

SEQ ID NO: 370 - DNA, 786 bp, Bacillus licheniformis
atgatagacggaacattgataaaagatacatgcttcgggagggagcttttgatctatcttcctccttcatacgggagcggtgaaaaccgctatcccgttctatacgtccatgacctgggagatttattcgatccggcatacagcaacagtctgcgctcaatcgaaaagctgttttcgagtcaggaagtgccggaattgctgctggtcggagtggctccaaaagacagggaaagcgaatacacgccttttcccaagcggcatttgctgccgaataaacgggagtacggcgggaagggcaacgaatatgccgcttttttggccaatcggctcaagcctcatatcgaccggcactaccgaacaaatccgagccgtgaacaaacaggaatcatcggaaagtcgttcggagggttgatctcggtttacacagcttttctagcatcggagacctttggaaaaatcggatctttgtcaggttctttctggtttgaaggaataaccgagtttatgaagaataaccgctttgagaataagcatctgcgcatttatatggatgtcggaagcacggaagggacagacagggataatctgcagaaagagatgataccgaggacaaaggaagccttcagcctgttaacagaaagcgccgcctccgaaaaagaactgaaatttgtcattgatgaaggtggctcacatcggcttgagcggtttgcgaagcgttttccggaagccgttaaatggctgtttggctcctgtcacaacagcgcacggaatggcaggagtttctga

SEQ ID NO: 371 - DNA, 384 bp, Bacillus licheniformis
gtggttgatgctgcttttaaatacggctacagcacaccggaatcattatcgggaggccttcagccgccttcacggcatcagcccttcacaggcccgagaaaaaggcggacgctcagggcatttccacgtctatcctttcatattcaaataaagggagtggaggatatggattacaagattgttgaaaaagaaccgtttcaggtgatcggcaaagcgttggaggttacggtcaaggatggtcaaaacaaaaaggatattccggctttttggaacgaattaaatcacaacggctttaccgattctttaaaaccgcacatcggcccgcttggcttccttggcgtctgcatggattttaacgatcaacccgatacgttcaatttttga

SEQ ID NO: 372 - DNA, 663 bp, Bacillus licheniformis
ttgaagcgggaacttgttttgcgctggcttttttattttgtcggattgattgttttgtctttcggggtttctcttacgattgaagggaaagtgctcggcatcggtccttgggatgcgtttcactacgggctgtatatgcttttgggccttacggtcggccaatgggcgattattgtcggggcggtcatcgtaggtttaacgtccttatttacaaaagcatggccgaaaatcggcgccgtgctcaatatgctgttaatcggtatttttatagatttctttacttatattcttccagacccggaaacgtatatttcaagcactgtcgtattcgtgatcggcgttatttttatcggttacggagtcggcatttatgtatcggccgatctcggtgcgggtccgcgtgactccctgatgcttttgatttccgagaaaacgggctggaacgttcagtgggtccgaaacggaatggagctgacgattttattgatcggctggctgctcggcgggccgatcggcatcggtactgttttaaccgccattttaaccggcctgattttgcggttttctttgccgcagtccaaacagcttttaaaagcagcaatggcaggaaggcgcatcagagctgccaagcctgtacatatgtcgctgaaaaaaaacggatga

SEQ ID NO: 373 - DNA, 531 bp, Bacillus licheniformis
atgaagaaactttatattagtgctgtcctgggtttattgtttgtttttgttggtggaacaaaaatacatgctcaagaaccacagaacaataacggggttttggatgagaataaattcattgatgaaacagtgtattcatatacgcagccaattagcatacaggatggtgaagtaacaacacaagcgaaaaaatatatcaaaaccgtgtcagttaataggagctataaaagtcttttaaacattgtagttgccagacattactctgatactactttcacttacggaagcggtaagttatataagagtcccagagctttaagtaatgattggtggacacttcctccgaattttaaatcaggaagctctaaaagctgggactggtacaatacagggaaaggtgcaacaggacgttctaatttacaagtaagatacacttggggagttccaacaccatgggggccagttggatctaattatagctcaagaataaaggtttcatttaaatcaaatggcagttggtatacaaattaa

SEQ ID NO: 374 - DNA, 549 bp, Bacillus licheniformis
atgggtacaatagggataaactttaaaaacattcaacatcaatatcgtaccaaggatgtgctaaggggggtgagtttccatgccgatccctcctccatcacgttcttggcaggcgagaatggagccggaaagacaactttgataaaggttgctctcggcttaatcagtccgaaggcaggaaatgcgctgttcgacgggcaaagcgtcggggaaatccgggagaagatcagctgcgtgtttgatgagcctcctgtttatcctaatgaaagtggtcttgacaatctaaagtttttatcaggtatacacagccttgatcgaaagtggagtcaggaggtttgtgccatgctcaaattggatgagggacttttaaaacaaaaagcaaaagcgctatcactgggtcaaagacaccgtttagctgtagcggccgcgttattgcgcaaacctaaatatttgtttcttgatgagccgtcaatcggcctcgacccaccgtcatggcagctggtccaaatcgctttaaaacagatgactgccagggatgtgcaattttga

SEQ ID NO: 375 - DNA, 327 bp, Bacillus licheniformis
ttgcaaagtggaaaaattatcttctccggtcctattgtaaaacttgttcaagcatttcccgtatatgttcgaattgtaactgatgaccatcgggaaatagctgtgcagtttccagaagctgaacctgattcttccggaatataccgcatcgtttgcgaatcaggtgaacaggcccgcgccgtgattgatcaggtgaggagaagcaccctgaattttcaagagctatcgactgaaaaagcgtcaatggggaaaatggtgacagatatttacaaggatggatttcagtcggaaaagagagggttaacgtatgaatccgttcaaaattga

SEQ ID NO: 376 - DNA, 900 bp, Bacillus licheniformis
atgaatccgttcaaaattgaaacgaatcaattgaagaatagcatgcttgtgagggtttgtatcgcgttattattttgttgctttatctgggggcttctcactttatatcaaagcgctgaaggcgaggaacgcagacaggaaaagattcaccaatccgtcattgatgaagtgaaaaagaatggggcggaggaagagcttgaaaacggcggattggagattgaaaaaaatgatgatatagcgcgtagtatgtacataggacttcatccaagtgttactcctaatctgtttttattaatcctcgcgaacattgggccaattgtttttattataatcggatctcaccttgtcggaagcgaataccatcaggggactgtgaaaatgaaagccgctcacatcggatggagaaaagcggtttctggaaaactatgcgcactgttaagtctggttattgttatggttattgcagctttattgcttggactggcaggcggttggctggcttggacgttcgccacggcacattcagacttagccgcttctcttgaagtgaatgcagctgtctcctatccgatattaattttgtttttaatgatcggattgacattttacagtgttctaggaatgactgtcacgctgttgacgaaaagccggctggcgggtgtgctgatcagcttggcgatcccgtatgctgagcaaatgatgagtctgccttttttgccattgactgcttatcaatccctcatggttcaccattttatttatgtcgacggaagcatcatcggccagccctatttgacagagccgatgggcgaaccgggcgcttgggctgttcttgtatgctggctctttgttgtcattgcggttcagcagtttgcagcgaaaaaacagcagattttatga

SEQ ID NO: 377 - DNA, 180 bp, Bacillus licheniformis
atggcgttgatttttttagttaggctgatctgtcttgcctttttagcctgtctggcgctgttgttttatgcaccttttctggcgatgcccgtttggatcgctttgatcattgccttaatcgtctgtctgtatcttgcctttatagaggaaatgaaggaatggagaagacgaaagcactaa

SEQ ID NO: 378 - DNA, 1662 bp, Bacillus licheniformis
atgcagcaacgcaatacaccggatgtacagagatggtttccgagcgaggacggaaatgaagcaaaacgaaacgagttcctatcattgatcgagcagctgatcgagggagtggacaacctgaaaaatccggatcaggtcaaccttggcggcgagaagaaccgagagggcttcttttatgaaaagctggttgcagagagtcggattccgcatgaaggtgcgccgatgaaagaggttaacgaagagctgttgaagctgttgcacggccatccgtatcacaccaaatactttttcacgaacattctgccgatggccagcatcccggggatattaggcatgcttacggcgtttatggtcaatggcaacaacctgtgggatgtgtacggtccagccggagcggaggcggaagtgaaggttacagcgatgatgtcaaagcttgctgggtatgatgccgaaacaagcggaggatatacaacgtggggaggacaaggggcggtatacagcggcctcagaatcgcgattgccaaaatggctccgtcatccctaaaagaaggggttcccggcaatttctatgcgttttgttctgaagcggctcattacagcttgtataagtcgatggaagccgcaggactcggcagcgatcatttaattaaagtcaaaacaaatctcgaccattccatggatacggaagatttgcgagagaagcttagacaagtatgcgaagccgggggcattcccgtctatatcgtagccacgacgggaacgacagatgcgatcggcatcgatgatgtgagcgctgtccgccgtgcggctgaagaaaccgcgaagagcttcgggctgccggttccgcatatccacgccgattccgccctgggaggattttttgccttttttaatgagtacgatctgaatgagaacgctttatccttcagtcccggtgtcctcagcatgatcaaaccgattcaggaaaaaatgaggcatctgcatgctgccgattcgctttgctttgattttcagaagctcgggcagacgccttatgtgacgagcctgtttcttgtgaaggatcgcaatgacttaaaacggatcgatctggatcccgatgagacgccgtatgtcggccaccgcggctatggggactaccatacgggctacacgctggaatgttcgcgcatggccagttcgatcagtatgtacagcgcattgatggcatttggctatgaaggctatcaaaagctgcttgcccagttccttgaagtcaacctgcattttagggaacagctgtctcggcagattccggaggccgatattgtgaacccggacaactgcggcatgtctacgctgtttcgcatttatcctgaaggggcgcctagatttgaagacgaaatttcgggagcatgcaccattgaagagctggaaagaaacaatgcgcttactgaaaaattatttgaaaagctcggaacaaaaagggacaagatgttttttggcgatacgaaaaaacacttgcttgtgaagtcctgtgaaggggttgaattaccgctttgcgtcagcaaatttttcgtcatttctccgtataccatgcctgaacatgtcccgggaattatcgattatttaaaagaaactattgaggaagtcttccgggagcatgggtctctcatgacaaattaa

SEQ ID NO: 379 - DNA, 1725 bp, Bacillus licheniformis
atgaaaacgttgaagaaaaagctaacagaacacatttcagtcaaaattatgattggcgtcgccttagtgcttttaatcacgatcgcatcattttcagccgtgtttacttttatcagcaaagacttgtcagagcagctgaaacagcagttccaaaaccgcctttataccgatattcatcttgctgaaaatcaaatcaaacgtctggacgggaatccgcttgagatcgattccgcagacggtccgctttacaagcagacaaaaatggctgtggacagcctgaaaaagaaaaacaaacttgagaatatttatatcctttccaatgaaggcgggaaggagcggattctcgtgctgtcggatacgcccgatgatttcggcacggattacagcttttctcctgaaatgaaagaagccttgacgacaaacaaagagacggtaagcgacgtgtatgaggacgaatacggcatccaccagtcgatttttctgccgcttgagaacggctcaggagaaaaggtgggaattttggggatcgaccttgatgcttccgtgattccggagacagcggcaaaagcgaaatggtatacaattgcgatctcagcatttgtcttgctgctcggaatggtcatggcctattttctcggttcttacatcgcgaagccgatcaggcagctgatgaaggcttcagaaaaaattgccgacggcgatctatcggccgacatttctgtcaagagccgggacgaagcaggaaagcttgccgaatcgttcaagcggatgagcgaaaatttacaacaattgattggacatatttcagcttcctctgaagaggtatccaagacgagcctgcagctgaaaaatgtatcggctgaatcgagcgaaagcgcagctcaagtggctgaatcgatgaacagcatgagcgagggaatcaacgaggttgtctcttcagtttcggattgtcatacatcggctgccgaaatcgatcagcagcttacacatgtcacagaaaaagtgaacgagatgaagaacgttgccgagggcgtcagcaaggattccaagacggggcaggagcttgtcgaagaaacattgcggcagacccagacgattaaaaacgtgatggaagagtcaaaacaagcggcatcagagatgcaaaaccatacagaagaaattgaaaaagtcatcggaatgatttcctctattgctgaacagacgaatttgctggcgctcaatgcttccattgaagccgcccgggtcggtgaggaaggccagggctttgcggttgttgccggagaagtcagaaagctttctgaacgttcggcagatgccgctttatccgtttcccagcttgtggcgggcacgcaggagagcagccggcttgtcatggaacgcattcaggaaggaaacgaagcggttgacaaagggcagattttaatcaatggcacatacgagaatttttcaggaatttttaaaggaatttctcaattcgccgaacgcacagatcaattgcttcagtccttgttaaaagtcgaaaaatcgtatcaaaccatttcgtctgcgatggagcagatttccgccgttaccgaagagcaggcggcaggctctgaagaagtcgctgcggcagcggagcagcaaagcgccggcatgcaggaaatcgcatcggccattcagcagctctccgctttgtcggaagaattgaatcaggcggcatccaagtttaaactggccgctgaataa

SEQ ID NO: 380 - DNA, 744 bp, Bacillus licheniformis
atgcttgcgatcaaagggctgaataaatccttcggcgaaaatgaaatcttaaaaaaaatcgatctgaacatcgaaaaaggaaaagtgatcgccattttagggccttccggttccggcaaaacgacgctgcttcgctgcctgaacgctttggaaattccaaaccgcggcattctttcttttgacgatttcaccatcgatttttccaagaaaaataaacctgctgacctcctccgcctgcggagaaagtcgggaatggtattccaggcctatcacctgttcccgcaccgcaccgtgctcgaaaatgtgatggaagggcctgtaaaagtgcaaaagcgcaataaagaagaggtcaaaaaggaagccgttcagcttctgcaaaaggtcggccttgaagacaaaatggatctctatccattccagctttccgggggacagcagcagcgcgtcgggatcgcccgcgccctggccatcaagcctgagctgatgctttttgacgagcccacatcggctctggaccccgagctggtcggcgaagtgctgaaagtcatgaaagaccttgcaaatgagggctggacgatggttgtcgtcacccacgaaatcaaattcgcgcaggatgtcgcagacgaagtcgtctttatcgacggcggcgtcatcgtcgaacagggcccgcctgaacaaattttctcagcccctaaggaagaacgaacaaaacagtttttaaaccggattttgaatcctgtataa

SEQ ID NO: 381 - DNA, 714 bp, Bacillus licheniformis
ttggcgaagatgtttctaagtaatatacaagcggcggccatcggccaggcgatcccgtgggatcttgtgcgtgagtcattttggccgatctttttaaggggaatctattactcgattccccttgccattctctcttttatattcggtatgatcatcgcattgatcacggcgctggcgagaatgtccaaatcccgcattttaagagcggttttcggcatttatgtctcagcgatccgcggaacgccgctgctcgttcagctgttcattattttttacttgtttccagcgtttcaagtcacgatcgacccgtttccgagcgcaatcattgccttttcattaaatgtcggcgcttatgcgtcggaaatcatcagggcttccatcctttccgttccgaaaggacagtgggaggcggcttattcgattggaatgactcaaaaaacggcgcttaccagggtcatcctgccgcaggctgtgcgcgtgtcaattccgccattatccaatacattcatcagcttggttaaagatacatcgcttgcgtcacagattcttgttgctgaattattccggaaggcccaggaaatcggggccggcaatcttgaccaaattttaatcatttatatggaagccgcattcatctattggatcatctgctttgttctcgcgcttgttcagcagcagattgaacggcgtttggaccggtatgtggccaagtaa

SEQ ID NO: 382 - DNA, 807 bp, Bacillus licheniformis
atgaagaaagcaatattcgctgtattattgacgctgttgatcaccgtgatggccgcatgcggcgcgtcaggggacaattccaaggataaaaacgcagccggcgacagcctctggtcttcaattaaagataaaggcgtattgacagtcggtactgaaggaacgtacgaaccttttacattccacgataaaaaaacagataaattaacaggttatgatgtcgaaatgatgcaggaagtcgccaagcgcctcaacctgaaagctgaatttaaagaaacgcagtgggacagcatgtttgccggactcaactcaaagcgttttgacgtcgttgccaaccaagtcgggaaaaaagaccgtgaagatcagtacgatttttctgattcatatacaacttcccaagccgtcgttgtcacaaaagcggacaacaacgatgtaaagtctgaaggagatgtcaaagggaaaaaagccgcgcagtctttgacaagcaactataatgaccttgcgaaaaacgccggcgctgaaatcgaaggcgtagaaggaatggctcaagcgtttcagctgattcagcagggccgtgtcgacctcacctataacgataaactggcggtgctgaactatttgaagacgtcaggaaacaaaaacctgaaaatcgcttttgaaacaggcgagccgcaaactacgcattttgctttccgcaaaggaagcggcgaactggttgacaaggtcaactccgcgctgaaggacatgaaagaggatggcacactcgcgaaaatagcgaagaaatggtttggcgaagatgtttctaagtaa

SEQ ID NO: 383 - DNA, 1413 bp, Bacillus licheniformis
ttgctgaaggattatgattttctgaaacttatttttcaaggaattatagatgaaatcgatatcggcttgcatgtcgtcgatgaaaacggcacatctgttgtctataacaaaaagatgagccagattgaagggatggatgtcggcgatgtgctcggcaaaaacgtgctggacgtgtttacgtttgccagccagcatgacagcaccctcctgcaggcgctgcatcacgggaaaacgaacaaaaacgtcaaacagacttactttaataacaaaggacaggaaattacgaccgtcaatcatacattccccattatggaaaacgggaatacgaaaggagcggtcgagattgccaaagatgtcacaaagcttgaacgcctgatcagagaaaatatgaacaaaacagaaagcacaaagtatacgtttgacagcctgatcggcgtcagtccggcgttcaaggaagtcattgaacatgcaaagcgggcgacccggacctcttcctccattctaatcgttggcgacaccggaaccggaaaagaactgttcgcccaaagtatacataacggaagccagcgctcaacgggcccattcatctcgcaaaactgtgcagccctcccggaaagccttgtcgaaggcctattattcggcacggtcaaaggcgcattcacgggagccgtggatcgtccgggtcttttcgaacaagctgacggcggaacactgctccttgacgaaatcaattctttggacttcagattgcaggcaaagcttttgcgcgcgattcaagaaaaaacgatcaggcggatcggcgcttcaaaggatactccgatcgacgtcaggatcatcgcgacgatgaacgaagatccagtcgacgctgtcagcggccagaggctgcgaaaagatttgtattacaggctgagcgtcgtcaccttgtttattcctccattaaaagaccggaaggaagatattatgccgctcacgcagcattttatcgacaaatacaacgcattgttccaaatggaggtcaagggttttgaagaagaggtgcggcggttcctgctttcatacgattggccgggaaacgtcagggagcttgaacatttaattgaaggcgccatgaatttgatgtcctacgaagacaaaatcgagctgacgcaccttccattgcaatacaggacgaaaccagcggcaaaagagcagctgccgcagcagggctatgatctgttcgccccgcttccttccgcctcggccgctcctttaaaggaacaaatcgagaatgccgaaaagtattatattcaaaaaaccgttaaaaaatgcaattacaatgtgtcacaagcggctcgggtgctggggatcagcaggcaaagcctgcaatacaggcttaaaaaatggaagatccgcttcgatcaggaatcagaatga

SEQ ID NO: 384 - DNA, 1203 bp, Bacillus licheniformis
atgacggttctatcaaagtccgagaaaattatgaagcaaaccgcacattttggcgcgaataactatcatcctctgccgatcgtgatttctgaagcggaaggcgcgtgggtgaaagatccggaaggcaaccgatacatggatatgctgagcgcttattccgcagtgaatcaagggcacaggcacccgaaaatcatccaggcgttaaaagatcaggcagacaaaatcaccctgacttcgagagcttttcacaatgaccagcttggtcctttttatgaaaaggtcgcttcattaacggggaaggacatggttctgccgatgaacaccggtgcggaagcggttgagtccgcagttaaagcagcgcggcgctgggcttatgatgtaaaaggcgttccggacaatcaggcggaaattatcgcatgtgaaggcaattttcacggccggacgatgctggctgtgtcgctatcttcagaagaagagtataaacgcggtttcggaccgatgcttcccggcatcaagctgattccatacggggatctggaagcgctgaaacaggcgatcacaccgaatacagccgcttttttaattgagccgattcaaggtgaagcgggaattgtcattccgccggaaggctttttgaagcaggctgctgaagtctgcaaagagcgcaatgtcttgtttatcgccgatgaaatacagtcagggcttgcacgtacagggaaaatgttcgcctctgattgggaggacgtcacaccggatatgtacattttaggtaaagcgctcggaggcggcgtgttcccgatatcgtgcattgcagcaaaccgggatgtgcttggcgtgtttaatccgggctcacacggatcgacctttggagggaacccgcttgcatgcgccgtatcgatcgcagctcttgaagtgctggaagacgagcggctcgctgaacggtcgctggagcttggggaatactttaaagaaaagctctcgcaaattgataatcctaaaatcaaagaagtgcgcggcagggggctgttcatcggggtagagctgaccgaggcggcgcgtccgtattgcgagcgcctgaaagaagaagggctgctctgcaaagaaacgcatgagacggtaattcgctttgcacctcctcttgtcatttctcatgaggatctggattgggcgattgaaaagattacccgtgttttgtcgaagtaa

SEQ ID NO: 385 - DNA, 1446 bp, Bacillus licheniformis
ttgaatcatgaaaaccgtgaacaatatacactgaaacgaacgatgaaatcccgccatttgtttatgatctcgcttggcggcgtcatcggaaccggcttttttctcggaacaggttatacgattaatgaagccggaccgatcggcgcgattctttcctatttagcgggcggaatgatcatgtattttacgatgctctgccttggggagctcgctgtggcaatgccggtttcaggctcttttcagacgtacgcgacaaaatttatcgggcctgctacagggtttgccgtcggctggatctattggctcggctggtcggttactgttgctttggaatttttgtcagcggggcagctgatgaaaagatggtttcccgatgtcggcgtctggatatggtgcttgattttcgggctgctgcttttttcactcaatgctttatcggcaaaggctttcggggaatcggaattttggctgtccggcatcaaaattatcgtcattcttctgtttattattctcggcggaggcgcgatgttcggactcatcgacttgaaagacggacaggctgcaccgttcttttccaatctgattggagacggaatttttccaaacggattcggcgcgatctttatcacgatgatcaccgtcaactttgcctttcaggggacggagctgatcgggatcgcggcgggggaaagcgaaaatccggaaaaaacggtgccccgctccatcaaacagacggtctggcggacactggtgtttttcggcctgtccgtatttgtactggcgggattgattccatgggaaaaagcgggggttgttgaaagtccgttcgttgtggtatttgaacaaatcggcattccgtatgccgccgatctgatgaactttgttattttaattgctttgttatcggtggcgaattcgggcttgtacgcatcgacgaggatgctttattccctggcgaaagagggaatggccgctcaggctttaagccgggtcaataaaagaggtattccgatgaatgcgctttggatcacgctcggttttgcgggtttgtccctcatctcaagcgtagtcgcagcagaaacgctctacatttggcttttgtctctagccggtttaagcgcgcaagtcggctggatcacgattacggtatcacagctgctatttcgcagacgatatgtcaaagaaggcggaaaggttgaagacttaaaatttaaaacgcctctttatccttatttgccgctgacgggatttattttaaacagcgccgtccttgtgagcctcgcttttgattcagagcagaggatggcattgtactgcgggattttattcatgtcggcctgctactttgtttatcacgtgtttgtgaaaaaacgccaggctcttgatcgacaagaagcaatgatctatcaaaacaaaacaaacgatgaggtggttattgatgaataa

SEQ ID NO: 386 - DNA, 894 bp, Bacillus licheniformis
atgaataaacaagtttctttgattggaatgccgatggacttggggcaggcgcggcgcggtgtggatatgggaccgagcgcgattcgctacgctcatatcgtggagcgcttaaacgagctgggctatgatatcgatgatctgggcgatgtgccgatcaaccgcgatcagccaaaaggagacgaagggctgaaaaatttagtttccgtactggaaggaaaccgcaagctggccgatatcgtcgacaatgtcgtcgagcagcgccgcttcccgctcgtgctgggcggagaccacagcattgccatcgggacattggcgggtgtagccaagcattatcaacagctcggcgtgatttggtatgacgcacacggagacctaaatacgcttgagacatcgccgtcaggcaacatccacggcatgccgctggcggtaagtctcggtgtcggccacgaaaagctggtcaacctccacggctatgcgccgaaaatcaaaccggagcacgtcgtcatcatcggtgcgcgctcgcttgatgaaggagagcgcaaatatatccgtgaaaccggcatgaaagtctataccatgcatgaaattgacaggctcggcatgacgaaggtaatggaggaaacgatcgagtatttgtcagcaaattgcgacggcatccatctgagccttgatctggacggtcttgatccgagtgacgctccgggagtcggcacccctgtcgtcggaggcatcagctacagggaaagccatttggcgatggaaatgctctatgacgcagatatcattacatccgccgagtttgttgaagtcaacccgatactggatcataaaaataaaaccggtgaggcggccgtcgaactgatcgaatcattgttagggaagaaactgctgtaa

SEQ ID NO: 387 - DNA, 873 bp, Bacillus licheniformis
atggatattcgccagttaaaatacttcgttacaatcgcccgggaaggaaaaattacaacggcggcgaagcggctccatattgcacagccgccgctctccaggcagttgaagcagatggaagaggagctcggagtcgttttatttgaccggaacaaaaagaaaaacctgacgttgacctacgaaggagaagtttttttgaaaagagcaaaagaaatcctgcacaagcttgaggattccatcttggaggtgcgggagctgcgtgaagaagtcaacggaacccttgccgtcggctcgacgatttactgcgcggccctgctgctctcaaaagtctcgaagatcagagatatgtatccgaatttaatgtttaacatttgggaaggtgagccttcacggctaagcgagctcctggaaagccggcagatcgatgcagccgtcacgacaacgcctatccacagcaaaaacaccgaatcaaaaagcctgccggaggttccatgcaagcttgttcttccagggaatcagtcgtatggcttaaaaggagaagccggaatgaaagaaattgccggcctgccgctgattctgctcaggccgtcgcacggaaaagggatttacgacgaggtcgtccatcactttcaatcatctggcctcgaaccgagggtcgtttgtgagtgccatgattctacaacgcttctcagcctcgtcacttcgggattcggagcgacgattctgccgctgtccatgctgccggcgcattttgcacggcatgttcagacattggaaattcaaaacaatccgttcattctgcagccgtctgtcgtttggagggccggcagttttctgccgaagcctgtgagagaatttttggctttattttga

SEQ ID NO: 388 - DNA, 570 bp, Bacillus licheniformis
atgaacatcatcgtcggaatcacgggcgcgaccggcgcggtatttggcgtgcggatgctggagtggctgaagaaaaccgacgcagagacacaccttgtcatctctccgtgggcagcggcaacgatcctgcacgaaacgggatatacgatgaaagacgtggaaaagctcgcatcttttacgtattcccacaaagaccaggcggcccgcatttcaagcggttcctttcaaacggacggaatgattgtcgcaccgtgcagtatgaagacgttggcgggcatccgcaccggtatggcggataacctcttgacccgttcggcggacgtcatgctgaaggaacggaaaaagctcgttctgttaacaagggagacgccgctgaaccagattcatcttgaaaacatgcttgagctgacaaaaatgggggcggtgatcctgccgccgatgccggctttttataatcatccccaaaatctgaccgaaatggtcgatcatatcgtatttcggacgctggaccaatttggcatccatctgtctgaagcgaagcgctgggaaggtatgaaacaggagaaataa

SEQ ID NO: 389 - DNA, 1422 bp, Bacillus licheniformis
atggcttatcaagattttagagattttttaaatacgctgaaaaaagaaggacagcttcttgaagtccaggaagaggtgaagccggaacccgatttgggagcagctgcacgcgccgccaacaacctcggagacaaatcacccgctcttttattcaacaacatttacggctataacaatgcccaaatcgcgctgaatgtaatcggctcctggccgaaccacgcattaatgctcggccttccaaaagacacgccggttaaagaacaattctttgagttcgcgcgccgttataatcagtttccagtaaaagtgcaaagagaggagacagcgccgtttcacgaaaacgaaatcacagaagacatcaacctgtttgacattctgccgctcttccgcatcaatcagggcgacggcggcttttatttagacaaggcatgcgtcatttcgagagatgtcgaggatccggaccacttcggcaagcaaaacgtcggcatgtacagattgcaggtaaaaggcaaagaccgcctcggcattcagcccgtcccgcagcatgacattgcgatccacctgcgtcaggctgaagagcgcggcgaaaacctgcctgtcacgattgcgctcggctgcgaaccggttattgcaacggcggcatccacaccgctcttatacgatcaatcagaatacgagatggcaggggccctgcaaggcgaaccatataaaatcgtcaaatcaaaactgtctaacttagatatcccatggggcgcagaagtggttctcgaaggtgagatccttgcgggcgaacgcgagtatgaaggtccgttcggcgagtttaccggccactattcaggcggacgaagcatgccgatcatcaaaatcaagcgcgtctgccaccgcaacaatccgatttttgaacacctgtatttaggcatgccttggactgaggttgactatatggtcggcattaatacatgtgtgccgctttaccagcagcttaaagaggcgtatccgaatgaaattgtcgcggtaaacgcgatgtatacgcacggcttgatcgccattgtatcaacgaaaagccgctacggcggattcgccaaagccgtcggcatgcgcgcgctgacaactccgcacggcctcggctactgcaaaatggtgatcctcgttgacgaagacgtcgatccgtttaacctcccgcaagtgatgtgggcaatctcaacgaaaatgcatccgaaacacgatgcagtcatcatcccggatttatccgttttggcgctagatccaggttctgaaccggcgggaatcacccacaaaatgatattggacgcgacaacgccggctgcaccggaaacaaggggacactattcacagccgctcgattcccctataggaacgaaagagtgggaagcaaaattaatgaatctgctaaatcaataa

SEQ ID NO: 390 - DNA, 456 bp, Bacillus licheniformis
atggctcagctatcaaacgaactatttcagcttttaaacggagagaagctcgccggtaagcggcacgaagcgatgatgctccagaccgtcacagaagacggctggccgcacacggcgatgatcagcgccggcgaaatccttgccctgaacaaaaccgacatccgcctggctctctggcaaggcacaacgacgaccgcgaatattgcgagaacaggacgggcgctcttcgtcgcttgctggaaaggcaaagcacattatgtgcggctgtctttaaagaaactgcccgaattaagagacgccaaacacccgagagcgcgcttcgccggtacggtcgaagcggcccgggaagatatcgcaaaatacgctgatatcatctccggcgttcagattaagctgaaggatgaagcggcggttttgcggcggtgggaagagacgctgggggagctgaggaaatga

SEQ ID NO: 391 - DNA, 447 bp, Bacillus licheniformis
atgtctaattttctacaaaaaccaagaaacaaagccatcttatccgtctacctgtttttcgtatgcggctccgttctaagcgccgttctgaatccgaagatgagcatcggggaaaagctgtttatcctctgttttaatattttctcggcaactttattcgcatttctcatttatctactgctaaataaattgatgaaagatgaagaccgcaaacacccggcagatcccgaaaaaaacgggattaatcaagtgatttggaaaaaatacaaaaagcctctgatcctgtttgtttattttggcagcctgtttgccgtctgcgctgctattcttcccatgccgatatataccgttgctgaaaagctcgtgatcctttcgatcgccattatttttattacaatttgctgtatcctggcttataaagtgacgaataaaatgctgcagaaataa

SEQ ID NO: 392 - DNA, 342 bp, Bacillus licheniformis
atgtcaccagaaacttttgttgaatataccgaatacttaatcgccggtatgttggccgctcatttcgcttacagtttgtgttttttaatcattgcgagtcatatgatcattgaatatgaaaaaatgatctttttaaaacctgaaaaacggtcccataaaatcacaaatacattcgtttttcttcttgtcggcaccggctactttgtttacaaacggctattaagatacaactggttcctgagaaaactgtatttcgccctttatcttgtgggcagaggcatcttaagcatcatcatcttttatattttttcttttctggtccatctcattttcagcgtttaa

SEQ ID NO: 393 - DNA, 447 bp, Bacillus licheniformis
ttgaaaggcagaaataaaatcattttcttagtttattccctatatgcaacaatcatcattttggccgcccttgtcaaacctgcaatcaactggaaggaaaggcttgccgtcatcggctttatgttcgtttcaatttctttattcacattcatcatttatgtgtttataaataagccgaagaaagatcaaagcgcgccccgatgcaacatcgtcgcgaaaatcttttggaagaaacacagaaaaccgttcacgctctctttctacttcgtcggcatactgattgtgggaatatccgtgttttccatgtccgaactctcactcgcttggaaatccggcatgtttgcgattctgtttgccgtgatatcgggcaatttttttgcggtttatcaaacggcgaatcaaatgctgaaccggtcttgtttggaaagaatgcctgacgaagaatga

SEQ ID NO: 394 - DNA, 681 bp, Bacillus licheniformis
ttgctgagattaaaagaaacggttgtatacaaagatttaccttacaatattcaatctcatttgaaggctcccgtcagccgggaaacgaaatggggaatggcctgttttatcgtgttggtgctggatattctctgcatattacctgtgctggcgagcaaagtcgaatttttcacttttgccgtcctccctgtcgctattctgatcaatgtttggatgatcctcataaataccagaaacatgaccgaatatcttcatcaccttcaatatgttcggtttatgggcgtatctttcagcggtatgtcatattgccagctgatcacggcgcaaaaaatgatgttttctgccatcggttttcatttaccgttgatcagtctgtcactattcatatatgccgcctctatcttcctcgtcattcggtattacttggctgtattccctgatcctaaaagaggcaaaagggagacagcagctccgacagggatgcttttggcggctgttccggcggccggttatatgataagtcatgctgttttgcgagtttcagagtctgccgtctatttgttgatgagtatcgtctatctgcttatggcttgtttattttctataatgggggtcaaattcatccacaaatacttcttcatcaaagcgaatcaagatatcatcagacagcataggatttaa

SEQ ID NO: 395 - DNA, 804 bp, Bacillus licheniformis
atgaaacacctcatcacatgtacatcagaagaactagcgcttttagtagggttatgtgactatcctggtgttgcaaaaggaattcttgaatcatcgttaggaaaaaaatcaaaaaaagaatgggatgcaatcttagaggcaactgtcaaccagctcattttaaaacaatactgggacgaagaaaaaagttcaaaagacgaaaatcctttaagcgaagaaatgcagaaattcatcgtttcctatgtgaattcagaacaaatgatccgctgttccaaccttgacaataaaaacactttaatgcttcaccattttgaaaatgaaacatggcttttccatatgattgaccgcgatatcatccatgaatttgcgtatgtcgacgagcaggaaattgcccagctgatgaaagactattaccacttttcaactgatgaggaacatattcctttaaaatttcgtctttcagataaatgctttgactggctgagtaataaagacatgacagaaaaggttcggaagaaaagttctttttcacctgaggaagaacatagctttaatcaattgatagccgatcttgaagcaaaccaatggtcgctaaacaacatctcacatttttacatccctagcttaaacgatggacctttcttgcaaaatatcgtcttttttattccatctgcccgtggcgtttgggttgctcagtatgatgaacacaatgaaaaacctgtacatatttcattaaggacacttgagcaatggaacgaattattaaaagggcttgagtatacagtatcttttcaaaatacataa

SEQ ID NO: 396 - DNA, 342 bp, Bacillus licheniformis
atgacgccgaaagtatttgttgaatatgctgaatatttgattgctgctattttaagttctcaatttgtatttggactttgcactttatttcttgggtatataactatgaattattatgagcaggggactttcagacccccctcaaatatatttaaaaaaactgttaatttcggttttgcattgatttttggtgcaagttattttacatataaacgactatatagatataacttgttcctaagaaaattttattatgccctttaccttctggggagcggtattttaagtatcatcattttctatattttatcatttatccttcacttcattttcaaggtttaa

SEQ ID NO: 397 - DNA, 1626 bp, Bacillus licheniformis
ttgaaaactctagatgttcaggcttttcaaaccggcctagacaaaacgctgaccgaattaaaaaaccagactgacgagatttcaaaagtcaaacaaagcatcaaaggcctcacctcccttgacgacgccttaaaaggcgcgggcggtgaagcgatccgctcgttctacgaagaatgccacaccacttttcttcttttttatgaatcttttatttccgactataaaggacttttagaaaagacgaaaagtgcgcttcattcccttgaaccgaaccaaaacggctttatctcgcaaagctttcttgagaacgaactccatgacggcgtcagtcaagccgaatcgctgactggcagattgacgtcaaaagccaaccagacgatggccactgtcagccacatcgtcgacctgcccgacctagacgattcagccgtcaacgaaaacgcaaaaaaagcgcaaagacaaatcagcgagacgctcgaaaagctccacaccttcgaccgcgaacagacaaatgcgctgaaagcggcgagagaagacctcgatacgatgaagcaatacatccagcagctggagaaaatgtatacggggccgaagattgaaatatcggaatataaaagcggttcaattttaaaaccgcaaaatgactcaacaatcagtcaagctcccggcggcctgcaaaacgacctgcaaaaccccggcgaaacaccgatggaaaagatgcttgggcgattagaagaaaaagcggcagaaacgttaacgaatcctgatacacaggataaagaaaaaacaaatatagcacacgaaattcttagttacttcgaaacattcggagaaccattagatgtcggtgataaagccttattagggtatcacgcagccaacgcaacagcatcaatcgcgtggacgcgaaaattaaaaatttattatcaaggaggaaaaccgacgaagtggcagcgatttaaaggggaatataaatttcaggtcatgtcacatcgttcttggacttctcaaggagatcacagttcgaaagttgcgagaaccattaaaaacatctctgactcgaatccaagcaacccattacttaaaaaagcgcaaaaatttgtcgcttcttatgatagtccatccatgatgtttaaacatgctgtggggttccctaaaaatcaacatagttttatagatgggaaagaatttcgcaagagagctgccctgaggacaaaagcgggtgcggttgatataatggagtccacagccaaggcaaaagggtttactgcattagaaagaggagtccctattgttggtaccgcagttactttcgcttctaaccttacagaatataccgatcccgagaactcggacaaaagttttgcagaaaaaacaggacgtttcgcagcaggtgttggtacagacatttttgctgtttctacaggtgttgaaattggagcaacaataggaagcgtcggcggtcctgtgggagtgattgttggtggagcgataggcggagtagctggagcaattgctagctcttcatacggtgatgcaattaaggatgctggtgaaaaagttgctggttctattgaaaaaggaattaaaaacagttttgagtctgtgaaaagttggtttaaatag

SEQ ID NO: 398 - DNA, 288 bp, Bacillus licheniformis
gtgattacgatgggtcaagaaatcaaagtcaaaacgggcgaagtcaaacaggcgctctcaaaactgaagcattcagcccaagccgtgaagccgaacgtgcagacagatatcagcggcaaaaacaaccttgacgtcgtcaaaaaaatcgaaagcatgaacaaagatttgaaaagcctgacaaaagcatacgcatcggctctcgctaaacaaattgcgcaaaccgagcaggctgtcaacgccataaaagacgccgacaaaaagctgtcgtcatcgatcaaagccaagtag

SEQ ID NO: 399 - DNA, 384 bp, Bacillus licheniformis
atgatctgggaaaaaacagttttatacgggctgcaaggtacacttctcatcaaaaaacaacagctcgaacaactgaaaaattgccaaactgaattagaagcagataaaaaggaatttgacgattcaaaagacagtatcaaaaagcccgaactgtcgccgacgacatggcagggcagcctggctgattcttttaaaaacgtcagaagcgacatgaaaacggcatataatgatatttgcggaaagcagctaaatgaagtgtttaaacaattaaaggagaaaatctcttctttaaatgatgatattgattcgctaggtaaggatatcagctcattaaaaacgaaaatcgaaaaactggaaaaagaagaaagagaagcccgccgctaa

SEQ ID NO: 400 - DNA, 993 bp, Bacillus licheniformis
atgaagaagctgttagttgtttatgccgtgatgctctgtttgttttttctgtatgtctacgactactcccggggcgataaagccggttctgcagaagaaagcaggaggcctgcggccgcaggcagtctgtccgaaaaatacgtgatggtcacgtttcaatcgggaatcgaatattggaagagcggtctgaaaggctttgaggatgccgcgcagcttttcaacgtctctgtcgagtatcggggggcggcccattatgatgtccatgagcaaacgaccgtcctcgagcaggtgattgcaaaaaaaccggcgggaatcgctgtttcggcaataaacccaaaagctttaaaccctgtcatcgacaaggcgcacgagcagggtattccgatcgttttatttgattcagacgccccgctcagcaaagcttctacatatatcggcacaaataatatggaagcgggtgctgtggccgcaaggcgaatggccgaatttttgaatggaaagggagaaaccgcggtcattacccagccgcagcagtacaatcatcaggaaaggacgaagggctttgaacaaacgatcaagcaaaaatacccgaacatgaaggttgccgcggttttggacggaaaaggggatgagctgacgtcgaaaaaagaagcggcgaagattttggaggaaaatccgtccatcaaaggaattttcacgactgaagccaatggagcgagcggcgtggcccgtgctgtgaaggaggcgggacttgaaggggaagtatgtatcatcggctttgataaagacaagaaaacgctggacggcatcaaaaacggatcgatttccgcgacaatgagccaggacacatggcaaatgggctattggtcgctgcacatgctgtttttctcaaatcaccatctgaagcatgaacgcccgcttccggccgcaatcgacacaggcattaccatcataacgaaagaaaatgtggcagcctattatgcgaatgattaa

SEQ ID NO: 401 - DNA, 1770 bp, Bacillus licheniformis
atgcgaatgattaaacgtttgatcaataatgcgccgatccgtcataagctgatcagccttctcttgttaatcagcatgctgccgacgatcggcctgggcattttatcgggatgggccgttgaaaatattattgaaaaacaggtgatcgaccaaacactgcagctgatcggcgaagtgaacaagacggctgaagtgtatgtcagccacatgcagaacctgacatatttaatatcaatgaatgaagaaatggaagcgttttttagtcataaaaaggaggatggagaggcggattataagcgaaggacgtttttgcagggcctgacttctttatattccgaagcagcgggtattctcgttgtcaatgataagggtgagatgatcagcaatgagatgtatgaacgcacgccgacagatttgacaaaagaaccatggtatcaggcggctctcgacaatgaagggattttcaagatgatcgggaagcctgtcaaccggaatatcagaagccatgtgcactatagggaagatgaggtcgtttccgccgtcagagctgttatcgatcctgaaacacagcatgtgaaaggcgttgtactcatcgatttgaagctgcgcgtcctcgcagaagcgacaaaaaatatccgcttggggaaaacgggttatttgatgatcatggatgaaaatggcggcaatatttattcgccggagacttcgaatctatttctgccgaaaaagtggttccgtcaagaacgttctggatatttttcgaagcggatcaagggagaggaatatcagttcatttatgagacgtcttcctttacgaactggacgacggtcggcgtttttaaagcgggtgaaccggttttcgaagtgaaggaaatccacttgtatgtgcttttgtttttattgacggcggcgtttctcggaatgtcagcttcctattatttgtcccattccatgtcgcggccgattttgaagctgaatgctgtcatgaaaacggcggaaagcgggaatttttcaacattgtatcaggaggaaagggaagatgaaatcggccttttgggaaaaagcttcaatcgcctgatgttcagaatccgcgagctgatgtccgttacagaaagacaggagcgccaaaaaagagaagccgaattaagagcgctgcaggcgcagatcaaccctcactttctctacaatacgctggatacaatcaattggatggcaaggaaaaaaggagcggaagaggtcagcgatctcgtgcaggctttatccaagctgttccgcatttccttgagcaaagggaaagatatcatcccgctgtctgatgaatttgaacatgttgaaaactatttgaaaatccaaaaagcgagataccgcgataaattaaactactcaatcgaaatgaccgggctttgtgatgaccgcctgattttgaagctcgttcttcagcctatcgtcgaaaatgcgatctatcacggaattaaagaaaaaaaggggccggggcatattgcgatcaaaggcatggaggaggatggctcgctaatcatcaaaatcgaggatgatggagccggaatggatgaagagacgctaaagcaaataacggatcaattcaaacacagggacgatacagcgggctacggcatgatcaacgtccatgaacggatcgctcttacatttggcgagccgtacggtataacggttgaaagtcggaaaggagccggaaccgccgtcacgatacggctaccaattttagcaaaagggggaacaagccttgagtga

SEQ ID NO: 402 - DNA, 1203 bp, Bacillus licheniformis
ttgagtgaatgttggcgcgtactgattgccgatgatgaaccgtggattcgggaaggaatacgggatgccgtctcttgggagcgctatcaaatgtcggtgtcggctgaagcggagaatggcgaggaggcttttgagctcgctctcaaacacggtatcgacttattgattgtcgacttgaatatgccgatcgtaaacggaattgccttgatgaaaaagctccgcggcgccttgccccagtgccgctttgtcatcgtgacgggctacgatcagtttgcatacgcgcaagaagcgatccggctgaatgttgatgattatttgttaaagccggtcgatcccgctcatctggaacaagtgctcaaaaagatcagcgtgtcgcttgcagctgagaaaaagaagctgagcgagcaaaagcttgctgagcagcatattcaacaaaacctcggccttctgaaggagcatgttttcagaagctggatcgaaaaccgggcagacgaagaagacgtttaccggcagctcgaatgcctccgtctgccggcgcgcaatcctgaaacgctcggcgtcatcgcggctggacatgtatggaacaaaccgtctgaagccgacaatctgaaagaaaaagtagaacgtttttttattaacgagcgagataaagccgtatttttcgacggagaccgcctgatcgccgcctgtctgtggcgttctgttacggaagccgaacagcgggcgcttgcagagatgatcaaagccgaattgcaggcaagcgcagccgtctgttttgcgaagcttgctgaaaacggccgctcagccccgcaatgctatcagcactgcaggcagcaagtgtcgaaagcattcaatatctcgccggttgtcataagggccaaggagtatatgcaaaagcatttcactgaaagggagttttctttaatacagatggcggatgcgcttcaagtctcgtccgtctatttgagcagaatgatgaagaaggagctcggcgtgacatttgttcagcttttgacggagatgcgcatggatcaagcggttcacctgttagagacaacccctctttcaattcatgacattgccgaacaaacgggctatgatacacagcactatttcagcactgtatttaaaaagacgatgggtgtatcccccaatcagtaccgccgcatgtcgggaattgaaagaacaggaggaaaattgtaa

SEQ ID NO: 403 - DNA, 1080 bp, Bacillus licheniformis
atgaaaaaatgctggctgttgatcactgcaatgcttttctgtctcatcgttaccgcttgttcggggaatcaggcaagcggagggggagacaaaggctacgtcggaatctcaatgccgacaaagtcatcggaacgctgggtgtatgacgggaaatacatggtgaaagagtttgaaaagctcggttataaaacggatctgcagtatgcggaagatgtcgttgaaaaccaagtttcacaaatcgaaaatatgattacaaagggcgtcaatgtgcttgtcattgcttcgattgacggagaagcgctgaccgacgtcctagagaaagcaaacaagcaggatattaaagtcatttcttatgaccggctgctcatgaacagcaaacatgtcgactattatgcgacatttgacaatcataaagtcggggaacttcaagggaaatatattgaagaaaagcttggcttaaaagacaaaaaagggccgttcaacatcgaattgttcgcgggatcgcccgacgacaacaacgcgcatttcttttttgacggcgccatgtctgttttgaagccttatatcgattcgggcaaattaaaggtgttgagcggccagacttcatttgagcaaggggcgacgctcaggtgggacggcgcaaccgcacaatcccggatggacaatttgctgagtgcgcattatacaaaggcgaagcttgatgcggtgctttcaccgtatgacggaatcagcatcggaatcatttcatccttaaaaggtgcgggctacggctcggacaagaagccgctgccggttattacgggacaggatgcagagcttgcttccgtgaattcgatcattaaaggggagcagacctcaaccattttcaaagatacgagagagctggcgaaaaaagccgttgagatggcgtcatccgtcttaaaaggcgaaaaagcggaagtcaatgacacaaagacgtatgacaacggagagaaggtcgttccatcatacctgcttgaaccggtcgtcgtcgacaaagagaactacaaaaaagtgctcgttgacggcggttactataaagaatcggaattagggaagtga

SEQ ID NO: 404 - DNA, 1569 bp, Bacillus licheniformis
atgtccgattgcattttagagatgagaggcatcacgaaggagtttcccggcgtcaaagcgctcgacaatgtccaccttcgcgttaaagcgggcgaaatccatgccctctgcggggaaaacggggcgggcaagtcgactttgatgaaggtgctgagcggcgtctatccgtacggtgcgtatacgggcgacattttatataaaggggaagtatgccaattcaaaaatattaagcaaagcgaggaagcggggatcgtcatcatccaccaggagctggcgctcgtcccccagctttccattgcggaaaatctttttttgggcaatgaacaggccagccgcggcgtcatcaattggcgaaagacaaagctggaaacgctcgaattaatgaaaaaagtcgggcttcaagaatctccggatacgcttgtttcccaaatcggcgtcggaaagcagcagcttgttgaaatcgccaaagctttggcaaaaaaagtgcagctcttgattttggatgaaccgacggcggctttaaatgaagctgacagcgagaatctgctgcagctcttgctcgaactgaaaaaacagggaatctcttcgattatgatttcccataaattaaatgaagttacgaaagtcgcagattcgattaccgtgctccgggacggacagacgatcgaaacgcttgatgttcaaagcgggcaattgactgaaaaccggatcatcagaggcatggtcggcagggagctgcaaaaccgctaccctgacagaagcgccgagatcggcgacgtcatctttgaagtgaaggattggacagttcaccatcctcttcaacaggaccgcaaagtggtaaacatggcggcgttttccgtgaaaagaggcgagatcgcaggaattgccggactgatgggctccggaaggacggagctggcgatgagcatttttggaagatcatatgggaaaaacatttccggcacaatcgaaaaagacgggcgggagctttacatcaaccaccctgaagatgccattaaaaacggcatcgtctatgtgacggaggacaggaaaggaaacggtttgattctgaaggacagcattaaagaaaacattacgctgtcgaaactggataaggtgtcgagccgattggtgatggacgagcggcgcgaacaacatgaagcggaggattttcgccggaaattaaacatcaagacgcccgatatcagccagcggaccggaaatttaagcggaggcaaccagcagaaggtcatgctgagcaagtggattttcgcggagcctgacgttttaatcctggatgaaccgacgcgcggcatcgatgtcggcgccaaatacgaaatctacggcgtcatcaatcagcttgccgaagcgggtaaagcggttatcatgatctcttcggagcttcccgagctgctggggatgtgcgacagaatctatacgatgtgtgagggggaaatcaccgccgaattttccaaagaagaagccgatcaggagaagctgatgaaatatatgaccatccgcatgaagagagggggagaagcgtatgcagacaccggtgcaaacggataa

SEQ ID NO: 405 - DNA, 1212 bp, Bacillus licheniformis
atgcagacaccggtgcaaacggataaagaccgcgctcagcccggctactttcagctgtttcgcgatatgtataagcagaatatccggaaatacagcatggtcattgcgctcgtgtttattatgctgctgtttcaaatattgacagacggaattttgctgagaccgctgaacattacgaacctgattttgcaaaacagctacattctcattttagcgattgggatgatgctcgtcatcatcacgggacacattgatctatcagtcggttcagtcgccgcttttgtcggcgccgtctccgcgatgatgatcattgaaaacgatatgccgctgtttgcggcggtcgtcctgtcgttgcttctgggagcggcaatcggcgcctggcagggtttttggatcgcttatgtcaagattccggccttcatcgtgacgctggcgggaatgcttttgttcagagggctcacgatgatcgtgctggaggggaaatcgatcgctccgtttcctgtgtccttccaaaaaatggcgtccggttttattccggactggctgaacggaggcacgttccatttgacgacgattgtcgccggagcgggtgtgtcgattctttatctcgtatatcagcttcagcagagaaacatgcagaagaaattccaatttgacttgcagggaaaaggtctgtttacagttaaggtgttttttatcatcgccattatcaacctttttacctacattctcgcgacttatgaaggtatacctctcattttgatcacattgttcgtcttaatcgccgggtatacattcgttatgaaaaaaaccgtcatcgggcggagaatctacgcgatcggcggcaatgaaaaagcagccgagctttcaggaatcaaaacaaaacggctcacctttatggtcttcgtcaatatgggcgtcttagcagccctttcaggcttgatttttgccgcccgtctaaacgcggccactccgaaagcaggaaacctgtttgaacttgacgccattgcggcctgcttcatcggcggggcttcggcttacggcggtatcggcacgatcggcggggccatcatcggcggtcttgtcatgggagtcatgaacaacggtatgtcgctgctcggcctgggcatcgactggcagcaggcgataaaaggcctcgtccttctgattgccgttgcatttgatatttacaataagaataaaacttcttaa

SEQ ID NO: 406 - DNA, 1269 bp, Bacillus licheniformis
atgaaacggaaaatacactacgcctggattatcgtttttgtgacgtttttgacgcttttggccgttcaaggagtgcgcctttctttcggagcctttattcagccttgggaagaggaattttcaatggacaggggcacgatttcgcttatttccatgctgagcttcattgtatatggcgtgtcccagccggtgatcggcaggcttgtcgaccgcttcggaccgcggatcattttatccctcagcacgcttctggtcggcttgagcatcttttttacatatctcgtgacttctccgtggcagctgtttattttgtatggcatcatcgtttctctcggcgtcggcggtgcgtcgaatgtcgcgtcgaccgtgatcgtgaccaattggttcaatgagaagcgcgggcttgcattcggcatcatggaagcgggattcggtgcgggacagatgctgcttgtccctggatcgctcatgatgatccactggtttaactggaaagtgaccgtcattgttctgggattgtttttagccgttattgtatttccgatcgtcatcttgttattgcggaaccatccttcggaaaagaatgtacagccgatcggcggcgctcagggcggcgagataaaagaagagccggacgcccagccgaaaaagattccatacaaagccgtttttctcaaaagaacgttttggttcctcgtcttgccgtttttcatttgcggatttacaacaacggggttaatggatacccatcttatccctttttcgcatgaccacgggttttcgaccgaagtaacaagcgccgctgtcagcctgctggccgggtttaacatcatcggcattttgatttccggcgtcgtcgctgaccgctggagcagccggaaaattttgtgctttttatatgccgtaagggcgctgtcgcttgtcattctgttgtcgagccacaactcgatgctcctgctttgcttcgcggttttgttcggtttggtcgactttgcgaccgtcgccccgacgcaaatgctggcaacccagtatttcaggcagtattccgtcgggttcattctcggctggctattcctcagccaccagatcggttcggcgctcggggcttatttgccgggcgtctggtacagccaaacaggcaactataacctgtctttctacctttcaatcgttattttggcggtagcaagcattttgaacatcctgctgccggaacctaaaaaaataaatccaacactgaatcaggaagggcgttccgtccagcaataa

SEQ ID NO: 407 - DNA, 918 bp, Bacillus licheniformis
atggcggaaatcaatcattctacaacattaaaattcagaaagttcaatcgattctatacaaatgtgctcggttttctgaatgaacatatttatgacagccctttttcattgacggaaacccggatattatttgaaattcacaatacggccgattgtacagccaaactgattcaagatacgctcggcctggaccggggctatgtcagccggatcctgaagcggtttgaaaaagaaaatatggtctataaaaagagaagcgaggaggacagccgcaaccactatatctacttaaccagcttcggtgaatccatttataaaaagctggaggccaaagccaatcaacaaatcgaaaacatgctgaagcatatcgacggccgccatcaggaaaagctgacggaggcaatgaatacaattgaatgcatattgtcggaacacctgcctcccgaaaaatcggccgtttctataagagattactatatatcggacgatatcaaactgatgatcgaaaaacagcgtgccttctacgcggagacacacggctgggacgattcatttttggattaccttcacgaaacattcgacgccgagatcgaaaaaatctggatcgcagagagcgccggaagattcgcgggatgtgtcgggctcgtcaaacaccccggcaggaccgtgcagctcagatggtttctggtcgacgccgcttttcggcaccagggagtcggcacacgcctcttggagcatctcatcgattattgcaaagaaaatcagtatgagcggatttttttatggacggtaagcacgatggccgaagcacggcctttgtatgaaaaattcggattcagactgacggaagtgaaagacgagactttattatgggggcagcggctccgggaagaacgctgggatgccgagttaggctga

SEQ ID NO: 408 - DNA, 2073 bp, Bacillus licheniformis
atggttaaaccgtatcccccgatcagccggaaagttccccgactattgcatggagccgattacaacccggatcaatggcttaaatatccggacgtattaaaagaagatatccgcctgatgaaactgtcccgctgcaatgtgatgtctgtcggcattttctcctgggtttcgctcgagcctgaagaaggaagatttacatttgactggttcgatcaggttcttgatactttcaaggaaaacggaatttatgcgtttttggctacaccgagcggtgccagaccggcttggatgtccaaaaagtatccagaggtgctgagaacggagcgcaacagggtcagaaaccttcacggaaagcggcacaatcactgctatacgtcgcctgtctaccgccggaaaacggcgatcataaacggaaagctcgcggagcgctatgcgcatcacccggccgtcatcggctggcacatttctaatgaatacggcggagaatgccattgtgaactttgccaagacaagttcagagagtggctgctggcgaaattcaaaacgctggaccgccttaatgatgcatggtggacatcgttttggagccatacctatacagattgggacgagatcgagtcgccggctccgcacggcgaggatgccgttcacggtctgaatttggactggaagcgttttgtcacggatcaaacggttgatttttgccggcatgaaatcgcccacgtccgttcgtttaaccctgatctgcctgtgacgacgaattttatgggaacgtatgccggattgaattattggaagtttgccgatttgcttgatgtcatctcgtgggattcttatccggcatggcacaacagccggcaggaagacagccggcttggagccgatattgcttttgttcatgacatcaatcgctctcttaaaggcggccggccgttcatgctgatggaaagcacgccgagcatgacgaactggcaggatgtcagcaagctgaagcgccccggtatgcatgaattgtcgtcattacaggcagtcgctcacggatcggacaccgttcagtattttcaatggcggaaaagccgcgggtcaagcgaaaaatttcacggagcagtcgttgatcatgaaggatcagagcatacgcgcgtttttcaggaagtgaaaaagctcggggagaagctcgaaaagctggaagacgtcgcagggacgacagtcgaacccgaggccgcgattatatttgactgggagaatcgctgggctttggaagatgcccaaggtccgcgcaatatcggaaagcattatgaacggaccgccaaatcgttttatgaaccgttttggcgggaaggcgtaccggttgatgtgattcatatggaggccgatttctcccgctataagcttttggtcgccccgatgctctacatgctgcgagaaggcaccgctgaaaggattgaacagtttgttcaaaacggagggacatttgtcgccacttattggtcgggcattgttgatgagaatgaacttacgttcctgggagggtttcctggaggcttaagaaaaacgctcggcatttggtctgaggagatcgatgctcttcatgacggacagaaaaataccattgtgatggatgaagaaaacaggctcggattaagcggaagctatgaagccagcgagctttgcgatctgattcatttagaaggggccgaagcgctcgctgcgtacgaggatgatttttacgcgggccggccggcgctgacggtcaatttgttcggagacgggaaggcctactatatcgcttcaaggaatgaggcggcgttccaagaggcgtttatatccaggctcattgaagagtgcgggattgccaaagtgctcgatacagagctcccgaaaggcgtcaccgcccagctccgcacagacggccgccacgattatattttcgtgatgaattttacagcggaaaacagaagtgtctcgcttccggaggaaacaaatacggacgttttaaagggaacccggaaaaaaggcgcgctcaaactgccgccttacggaacgagcattttacggagaagccataaggcatag

SEQ ID NO: 409 - DNA, 1128 bp, Bacillus licheniformis
atgaacttttacaaaacgctcgccttatcaactcttgcggcatccttattgtctccctcatggagcattctcccccgtgccgaagcttcagcttataaggacttctcggtgactgccgatgcagagacagagccggtggatacccctgacgacgcggcagatgacccggcgatttgggttcatccgaagcagcctgaaaaaagccggctgatcacaacaaataaaaaatctggcttgatcgtttacgatttaaacggaaaacagctggcagcctatccgtttggcaaattaaacaacgtcgatctccgctacaattttccgctcgatggcaaaaaaattgatattgccggggcctcaaaccggtcagacggcaaaaacacggttgaaatatacgcctttgacggcgaaaaaaacaagctgaaaaacatcgtcaatcctcaaaaacctattcaaaccgatattgaggaggtgtatggtttcagcctgtatcacagccagaaaaccggcaagttctacgccatggtgaccggaaagaacggagaattcgagcaatacgaactgtttgacaacggaaaaggacaagtcgaaggcaaaaaggtccgctcattcaaaatgagctctcaaacagaagggcttgcagcagatgatgaatacggcaaaatgtacatcgctgaagaagacgctgcgatttggtctttcagcgccgagccaaacggcggagataaaggaaaaattgtcgatcgcgcaggcggaccgcatttaaccgctgatattgaagggctgacgatttactacggagaagacggcgaaggatatttgatcgcgtccagtcagggcgataaccgttatgccatctatgaccggcgcgggaaaaacgactatgtcgccgatttttcaattgatgacggtaaagaaatcgacgggacaagcgataccgatggaatcgacgtcatcggcttcggcctcggcaaaaaatatccatacggcatctttgtcgcccaagacgcgaaaatacggaaaatggacagccagccaatcagaacttcaaaattgtctcctgggaaaaaattgctgacgcgctggacgacaagcctgatatcgatgatcaggtcaatccccgaaaactga

SEQ ID NO: 410 - DNA, 1491 bp, Bacillus licheniformis
atgtcaaaccatcaaaaagaaacttttcaaaacattccgcaaaaggggttttttggacatccccgcggactcttcaccttattcttcactgaattttgggagcgcttttcatactacggcatgagagccatccttatctattatttgtatacagaggtgacaaaaggcggcctcgggtttgatcaaacgacagcgaactcgattatggccgtatatggttccctcgtctatatgtccggcattatcgggggctggatagcggacaggctcctcggaactgcaaacaccgtgttttacggcggcgtgctcattatgttcggacacattcttttgtcattcccgggaagcgtccccgctttcttcatcagcatgttcttgatcatcattgggacaggccttttaaaacctaacgtatcaagcgttgtcggcgatttgtacagccctgaagacacccgccgcgattctggtttcagcatcttctatatgggaatcaaccttggcggatttctcgcgccgattatcgtcggcacagtcggtcagacatacaactaccatctcggcttcagccttgctgccatcggcatgttgttcggactgctgacctatttagcgacgcggaagaaaaacctcggatctgccggaagaacggtaccgaatccgctcacaccagctgaaaggaaaatggtgttcggacggatcgggatcggtgttttggtgatcgctgccatctttggctattccatctttatgggctggatgacaatcaagctgtttacgatgatcgtcagctgtctcggcattttgatcccgctgatttatttcatcgtcatgtttaaaagctccaagacgacgagtgatgaacgttcccgtctcacagcttacattccgctgtttgtcgcatcgatgatgttttgggcgattcaggaacaaggcgccaatattttagccacctatgcagataaacgcactcatttggaatttttaggtgtccaattgcactcttcttggttccagtcgctgaatccgttgttcatcgttgtgcttgcaccggttttcgcatggatttggatgaggctcggaaaccgtcagccgtcaacgccgacgaagttttcactcgggttgattttagccggactgtcatttgtcgtcatgattttccctgcttacatcaacggcactgaatcgcttgccaatccaatgtggcttgtgctcagcttcctgatcgtcgttctcggggaattgtgcttgtctccagtcgggttatccgcaacgtcaaagctggctcctgctgctttctcagcgcagacgatgagtctatggttcctgtcaaacgcttctgcacaggccatcaacgcacagatcgtcagattttacagcgttgataccgagatcgcctacttcggcatcatcggcggtgtatccatcctgctcgggatcattttgatgctgctgtcaccgaaaattcagaaatttatgaagggtgttaattaa

SEQ ID NO: 411 - DNA, 1758 bp, Bacillus licheniformis
gtgcagcagcaacctgatgaaatgagaatgacagtggttgacgcgacaaagttcggcgctgtcggcgacggcaaaacagactccacaaatgcgatcaacgaatgtttggcatggacaaagtcgatgggatacaacacggtatggataccgaacggcacgtacatgattgacgggacgaaaaacggcgacccgcgggctccgtttcgcggcgccggcatcaatgttcccggcaatattgaaattttgatggacgcggaggctgtcatcaaggtaaagccgaacagttcatggggatacgctgctttttatataggcggaacatccgatataaaaatatccggaggcagcatcattggtgaaagagatgaacacacatatacaccggccccgaggccgacccatgaatggggattcggaatttgcatcgaaggggcgtcaaatgtcgtcattgaacacgtgagaatagccgattttacaggagacggaatcattatcagcaacggaggagaagggtatagaccgtcagagcgtattcaggtaaccaattgcgatatcaggcgctccagaagaaataacttgtccatcacagggtgcgacaatgttcttgtagaaggatgcgaaattgcagatgcgggaacaggaaacggaaccgctccttgctttggcattgatatagaaggctatagtgaaggaagcatcgtctatgaagaacccgtcaatgtcatcatcagaaacaacgtgttaaaaggcaatgtcaatcatgccgtttccaacttcaacggtacttctgtcatcatcgaaggcaatgttgcagacggtaccatttcatacggctatggaacggggacgacgattgcaaacaatatcatcaagaaaaatcccgaattcaccgggcagagcactggaattaacggcctcggtgtaggggctttggaagaaagaagcgatgccgtaataaagggaaatttgatttccggttttacgacaggcatagatatccgcggaaaaagcgtttttgctacggggaataaaatccgtgattttgtaaatgccggaattcttgcttatcaagcgtcgcaagtcttcattgaaggaaattatattgaaaacgacgtacctgaacaaaggtccggcaccgctttcagcatcacgcaatcagacaatgtaacatgttccggcaatcatattgcaaatgtcgttcttgctgtcaggagcacagggaacgacgtccaaatcaagcataacgtcattaagcaattttccagaggcatatggatatctcaaggaaatgctgtaatagaaggaaactttatttcgccgaacggctttcaaacggtgccggagtcatatgctgtatccgtcacaaacacagcttcggcagttattcaacaaaacaccatcacacgcttcagaaactttccaatatactgctcgacaaatcagcatacaaaaattatcggaaactatattgaagattcaccgctgatcgtcacggtgtttctcacccgcggaacacacgaggttatcggcaatacgataacgctcagcaggccgtccttgccggctgtcctcatttatcttgaccaatcgtcggactcggcgatcctcaacaacacgcttcgaagcaatacggaagcaagagtaacggccattcaaaccaatacgtcaaggcaaacgctcatcatcggcaatacgattgtcaaaggaatgatccattcccaccaaacagatacagtcaatggaaatatcgaagtttaa

SEQ ID NO: 412 - DNA, 219 bp, Bacillus licheniformis
ttgaaattaatcggaatcgggcttttattattagcttccttagaggcttttgccgtcatgctggatgtatttcaaggcatgaccttgcaaagagccattgtaaactccctgacgtttgccatcctggaagtgggcgagtggatcatcatccttttatttttgtttatcatttttctcgaagcctcggaaagctttcgcaaaaagagaaaaaggacataa

SEQ ID NO: 413 - DNA, 1590 bp, Bacillus licheniformis
atgagcggagataagaacccggaaaccgtaaagttgtctgggtttgtgcgtcccttgcttgccgaaaacctgagcctgattaaagaaatgaccggaaacagctccgatattgtcatccgcaagttaaaaacgggcgctggcgaaaaaattgaaatagccgtcgtttatgtcggcggcattacagatgagaaagcgattcacgattttttgctggaatcgatcatgaactccgaagaattggcggaaaaggagtacggcagggaggttcttgagacgattgcaggtgatgccgttgcactgggcggtgtcgaaaaagaaaagcggttggacaaagtgcttgaatctttgatggcaggaaatacgatcattttggcagaggagacggcagaagctgttattacgaccacgaaaggcggagaaaagcgctcgatcaaggagcctgaaaatcagcaggcattccgcggttcacgtgaaggatttatcgaagcgctcgacacgaatatttctttggtgcgcagaattattaaaaacccgaatctttgggttgaaaaaacgacgatgggaagcgtcacaaaaaccgatgtggcgatcatgtatatcaatggaatatgcgacccgaaagcggtgaaagaagtcaaaaaaaggatggaaagcattgagatcgacagcatccttgaatcgggctacattgaacagtttattgaagacaccgtatttacgacctttccgacggtatatcatactgaaaggccggatatggtcgcagggaatctgcttgaaggaagaatcgccatctttgttgacggtacaccgtttgtcctgcttgtccctgccgtttttattcaattttttcaatctgttgaggattactattcacgctttgacattgcgacattcatccgctttttgcgcgtattgatcttctttatttcgctgattgcgcctgccgtctacgtcggtgcgacgacttttcacaaggaaatgatcccgacggagcttttggtcgtaattgccgcgcagcgtgaaatcgtgccgttcccggctgtggtcgaagccatgatcatggaaatttcgtttgaaattttgcgggaggcgggcatccggcttccgaaagcgataggttcagccgtttcgattgtgggagccattgtcattgggcaggcggcggttcaggccgggattgtgtcgccggcgatggtcatcatcgtagcgatcacagcgatttcaagttttgctacaccttctttctccatggcgatttccgcccggctcgtccggtttttcttcatattagccgcggcgacgacgggtttttacggcattattcttggactgatcatcatgtttgtccatttatgcagcctgcgttccttcggtgttccatatatgactccttttgcgccgtttattttgaaaaactggggcgacgccatcgttcgtctgccttggtggacacatgagaagcggcctgaactgatcggcaatgacaataaggtgcgccaaggagaataccagaaacccgagcccccggattcaggcgatatgaagacaaaacaagaagatggtgatccaaatgaaacgaatcgttaa

SEQ ID NO: 414 - DNA, 1224 bp, Bacillus licheniformis
atgaaacgaatcgttaaaattgtgctcctacttgccgccattgtccttcttcaagggtgctgggataaaagagagctgacagatctgctgctgatcactgccatcggtattgataaaggtaaagatacagattacgaattaagctatcagatcgtcaatccgatcaatgtgacaggcggccttcaaggcggacagggaggagacaggccgccgatttcaagctattctgtgacgggcaacaatctgacggaaatgagcagacatgcgtcagcaaaaatgtcgcgggaaatttattactcccacaccaacctcgtggttgtcgatgaaaaactcgccaaggaggaaggcttgatcaaaattctggatgttcttgaccgggacaccgattttcgtacaacggcgacgattattatttcccgcggccaaaaagcgaaaacattcatccggacgctgacgccgatcgataagatcccgtcaaataaagtaaacaaaacgctgcaatttaccgaagagcatttgggagaacatatgaaaacgagcgtccaggatgtcatcaagtgcttaacatcgaaggcaaagcacccgattatttcttcctttaaagtaaccggaaacaaggaaaagggtgaaaaaatggaaaacgtgcagtctacatctcctgaggcaatagtcgaagcggacggcttggcggtcattaaagagggaaagctcgtcaattggcttgaaggcaaaacggcgagaggcgttttatggctgcgcaataaaatcagcagaacgtatttgacaattccaatgaatcatgagagagatgccgtcacatttgacgtcatccgccaaaaaacaaaaatcggatctcacctgaaaaacggcaaaccggcgatttcggttgacgtggctatggaaggggacatcggcgaaacaactgtgccgattcacctggatgatccaaaagtgctgagcgatatcgaaaggaaggtggcaaaggaactgaaaaatgaattgcagaatacgattgacattgttaagcggaacaagacggatgttctgcaattcggtgatgttgtgtatcgcacccaccccgaagtgtggaaaaagatggagggtgaatggagcaatcggtattttcctgacacagacgtcgacattacggttaatgcatacgtacgaagaacaggtttaagaaacaatccgaacattttgaatcatcatgaagggcgttcttga

SEQ ID NO: 415 - DNA, 1107 bp, Bacillus licheniformis
atggagaaagcaaaaatcagtgctgcacagctgttcgtgcttattgttctgtttgaactcagcagctctctgctgatttttccaggacaatctgccgaacaggacgcctggatcgcgatcttgttcggaacagtcggagggctggctttgtttatgatgcatcactttttctaccaggtgaatcccgacgcctctccctatgaaacgctgatgaatatttttggaaaaccggttggctggagcatgacatttatctacattgtttattattgttacattgcggcaagggttttgcgcgattttggagaaatgctgctgacatcggcttatccgaacacgccgattatcttcgctaatggattgttgattgcagtttgtatttttactgtgaggaagggaatcgaggtccttgcccgttcaggcgagctgttgtttggcatcatgttttggcttgctgtcacaggcctaatcctgatagtttcgtcaggcttgatcaaaccgaaagagcttttgcccattcttggaaacggacccggtccgatgtttcatgccgtgttcacgcaaacgctgtattttccgtttggagaaattatcgcctttacattgatcctgccgtatttaaaggaaaagaaactagcgaaaaaagccgggttgttgggaattgccatcagcggcctcatcctggcttttaatgtcgcattgaacatcagcgtgcttggcgtcgatctcaatatgcggtcgcgcttcccattgctgagtacgatccagacgattcaagtcgccgaattcttggacaggcttgatgtatttttcatgctcgtgctggtgattggcggtttttttaagatgagcattttcatgtatgccgtaaccgaaggcgtgaccgttttattcaagcttaaaaacccctccaaagttgttcatgtcatcggcattattattttgattttgtccgtctccattgccagcaatatttcagagcatgttaaagaaggaatcgagtttgttccattatatgtccatttgccgatgcaggtgatccttcccgcttttatttgcatagtcacttatgtgaaaatgaaaaaaaataaaaaaaaggccatgtaa

SEQ ID NO: 416 - DNA, 729 bp, Bacillus licheniformis
atgctctatacggtaaaagaagtggctcgcttggcgaatatcacgatcaaaacgctgtaccactatcataaaatcggacttttatgccccgcggaggtgacggatgccggctatcgcctttacggggtaaaagagctggaacggctgcagcacatcttgttttatcgggagctcgaatttccgctcaaggcaattaagcaaatactggacggcaaagctgatcgactgacgattttgtctgagcagaaacgtcttttcactgcccgtttggacagaattaaacagcttatttctacgatcgatctctcgattcagcaggccgggaaaggagaagcaatggatcaatcaagcatgttcaaagggttttcaagcagcagggaatgggaggatgcgctcgctgaacaaaaccgctatttgaaggaggcgtatgatgtcgatttgctgaaaggagaaccagtcatagcggaagaaatgaatgaaaaagctgaagaggcggcccgttttatgaatggaatggccgaagcgctcagagacggagtcaaacacgaccatgaacaagtgaagactgcaattaaacggcacctcaagtttttgggaattacgcccgacgattttcagtcccagacacgcttctttatcgaagacgattttcatcgcggaatgcttgaaaatcagcaaacaggcctctcgtattatttggctgctgctgcagaagcatttgcttcataa

SEQ ID NO: 417 - DNA, 684 bp, Bacillus licheniformis
atgggcagtattttagaatttcagaatgtcggctattggtataaaaatcaggatcagcctctattcgaggatatcagcattcaattcagccaaggactcttatatacgattgtcgggacttccggttccggcaaaaccacctttttatcgttggcgggcggacttgacgcgccaaaagaggggaacatcctctacaaaggagaaaacatttcaaaaatcggactgaccagcttccgcaatcaatatgtatcgatcgtttttcagtcctataacctgctgccgtatatgacggctctccaaaatatcacgtcggccatggaaatcaccggatctcaggtcaaaaacaaggaacaatacgctttggagatgctcgaaaaggtcggcatcggcgaaaagcaggccagacagaaagtattgacattaagcggcggccagcagcagcgtgtctccatcatcagagcgttctgctgtgacacggatttaatcgtcgccgatgaaccgacaggcaatttggatgaagatacatcaaaagacatcgtccggctctttcaaaaccttgcccaccaagaaaacaaatgcgtcatcatggtcacccatgatgaacagatcgcaaaggtatccgatgtcaacatcacgctttcaaggggcggctttaccgtcaaaaaacgcatatcagcaggataa

SEQ ID NO: 418 - DNA, 1440 bp, Bacillus licheniformis
atgaattttttcaaacgagccttttggagcatgaaagcgaaaaaaggaaaaacacttttacaattgtttgttttcacgatgatttgcgtgctcgtgctgacaggaattacgatccagtcggcagccgtgaaatcgagcgaactggcgagggaacagctcggaggcagcgtcacgctcaaagttgacagggaaaaaatgatgaaagaacagcaggactcaggagaccggaaaaggtttgaatcgacccccgtttctctcaaatcagccgagaaacttgcgagcctttaccatgtcaaaagctataacttcatctcctcaacatctgctttagcggacaacttcgatccgatcgaaagcggtgacgaggattcaacggactcaaacagcgatcagccggccggatcgggcggcaatgaacagggcggccggcaaatgatgcaggctgacgtatcaatcgaaggtgtgacaagcacagccctcgtcgacgaatttgccgacgggacgtccaagatcacggaaggccgtgctttaacaaaggatgatgtgaatgaaaaagtcgccgtgattgaagaaacgcttgccgaagaaaacgagctgaaggtcggcgatacgatcaaagtcaaagcgagcagcgatgaagatgcaacgatcaatttaaaaatcgtcggaatctataaaacgacttcatccggagacaatcaagcgcaaaacttcgcctttttaaacccttataacaaaatctatacaccatatacggcggcatcggccttaaaaggcgacgattatcaaaacgcgatagatgaagcggtctacaatatggacgacgcctccaacatcgacgctttcattgcggctgccaagaaaacaggcattgatttggatacattcacattggacgccaatgaccagttgtaccagcagatggtcggcccgattgaaaatgtcgcctccttctcgaaaaatgtcgtctatcttgtcacggtcgccggggcggtgattctcggactgatcgtcatgatgtcaatcagggagagaaaatacgaaatgggtgttctgatggcgatcggcgaaaaacgccggaaactcatcggacagtttttaaccgaaatcttaatgatcgcagtgcttgccatcgggatctcagcattaaccggcagcctgattgcaaagcaaatcgggaaccagctcttgagccagcaaatcgaacaaacgtcagctagccagtctgcaggcggaatgatgggcccaggcggcggaggcttcttcggacaaagtactgctcaagtctcagccattgatcagctcgacattcaagtatccttcgggaacttaatggcacttggcggaatcggccttttaattgcgatgttcgcgacactccttccgtccatatctgttttaaggctccatccgaaaacgattttaacaaaacaagaatag

SEQ ID NO: 419 - DNA, 687 bp, Bacillus licheniformis
atgaaaatattaatgattgaagataatttaagcgtatgtactatgacagagatgttttttgcaaaagaaggatttgaaacagagttcgtccatgacggactcgaaggatataaccgttttaaatcaggtgattgggatttgctgatcatcgatatcatgctgccgtcgatggatggggtcacgatctgcaaaaaggtcagagaagagagcacggttccgattattatgctgacggcaaaggatacggaatcagaccaggtgctcggttttgagctcggggctgatgattatgtgaccaagccgttcagccctttggcgcttgtggcgagaatcaaagcggtgagccggagatatcaaaacgccggccggcaggattccgctgacagcgacacgcttgaaacggaacattttaaaatcaataaaaaaacgagagaagtgtttttggacggcgttcaaattcaaaatttgacgcctaaggagttcgatttattgtattacttggtgcaaagcccgaaacaggttttttcaagggagcagctgcttgagcaggtttggggataccaattctacggagacgagcggactgtggatgttcatattaaacggctgagaaaaaagcttggcagcgactcgcggccgtttctttacaccgtatggggagtagggtacaagttcgatgaagattaa

SEQ ID NO: 420 - DNA, 1428 bp, Bacillus licheniformis
atgaagattaagtatctctatcagctgctggccagtcacatcagtatattagtcttggcttttctcatcacgggggcgctgttttcacactttgccaaagactttgcatacgagagcaaagtcgatgagctgtcttcctacggctaccgcatcatgggcgaaatggagatgcggccgaaaggagcgccggccattatgaagccgtttgaggaaattttgcgaagcaggaagatcagcttttttctgtttaatgaaaagaaagagatcttgatgacgccggccgatttgcggccgcgaaaactgctgctcagtgatgaagaatggaaagagcttaaagatggaaaggccgttgtcgtcaaaaccgactttaaccgttttaatgaggaagtatcggtcgtcgctctgcccaacatcgtcaacaatgaatttcagggaggcattctgctgaccgctccgatcagcgggaccgaagaaatgatcagcgacatgaaccgctttatgctctttacggcggcgggtgtcatcttagtcgctattctcttaagctggctgacgtcgaaattccatgtcgcccgcattcagaagctccgcgacgccacgaaaaaagtcgcggccggggattatgacatccatatcgaaaaccgcaataaggatgaaatcggtgatttgggcgacgactttaacattatggcccgcaagctaaaaagctcaagcgaggaaatcgaccggctcgaaaagcggagaaggcagtttatcactgacgtttcacatgagctgaagacgccgctgacgacgatcagcggtttagtggaagggatgaacagccagacgatacccgaagaccagcaggataaatgtatgaagctgatcacggaggagacaaaaaggctgattcgcctcgtcaacgaaaaccttgattatgaaaaaatccgctccaaccagattacattgcaaaagctgcattatccgctgatcgaagtgtttgaaatcattaaagagcagctggcgcttcaggcggaggagagacagaatcagctgatcctcgatgtggaagatcatgtaatggtcaatgccgattacgaccggctcatccagattctcgtcaatattacgaagaacagcattcaattcacaacgaacggaaccgtttggctgagaggccgggaagactacaaggagacggtgatcgaagtagaggataccggaatcggcattgatgaaaatgatatcgaaaacatttgggatcgtttttataaagcggatttatcacggacaaacacaccttacggagaatacgggctggggctgtcgatcgtcagacagctcgtctcccttcacaacggcacggtagagattgaaagcgagaaaaacaaaggaacaaaatttatcatccgcctgccgctgacggcgagagatgatgatgaatag

SEQ ID NO: 421 - DNA, 1719 bp, Bacillus licheniformis
atgaatctgttgagaaatataaaaatcagaagcaaactgtttgtcatcattatcatttcggcgctggctttgtcaattgtaggcatccagggggtaggcgggctgagcaagctttccaaaggttccgagatgatctatcaagatcaattgattcccaaccagttgtttgcaagattaaaagcgaacaacctcgatcttgatacgtacaaattcgagttaatggtgacgaaagacagcgatcgaaatgaaactttgcaaaaaaacatcaaggaaaaaaacgaagaaaacaacaccttaatggaaaagatcgatcagctgaaattaatggacaacgtctctgaaaaatacgagagcttcaaaagcgaatacaagaaattgcaagatatcagcagccagatgctcagcttggcggtgaagaacgaaaatgacaaagcttatgatgtctatctaaaagagatggagcctcaaagagaaacggtcaaccagctgattgaagacattcaaacgctaaatgctgacaacgccaaaacgatctatcagcgggattctaaagaagccggttccatcatcacgcttctcatcattgtgatcgcagcatcgcttgttttatccatctcgatcggactcttaatgacaaggctgatcacaaagccgatcaaagacattcaggcgctgttcgcagaaacagagcaaggcgattttactgtcaaaggaacatatcaatcgaaggatgaattgggattgctgaccgcatcgtttaacaaaatggtagcaggcgtccgttcgatcattgaaacggtcggcgaaacgtcccaccaagttgcttcatcatcacaagaattgagcgccagcgctgatgaaagcacaaaggcgagcgagtacatctcaacgacgatccaggagcttgcggtaggctctgatcagcaggtggaaagcgttgaaaacagcagaaccgttattaagggaatgaccgagtttgccggaagaatttcttctagcgccgaaaaggcagccgccaccgcagaccagacggcgaagatgtcgcttgaaggcacgaaagccattgataaagtgagcgcacaaatgcagtctattaatgaaacggtcgtttctctttcagaagcatttaaacatttaacagaacgttcaaatgagatcgggaatattaccgaagtgattacgagcatcgctgaacaaacgaacctgctagctttaaacgcggccattgaagcggccagggctggagaacaaggaaaaggctttgccgtcgtcgcggatgaagtcagaaaattagccgagcaatcggcccagtcagcagaacagattacaaggttgattacgatcattcaaaacgatacaaagcagacgatgaactcggtcatttcggcaaccggcgaagtcaaagaaggacttgtcgtcgttcatgaagccggaggcgctttccaaaaaatcgaaaactcgataactgaggttgtcacacagatcaatgatgtgacaaacttggtgaaaaacctgacagccggcacaagcgaaatcgaaaccgcgatttccggcgtcaaagaagtagccgagactgcagcgggaagcacgcaaacggttagtgcggcaacccaggagcagcttgcttcaatggaagaaatcgccgccgcatcacagatcctcgcgcaaaacgccgaagagctgcagcacctgattcagaaattcaaaattaaagattaa

SEQ ID NO: 422 - DNA, 1362 bp, Bacillus licheniformis
atgaaagtcgttaaatttggaggcagctcgctcgcatcaggagcccagctagagaaagtatttcaaatcgtcacttccgatccggaaaggagggccgtcgtcgtatcggcacccggaaaacggcatcccgaggatacgaaagtaactgacctgttaatcgaatgcgcccaacagtacctattatcgaaagaagcgaccggcctggttgaggcgattgtcggacggtatgccgatatcgcgctagagctcgggcttgccgatgacgtgatcaaccggatccgggcagacctgcttcagctgctcgaaggtgataaaacaaatccggaacggtttattgatgcgatcaaagctagcggcgaagataacaatgccaaactggtagcggcctacttcaggcaccgtggagttgaagcacattatgtcagtccaaaagacgccgggctgttcgtgacgagcgaacccggcaacgcacaagtgctgcccgagtcctacgacaatctgtttcagctcagacagcaaaagggcatcattatctttcccggcttcttcggattcagccaggaaggagaagtgatgacgttttcgcgcagcggctctgacattacgggctccattttagcgaatggattgaaagccgagttgtatgaaaacttcactgacgttgacgccgtttattctgtcaacccggcgatcgtatccaacccgaaagaaatccgcgagctgacataccgggaaatgagagagctgtcgtatgccggcttttccgtctttcatgatgaagcattgatccctgctttccgggcgcgcataccggttcagatcaaaaatacaaacaacccggacgcagaagggacaagagttgtcgccacacgcgacaacacgaacggacctgtcgtcgggatcgccggcgacagcggattttgcagcatttacatcagcaaatatttgatgaaccgagaaatcggcttcggccgccgcgtcctgcaaatccttgaagatgaagggctgacatatgaacacattccgtccggcattgacgatattacgatcattttaaggcagaatcaaatggatcaagcagcagaaaaacggatgatcaaacggatcaaggaagagttggatgctgatgaagtagcgattgaacacaatattgccctgatcatggtcgtcggcgaagccatgcgccataacgtcggaacgacggcaagagcgtcaaaagcattgtctgaagccggcgtcaacatcgaaatgatcaaccagggctcctcggaagtcagcatgatgttcggcgttaaggaagctcaggaaaaacaagcggtccgcgcattataccaggagtttttcgcaaaagttctcgtttaa

SEQ ID NO: 423 - DNA, 954 bp, Bacillus licheniformis
atgaaattacgatacttattgctaatgctcatcattctttcattcagctcgatattcatcggcgttaaggagctttcgcctcttgaccttttccgctttaatgaggacgaaattcaaacgctttacataagcagaatcccgcgcttgatcagcatcgtgcttgcgggaatgagcttgagcatctgcgggctgatcatgcagcagctgacgcgcaataaatttgtttcaccaaccaccgctggaacgatggattgggctcggctcggcgtgatcattgcgatcgtgcttttttcgtctgcagggatagtagtcaaaatactgtttgcctttgtttttgcactgtttggcagctttttgttcgtcaaaattttggacagaatcaagttcaaagatgcgattttcatccctctcgtcggaatgatgctcgggagcgttgtcagcgccatctctactttcatggcttatcagtacaatattattcaaaacgtcaatgcatggtttgaagggaatttttcgctcgtcatgaaggggaggtatgagctcttatttctgagtataccgctcgttatcattgcctatctgttcgccaataaattcacgttggccgggatgggggagtcattttccatcaatcttggtttgaaatacaagcgggtggtcaatatcgggctgatcatcgtatctattatttcgtccgtcgtcatcctgacgatcggcacgcttccctttttgggattgatcatcccgaacatcgtgtccatttacaggggagatcatttgaaaaacagcctgcctcacacggcggttctcggagccgttttcgtcttgttttgcgatatagcgggacgtctcgtcatttacccgtacgaaatttcggttggtttgatggtcggcatcatcgggagcggcgtttttctttacttgcttttaaggagaaaagcctatgcgtcataa

SEQ ID NO: 424 - DNA, 945 bp, Bacillus licheniformis
atgcgtcataaacagaaaatgcttgtactcatcgtgatagcagcagtctgcatcgggctgtttctgttctacggtttgccgtctgtatgggaatatgcgcttccgcggaggtttgccaaggtttttgcgatcatcattgtcggtacagcgattgcgtattcgtcgatgattttccaaacgatcacaaacaacagaattttgacgccgagcatcctcggactcgattctctctatgttctgctgcaaaccgggattattttctttttcggtgcagccaaactcgctgaccttggcaaaaacggcaattttctattgtctaccggtttgatggtctgcttttcatttgtgctgtttttcctgatgttccgccgcgggggaaggcacatcttcctgctgctgctcgttggaatcgtgttcggcacattgttcagaagcctgtcatcctttatgcagatgctgatcgatccgaacgagttccaagtcgttcaaaacaagatgtttgccagcttcaacaatttgaatacggacattttagtgcttgcttcgctcgtcattctggcgattctcgtttacgcttggcggtttaatccgtactttgacgtgatttcgctcggcagggatcaagccgtcaacctcggaatcgattacgaccggacggtgaagaaaatgctgatcgtcgtcgccgttctcgtttccgtgtctactgccctcgtgggtccgatcacatttttggggcttctcgtcgtcaatgtggcccgggaggtatttaaaacgtataagcacagcgtcctgattcccggagcggttttgttcagcatcattgcgcttgtcggaggccagttcattgttgaaaagctgtttggtttaacggtgacgctcgtggtgatcattgattttatcggcgggatttattttatttacctgttgctgaaggagcgtaaataa

SEQ ID NO: 425 - DNA, 759 bp, Bacillus licheniformis
atgatagaagtacgagatatcatgaaacaattcggagagcagaccgttgttcatcccacgactttaacgatacaaaaaggaatgatcacgtccttcatcggaccgaacggagcgggaaaaagcacgcttttgtccatcatcagcaggctgatcggcatggacgccggaaaagtgctgattgacggcaaagaaatcggcgcttacaaaagcaatgatttagcaaaaaaaatcagcattttaaagcagtccaaccagatcaacatcaggctgactgtcagggagctcgtcagcttcggcaggtttccttattcacagggaaggctctcgaaagaggactgggcatatgtcgatgaagcgattgattacatgaagctgagagacattgagcataaacaccttgatcagttaagcggcggccagtgccagcgcgctttcatcgcgatggtcattgctcaggataccgactatatattgcttgacgaaccattgaataatctcgatatgaaacactcagtagagattatgaagctcttgaaagaccttgtcgaaaatcgcggaaaaacgatcgttattgtcattcatgacattaatttcgcctcggtttattccgacagaatcgcagccctgaaaaacgggcggattgtaaaagaggggccggcggaagacattatccaaacgccggtgctgaaagacatctatgatatggacattccgatccaacaaatcggagatcaaaaaatctgtgtatattttaaatga

SEQ ID NO: 426 - DNA, 948 bp, Bacillus licheniformis
ttgaaaaaactatctttattgattatggcattgataaccgttcttgtcgtagccgcctgcggaaacaaagctgctgacacagatgcaaaatcttcctctaaaaaagaaaccgtcacaattaaacacaacagcgacacaacagatgtaccgaaaaacccgaaaaaagtcgttgtcttcaattttggaatgcttgacacgcttgatgagcttggcttaagcgaccgcgttgtcggccttccgaaacaaacccttccgtcttacttgaaaaaatataaagacagcaaatttgaaagcgtcggcggactaaaagagccagattttgaaaaaattgctgagcttgagcctgatttgatcatcatcgaaggcagacagtctgaacagtatgacgagtttaaaaagatcgctccgacgatcgacattgagcttgaccagaagaactacatgaacagttttaaagaaaataccgaaaacattggaaaaatcttcggcaaagaagatgctgtcaaagaagcccttgcgaaaatcgatgaaaaagtagagaaagccaacaagctggcgaaagaaaaaggcggcaaaggattggtcgtcttaacgagcgataagcaaatcagcgcgtatggaagcggctcaagattcggcttgatccacgatgtgctcggcgttgaacctgtcgataaaaacatcgaggtttcccttcacggccaaagcgtctcttcagaatatatctctgaaaagaatcctgattacctgtttgtcatcgaccgaagcgctgccatcggcgaaaaaggaacagcaaaagaagtcatcgaaaatgaaattgtaaaatcaacaaaggcctataaaaacggccatatcacataccttgatccaggctactggtacctgtcaggcggaggccttgaatccgtatctgaaatggtgaaagaagtcgaaaatggattgaaataa

SEQ ID NO: 427 - DNA, 1422 bp, Bacillus licheniformis
atgagtacaggaactgaacaacagacatacaacagaaatatcatcgtaggtttgcttattgccggggcgtttatcgcgatcttgaaccaaacgctcctggttaccgcactgccgcatattatggcagacttgaacatagacgctacaaaagctcaatggctgacaacggcgttcatgctgacaaacgggattctcattccgattaccgcctttttgatcgaaaaattctcgagccgcgcgctcgtcatcgcggcgatgagcatctttgcggcgggaacagtcgtcggtgcggtggcgcctaactttccggttcttctggcggcgcggatcattcaggccgcaggcgccggaattatgatgccgctcatgcagacgatctttttaacgattttcccggttgaaaaacgcggggctgcaatgggcatggtcggcttggtgatcgcatttgcaccggccatcggaccgacattgtcaggctggatcgtcgacagctttacatggagatacttattttatattattctgccaattgcactgattgatcttgtgcttgtcatcttgctgatgaaaaacgtcacgaaattgagagaaacatcagtggacatcatatctattatcctgtccagcctgggtttcggcggtttattgtacggcttcagcaacgccggatcagaaggctgggggagcaatactgttttaatttcctttgcagtcggtgcggtcgccctgttcttctttatctctagacaattgaaaatcaaaaggccgatactcgagtttcgcgttttccaatcgtggacttttacgataacaacgctacttggtatgatcgtttttgcattaatgatcggtactgagaccattttgccgctgtacacgcaaaacgtcagagacgtgacagctttcgattcgggtttgatgcttctgccgggcgcgatagcaatgggcatcatgtcgccgatcatcggccggatttttgacaagatcggcggaaaaggccttgcgattatcgggtttgccgtcttgctgctgacgtccatcccgtttgcggacctgcaaatggatacttcgctgacatttattatcgtcatttatacgctgcggatgatgggaacttccatgattatgatgcctctcacaacggcgggcatcaatgcccttccggcgcacctcattccgcacggaacagcgatgaacaatacgatgcgccagatcggcggttcgatcggcacggctgttctgatttccgtcatgagtaattcagccaaaaacgccgcgacatctcatccgttaaatgcgctcattcacggcatgaattccgcctttatcgtggccgctgtcttggcgctgatcggatttatcctttcgtttacattgaaaaagaagccgcaggccgacaaacaaggccagccggcccgctga

SEQ ID NO: 428 - DNA, 921 bp, Bacillus licheniformis
atgagttttatcattgcgaaagaaggagccggaatgaacgaaaaaaaagcagcagtcttaagggccgccaaaaagctgtttgcccaaaaaggctatcacaatgttgcaatgcaagcgatcgctgaagaatgcaaaatgtcaaaagcatctatttataaactgtttcaatctaaagaagatcttctgctggcattgatcaagttcagaaagcatgaaatgctgaacaaaagcgccgtcatcaatacggaaacctcgctgacgccgaaagaaagattcgctaaaaaaatcgctttggagattacggaattcagggaaaaccgccaatttatcaatttcatctccaatgagggatcatctccggataccgcagtatttaaaaagcatctgaaagaaacaaaatcaatgattatcagctggcataaagactctatcattcaagcgtacggcgaagaggtcgagccgtttatatgggatatcgtcatcattttccacgggctgatgagggaattcctgtttttagtcggcactggaaaagcgcagcctgacgttaaaacgattccgccattcattatgtcagttctggacctcttcatagagaaaaagctgaacgaagatcagaaaagttcattaaatgaagacattattgcctcctattcgaatttctcatcatgctgggcaccgcccaaaaaagaggaattgcttgaagaccttttgcaaaaactgaaaaccaagatttcttcgctgccacaagacgatgtttccgtgacagaattgctgtctgccgcagatttgctgagcgaggagcttttcgccaatgagccacgcacgtatttaattaaggctctccttgattaccttggaaaaatcgaggccatccaatacgatgtttcacaaatacaaacgattagtataaaagaataa

SEQ ID NO: 429 - DNA, 843 bp, Bacillus licheniformis
atgaaatcatttgcaaagtatcaaacatttctggatctccatcatcagtcagacccattcgttctgccaaatgcatgggatgcagccagcgccaaagcatttcaaaactgcggttttaaagcagtcgggacaaccagcgccggaatcgctatgtccctcggctatcccgacggcgaacatctcccctttgaaacattgctttccgtactgaaaaccatcacggatgccgtcgatattcccgtcagtgcagatcttgaagcgggttacggccaaacaccggaaacagtcgctgaaaacgcaaaaaaagccgcagctgccggggttgtcggtatgaatattgaagacggaacgaaagacccctgccggccgctttctgatgcaacattaatggaagaaaaaataacggctgttaaaaaactgaaccttcctgttttaatcaatgcccgtacggatgtgtactggctcaatgctgacgcccccggctcccgtcttcaagcagcagtccggcgggcaaatcggtacagtcaagcaggcgcggactgcatttttatccccggagccgatgatgcaggcaccattgccgggctgagaaaaggtatatccgggccgatcaacgtgctggccggctcacacaccccctctttacagattctttccgaactggggattgaaaggatcagctgcggatccgcccctttcagagctgcactgtcactggtgaaaaagatcggtgaagacatcatccgccgcggcgccttcaatcgtatgacggacggcgtgctttcatacggagaagcggctgattggatcagccttcatcgtgacccaaaacaaaatcgttga

SEQ ID NO: 430 - DNA, 738 bp, Bacillus licheniformis
atgaatgaagtattgaaaacattgaaagaccatagatcaatccgcagctatacagatgagcccgtgagccctgaacagctggacgacattattcaagccgttcaagccgcgccgaattccattaacggccagcaggtcaccgtgattacggttcaggatgaggaacggaaaaagaaaattgccgaactggccggcggacaggtctggatcgagcaggcccctgttttccttttgttctgcgcggacttcaaccgtgcgaaaatcgcccttgagaaaaacggcgaaacgcttgcgatcacagacggaatggaatccgtgcttgtcggagctgtcgacgcaggcatcgccctcgggacggccacagcagccgctgaatcgatgggacttggcactgtgccgatcggcgcggtccgcggccgtgcagaagagttgatcaaactgctcaatattcctgaatacgtcttccctgtcgcaggacttgtcgtcggccatccggcggaccgctccgccaaaaagccgcgcctcccggaacaagcggtaaggcacagcgaaacgtatcaaccggatttaaaaccgctgatcgacgcgtacgatgaagaaatatccgaatacatgacaaaacggactaacggacaggaaacaagaaactggtctcagggcatatccgcttattacaataaagtgtactatcctcacatccgtgaaatgcttgagaaacaaggatttaaactcgaatag

SEQ ID NO: 431 - DNA, 288 bp, Bacillus licheniformis
atgatcgtattgcaagcctatatgaaagtaaaaccagaaaaacgagacgcctttctcgaaagcgtacaaccgcttcttaaacattcaagagctgaagccggcaatgcccagtaccagctgtttgaagataccgaacatgccaatacatttgtcatgcttgagcaatggaaggatcaagacgcgcttgacgcacataatcagacagagcattttcaagctttcgttcaagcggcgggcgaccttttatcagaacccctgaatgtggttaaaacgcacacaacggattaa

SEQ ID NO: 432 - DNA, 297 bp, Bacillus licheniformis
atgaaaacaaatgaaatgaagttaacagccgttctccaagccttgagtgatccttacaggcttgagattgtcaaagcattggctgacacagccgagaaaacgtgcggtacgtgcacaaatctcaatattgcaaagtctacgctgtcccaccacttcaaggtgctgagggaagcgggtctgctcaaagtccgcatcgaagggaagcatcattattactccctctgcaaacgggaattggaggagcagtttccgggactgatcgaggcggttctcaaggtagaaaaggaacggtggtaa

SEQ ID NO: 433 - DNA, 1431 bp, Bacillus licheniformis
atgatcacaataccgattgaccgctccaagggcgcggaatatatttatcaccaaatctatcaacggattaaagaagaaattttcagccgcaaccttttgccggggaaaaagctcccatccaagcgagagctcgccgaaacattgaacgtcagcatcaattcggtcaacgccgcctaccagcagcttctggcagaaggttatctttattcgcgtgaaagaaaaggcttttttgtagagcagatcgaaacgttccacgccagccgtcaccccggtccccttcaattggaaaaagaactggttgaagagcctgaaagcaaagacggctggatctcgttttcccatatgagcgtcgatacggcgcattttccgtttaaaacatggcttcgctgcgaacagaaagcggtttcttcacatgttgacgaactcggagaaatgacgcacccgcaaggcgtctacgaagtgcgccaaacgatcgcacgctttatcgctttaacgagaggcgtcaaatgtctccccgaacaaatcgtgatcagcgcagggacgcagtccttaattcacacgctccaggaccttctccccgcctcagccgtctatgcgatggaggagccgggatacagccgcatttatcgactgctgaaaaatgaaggaaaagaagtcgccacgattcagctcgaccataaaggaatgcggatcagcgagattcaccgtctgaatccggacgttttatttgtcacgccttcacaccagtttccaacaggaatcattatgccggtatcgaggaggattcagcttttaaactgggtttccgacggggcaaaccgctatattgtggaagacgattatgacagcgaatttaaatacgggagcgatacgatccccgccctgcaaagccttgaccgctctgaaaaagtcatctacatcggcactttttcaaaatcgcttcttccgggcctgagaatcagctatatggtactgccgcaaaagctgctgaagcgatacagaaaaaggcaccatttctcgattcaatcgagcagcgtcttaacgcagctcgccctgcaggaactgatcgaatcgggggagtaccaaaagcacattaagaaaatgaaccagatttacgaaaaaaagcggacaaggctgatcggaagccttgtcaaacactttaacggccgggtcaaaattaaaggcgagagcgcaggccttcactttgtggccgattttgaaacggatagaagtgaagaagaggttttattaagagcaaaggaaaggcgggtcgaggtttacggcatgagtcggtttacgttaaagaaagagcagacaaaacatgaaggaacggtatcgctcgtgctcggattcgccaaaatcgctgccgatcagatcgacgaagggactgccaagctttatgaagcggtatgcggtgatgagaagctttaa

SEQ ID NO: 434 - DNA, 1314 bp, Bacillus licheniformis
atgagtcggaacacaaaagcattcacaacggaagattggcaggccaaacgggatcaattcgtggcaaggggtgtctccaacggaaatcgtcatctggccgctaaaggggaaggtgccgttttatatgatattgacggacgccgttttatcgattttgccggggcgatcggcacattaaatgtcgggcattcacatccgaaagttgtagaagctgtcaagcggcaggccgaacagctcatccatcccggttttaacgtcatgatgtatccggcctatttggaattggcggaaaagctttgccggcttgcgccgggcgcccatgagaaaaaagcgattttcctgaactcgggtgcggaagccgtagaaaacgccgtgaaaatcgccagaaaatatacgaagcgtcaagccgtcgtttcttttacccgcggattccacggacgcacaaacatgacgatgagcatgacgagcaaggtgaaaccgtacaaattcggattcggtccttttgcacccgaggtatatcaggcgccgtttccttactactatagaaagcctgaagggatgactgatgaaagctatgatgacatggttattcaggcgtttgacgatttcttcgtctcgtctgttgctccggagacggttgcttgcgtcgtcatggagccggtacagggagaaggcggttttatcattccttcaaaacggtttgtgcagcatgtcgcagccttctgccaaaaacacggcatcgtttttgtcgctgatgagattcaaacaggctttgccagaacgggcaaatattttgcgattgagcattttgatgtcgttcctgatcttgtgacagtgtcaaaatcgctggctgccggcgttccgctcagcggcgtcatcggccgggcggaaatgctcgatgcggcggatccgggtgaactcgggggcacctacgccggaagtccgcttggatgcgtagccgctttggcagtgctcgatattatcgaatcggaacagctcaacaagcgctctgaagaaatcggcaaagccatcgaagagcgggcgcttgaatggaagatgaaatatccgcagattggggaagtccgccgacttggcgcaatggctgcgattgaaattgtccgggacgaaaagacgcgggagccggacaaagcagctgcggccaagattgccaagtacgccaatgaacacggtctgctcttgttgacggcagggatcaacggcaacattatccgttttctgtctccgctcgtcattactgatgaattacttgaggaagggttcggcatcattgaagaagcgctggaacagctctag

SEQ ID NO: 435 - DNA, 1392 bp, Bacillus licheniformis
atgggtaaacagcaaatgaaaaaaacgatgtcgcagacggatgtgctatttttagcgatcggagctatgctcggctggggctgggtcgtcctttccggcgactggatttcgacagccggctttttgggcagcacgatcgcgtttatcatcggcggcatactcgtcatcttaatcgggttaacgtacgcggagctgtcttctgccatccctgaaacgggtggcggcttgattttcgtctacagggcgttcggacgaaaaacggcttttgtcgccgcttggggtgtgctgttcggctatgtttcggtgattacatttgaggcggtcgcattgcctaccgtcatcgattacgtcctgcctgtcgaacatcaggggtttctctggtcgctaagcggctgggacgtgtatgtcacttgggtgttgatcggttcgggaggtgcggtcgtcctgacagcgctcaattacttcggcgtcaagccggccgcgatttttcagtcggtctttacgattgcgattatcgccacgggctttctccttttgggcggcgccttggtaaacggtgatttcgaacatgtacagcccctttttaaagacgggttttccggtatgatgtccgtccttgtcatgattccgtttctatttgtcggatttgacgtcatccctcaggttgcggctgaaattaatgccccgaaaaaaatcatcggcaaaattttgattatttcgattatcagtgcggtcgtgttttatttgctgattgtattcggcgtaacgatgggtctgtcagaaagcgagcttgcgacgacttctttggcaaccgcggatgcaatggtcaatctgctcgggaaccagctgttcggcacggtgcttgtcctcggcggcgtcgccggaatcattacgagctggaacgcatttatcatcggcgcgagccggattctgtttgcaatgtcggaaaagggcatggtgccgaaatggttcggcttcatccatccgaagtataaaacgccgactaatgcaattttatttctgggtgcgctggcgttttttgccccgctgctcggacgccctgcccttgtttggatcgtcaatgcagggggaacaggtattatagtcggatatttgatcgtctcgattgcattcatgaagctgagaaaaacagagccggatttacacaggccgtataaaatcaataagtggaaaacaacgggtatatctgctatcctcttaagtgttatcttccttgccttttatttgccaggcatgccggccgcgctcacatggccgtatgagtggctgatcttggcgggatggacattgatcggttttcttttatacaacagcagttcaaaacgtaaaggggaggagattcaacatgaccagcatgctagaagtatataa

SEQ ID NO: 436 - DNA, 1395 bp, Bacillus licheniformis
atgaccagcatgctagaagtatataatcctgcgactggagaaaaaatcaaatcggttccccagcaatccgcaaaggaagtcgaagaagctgtcgtacgctcgcatgaggcatttcaaaaatggtcgaaaacatcggctgcagaacgagcgggcttgctgaaaaaatggtttgatttaattgtggagcagaaggacgagctggcaaaattgattacgcttgaaaacggcaagccgtacgctgaagcgcagggcgaagtcttatatagcgcaggctatatcgaatggtatgcggaggaagcgaagcgcatctacggaagaacggttcccgcctctgtgacgaacaagcgcatcatcgtcacacgccagggagtcggacctgttgcggcgattaccccgtggaattttccggcggcgatgatcacgagaaaagcggggccggctttggcggcgggctgtacctttatcatcaagccggcgcctgatacgcctttaacggcgcttgagctcgtccgtctcgggcacgaagcgggcattccgaaagacgtccttcaatgtgtgatcggcgacggacaagagatcggctctatttttacaagccatccgctgatccgcaagattacgttcaccgggtcaacacctgtcggcaaacatttaatgaaaaacagcgccgagacggtgaagcatgtgtcaatggagctcggcggccatgccccgctgatcgttgatgaagatgccaacattgacctcgccgttaagcagacgatgctttcgaaatacaggaatgccggacaaacgtgcgtctgtgcaaaccgtctgatcgttcatgaatcggttaaggatgaatttgcagaaaaactccgcgcggaagttgccaagctgaaagtcgggaacggactcgaagaaggtgtatcaatcgggccgatcatcaataaaaacggcttccaaaaaatcgtcgatcaaatcaatgacgcggtgaataaaggggcgaaagttctcatcggcgccgaatatgaaagcgatgatgagaaatcatgctactttgtccatccgacagtgctgacggatgttgatccttcaatgacgatcatgcatgaggaaacattcggccccgttgcgccgattacgtcttttaaaacgctggacgaagcggtcaagctcgccaatgatacgccttacggtttagcggcatacttctttacggaaaactaccgccgcggcatctatttatccgaaaaccttgattacggcattctcggctggaatgacggcggaccgtcaaccgttcaggcgcctttcggcggcatgaaggaaagcggtatcggacgcgaaggcggactggaaggcatcgagccgtatttggaaacaaaatatttgtccatcggtttggatgaataa

SEQ ID NO: 437 - DNA, 861 bp, Bacillus licheniformis
atgaaagtatcggttctgtttgtcttgcttgcggcaattttatggggaacgacgggaacaacccaggcatttgcgccgaaagaggcggcacctcttgtgttcggcgctgtcagaatggctgtcggcggcatcaccctgctcttgttcgcggctttccgcggtcaattgaaacgaagcggctggcccgttaaaacgctgatcatcgcagcattgagcatggcattttaccagcctttctttttttcagccgtcagcctgtcaggaatcgccgtcggaacggtcgtcgccatcggcagcgctccgattattgccggctgcctcgaatggctggtgttcaaaaaggttccgcagacgaaatggtggatcgcaactgctgcagcgatagcaggcgtagccttattattcattccctccgcctcatcgggggggagctttctcggcatactgctcgcacttggcgccggtctttcctttgccgtctacacgctgacaagcaagaaactcctgcaaaagcaaaagccggaggctgtcacaggcaccgtattctttttaagcgctgtattgcttgccccgttgttgtttctgtacgatctcggctggatctcatcggttcagggaatggctgtcagcctctatatcggggtcattgcaaccggagccgcgtacctgttatttacgacaggattggcaaaagtgcccgcctcaacggcggtgacgctgtcgcttgctgaaccgcttacagcgtcgctgttgggaaccgtgcttgtcagggaatcgctgcctcttgtttcctgggccgggatcgccctgcttcttttaggcattttttatattcctatcagcccaaaaaggataaaataa

SEQ ID NO: 438 - DNA, 492 bp, Bacillus licheniformis
atgaaaaaacgaacagttttattcttcttgttgatctggctcgccggatgtgcgagcgcccaagaggctgaggaacaaaccaaatgggtgaacagcgaacagaaagcgattgagaacggcattcgttatgaaagcattacaaaagacgatattatagacaaaatcgatttaaacggtgaacaagtcgtcgtttttcgattcggcgattcggagggagaggggattggcctcgcacacatcaaaagggaaaacggcaactatcaatggtaccgcgacttaaattacgcaattgtaaaatcggaccacccgaaaacggagaatgcggaagcttccgcgccgttcacaacccctaagggaagaaagtacacgttatatacaggggatgcagatcgcctgaatggtacatttgagactgatgacgggcttcatttggagccggtggtcgatcaaaaaacgggcatgtattatcagatcgtgcaggattcggactga

SEQ ID NO: 439 - DNA, 645 bp, Bacillus licheniformis
atgttgaaaaagacattatggatgggtgcaatcctagcatcatttttgcttttctccgtgccggtcagcgcacatgtcacggtaaaaccgaccgaatcagcagcaggctcatgggaaacatacactgtcaaagtaccggttgaaaaagacaacgccacgatcaaggtcgttctcagcatgccggacggtgttgaatttcagcagtatgaaccggtgccggggtggaaaacaagcactgaaaccggcaaaaacgaaaaagtaacaagggtgacgtgggaagccgaaaacggcggcattcagcctggtgaattccagcagtttaccttcaccgccaaaaaccctgacaaagaacaaaaggccgcctggaacgcataccaatattataaggacggcacaattgtcgagtggaccggtgatgatgacgccgataccccgcatgcaatcacaagcattgtcgacgctgcaaaactcggacacgaaacggttgatgcacacggcgcttcaacgaaacaaaacgctgccgcagaaaatgaagacagtcaaggaggacaagggattcaaaccgcttccctgatcctgtcgatcctcgccgtgcttcttggaggtgctgcgctgctcttgacagtgcggaaaaagaaatcgtaa

SEQ ID NO: 440 - DNA, 1647 bp, Bacillus licheniformis
atgaatgtgatgaaaagagcaacactctgggcagttctggctgttctttgtaccattctgctgccaaaagccgcttttgctcacgcttatatcgtacaatcaactcctgctgaaaatcaggagctgaaaaaagcgcctgaagaaattaagatcgaattcaatgaagcgattcagaacgggtttcattcgataacggtcagaaattcgtcgggtgaacgggtagattccggcaaaacggaaatcgacccccaaaacgcaaagatcatgaccgtcaagctgaaaccgaagttaaaggatgatatctactcggccgaatggagagccgtatccgcagacggtcatcctgtatcaggcacgatcccttttagtatcggaaacattcaaggcgggctgccgaaagatcagcaaaatcaagcatcaggcctgccggcagccgatatcgtcattgaacgcgtccttttgtataccggtttctccctgttcatgggagccgctctttttcagctcgtctggcaccgacctgaaaacggctggccgggtgacaaaaagcgccgtctgaagcggatcacgaatgtggcgctcttattgacaggggctgccatcatcattcagctgccactgcaaacaaaaacaaacgcaggcgtttcctggatcggggcttttcagccttcgcttttaaaagaaacgcttctgaatacgacgggcggaacgctgtggctgatcaacatcgccatcatcgccttgcttgttttctcttcgaatagaaaaggcctgaagagcgcgatcttgagcctgttcctttttgccggactattgttcgtcaaatcgctcgacggccatgccgcttcgacgagcgcaggctatatgacaatcgcgatgaacttcatccatctgaatgccgcttccatttggactggcggactcgcgatgtttgtgctgtttttcggaaaagactggctgaagcctgacaaaagtttgatatgggaaaccattcggcgcttctcgccatgggcgctcgcttcagcagggctactcatattctcgggccttttcaacagctttttcattgttcatacactggataacctgttcgggacggcttacggaaaagcgctccttgtgaaatcggcgctcgtccttctcatgatcggactcggggcatttcactattttcgttttagaaaagcgccgaaacagcagggcggccgttcgatgaaagctgaatgggcggtcgggcttctcattctgctgaccacggcggttttcaccaatattccaagtccgcccgcgccgctgccgcagcctttcagtgagacgaagcagctgacggaaggaaatacgctgtcactccgaatcagcccaaacatgccgggctcaaatacgtttgaagtcaccgtcagaaacagaaaaggagacgtcgtcaaagatatccaaaaaattgaattaaccgttgagaaaaccgggcttttcggggatgacaaggaaagcacgttcagcctcagcaaaaataaagacggtgttttccaaacgaaaaatttaaatttaagcgaagacggcatctggaagatccgcgttcacggattaacggcgtcatttgaggaaatcagaacagttttcaatgcaaaaattaataaaaaggagttttga

SEQ ID NO: 441 - DNA, 573 bp, Bacillus licheniformis
atgctaccgattaaaagaagggagcagattttggcttggatcaaagaagaagaatctctgcgcatttcggaaatttcgaaaaggctgaacgtctctgaaatgaccgtttaccgcgacattaaaccgctcgttgaaaacgggcaggtcatcaagaccgcaggcggaattacgctaaacaagccgaagcagcagcttgggcagctttgcgtcgtttgcggaaaaggggcaggttcgaggcttgccgtgcaaattgtcaaaaacgacagccaaattgaacagttttgctgcgtgcattgcgcaatgctccgctatgagaaagtgaaagatgatgtatcacagattatctgcagggattttttgctggatacgacgatcagcgccaaagctgccgtctttttgctggatacagatcttcatttgaactgctgcgagccgcatgcgctccctttcgcttctgaagcagaagcgcggaaattcaaaaaaggctttggcggacagctgttatcgtttgacgatgccgcgcttctggtccagaaaacgatgaagaacagctgctgcagcctgaagacatga

SEQ ID NO: 442 - DNA, 2295 bp, Bacillus licheniformis
atggggaaacaaaggcttgttttaataggaaacggcatggcaggggttcgcacggccgaagagatttcactacacggcgggagccggtttgagatcgtcatcatcggcagcgaaccacacccgggctataaccggattctgctgtcttctgtccttcagggagaaacggattggaacgatgtgatgacaaaaagccggagctggtatgaagaaaacgggattaccctttatacaggggaaacggctgtcgcaatcgatacggttaatcaaacggtggcgacagatcaaaaccgcgaaatcgcttatgacaaactgatcattgcgacgggctcttccccgtttatcctcccggttcatggtgcagacaaagaaggggtatatggttttagaacaatagacgattgccgggcattcataaacgcatcaaagcgatttaaaaaagcggccgtcatcggcgggggaatattgggccttgaggcggcgcggggattggcaaacctcgggatgaaggttgatgtggttcaccactcttcctccatcatgcagactcagcttgatccgccggcttctgccatgctccagaaagagctggagcgtcaagggatccattttcttttggagaaagatacagaggcgattttaggaacatcgcgcgccgagggtgtgcggtttaaagacgggacgaagatcagcgccgatctcgtcgtcatggctgccggtgtcagaccgaatatcgaactggccaaggcgagcggtatttcaaccaacagggcgatcatcgtcagcgactatatggagacaaatgttccaaatgtctacgccgtcggtgaatgcgcggagcataacggaacggtctacggcttagtcaagccactgtatgagcaggggaaagtgctggccaaacatatttgcggcctcgaatgttccggttatcagggctccgttcagtccgcggctttaaaaatgtccggaatcgacgtcttttcggcagggaaaatcacagaggacgactcgacgacggctattaaacttttagacgaagcggccggagtctataaaaaagcggtctttcaaggggataaaatggccggcgtcattttatacggagacaccagcggcagccaaaggctgttggaaagcatcatcaaacaaagggatattaccgttgtcaaaaaagagctgtttcaatcggaggaagacagttcagtcgcttctatggcggttcgtgaaacgatctgccaatgcaacgcggtttcaaaaggcatgatcatggaagcgatacagacgcacggtttaaagacggccgaggaggtcaaacgctgtacaaaagcttccgggtcatgcggcggctgcaggccgttggtcgaggaactgctcctccataccgccgaacatgatggtcacatatctgcggcggaacaaccgatgtgcgcctgcacttcattcacggaagatgaagtcgtgaacgaaatacagatgagaaatctttcttccgttcacgaagtcatctcggcgctcggctggaaaaatagcagcggatgccggatttgcgtgcccgcgcttcactactatttaaaaatgatccgtccggacatcgcctatgaggagcacgaagaggagacggatgccatcatcccgcaaatgtacggaggccggacgaatgccgaagagctgaagcgcattgcaggagtgattgaaaaatatcaaattcaagaggtgtacatgacacaccatcagagattaaagcttgccggcatcaagccggagcatatagagcgcgtgaaagaagaactcggcatgccgtattgcctgccgcaacagcagcggatcgccgcggttaaaacgtgcccatgcggatcaccgcagattcaaacattggcagcagacttggaaaaagcagcagaatccctcctcattccggccaaggtctccattggggtgtcgggctgtttggacgattgcgtgtacgcttcagttcatgacatcggacttctcaaagtaaacggaggatgggagatttatgcgggcggccaaggaggacagcatgcttccccgggagagctgctttcagtagccgactcggcggaggaagcgggtgaactcatgaaaggcctgcttcaatattaccgcgaaacagcaaactatcttgagaagatcgggcattggattgaacgcgccggcatcattcatatccgggaagttttatttgacaacggacttcgcggccagctgttcgaacggcttgaaaaagaaaagcggctggctcagcaagaaatgataaaagggctgatgtga

SEQ ID NO: 443 - DNA, 2160 bp, Bacillus licheniformis
atgacagaacgattgctaaagtactttcgcacaaagcaaaaagaagtgcaatccgaaaaaacgtatgacacccaatgtccattttgcagcatgcagtgcaaaatgcagctcattgaacagacgattgtgacaagaaaaaaatacacggcggtcggaaaagacaatccgacgacaaaggggcggctgtgcatgaaagggatgaacgcccatcagcacgcgtttcattcagagagaatcacccatccgctgatcaaaaaaaacggcgaatttgtccgtgtatcatgggaagaagcgcttcagtacatcaaagaacaagtaacagcgatccagcatgaagacggccgcgatgctttgagtgtatacggcagcgcgtccattacaaacgaagaagcgtacctgctcgggaagttcgcccgcgtcgccttgaagacgaagcatattgactacaacggcaggctttgcatgtcggcggccgcaacagctgcaaatcaaaccttcggaatggaccggggactgacaaatgccctttccgagatcccccatgcaagggtcatcatcctcgcaggtacgaatatcgccgagtgccagccgacgatcatgccgtattttgaagaagcgaagcaaaacagggcgtacatcatcgtcattgatccccgcgaaacggcaacggccaagatcgccgacctgcatttgaaaatcaagccgggaacagacgccgcgctcgcaaacggaatgctgaaaatcatcattgaagaacagctgacagacggagcttttatcagagatagagctgaagggtttgaagaggtcaagcgccatgtagcatctttatcgcttgaagacatttcggccaaaaccgggatacaaatcgagcagatcaaaaaagccgcggtaaaattcgcccgcgaggagacgggaatgctgttcacggcaagaggggttgaacagcagactgacggaacggctgctgtaagaaatttactgaatattctaatatcaacggggaaaatcggcaaatatgcttgcggctacggcgccgtcaccgggcaaggaaacgggcagggggcgcgggagcacgggcagaaagcagaccagctgccaggttaccgttcgattgaaaatgaagccgaccgcgcctatattgcggatgtttggggcataaaagctgaagatcttccgggaaaaggcgtatccgcttatgaaatgatgaagaaagttcatgaaggcgaaattacaggaatgtttttaatgtgttcaaaccctgttgtatccagcccgaccgccggctttgtcaaatccgctttgggtaaattaaagttttttgccgccgttgatttgtttctttctgaaacggcaatactcgcggatgtcgttctcccagcatcatcctatctcgaggacgaaggaacgatgaccaatctggaaggcagagtgacattaagggaagcctcaaagccgtgtcccggtgaagcgaggcatgactggcaaattatttgcgatatcgctaaagcgcttggaaaaggccgctatttttcatatcgatcggcagaggatgtttttaatgaattgagaaaagcgagccgcggcggaattgccgactattcgggcatcacctatgaacgtctgagaaaggaaggcggcattttatggccctgtccagaagaggggcaccctggaacacagcgcctgtttgaatcatccttctcccacccggacaaaaaagcaagaatgtgcgtcgtcccgaacgaaccaaaggtcaaaaaagatgtaccgactgaggagtatccccttattctgacgaccggaagggtgatgtctcactatttaaccggggtacagacgagaaggagcgctgcgctcaaggcgagacactttgaatcatttatggaaatccatccgaaaacggcggaaaagtacaatattggcgaccgggtgctggtcagggtggaatcaaaaagaggcagcatcatcgtcaggagcaaatggtcggaagccatcaggccggataccgtttttgtaccgatacattgggcggattcgcaaaatgtgaacgatttgatagcggaaacgctcgatccgtcctgcagcatgccgggatttaaggtttgctccgtgaaaattcgtccgtcagttgacaattttgtgaataaattgtcataa

SEQ ID NO: 444 - DNA, 2421 bp, Bacillus licheniformis
gtgaaaaaaaagcagcttgtccttgtagggaacggtatggccggggtcagggccattgaagaaattcttaaaatttcaaacgaagagtttcagatcacgattttcggcagcgaaccgcacccaaactataaccggattcttctttccaaagtgcttcaaggagatacggatgttaaggacattacactgaatgattgggattggtatgaagaaaacggcattcagctgtatacaggtgaagaagtcgttaaagttgatccggagtccaaaaccgtcatcacggatacgggaagagtccagccgtatgatgaactgattttggcgacaggttctctcccttttattctgccattgcccggagcggataaagaaggtgtaacagctttccgtgatatcaaggatacggatatcatgctcgaagcttccaaaacgtacaaaaaagcagcagttatcggcggcgggctgctgggactggaagcagcgcgcggacttctcaaccttggcatggatgttaccgttgtccacctcgcgccatatttgatggagcgtcagcttgatgcagccgcaggacggcttttgcaaaaagagctggaaaagcagggcatgaaatttttactggaaaagcagaccgaagaaatttacggagaaacacgtgtcgaaggcttaaaattcaaagacggctcaacgcttgaggccgatttggtcgtcatggcggtcggaatcaagccgaacgttcagctcggcaaagactgcggccttccggtaaacagaggaatcgtcgtcaatgattacatggagaccgaagttcccaacatttacgctgtcggagaatgcgcggagcataggggcattgcctacggacttgtcgcgcctctttatgaacaggcaaaagtgcttgccaaaaaaatctgcggcgttgaaacggctccgtatgaaggatctgttttatctacccagctgaaggtttccggtgttgaggtcttttctgccggtgactttaatgaggatgacggagaagacaaaaaagcgctcaaagtgtttgacgaacaggacggaatctacaaaaaaatcgttctgcgcggcaatcaggtgatcggcgccgtactgttcggagacagcagcgaaggaaacaggctgttttccatgattcaaaaaggagcggatatttctgatacttcaaaaatttcaatcttgcagcctttgaatcaggaagaaggcatgagcttgaccgctgcgatgagcgacgatgagatcgtgtgcggctgcaacggcgtttcgaaaggaatgatcattcaggcgatcaaagagcagggatgcacatcgacggatgaaattaaagcatgcacaggcgcatcgcgctcttgcggaggatgtaagccgcttgtcgcagagattctccagcatacgctcggctcagaatttgatgcttcagcacaaaaagaagcgatttgcggatgtacggacctttcaagagacgaactcgtggccgaaatcagagaaaaagggctgacccatacaaaagaagtcatgaacgtgctcggctggaaaacggcggaaggctgttccaaatgccgccctgcgcttaactactacctcggcatgatcaatccgaaggaatatgaagatgaaagagaatcccgcttcgtcaatgaacggatgcacgccaacattcaaaaagacggcacatattcagtcgtaccgcggatgtacggcggggtcaccaattcgaatgacttgcggcgcatcgccgatgtcgtcgacaaatatgaaattcctctagtgaaaatgaccggcggccagcggatcgatctgatcggcgtcaaaaaagaggatcttccgaaagtatgggctgatcttgacatgccttctggatttgcttacggaaaaacgctcagaaccgtaaaaacgtgcgtaggcgaacagttctgccgcttcggaacgcaagattcaatggctctcggaattgaccttgagaaaaaatttgaagggctctacacgcctcacaaaattaaaatggcggtttccgcttgtccgagaaactgtgctgaatccggcattaaagatatcggcgttgtcggcatcgacggcggctgggaaatttacgtcggcggaaacggaggcacacatctgcgtgcaggcgatctgttaatgaaagtcaaaacggctgaagaagtcatcgaaatcacaggcgcatatctccaatactatcgtgaaacagccaactatttagagcggacatctgcatggatcgaacgtgtcggcttgtcccacgtccaatccgtattgaatgataaagaaaaacgcaaagagctgaatgaccgcatcaatcaagcgctgtctgtccataaagacccgtggaaagactttttggaagacggaaagacaacaagacagctattcgaaaatgttgtcacttcctaa

SEQ ID NO: 445 - DNA, 321 bp, Bacillus licheniformis
atggtgaacaagaacttaacaaaggtgtttgtttcgaagatcggggatttgccgaatcagcttgggaagacagtgttcatcaaggacaaggaaatcgcggtattcaagctttcaaacggcagcgtccgcgcgattgaaaaccgctgcccccacaaagggggcgtgcttgccgaaggaatggtaagcggcgaattcgtcttctgtccgatgcacgactggaagatcagccttgaagacggcaaagtccaagagcctgacacggggtgtgtgcagacatacgaaacggtcgttgaaggcgaagatttgtatatcgtttattaa

SEQ ID NO: 446 - DNA, 1461 bp, Bacillus licheniformis
atggggaatgggaaagtttattttgtcggggccggaccgggcgattcaggattgatcacattaaaaggaagaacgctgatcgaggcggcggatgtcatattgtatgacaggctcgtcaattcccggctgcttgagcatgcaaaagcatcatgcgaatttgtctactgcggcaagctcccggaccgccattatatgaggcaaagtgaaatcaatgcactgctcattgaaaaggggctgaaaggcctcaaagtggtccggctgaaaggaggagacccgagcgtgtttggcagagtcggggaagaagcggccgccgtcagcgaacacggcatcccgtacgagatggtgccaggcattacatcgggaatcgccgctcctctttatgccggactgcctgtgacccaccgcgatttcgcttcatcctttgccgttgtcaccgcccatgataaatcgggcaaaccggagatgaattgggaagggctggccaagggcgtccaaaccctcgtcttttacatggggatcaaaaaccttggttatatatgcgagcagctgatgaaacacggcaagtccccccttgttcccgcaatggccatccaatggggcacatggggccggcagcggagtgttaaagggacattgcagaatatcagggagaaaataaccgagcatcagatcaaaaatcccgcgattatcgtcatcggcgacatcgtatcattcaggcagaacagctggtttgaagaaaagcctttgatcgggctgaacatcatggcagtcaaaagctgtgaagaagaacaaattccagtggaggcgcttcgtgaacaaggcgctgaagttgtggaatggccgaaatggaaatcggccgaaacggtgcctgacgatgcacttttaggtcgaatcgcttgttttgacagcctgctgttcacctcaagtgcgtcactgcgcagatttttcagccggcttgctgctttgaagatcgatgtcagggaaatgcgcggaaggctttacgcttcagatcagcatgtaaaagcagctcttgaagaacggggatttgaagcctttctgcaaacggaaatgccggtctcgggcagctgtttgctgatcggcagccgggaagccgtgcaaaattacccgcactccgggtgcgaggtattgattacacatgacagggtgatcgacagccgctttacctcgatcatcaaacgggaaattgatgagtttcctattgatatagtgttgttttcaaatcgaacatgcgtcgagctgttcgtaaacgaggcggagacagtcggcctccatccggaaaaaacggctgcccgtcttcaggcgttctgcctcactgaagaagcgggggagagagctgcagccgtagggtttcagcgcgttcatgcagtgaatgatcgcgatcgcctgccggatgtcatcaaagagatcaaccgaacagccgaatttgtctgtcagagctga

SEQ ID NO: 447 - DNA, 681 bp, Bacillus licheniformis
gtgaagttttcgatccaacgtgcagtctcttatcatgatcaagtccatcattatttaaaagatatgattattaaaggaggatatcagcccggcgaacggatctatgaatccaaaatcgccaaggagctgcaagtgagccgcagccccgtcagagaggcgattcggacacttgaacaagaaggcctgttattgatagatgataaatcaaaaattacagtttatgaaccgacaatcaaagatcttgaagaaatataccaatgccgtcaggcgctcgaatccctggccgtttctttggcgactcgccttgcctctaatgaaacactggagctcatttccgaaacgctctctgaggcgcataagcaccagaaaagccaaggtccggagtcggctaatgctctgcttcgcctaaatacgcaatttcatgatgccatcatcgaagcgagcgaaaacgaacgcctgcaaaaacagctgcttgatttacggtcgctgacctttttctaccggagcaaaaaccttgaaaaaccggagcgcactcttgaaatcatcaatcagcacgaggagattctgcgtcacatgcaggacagaaatgacgcaaaagcagccgaatcaatgaggaagcatatagaggcagacctttgctacttaaaagaggtgttgttcagaagcagtgccgcacgctaa

SEQ ID NO: 448 - DNA, 1641 bp, Bacillus licheniformis
atgaaatcaagcgttgtgtcagcatgggatatgctttggagatcacaccgggaagcaaagaggctgcttttgttcgccatgcctgtcagggcgggaaaagatgccggtttaaagataaattcggaacaaaccatgaaggaagagaagccgccgagctataaaacgcctcaaaaaatcgggctgctgcttggtcctgcattgtttttcgctgtccttttgttcttttttcccgagggtctgagctatgaaggtagaatggtattggcgactactttgtgggttgcggtttggtggattacggaggctgttccgattccggctgcatcattgctgccgatcgtgctgcttccgctgacgggggcgctggaaggggcagctgtcacgtcgagctacggcgatccgatcgtctttttattcttagggggcttcttgattgcacttgcgatggaacgttggaatctccataaacggattgcgctcaatattatttctgtagtgggcacgagcacctcgaggatcgtcctcggttttatggcggccacaggatttttgtctatgtgggtctcaaatacggccgcggtgatgatgatgcttccaattggaaccgctatcattcatcaggtatcagctgtcataaagtctgaaagaaaagatttagccgcagaagaggcgaaattttcaaaagcgctgatcttcagcatcgggtatgcggggacaatcggcggactcggtacgctgatcggcacgccgccgaacattattttggcggccaatattaagaagctgtacggagttgaagtgtctttcggcggatggatggcttttgccgttccggtcgtcgtcattttgcttgtagcggtatggctgtacttgacgaaagtggcgcatccgatcaagatgaaggagcttccgggcggaaaagaattgattctcgaagaaaaaagaaagcttggaaagatgagttttgaagaaacaatggttctgctcgtcttcgggtttgccgcgtttatgtgggtgacgagaacgtttttatgggatgacaaaataccgggtattgacgatacaatgattgcgatattcgccgcttcattgctcttcttgatcccttcgctcaataaagggggcagggtattggactggtcggtatcaaaggacttgccgtgggggattctccttttattcggaggaggcttggcgctcgcaacaggttttaaagaaacgggtctggcggagtggatcggcggaaggctgacggtattggatggatttaactttgtggttattgtcatcatctcaacggcattggtgctgtttttgacggagattacgtcgaatacggctacggcgaccatgattctgcctgtactggcctcgctcgctttagcgctgaatgttcatccgtacgcattaatggtgcctgctgcaatggcggcaaactgcgccttcatgctgccggtcggcacgccgccgaatgcaattattttcgcatcgggcaaattgaagatcagcgaaatggttcgaaccggctttgtcattaatattttcacgctaattttaatcgtcggagctgtgttctacattcttccgcatttatggggagtagatctgaccgtcttccccgacaatctgaaatcgaattga

SEQ ID NO: 449 - DNA, 222 bp, Bacillus licheniformis
ttgaaagaaccggctgaaatcggctttctgtcttcggtgaaaaaagccgaatgcaccggcaaggccgttgtgggagacaaacttgatctatactttgaagtttcccgctataaacgggggtttttattcggcaaaggaaccgcctcagtaaacggaaaacctgcagtgaaagcagagatcggaatttttatggagcaaagtgaaagcgggggagaagattga

SEQ ID NO: 450 - DNA, 468 bp, Bacillus licheniformis
ttgatagaaataaagcctgtcgcgtttgtggaaaacttgcggactttcccgaaggatgatcattggggcgatgtgatttctgaaattaagttggctgaaggcatccatccggacgctttaaaagggatcgaagaattttcccatttggacattatcttttactttcatcaagtaaaagaggaacacattcaatataaggcgaggcgcccgagaaacaataaaaactatcctgagacaggcattttcgcccaacggggaaaaaacaggccgaacaggctcggcgcgaccgttgtcaccctccttgaaaaatccgggagcaagcttgtagtgaaagggttggatgcgattgacggaacacctgtaatcgatatcaaaccggtgatgaaagagtttctcccgaaaggacaaatcatacagccgaaatggtcggaagatttgatgaaagtatattggcatgcagctgattga

SEQ ID NO: 451 - DNA, 2052 bp, Bacillus licheniformis
atgatcaacgagaaacgtcctgctcaattgctccaatatttgctgcgtgtcagagaggcgacaatgcatcagctgattgatcattttcaattatcgaaacggcaaatctgctatgacctggacaaaatcaatcattggctgaccggcaagcagctgcctgaaatcgaatataaaagaaagaacaggctggccgttccggaaacattgcttgaattgcggttctccgaagcctgttcagacatcggccgctcgtttatttttacgcaggaagagcggatcaaggccttgtacatgtttctgtttgtccgcagggagccgatttcatccgctcatctgacacagctattgcaggtcagcaaaaatacggtcatgaatgatgtgaaaaaagcgaatgaggcgctgactccgtttttagtggcgatcaaatatacaagacagcgcggctatcatttaataggaagcgagtttgataaaagagttcccgtcatgcaccacctttcttctttcctgcaaaagccttacggcaaagaaatccttcattatattttaaaaatttccggctcgcgcgatcacaaacaacaagaatttaaaagagcggttgaacttgtctcaaaagaatacgggcttcaactcgtcgaagaaaggcttaatgaatttatctactttctgatgatgtattcgatcagagtggccgaaggaaaaattgtccgttttcaccaggaggagggtgagcttttaaagcaaagtccgctgaaaaacgcagccgtaaggcttgtgaatgagcttcggattcccgttcatgaaacggaactttgctacattttgatccagctgctcggtctttcattcggacagcagccggcacatgatccgctttatcagctgtgtgaaaaacttgtatttgaatttgaatcaagagcatgcatcacatttcccaggaggcgcgaggtggcggaatctctttaccggcacttgaagccggcatatttcagaatgaaataccgcattccgattcacaatcccttgctcagcaaaattaagaaagagcataaagaactgtttaccatcgttcaaaagctgatgcggcaccttgaagcgctgttgaacaaaccggttccagaggaagaaatcggctttatcacaattcattttggtgcattgcttgagcagccggtgcagtccgggtcatccaaaaagacggcagtcgtcgtctgtccgagcggtgtcagctcatccttaatggtcaggcgccagcttgaatcgttattttcagagattgtcgttgagaaagcgatgtctttgcaggaattcacacctgacgtctttgatcattatgatgccgtgttttccaccgttgagctgaaaaccaaaaagcgatactacatggtcaggccgctgatgacgcccgctgaaaaaagcaggcttgtcaatgaagtgtatcaggaaatgttcggtgtgaagcaaagggagcttttgacagacgaatttcttcacatcctcaagaagcatgccagtatcatagacgaaaaaggactaagagaatcattgaaaaatattgcatttgttcaaaaagtgacggaaacaagggggaaacgaccagtgctgaaagatcttctgacagatgaaaccattcaaatggccgaccaaatcaaaggctgggaagaagcgattcaaacagcggcaaagcctttgcttgataaggaggtgatcttgaaggaatacacggatgccatgatcgacaatgtcaaaacgatgggaccttatatgattatcggccccgagattgccatccctcatgcaagacctgaaaagggcgtccaaaaggtgggaatgagtctcctgaaactgaaggagccggtctattttttggatgatgagcagtatccggtaaggcttttgttttgcattgcggcggttgaccatacgacacatctgaaagcactttcccaactgacccggcttctcagcaataaagaaaatcaggattccttaaaggaaaccgagtcgttggagcatatcaaacgtttaatcgaagcctattcatccaattaa

SEQ ID NO: 452 - DNA, 282 bp, Bacillus licheniformis
atgaagatattggcagtttgcggatcaggactcggaagcagttttatgctggaaatgaatattaaggatattttgcaggaaatggggttaatggagatcgaggtggatcattcggatttgagttcagcgtctcctgatcaagcggatttgtttatcgttgccaaagatatcgcagaaggagcggcccacctgcgcgatatcgtcgtgcttgaaagcattatagacatggatgaactgaaaacaaaactggttaaaacattgcaggaaaaaggagtgctttaa

SEQ ID NO: 453 - DNA, 1374 bp, Bacillus licheniformis
atgggtgaaagagcactaaagctgatgatggatgtgttaagccagccggctgtattaattgcagccatttctcttatcggtcttctgcttcaaaaaaagcctgccaatgaaattgtgaaagggacgaccaaatcgtttttaggctttatcgtgatttcagccggggcgggcatccttgttggctcgcttgagccgttcggaaagatgtttcaagcagcctttcatgtgaacggcgtcgttccgaacaatgaagcgattgtcgcgatggcgctcaatgaatacgggacggcaacagcgctgatcatgtttttcgggatgctgtccaacatcttaattgcccgttttaccagattaaaatacatttttttgaccgggcatcacacattgtatatggcatgtttaatcgccgttatactggcggtggcgggtttgaagggcccgtttttgatcggcgtcggagctgtttcgctcggcttgacaatgagtttgtttccggcgatggttcagccttttatgaaaaagataaccggcaatgataaggtcgcgttcggccatttttcttcaatcggttacgctgtgtccgggttaatcggcaaagcggcaggcaagggctcgcgctcaactgaaaaaatccggtttccaaacggcctcggatttttaagggacagctctgtcagcattgcgctcactatgaccatcttgtacgttttgattgccttatttgcaggggcgggctatgtggagcgcgagttgagcggcggtacgcattatcttgtcttctccgttattcaagcggtcacatttgcggcaggggtgtttattattctttcgggagtcagactcgtgctcgcggagatcgttccggcttttaaaggcatatctgacaaactcgtaccggattccaagccggcactggattgtccgatcatttttccgtacgcgccaaacgccgtattaatcggctttttttgcagcttcattggcggcatcaccggcatgctgattctcggagcggccggagccgtcatcgttcttcccggagtggttccccactttttcacaggagcttcggccggcgtcttcggaaacgctgcaggggggatacggggagcggtcttggggtcttttgtcaacggtctgattatcacgtttttccctgtgttcctgctgccggtcatgggtgatttaggctttgccaatacgacattttccgataccgattttgccgcaacaggaatcgtgcttgggcatgcggtgaaactgctgggatctggaggcgttgtaattggaatcgcagcggtagtggttggcgcagtcttgttcggctttaaacgcggaaaggcggaaaagccagatcagaaagtcgaagcataa

SEQ ID NO: 454 - DNA, 843 bp, Bacillus licheniformis
atgtcagtaagggaaatcgatatggagcgttttcgtgatcaaatcaggctgctgacattgaaacagcttcatcacctcggctttggacattatggtggcagcttgtcaatcgccgatgtgttggccgttttgtatggaaaggtgatgaaaatagatcctgccaatccgtcgtgggaagatcgggacttctttatcctttcaaaagggcacggcggccccgccttatatgcagcgcttcatctttccggctattttgaagaagatgtgctctatacgctaaaccaaaacggcacagctcttccgtcgcaccctgaccgaaatttaacaccgggagtcgatatgacgaccgggtcgctgggccaggggatctcggctgcagcaggagtcgcgctgtcgcacaagctttcaggacgcgctaaccgcacctttgtcattgtcggcgacggggagctgaacgaaggccaatgctgggaagcgatccaatttgcggcgcaccataagctccgcaatctttatgtgtttgtggatgataataaacaacagctggacggcccgacgaaagagattatcgatccgctggattttgtcagcaaatttagagccttcgggttttattccgaaagggtaaacggacacgaaccggaagcgatttatcgtgcggtcaaaagaggcgaagcccagcgggaaaggccggttgccgtcatccttgatacggtgaagggaaagggcatcccttattttgaaaaaatggagaacagccaccacattagagcaaatgaagagcaaaaccgcatgatcgaaaggatcattttgacgcttgaagaaaaggaagtgagggcatga

SEQ ID NO: 455 - DNA, 951 bp, Bacillus licheniformis
atgaatgaggcggcaaatgtagagctggacgctgttgaaatgaggcaggcatacagctcagccgtttatgaactggctcaagaaaacacggacatcgtggccttggaagcggatttgatgagctcgatctccatggacaaagtcaaacggcgcattcccgagcaagtgatcaattgcggtgtcatggaagccaatatgatagggattgcggccgggctttcgttaaccggaagaatcccgtttgttcacacgttcgctcagtttgcgacaagacgctgttttgaccagctgtttgtttcaggtgcatatgccaaaacaaacattaagattctcggatcagattcgggaattacggctgaacataacggcggaacccatatggcctttgaagatttgggactcgcccggctgatcccaaacgcctttgtttatgaagcaagcgatgcggcaatgctcaaatttttgatcaaaaaggctgcggcagagtacggcattcactatatcaggacgatcagaaaaaaggctgtcaggctttatgatgaacacgaaacattcgcagacggaaaagcaaaagttctcaaagatggcagcgatgcggcgctgtttgccagcggcatcatggtcgccgaagctttgcaggcggctgaactgctaaaagaaaaaggaatcgatgcagcagtgatcgatatgtattgcatcaagccgattgatcaagaaacggtggttcgttatgcacaaaaaacgaatgcgattgtcacggctgaaaaccataatgtcataggcggattgggaagcgcagttgcggaagtgctgagtgaacattatcccgcgccgcttaaaagaatcggggttcatgaagccttcgggcaggtcgggacaatcgattatttgaaaaaatcttaccgtttgaccgcagaacacattgcactggcggcggaacagctcgtttaa

SEQ ID NO: 456 - DNA, 756 bp, Bacillus licheniformis
gtgtcagtcagtcaaagaaatcgaatcgatgtgaagctagtagctctggatatggatggaacactgttaaatgacgaacaaaccatttctgatgaaaacagaaaagcgattaaagaagctgaggaaaaaggggtttatgtcgtgcttagcaccgggcggacgctgatgacgtgccgggagttggcggagtcgctcgaactgtcttcttttttgatcacggcaaacggcagtgaaatctgggattcgtctttcaacctggtcgagcgccagctgcttcatcccgatcatgtccaaatgatgtgggatttgcgcaatctgcacaacaccgatttctgggccgccagtgtcgataaagtgtggagaggcgagtttcctgaggatatacaagcgtatgaatggctgaaattcggctttgatattccggatgacgacgtcagaaaccgggtcctggaagagctgaaaaagaacaaagaattggaagtcaccaattcaagcccgaccaatattgaagtcaatgccatcgggatcaataaagcggccgctttggcaaaagtgtgcgagcgcctcggctttacgatggaacatgtgatggcggtcggagacagtttaaatgatatcgccatgatcaaagaagccggtttaggcgttgccatggggaacgcccaggaaatcgtcaaagaaaccgcggactggattacagattccaatatcgaacacggagtcgcaaaggcgatcaggcattgggtattgtcctag

SEQ ID NO: 457 - DNA, 762 bp, Bacillus licheniformis
atgaatcaagttgatttaaactgcgatcttggagaaagcttcggcgcttataaaatcgggctggatgaggagattctcgagtttgttacatcagccaacatcgcttgcggatttcatgcgggagaccctggcgtcatgcgcaaaaccgtcaaaatggcggcggaaaaaggcgtgaaaatcggcgcgcatccgggacttcccgatttagcgggattcgggcgccgcaatatggcgatcacgcctgaagaagcatacgatcttgtcgtgtatcaaatcggtgcgctttcaggatttctaaaggctgaaggcgtgaccatgcagcatgtgaaaccccatggcgcactatataatatggccgcgcaaagccgggaactgtcggatgcgatcgcgcgcgcagtttatcaaacagacccggaactgattttattcggtttggcgggaagcgaacttgtgcttgccggtgaaagagccggtttaaaaacggctcacgaagttttcgccgaccgtacatatcaagaagacggaacgctgacttcccgccgccagaatgatgcgctgattcaagatgacgatgaagccgtcggccaggtgatccgcatggtgaaagaaggcaaggtccgcagcctgcagggaacggatgtcagccttaaagcagatacggtgtgcattcacggtgatggtgcacacgcgcttcattttgcgaaaaaaatccgccgcgaactcagagcagcagatattaaagtacaagctttttctacatga

SEQ ID NO: 458 - DNA, 1212 bp, Bacillus licheniformis
ttgaaacaaaataaaaaaacaaaagcgccggcaggcaactggacgttgcttttgggcgccgcttttttaatggccacatctgcaatcgggccgggatttttaacacaaaccacagtatttacacaatctttggccgcaagcttcggctttgtcatcctcgtttccatcattttagatattttcgcccaaaccaatgtgtggagaattattgcggtttctgaaaaaagagggcaggaaatcgccaacctcgtcttaccgggactcggctattttatcgcctttcttgtcgttctgggcgggcttgccttcaacatcggcaatatcggaggcgccggtctcggcatgcaggttttattcggcatttcgccgcagatgggagccatcatcagcgccgtcatcgcgattttgatctttgtcattaaagaagcgggaaaagcgatggaccggtttacgctgatcgcaggctttgtcatgattttactgacggtgtacgtcgctgtcaccaccggacctccggtaggggaagcgataacgaagacggtcatgcctgataacattgattatcttgcgattataacgcttgtcggcggtacggtcggcggatacattacatttgccggcggacaccgattgcttgatgcgggtgttaaagggaaggatgcgatccctgaagtaacgaaaagctctgtttccggcattttgatcacgtctgtcatgaggattgcgcttttccttgccgtacttggcgtcgtatcaaaaggtatgcagattaatccggataatccgccggcatcagtattccagcatgccgcaggaaatgtcggatacaaaatcttcggcctcgtcatgtggagcgctgctattacatccgtgatcggtgctgcttatacgtcggtatcattctttaaaacgttttctccgaaaatcgaaaagaattcacgcggcattataattgtctttattattgtatcaacgctttgctttgtaacaattggaaagccggtcaaccttctcgttcttgccggcgcattaaacggcttaatcttgccgatcgcactaggctcccttttaatcggcgcacataagaagaatgtcatcggcgactacaggcatccgatctggcttacaattccgggcattctggtcgttattgtcatggccatcatgggaggctatacgttaatcaatgaaattcctaagttatggggatga

SEQ ID NO: 459 - DNA, 789 bp, Bacillus licheniformis
ttgcatgtaaatgaaatgcgtcctgacgaagtcagggctctgattcgaaaaggggaaataacgggtccgacagccggcatggccgggggttttacccaggcaaacctggtgattttgaaaaaagagctcgcttttgagttcttgctgttttgccagcgcaatcaaaagccgtgtccgattcttgatgtcacggaccccggatctccggttccgtccatcacggcgccggacgctgatatccgcaccgattttccaaaataccgcgtatacaagcgtggcgaattggcggatgaagtgacagatatctcttctttatgggaagacgacatggtcggttttttaatcggctgcagctttacgttcgaacaagcgttaatgaataacggaatccctgtcagacacattgaagaaaagcgaaatgtcccgatgtatcaaacgaatattccttgtgtcccggcaggccgttttcaagggcctatggtcgtcagcatgaggccggttccggaagagcaggcggtgcgagccgttcaggttacatcaaggcttcccgccgttcacggagggcctgtccatatcggcagtccagaagccatcggtataacagacatcgcaaaacccgatttcggcgatgcggtaacgataaaaaaaggggaagttccggtattctgggcttgcggcgtcacccctcaggcagtcgcaatgcacgcaaggccggagctgatgattacgcattcgcccggccatatgctggttaccgatgttcgggatgaacaatttggtgtgttatag

SEQ ID NO: 460 - DNA, 735 bp, Bacillus licheniformis
ttgaaaaatctttcgaatgcgacaatgtctccgctcggcgactccgcggttatcatccagcttggagaggggataagcgaacagacgcaccgtgtcgtcagcgcgctgacaaagcggattgaaaacgatccgtttcccggttttattgagtgtgtgccggctttcacgagtgtgaccgttttctatcagccatttgaagtataccgcaagatggagagcggcaaggctgttgattctccgtatgaaaaggtaaaagccctcctcgaccatcatctccaagagctcacaatggaagaagagacagatcagcgcacggtggaaattccggtttgttacggcggccgtttcggccctgatttggaggaagtggccgacatcaacggcctgactgcacaggaagtcatcgatattcacacctcgggtgagtacctcgtttatatgatcggctttgcgccgggcttcccttacctaggcggaatgtctgaaaagatagccgcaccgcggcggtcatctcctcggacttcgattcccgccggttcagtcggaatagccggcatgcaaacaggcgtctatcccctttcaacgccgggcggctggcagctgatcggcaatacgccgcttgaattattcaagccttatgaacagcctccgagccttctgagagcaggggatatcgtgaaatttgtcagcgtgacagaagaggagtatcacgcgctgaaggaggggaaatcttga

SEQ ID NO: 461 - DNA, 1014 bp, Bacillus licheniformis
ttgagcatagaagtgttaaagccgggtctgatgacaacggttcaagacttgggccgcacaggttttcaaaaatacggcgtgcttgtcagcggtgccatggatgccgattctttgcggattgccaatctgctcgcggggaacagccagaacgaagctgcgcttgaagtgacgctgatggggccggggccgtctctccgctttcaaaaacctgctcttatagcggtgacgggcgctgacttttcactgatggtaaatgacgaagaagtcccgctttggcgcccggttttcatcaaagagggcagcgtgttgacattcggcatgtgcaagcgcggaagccgtgcatatatggcagtggccgggggaattgatgtgccgcctgtaatggaaagcaaaagcacatatgtcagagcaggactcggcggctttcaaggaagggcgcttcaaaagggagacgtgttatcgctaggcagcccgacgccgttgtcggaagcgctgcacagaaagctcgcagacgagggcaaagaacggggctttgcggctccgaagtgggctgtcgaccgcaaatattttctcccgctaaaaaagaacccggtcattcgtgtcatcaaaggcgatcagtttgcttgctttacctcatcatcacaagagcgctttttcgcgggtccattccgggtgacggctaaatccgaccggatggggtaccgtcttcaaggagaggcgctcgaactcactcagcctctggaaatgatctctgaagcggtatcattcggaacgattcaagtgccgcccgacggcaatccgatcgttcttctcgcagacaggcagacagcgggcggatacccgagaatcgcccatatcgcatcagctgatttttctcaggtcacgcagatgatgccgggcgagcaggtgcagtttcagcttgtcagccttcaggaagcagagcgcgtttacatcgaacgggagacgaaaatcagcgaactttctgcccgattgaagcttgaatacatgttatga

SEQ ID NO: 462 - DNA, 750 bp, Bacillus licheniformis
atggaacataaaaacaaaacagtcgtcaaagccatgaccctgctcaatctgttcctgacgagagaaaggctctcgctgggcgacatgattgagctgacaggcatgccgaaaacatctgtctaccgcatggtttgttctctcgaagaaatgggttttctcgaccgcgacgagaacgggatgtatagcttaggactgctgtttttgcaatacggccaccttgtttcagaaaggcttgatattcgaaaaatcgctctgcccatcatggaagaactccgcgatgacgtggatgaagccgtccatttaattgtaaggcagggaaatgaagcaatgtatatagaaaaaattgagggcacgcagaccgttcgcctctatacagcgatcgggaggcggtcccctttatatgccggagcctgtgcgagaagcattctgacgtttttgcctgaagaggagcgggatgcctatatcgagcaaacagagctggtgccgatcgcttccggcacgatccgggacaaggctgagctgatccgcattgtggacgagtcgtaccggagcggctgcacggtcagtcattcggagctcgaagactacacctccgcgattgccgcgccgattttcaatcataagcgcgaagtcgcagctgggatcagcatcgccgggtttgaagcccgctttcagaaagaccgtcttccttatttgaccgaaagagtgaaaaaggcggcgcttgacatctcgagaaaattaggtttttag

SEQ ID NO: 463 - DNA, 639 bp, Bacillus licheniformis
atgacgcttcaatatacggctctcggcgactctttaaccgtcggggtcggtgcaggtttgtttgagccgggatttgtacagcgctataaaaggaaaatggaagaggatttgaacgaagaagtttctttgattgtatttgcgaaatccggtcttgagacgtcggaaattttagcgatgctgaacgagcctttcatcatggaacaggtcaaaaaagcggacgtcatcacgataacgggctgcggaaatgatcttctgcaatcgctggagatatatgaaaaagaaaaggatgaacacgtctttttggaagcttcctcccactgtcagaaaaactactcaggcatgcttgagaagatcagagaaataaagggagaaaaagatacgcgttatctcgtccggcttctcaatttatacaacccatttccgtcaatcgaattagcggacaaatggatttccggctttaacaggcacttaaagcagctagagtccgctccgcaaatcaaggtgatcgatacttatgctgtctttaaaggacgcgaaaaagaatatttgtcaattgaccgtgtgcatccaagcagcagagggtatgaagcgatgtcggaaaagctgagagcggcgggctacgggcggctggagggctga

SEQ ID NO: 464 - DNA, 1932 bp, Bacillus licheniformis
atggaagatagacaaaatcaagatttcaaagtaaagattcaacgtttcggaagctatttgagcggaatgatcatgccgaatatcggtgcatttatcgcatgggggatcattaccgcattgtttattccgacgggatggatgccgaatgaagcgcttgcttcattggttgatccaatgatcaaatttttgctgccgctcttgattggatacacgggcggtaagatggtgtacgatcaccgcggaggcgtcgtcggtgcgactgcagcgatcggcgttatcgtcggcgcggacattccgatgttcctcggcgcgatgatcatggggccgctgggcggctacctgatgaaactgacggacaggcttttcaaagataaggtccgttccggatttgaaatgctgatcaacaactttacagccggaattctcggcttcattctggcggtgctcggctttcttgcaatcggtccggtggtgctcggcttaaacaaaacattggcggccggcgtggaagtgatcgtcaatgcgaatctgcttccgctcgcaagtatttttgtagagcctgcgaaagttcttttccttaacaatgcgatcaaccacggtattttgagcccgattggtattgagcaggccgcccagacaggaaaatcaattttattccttttagaggcgaacccaggccctggtctcgggattcttttagcttacatgattttcggaagaggcacatcaaagcagaccgctccgggcgctgcagtgatccatttcctaggcggtattcacgaaatttatttcccttacattctgatgaaaccgctgttaatcctggctgcaatagcgggcggagcgagcggtgtgctgacgttttccatctttaatgcggggcttgcggctgttccttcacctggaagtattattgcggtgctggcgatgacgccgaaaggcaaccacatcggcgtgatccttggtgttctcgtcgcagcagtcgtttcattcattgtagcttctttgattttgaaaacgtctaaagccggcgaagaagatttgacggccgcggcggaaaaaatgcagcaaatgaaaggcaagaagagccaggccgtttctgcattgacttcggctgacgaagcggaagaatcagcggctccgtacgaaaatgtcagcaagatcatcttcgcgtgtgatgccggaatgggctccagtgcgatgggggcatcaattttgaaaaacaaagtcaaaaaagcagaactcgatatcgacgtatccaatacatcgatcaataatctgccggaagatgccgatatcgtcatcacgcataaagacttaacggaacgcgcaaaagcgaagcttccaagcgccagacacatatcggtggaaaacttccttaacagtccaaaatacgacgaactgatcaatcagcttaaaaagtaaagtttgagaacccgtgagcctgaaaatcaggctcacacaacatgtatgaaagagagtgatttcccaatgaaaccagtacttgcaaaagaaaacattcatctcaatcaatctgccgcaacgcaggaagaagcgatcagactggccggaaaggcgctggttgacgccggctatgttaccgcggattatatcgagaaaatgttggagagggaaggcctcacttccacttacatggggaacgcaatcgccattccgcatggtacggaagacagcaagcaggatgttcttcattccggaatatccgttatccagcttccggaaggtgtcgaatacggcgatggcaatattgctaaagtgatctttggcattgccggaaaaaatgatgagcatttggagattttgtcaaagattgcgattgtctgctcagaagcggacaatgtcgaacggatcatcaatgcgaaaaatgaagacgagttaatggcggtttttgaagaaggtgaccaggtatga

SEQ ID NO: 465 - DNA, 1140 bp, Bacillus licheniformis
atgattgcactgcatttcggtgcggggaacatcggccgcggatttatcggagccttgctctgcaaatcggggtatgatgtcgtgttcgccgatgtaaatgatgccgtgatcaatgaactgaacgataagggccgctataccgtcgaaatggccgatgccggaaggaagcaggaaacgatcggaccggtccgggcgatcaacagtgcgacccagcttgacgaattgtatgatttgatagcgaaagccgaccttgtcaccacagcggtaggcccggcggtgcttaaattgatcgcagagccgattgcagaaggtttgaagcgtcggatgaaaataaacaagcagcctttaaatattatagcttgcgagaatatgatcgggggcagcgctcatcttcgcgaggaaattttcgcccgcttaactgaaacggagcgcgccgcaatcagcgattcagtcggctttccgaactcggcagtcgacagaatcgtgccgatccagcaccatgatgatccgttgaaagtaacggtggagccttttttcgaatgggccgttgatcaaacggaattcgccggaaaagtgccggatattgaaggtgtgacatatgtagcggatcttgcgccattcatcgaaagaaagctgtttacggtcaataccggacacgccatggcggcgtatgccggctataagaaaggtttgaagacgataaaagacgccattcatcatccggaggtccgccaaacggtggcaggcgcgctagaagaaacaggccggtaccttgtccaaacatacgattttacacaggaagagcaccgggcatatatgacaaaaattatcggccgctttgagaatgaatgcctgtcagacgatgtcacccgtgtggccaggtcgccgcttcgcaagcttggcagggatgaccgtcttgtcggcccggcccggaagctttgcgatctcggctttgaacctgtccgccttgcagaaggcattgccctggcgctgcagtttgattgtgccgatgatccggaagccgttcagcttcaaagcatgatcgctgaaaaaggctatgccggcgtgcttcgcgacgtatgcggactcgaagaggatcattctttattcaaactggtaatcagccatttgaaagcatag

SEQ ID NO: 466 - DNA, 2049 bp, Bacillus licheniformis
atgaaataccttttgcatcaaaaccgttatgtcaaagtcaatgaaattgccggctatatagaagtcagcacaagaacggtccaccgcgagctcaaagcggttaaatccgttctggacaagtacaggcttcagcttgataagcagccgggaaaaggcttgaaactggtcggagcctacagagacaaacagcggcttcttgaagatctgtcccgggacagtcatgtcgaatacagtgccgatgaacgaaagcttttgattttatgcgcgatgcttgaaacgggagagccgatcaagctttatacaattgcccatgacttgcaggtgacggcggcaacgatcagcaacgatcttgacgagctggagaagtggatcgctccattcggcctttcgctgatcagaaaaagaggctacggtatagagctgagggggccggaggacgccaagcggaaaatcgtcggaaacttgatggccgacaagctcgatgttcagcagtttctggaaacgatcgaaatgaatattaaaggcaagaacgaagcgccggagaaaatattcggtgtcgtcagccgggggaaattgctgaaagcggaaaaagtgctgtttcagatgaaagaaaagtatggactttctctttccgacagtgcatacatcgctctggtcgtccacttgacgtttgcgatcgagcggatacagctcggtgaaatgatcaatatgaatgaagaagaattgacggatctgaagcgtacgaaagagtttgaactggcgcttgcgcttgcaaaggcgcttgaagatgcgtttcacgtgaagatacccgaagctgaggcggggtatattacgatgcatttaagaagcgccaacaaaagcttcaaaatcgactacagagcggaagatatcgagctggatactgcgctcagaacgaaaaagctgatcgatttcatctcgcaaaaaacgggcatgaatttaaccggcaatcattcgctttatgaaggattaatcgcccaccttgaaccggcgatcatccggatcaaagaaaagatgtcggtgcataatccgttaacagagcaggtcaaaaaagattattttctcctatatatggccatagaggaaggcgtcgaaatatttttcccggaaatccggtttccagatgaagaaattgcttttatcgtccttcactttggatcggcgcttgagatgagcaaacaaaaagtagacatcaacgcgctcgtgatttgttcgagcggaatcggttcatcaaagatgctggcctcgcggttgaaaaaagagcttcctgaaatcgcttcctttgagatatcctctctgatggaactgaagacgaaaaacactgatgcctttgacatcatcgtttcaaccgtgccgatcccatatgaaaacattgactgcgtcaccgtcagtccgctccttgacacggaagatgtgaaacagatcaaacaccagctcacccgaaaaatcccgctcatccttcggaaaaagcggatggcgcccaaaaaaccggagccgtttccagatatgcttcagattgcgcggaaaatcggccattacgcggccggcattcaacatatactgagccattttacggttgaaacgatggaagctgaatcaagcctggaacatacggtcaaacggatttgcggaaccctggaagatcaaggcctggttaaggatgcagggcagatggcggatggactgatgaaaagagaagcacagggtggcctcggaattcccggaacaaccttcgcgctgtttcatttaaaaagtgaagcggccgcggttcccctctttaaagcttatgatctgtccaaaccgttcgagatcaaagggatggacggaagcgccatgaagatgatgcggatgctcatcatgctggcgccggccgatctgtctccggaaggttccgagattctgagcttcatcagctcttcgatgatagaaagtgatgagagcataaaagcataccagaccggagaccgcgagcagctgtacggcatgctgaacgtgctgtttcaccggtttatacaggataaagagtggtga

SEQ ID NO: 467 - DNA, 870 bp, Bacillus licheniformis
atggatttgcgcaatcagcagacaaacgggcagccggcgcagacgcaagaccgccagcccggcatcgaaagcgtcatgaatccgcgtccgatctatgaggatgaaaattacaaaggaacggataaactgaaaggaaaggtcgcgctgatcacaggaggcgacagcggaatcggcagagctgttgccgttgcctatgctaaagaaggcgcggacatctcgatcgtctacttgaatgaacacgaagacgctcaggagacgaaagcgcgcgttgaaaaagagggcgtcaaatgcctgctgcttcccggcgatgtcagggatgaagctttctgcaatgacgcggttgagcagacggtgaaggagctgggccgtcttgatattcttgtcaataatgcggccgaacagcatcctaaagacagcattaaagagatttccagtgaacagctcgagaaaacatttaaaacaaatttcttctcttatttctactttacaaaaaaagcgattgattatctggagccgggcagcgcgatcatcaatacaacatcgatcaacccttaccggggcaatccgcagctgattgactacacggcaacaaaaggggcgatcaatgcgtttacacggtcgatgtcacaggcgctcgtcaaagacggcatccgtgtcaatgccgttgcaccgggaccgatttggacgccgctgatcccgtcaacgttttcaggggaggaagtggcgaagttcggtacagatacaccgatgggccgtccaggtcagccggtcgaccatgtgggctgctatgtgcttttagcatctgacgattcttcgtatatgacagggcagaccctccacgtcaacggcggagactttatcacgacataa

SEQ ID NO: 468 - DNA, 504 bp, Bacillus licheniformis
gtgaaggtgacaaaggaagatgtaattgaatactacgagaaagcgggcattgtgctgaacgacgatgataaagaaaacatccaaatcatggactacggattaaataagctggataagctggggcttcagctgttcgtctatgtcaacacagaccgctactgcgccaaagagctcgtattattccctgaacaaacatgccccgaacaccggcatcctcctgtagacaagcagaaagggaaggaagagacattcaggtgcagatacggaaaagtgtatttgtatgtagaaggagaaaaaacggaagccccggccgttatgccgccggacgaggatattgaacatttcaccgtttggcacgaaattcagctcacgcccggcgaacagtttacgattccgccggacacgaagcattggttcaaagcggggagtgaaggtgcggtggtcacggagttttcttcaacaagcaccgatgatcacgatgtgttcacagatccgagaatttag

SEQ ID NO: 469 - DNA, 384 bp, Bacillus licheniformis
gtgaatattttcatatcgtttgatgccgaggctgatatgggctacattgctttaacggaaaggcgggccggatcggtatcagcaacagatgatatcggcgacacggctttgtctgcagactttgaccgccatcagcggatcatcggtgtcgaatttccgggggacgaggctccggaaatcgcgcggcttggaacgctgaccggcagaaaatataaacttgaaccggcttacctaaacgggacgcacgttcggcggtttcgaccgacggcacaggaagcggtcaaaacactttgtgtgaacggtgttcaattttattttgccgatcatgacggacggcacttcatcggctttgatgtgatggagcgagcgaaaaaaagcgaatga

SEQ ID NO: 470 - DNA, 423 bp, Bacillus licheniformis
atggatcagcagcaattgaagaacaaggtgcttgatattctcgatcatcataaaatcggttcgcttgcaacggttgaaagcggcaagcctcattcccgctacatgacctttttccatgacgggctgacgctttatacaccgacaagcgatgagacgcacaaggcggaagagattgataacaatccgaacgtccacgtgctgttgggttataacggcgaaggattaggcgatgcataccttgaaattacaggtacggcaaagctcaaccattcaaaggatttaaaggacaaaatttgggatgaaaggcttgagcaatggtttgacggaaaggacgatccgaacttgaccgtgcttgagattgagccttcggaaatcagactgatgaatgaaggcgaaagcaccccggtcacgcttgacatgtag

SEQ ID NO: 471 - DNA, 810 bp, Bacillus licheniformis
atggactttttaacatccaaggtgctattgattttttgttttctgttgttgatccattccatcgaaacgctcgcttacgctgcccggctgtcaggcgcgagagtcggatttatcgcatcggctctgtcattatttaatgtgatggtcatcgtctcgagaatgtcaaacatggttcagcagcctgtgacgggaaagcttgttgatgtcgcgggggcggatgcgctttccctcgtcggtagccaatttcggtttttgatctttggttcaaccgtcggcacaattttcggaatgctgcttctgccgacattcgtcgccgtattttcgagagcgattgttcatttggcaggagaaaatggctccgttttgcaagtgtttcgcaaggcgttttcaaaaaatagcttcaagcatgcaaagcattatgcaaaaagaccgagcctggaatatgtgaaagactttcggttccgctatataccgaaacggctgtttgtcttgaacatggtcattacggcgatttatacaatcggcgttcttgccgctctttatgcgggcgtccttgtgcccgaaaggcatacgaccgcggtgatggcctccggccttgtcaacggggttgcgacgatgctgctcgcgctgtttgtcgatccaaaggtgtcggtacttgcagatgacgtagcaaaagggaagcggagctatacgtatttgaaatgggcttcgatcacaatggcagcatcgagggtggccgggacgatttttgcccaagtactatttattcccgcttcttactatatcgcatggatgacgaagtggatgtag

SEQ ID NO: 472 - DNA, 942 bp, Bacillus licheniformis
gtggagagggttagagtaagagtaagaaaaccgaaaagaaaaaggcgaaaaatcataaagcgcctgtttacattaactttgctggttatcatagcagcagcgggttatacctactttgaatacaaaaaaggcttatctgaatctgacggagattttaaagaagacggacagtttgaatttaacggggaaggctctgatcttgatgaagtgaacatcctcgttcttgggatcgattcaagaggggaagaccattcaaggtctgactccatgatggtcatccactataataaaaagcagaaacagcctaaattgatttcgattatgagggacagctatgtcgacattccgggatatgacaagcaaaaagtcaatgcggcttatgcatacggaggcccggaactcgtcagaaaaacattaaaagaatcctttgatttggacattaactattacgctgtcatcgattttaaaggttttgccaaaatcgttgatgcggtggcgcctgacggcatcgaagtcgatgttccgaaaaaaatgtcatacggaatcggcatgacactgcagccgggaaaacaagttcttcacggtgaaaggctgctgggctatgtccggttcaggcatgacagagaaagcgattttggacgggtcagaaggcagcaggaagtcttttcaaagcttcaaaaagaagcggtgagcatcggaaatatcgcacagcttccgaagctgtgggggctcgtcgatccgtatattgaaacaaacattccgaacggcgtcatactctccgtcggcaaagactttttgcttggaagcgtaaaagaaaccaaaagcttcaggctgccggttgacggatcatttacgaacaaagacgatccaaaatacggggcagtccttgatttagaccttgaacaaaacaaggaagagctgaaacgctttttaaatgagtga

SEQ ID NO: 473 - DNA, 294 bp, Bacillus licheniformis
atgctgcaaacgccgattggccgccttcggttgatgggttttattgaaggcatgtcgcttttaatcctgctgttcatcgccatgccgcttaaatattgggcggattacccgatggccgttacgattgtcggatcggttcacggcggattgtttattttgtatttgtttgttctgttgtatgcaacttttgtgctgaggtggtctgtgaaatggccggctgccggtcttgtggccgcatttgttccattcggcaatttcctttatgaccggggactaaaaaaatatgatcagtaa

SEQ ID NO: 474 - DNA, 411 bp, Bacillus licheniformis
atgacaagaatcaatttttcagacagaggagagacgccgtttcagcggctgctcggacactctgaaagcctgatgtcaagctggacggctttagctgaggagctgtcaggagatggctttttatcaaaggaactgaaggagcaggtgcgccgtgtgctggctcagggaaacgggtgtgaatattgcaaggccaaggggaagcccgagattccgaatcagcagaaaacgagctttgcgatggggtttgcagaggtctttttggcgcagagggagcgcgtgtcagacaggcagtttgatgttttaaaagaagtgttttcagaagaagaaataacggaattgaccgcatttatttgttttacgactgcccagcaatacttcggcgctttaatgaagcttccggcagacgcataa

SEQ ID NO: 475 - DNA, 429 bp, Bacillus licheniformis
atgaaaattgatgatctcgattttaaaatcatagccgaattaaagaaagacagccgtttatcgatgcgggagctgggcaggaagatcagcctttcggcaccgtctgtgaccgaaagagtcaggcggctcgaatcgttcggcgtcataaaaaaatatacgctggacatcgattaccaaaaggtcggtcttcccgtttcctgcatcattgaagcaacggtgaaaaacggggaatacgagaggtttaaagcgtatatcgaacgcctcccgaacattgaattctgctaccggatcgcgggagctgcctgctatatgctgaaaatcaatgcagagagcctggcgaagatcgaagcgtttatcaatgaaacgtctccatatgcccaaaccgtgacacacgtgattttttcggaaattgaaacaaaggaatcgtga

SEQ ID NO: 476 - DNA, 2193 bp, Bacillus licheniformis
atgatggacgtgtctaaaacagttgttttagcagaaaaaccttcagtcggccgtgacttggcccgcgtgctgaagtgtcataaaaaaggaaacggatatcttgaaggcgaccgctatatcgtgacatgggcgctcggccatctggtcacattggcggaccctgaaggatacggaaaggaataccagtcttggcggcttgaagacctgccgatcatccctgagcctttaaagctcgtcgtgatcaaaaagaccggaaaacagtttcaggcggtaaaatcgcagctgatcagaaaagatgtcaaagacatcgtcattgcaaccgatgccggccgggaaggcgagctcgtcgcccgctggatcatcgaaaaagcaaaggtcacgaagccattgaagcgtctgtggatttcatctgttactgacaaagcgatcaaagacggatttaaaaacttaaagaacggcaaagactttgaaaacctttaccattcagctgtggctcgagctgaagccgattggatcgtcggcatcaacgcgacgagggcgctgacaacgaaattcaacgcccagctttcctgcgggcgcgtacagacgccgacgctggcaatgatcgccaaaagagaggaagatattaagaactttaaacccgtcccttatttcggcttgcgcgcagcggtcgacggcatgacgctgacatggcaggacaaaaagacgtcacagacacgcacgttcaacgcatctgtgacgtcgcagcttgcaggagcgctgcaaggcaaaccggccgtcatcgtcgacttgaaaaaaacggcgaaaaaaagctttgctcccggactttatgatctgactgagctgcagagggacgcccataaacgcttcggcttttccgcaaaagaaacgctgtccgttttgcagaagctctatgagcagcacaagctcgtcacctatccgcggacggactcaaggtttctttccaatgacatcgtcccgacgctgaaagaccgtttggaaggcatgcaggtgaagccttatgcccagcatgtggcccggatcctgaagcggggggttaaagccaataaaagctttgtcaacgatgcgaaagtatccgatcaccacgcgattattccgacggaagagccgcttgcgctcggcgcgttaagcgaaaaggaaagaaagctttacgatttgatcgcgaagcgcttcctcgctgttttaatgccgccgtttgaatatgaagaaacaaaagtgtttgccgaaatcggcggagaaacctttacggcaaaagggaaaacagttcagtcgcaaggctggaaagcggtgtacgatttcgcagacgaagatgatgacgaggaagaaaaggatcaaacccttccaaaactcgcaaaaggcgacacgctttccgtccggtctttgacagagacgaagggtgaaacaaaaccgccggcgcggtttaatgaaggaacattgctgtctgcgatggagaatccagccgcatttatgcagggagaagaaaaaaaccttgtgaaaaccctcggagagacgggcggacttgggacggtcgcgacacgcgccgatattatcgaaaagctgttcaacacgttcctgattgagaaaaaaggaaaagatatttacattacttcaaaaggaaaacagctccttgagcttgttccgtcagatttaaaatctccggccctcaccgccgaatgggagcagaagctgtcaggcattgcgaaaggaaagctgaaatcttcagccttcattaaagaaatgaaggagtacgcaaagcagacgatcagagaaatcaaaagcagcaatcaaaagtttaagcacgacaatatcacaggaacacattgccctgactgcggaaaactgatgctgaaagtaaacggcaaacgcggcacaatgctcgtctgccaggacagggagtgcggccatcggaaaacggtcgccaaacagacgaacgcccgctgcccggtttgccataagcgcatggagctgcgcggccacggggaaggccaaacctttgcctgtgtctgcggccaccgcgaaaagctctccgttttcgaaaagcgcagagccaaagacaaaaattcaaaagcgtcaaaacgcgatgtacactcttacatgaaaaagcaaaacaaggatgagccgatcaacaatgcgctcgccgaacagctgaagaagctgaagcttgatcaataa

SEQ ID NO: 477 - DNA, 153 bp, Bacillus licheniformis
gtgcggggcgattttccaaaggcggagtcggtctttatacaagagcggctgacaaggatttcaacattgatcggcatccagaatatcctcatgtttcaatccgattttcctgggcgcggctacatgaatttcccggttttttccgcgcagtga

SEQ ID NO: 478 - DNA, 114 bp, Bacillus licheniformis
ttgtggcaggggaattttagcgaagttgagcacagccggaaaacgaagcatgatatctcgattttctcttttgctctgtcgggtttaagaaaagaattgatgtacaatcaatag

SEQ ID NO: 479 - DNA, 117 bp, Bacillus licheniformis
ttgctgttttttcagtattttttcgcacaaaaaagcgcagaggcaaaagcccctgcggaatcggatttttattcccaggttatctccctctctcttaacgcttacgaggttagctga

SEQ ID NO: 480 - DNA, 549 bp, Bacillus licheniformis
atgtatagtgcaataaagcggtttttaatcgggaagccattgaaatcaaaagagcttagagaacaaaagattacaaaaacaaaagcattggctttgctttcctctgacgccctgtcttccgtcgcttacggaacagagcagattctgatcgttttggcggctgtcagttccgccgcattatggtattctctgccgattgccgcaggcgtcatgattttattgacggcattaattctttcataccggcagatcattttttcttatccgcacggaggaggagcttatgttgtatcaagggaaaaccttggagtgaacccggggctggtcgcaggagggtctcttcttgtcgattatattttgacagtagccgtcagcgtttccgcgggaaccgacgccattacatcggcagttcctatgttgcatccgtatcatcttctgatagcgattgtgctggtgcttttgattatggttttaaaatttacgagggctgacagaattcggcttcaatattggcataccctgtgtatttatttgtggccgctcttctga

SEQ ID NO: 481 - DNA, 1314 bp, Bacillus licheniformis
ttggcataccctgtgtatttatttgtggccgctcttctgattctgatcgcggcaggcagctacaagctgcttaccgggcaaatcgagccggcggagcatgctgcagtcggcacgcctgttgccgggctgtccctgtttctcctgcttaaagctttttcttcaggctgttcggcattaaccggcgtagaggcgatttccaatgcgatacctgcttttaaagatcccgcgccaaaaaatgccgcaaatacccttgcgatgatggggatattgctggctgtcctgttttcggggattacaatgcttgctttcggttacggcatcacgccgaaaagcgaagagacggttgtttcgcagattgcatcggaaacattcgggcggtctttcctttactttttcattcagggcacgacttcaatgattttagtgctggcggcaaataccgggttctcggccttcccgcagcttgcgtttaatttggcccgggataaatatatgccgagaatgtttacggtcagaggagaccgcttagggtattcaaacgggatcatctttctcggtattgcatcgattgtgctgattgtgctgtttaacggacagacggagcatctcattcctttatatgcggtcggcgtgtttataccgtttaccctttcgcagacggggatgtgcttgaaatggatgagggaaaagccggacggctggattgcaaaaatgatcattaatgcagcaggagccgccatctccgctgtcgtgctgctgattttattcattacaaagtttgcgcttgtttggccgattgtcatcttcatgccgattgtcatttgggccttttatgtggtgaaaaagcactatacagcggtgagcgagcagctgagaataacaggcaagcctttggagccgatcaaaggaaatatcgtcattgtacctgtcgcgggtgtgacaagcgtcgtcgaaaagtcggtccaatacgcaaaaaccttgtcagatcaagtgattgcggttcatgtatcatttgacaaagaagaagagaaaaagattgagaagaaatgggaggctcttcaaaacggggtcaggcttgtaacgctttattcctcataccgaagcttgatccacccattggaaaagtttctggaaacagttgaagccaaagcggcgagctacaactactctgtgatggttctcgtaccccagttcattccgaaaaaaagctggcacaacattcttcacaatcagtccgcgcttttgctgcggctgaggctcctgtggaaaaaagacatagttgttgccacgcttccataccattttaaaaagtaa

SEQ ID NO: 482 - DNA, 1722 bp, Bacillus licheniformis
atggcaaacaaaaccgcaggaaaaatagctgcagaactgctgaaggaatggaacattgatcatgtttacggcatgccgggcgacagcgtcaacgaatttatcgatgaattgcggcatgaagaaaacagcctccgcttcattcaagtgcgtcatgaagaaaccgctgctctcgctgccgcagccgatgcaaagctgacaggcaaaatcggcgtctgcctttcgatagcgggcccgggcgccgttcatctgctgaacggcttgtatgatgcgaaagctgacggggcgcctgtgcttgcgattacaggacaggtgtcttcggatgaaatcgggagagattattttcaggagatcggtcttgaacgaatgtttgaggatgtggctctctttaatcagcaggtgcattcggctgaagccctgccagatcttttgaatcaggcgatccgtaccgcatacagccaaaaaggggccgccgttctgagcgtatccgatgatctgtttgcagaaaagattaagcggaagccggtttatacgtctgcgctttatatcgaaggcgatcttgaaccgaagaaaagccagctgatgcagtgtgcacaattgattaaccaggcaaaaaaaccggtgattttagcgggacggggaatgaaatcggcgagagacgagctgctcgagtttgcagataaagcggccgctccgatcattgtcacactcccagcgaaaggggtcgtacctgatcggcacccgcatatgctcgggaacctcggacacatcggcacaaagcctgcatatgaagcgatggaggaaagcgatctgttgatcatgctggggacttcatttccgtaccgcgattatctgccggaagatgccccggctattcagcttgacaacaatccggcgaaaatcggcaaacggtatcctgtcaccgccggccttgtctgcgatgcgaaaaaagggctttttgaactgacgaaaacaattgaacggaaatcgaaccgcgcatttttggaaagctgtatacaacatatgaggaagtggcgttatgaagttgaaaaagacgaacaggtagcgacagagccgctgaagcctcagcaggtgattgcaagacttgaggacgcggtcgcagatgatgcggttctgtccgttgacgtcggaaatgtgacggtttggacggcgcgccattttaatatgaccaatcaggattttttgatatcaagctggcttggcacgatgggatgcggtcttccaggcgcgatttctgcaaagctttcccatccggaacgccaggttgtagccgtgtgcggagacggcggtttcagcatgtctatgcacgattttccgactgctgtcaaatacgaactgcccattgttgttgtgattttaaataatcagaacttgggaatgattcaatatgaacagcaggaaaaagggcatgttaattatgcgacggcgctcgaaaacgtcgattatgccaagtttgccgaagcctgcggcgggaagggcttcagcgtgacaaagcacgaagagcttattcctgctttgaaaagcgcctttcattcacaaaagccgtcgattatcgatgtggcaattgaagacgaaccgcctcttccgggaaaaatatcctatacacaagctgtaaactacagcaaatatatgatcaaaaaactagttgagaaaaaagagctcgacttgccgccgctgaaaaaaagtttaaaaaggattttttag

SEQ ID NO: 483 - DNA, 612 bp, Bacillus licheniformis
gtgtatcgtttgccaaaaaccaccttcagcaccgttttcatattagcagccggattgctgtggatgtccatcgttcctcagcaggccttcgctcatggttttatcgaaaaaccggggagcagagcggctctgtgcagtgaggctttcggatttctcaatctgaattgtggaagcgtgatgtatgagccgcaaagcctggaagcgaaaaaagggtttccgcatagcggcccggcagatggacaaattgcatccgcaggcgggctgttcggcggaattcttgatcagcagtcggaaaatcgctggtttaaacatatcatgaccggcggagaacacacctttacctggacatataccgccccccacaatacgagccaatggcactactatatcaccaaaaaaggctgggatcctgacaaaccgcttaagcgcgcagactttgaactgattggcgccgttccgcatgacggttcccctgcatctcgcaatttatctcaccacatttatattcctgaagaccgcctcgggtatcatgtcatacttgccgtttgggatgtggctgatactgaaaacgctttctatcaagtgattgatgttgatctagtgaacaaataa

SEQ ID NO: 484 - DNA, 861 bp, Bacillus licheniformis
ttggagccacgagtcattgtccaagttgtagaagaactctcagccacttttaaaataattgatattcttggagtattaggcatacctaagtcaacatattaccgttggaaaaagaagtataaaaaagttgagctaacttcattagaagagctagtaatcaagctgtgtaagaaaaacttctatcactatggtcatcgtaaaattaaatccatcttaaacagaaagtatgggataaatgtaaaccgcaaaactgtacaaaaaattatgcaaaagtttgagattcagtgtcaagttaagaagaagcgacaaaagtacatttgtggtgagagtaatattattgtgccgaacactctcaatcgtaattttaaagcaagccgattaaatgaaaaatgggtaaccgacattacctacttaccttatggctcgactatgttatatttatcaacgattatggacttatataacaacgaaatagtggcttacaaaataggtacgagccaagatattaacctagtattagacacattgagggaagctgtagaattacgtaaaccagtagggttacttcttcatagcgaccagggatctgtctatacttcacatgcatatcagaatttggccaaagaaaaaggcattaccacaagcatgtctcgaaaaggaaactgccatgataatgccgtcattgaatcctttcactcctcgctaaagtcggaaggatttaacgctcaaagtagagcatctatatccaattctaaagtagtacaaattgtaaatcaatacatgtatcgatataatcatgtacgaattcaggcaaaattaaactacctgtccccactggaatacaggggacaggcagcatag

SEQ ID NO: 485 - DNA, 333 bp, Bacillus licheniformis
atgggcacaagagtacattacgcagaagaagtaaaatgggaagtaattaaaatgaaacaagctggaatgacaaacaaagaaataatggaacaactggggataaaaaataagactcaaattaaaacatggatgcgatggtacaaaacaggccaaacctatcgattttcgcaacaagttggaaaacaatattcctacggtaaagaatcggaggaaatgagtgagctagaagaattaaaactaaagaataaacagctagaggctcaattggcaattataaaaaagtaccaggagatcgaaaggagttggagccacgagtcattgtccaagttgtag

SEQ ID NO: 486 - DNA, 258 bp, Bacillus licheniformis
ttgaacatgaaagtatttatactgttttatctatggattgtcccgctcgtcatcgggctgatatttttccgggttacccagcggacaagttttaaaaaaaggttttatccaggctacatcatgatcgttcttgctgcggctgtatttgccgtctgctacttgatcggacagccttacctcgggaatttcttcggcggtacgatgctgttcggcaccctgctgccgtttatggctgccgcaatgaagaaaaagaaataa

SEQ ID NO: 487 - DNA, 552 bp, Bacillus licheniformis
atgtttaaattaatggtacgtgatgatctgtatttaaaaatgctcgaaccaaaagatgccagggccgtttatatgcagatccaacagtctaaagatgtgttgcggaaatggctgttttgggtggacggcacaaagcagctggaagataccgaagcttttatcgaagaaagcatgaaacaggccgctgcaaacaacgggtttcaagcgggaatatggcatcaaggccaatttgccggaatcatcggactccattacattaactggatcaaccgcacgacttcgatcggctattggctcggggagccttttcaaggaaaaggaatgatgacggatgcctgccgggcgctgatcgatacgcttttcagcgaatacgatttaaaccggattgaaatcagggccgctgttcaaaacgtaaaaagccaggccattccggaaaggctcggcttcacgaaagaaggctgcctcagacaatgcgagtggctccacgaccacttcgccgaccatttcgtatacgggcttctgaaagaggaatatgaggcccgcagcaaatga

SEQ ID NO: 488 - DNA, 1281 bp, Bacillus licheniformis
atggtcagtcacgatttgtccaaacactcgcaaatatcaaaagaagcccaagatgcactggatggaaaaagcaaaggcttcaaaaggctgctcccttttttgggtccggcgtttatcgcggctatagcctatattgatccaggcaatttcgccacaaatatcgcggctggttcgaaatacggctacttgcttttatgggtaatccttttttcaaatattatggctttgctgattcagtcattgtcagccaaactgggaattgcaacgggtaaaaacctgcccgaagtcgcccgggaagaattccccaaaccggtctccatcggcttgtggattcagggagagcttgtcgtgatcgcgacggacttggccgaatttatcggagctgctctcgggctctacttgctgttcggcataccgatgcttgaagcatcgattattgctgccgccggatctttcgccattttggaactgcaaaggcgcggcgtcagaccgcttgaagcggcgataacaggaatgcttttcatcgtcgtgatcgcatttgcctttcaaacgttttttgcaaaacctgatatcggatcggttttggagggcatgtttgtcccccgcttcgatggtgctgacagcatcctgctggcggcgggaatcttgggagcgacggtgatgccgcatgccatctatcttcattccgctctcacacagcgaagagtggtcggaaaaacggaagcggaaaagaaaaagatattccgctttgagttcatcgacattttgatcgccatgctgattgccggagcaatcaatgcgagcatgctgatcgtagccgctgcactgttttataagaacggcattttcgtcgaagaccttgatgtggccttcagccacttcagcagcatggtcagtccgctttccgccgtattgttcggcgtcggcctgttaacagccggtttatcaagttcgtctgtcggaacgctttcaggagatattatcatgcagggcttcattaatttcaggattccgctttatttaagacggttcattacgattttgccgccgatcgctattattgcttcaggggtgaatccgacaaccgctcttgtcttgagccaggtcgtcctgtcattcggcatcgcctttgcccttatcccgcttatcttatttacgagcaataaacgcattatggggagcctgaaaaatgcaaagtggataacagccgtctcatggctgatcgctgccttaatcgtcgccctcaatattttcctgatttacgatacattttctggttaa

SEQ ID NO: 489 - DNA, 249 bp, Bacillus licheniformis
atgttaggatttctcgtttctttaatcgtagccattgtcatcggattaatcggaggtgcaatcggagcccacggtgcaccgggctccatggtcatcggctttatcggagcttggatcggccacgggctgtttggtacgtgggggcctgatattgcgggattcgccatctttccggcgattatcggagccgcaattctcgtcttcattttaaacctgatcttccgcggaagaatgggttctcaagcataa

SEQ ID NO: 490 - DNA, 1422 bp, Bacillus licheniformis
atggatacgaaagcaaccaggatcgagaaggattttctaggtgaaaaagaagttcccgttgacgcctattacggcgtacaaaccatgagagccgtggagaactttccgattacaggctatcagattgatgaagagctgattaaagctttggcaatggtcaaaaaagcggcggctctcgccaacatggatattaaacgtttatataaagagcttggcgaagtcatcgtaaaagctgccggcgaaatagcggaagggctctggcacgagcattttattgtcgatcccattcaaggcggcgccggcacttcaatgaatatgaatacgaatgaagttatcgcaaacagaggtttagaacttttagggaaagaaaaaggggattacttccatttaagtccgaacacacatgtcaatatggcccaatcaacgaatgatgtgtttccgacagccattcatctggccacattgaatcacttaaaacggctcttatcgacgatggagcatatgttggatgccttccgcaaaaaagcggcggaattcgattcagtcattaaaatgggccgcacccatcttcaggatgccgtcccgatcaggctcggccaggaattcgaagcctactcccgggtgatcgaacgcgatattcagcggatcaggcagtcgcagcatcatctctatgaagtcaatatgggggccacggccgtcggcacaggtttgaacgccgatccgagatatattcaaaacgttgtcgcgcacctctcagatattagcggctatcagctgaccggcgcagaccatcttgtcgatgccacacaaaacacggatgcctacacagaagtatcggctgctttgaaagtcggcatgatgaacatgtccaagatcgccaacgatttacgtttaatggcgtctggcccgagggcaggtctagccgagatccggctgccgccccgccagcccggctcctccatcatgcccggcaaagtaaatccggtgatgcctgagctgatgaaccagatcgcatttcaggtgatcggcaacgataataccatctgccttgcatcagaggcgggtcagcttgagttaaacgtgatggagcccgtgcttgtctttaatttgctgcagtcgattaaaatcatgaacaacggatttcgcgtatttaccgattactgcatcaccgggattgaagcgaatgagatcaggctgaaggaattcgttgaaaaaagcgtagggaccattacggctgtcaatccgcaccttggctatgaagccgccgcacgaattgcgaaagaagcgatcgccacaggacgatcagtgcgcgagctgtgtttgctccatgatgttttaacagaggaagaattggatctcattctggatccttatgaaatgacgcatccgggcatcgcaggcgcttcgcttctcgaggaatag

SEQ ID NO: 491 - DNA, 1185 bp, Bacillus licheniformis
atgggacatgtactgatgattaatttcccgggggaagggcacatcaatccttctatcggcgtcacaaaggagctgcaaaggcgaggggaaagcatcgtatattatgcagttgaggaatacgctgaaaaaattaaaaaaacaggcgcagaagtccgtttatacccggatttcagagaggttctatcacccgggaagaaaaaagaaaagatggactttgccgaagtggtttacaatatgtcaagtaaagtcaatgagatcgttcagttcatctaccgggaagtcaagagtgaatcttatgattatgtgatatatgaccatcacttcttagcggggaaaattattgctgaaatgcttgagctgccgagcgtttcgttatgcacgacatttgcaatggacgagcagtttgcaaaaacgtttaccccgcaaggcgaccttgaaagctcgccttattttgaaaaattgaaaggatccctcggcgaattaagtgagcggtatcctgtcagtctcgacaagccgtttgacgtattctcctgtccgggggatatcacgattgtctttacttccagagcgtttcagcctcatgccgaacgatttggaagtgactatttgtttgtagggccgtcgattgcgagcaggcaggatccgggaagcttcccgttcgccgagctggagggggaaaccgtcatcttgatctcgatgggcacgatctttaatcagcaaaaagagctgtatcatatgtgtatcgaagcgctgaaagactttgacggcaaggtggtcatgtctgtcgggaaatcaacggatcctagggatctcggcagcataccggatcattttatcgtgaggccgtatatcccgcaattggaggttttgaaacaagctgatgtatttgtcacacacggcggtatgaacagtacaaatgaaggcctttactttgatacaccgctcatcgtcatcccgatgggggcagaccagtttttcgtcgctgatcaggtggaacgtacaggcgccgggatcaagctggacaaaaatgaactttccccggctgttttacaaaaaacgattaaagatatgcttgaaaaccgctcctataaagacgacgccgccaaaatcggccgctcgctccgcaatgccggcggctatcaaaaagcagcggatgccgtattggagttggcggggagaaagtaa

SEQ ID NO: 492 - DNA, 447 bp, Bacillus licheniformis
atgccatggtcaatggaagactatcctgcttcattgaaacatttggacaaaccggtgaaaaagaaagctattgaaattgcgaatgcgatggttgacgaaggatacgacgaaagccgggcaattccgattgcgacgagtcaggcgaaggaatgggcggataacagaagcaaaagcgagcttaaatcctatgcagaaaaagccgatgaaacaaaacgtggtgacagcggttcgagcagcaggccggagcttgcggaaaagtgcgagcatgtcatcaaacatgaaaaaggctgggcagtcaaagccgaagacgctaagcgggccagcgaagtaaaggatacaaaagcagaagccgtcgaacgggcgaaagaaatcgccgaaaataaaggaaccgccgtcgtcgtccataaaaaagacggcagtgttgagcggaagatcaggatgaactag

SEQ ID NO: 493 - DNA, 825 bp, Bacillus licheniformis
gtgcgctacgacaaaacagatttggaaaacgaactgaaaaaaattgaaaaatgggaaaaggaacagcagaaagcatggttttgggaaaggatcggccggctgccgttcaaagttctggacaagcttacgccggcattcattcaagataaaatcggcctgctgctagacgaaatcggcggctttattcaaaatggaggccaatatttgacgtccgaaaagcatctgatccgccagtttcaaaaaaagctgccggatgaaacgatcgaaacgattgaagatattcaatgggctcctttggaagtgatggatcaaatatgtgaaaatctcgggaaaaacagggcgaataccgcagcagtccaaggagcgacaaccggtgtgggcggcttgttcacgcttgccgtcgatattcccgcaatcctcggcctttctttaaagacattgcaggacatcgcggtatcttacggctacgatcctaaagaaaaaacggagcggatgtttattattaaatgtctgcagctcagcgctgctgatattgtcgggaaaagggcgatcattcaggaactcagccgataccatcaaccatcaggctcccgtgaaaatatgatttcgcaaattcaaggctggcgggaagttgtttatacataccgcgattctttcggatggaaaaagctgtttcaaatggtgccagtagcaggaatcctttttggtgcaatctcaaatcgttcgatggtgaacggtgttgccgaaacagggatgatgatgtataaaaagcggcgcatcatggaaaggcttgcggagctggacgcgacagaaacagagggataa

SEQ ID NO: 494 - DNA, 1290 bp, Bacillus licheniformis
atgcaaaatcaaaacggaaaagcctcagggcttttgccgctgtttttatttgtttgtttattcgttggatcaggcttgatcacaggcgacttttacagcctgccaatcgtggccgcggcgcttgcggcatcggttgtctcactggcgatgaacaggaaggagaagctcagccaaaagacggagtggtttgcgaagggcgccgggcaccccgacataatgatcatggtgatgatctttattttggccggagcgttttcatcagccgcaaaggcgatgggggccgtcgaatcaaccgttaatctcgcgctttcatttgtaccggggcagtttatggttgccggtttatttatcatcgctgcgtttatctctgtgtcgatgggcacgtcaaccggaacgattgctgcgctcgctccgatcgcagcggggattagcgctgaaatcggcgttccggcggcatattcggttgctgcggttgtggggggcgcgatgttcggcgataacttatcatttatttccgatacgaccattgccgctgtccgcactcaaaagacgaaaatgtcggacaagtttaaaacgaatttcctgatcgttctgcctgccgcggttgccacggtcattctgctgatggtgttctcagccggagggcatcccggagcacaagccgggacttacagctgggtgaaggtgctgccgtatctcggggttctgatatttgcccttctcggatttaatgttatggccgttattttcggcggcatcgtattagccggggtaatcggaatttccgacggaagcctgacgcttcatacgtatttgacggcgataaccgaaggcatcggcgggatgtctgaactgatcattttatcgcttctgattggcggaatggcggaaatgatgaagcgaaacggcgggatcgcgtttctccttcaatttgtatcgcggagaatccgttcaaaaaaaggagctgaagcgggcattgccggccttgtcagcgcggcaaacctggcgacggccaacaatacgattgccatcattacagcggggccgctggcaaaagatttatctgacaggtacggaatcgacaacaggaaatcggcgagcatccttgatattttttcctgtgcggttcaaggattgattccttacggtgcacaaatgctgtcagctgcacaaatcgcgaaaatatcgcctatcagcatccttccttattctttttatccgattttaatcggcgtctgcggcatttgcgcgattatcttcagactgcctcgctttacagaaaaagcgtaa

SEQ ID NO: 495 - DNA, 717 bp, Bacillus licheniformis
atggatcgcaaaacgaatcttcttgaattgacaaaggaagtcgcagaaaagcacgccaattttcttgtttcggaagtgaacgaccattgtatgcgaattgccgttttggagggcgaatacgtatggcatatccatcccggctcagatgaactgtttattgttttggaaggggagctgttgatcgattttcaggatcgccccacagaagttctgaaagcgaatgattccctgctgattccgaaaggcgtcattcaccggacacgcgctgatgtcaggtcggttaacctttgtatagaaaaaactaatgcggaaaccgtcccgttcgcggaagggaatgtgctgaagctgatacggtgcaaatcagccgaacaaaagcttcaagcattcagcgaggcgcaggccaaatgggctccgctgcaaaacgtcagcggattcatcaggcagtggggcggatggatggaaacagaagacgggccggaagccgtcgtcctggcgctttggaaatcgaagcacgattatttgaactttatggcggaacatcatgatgagatatatgaaagaacgcatcagaaaggcacattcgaatccatcaacattacgctgtttgaagatcctgccgagatatctgaaacgctgcagaacaatacgccggctccggtaccggaatggacggtaatgggcagcggacgattgcgcgatccacactctctttcgtga

SEQ ID NO: 496 - DNA, 441 bp, Bacillus licheniformis
atggcaaacaataatgacgacaacaaaatgagcagggaagaagcaggcagaaaaggcggagaaaaaacaagccaaaaccatgataaagaattctaccaagagatcggtcaaaaaggcggagaagctacaagccaaaaccatgacaaagaattctaccaggaaatcggcgaaaaaggcggggaagccacaagccgcaaccatgacaaagagttctaccaggaaatcggcgaaaaaggcggagaagccacaagccgcaaccatgataaagaattctaccaagaaatcggtgaaaagggcggagaagccacaagcaaaaaccatgacaaagaattctaccaggagatcggtaaaaaaggcggagaagccacaagccgcaaccatgacaaggagttctatcaagaaaacggcgaaaaaggcggacgccaaagaagaagcggttaa

SEQ ID NO: 497 - DNA, 1041 bp, Bacillus licheniformis
atggcagcgttgattaaattttttcagcatcctggggtcaggcgtttttcagtttttgttgtattggcgggggttttatatctgttccgcagcatgatgaatctcatattgctcacatttatctttacgtttttgatgaaccgtctggaaaatgtgatccgcggttttttaaaccgctttattaaagtcagccagagactgattatttcttgtttgtatgcggctcttgccatcgcgctttcgatcggcggtgtggtctattaccccgtaatcgtcacccagattcagcagctgatcaaacaaggaaagcatatcgcttctcaccctgacagcattccttttctcgatatgatcaccggtatgttcggcgatatcaatttgacatcctatttggaaaagggtcttaactttatctatacatatatcacggatatcagcacgtttggcctgcaggtggttatgtcattggttctcagcatgttcttattgatcgaaaaagacaaagtcatgagcttaatggataaatttaagacgagcaaaatagctattttctacgaggaaattgcttactttgggaaaaaattcacgagaacgttcggcaaggtgcttgaggctcagtttattatcgccaccatcaattgcgcactgacgaccattgccctcgccattatgggttttcctcagcttttcggccttgccgtcatggtgtttttcctcgggctggttccggtcgcaggcgttgtgctctcccttattccgttaagcattatcgcctacagcatcggcggaatcgcttatatcgtatcactggtattggtcatcatgatcgtccatgcgatagaggcctatttcctcaatccgaaattgatgtccgcaaagacggagctgccgattttcttcacgtttatcgtgctgattttttctgaacattttattgggatttggggtttaattatcggtattccaatatttgttttcctgcttgatatacttgatgttacaaatcaggagaaaaaccgaacagcaggcacacgaaaatag

SEQ ID NO: 498 - DNA, 1245 bp, Bacillus licheniformis
atgaagttagcaacaaaaattattatcgctctattgctcggtgcagtcgtcggtattatactgaacgtcacttcaccggatttattcagcaagcttaatacatttttattcgggccgctcggcacgatcttccttaacttaatcaagatgctcgttgtaccgattgttttcttttctctgactttaggggtagcaggacttggagatccaaagaaattgggcagaatcggtgccaaaacgatttctttctttttaataactactgcaattgccattattatcggacttgttttagcgttggtcatcaaacctggaacgatcggaacatatgatacaagcgctgcggaatattcagcccagaaagcgccaagcatttctgacacgcttttgaatatcattccgacaaacccggttcaggcaatggctgaaggaaatatgctgcaaatcattgctttctccattttggtcggtctcggaattacgatgctgggcaaaaaagcggacgctcttctcaaagtggttgaacagggtaacgatctgatgatgtacctggtcaatcttgtcatgaagttcgcgccgtacggtacgttcggcttgattgccggggcaatcggaagccagggctgggacgccattaaagcaatggggctttatatgatcgtcgttattctggcgctgttcattcataccatcgtcacatacggcgcagcgattgcgcttctggcaaagcggaacccgctcacattctttaaagatttttcagaaggttatgcttgttgccttcagtacgtccagcagcaacgcgacgcttccggtttcgatggatgtcgctcaaagaaagctgaaagttccagagccgatctcaagctttgtccagccgctcggagctacgatcaacatggacggaacggcgatcatgcaaggggggcaacagtctttatcgctcaggtgtacggcaatgacctgtcgctcacacagctgttgatggttgttctcacggcagtgcttgccagcatcggaacagcgggtgttccgggtgtcggactcattatgctcgccatggttcttcaaacagttggccttccagttgagggaattgcgctaatattgggaattgaccgacttctggacatgattcgtacggctgtcaatacaacaggcgatgcagcatgtgcggtcatcgtcaccgagacggaaaagaaacacggcaaaatcgaagcccctcatagtgaagtgtccgtgtaa

SEQ ID NO: 499 - DNA, 927 bp, Bacillus licheniformis
atgacaaagcagcctgttttacatatagaaaatgttgataaaatcatagacggcaaaacgatattgaaagatatccgcttaacggcggatgaaggggagatcatcggtctgcttggtccgaacggatcaggaaaaacgaccctcatcaaattgatcaccggtttaatcaaaatgaagagcggatcaattgtcataaacggctttccgattgaccgccaatttgaaaaagcgatccagtccgtcggagccattgtagaaaatcctgaattctatccgtatctgacaggctatgaaaatctgaagcactatgcaaatatgcacgctggaatcggacgggaaagactggaggaagtcatcagcagagtcggccttgaagatgccgcagaagacaaggtcaaaacatactcgcttggaatgaaacagcgcctcggtattgcccaggcgattcttcaccggccaaaactgctgattttggacgagccgacgaacggattggacccggcgggaatgaaagatttccgcgaacacttgcgtgaactcgccgaagaagaaggaacggcgatcctgtttgcgactcacttgctgaaggaagtggaagatttatgcgaccgggtcgtcatccttcaaaaagggaaaatcaaatcaactgtcgtccttaatcaagcggacgagaaacaggaaaaggcgatgctggaggtacagcctcatgacaaagcgcttcagtggctgaaagaccaaggatacgaagctcgcaccgaaaaaggcctgcttgccgtaaaggtggagaaagcgcaaattccggctttaaatcaacagcttgtcgccaatgatattgacgtctattcgatcgctccgtttaagcagtctcttgaggatgaatatatggcgcggacgaatggaatagaagagaggaatgctgatgtttaa

SEQ ID NO: 500 - DNA, 774 bp, Bacillus licheniformis
atgctgatgtttaaactgattcaaaacgagcatgttaaattgctgaagcgcaaagtaacatttgtatcgctggcgctgattgtagtctttcaatttctcctcgcgctcatcaccaaaagaatcctgatgggcgccggggcagaggatcattttatcggctatttttcattcaccccaaacctgaatatcctcttgcaggggctttcgattgtggtggcggcttcaattatatcctttgaatatgataaaaagacgatcaagtttttgctgatccgccctgtcagaagagaaaagattctcgtttctaaatacgtgacgagcgtgctcgcaagcatttggctttttattatttactacggattttctatattgttcggcctgctctttttcggcgtgaagctcgacgaaaaagcggagccgctctttatcaatacggtgaaaatgatcgggacgcagtggtttgaagtatggatgatggtttcatttgcgtttttatgctcggcattattcaaaagcagcgcgctcagcatcatggtgtcgattgtcgtgctgtacggcgccaaaatgcttgtgacgattatggcgtatttggaaaagccgctcggcaagtttttattgttcgccaataccgatttaacgcagtacgccggagaggcaaagccgctttttgccgggatgacgcctttattctcgctcttcatcgtctttatccatctcgtgttttttctcggaacggcatggtggggcttttgcaaacgcgatatgaaggtataa

SEQ ID NO: 501 - DNA, 339 bp, Bacillus licheniformis
atgaaaaagtttattacggcgttgccgattgtattgctgctgtcattttcatttgtttcttttgcctttaactttgatcatctcgtatattttagacttgcgctcggactattttcgcttgcaggtttgtttctgttatataaattgaaaaacggcgtccgcctctttatggcatacctttatggaagctggatcgtgctggccggaatcgccgcatatgaagaaccgcttttttccgatttcttcttcggcggcctcacgatcacgatgggctacttaacctacatgctgatttatctcggtatgaaggttgaccgccgcggcggtcaagccgtttag

SEQ ID NO: 502 - DNA, 1149 bp, Bacillus licheniformis
gtgtgttcaatatttgtgaaaacggaaaggcagcaggaatggctcgataaaatcggaaaattggcggatgaatttgagaaaacagcagcgtactatgacgaacatgcacaatttcccgcagaacatattcaaaagctgcgggattcaggctacacagcgctgacggtcggaaaagattacggaggagaaggcatttcgctctacgatatgcttttgtttcaggaacggcttgccaaaggagacggaccgacggctctcagcatcggctggcacttaagcgtgatgggggaactggcggagggaaacagctgggaccgggatgtgttttcatcgctttcccatgaagcattaaagggcgcgctgatcaacagagcggcaagtgaagcgcagacaggcagcccgacaagaggaggacgccccggaacccatgcagtcaaaaagaacggcggctggattgtaaacggccgtaaaacattcacaacgatgtctccggttctcgactattttcttgtcaccgcttggattgaagagaagcaaatgatcggcgttttcttgatccataaagatgcggaaggcttggcaatagaagaaacgtgggatatggcggcgatgaggggcacgggaagccacgatttggtgctgaccgatgtccgtctggacgaatccatgcttgttgaactgttggctggtaaaagaaccgataaaatcaacggctggctgcttcatataccggctgtctatttagggatcgcacaagcagcgagagactatgctgtccaatttgcaaaagactatcagccgaacagcttgaaaggtccgatcaaagaggtgcccgctgttcagcgccatatcggcgaaatcgatctggaactcatgaaagcccgccactttatgtatcatgttgcagagctttatgatgatccggagcgccgcgcccttttgacaggtgagcttggagcggttaagcacacggtaacgaatacggccattgatgtcgtagacaaggcgatgagagtcgtcggagcgaaaagtctcgcaagaacgaacccgctccaaagattctaccgcgatgtccgggcgggcctccacaacccgccgatggatgatgcgacaatcgccaagcttgcaggaattgcattcagcgaatag

SEQ ID NO: 503 - DNA, 156 bp, Bacillus licheniformis
atgtcaaaacggaagattaaaacctttcatcagcttgtcgaagaatataaaaaagaaatcgccaagaacccgaaagaaatggaagtcatttatgacaagatcgaccgcagacacgagaaccgccttttggccatttcaaaagcaaaacaaacataa

SEQ ID NO: 504 - DNA, 180 bp, Bacillus licheniformis
atggcccctcaattaaagaaagcggtggaaatgagaaagaaacaactcattcagcgtcttatccagcttggcatatataaaaaagaagagcgccacctctacgaattgtctttaagcgaactgaaagcgaataccaatccatcaagaaaggcggataaacatgtcaaaacggaagattaa

SEQ ID NO: 505 - DNA, 321 bp, Bacillus licheniformis
ttgaaaaaaatcacaacagaagcgcaatttaatgaattgatccaatccgataaagaaatcatcgtcaaattttacgctgactggtgcccggactgcacacgcatgaacatgttcatcggagacattcttgaggcttatcaggaaaatgactggtatgagctgaataaagacgaccttcctgaacttgccgacaagtaccaggtcatgggcattccaagcctgttgattttcaaaaacggcgaaaaaacgggacaccttcacagcgcaaatgccaaaacgcctgaagaagtgaatgaattcctggctgaacatattagctaa

SEQ ID NO: 506 - DNA, 1086 bp, Bacillus licheniformis
ttgaagacaagattaggattggtatacggcggaaaatcagcggagcataacgtttctctgcaaaccgcgctggccgtcacgaaagcattagatactgaaaaatttgatatacacccgatttatataacagaaaaaggcgagtgggtgagagggccgcaactgacagaaccggtttcaaatgtgaaaatgctgcaatttgaacagacgggccagacattttctccggctgtgttgaaccgcgatatgtttcctggcgaagctgatgcaaaagaagactctatcgatgttgttttcccgcttttgcacggaccgaatggggaagacggcaccattcaagggatgcttgaactattgaatgtgccatatgtgggcaacggagtcttggcttcctctgcgggcatggataaagtggtcatgaagcatctgtttgcacaggcaggtcttgaccaggcgaaatacgtttcatttttgaaaaaaacttggagtcagtctaaagaagaatgctatgctcaagtggaaggggaacttggctatccgtgctttgtaaaaccggccaaccttggatcaagcgtcgggatcagcaaatgcagaagccgtgaagagcttgaccaagcctttgagcttgcattccaatatgaccggaaaattgtcgttgaagagggcgtcatcggacgggaaatagaactcggcgttttagggaatgatgaacctgtctgctcagtcgcgggggaaatcgctccgaagaaagacttttatgactataaagcaaaatatgaagacggcgatactgatttgattattccggcttccctgacagaagacgaatacgaaacaatgcgcagcatggcggtcaaagcgtttcaggcgattgacggttcaggccttgtgagagcggactttttccttacaaatgaaggcagggtcctgatcaatgaagtcaatacgatgccgggattcaccccgttcagcatgtttccgcttctctggaagcaatcaggggttgagtacgctgaactgattgaaaagcttgtcgctttggcaatcgagcgccacgaagaaaaacagcagattaaacatacattttaa

SEQ ID NO: 507 - DNA, 1371 bp, Bacillus licheniformis
atgataacaagaacggtaaaagaaattgctgaaatgtcggaaggcgttttgacgaatgaagcttttgaagggcgtctcatcaaaggcgtctcaaccgattcgagaaaactggcgaaaggccaactgtttattccgcttgcaggcgagcggttcaacggacacgtttttgcagagcaggcttttcaggaaggcgttgcggccgtgctgtggaaccgaagtgaaccgaatcctccggaagggaagccggtcattttagttgacgatacgctggaagcgctgcagaagcttgcgaaggcatacaggaatcagctggacgtaaaagtcgtcggcgtgaccggttcaaacggaaaaacgacgacaaaagacatgattcatgctgttttgggcactgagtataaagtgcataagacagaaggaaactacaataaccatatcggcctgcccctgacgattctggcgatgcccgaagacacagaagtcgccattttggaaatggggatgagcgccaaaggagaaatcgattttctcactcgtctggcgcggcctgatattgcagtcattacaaacattggtgaatcacacctccttgaactcggatcaagagaaggaattgcagaggcgaagctcgaaattgtcaatgggctttcaaaagaaggcacactcatttatgtcggagatgaaccgctgctcaccgaaaggctgaaccagccgccttacgatacaaagacgtttggagaggatccggctttcgattatcagcttgaggatatgacacagactgaagaggggacggcattccgcgtgagaggaatcgaaaacgggttcttcatcccggtccttggaaagcataatgtgaaaaacgcattagccgcgattgcggccggagacctcttgaatgtcagccgcgctcacattgcagaagggctgactaaactgaaagtgaccggaatgcggcttgagctagtaaagacgccggacggcgttgcgatcattaatgacgcctataatgccagcccgacatcgatgaaagcggcgatcgagcttgtcgaacagatgaagggatacggcaagaagattcttgttctcggcgatatgctggagctcggagaaggagaaaaagcgtttcatgaagaaatcgggcaggcggtcaacccggactcgatcgactttttatttacgtatggagaactcggtgcatatattgcaaaaggggcgcttaaacatttcccggaacaccgcgtccttcatttcaacccggaagaaaaagacagtttgaaaaagacactgaaagaaaaagcgaatacaggggatttaatcctcgtcaaagcgtccagaggcatgcgccttgaggatgttataaaagatttgtaa

SEQ ID NO: 508 - DNA, 711 bp, Bacillus licheniformis
atgataggatgtttatgcattcacggatttaccggagcgccgtatgaattggaaccgctggcttctcatttaaaacaaacggcagattggcaagttgaaatgatcacgctccccgggcacggtgagatgccggttttaaaaggcgtctgttttcaggaatggatcgcttgtgctgaagtggagctcatccgcttgttgaaaacgtgtgatacggtatttttaatcggattttcaatgggcgggatgattgccggctatttagccggaaaatatccggtcagccgccttgtcctgttgagtgcggccgcccagtacatcagcccgggacagctgatccaggatttgaagaatgtgatcaaagattcactgcaaggcaagctagaggataatctgctttacaaaaggtacaaacaaaagctgacaagcactccggtgtcttctgcatttcagtttcgcaagctcgtcaagatgacaaagcctgcattgaaaaacctccggatccctgtgctcattgttcagggggagtgtgatgccatcgtgccggtgtcaagcgcgtattacttgtatgaaaccattccttccgaagaaaaagagctgtgcctcttgccggaatccaagcaccatgtctgccttgaagaaaactcctctatcctatttcaaaccgttgaggcgttcctcaaaaaaacgccgattgaatctataaaaaaataa

SEQ ID NO: 509 - DNA, 1464 bp, Bacillus licheniformis
ttgacaataacgtttcaagattttcaattaagttctgatctcacaaaagcaatcaagcgtatgggatttgaagaggcaacaccgattcaggcacaaacgattccactcggccttgcaaataaagatgtgatcggacaagcgcaaacgggaacaggaaaaacggctgcatttggcatcccccttgttgagaaaatcaaccccgagtctcctaacattcaagccattgttatcgcacctactcgtgaactagccattcaagtttctgaagagctatataaaattggacaggataaacgcgctcgcgtgctgccgatttacggaggacaggatatcggacgccagattcgcgcgcttaagaaaaaccctcatattatcgtcggcacacctggtcgtctgcttgaccatatcaaccgccgcacaatgcgtcttcaaacagtgaacaccgttgtgcttgatgaagcggatgaaatgctgaacatgggattcatcgaagatatcgaatccatcctttccaatgtgcctgctgaacaccagacattgctgttttctgcaacaatgcctgctccgattaagcggattgcagaacgtttcatgaccaacccggagcacgtaaaagtgaaagcaaaagaaatgacagtatcaaacatccagcagttctacctagaagttcatgaacgcaaaaagtttgatacgctgacacgccttcttgacatccagtctccggaattggcgatcgtattcggccggacaaagcgccgtgtcgatgaactgacagaagcgcttaatctgcgcgggtatacagctgaaggaattcacggagatttgacccaggcgaagcggatggttgcactccggaaatttaagcaaggcgcgattgaagtgctcgttgcgacagacgttgcggctcgcggccttgatatttcaggtgtaacgcacgtctacaacttcgatgtgccgcaagatcctgagagctatgttcaccgcatcggaagaacgggacgcgcgggcaaaacaggaatggcgatgaccttcattacaccgcgtgaaaaggatatgctgcgcgccatcgagcagacgacaaaacgcaaaatggaccgcatgaaagcaccgactctcgatgaggccattgaaggacagcagcaggtgacggttgaccgcatccggacgatcatcgaggaaaataacctgaacttctatatgacggctgcagcggaattattggaagaccatgattctgtgacagttgttgcggctgccattaaaatgatgactaaagagccggacaacacacctgtccgtttgacggaagaggctccgctcagaacgaagcgaaacaaaaatcaccaccaccgttcatcaaaacgcagagacggcggcggctacagaggaaagaacaatcgttcatcttatgataaaaagcgttcttcgaatgacagacgccaaaaaaaatcatataattcataa

SEQ ID NO: 510 - DNA, 480 bp, Bacillus licheniformis
ttgagaagcgagccgaaaaatcaaatcagccgtgatggcgttaaagtctggagaatcacggcttgtatcacatcattcgttttaatgctggctgcagcaggcctgattgccgccggggtgatatttaagtggccggtatggatcggcattttgtcagcggccgtttggctggggatttcatttgtcatcattatcatgattccgaatatccgccacagagtctggcgctacgaagtccatgagaacgaaattgatattcagcacggcatctttgtggtgacccgcgtgatcgttccgatggtcagagtccagcatgttgatacatcgcagggccccatcctcagaaaatataatctcgcctccgtgcaaatttcaacagcagcgacgacccattccattcccgctttggatgttgaagaggccgatcagctcagagattccatttccaggctggcaagggtgactgaagatgatgtctga

SEQ ID NO: 511 - DNA, 1479 bp, Bacillus licheniformis
atgtctgaaccgagacgcatgcaccctgccgccgtcattctcaactttatcaaaggccttgttgagacggttaaaaattttatcattccatttggcgtggtgatttttttaaatcaatcgcaaacagtcaaaatgatagcgatcgccgcggccgtgctgtttttcattgctttggttgtgacgagcatcatcaagtggagcaaatttacataccgtatcgaagaggatgaattgcgaatagaggaaggcttgatcaataagaaaaaaaggtatattccgatcgaacggattcaaacgatcaacacaagcgcaggcctcattcaacaaatgttcaagctggtgaagcttcaagtcgaaacggcaagcggaggaacggaagcggaagtttccctggtcgccattacccaggcagaagccgaacgtattcagcaagcgcttttcgaaaggaaaaaagcggcggaagacacggggaccgatgtcccggttccgctggaagaaactgctgaagaggcggaggaagcggaagagccggtaatgatgtacaaaatgaccggccaggagctcttaaccgccgcttcaacctcaagcggcatcggcgttattatttcaggggtattcgcttttttcactcaagtcgatgatttctttgatttggattggctgtatgaccgctttgcttttttgaacagcgcaggtgccgccgtcatcgcattggccgcctttgttgcccttttcatcgcatggctgctcagcatcgtcgggatgcttttgaaatatgcgaattttactgtcgtgcgtaaagagaaagaaatcgtcatttccagagggctgattgaaaagcaacaaatcacgattccgctccagcggattcaagcgattaaaatcaaggagagcctgatcaggcagccttttggacttgcagccgtcacgatcgtcagcgcaggcggaaacgtcctggaagaagataaatcagccatcttatttccaatcatcagcaaaaaaataatcaatcagcgtctcggcgaattcattccggattatgcgccggaagacgatttgaaccgcttgccgaaacgcgcgctgcgccgctatatcctgcgcgcatcctggccggttctcgccgtcgttccgctttccattctgtttccgccatggggctatttgtccgctgtattgattcctttttactggatcatcggctatttctcataccgcgatgccggatggaagatcagcggcagcaaaatcatcatgtcatcgcgcttcatcggcagaacaaccgctgtcattcaacgcaggcgcatgcaggttttcgaagtcagccgctcgtatttccagcgcagaaaacagcttgtttcgattcatacatcaacaaaatcgtctgttttaatggagaagttttcggtggctgatgttgaggagaaagattcggacgatatcattgcatggtattcatatgaaaaaagagtgaacggttaa

SEQ ID NO: 512 - DNA, 600 bp, Bacillus licheniformis
atgtttatcagaacagaaaattttcagacgtttatcaggctctacccggtcacatccgccatattggccctgcagcttgccatttggattctttttttatttccgtttacggccgtacagatgtggtctgatttattgattggctttaactggggaatagcgaacggagaatggtggaggtttgtgacgccaatctttattcacgccggtttcggccacctgctctttaattcgatgtcgatctttttgtttgcccccgggctggaacgaatgctcgggaaactcaagtttctcatcgtttatatcggagcaggagtgattggcaatatcggcacatatttcatcgaaccgctggagtatatgcatgtcggcgcttcgggagccattttcggcttgttcggcgtgtacctgtacatcgtgctgtttagaaaagagctgatggggagcgccaattcccaaatcatcgtcaccatcctcgccatttcggttttgatgacgtttgtaaaccaaaatatcaatatgatggcgcacatcttcggtctgctgggcggactcgccttggctccgccattgttaaacaaaagagtgaacggcttttaa

SEQ ID NO: 513 - DNA, 969 bp, Bacillus licheniformis
gtgagaaaaagctttgttttgcttttaacggggctgcttgtaatccttatgctttctgcctgcggccaaaaatcgcaagaagatgttgtgacggggctcgacaagaaggcaaaagaatacacgtcctataaggcaaaagcgaaaatgaccattgaaacgggaaatgaaccgcaggagtacaacgtggaaatctggcataaaaaaccttctctttaccgggtctatttggaaaacccgaaaaaagaccagagccaggtgatcttgcgcaatgaaaacggcgtgtttgttttgactccgtcgctgaataaaagcttccgctttcacagcgactggcccaataacagcagccaggtatacttattcgaatcgctcgtaaaggatgtcaaaaatgatggggaagcttctttttccgcaaaggattcaaaatacatttttgaaacgaaaacgaattatcagcataatcagatgctgccgactcaggaaatcgttttccataaaaagaccatggctccttcatcggttaaagtgatggataccgaccgcaaaccgatggtaaaggttgagtttacaagctttgaattcgataagccgctcgataaagactcttttgatgaaaagaaaaatatgacgctgtctcaaattgacgtagcgacaagcgctgacgtgtcagactctttcgctgtcaaaacgccgctcgatgtgcctcagggcgtgaaaaagcttgaagagaaagagatggcgactgaagacggcaaacggatcgtcatcacatatggcggtgaaaaatcctttacattgattcaggaaaaagcccgcgtcgccaaaacatccacttccgtatccatgaacggagagcccgttgacctcggcttcacggtcggcgcactgacggataaatcgttgtcatggacatatgacggagtcgataccttatctcatcagaagatctttctcaagatgaacttctga

SEQ ID NO: 514 - DNA, 1188 bp, Bacillus licheniformis
gtgaaacaaggaacaggaagtgtcatgatgagcttaaaaccattctatagaaagacatgggccgaaatcgatttaacggctttaaaagaaaacgtccgcaatatgaagcggcacatcggcgagcatgtccgcctgatggccgtcgttaaagcgaatgcctacggacacggggatgcacaggtagcgaaggcggctcttgcagaaggggcgtccattcttgctgtggctttattggatgaagcgctttcgctgagggcgcaggggattgaagaaccgattcttgtcctcggtgcagtgccgaccgaatatgcaagcattgccgcggaaaagcgcattatcgtgactggctactccgtcggctggctgaaagacgtgctcggttttctgaatgaggccgaagctcctcttgaatatcatttgaagatcgacacgggcatgggccgccttggctgcaaaacggaagaagagatcaaagaaatgatggagatgaccgaatcgaacgataagctcaattgtacgggcgtgttcactcatttcgccacggcggacgaaaaggacaccgattatttcaacatgcagcttgaccgctttaaagagctgatcagccccctcccgcttgaccgtttgatggtgcattcgtcaaacagcgccgcgggtctgcgcttcagggaacagctatttaatgccgtccgcttcggcatcggcatgtacggtttggcgccgtcaaccgaaataaaagacgagctgccgtttcgtctgcgggaagtgttttcgcttcataccgaactcacccatgtgaaaaaaattaaaaaaggcgagagcgtcagctacggggcgacatatacagctcagcgcgacgaatggatcgggacagtccccgtcgggtatgccgacggatggctgaggcgcctggccggaacggaagtgctgatcgacggaaaacgccaaaaaatagcagggagaatctgcatggaccagttcatgatttcccttgccgaagaataccctgtcggcacaaaggttaccttgatcggaaagcaaaaagacgaatggatctcagtcgacgaaatcgcccaaaatttgcagacgatcaattatgaaattacctgtatgataagttcaagggtgccccgtatgtttttggaaaatgggagtataatggaaataaggaaatccgatcttgcctga

SEQ ID NO: 515 - DNA, 243 bp, Bacillus licheniformis
ttggctgaatcccgcgccaccactggaatattgattcccttggccgaaactttaatatccaaactggatgggggcctcctgccagataaccggagccaaaatggactggtttacccagccaccaaaatggattttccccaaccccaaaatccaccaattccggaatccatgaaaccccggtatatggagaatggccagaaccatttggacatctcttctgaaggctcattttgcagagtatga

SEQ ID NO: 516 - DNA, 351 bp, Bacillus licheniformis
ttgattgttaaacgcggcgatgtttattttgctgacctatctcctgttgttggctcagaacaaggcggggtgcgcccggttttagtgattcaaaacaacatcggcaatcgcttcagcccaactgctattgttgcagccataacagcccaaatacagaaagcaaaattacctacccacgtcgaaattgatgcgaaacgctacggttttgaaagagactccgttatattgctcgaacaaattcggacgattgacaagcaaagattaacggacaaaatcacccatctcgatgatgaaatgatggaaaaggtcaacgaagccttacaaatcagtttggcactcattgatttttaa

SEQ ID NO: 517 - DNA, 828 bp, Bacillus licheniformis
atgtcgaatcaagcggtgttaaaatttatctcggaacaccaaaatgtactcgccgggaatttggcggatattctgaaagacttaaacagcaacatgacaaacgtgaagctgactgaacacatgtatgagacgatcagcaatgaatatattcatatcctcatgaatgagtccggggacgggaatgaaaaatcgatcgacaccatctaccagttctcttcaaaagccgtacagctcggcgttccgctgaagctgctgtcgtcgggattatcagctttttggaagcacctttactatgaaatgaacaaggatgtgccggaagatcagcagtgctatgatttgatttgggaaatcgataaatttatcgaaccgatcaacagcgaaatcttgaatcagtatgcgatctcctgggagaaaaccgttgctctgcaaaaggtcgcattacaggagctctcggcgccgctgatcccggtttttgaaaatattacggtgatgccgcttgtcggcacgatcgatacggagcgggccaaaaagattatggaaaacctgttgagcggcgtcgtcaaacaccggtctgaagtcgtgctcattgacattacgggcgtgcctgtcgtcgatacgatggtcgcacaccacatcatgcaggcttccgaagccgtcagacttgtcggagctaaatgcctgctcgtcggaatccgcccggaaatcgcgcagacgattgtgaatttgggaatcgatttaactcaggttattacaaaaaataccctgcaaaaaggaattcaaaccgcattagaaatgacagacagaaaaattgtttcattggaggaataa

SEQ ID NO: 518 - DNA, 366 bp, Bacillus licheniformis
ttgagggtacctaacattccaattttgaagctgtataactgtttattggtatccattcaagtagagctcgatgaccaaaccgctctgaaattccaagaggacctgctgaacaaaatatatgaaaccggttcgaacggagtggtgatcgatctgacttcagtggacatcatcgattcattcatcgccaaagtccttggcgatgtcattacaatgtcaaaactgatgggcgccaaagtcgttctgactggcatccagccggctgttgcggtgacattgattgaactcggcatttctttggacgagatcgagacggcgctcgatctcgaaaaggggctcgagacattgcagcgggaattgggggaataa

SEQ ID NO: 519 - DNA, 402 bp, Bacillus licheniformis
atggcagaccaatcctgtgtgaagattttgactgaatgggacatagtggccgccagacagcttgggcgaaatgtcgcaaaagaactggggttcggcacagtggaccaggccagaatcacgacagccatctcagagctggcgcgtaatatttatttgtatgccggaaaaggccgaatctgcatcgaacaggttcaggaagaaggaaaaaaggggttgaaaatcgtagcggaggatgaggggccgggaatcgctgacatcaaaaaagtgatggaagacggtttttcaacctcaggcggcctcggagcgggcctgccgggagtaaagcgtctgatggaccaatttgaattgcattcggacgcggaaaatggaacggatatacaagccgtaaaatggctgcggtag

SEQ ID NO: 520 - DNA, 1008 bp, Bacillus licheniformis
atggatttcagggaagtgattgagcagcgctatcgacagctgcttagccgttatatatctgaattaacagagacatccctttatcaggggcagaaattcagcagaaaaacgattgaacatcaagtgccgccggaagagattatcagcatacaccgaaaagttctgtctgaattatatccggatcttccagaccatgtgttccattctctcgattttttaattgaagtgatgattggatacggtttggcctatcaagaacatcaaacattaagaggaattcagcaggaaattaaatcggaaattgaaattgccgcgaatgtccagcaaacgctgcttgagacgacggttccgaaagttgaagcgctcgaaatcggtgcggtcagcattccggccaagcaaatgagcggtgattattatcattttgtgcgcgacaaggaatcgattaatatcgccattgcggatgtaatcgggaaaggaataccggctgcgttatgcatgtcgatgatcaaatatgcgatggactctctgccggattcgggcacgtctccttcacaggtgctgaaaaacctgaacagggtcgtcgaacaaaatgtagacccaagcatgtttattacaatgttttatggcaactatcatcttcaaaaacacctatttacgttttcatctgccggtcatgaacctggcttttattattcttgcagggaaaataaattttacgatttaaacgcaaaaggcctcgttcttggcatttcatcaaattacgactatgagcagtacgagcaaaaactggatattggcgatatgatcgttcttttttcagatggtgtaactgaatgccggacagacagcgggtttttggagcggtctgacttgcagaacctgattactgtacatatggagaaaccggctcagcaaatggttgacaatatatacgaacatctgctcaagcttcaggattttcagcttcatgatgattttactctcattgttttaaaaagaaaggtttaa

SEQ ID NO: 521 - DNA, 321 bp, Bacillus licheniformis
ttggcagttgatacgaataaaaatgaccatgtgatagaagtaaaagttgcgggcgaaattgacgtgcacacggctccaacactgcgggatgagctgatgccgctcgcggaagaaggaaaagatctcaaagttagtctgaaagacgtttcatatatggacagcacagggctgggtgtattcgtcggcatttacaaagcggtaaacagaactgggggttctttagtgcttgaaaatctgtcagagcgtttgattcgtttgtttgatattacaggtttaaaggacatcattgacatttctggaaagtcagagggtggattataa

SEQ ID NO: 522 - DNA, 486 bp, Bacillus licheniformis
atgaagagagcagctgattacattgaaatgaagtcacctgccaaaccagaatacgtaggaatcattcgtttaaccctgtcggggattgcaagcaagatggggtattcttatgatgacatcgaagacttgaaaattgcggtcagcgaagcgtgcacaaacgctgtgcagcatgcttataaagcagacaacaacacaggagaggtctccgtcagattcggcgtgttcgaagaccgcctcgaaatcgtcgtcgccgatcagggagacagttttgatattcaggataaacagaaggagctcggaccatattcccctgagcatacggtagatcaattgtcagaaggagggctcggtttatatttaatggagacgctcatggatgaagtgcatgtccagattgactcaggcgtaaccgtctcgatgacaaagttcttaaacagggagcgagttgatgatggcacaaccgtccaaaactacgaaactaactaa

SEQ ID NO: 523 - DNA, 792 bp, Bacillus licheniformis
atggcacaaccgtccaaaactacgaaactaactaaaaccgaagtcgacacgctgattaaaaaatatcaggagaaccaggatgaagacgctcagctgacccttgttcaaacatataaaaatctggtggaaacactcgccaaaaaatattcaaaaggaaaaagctttcacgaagatctatgccaggttgggatgctcggattgcttggagccatcaaacgctatgaccccgatgtgggaaaatcgtttgaagcgtttgccattccgaccatcatcggagaaatcaaacggtttctccgagataagacctggagcgtccacgttccgagaaggatcaaggagctcgggccgagaatcaaaatggcggtggatcatttaacgactgaaacgcaaaggtctccaagagtcgatgagattgccgagtttcttgacgttacagaagaagaagtgctggaaacgatggagatgggcaaaagctatcaggcgctttccgtcgaccacagcattgaagctgatgcagacggcagcacggtgacgatcttggacatcgtcggctcgcaggaggaaggctatgaaaaggtgaaccaaaagctgatgcttgaaagcgtattacacgtactatccgaccgtgaaaagcaaatcattgagctgacttacattcaaaacaaaagccaaaaagaaaccggcgaaatgctgggcatatcgcaaatgcacgtctcacggctgcagcgcaaagctgtcaaaaggctgagggaagcattggctgaagatccgtatatggagcttaaaccatga

SEQ ID NO: 524 - DNA, 600 bp, Bacillus licheniformis
atgatttggactgagtcgaatgaacacatgcaagcgcttgtttatcagcttcctaaagaaggaaaagccgtctgcggtgacagtttttatttccatgcgactgacgaaaccatggtgtgcgcactggctgacgggcttggcagcggtgcgttggcacgcgaatcctcttcggtcatcagcgaagttgtcgaagagcacggccatgaagatgtcgaaagcttgatggaacggtgcaatcaagcgctgaaacataagcgcggtgcgaccgtttcaattttaaaagtcgattttcgaacaaggacgatcgcttacagctctgtaggcaatattcgctttatcttatacgctccttcggacaaatatatccaccctctccctgtgacgggatacatgtcgggaaaaccgcaaacatacaaaacattcacctatacgtatgaaaaaggatcaagattcatcatttattcagacggtttggaagtacccgccctccggacttatttaaaacagcaccatacaccgggagatatatcgaatcagcttgaatcatacacacgaatgggaaaagacgatctcacctatatcattggacagcttttttaa

SEQ ID NO: 525 - DNA, 2175 bp, Bacillus licheniformis
ttggaggctacaatggatactttagcgtcaatcgtcaaacaaatcgcaaaagaaacggggcttgcgccaaagcatgtcgagagtgtcattcaattattagaggacggcaacaccgtcccctttattgcgagataccgaaaagaacaaacgggctccatggatgaagtccaaatacaaactatctccgaacgctggggatacattcagcatttaaatcagcggaaagacgaagtcatcaggctgatcgatgaacagggcaagctgaccggacagctgaagctggatatagaaaaagcggacaagctccaggaagttgaagacttatacagaccgtttaaacaaaaacgaaaaaccaaggcgacgatcgccaaaagcaaagggcttgaacctttggctgatttcatcatctcgctcccgcgtaatgaagatgtagcagccgaagcccgcaagtacataaatgaagaaaaggaagtcatgagcgccgaagaagcgcttgaaggagcaaagaacatactggctgaacggatctcagacgaaccggaatacaggaagtggatcaggcaggagacttttaaaagaggaacgctgaagtccgcggcaaaagatgccgaagcggatgagaagaaaatctatgaaatgtattatgaatacgaagagccgattcaaaaaatcgttcctcatcgcgtactcgcagttaaccgcggcgaaaaagaggagattttgagagcgtcggtcgagccgccggcagaccgcatccaagcttacttggaaaaacggattttacaacaaaagcaaacaagtgctcaagatgtcctgaaaagcgcgatcgaagacggctataagcgcctgattcagccgtcaatcgagagggaaatcagaaaagaattgacggaaaaggcggaagaccaagcgattcacatatttgccgaaaatctgcgcaagctgctgctgcagccgccgatgaaaggaaagctcgttctcggcgtcgacccggcattccgcacaggctgcaagctggcagtcgtggatgagacgggaaagatgctcaagatcgacgtcatatacccgcaccctcccgtcaataagaaaagcgccgccatcgaaaaagtaaaacgcatcatcgaagactttcaaatcgaggtcatcgcaatcgggaacggaacggcatcaagagagacggaacagtttatcgccgatctcttgaaggacatcgacagaaaggtgtactatctgatcgtcaatgaagcgggagccagcgtctattcggcatcagagcttgcgagggaagaattccccgatctgcaggttgaagaacggagcgccgtgtcgatcgcacgcagactccaagacccgctcgccgaactcgtcaaaatcgatcccaagtcggtcggggtcggccagtaccagcacgatgtcagccagaaaaaactaaacgattcgctccgctttgtcgtggaaaccgtcgtcaaccaggtcggcgtcaacgtgaatactgcatcagccgcgctcttgcaatatgtggccggactatcgaaaacagtcgcggccaacatcgtcaaaaaacgggatgagatcggaaaattcacgagccggaaagagctgaaagacattccgcgcctgggcgcgaaaacgtatgagcaatgcatcggctttttaagggtgcctgacggcgatgaaccgctcgaccggacaggcatccacccggagagctataaagagacgagagagctcctgaaaaagctgggcctttcaacagcccaaatcggcacaaaagagcttcaggacaaaatcaacgaactgaatatttccgaagcagctgaacagctggggatcggggaaatcaccctgaaagacatttgcgcccagctgacgaggcctgagcgcgatccgagggatgaagtccctaaaccgctcttaaaaaccgatgtgcttcaattggaggacttaaaagaggggatggaacttcaggggacagtgcggaacgtcgttgacttcggggcgtttgtcgacatcggcgtgaaacaggacgggctcgtccacatttccaagctcagccattccttcgtcaagcatccgctcgacgttgtgtcggtcggggacatcgtcaccgtatgggtggaagatgtcgacgctgcaaaaggaagggtctccttatcgatggtaaaagatcgatag

SEQ ID NO: 526 - DNA, 558 bp, Bacillus licheniformis
atggaggacagaaggtcaattaaaacaaaaagagcgataaaagaggcttttttaaagctgctccatgagaaagaaatcaataaaattaccgtttccgatttatcgaggcgcgctgatttagggcgcgggactttttatcttcattatcgggatgtttttgatttgtatgaacaaatcgagaatgagttgtttgatcagctggggaaattttacgatgattattttccaagcgaagatccgcaccatctgctcaccttcatcgaaaaaacgactgaatatatttatcaaaacgctgcaatcttcactttattgacgaaaccgaaaggaaacattttgaccatcaataaatttaaagattttttcaagcagaagattttcgaagaattgagcatgatgcagcaatcaggtaatgagatggcatgcgatgaaatggaaattacatttctagtatccggagcggtcggcatttttgaagagtggatcaacggcggcatggttcagacgccggcacatattgcaggcgtcgtccaccgcatcctgttgaaaatcgcgatgtaa

SEQ ID NO: 527 - DNA, 3120 bp, Bacillus licheniformis
atgagaacgattataaaggcgagatggatcattgcggcgctctggattgcaatggccgccgtcttattcatcacggcgcccgatatggggcaattaacaaaggagaagggccagatagcggttcctgaaggctatccgtcttcttatgcgaacaagcttctcgaacaaatgtcaaaagacggggatacgaacaaatcggttgtcgtcgtatttcaggacaaacacctcctgccgaatcgggaggcggctttaaaaaaagcgatcaccactttagagaaggattcctcccttcacgtctcagatattacatcgtactttaacgcggatgaggatattcaaaagcagctgttgtcaaaggatcgaacgacgctgctcgtgcctgtcacatttgatgcaaacaaaatcagtgcggccgaatttaaagcaaaggtcaatgaaaagcttaaaactttaaaacttgactacgagatgaccgggcagccgctcatcgatgatgatgtcatgacaagctcgcaggaaggcttgaagaagaccgaatatatcacggtcggttttattttaatcgtgctgattctcgtattccgttctgcggttgcgccttttgttccgcttttggcggtcgcgctttcataccttgtgagccagtccgtcgtcgcctatctagtcaaatacgctgattttccgctgtccacgtttacgcaaatctttatggtggcgatcatgttcggaatcggcacggattactgcattcttcttttaagccgttttaaggaagagatcgcccgcgggaaagacaagatcgaagccattctgacaacgtataaaacggcggggagaaccgttctgttcagcggaatcgccgttttgatcggttttacttgcatcggctttgccgaattccagctttacaagtctgcggtcgcagtagcggtgggtgtcgcggtcttgattttggcgcttctgtcgatcgtgccgtttttcatggctgttttggggaaagtgctgttttggcctgtcagaggaaatatcgggcacccgcagtcaaagctatgggaaaccgccggccgtttcgctttcagtaagccgctgatcagcctgttgatcgtagcggccgtggccgtgccgccgatcttgatgtataaaggaacgctttcctacaacagccttgacgaaatcggagatcaatacgaatccgtcagcgcatttaacaccatttccgacaagttcgggccgggagaatctttgccggtcacggtcgtgctcaaaacatcggatgcgctcgataccaatgacgggctgatcgcgattgaaaaaatcagccgcgccattgaacagacaaacggcgtcagcaaagttcgcagtgcgacccggccggtcggaaaagggctgagcgacctgtacgtcaaaacacaggcgaacgagctgaataaaggccttgaaagcggcaataaaggtctgaaaaagattaaagacgggcttgcagaagcgagcaagtcaatcgcggatcaaaagccgcaaatcgaagcgtccggaaaaggaatcaaccagctgatcaaaggaaccgaatcgatccaagccggaatcagcgacgttgaagccaacatgagaaagctgaaggaaggaacagaccaaagcaaacaaggcgtcgcccaggcgaaaaaagaaatccaaactgcgaaaaaacagctgacggcgcaagtcgatcaattaaatggacaaatcgaaacctacaaagaaatatcgaaaatcttaaaagcggcattgtctcaagccgaaaatgcccaaggcataacggctgacgtgcaaaagatgattgagcagacaaatcaaaatttcaaaaatcttgaaagcgaaattcccgaagtgaaggagaatccttcttatttggcgatcaaaggctcttacacagagcttgcatcggcaatcaagcagggatcacagaaagcggccgtttacacgaagcaggcggcaaacgcgaaaaagcagcttgaagcagcagatgcatttatcgcaaaagcgcaggaagagcaaaaagtgtacacaagcaaaatcgatgctctgataaacggcctcggccaaatcgaaaaagggcttgaagagacatcgaaggggcagggacagctcgccgattcgctgcctaagctcgaatcaggcgcaggtgaggtcgctgaaggccaaaagcagatgaaggaaaaagtcggagaattcgccggccagctcgatcaattaacaaaagggctgaattcaagcgtggacggcctcgaaaaaatttcaagcggtctgatgggagcaggcgactacctggatcagctgaaaaacgcatcggatcaagaaatgtccggctggtttgtccctaaagaagtgctgaaaaacaagcaatttcagcaggtgtttaattcctatatgtcagacgaccgccatatcacgacgatcgatgtgatattggaagacaatccgtatggaaacggagcgattgccaaggtcaaagacattgaagcatcagtaaaacgggctcttcccgacacgcatttgcacgatgcatcgtttggcgtcggcggcgtttccagcatcaacgccgatttgaagcagctgtcagaccaggacttcagcaacacggtgatctatatgatgatcggaatcttcctgatcctcgtcctgctgttccgttcaatcgtcatgccggtgtatttggtcggatcgctggtcttgacgtactttgcatccatcggtgtaaccgaatttattttcacggcgtttttcggctatcccggcctcaactgggcggtgcctttctttggctttgtgattttaatggcgcttggtgtggactattcgatcttcctgatggaacggtttaacgaataccggggaacggatattatgacggcgatgacggaatcgatgaaaaatatgggatcggttattatttcagccgctgtcatcttggcgggaaccttcgcggcgatgctgccgtccggcgttttatcgcttctgcaaatcgccacccttgtgctgacgggtcttttgctgtatgcattcgtcatgctgccgctgttcgtccctgtaatggttcggatcttcggctcagccaactggtttccgtttaaaagaaaagaataa

SEQ ID NO: 528 - DNA, 111 bp, Bacillus licheniformis
atgccgaattggctcaaaaaccagatgcagagagctttttatgaaaaagatcattaccagattaaattgctgaatcagtgctggtatttttacagaaaaaaacactgctga

SEQ ID NO: 529 - DNA, 462 bp, Bacillus licheniformis
atggatgaacaacaactgcagcagctgacagaacagctttcgctcacatactttaaaaaaccgttccggcaccgcgcttacttcaacagccgcctgaaaacgacaggaggcaggtatttgctgaattcccacaatatcgagctgaataaaaaatacctgacagaacacgggcaaaaagagcttgaaggcatcatcaagcatgaattgtgccattaccacctccatcttgaaggaaaaggctacaagcaccgcgacaaggattttagaacgctattaaaggaagtcggtgcgccgcggttctgcacgccgctcgaaaaagagaaaaagccgcaaagaaaagtacgcacatacaagtgtgaagcatgcggacaaacgtttctccgaaagcggaaaatggatacaagccgttacgtttgcggcaagtgcggagggaaaataaaagaaatcataaaaaagggttga

SEQ ID NO: 530 - DNA, 915 bp, Bacillus licheniformis
atgcctattataatcggagggaacaaaaaaatgaaaaataccctgttaggttctatatatttagctttagccgctagtatctggggcggcatgtatgtagtggttaaggttgttgtcgcagtaattccgcctattgaattggtttggattaggtacgtaatcgccatccttacacttcttatcgttggtttaataaagagacaatcttggaaaattcataaacgtgaccttttattaattgttgtcattggaatagttggcaacacaatttcaattgttacgcaagaatatggaacgatgttatcttcagcacaaatgggggcgattattacgtcttccacaccagcgttcatggttatttttgctcgtctattacttaaagaaccattgaatataaaaaaaggaacctcaattattttagcgactataggcgtattatttattgttggaaacggtcatattgatacttctaatcagattggtggtatttctctgcttgctgcagcacttacatgggcgctaatgtcagtgcttatcaaactcgtgcccaacagctattcgtctttacttgtgacaacgtattcaacttttgttgccattgtggcactaactccttttgtaaaacctaccgcaattttcacgtcacaactgcttgaccctaaaattctaggtggtcttttgtatttaggaattgtttcaacagcttgtgcttttttattatggaaccgtggattgcaattattaaatgcttcaagtggaggtctctttttcttttttcagcctctagttggaaccttacttggatggcttctgctgggagaaaaaataggcgggacattttggataggttcgtttttaattcttattggtgttttattagttattaaagagaaagaaaaagacgttaattcataa

SEQ ID NO: 531 - DNA, 414 bp, Bacillus licheniformis
atgataagtaagtttttctcaggtatccataacacaattttttcccctttaaggtcctgggctgaacaatctccgggaaattggaatattctcatcgttgttggttttttattggtttatggtagcgggattttggtctatgtattttataaaaagcttggaaaagacgacgaacggacaaataaaatctatttgaaaagtagttcctatatgctgttggtcattattctatgtgacatgatttttcctaaagatgatatgtggaccatctttttcttgtacaaatatgcgctggcatttttagctgctgggatttacctatccgtccaatataaaaaggattttcataagaaaggccggggagtgattctcagccatgggcggaggattagacaatacctccttacagactaa

SEQ ID NO: 532 - DNA, 246 bp, Bacillus licheniformis
atggtcgtgaagaaagactttggtgattcgatatcaaataaggtttatgaatatcgtgtacttgccagaatgtctcagcaagaattagcggagaaagtcggggtttccaaacaaaccattttcgtaatggaaaaaggaaattatgttccgactctgctgttggcttttcgaattgctgaattttttaatgttgatgtaaacgaaatttttacttatgtgaaaggaaatgatcaaaatgataagtaa

SEQ ID NO: 533 - DNA, 1029 bp, Bacillus licheniformis
atgaatgaccaaaatctaaagactttgagaaaactagttacaccttatgaaaagtccgatttacaaaaaagcatttaccaaatcattaacacattgataccatttttcctgttatggtgtttagcatataagagcttgtcgatttcttatttccttacattagcgatttctatcgttgcggcaggttttttagtgagaaccttcatcatctttcatgattgctgccactattccttttttaagaacaaaaaggcgaatcgaatccttggaacaatcacaggaattctaactttgcatccttttgatcattggggacgcgaccattctatccaccatgcgacaagcagcaacctggacaaacgaggtacaggcgatatttggttgctgaccgttgaagaatataaggaagcctcaactaagacaaaaataatgtaccgtttatacagaaatccgtttgttatgtttatgattgggccgatttacgtcttcgggattaccaatcgttttaatcgtaaaggggcaaaacgcaaagaacggatgaatacgtatgtaacgaacttgggaatcgccgctttgacagcacttttatgctgggctattggctggcaaaacttcctgctggttcaggcgccaatttttatgatatcgggatctctcggaatttggatgttttatattcagcatacgtttgaggattcttattttgaagaagatgagcattgggaatatgtaaaagcagcagttgaaggaagctctttttataagcttccaaaagtcatgcaatggctaacaggcaatatcggtttccatcatgttcatcatttaagcccgagagtcccaaactataagcttgaagaagtgcataacaacattgaaccattgcaaaacgttccaaccattacactggcaacaagtcttaagtcgttaaagttccgactatgggatgaagaaagcaaaaaatttgttggttttagccacttaaaaaaagcttctaaaagccaagtatcagcgcaactaagaacggattaa

SEQ ID NO: 534 - DNA, 204 bp, Bacillus licheniformis
atggaacaaggtacagttaaatggtttaatgcagaaaaaggttttggatttatcgaacgtgaaaatggagacgatgtattcgtacacttttctgcaatccaaagcgacggattcaaatcattagacgaaggtcaaaaagtaacatttgacgttgagcaaggtcctcgcggagctcaagctgctaacgttcaaaaaactgcttaa

SEQ ID NO: 535 - DNA, 987 bp, Bacillus licheniformis
atgaataatgtttcattaatatataaggaattcggtgatccgcttcaaaaattacagctacatgccggagaaaagcttcctcttcagccaaatgaaattcttgtcaaaatgattgccagtccaattaatccatcagatttgcttccaattagaggagcctattctcatagaattaagctgccggctgttgcaggatatgatggtgtggggattgtcatagatcagggcaaagatgtatcaccatcattgattggaaaaagggtcctccctgtaagaggagagggaacttggcaacaatatgtaaccacaaaagctgattatgctatagaacttcctccatcaataagtgataacgacgccagtcaactgtatattaatccattaacagcctggctaatttgtacggaatcattgcgtgttcagccgaatgaaattgttttaatgaatggcggaggtacatctattgcaggtttgtttgcgcaaatttccaaaatactgggattccgtttaattgtcatgacaagaaacagccgcaagatagaaaaacttcaaaaactcggggcatggagagccatcgacgcttccaaaggttctatatatgaaaagatttctgatggttgcgacatcggtgttgaccatgcaattgactctgtgggaggagaaagcggcgaactgctggcgagggcattaaaacctgaagggacgtttgtcagttatggtctattgtcaggtataccaaacgattggcgaaagctacacgatgtataccatgtgtcaccgcaattattcgccttaagactttggaatgagagacattctgtttctgaataccgcaatcgcttctcagaggtgattaagcttgttgagagcggaagaatggtcatcaatgccccagaaaaaatatatgattttgaagatttttatgatgccttgaagcattatgaacagccgggtttgaatggaaaaatactgttgaactttgcatga

SEQ ID NO: 536 - DNA, 606 bp, Bacillus licheniformis
gtgaaatatcttttttatgtaataggaattttaatcttaacccttggtattgctttcacgattcaatcagatctcggcgcttcgccttttgacgcacttttggtggtactggccgtacatgcggggcttactgtgggaagttgggaagtcatcattgctctgctattaataggctgcaattcggttttaaaaagacaaagaccggaagtttcggggctgctaacagcgtttataaccggtatcggcattgacatgtggctttttttgctgcatttttttgtgacaccagaacaatggtacagcaaagcggtttgttttgggatcggcttggttgttacaggattaggaaccgcgacatacttatacacaaattttgcttcgatgccaattgaccgtctaacattcatcataaaagaattaacaggaaccaatatatttttttcgagaaccatcatttaccttgtcttcttgacagcggccgtcatgttaaaaggaccgattggcatcggaactttattaaccgtttgtttaggagggctggcccttcatttgtttatgccgtttgctggaaaagtgttgggtcgctttacagacgctcgtacatga

SEQ ID NO: 537 - DNA, 453 bp, Bacillus licheniformis
atgaaggatattctgcgtgaaattggaatgattgcccgagcattggattctataagcaatatcgaatttaaagaacatgacctgacaaaagggcaatatttgtaccttgtccgaatatgcgaaaacccgggaatcattcaggagaagctggctgagatgattaaagtagacaggaccaccgcagcccgtgcaataaaaaaacttgaaatgaagggctttattgaacggagagatgatgaacataacaaaaaaataaaaaaactttttccgacggaaaagggaaatgaggtatttccttttataaaaagagaaaatgaccattcgaatcgtgtggcattagagggattttccgagggggaagcggagatcatcttcaatcttcttcaaagagtaagaaaaaatgtagaaaaggactgggaattcgtgaaaaaggggaacaagagaaattattga

SEQ ID NO: 538 - DNA, 519 bp, Bacillus licheniformis
atgacagtaaatataaaaaggtgtacccttgaagacttacacaagcttcaggaaattggttatgaaacatttaatgagacatttaagcatcagaattcgccagaaaatatgaaagcctacttggacaaggcatttaacttaaaacaattagaaaaagaattatccaatagctcttcgcaattcttttttgtttattttaacaacgaaatcgctggatatttaaaggtcaacaccgatgaggcccagtctgaaaaaatgggtgatgaatcacttgaaatcgagagaatttatatcaagaacaactttcaaaaacacggcctgggcaaatatctgttcaataaagctgtggaaattgcaaaggaactgaataaaaagaaaatctggctgggcgtatgggaaaaaaacgaaaatgcgattgctttttataagaaaatggggtttgtacaaaccggcgcccactctttttatatgggagatgaagagcaaacggactttatcatggccaaaacaatcctataa

SEQ ID NO: 539 - DNA, 618 bp, Bacillus licheniformis
atgtatattccaaaatattttaaagtcgaaaatgctgatgaaattttggattttgtccaaaaaaactcttttggcacgattgttacgacagaacaagggaagccaatcgcgactcatttgcctttagggctcaataaaaaaggcgatgattactatatcactggccatatcgcttatggaaacccgcaggtgggaactttggaaacctgtaaagatgtgcttgtcatgtttcaggggccgcacgcatatatttcttcttcctggtatgggcatgaggatgttccaacatggaattatcaagccgtccatatatacggtaaagcaagcattctagagagagatgaattaatagaagaattaacaatcatgatggaaaaatacgagaagcatcgggaaaatccaattttatgggataacctttctcctcaacttttggagagacaactgaaagcgattgtcgggtttaagattaaggtggaagacattcaggctgcatataaattaagtcagaaccgaaatgatacagactacatgaacatcattgatcaattgcaaaatgaaggagatccagattcggagcaattggcagcagcgatgaaaaagaggctggaaaattag

SEQ ID NO: 540 - DNA, 915 bp, Bacillus licheniformis
atggctaaaaaaacaattcgtctgttaatgccgcaatggcaagggggaaacaatcccaactactcttttggagcagaactgcttgcttggctggctcctgaaaatgatcagccccttattcatgttccggttcaaccttatgatggaactccgcttgaaaacgaaaacgggataaacgggagaaaacaactgctggaacaattggaggctgctcagcatatcattcatgctcataagccggatcgcattgtcatgtttggcggtgactgcttagtcgaacaagcaccatttgcttatttaaacgaacgatacggcggggacttaggtttaatttggattgacgctcatagcgatttagttagatatgccggttatgacaacggtcatacattaccgctcgggaatcttttgggagaaggagatgaagagttcgcaaaacatgtgaaaattcccctgaaacctgaaaatgtctttattgcgggattagcagctcctacagaagaagaaacaaaagtgatatcaaatgaacttcaaagacaaggtatagctcccacagaaccagacactgaagtgattcaaagacttgggattagaactgccggaactaaaaagttaatgaccagtaccgaacctataaaagaatggataaaagaaagcaacatcaagtatctggcaatacaccttgatttagacgtgcttgatccgaaggcgtttcgttctttattattcgccaatcctgaagcacctgtaaatttttctcctgagggaacaatgcaaatgccgtacctgcttcatcttctgaaagaactctcttccgaaacggatgtggttggattaggtataaccgagcatttgccgtgggattctattcatttgaagaaattgcttagtgaaatccctattttaacccaataa

SEQ ID NO: 541 - DNA, 402 bp, Bacillus licheniformis
atgaacgcaaataaaaaaatagtacgcactttaatgacaggtactatccaaaaggagagtgtaaaaatgagtatggcagaatataaaggtaaagtgaaaaatattcaagatacaccttttggatacacattgtctgttatcggcggtaaatggaaaatggttattatttacctcctggcagaaaatcaaccaattcgcttcaatgagttgaaaagacaaataggggctattacttataaaacattgagttcacaacttaaagaattggaagcggatggactggtgaaacggaaagagtaccctcaagttccccctaaggtcgagtacagtctcacggataaagcggaatccctattgccggttttagaagggttatgtgaatggggtttaaaaaaccaataa

SEQ ID NO: 542 - DNA, 873 bp, Bacillus licheniformis
atgaataaaatcgaaaaacataggaaatttagagcgaagatgattttcaaagtcataatggtcatgatcggaggaatcatagcggcatatggattggaaacagtgctgattccaaacagtgtatctgatggcggagtgacaggacttagcattgttggttcacaactgtttgatttgccgcttgggattcttatcgcggttttaaacataccgtttgtctggctgggatataagcaaatcgggaaaagctttgcgctattgtccattatcggaatcgcatcacttgcagcagggacaagttttatgcaccacactccagctataatcgaaggggataccttgctagtcactgttgtcggggggatcatccttggatttggaatggggctggcgctccgcaatggcggagcattggacggaattgatatgcttgctgttttgttatcgcgaaaattgccatttggaacgagcgatcttattctattctttaacctttttgtgtttatttttgtttccgctgtatttggcttgcagggggcattgctgtcagtcattgcctactacatcgcgtccaaagtcattcatgttgtcgaggaagggttaagcggatctaaaacttttcaaatcattacaagcgaacctgaattaatggttgagacaattcgtgatcaattgggccgaagtgctacatataaagaagcttacgggggtttttcccacgagaaatttaaagaaatcacctgtgtcatcaaccgcttagaagacaccaaattaaaagaaatcattaatgaagttgataaaaatgcttttgttactgtatatgacgtagctgaagttaagggcagtaattttagaaaacctaatattcattag

SEQ ID NO: 543 - DNA, 579 bp, Bacillus licheniformis
atgagtattatagcttttctttcgtatgtgattatgacatccattacgcccggcccgagcaatattttaatgatgaatgaagcgcaaaggttcggctttacaggttcatggcgttttagcagcggtatcttggcggggtttgcagtacttgggattctcagcggtgcctttacaatcagcctgtacaattggattcccgttgtagagccttattttaaacttgccggcgcgtgttatttgatttatttggctttgcaagtcggctttaccaaaaataaaaaacaggattccacagaagcccgctcctcttttatatccggctttatatttcagctgatcaatattaaaagcattttgttcttcttaaccgtaatgagcgcgttcgttttgccgttcaaccattccttgaaatcgacaatctattatttggcattagccattgttctcgggtggctggcgctgctattatggtcgggattcggctccgtttttaaaagggtatttgcaaagcacgaccgggtatttcgagtccttatgtgcctgctgctcatgtattctgcggtgtctattttccgatga

SEQ ID NO: 544 - DNA, 882 bp, Bacillus licheniformis
atggaaatcagacatttaatcacgtttcagaccatcgttgaaatgggaagttatacgggggcggcttcgaaattaggctatactcaatccacgatcaccactcatatccaggctcttgagcatgagatcggcggggctttatttacgtatgaaaaaaggaatttaaaactgactcagttaggaagggagttaatgcctttagccgaagaattgctgtcaacccataatcagatcaagaatttgcagagcgctcacgaagtgaagggggtattgaaagtggctgcgcccgagtctttaaccatttctaggctggggccaataataagggagtattcgttgaaatatcctcatgtcaaattgaaactgagcaacggtacatgcggacaaaaccaagtcgacttattaagcgggaatgtggatgtcgctttaatggtttatcccgaaatcgagctggacaaatgcattcgctacacgttggctgaggagaagatcgtccttgtcggcagcagtgaagggcctgaggatttagaagaatatcaaaaacatttttttataacgaatgaagaagactgcagctatcgaaccatgtttgaaaaatatctcttgaaaaacgatattcattactttccaacgatggagttgtggagcatcgaagcaataaaacaaacggtcatgagcggactcggattttctgttttgccttacattacggtgaaagacgaagtggaaagcggtaaactgaaaatccttcctcattctcaatacctcgacccgctttattcccagatgcttatcaaaaagaaaaagtggcagctgcctgctgtggatgcttttgcggatctggtattgcattcgtttcgtgaacctcgattaataggataa

SEQ ID NO: 545 - DNA, 222 bp, Bacillus licheniformis
ttgcgcgaatttgcacctaaagtttttcaaacgacagggattattggttttattttagcttttgtccaaattccaatcggctggtttatcggatttttcttttccggtttgttcttcatgatgttgaaatcaaacaatgaaaaatcgggaaccttcaacatgatggctgggattgcgtgtttattgtattcattctattgtttgtttacgcaagtgttgtga

SEQ ID NO: 546 - DNA, 1227 bp, Bacillus licheniformis
ttgcgaaagttgaaactgttgcttgccgctaatttgatttccaccgtaggtaccggcatcacttcctatttgattgtctggctgctgattgatcaattgaaacaatccgttttatatgggttattgacgatggcaacgatgattttagtgttttttgcctcaccctatttagggagtttggtggatcgatattctcgaaaagcgatattcctctatatggaaattacaggaatagtggtcttgggcgttttttctgttctatgcaatgtttccgccgtgttggacatcacccttgttgtgatgctgattttttatcatacagcttacgattcgataaagtatcctgctttagccgctttaacacaggaaatgttcaaaaaagaggactatagtaaagtgaacagcagtcttgaagttcaggggcaggcggcgctgatgattagttcggggctggctgccatgatgatcggcaagatggatgcggcagttattttggttatgaacatctctacatttatagcagcttccatcctcatctaccaacttccttatcaaagaaatgctgaagcggaagagcattccaatacaatgaaaaatgaatcttactggaaaaacttcagatcctcactccaatatttatgttatcgaaaagttttgtttgttcttttattgacttcttttataccaagcatcgtgattattgtcgcaaactacttggatccggttttcatttacgactatttaaacgaaggtccgtcagttatcggcattgccaatattgtttacgccattggagctatgggtgcgggctttgtcgcatatcaaatatcaaagaaatggtctgatatgcaaggtgttatattgtttatggcagtatttgctctagcaacaattgcgatcttcctcgttccgaatgccgtgacatttatagtggcaagcctcttttgggggcattcaaatgctgcgatcagagtatttagaaaaagctatatgttccatcatgtcgataatgcatatatgggacgtgtcaattcgttgtttaatgcggtaaagctgttgggacaagttgctttaataggcatcttgacgattacagtagtgccggcgggtcaaactgtttacggatacttcgttttattcatcattgtaattgctgctcttttaacaacaacttatttatttaacagaacttataacaaagataaagaaaagcgggtatctttatag

SEQ ID NO: 547 - DNA, 783 bp, Bacillus licheniformis
atgaaaatcaatcaaattgtagatttgtcggtatcgctaagaggcgatattccgtctgacccgccggggtttatccctgaaatcgaatatgcggatcataagcaaggagccaaacagatggtccagagctttcccggcctctcttcgcaagatcttcccgggggagaaggctggtcgctggaaaaagtgaaaatgtcaacgcatgccggaacgcatatagacgctccataccattaccgttctgttactgatgacggcaagcggatgatgacgattgacgaagttccgcttgactggtttcatggccccggcgttaagctggatttcagacatctgaaagacgggcatatcgtaacccctgaagaaatcgaacaagaacttcaccgcatcaatcataaactcgcgcccggggatattgttcttgtgaatacgtcggccggtgccaaatacgggcaaagcgattacctggacagcggctgcgggatggggcgcgaagcaacgctttttttaacggaacggggcgtgcgccttgtcggaactgacgcttggagctgggacgctccattcagcatgaccgccaagcgctttgaacaggaaaaagacccgtcgattatttgggaaggtcattattcaggaagcaccattccttactgccaaattgaaaagctcgccaacctggatcaattgccttccaccggattttatgtcatggcttttcccgtaaaagttgaaaaagcgtcggccggctgggcgcgtccggttgcaattcttagcggtgaatga

SEQ ID NO: 548 - DNA, 1383 bp, Bacillus licheniformis
gtgacagaagatgtaactgacaacgatatacacgaacaaaaattatcgagaggcctgaaaaacaggcatattcagctcatcgccatcggcggggcgatcggaacggggctgtttcttggttcggggaaatcaatccattttgcaggaccgtcgattttatttgcttatctgattacgggaatcatttgttttttcattatgcgttctcttggagaactgctcttatccaatttggaataccattcgtttgtcgactttgtaagagactacttaggcgacatggcggcatttataacggggtggacatactggttttgctggatttcgctcgcaatggccgatttaaccgcggtcgggctttatacccaatactggctgcctgatgtaccgcaatggctgcccggattgatcgccctgatcattttgctgatcatgaacctggccaccgtcaagctttttggagaattggagttctggttcgcgttaatcaaagtcattgcgatattggcgctgatcgcgatcggacttttcatgatcttcaaaggattttctacccattcgggcactgccgcctttcacaacctttggagccacggcggcatgtttcctaatggactgcacggatttctcctttcattccagatggttgtctttgcgtttgtaggcatcgaacttgtggggctgacagcgggggaaacgaaagatcccgaaaaggtcattcctaaagcgatcaacaatatccccgttcgggttttgcttttttatatcggtgcgctccttgtaatcatgagcatctatccgtggaatgtcatcaatcctaatgagagtccgttcgtccaagtcttcgcagcggtcggcatcattgcggctgcaagcatcatcaactttgtggtgctgacatcggcggcttcggcaagcaacagcgcagtcttcagcacaagccggatgatatactcgctcgcgaaagaacataatgcgcccggcgctatgaccaaactgacctcccgcaaagtgccgggcaatgcattgtttttctcagcggtcgttattctgattggcatcatgctgaactatatcatgcctgagcaagtgtttacgctcattacaagcatctcgacgatatgcttcatctttatttggggaataaccgtcatctgccatttgaaataccgcagaactagaccggatttagcgaaaagaaacaaattcaagatgccgctttacccgttttcaaattatgtggttctcggttttcttgcgtttatcctcattgtgctcgcactggcgcaggacacccgtgtttccttatttgtcacgccggtttggtttatcatgctgatcgcgatttacaagctgagaaaacctaagtcacggcaagtgtag

SEQ ID NO: 549 - DNA, 501 bp, Bacillus licheniformis
atgtatgttcatgtcattgccgcttgtttggcgatggtttcgggagctgtcaacttctccagcggcttgttggccaaaagccgcaaaatccaccggcttaacggctttatttacgtcgtctcggtgatggtagttacgctatcatcaggctatatggcaccccattctacgggaggtagagccgtcagcatagcctttaacatggtgaacatgtattggccggcggccactgttatttccgtcatcaaagcacggcgaaatcagtttacaaagcatcggaattggatgattcgcagctatctattctgttttaccaatctgtttattcatttcatcacgtttgtgtgccgaagcggattcggtttgccatacgatatcagctacacgataggcgtttacggggcgattgcactgaacgtggcggcagctgagttcgtcattcattttacacgcagaaaagcggtggacattttgcatacagctggattcgataaggtatag

SEQ ID NO: 550 - DNA, 636 bp, Bacillus licheniformis
atggatgacagaattgaaacaaaagagccgatgccttcattaatcggcttgatcacgaacccggcattgcagtttgaaagaatgaaaaggcggccggcggttgctctgccgatgtttattgtattcgttttatcggttttatctgcttatctttatatttcaaaagattttcccgatacgtatacctactttggaatgatcatatttttatgggagtttttaaagacggggatctatttgtttgtatcagctttaatattatggctgatcgcgacaatagggggcggaaaaacaaactttgtgacgatgttttcgttggcgtcttttgtaggctttgccaaaatcattggcgacgtgataaacaatacagtttatcgttttgcgaatgtgccggaagggacttcgtttacatctttgcacgatgttttttcggccgtcgagccttataaaagcatattgggcgtgtttgatatctttatggtttgggcgcttgtgttagcggctgaaggtcttcagaaagcgggtggagcttcgaaacgggcttcatggatcgccgttgcagttttatttattctcaagtttttgttcgcttgtttttttggtttgtttgccgcattgtttgaggatattttttag

SEQ ID NO: 551 - DNA, 498 bp, Bacillus licheniformis
atgaagaaacaagcagccagagcgtctcttgtcgcttgcataacagaccggaaagaagacttttaccggctggcatacagctatgtgaaaaatcaagaagacgccttagatattgtccaggaatcaatcaaaaaagcgctcgattccgtcgattccgttcgcaatccggatacgatcaaaagctggttttataaaattttggtgcggacggcaatcgattttttgcgcaaacagaaaaaactaaaggttatggatgatcaaacgatcgagtttttaagccagggcaaggaagatacctaccgggatacagatctccatgaggcgcttgatgagttgccgcaaccctaccataccattattgttctgcggtttttcgaggatctcaaactggaagagatagcggaaatcacaggcgaaaacttgaatacgatcaaaacgcgcctttacagaggattgaagcttatgcgcatccaattgacgaaggaggatctttcttaa

SEQ ID NO: 552 - DNA, 861 bp, Bacillus licheniformis
atggataagaaattggaacagctgagaaaagcatatcaaaacgtccccattccgaaggagctggatcaggttgtcgagactgcgcttcagcataaaccgaagaagaagagaaggatagtggtatggcccgcatcaacgctggtcgcggcggctgtactattggctgccgtcgtgaatatcaatcccggagcagcgcaggccatgtcgcagatacctgtcatcggcaaggtcgttaaagccatcacattcaccgagatcaaacagaaagatggagaatcgagcattgacgtgaaaacaccggctctttccggcttgaataaccgggagctcgaaaatggcatcaacgagaaatatgtaaaggaaagccatcagctttaccgggaattcatgaaggagacgtcccggaataaaaaagggcatctcagcatctacagcgattatgagacagtcacggatacgaaagatttgatttcgattcggcgaagcgtcgaaagaacggaagcgtccagctataccgaacggcgctatatcaccattgacaaaaagaatgaagtcctgctcaccttgaaaagcttgtttaaagacgaccggtatatcaccgccatcagcgaaaacattaaagagcaaatgaaacagcaaatgaaagatgatcctgataaaatatattggatcggtgacgaagaagtcgagccattcaaacgaatcaaggccgaccaaaatttttacattacagagaatcataaactggtgatttcgtttgatgattatgaagtcgctcccggctatatgggcgcggtggagtttgaaattccgactaaggcgatttcgaacctgctgatcggcgaccgctatatccgctag

SEQ ID NO: 553 - DNA, 1881 bp, Bacillus licheniformis
atgcgagatcagacacaacaacaccgttacataccggggttagacggccttcgggcttttgccgttttggcggttatcgcttaccacctcaacatgagctgggccgacggaggcttcattggggttgatatcttttttgttttatcaggatatttgattacatcgattatcctgccggcgtatggaaatgacatttccctcacattccgcgatttttgggtgcgccggatacggcggctgcttccagcggcgacgctcatgattttcgcaaccgtcatatgggtcgctttgtttaacagagagctgatgcataccgtacggggagatgcgatctcctctcttttgtatgtcagcaattggtggtttatctttcacgacctgtcatattttgatagtttcggatcgccgtctcctttaaaaaacttgtggtcactggcgattgaagaacagttttattttatctggccgatcattttgctgttgggcatctacatatttaaaaagcgggagaggtttgcagcggcggttgtgctgtgtgcgctttgttcagccatatggatgagcatcctgtacgtcccgggcggcgatccgagccgtgtatattacgggacggatacacgcgctttcgagctgttgatcggatgcgcattagcccttgtgtggccgatgaaaaggctgtctgggaacaggctccccaacagcctcaagcatgcattgcacggaactgagcttgccgctttcgcgctgcttatgatgtgcatttattttgtcgatgaattcagcccgtttctctatcacggcggaatgcttataatcagcataatcgcagctattttgattgcatgcgtcagtcatccgagcagcttcctgggctttgccctttccgtgaagccgctgcgctggatcgggaaaaggtcgtacggcatttatctttggcactatcccgttatcgtgctgagcacgcctgttcaggagattggaaatccggtgtactggcatgttgcgatgaaggtcgccgttacatttattctggcggaactttcgtatcgctttattgagaagccgatccgaaaagacggttttaaaccgtttgtcagccgggtttttctggataagatcacggaatggaaaacggcttccgttccaagcaaaatatcaatcggcctgatgtttgccgcgctcctcgtttttgcagggggtctgtcgggattggccgacgaaaagaaacagccgcagcaggcctattcaaaatcttatgaggaaacaagcgcctcagcggatcagccggctgacaaaagtgaagaacggcaggacgataagaaagcacaaactgagagcggaaatgagagtaaaaccggaaacggggaggaatcgtcagatacgaaagatgagcagtctgcggaaaaagagccggatcgcatcgaaaaagaagtattggctgtcggggattcggtcatgctggacatcgcttcaagcctgcgccggaagattccgggaatcacaatcgacggacaggttggaaggcaagtgagggaagcgcttcaattgacatcaacctacgcctcctttaatcatccggacaaagccgtcgtcattgaattgggaacaaacggctattttacggacggccaattggacgctttgcttgatgctttctcaaaagcggatgtctatctcgtgaatacgcgcgtcccccgacaatgggagagcaaggtgaatgaatcgcttcggaagcatgcggacagccgtcaaaatgtgacattggtcgattggcacgctgaagcactgcaacatcccgaatatttcaccgccgacggcgtccacctgatgccgaaaggtgctgaagccttggcatcgcttatcgtcaaagcgatgaaataa

SEQ ID NO: 554 - DNA, 1176 bp, Bacillus licheniformis
ttggcattggcttttctgctcggaatgcttgccatacttggacctcttaatatcgatatgtatttgccgagcttccctgaaatagcggatgacctgggagccggtgcgtcgcttgtgcagctcagcttaacggcttgcttgatcggccttaccatcggccagctcgtgattgggcctgtgagcgatgcgaagggaaggcgaaaacctttattaatttcgatttcgctgtttgcgctgtcttcactgttttgcgcgctgtcgcctaatatcgcgacattagtgcttgcccgttttttacagggatttaccgcttcggctggaattgtgctgtcgcgcgccattgtacgggacgtgtttacagggagagagctttctaaatttttctcgcttctaatggttatcaccgcggttgcgccgatggtcgcgccgatgacggggggagccatcctgcttttgccgttcgctacttggcatacgattttttatacgctggcattgatcggattgttactagtactcgttatctcgatgaaattgactgaaacattgccgcccgaaaaacggattccaagctcaatcggttcgtctctcaaaacgatggggagcttgttgaaggatcggtcttttatcggctatgcgctgactgtcggtttcattcacggaggcagctttgcctacgtatccggaacgccttttgtatatcaggatatctatggggtttctcctcaggtgttcagcgtgctgttcggcattaacggcctcgccattatttcgggaagctttatcatcgggcgattcgggggaatcattcatgagaggaagctcttgcggatcgcggtcattaccgctgtcatcgcgacatccgttctcctgacgatgacgattttgaaaggaccgcttgcagcgattgtcatttcaatctttatctacatgataaccatcggaatgacgttgacaagcacatttacgctggcgatggaaaaccaggggcaccgtgcgggcagtgcaagcgcaatgctgggcatgcttccgctgctgctcggttcgatcgtttcgcctctcgttggaatgaatgaaacaacggccgttccaatgggtgcgatcatgttcatcactgctgtgatcggctctttcgctttttttgctttaacgcgggaaaaccagggggagcggtaa

SEQ ID NO: 555 - DNA, 3093 bp, Bacillus licheniformis
ttgaaaaagctatttgttttcatttcgattattctcggctatgccggcttcttttttattttcttattcattaacaaccaattgtccgagcaaaactaccctgaagcgaagcaaggaatcatcaatctggaaacatgggattttcagaaagacgggaacatcgcgctcaccggagaatgggcactataccgaaaccagcttctctccccaaaggacattcatgcaggcaaaggaaaagcccccatttattccgatgtgcctaacaatgtcaaacttaccgattcaggaaaaaacgtggattacggtacatacagactgatgatccggtcaaagcaagacaatgagatgttcggaatcagcacctcttttataaacagcgcaaaccgagtttatttcaacggcaaattgatcgggcagagcggaaccccttcaaacaaagcgaatttcacggcgcaaaacaggccttatacgagttttttcgaggttcgccgcggagacaacgagttgattgtacaattttcgaacttcaaaaaaacaccttcatgggggatagaaaaaccgattgcctttgggatgcagcagcacattttacaccaaagcaaaatctcttttttaaatgaaaccagcatgatcacagcattctttattaccggtttatactttctcggcttttttctgcatcgaagaaaggataagcacttattctttttttccacgatgtgtcttcttttttcggtcatagtgcttttaatcggaagagaacgaatgatctttcttctctttccgtctatctcattctcagctttaagcgtcgtgagggcgaccacaatggtgcttgtcagtatggcggtttttctctatctatatttcgcttacaaagaaatcgtttcgaaaaaatggataatcgccgcgactgcattttctgtactggttttgatgattgattttattacctggggttacacagaccgtctcgcatatatattgcactctgttcttgccgtcacgactttgatttatattacgtatgtgtttgcgatttctgctgttcggaaaatgaaaggcagcctttatcttacgattgcagcgatctcgatgagcgcattcgtcattttaacgacagtttctgcttacagcggcaaaagaggcttttcattcaattcgctctatgccgtgccgtcgatcatcgctttgctggcggctgtactgatgatggcgcagcaattcgcaggcgcattccgcgagaacgaaatcctgtccttgaaattgctcagaatgaatcgattaaaagacgagtttatcgccaaaacatcacatgaatttaaaacgccgctgaacagcatgattaatatatgccagacccttttggcaaggaagagaaaaaggacgttagaggaagaaaaagaaaatctgcagctggtcatccgcatgggatacagactctccagtctggtgaacgacattctcgatttggaaaaaatgaagcagggcatgctgcagattcaggccgttcctgtcgatgcccattcggcgatcagcacggaaatggacttctatcggctgttgtcaaaaaataaaaatgtccggattgtaaaccgtgttccatccggactgccgctcgtcttggccgacgaaaaccgcttccggcaaatcatgaccaacctggttgataacgcgatcaagtatacgccggaggggcagattacgctctccgccgaaaggctcgaccaagagaaggtcaaaattacagtagcagatacaggagtcggcataccaaaagccgtgcgtcaattgatattcgaagcttttcaacaagcaaaaaaccataaagacgacggagccgggcttggtttaagcatcgtcagacagctcgttcagcttcaaaatggagagatctgggtagaatcggaagaagggaaaggatcggcatttcatttcacactgcctgttgcaaaaaatgaccctcttcctgacgcgaagaaggagaacatgcctcaacagcaagccgtcagagatctgcccgatgtttctatcagcacgccgtactactcaaagaaaatggatgcttcaactgttttgatcgtcgatgataacatcgaaagcttaaaaattttggccgatatgcttgaaggcgttccttatcaagtcatcgcagcaaaaagcggccatgaggctctcgaagtcgtctcccgttcaaagcttgacttggtgattttggacctgatgatgccggatatgacagggtttgaagtctgcatgaaaatccgcgaaaggttcacaatggtggaacttccggttctgatcattacggcagccatcatcgaccatgataaatacaaggcttttcacgctggggcaaatgacattttgcagaaaccgtacaactacactgaatttgcagcccgcgttaaaaacctgatcatgatgaaagatacggcagcccaagcgacaaatatggagatggcattcctccaatcgcagatcaagccgcactttcttttcaatgtattaaataccattatcgcgctcagtcatttggatattgaaaaggcgcgcgaagtgacggctgattttacaaactacttgagaatgagttttgactttcaaaatacatcagggatgagttctttcaagcatgaactgtcgattgtgaattcgtatctttccattgaaaaaacgcgcttcggcgatcggctggacgtcatttacgatattgaggaagacatcgactttacccttccgcctttaatgattcagcctcttgtcgagaatgccgtccaccatggcatcagcaagaaaagaggcggaggctggatcaagctgacggcaaaaaaagaaagcgaaaaccgctattatatcaagatagaggacaacggaatcggcatgccgccggagaaacaacaagatatcttttcttctcatttcactcatagtgtcggtatgaaaaatatcaaccgcaggctgaaacacttctgcggaagtgaactgaatatcgaaagtacgcctgatagcgggaccgctgtctcaatggtcatttctatcaatgaatccgcggacgtctcagactccgccatccagcgggcgcctctataa

SEQ ID NO: 556 - DNA, 1077 bp, Bacillus licheniformis
gtgaaagcgttaattgtggatgacgaggaactggcattgcttcattttaaaaatatgcttgaacgaacaaattgctttcgattcattgaaatgtttcaagatccggctgatgttctggaatatccggatattcgggatatagacacggtgtttcttgacattgaaatgccggggataaacgggattgagctcgctgaagcgattcaatcgatgaatgaaaacattcaggttgtttttatcacggcttataacgattttgccataaaagcgtttgaattaaatgcggtggattatttgcttaaacccgtcgattacgtccggctcgtgaagacgattgaacggatcagggaaaacagcttgctaaaggcttcagcggtaaataccggaggggactatttcatccaatgttttgggaatttgcaattttacaaagcagagaagggcgtcaaaacatatatacctgttaagtggagaacatccaaggcccgtgaaatttacgcgtatttgcttcatcatcacggccatgtgatcagcaaagacgtgctgatcgacctgttctggcaggatcatgatgtctctaaagcaagcactcagctatattcagcgatttatcaaatcaggaaattaatcgataggcttcctttcggtcaatccatcgagaagactgacacaggatatgtcctccggatttccggtgtgaaagtggatgctgacgaatgggaaaagtcgctgaaagaggctcctcccatccatatggcgacgatcaacaggcacatggaattgctgcttgcatacgaaaaccattactttatggaacacggttatttgtgggccgaacccgaaaagacgcggcttgcccggatctggcttggaaaagcttatgaactggtcgattttcttattcatgaaaaagactaccgccgggggcttgatatatgtctgctggtcgagaaaatcgaaccgtgcgatcataaaatcatccaatacaagatgcagctgtttaataaaaccgggaatgtagaagaagcgatcaaggaatatgagcgctataaacttatgaaggacaaaatgaattaa

SEQ ID NO: 557 - DNA, 5928 bp, Bacillus licheniformis
ttgagatcgaaaaaatattcgttcagcctcagcaaaaaaagagggctgaaatcatttttggtcacttgcctggcattgtatttgatcttcagtcaagttgtcggctttacgctgacggcagtggctgccggcacatcaacaggcggcagcgtgttttttgattcagtgacaatcaaaaacagcgaagatcaaacggttgacggctcaaagggagacgaaccagcattaaagccgggagacaaagtgacactcacatacgagtggtcgttaaaaaacgatgaagaagccggcgccgaaaacagtttcactgtagaggtacctaaaagcttcgaattcgctcaggatgccgagggagaagtgaaatcggcagatcagcagatcatcggcagctatcaagtgaaagcggacagcaacatttttaccgtaactctaaaaagccctgccgagggctctgccggagcaaaaggggccattgcgctgtcagcaaagtttgccgcagatatgaaaagcgatacaaaaacggtcacagctctctttcaactcggagcaggcaagacacagcaagtgatcatacccgtgaatacaggctccgaatcggaaacggcgaaaaatgatcctccgtcatctgaggacgatcagtcagacgatcaatcaaaatcttcaggaggacaggaccaagaggaaacgaagaaaaaagctgccgacgctgagaacagcgattcaaaaccggcggcatcttccagactggcggcagccggaagccttgcgtccggtggcaatcaaatcacccaaaatattttaaccggcgtgacgctgacggatgagcacggaaagccttatgacaaaagcaatcgagccgacacgaattctccggcgaaaatctcaattacttgggacatcccgaatgagctcggaaagacgataaacgacggcgaccgctatgaatttgatctgcctgaagcttttatcatgtacaacgacattacgaatcagccattaagctcagacggcatcacgtacggctatttttcaattgatacaaaaggccacgttgtgatgacgtttaacggcgaagtgaaagaagattcgaatgtcaaagggacgttgtttgtcaacacccagttcaacgcacaaaaaataaaaggctcgacgactcaaaagattccttttccggtgaaatcagacactccggaagtaacggtttatttcaaaccaaaagtaagcaaaaccattgataaatcaggaactttcgataaaggcatcaaccccgggcaggtcacatggacagtcgacctcaacaaaaaattggatcaggtgaaaaatgccaagctgcagaactttccagaggggctgacctatcgttctgtcaaagtttatcagctggatgtcaacatagatggttcagtcagccggggagatgaagttctttcaggctacaccgtagacgcagatggaaatgtcacattcgacggtgagatagattcggcttaccgcctcatctatgtgacggacatcgatgactccgcaaaaccgaacgaaggcggaaacgctgcatttaggaacaaggcaacgttcggcggagacaatctggaaccggcttctgcagaggcctctgtcacggccaaatacgggaaaatgatcgaaaaatcgtcgacaggttataaaagcgattcacagacgttcagctggacgattttatataactatggagagaaaaaaatcgacgaatccaaagcgagcataacagactcgtttggttccgctgatttgcatcttgtttcagattccttaaaggtgattccgattactttcaatcagaacggcagtgagcaggctggaacgcctctaacggaaggcaaggattatacgctctctgataatggaagcgggtttgaaatcaaatttaaccaagatgttaccggagcttacaaaatcacgtatcaaaccgaggtcaacagcggagtaatcatcgataaatcaacaacctatacgaacactgcagtgaccggaacaggagaatcaaagaaagcttcaggtacagccgttcagcagaatttgataaaaggctactcaaacattgattacaagaagaaaacggtcgattggacgatcgcaatcaacaaaaacaactacacgatgaacaattggaagttggatgacaatttcgaaagcggcgggctcacgctcctcgacggatcattccgccttcaggatgtgacgaataacaaaacgcttgaagaaggcaaagactatacattgataataaaaccggatcatgaaggttttctcctggaactcatcggagattatgcgacaacgaacagccagcttaagatcacgtataccacgaatatgaatgccgacttttccaacgaaaatgtcaaaaacacggcagaatcaacgtggactgatcacagcagcactgaacgcaaaaataaggaagcgagcagttttacgccgaatcgccagacatcccacaacggcttcaaacacggcttatacaacgctgtttcaaaagaaatcacgtggaaaatcggcatcaactataatggagagccgtcaaaaaacccttatattaaagattctttagcagatgaccagcaatttgaaaaaggctcggttgtcgtcaagagctattcagttaataaagacggttccatcacagaaggagacatcctgcccgcctcccaatatgatgtggaagagccgtcggctgccaataaacaaactttgaccgtccatttgaaaacggacgattccgtcccgtatcttattgaatttaaaacatcgctaaaaggacaggtcattaagcacgatccttacaccaataaggccacgtaccataatgccggatattcagagcgtgagttgacggcatccgtttcggtcgcagacggaggaagcctcgttttcaaaggaggcaaacaaaacggaggttatgtcgattggagcatcaatgtcaacgcgagccagtcggtgttggaagatgtaaaagtcaccgatactccggataccaatcaaattttagctgaagattcttttaaagtttatcaggctaaatatgatgaaaaaggtgcagtcaaagacagcagcggaaatcttgtcccggatgatgttcagcttaagaaaggcgaggactatacactggatatcaagaccgacaatgcaaccggcgaacaatcatttgtcctgaaatttacaggcgattacaaaaaaatcgaccgcgcctatgttattcaatatcaatcattgatcaatattgccggcacgagcggccatgttaacaacaaagtgtcgatttcgggaacgaatgtccaggaacagacccaggaaaacaacagctcggtctttgttgccgtttcaagcggcggcggttcaggctcaggggaaagaggaagcctgacaatccttaaaacgggagaagacgggacgccgctttccggagcagattttcaattgcggacaaaagataatgagcagctcctgcggacaggaacgactgacgacaacggcaagctgacattcggcaatattcgctatggcacttacattttaaaagaaatcaaggcgcctgacggatatacgatcagcgacgcctatgcagacggggtctccgttgagattaacagcagctcttcaagtgccggagcgctttacaaagtcgtgaatgagaagaataaggtgacgcttatcaaacaagacgaacaaaagaatccgttggaaggagccgtgttcaagctggagaaaaaatccggcgatggcgcctttacgacaatacgtacaaatattaagagcgacaaaaacggaaaagttgagatcaacggtttgccgcccggcgattatcgtttgctggaaacgaaagcgcctgaaggttatctcttaaatacaaaagaactcggcttctccgtcaaaacgaatgataagaatcaagtacctgacgttgatttaggaacattgatcaactataaaggcagagcacatttaacgaaagaagatgcagaaggccgtcaattagagggggctgaattcaagctcattgatcatgaaggcaaaaccattcatgaaaagctcacctcagatcaagacgggaaaaccgcggtatctgaccttgcgcctggccgctatgcctttgttgaaaccaaagcgcccgagggctatgtgataaacagcaaggcaatcgagtttaccatatctgaatcggcaaaagaaaaaccggaatccgtggacgcaggcaaagccgtcaactataaaggttcggtttatttgacaaaagaggatgcggaaggccgtacgctgaagggcgctgagtttaagatcgttgatcatgaaggcaaaaccgttcatgaaaagctcacttccgatgaagacggaaaaatcgcagtttcaggcctggcgcctgggcgctatgctttcgtggaaacgaaggcgcccgagggctttatgttaaacaacgatcaaatagaattcaccatcccgggctcagctgaagggaaaccggagccggttgatgcaggcgccgctgttaattataaaggctcggttcatttaacaaaagaagatgcgaaaggccacaagcttgaaggagccgtttttaagatcgcagatcaaatcgggaataccgtacaggaggaactggtctcagatcgaaatggaactgttacggcttcaggcctggcgcctgggcgctatgctttcgtagaaacgaaagcgcctgatggatttgtattgaacagcgggaaaatcgagtttgtcatcccggattccgctaaaggaaaacctgaacatgtagatgcgggcacattcgttaactataaaggttctgtttacttggagaaaaaagatgaagacggcaatggattagaaggagccgtgtttaaaatcattgacagcgaaggcaaaacggtcaaagacgatttgatctctaaagaaggcggcaaaatcgaggctggcgatttggcgccgggaagctatcaatttgttgaaaaacatgcgcctgacggctacctgctgtcaacagatccgatcccattttccattaccgggaaacacgaaggtgagccgaaacaggttaaactgacggctctcaacaagaaaaacagcgttgtgctcacaaaagtcggccaggatgacaagagcgccggacttcagggagcgcagttcgatttgacagatgaaaccggcaaggtgctgaaaaccggtttggcaacagacgcagacggccggatcacagtgtacggtcttaagcccggtaactaccaatttgtcgaaacaaaagcgcctaagcattatcaattggataagacgccaatatcgttcacagtcaaaaatactgatacaaagcaaatcgaactgactgcagagaaccaattgacacctggcgatgtgaaactgacgaaagtggacagcaacaataaaaaggctgttttaaaaggagccgaattcaaactgctcgatgccgatggaaagccagttaaagccggaggcaacagcaaaaagctgccggcagtctggactacagaccaaaacgggcagttcacagcggagggattggcacctggacgctatcaatttgtcgaaacgaaggctcctgacggttacaagctggatgaaacaccgattccttttgaaattaaaaaaggacagacaaaaccggtcgaggtgatcgcgtccaatgaaaaactgaaaacgccggctgttgataaaggcgcaccggacccgaattcgggagaccctaaaacagataacaaaggcacaccggaccgaaattcgaaaggagatcctaaaacaaatgacaacggtcatttgaaagatacgcttccgaaaaccggtgacacagacagcatcattccgatcatgatcggcatcctgctgattctgtctggaggagccttcgctttcttcacaagaaagaaacaaagaaaggcgtaa

SEQ ID NO: 558 - DNA, 633 bp, Bacillus licheniformis
atgtataaaaaaatgatcgttgccgtgcttgtcatatcaggaatactcttcgtcttgtctcctttcattaaagaaagcatcatcatcaatctcaacaagaataaaaattttgatttgactgctgaacaggcggaacaaaacaatgcacaaaaggcttcatttgattttgaggcgattcagccgccttctattttggaaacaataaaagccagcctcgatcgtgaatcaaaagcggtcatcggccggatcaccataagcagcgtcaatctcaagcttccgatattgaagggcacaaccaatcaaaatcttctttacggagcgacaacaatgcgacccgatcagaaaatgggcgaaggcaactacccgctggcaggccatcatatgaagcgggagagcctcttattcggtccccttctcaacattgaaaaaggagataccgttaaaatcacagactttaaaaaagactatatatacgctgtgacgtcgaaacaattcatttctgaaatggacacagatgtgattcaagagacgaaaaaaaaggaaattacactgattacatgtgacaaagctgtgagaaccgaaggacgccttgctgtcaaaggaaagctgattcatgttgctgtacacagataa

SEQ ID NO: 559 - DNA, 111 bp, Bacillus licheniformis
ttgagtaaaatcgccgccaaccccggtatgaaagaaaaatatccaatccgcatcgtttcattttctttttttgttatttctcattacttttttactcttgtcatttcatag

SEQ ID NO: 560 - DNA, 1422 bp, Bacillus licheniformis
atgaatgaacagggaaatcagaaatcatttttgcgtactattattttagtctcgacgttcggcgggcttctattcgggtatgataccggagtaatcaacggagccttgccttatatgtctgaaggagatcagctgaacctgacagcatttacagaaggattggtcgcgagttcgcttctcctgggagccgcattgggagcggtgttcggcggaaggctatccgattatatcggacgccgcaagaacatcatttttctagctgtacttttctttttctcgacgcttggatgtacgcttgcgcctgatgtgacggttatggttatctcacggttcctgctcggagttgccgtaggaggagcatctgttacagtcccgacttacttggctgaaatgtctccttcagaaaaaaggggacgaatggttacccaaaatgaattaatgattgtctccggacagcttttggcatttaccttcaatgccatcctcggaaccacaatgggcgattcctcacatgtttggcgttacatgctggccattgccgcagtcccggctgtattcttgttctttggtatgctgagaatgcccgaaagtccgcgatggcttgtctctaaagggaaaaatgaagcggcgctgggtgttctgaaaagaatccgcaaggaaaaaagggcgcattcggaagttgctgaaatcgaagctgcagtcatgaaagaatcggaaatgaaaaaagcgaattataaggacctggctgttccttgggtgcgccgaatcgtatttcttggaatcggtatcgctgtcgttcagcagattaccggtgtaaactctattatgtattacggaacagaaattcttaaaaatgccgggtttgaaactaaagctgcactcatcggcaatattgcaaacggtgtcatttcagtattggcgacgttcgtggggatttggcttttaggaaaagtgggacgcagaccgatgctgttgaccggtttaataggaacgacatcagctttgctgcttatcggcatcttctcaaacgtccttcaaggttcagctgctcttccttatgtcgtacttacgctgactgtaaccttccttgcattccaacaaggcgccatttctcctgtaacatggctcatgctttctgaaatattcccgcttcgcgtacgcggcctcgggatgggcgtcaccgtgttttgtttgtggatcgccaatttctttgtcggattctcgtttccgatactgcttgaatcgattgggctgtcctcgacattctacatttttgtcggacttggacttctttccattgcattcgtgaaaaaattccttcctgaaacaaaaggcctcacgcttgaacagcttgagcataatttccgcaactataaatcggaaacagcacaaagcggtgcaagcgctaaaatcagcgggtga

SEQ ID NO: 561 - DNA, 984 bp, Bacillus licheniformis
atggacgaatttgaattaattcaaaggattacgccccgttcgctttctcatcgggaaatagaaatcggtattggagacgatgccgctgtttatcatacgaagaacaattatcaggagatcgttgcagtcgatacgatggtcgacggtattcattttttatcatcccattcatcgcctgccgatatcggatataaagcattggctgtgaatattagcgatattgccgcaatgggaggccgacccaagtactatcttgtgtcaatcgccgttccttccggttggggcgcgacggatattgaagccatgtatgaagaaatgaataaactggcgacactatatgaaatggatttaatcggcggggacaccgtatctgcaaacgggccgctcgttttgaccgtaacagcaatcggcgaaattgaaaagggcagatcttgtttaaggagccatgccgagcccggtgatgtcgtttttgtgacgggagaacttggctcatcagctgccggcctgtcttttatattgggccaaacatcggcgagagacgagacgcagtctcaatactttattgagcggcacaagaggcctgagccgagggtggaagcaggtttgatctgttcacgctatcaccatgtggcgcttaatgatatcagcgacgggcttgccagtgaattaaatgaaattgctgaagcgagccgtgtttccattgacatatataaagagttgattccggtccattcggatttacatatattgcacacaaaatgggaagagtgggtccttttcggcggcgaggattttgaactcgtcggtacgatttctaatgatcaatgggaacgttttagtcaggaatgctccgagcatgatgtgcgggttcatcaaatcggccgcgtcacaaaacaaggacaggcggaagtgttttatcatgacggacaggaccgcgttcttctcgaaaaaaaaggatataaccattttaaacaagacaggtga

SEQ ID NO: 562 - DNA, 477 bp, Bacillus licheniformis
gtgaaaacgttagagtggaaaacgacagagcctgaagagacaaaaaacattgccaggctggcggcaaaatatgttcagcccggtgatgtcatcacattggagggcgatcttggagcaggcaaaacgacttttacgaaagggtttgccgaagggatcggcatcaagcgggttgtcagcagcccgacttttaccatcatcaaagaataccgtgacggctctcttccgctgtttcatatggatgtgtacaggatggaagacgagacggaagatctcggattagatgaatattttgagggagacggcgtctgccttgtggaatgggcgcatttgattgaagagcagcttccaaaagaacgccttgaggtggtcattaagcggcttggtgatgacaagcgaaagctgacctttacacctaaaggcaggcgctacgaaaatctttgcgaggagatcagcaaacatgacgatacttgcgattga

SEQ ID NO: 563 - DNA, 690 bp, Bacillus licheniformis
atgacgatacttgcgattgatacatccaatttaacgctcggagtggcattaatcaaagacggaaaagtgatagccgagcatatatcccacttaaagaaaaaccattcggtcagagccatgccggcaatcgacgaactccttaaagagtgcggtttaaagcctagtgacctgacccaaattgcagttgccaaaggcccgggttcatatacaggcgtgcggatcggcgtgacgattgccaaaacgcttgcatggtcattaaatattccggttaaaaccgtttcaagccttgaagtgcttgcggcaaacggccgttttttccaaggcttgatttgtccgttgtttgatgctaggcgcggtcaggtttatacgggactgtaccagtatagggacggcaaactccatggattggaagaggaccagaacattctgcttgaagattggctaaaaaagctgaaagccatggatcagcaagtccttttcataggaagcgacaccgggattcacagggaaatgatcgaacggattctcgatgaacaagcggttattgcagaccctgccctgcagcttccaagaccttcagaattggctttaatcggagaacttaaagaggacgagccagtgcacagcattgttccaaactatattcgtctggccgaagccgaggccgtctggcttgaaaaacaaaagtaa

SEQ ID NO: 564 - DNA, 459 bp, Bacillus licheniformis
atgaacacgcaaatggtcatacgcgatatgaatccaaaggatttggaccaggtttttgaaattgaaaaaagctctttttcttctccgtggaaaaaagaatcttttcatcatgagctttttcacaatatgtatgctcattatctcgttctcgaagttgaggagcaagtcgtcggctactgcgggatttggatcgtaatggatgacgcccagatcaccaatattgccgtttcacctgcataccggggccgccgcttcggtgaagctcttttgaaggcggccatgaagctttgccggatgaaaagggcggttcagctttctttagaggtgagggtatcgaatcatattgcacagagcttatacaaaaagctcggctttgagccgggaggaattcgcaaaaattattataccgataatggggaagatgcattattaatgtgggtgagactaaatgaatcataa

SEQ ID NO: 565 - DNA, 1026 bp, Bacillus licheniformis
atgaatcataaaaaagatctgtatgtattaggaatcgaaacaagctgtgatgagactgccgctgcgattgtcaaaaacgggacggacatcatctcaaatgtcgtagcgtcgcaaatcgagagtcataaacggtttgggggcgtcgttcccgagatcgcatcaaggcatcacgtggaacagatcacgatcgtgcttgaggaagcctttgcacaagcggacatgacgtttgatgacattgatgccattgcagtaacggaaggaccggggcttgtaggcgctctattgatcggcgtgaatgctgcgaaagcgctcagttttgcccggggcataccgctcgtaggcgtgcatcatattgccggtcacatctatgccaacaggcttgttcaggacattcaatttccggcgattgcccttgtcgtctcaggcggccacaccgaactcgtatatatgaaagagcacggctcatttgaagtaatcggagagacgctcgacgatgctgcaggcgaagcctatgacaaagtggcgagaacgatggggcttccttatccgggtggacctcacattgacaaacttgcgcaaaaaggcgaggcaaatgtgccgctgccgcgcgcatggcttgaagaagggtcttatcatttcagcttcagcggattgaagtctgcagtcatcaacacgcttcacaacgcttcacaaaaaggcgaaacgatagctccggaagatttgtcagccagctttcaggaaagcgtcatagatgtcctcgtgacaaaaacggaacgcgctgcggaagcttatggcgtcaaacaggtgctgcttgccggaggagttgctgcaaacaaagggctgagagccgcgctcgaaaaaacgttcagcagccgtccggagatcgagcttttgatcccgccgctctcgctgtgtacggacaatgccgccatgattgccgccgcaggtacggttgcttttgaaaaaggaatcagaggaaaatatgatatgaatggtcagcctggcttagatctgacgtcttattga

SEQ ID NO: 566 - DNA, 723 bp, Bacillus licheniformis
ttgacgtcgtcaaaacgcgtgcttgacgagctttgggacgattatccggagatgaatgaaaaggatatcaggacctgcctcggcaacttcttgttctcgggagaagatgtattaaagcctgtacatgcattaagcggtggcgaaaaagccaggcttgccctcgccaagctgatgttgcaaaaagcgaacttccttattcttgatgagccgacaaaccatctcgacctggacagcaaggaagtcttggagaacgctttaatcgattacccgggaacgatattatttgtgtcccatgaccgctattttatcaaccggattgcgacaaaagtactggagctttctcgcgacaaagccgaagaatatttaggcgactacgattattacacggaaaaaaaagcgcagcagcttgaactgaaagaactagaaaaacagacggaagagcgtcagaaagccgcttccgaaaaaccgggcgcaaaaaagagctatgaagaagaaaaagagctgaaaagaaaagaacgccagcggcagcgcaggattgaagacatcgaaacaagaattacggccattgaagaacaaattgaaaagaatgaagagctcctatgcaatcccgacgtcttccaagaccacgagaaggttcaggaaatccactctgaaaatgaacagctgaatgaggagcttgaacagctgttatcagaatgggaaacactatctacaaatgaataa

SEQ ID NO: 567 - DNA, 1218 bp, Bacillus licheniformis
atgatgattttacaagtaaatcagctttcaaaatcgtttggagccgatacgattttaacgaatataaaactcgaagtcaggtctcgggaccggattgcggtcgtcggacgcaacggcgccggaaaatcgactcttctaaagattatcgcaggaaagctctcatacgaaaagggggacatcatcaaacctaaagatttgacgatgggctaccttgaccagcattccggcctcgattccaagctgacgcttaaagaggaattgctgtcggtatttgattttcttaaaaaaatggaaaaagaaatgcgcgcgatcgaggaaaagatggcgcaagccggaccggacaagcttgaatcattaatgaagacatatgacaggcttcagcaggagttcaaggacaaaggcggctaccaatatgaggcagaggtcagatccgtcatgcacgggctcggctttgcgggatttgacgactccgtccgcgttcaggatttaagcggaggccaaaaaacaagacttgccctcggaaaaatgcttttgacaaaacccgacctcctcattttggacgaaccgacaaaccacttggatatcgacaccctgacatggctcgaacaatatttgcaaagctacagcggagcgattttaatcgtttcccatgacaggtactttcttgacaaagtggttacccaagtttacgagattaccaggtcccaaagcaaaaaatatatcgggaactacagctcttatctccaattaaaagccgagcagctggaaagggaaacaaagctttacgaaaagcagcaggacgaaatcgccaagctgcaggatttcgtcgatcggaacttggcaagggcttcgacgacgaaacgggcgcagagcagacgaaagcagcttgaacggatggagatcatggacaaaccgcttggagatgaaaagtcggcgtcattccgctttgaaattacaaggcaaagcggaaacgatgtactgcgagtggaagacctgacggtaagctatcaggaccagcccccgcttctccgttcactggattttcgcattacccgcggggaaagcgttgcactagtcgggccgaacggaatcggcaagtcgacccttttgaaagcattgatccaaccagctgcagcagctgttgtgagcaacagtcgacggggtgctctcgtcgtctcatatcgatcggatactacgaccaggaacaggctgaattga

SEQ ID NO: 568 - DNA, 507 bp, Bacillus licheniformis
atgaatgagtttacacattttaatgaacaaggcagagccaagatggttgatataagcgaaaaggaagcttcagtgcgcacagctgcggctgtttcaagcgtgtccatgaatcgagaagtacatgaaaaaatcaaaaaccgcgaaatcggaaaaggcgatgtgttggcggtggcgcaagtggccggaatcatggctgcaaaacagacatccgccatcatcccgatgtgtcatccgatcgctctgaaaggagtcgacatcgccttttgctgggagaagaaagagcagaagagcatcctgcatatacaatctaacgtcaagaccaaagggagcacaggtgtggaaatggaagcgttaacgtcggcctccgtatgtgcgctgaccgtttatgacatgtgcaaagcggcggataagggaatggtgataggaccgacctttcttctcgaaaagacaggcgggaaaaacggtgactataaaagggaaaaagctgatgtagacatggaggattag

SEQ ID NO: 569 - DNA, 648 bp, Bacillus licheniformis
atgaacatggatcattcaaaaattccgcaagcgacagcgaaacggctgccattatattatcgttttttaaaaaaccttcatgcatccgggaaacagcgtgtatcttccgctgagctgagcgatgccgtcaaagtcgattccgcgaccatccgaagggatttctcgtacttcggcgcgctcgggaaaaaaggatacggctacaatgtcaattatttgctgtcctttttcagaaagacgcttgatcaggatgaaacgacgaacgtaacgcttattggcgtggggaatttggggacagcctttctccattacaattttatcaaaaacaataatacaaaaatcgccatggcgtttgacatcaatgaagaaaaaatcggaaccgaggtcggcggcgttcccgtctatgacctgaataagcttgaagagcatatgacggatgatgatatcccggtcgccattttgacggttccagctcaagccgcacagtcgattacagacaggctggtggcgcttggcattaaaggcattcttaatttcacgccggctcgcttgaatgtgccggaacacattcgcattcatcatatagatttggcagtggaacttcagtcgctggtgtattttctgaaacattattcaatgcaggaaaagtaa

SEQ ID NO: 570 - DNA, 180 bp, Bacillus licheniformis
atgccaacaatcggtcctggaagctttattttaattgtcgtggtggcgcttttgatattcggcccgaaaaaacttcccgagctgggaagagcggcgggaaacacgctgcgggagtttaaaaatgcgacaaaaggtttggctgacgacgattccgataataaaaagaaagaagatcagtag

SEQ ID NO: 571 - DNA, 663 bp, Bacillus licheniformis
ttggcgaagccgctcataatctacctgcagcagacggatgaagcgaagctgctgactctcaatgcgttcaagctgaccgatcctttatttgtgtacgtgcagttcgcgttcatcatcggcgctgtcttgacttcgccgcttgttctataccagctgtgggctttcatcagcccggggctgtatgaaaaagaacgaaaagtgacgctcagctatattccaatatcgatcattctttttttaggcggcattgccttttcttactttattttatttccgtttgtcgtggactttatgacgagagtctcagatgatctgaatgtcaaccaggtcatcggaatacacgaatattttcagtttctgcttcagttgacgcttccttttggcttgttgtttcagatgcctgtggtcatcatgtttatcacaaggctcggtctcgtgacgccgatgtttttggcgaaaatccgaaaatatgcatattttgtgttgttcgtcattgcggcgctcattacaccgcctgagttattgtcgcatttaatggtctccgtgccattgctcattctttatgaaatcagtatcgtgatttcaagaatatcctacaggcaggcgcaaaaaacaatgattcaagaggaaaatcaatcgtttttgaacgaccatacaaaataa

SEQ ID NO: 572 - DNA, 192 bp, Bacillus licheniformis
atgagaagccctaaattctggggagtgatttatttattaacgggtgtgctgtttacgtatctcgcggcaacctcgcccggaagcatgtggtctttttatacgatcctgctgatgcttttcgcagcctataatatcagcatctcctttaaaatgttcgccctggccggcaggatgaagcgaaaagatcaatag

SEQ ID NO: 573 - DNA, 636 bp, Bacillus licheniformis
ttgagaaaacaatactggtttattatattggcatacgttctcatgcaattgtcggcggttgtcggcttgcctcttctctactttttgggagtgggcagaggacagcccaaggctgaagctcagcttacattgacgggcgtctggtctgtcatcgcgtttaccctctgtctcgtcatcgtgctgctgattttgcggacggtgccgaagacgacgcttcggaatcgtccaaaagcatcggttgcagcgtcaatcggatgggcggtagccggcgtttttctcgctttgtttgcgcagtcaattgccgcttcgatcgaaatgaacttgttcggggtcaacccggaatccgaaaatatgcagcggattatgaaaatcatcaccgcattgccgctgatggtgtttgtctcttctgtattcggtccgattcttgaagaaatcattttcagaaagatcattttcggtgcgatctatgagaaaacgaattttttcgttgccgctctgttcagttcggtgctcttctcggtcgtccatttggatttcagccatctgctcatttatacggcaatgggattcacattcgccttttttatgtcaggaccaaccggattatcgtcccgattttcgcccatgtcgccatga

SEQ ID NO: 574 - DNA, 285 bp, Bacillus licheniformis
ttgttaaagccattaggtgatcgcgttgtcattgagctcgttgagtctgaagaaaaaactgctagcggaatcgtacttcctgactccgcaaaagaaaaaccacaagagggtaaagtggttgcagccggttcaggccgtgtgttagagagcggagagcgcgttgcattagaagttaaaacaggcgaccgcatcatcttctcaaaatatgcaggtaccgaagtgaaatatgaaggtactgactacttaatcttgcgtgaaagcgacattttagctgttatcggctaa

SEQ ID NO: 575 - DNA, 1635 bp, Bacillus licheniformis
atggcaaaagatattaagtttagcgaagaagcccgccgttcaatgctgcgcggtgtagatgcattggcggatgctgtaaaggtaactttgggacctaaaggacgcaacgtcgttcttgagaaaaaattcggttctccattaatcacaaacgacggtgtaaccatcgcgaaagaaatcgagcttgaagacgcgttcgaaaacatgggcgcaaagcttgttgctgaagttgcgagcaaaacaaacgatgttgccggtgacggtacaacaacagcgacagttctagctcaggcgatgattcgcgaaggtcttaaaaacgtaactgccggcgctaaccctgtaggcgtgcgcaaaggtatcgagcaggctgtggctgtagctgttgaaagcctgaaagaaatctctaaaccaattgaaggcaaagaatcaatcgcacaagttgcttcaatctccgctgcagacgaagaagtcggaagcctgatcgctgaagcaatggagcgcgtcggcaacgacggtgttatcacgatcgaagaatccaaaggattcacaacagagcttgaagtggttgaaggtatgcagttcgaccgcggatatgcgtctccttacatggtgacggattccgataagatggaagcggttcttgagaatccgtacatcttagtaacagacaaaaaaatcacaaacattcaagaaatcctgccggtgcttgagcaagtcgtgcaacaaggcaaaccgttgcttctgattgctgaagacgttgaaggtgaagctcttgcaacattggttgtcaacaagcttcgcggaacattcaacgcagtggctgttaaagcgcctggattcggcgaccgccgcaaagcgatgctcgaagacatctctatcctgacaggcgccgaagtgatcacagaagatttaggtcttgaccttaaatcaactcaaatcaatcaattgggacgcgcttctaaagttgttgttacaaaagaaaacacaacaattgttgaaggtgcgggagatacagagcaaatcgcggcacgcgtcaaccaaatccgcgctcaagttgaagaaacaacttctgagttcgataaagaaaaattacaagaacgccttgctaagcttgcaggcggcgtagctgtcatcaaagtcggagctgcgactgaaacagaattgaaagaacgcaagcttcgcatcgaagacgccctgaactctactcgcgctgcggtagaagaaggaatcgtatccggcggtggtacagctcttgtcaatgtttacaataaagtagctgcccttgaagctgaaggcgacgaactgactggtatcaacatcgttcttcgcgctcttgaagaaccaatccgtcaaatcgcgcacaacgcgggtcttgaaggatctgtcatcgttgagcgcctgaaaaatgaagaaatcggcgtcggctacaacgctgcaacaggcgaatgggtgaacatgatcgacaaaggtatcgttgaccctacaaaagtaacacgctcagctctgcaaaacgcagcatctgtagcggctatgttcctgacaactgaagcagttgttgccgacaaaccggaagaaaacaaaggcggcgcaggaatgcctgacatgggcggcatgggcggcatgggcggcatgatgtaa

SEQ ID NO: 576 - DNA, 234 bp, Bacillus licheniformis
atgaaacaagaaccatttaaagcaggcggtggagcaacctctggtcttgctttaatatcaagggttatacccgtacctcctacacaattagcaagcgtaatttccggagtaatcggaggcggactagttggttttggtcaaatgattcaagacgaacatgaaggtcatggtgttagaatacgttttactggactcggatatgcagctgttccaactggggtttttccacaataa

SEQ ID NO: 577 - DNA, 348 bp, Bacillus licheniformis
gtgagtatgaatgatgtaaagaaattagaagcttatcttaaattaaacgcagatggaactcttaccttagatccatcttatactaaactagatatttcacgttctgtcaccaacgaagttcaagactggattaaatacttgaacgatttagtgaaacaaaaagaagctgtcattaactccgattttagtgtgaaaattttagacaaagacggtagtgtattgacactggagaatggaaacaatcataaaatgaaagtagcgaaaaaaggctgcggtcgatctggtcatgatctctactggtggggatataatctttattttgactgtaatgaaacaagaaccatttaa

SEQ ID NO: 578 - DNA, 315 bp, Bacillus licheniformis
atgatgctgtcggaacacctcagcctgctccgcgaattagaaagcaatcggaacaaggttaaaaggccggttcttgacatggttcaaatagaagacatggataagataatatgtgaagcaatggaatttaatttaacagttctgttctctgtatttaaaccgctgccctttttaaatagagcagaatcaggagagactattaacatagaaggaaaaattcattacataaatcatatccgtaaggtttttcatattgtggaaggagacaccaatttcattaaatttgaggatgctgtttttagagaaataaagtaa

SEQ ID NO: 579 - DNA, 111 bp, Bacillus licheniformis
ttgaccatctttttaaaatcccccatttttcacaaagaatcaaatttaggtcttgcggttttaatgccatttgctgacgcactggccgttgaaagagattacgggcaatag

SEQ ID NO: 580 - DNA, 210 bp, Bacillus licheniformis
atggtcaaaaaaattgtaaatggattcaattcattttcactactggggacaatcttttttatcggcagttattttacgtacaaatttaatggcgtggagctggtcgggttcctgtacttaggtattatttttttgacagctctgatcgcaaccaccgtaatgttaatcaggctaaaaagaaaaggaatcaataaagataaacaggcttaa

SEQ ID NO: 581 - DNA, 918 bp, Bacillus licheniformis
atgttgaaaatttggatgactggacttttactattagcgcagcccgcggggcattctgacagcttaacgatcactcagcaagggaagaaagtggccgttgtgaaccgcgaagattttacaatgccgcttcccggaacaccgatgattgatgataaaaaatacaacgaattcgttgacaggcttgaacggaaagtacacaaggatcctgtcaacgccgtgatcaacgatcagggaaggatcgttcccggcaaggttggctacagcctttcccggaaggggtttaaggagcagttttacgcgtatttttatggggatggcccgtccacaatagaagtgcctgaattgaatgtttacccgaaagttgacagcgaactgctttcccatatccggacacagcggatcggccagtatgtgacgtactttaattccgggaataaaagcaggacgcacaatatttctctcgcggcaaaggcaatcgacaatcatgttgtttttcctaatgagacgttttcatttaacaaagttgtcggaatgaggacgccggacaagggatatatgaaggctcccgtgattgtgagaggcgaattgtctgaaggagtgggcggaggcatttgccaggtttcgtcgacattgtttaatgctgttgaccgggcaggactcgaaatcgtccagcgctattcccacagccggcgtgtcccttatgttccgccggggcgcgacgcgacggtcagctggggcggacctgatttgcgctttcaaaacaaatataaccagccggtcttgatccgggcgaaacggcacgggggaacgatggttgtgacgctttattcttctgatgtggtcaatcatcagctgcgaaaagtcccgaaggctccggcccaaattccaaaagaagagcatcaaagcggggatcactaa

SEQ ID NO: 582 - DNA, 450 bp, Bacillus licheniformis
gtgacatggctttttgtaacctttttggtgatcttcagtctttttaaaatattggtcacttgccttccgagcggtgtcgtagagtggctgaccggcaaatttcaagttcatgtgaagcttgaggaatcgaatgttcaagtgacattcggcggaaaacgtttagagggatctgacaagagtcgatttattcaaaactttaatgaagcggtatttatggagcggtactacatatacccgggagatgagccgctgtatgtcaatccgaaaaacgccgggacaccgtttgtgatcgaaacaactaaaggaaaaaacgctgtgaagctgtttgtatacagatacgatgatcatatagacgtcgttaaacaatataagaaaaagacggccgcttattgtctgcgttctgacagtctgcaaacatgcggggggatgaaaacggcggatttgatttaa

SEQ ID NO: 583 - DNA, 462 bp, Bacillus licheniformis
atgaccatacatattcaacagcttgaagcccctctgaatcgtgagtttgttgatgaactgatcaatttgtggaatgataatacgttggaaacggctgattgtgcattagatgatcaagatagagaaatgatacaccagcagctggaacaatatgttcaatccgcatacggagcggtttttgccgtcgtgaatgagaagcaagaagcggtcggatacgggctggcctctattaagaaagatttggtcagcgattgtctgagcgggcaaatcgatgaagtgtacatagccccggactatcgaagaaataagctggggaagcttgttgcagaccgtatgatggattggtttgaacaacatcaagtctctcacgttcaagtatcggtcgatatcgataatcaatcggcgctgcatttttgggaaggcatcggcttcagcagtgatttttatcttctgacaaattag

SEQ ID NO: 584 - DNA, 675 bp, Bacillus licheniformis
atgtgcggcaggtttacgctgttttctgaatttgatgagattattgaccgtttcgagattgatcaaatggcgattgaagattacagccccagttataacatcgcgccttcccagtatattctcgccgtcatcaacgacggttcgcataaccggctagggcggctgcggtggggattgattccgccgtggtcaaaggatgagaaaatcggttataaaatgatcaatgcgcgcgctgagactttggcggagaagccgagctttcgaaagccgctgatcagacaaaggtgcctcattccggcagacagtttttatgagtggaagcggaccgatgcaaagacaaagcggccgatgaggatcaagctcaaaacaaatcgactgttttcatttgctgggctttgggagaagtggcagcctgcaggcggcaagcccgtctatacatgcacaatcattacgacaacgcccaacgatttaatgaaagacattcatgaccgcatgcccgtcattcttgatcgccaggctgaaaaagaatggctgaatccgaagaatcaaaaccttgcatacttagaaagccttttaaaaccatatgcgtcaaaagagatggaagcgtatgaagtcgcgcctctcgtcaattcaccgcatcataattctcctgagctcatcaaaaaagccccttaa

SEQ ID NO: 585 - DNA, 615 bp, Bacillus licheniformis
atgcctttacagctttatgaaaaagagcaaatactcgatgcctgtttggaggtttttgcccggcatggctatgcaaagacttcgaccggaatgctggcggaagcggccggcatttcaaaggcgctgatttttcatcattttaaaagcaaaaaagatctgtacttaactgtgctcgattattgtattgagaaggtaaagtcgcgcctttcccttgatgacctggcgtcttatgatgatttctttgaagcgaaagaaaaaataagcatggctaagcttgagtttttcgcggattattcaaatgtatacaagctcacgaaagatgccttttattcaccgccttccgaattaaaaaaagaaatcgctgcaaagtatggggagcaatttgccgttagaaatcgtattctaaaacagctttttgcgaaagttccgttgagggaaggagtggatcgtgaagaggcgttcgaacttatcatggtcatgatggggcattttgaacaaaagtttctagcggaagtaacggctgaggacgattttgatccagcctggagcagacgtcttcttgaagaacgaaaacggtttttggatatgattcgtttcggcattgaaggcgaataa

SEQ ID NO: 586 - DNA, 2622 bp, Bacillus licheniformis
atgggacactatgtattgggctttcatgagatcgatcgaaccgatttgccgcttatcggaggaaaagggctgaacttgggcgaattgtcaaaaatggacggcatccaagtgcctcccggtttttgtataacaacaaaagcatatgaaaagatgatcggtgaaaacgataaggtcagtgaacagattgatcagctgtctcttttaaaagtgaaggacagaaaacagattaacgatcttgcccttcagatccgcaatggtattgaaagggccgaaatcgccgaagagatcaaagaagcggttaaaagcgctcactcaaatgctggcggcgatgcatatgcggtccgatcaagcgctacggcagaagatttgcctcatgcctctttcgccgggcagcaagatacgtatttaaatataaaaggaatagaggcgatcttgaagcatatcagcaaatgctgggcttcactgtttacagagcgggccgtgatctaccggattcaaaacggttttgaccaccgcaaagttcaattatcggtcgtcgtccagcagatggtgttcccggatgcgtccggcattttgtttacggcagatcctattacatccaaccggaaggtcacctcgattgatgcaagctttgctttgggagaggcgcttgtatctggtacagtttcagcagacaactacaaggttcgtgaaggcgcgatcattcaaaaaacgatttccgagaaaaagacggcagtctattctttggaaagcggcggcactgaggcgcgcgaagtcgaagcgggctgccggaaagagcaaacattaacagatgaacagatcatccggcttgaaaaactgggaaggagaatcgaagcccatttcggttttccgcaggatattgaatggtgtctggctgatggcgaatttttctttgtccagagccggcctataacgacattgtttcctcttccgaaacagagcgatgacaagcttcgcgtctatatgtctgtcgggcatcagcaaatgatgacagaaccgatcaatccgcttggaatatcgtttttcgggttgatctcggattatgagctgacttgtgccggcggaaggctttttattgatttatcacacgatttggcatcttttgcagggcggaaagtcgtcctcagtacggcggggaaaaatgatcctttcatgcatagcgctcttgtgaattttttgaaaagaaaggagcttgtcaaaaccctgccgaaagggaagcggatgtttagattaggggctgaagggctgtcatggtcgctgccgggtgatgcgctgaagatttaccggaaaaacgacacagatgtagtcaaacggctcatgtcgaaagcggaagcatccattcaagaggctgaacagcgattgaaaaacgcatcgggtgaaacgttatttgcacagatagaagaggatcaaaaaagcttgaaaaaagttctctatgattcagagagcatggctgtaattatggttggtttatatgccgtttactggctcaatcgaaaaatggagaaatggcttggcgaaaaaaatgtcgccgataccctttctcaatcggtattgtacaatgtcacatctgaaatgggattggcgcttttggatgtatcagatgctgccagaggataccccgaggttcagaagtatttagcatatgccaataatgaaaccttttttgaagatctcaaacagcttgacggcggtcccgcctttatcggcgcattgcgggcattccttgagaagtacggcatgcgctgcaccggtgagatcgatataaccaagacccgctggagcgaacgtccttccattcttgctccaatcattttgagcaacatcaagaattttgagcccggcgcgcgaacggctaagtttgaacaggggcgattggaagcggagaaaaaggagagggatttgttaagccgtctgcaacaactaaagggaggcagacaaaaggcaaaaaggacaaagaagatgatcagcgtgctgcggaattttatcggctatcgggaatatcccaaatacgctctgatcaaacgctatttcatatataaggaagcgttgatgaaagaagccgctgttttacagcaaaagaagctgatacaagcgaaggaggatatttattatttgtcctttgatgaattgaaagaagccgtgtgcacaaaccgtctcgatgtgaagaagatcgaggaaagaaaagcggaatatcggcattatgaaaaattgacgcctccgcgaatcatgacttcagaaggcgaggtcatcaccggagaagccttgggggatcacattccggcaggagcgttggcgggcgttcctgtttcatcggggatcatcgaaggaagggcaagagtgattctgaaattggaggaagccgatatcgaagagggggatatccttgtcacgccttttacagatccgagctggacaccgttatttgtctcaatcaaaggtttggtgactgaagtgggcggcctcatgacacacggcgctgttattgcgcgggaatacgggcttccggcggtggtgggggttgagcatgcgacgaaagaaattaaagacggacagaagatcaggattaacggatcggaaggatatgttgaaatactcgaatga

SEQ ID NO: 587 - DNA, 285 bp, Bacillus licheniformis
gtggagatgaacctgttttggatcggacttggtttagcggctttaggctattttatcggtgacggcttgaaaaactttaaaaacccaaagggaatttattcaggctatccctatttaatcaaagaagacgatttacattattatttaggcttgagcaaagtagaaacgaaagaaatgctgcgtaaatatcctgacatacctaaaattgaattaaatggcacgacctattatccgtatcagcaattgatggattggatgttgtccgccgacctttataaaaattaa

SEQ ID NO: 588 - DNA, 363 bp, Bacillus licheniformis
atgccgtttattctccagcgcatttatcaagaaaaccagcaaacagaaggacgccgcattttaatcgatcgtgtgtggccgcgcggcatatcaaaagaaaaagcgaaccccgactgctggatgaaagaaatcgctccaagccccgaattaagaaaatggttcggtcatgatccgaaaaaattcgaatcgtttaaagaagcctatcaaaacgaaattaaacaaaacgctgaaaaacagaaaagcttcagggaattaaaaaaaatggcggcggacgaaaccgttattctgctttacggggccaaagatgagcgccataaccatgccgtcgttctttatgagatgctgaaccggcaaagcctttga

SEQ ID NO: 589 - DNA, 765 bp, Bacillus licheniformis
atggaactgtcgggaaacacagtgctgatcacaggcggcgcatcgggaatcggctttgcttttgccgaacgatttataaaagcgggaaataccgttatcgtctgcgggagaagggaaagcaagcttaaagaagcaaaggaaaaacatccggagctgatcacgtgtgtatgcgatgtggccgttgaaacggaacgactggcattatttgaatggatcaaagaacatcatccgggagtaaacgtacttgtgaataatgcgggcatacagcagcgctaccacattttaaaagccgatgttatagacaattgggctgactacaataaagaaatcaccgtcaatatggaggcgcctatccatctggccatgctctttagccgatactttgccgaaaaagccgggaaaactgcgatcatcaatgtgtcatcagggctggcgtttacaccgatggcggtcgcaccaatctactcatcgacaaaagccgctctccactcctttacgatgagtttaagacaccagctttccgaggccggcgttgaggtcatagaagtcgctcctcctgcggtcaatacggatctgggcggtgtcggactgcatgattccggagctcctttggatgaatttgccgatgcgatctttaaagggctggaagaaggccggttggaaatcggctatgccgtatcggaaaaagccttgcggatgtcaagagatgaaatcgatgaaagcgtcagccaattgtacagttctttaaaacattccatcgaataa

SEQ ID NO: 590 - DNA, 1473 bp, Bacillus licheniformis
atgtatgatacaactgtcgaaacacgcttcggaaagctgaaaggcagagcggaaaacggagtccgtatctttaaaggcgttccatacgcaaaacctcccgtcggcgacctaaggtttcgggaaccgcagcgaatggaggcctgggaaggtgagctggatgcttttcaatttggcccggtttgtccgcagcctgatggggtattgcctgagtcagcgggggttcaaaagtctgaggattgcctttatttaaatgtgtacgcacccgaagaggcggacggggatctgcctgttatggtgtggattcatgggggcgctttttatcgcggcgccggaagtgaaccgctctatgacgggactcagcttgcaaagcagggaaaggtgatcgtggtcaccatcaattatcgcctcggtccgttcggttttttgcatctatcctcaattgatgattcctacagcagcaatcttggcctgctggatcaaatcgcggctctcgagtgggtgaaagacaatatcgctttctttggcggagaccgtcatcacattacggtttttggagagtcggcgggatcgatgagcatcgcttcgcttttggcgatgccgaaagcaaaggggctttttcaacaggccattatggaaagcggggcttccgcaactatgtccgataagcttgcgaaagctgcagcagaaagattcttaaggattctcgatattgatcatcatcatctggagcgccttcatgatgtatctgatcaagaacttcttgaagccgccgatcagctgcgcactttaatgggagaaaatatttttgaattgatttttctgcctgcgcttgacgaaaaaaccttgccgctgaagccggaggtcgccgtcgcaaaaggcgcggcaaaagagatcaatctattaatcggaacaaaccgtgatgaaggcgtcttgttttttccctctgattcggatcttttgcctgagagcaagatcaacgagattttagaagaatacatgggtaaagaggccgccgaagccgcctcctctctgtatccgaggtcattggaaggccatgttgatatgatgacagatctgatcttttggcatccgtctgttgtgttcgcttcggctcaatcacgatatgcatctgtctttatgtaccggtttgactggcatgcggattcagagcagccgccgttcaacaaagctgcgcacggcttagagattccgtttgtatttggaaatatggacattttggaacagctgacaggtacgaaggccggtgaagaagcgcagctgcttgctgaacagatccaggctgcctgggtgtcttttgcccgatccggaaatccgagcaccgatgatgtcagctggcctgattatgatgaagattcacggaaaacgctgatttttgatcaagaggtcgcagttgaaagcgatccttattcagataagagaaagatgttgacagccccgaacccgcagatttag

SEQ ID NO: 591 - DNA, 1278 bp, Bacillus licheniformis
atgccagggagaaaaaaaggcagtttgaagtcgacgattacggtcgccatgtccaactatttggaggcgggatccatcgtcgcgggggccggcgggctttcgttatgggttgaatatttaggattggacgacgcccgggtcggacttctcggcgccttaagcgcaaatggtttcggcgcggcgatcggcgcttttctcggcggttttttagtcgaccgttacgggagaaaattcatatataaatacgatctattagtctatatgcttggcgttttactgatcgccgcgtcgtttaattttcccatgcttttaaccggatacatcgtgacgggaattgcggtgggcgcagcaattccggctgcttggacttacattgccgaggaggcccctgaccatgaacgggccggacgcgtcggctgggggcagctggcatggtcggtcggaccggcgcttacgctgctgttatcagttgccttggcgccgctcggtttaatgggaagccggttgatttttgcccaattattcgtcgtcgcagtcatcacctggattttgcagcagcagattcacgaatcgtccatctgggaggagcaaaagcgaaaagaagccgaagacaaagcaaaaggagttgaagaaaaggcgtcgatcaaagagctgttgaccaacaaagcgaaccttcgcgcgatgattctcctcatcggaatttatgcgttttggaaccttgttgccgggacgatgggatatttcatgccgtatatctatgagacggtcggcggcctaacagcggcacaagccaacctgctgcaggcatttttatggattttgactgtggcgtccacatacttcgtctttatccgtctcggcgataaagtcaatcggaagttgctttttggcataggagcagctatggcaaccgccgcatgggtcatcctcaccttcggcacgatgaacatcacggagcttttattattcgtatgcctgtggggcatttctgcgggttttggagcgcaggcgttttacggactgtgggcggcagagctgtttcatacgaaatacagggcgctcgctcaaggcttcatgttcttcatcgtccgcatcggcgtcggactcatctcattggtcgttccggcgatgattacgggcttgggcttcaaaacagccggcgccgtcatgattgcatttctcgtcattcatatgatcatcgggctccgtatggcgccggaaacgcgcggcaaatcgcttgaagccattcaaagcgaacgctatcatcaaagcggctga

SEQ ID NO: 592 - DNA, 681 bp, Bacillus licheniformis
atgagtatattaagcaggttcaaagacattatggccagcaatattaacgctttgctggataaagcggagaacacggaaaaaatggtggatcagtatgtcaggaacttaaacagcgacttaaacaaagtaaaggcggaaacggcgtccgtcatggcggccgagcaaagggcaaaaagagaactggcggattgccgggcggaaatcgacaagcttgagcgctatgcaatgaaggctttggaagccggcagcgaggcggatgcccgaacatttttagaaaagaaagcggtgcttgaaacgaaggcatccgagttagaaactgcgtttcaaacggcgtcatccaatgcgaatcaaatgaaaaaaatgcacgataagctcgtttccgatatcggggagcttgaagcacgccgcgccgcgatcaaagcgaaatggacagcggcgaaaacacaggaaagaatgaataaactcggtgcatctgcagcgaatgccaaccattcaatgtccgctttcggcagaatggaagaaaaggcaaaccgggcgcttgatgaagcgaatgcgatggctgaattgaacgccgctcctcaagatgacatagaagacctgaaggctaaatatgacagcccttctaatgtggatgatgcgcttgccgcattgaaagcgaaaatggcgggtcaaaagtcatag

SEQ ID NO: 593 - DNA, 1026 bp, Bacillus licheniformis
atggtaatttcttataaatgtccgggctgcggggatgacatggcctttgacgctgaatcgggcacgctcgcctgccgcagctgcgggagacaggacaagattgaaaacattccggaagaattgaaaactgcgagatttactgaagatgaagcaacagaatatcattgccaaaactgcggcgctattttgatcactgagaaagaaacgacggctacatcctgcagcttttgcggaggagcggcagtgatcgccgaccgcctgtccggaagccttgctccggcaaaggtcattccttttacgatcagcaaagaggaggcggcggacgcgtttcgcaagtggtgcagaaaagggctgctcacaccaaagggctttatgtcggctgaccggattaaaagcattacaggcatgtacgtccctttctggatgtacgatttaaacagcaaagtgcaggtcagcgcccgctgcacaaaggtacataggtatatacagggcgactatatctacacggagaccgaacattatgatgcgtttcgcgatatcaatctcgactacatcaaagtcccggtggatgcctcagaaaagatgaacgatcaattgatggacaaattggagccatatccatatgatcagctgaaagattttaaaacggcctatttggcaggctacatcgctgaaaaatataattacgatgatgaagagctttttccgcgggcgaaaagcaaaatcagcggctacatcgagtcatatatcgattccaccctgtccgggtacagctcagtcgatgtgaaaacgaaacacgtcgatacacaaaaagtgaaaagcttgtatgtgcttttgcccgtctggatggtcaattacaactacaaacaaaaggattacatctttgccatgaacggacaaacgggaaaagtcgtcggcaagccgccgatcagctcatttaaagaaaaaatgtggttcagcgggctggccgtctccatatttgcactctggaaaatcattgctgctgtaatgggaggcggggcgtga

SEQ ID NO: 594 - DNA, 768 bp, Bacillus licheniformis
atgagaagtttattgagaagcgcgatgatcttatgtatgattttccttgtcttcatccctatagcctccggtgcggcagcctctgaacagaagcggtttgtttatgatgaagccgggcttctgaccaaacaggaaatcgagaagctggaaacgctggcagccaaattgggcgccgaacgggagaccgactttatcattgtgacgaccaatgatacaaacggccgcgatgtaaagaaatatgcggaggacttctatgacgaaaaagcgcccggctaccagaagaagcacggaaatgcagccgtattaacggtagatatggagcatagagaagtctatcttgccggctttaaaaaggctgaagaatatttgaatgacgccaggctggacaaaattagagaaaaaatcacgccggatatatccgacaagcattatgaggccgcattcgaaatgtttatgaaggcggcgcatgatgatatggagaagaaaccgtgggcggacagcatcttttttaagacgtggtttcaattgcttgtttcggcagtcatcgcgggaattgccgtcgccattatgaaatacaattcaggcggcaaagtgacagtaagtgcaagcacttatatgaacggtgatacgtccggagtgatcagaaataatgacgaatacatcagaacgaccgtcacaaaacagagaaaaccgtccaataataaaagctcaggcggcggaacgacgagcggaggccattcgcacagcggcagccggggaagcttttag

SEQ ID NO: 595 - DNA, 975 bp, Bacillus licheniformis
atggtgttttttagaaatcaatttgcaaatgtagtagagtgggatgaatttcgcgatgatatgattttctataaatggaacaaccgcgaaatcaaaaaggggagccggctgatcattcgccccggtcaggatgccgtctttttaaacaacggaaaaattgaaggcattttccaggatgagggcgactatgatattgaatccgaaattattccttttttatccactttaaaaggttttaaatttggctttaacagcgggatgcgcgccgaagtcctgtttgtcaacacgaaggaatttaccgtcaagtgggggacgaagaatgccatcaatatcccggctgcaggacttccgggcggcatgccgatcagggcgaacggaagatttaactttaaggtgaatgattatgtcgcattaatcgataaaattgccggtgtgaaagatcagtatgttgtggaagatatcaaaatacggatcacatccattctcgatcagcttctgatgaagtggatcacaaaagaaggaaaagatatgttcaaccttcaagccaacgcctttgatatcgcaaagggaatcaaggaagatcttgatatggagattgtcggcgacggcatgacgataacaggctttaacatcatgagtttcaattatccgaaagaagtccaggacatgatcacgaaaaacgcttcccacggcatggtcggcgatctgaacagatatcagcagatttcaatgacagacggcatggcttcaggaaagatgacaggcggcggtgccgcatctgacatggccggcatgatgatggggatgaacgtggcgaaccaaatgatgaatcagatgaaccaaaatcagcaggcgcaaacacagacgccaccaagcgcgccgcagccagcggcaaaaccgaacttctgtccaaactgcggaacgaaaacgggcgaagccaatttctgtccgaactgcggtcagaagctagtgtaa

SEQ ID NO: 596 - DNA, 1056 bp, Bacillus licheniformis
atggaattaggcatcagcacctttgtagaaacgacccctgatatcaaaaccggaaaagtcatcagccatgcggagcggctgcgcgaagtagtggaggagatcgtccttgccgatcaggtgggcttggatgtattcggagttggagagcatcatcgtcaagattacgcagcttcttctcctgccgtcgtcctggccgcagcagcttcacagacgaagcgcatcagattaacgagcgcggtcaccgtgctgtcgtcggctgatcccgtccgtgtttttcaggattttgcgacgctcgacgggatttcaaacggcagggcggaaatcatggcgggcagggggtctttcatcgaatcctttccgctgtttggatatgatttagacgattatgatgagctctttgaagaaaagcttgatttgctgctcgaactgcaaaagtcggaaagggtcacatggagcggcaagcatcgcccggctattcacaatacaggcgtttacccgcgtcccgtgcagaagccgctgcctgtatggatcggaagcggcggaaaccaggaatccgtcgttcgcgccggcctgctcggcctgccgctggttctcgcgatcatcggcgggagtccgcagcactttgccccgcttgttgagctttattacaaagcagcggaacatgcagggcatgacgcctcaaagctgattgtcgcttcccattcccacggctttatcgcggaggataccgagacggccgccgatcgttttttcccttccacccagcaggccatgaatacgctcgcaagagagcggggctgggggccgtacagccggtcgagcttcgatgcagccagaagctttgaaggggcgctctatgtaggcgatcctgagacggtggcggaaaaaattattcatctgcgcaagaatgtcgggatcacccgatttttgcttcacgttccggtcggttcgatgccgcacgaagatgtcatgaaggcgattgaactttttggaacaaaaacggcgccgctcgtcagggaagaagtatcccgctgggaggcatccgaaaggtcataa

SEQ ID NO: 597 - DNA, 828 bp, Bacillus licheniformis
atgaaggaaaacatattagacgtactgaaaaacctgaatttcaccgagtatgaatcgaaagcatacttggcgctcttggaagaatcgccgctgacaggctatgcggtggcaaaaaaatcgggtgttccccggtcgaaaatatacgaagtgctggagagccttgtaatccgcggcgatatatttgtcagctacggcaacacaccgcagtacattcccgttcccgccaaggacctgattaaaaaccggcggatgaaagcggaagagacttttgaacaggcagaaaaatatttcgagaagtttgagcgcactgcaaatgaccgggaaaatatttggaacatcaccgggcgaagcgagattctcgataaagtaaaggcgtgcatatcatcggccggaaaaaggattctcctggaaatttggaaagaggattttcctgaattggagcctgagctcaagcgggccgcaaaaaaaggcgtcattgtgaccattattgcatacggcgacattgaagcggatttcgccaatgtctatctacatgacaacagcaggcaaattacagaagagtatgacggacgctggctcgtattcagcgtcgacgattcagaagttgtggccggcattgtctcgcatgggaaagacagccgcgcagcctggacgatgcatgtaggcttggtgatgccgattaccgaagtgatgattcatgatttgtacctgatggaaatcatggagaagcacagagaggtattggaggaaagtttcggcgaaaacctgatccatttgcgccgcaaattttcgatacatccggattttaaaaagcattatatgaaataa

SEQ ID NO: 598 - DNA, 504 bp, Bacillus licheniformis
ttggcgacggggctttctttctggacgctgattgccgttctcggcttagcggtggtgattgcgaaatcggtgattctgttcaatacgatcaaatacttgggggcggcctatttaatatatttaggcattaaaagctttttcgcgaaaaaaatgttttctttggaagagatacaagccgagaagaacaaaaacgaaaacgcatcaagccggcattataaggattcttttatgcaaggattgttcagcaacattctgaatccgaaaactgttttggtctatatcacgattatgcctcaatttattaacttaagagaaagcgtcaaccagcagttgatcatcctcgctttaatccttacttttcttgctgtgttttggttcctcatcctcgtatatttgatcgatttcgcaaagaaatggctgagaagcgtgaaattccagaagatctttcaaaaagctgcgggtctggtgcttgtcggatttggcgttaaaacgggtttagattga

SEQ ID NO: 599 - DNA, 645 bp, Bacillus licheniformis
gtggatgaacaaaagaaaaatcagctgggagtgctgctgaaagagcagttgcgaaaacgatcattatctttaagagaattgagcgaacgcactcaaatcgataaagcgaccatctcaagaatcatcaatggcaaaagaaaagcaaacctgaaccatttgcaaaggttttcagaaagcttcggcgtttcttttgatgagctgatgacagcggccggctatgcgatggagaagacgcaggaaagcgaacgtccggatattcactcgtcagttgccgaaattgaagatgttttgcaaacctcaaatgtctatgatcggccatttaccatggaagaactgaaaaacaaattgaatgagtgcgaacaatattctcagacggaggaaggaaagcgtaccattctggctgagtttgaatctaaaatcgagaaagttgccggcattggtccttttctgacccgtctgcacgacatgtacagcagatttacctcggggcgggggacgccgcgtgaattgctgctgatgggcggcgctttgctgtatttcatcgtttctgttgatgtcataccggattatatttttccgatcggctatatcgatgatgcggcagcggttcatttcgttttcaaccagctgtcatataaatcatga

SEQ ID NO: 600 - DNA, 1158 bp, Bacillus licheniformis
atgaaaagaaagcatatcaacattgacatcagtctgctgctcattctattttgtttgtttatcatcagcctgctggccgtttacagcgggtcgggccagtatgaaacacaggaccctttttattttgccaaacggcaggtcttttggtatcttgtcgggtttggcgtcatggcgggaacggcctacatcgactatgagctgcttgaacgattggcgcttcgtttatttgtgggagccgtttttcttctgattctcgttcatttttttggaacttacaaaaacggttcgcaaaggtggatcagcttcggggtcatcgaaatccagccttcagaatttatgaagatcattttgattcttctgctggcttcgatactcaatcaatttcagcataaaaggttctccttcgccgagagcatcattccgacgggaaaaatcatgatgtacacggtgattccgtttttctttatattggttcagccagatttagggtccgcattggtgattttatcgatcgcattcacgttgatgctggtctcggggatttcgggcaggatgatcgtgtccctgtcacttggattcatggcattggttgcctttttgacgtatttgcacaatcattactttgagatattttcaaagattattaagcctcaccagcttgaccggatatatggctggctcagtcctcatgaacatgcctctacatatggataccagctgacgcaggcgttattggggatcggatcaggccagctgtcagggagcggctttactcaaggaatccaagttcagggagggaaaattccggaggctcatactgattttattttcgccgtgattggtgaggaattcggttttttgggtgccgtaacattagtctgtctgtattttctgatgatctacagaatcatcaggattgcgctttcgtccaacagtctgttcggtctttatatatgtgcgggggttgcagggttgattgtattccaagtgttccaaaatatcgggatgacgatcgggttaatgccgatcacggggctcgctcttccgtttatcagctatggcggcagcgcgctgttgaccaacatgatcgctttaggtctcgttttcagtgtgaatatcagatctaaacattacatgtttgggaatgattggggatga

SEQ ID NO: 601 - DNA, 1149 bp, Bacillus licheniformis
atgaagttgctcaaaatgattctttcccatctaaagaaacttgattatgtattgattgccgcggttctgtttttatctgcgtttggcttgctgatggtatacagcgccggctaccccctcggatatatgaagtatcatgatggcagctatttttttatgaagcagctgcaatggctgctcatcggtttggcctttttttcggctgccgccattttcccatacaaagcttacagcaaactcattcggtttttggtgaagctttcttttttaatgctgattctcgttttgctgccgggaatcgggatggagaaaaacaattcccaaaggtggattcaattcggttcgctcatgattcagccgtctgaggctgtgaagcttgtgatggttatttatttcgcctatgtgtatgcaaaaaagcagaaatacatcgccgatttcggaaagggcgtcatgccgccgctgctgattttggcggctgtgttttttttgattttaaaacagcctgacttgggcaccgccgtttccatcctgttaagctgcggagcggttctgttgtgcgccggcctcagaatgcggcacttgctgcttctcggaacaatggcaggggctggcatcgcatattttgcaataacagcgccgtaccggttaaaaaggctgacatcgttcagcgatccttttcaaaatgaaaacggagacggctaccagttgatcaattcctaccttgccattgattcgggcgggttatgggggaatggattggggaacagcgttcaaaagctgggatttcttcccgaagcccatacggactttatcatggcggtcatcactgaagaactcggcggtatcgggctggcggtgatcatctgggcttacctgttgatcatgttcagaggggttcggatcgctgtgcaaatcgatgatccgtttggaaagctgctggcggtcggccttactttccagatcatgattcaagcgttatttaacctgggcgctgttttcggccttcttcccattaccggaattcctcttccgtttgtcagctacggaggttcttcgttattgttcatgctgacgacagccgggatattggtcaacctctcatcacatgttaagcggggagttaaaaaagatgtggcctttcttttgtag

SEQ ID NO: 602 - DNA, 162 bp, Bacillus licheniformis
atgagcagggttccggctaagaaaaaacagcatttactcagtttgaccgcagaacgttttaagaaaactgcggtttttcaaatttgcatgtcaacggacatttatggaaacaactctgctttttggtataataagggttggcagcagttcggttctatataa

SEQ ID NO: 603 - DNA, 426 bp, Bacillus licheniformis
atgaaaacgcgattcacaccttatatcctgatgaatggaagagcaaaggaagcgattgattattaccgtgatgtactcgatgccgaagtaaagttcagtcagacgattggtgaaggccccgcagatgaggcagcgaactttaaggaagacgaattggatttcatcgcacatgccgttttgacaatcggcgacgctgtcctgatgatcgccgacattattcctgaactgcctttccaaagcggaaaccaattgtccatttgcgtaacggcagccgatgtttcttcggccaagcggcttttcggcaagctgagcgagcggggcgaggtcaagcttgagctgaaggaaacttatttcagtcccgcatacggcattgtcactgatccgttcggcgttgccttccaaatttttgccgcgcgtcccgcataa

SEQ ID NO: 604 - DNA, 960 bp, Bacillus licheniformis
ttggaggtattcatgtctaaagcgaaacgattgaatgaaatgatcatgatggtaaaccggaaaaaacgatttacggtcggggagctggcgcgggaattcggggtttcaaagagaacggttttaagggatttgcaagagctcagcgaaatgggggtgcccctctattctgaaaccggcccccacggaggatatcaggtgttaaatgaaaggattcttcctcccatcgccttcagcgagaacgaagcgatctcaatcttctttgcgatcgatgcactgaagcattatatatccctgccgtttgatgcccagtacgcatccatcaaaaagaaattttatttaaacctttcaggagatatccgggatgcgattgacagtatgaaggaccgcgttgctttttatacgccttatgagcaaacagacgacattccggttttaaaggtgctgcttgaggcagcggttcagcaaaaggtgttgatcatcgagtatgaagcaaatggcgcatcaagcaagaggagcattcagccgatcggaatctatgccaatcaagggaagtggtattgcccggcttactgttttttaagaaaggattaccgcatattcaggtgcgaccggatcaagcgggccgagcttgatgaacataaggcaccgattgatttgtccggcctcaatttaaagaaccgtttttcggctttgtcccggccaagggagacattggaattatccgccgagctgacaaaaaagggagtagagcggcacggttcactcaaatggccgcaccttgaactgcatgtaagagaagatgggtccggcgtgctgaaaggcgaaatcgcgccgaaggatatcgatttttttgcggattatttcatttcgttcggccgggaagcggttattcagaagccttccaaattaattgaaaggatgaaacggacattatccgacatgctgaaacaatacggctga

SEQ ID NO: 605 - DNA, 678 bp, Bacillus licheniformis
atgaaaaaagcgatggctattttaggattccttgtactcacagcatcgctgctatttatcatcaataaaggaacatctcaaataaacgcttcacaaaatagaaaagccgcggttcacacggagtattacaaagacatcagttcgctttcttttccggtattcagcgatttgaaggaagaggatgccaagctggccaacgatgcggtaaaacttcatttaaaaaattcctataaagaatttcaaaaaatcgttaatgatgccgaaaagaaggataaggatgaagaaaacgtttatgaaacgtcctacaaagtcaaatacaacgaggaaggcaaactgagctttttaatctatgactatcagttctccggcggtgcgcacggcatgtacaccgtaacatcctacaactttgactttgacaagcataaacaagtcgtgctgactgacgtattaaacaatcaggcgaaaatcgaaaaggcaaaaaactatattttcagctatatcaacgaacatccggaacagttttattctgatcttaaaaagagcgatatccgtttggatgaacatacggcattctattatacaagcagcggaatttcaattgtatttcagcagtatgatatcgccccgtatgcagccggaaaccaggaaataaagcttccgtcgacgcttttatattag

SEQ ID NO: 606 - DNA, 1317 bp, Bacillus licheniformis
ttggcagggtactcttacaataaagtgtcaagcaacagccaagagccccctcagccaaaaaaagaccgcggacaatccggcctcggcgtcgaatccatggtcaatgacagcaaacaagagaggtatgccatccattatccggtgtttcacataaaagaaatcgatgaacaaataaaagattatgtgaatcaagaattggccggttttaaagaggataacgcaaaggcccaggctcaggatgaagacgggccttttgaactgaacattaaatataaggttgtctattatacaaaggatacggccagtgttgtgctgaatcaatacatagaggccggcggcgtatcgggtacaacatctgtcaagacgtttaacgctgatttaaagcagaaaaagctgctgtcccttcaagatctgtttgaagagaattcagattttctgaacaggatttcaagcattgcctatcaggaattgaaaaatcggaatccgtctgctgacatggctttattaaaagaagggacgagccctcaggaagaacatttcagccgcttcgcgcttcttgaaaacgaggtggaattttattttgagaaaaaacaaaccggtcttgaacagtctgtaaaaataaaaaaagaatgggtaaaagatattttaaaagaccgatatcaggatatgaaaaagaatcgtcttcaggccaaacctgatcaggagcctgttccgcttccgaagcaagcgaaaattaatcccgatgaaaaagtgattgccctcacatttgatgacggtccgaatcccgctacaacgaataaaatattaaacgctttacagaagcatgaagggcatgcgaccttctttgtgcttggaagcagagcgcaatattatcccgaaacgataaaacggatgctgaaggaaggaaacgaagtcggcaaccattcctgggaccatccgttattgacaaggctgtcaaatgaaaaagcgtatcaggagattaacgacacgcaagaaatgatcgaaaaaatcagcggacacctgcctgtacacttgcgtcctccatacggcgggatcaatgattccgtccgctcgctttccaatctgaaggtttcattgtgggatgttgatccggaagattggaagtacaaaaataagcaaaagattgtcaatcatgtcatgagccatgcgggagacggaaaaatcgtcttaatgcacgatatttatgcaacgtccgcagatgctgctgaagagattattaaaaagctgaaagcaaaaggctatcaattggtaactgtatctcagcttgaagaagtgaagaagcagagaggctattga

SEQ ID NO: 607 - DNA, 1539 bp, Bacillus licheniformis
atgaaacaacaaaaacggctttacgcccgattgctgccgctgttatttgcgctcatcttcttgctgcctcattctgcagcagcggcggcaaatcttaaagggacgctgatgcagtattttgaatggtacatgcccaatgacggccaacattggaagcgcttgcaaaacgactcggcatatttggctgaacacggtattactgccgtctggattcccccggcatataagggaacgagccaagcggatgtgggctacggtgcttacgacctttatgatttaggggagtttcatcaaaaagggacggttcggacaaagtacggcacaaaaggagagctgcaatctgcgatcaaaagtcttcattcccgcgacattaacgtttacggggatgtggtcatcaaccacaaaggcggcgctgatgcgaccgaagatgtaaccgcggttgaagtcgatcccgctgaccgcaaccgcgtaatttcaggagaacaccgaattaaagcctggacacattttcattttccggggcgcggcagcacatacagcgattttaaatggcattggtaccattttgacggaaccgattgggacgagtcccgaaagctgaaccgcatctataagtttcaaggaaaggcttgggattgggaagtttccaatgaaaacggcaactatgattatttgatgtatgccgacatcgattatgaccatcctgatgtcgcagcagaaattaagagatggggcacttggtatgccaatgaactgcaattggacggtttccgtcttgatgctgtcaaacacattaaattttcttttttgcgggattgggttaatcatgtcagggaaaaaacggggaaggaaatgtttacggtagctgaatattggcagaatgacttgggcgcgctggaaaactatttgaacaaaacaaattttaatcattcagtgtttgacgtgccgcttcattatcagttccatgctgcatcgacacagggaggcggctatgatatgaggaaattgctgaacggtacggtcgtttccaagcatccgttgaaagcggttacatttgtcgataaccatgatacacagccggggcaatcgcttgagtcgactgtccaaacatggtttaagccgcttgcttacgcttttattctcacaagggaatctggataccctcaggttttctacggggatatgtacgggacgaaaggagactcccagcgcgaaattcctgccttgaaacacaaaattgaaccgatcttaaaagcgagaaaacagtatgcgtacggagcacagcatgattatttcgaccaccatgacattgtcggctggacaagggaaggcgacagctcggttgcaaattcaggtttggcggcattaataacagacggacccggtggggcaaagcgaatgtatgtcggccggcaaaacgccggtgagacatggcatgacattaccggaaaccgttcggagccggttgtcatcaattcggaaggctggggagagtttcacgtaaacggcgggtcggtttcaatttatgttcaaagatag

SEQ ID NO: 608 - DNA, 951 bp, Bacillus licheniformis
atggcaacgttatctgatgtagcaaagaaagcaaatgtgtcgaaaatgacggtatcgcgggtgatcaatcatcctgagactgtgacggatgaattgaaaaagcttgttcattccgcaatgaaggagctcaattatataccgaactatgcagcaagagcgctcgttcaaaacagaacacaggtcgtcaagctgctcatactggaagaaatggatacaacagaaccttattatatgaatctgttaacgggaatcagccgcgagctggaccgtcatcattatgctttgcagcttgtcacaaggaaatctctcaatatcggccagtgcgacggcattattgcgacggggttgagaaaagccgattttgaagggctcatcaaggtttttgaaaagcctgtcgttgtattcgggcaaaatgaaatgggctacgattttattgatgttaacaatgaaaaaggaacctatatggcaacacgtcacgtcattggtctgggcgtccgcaatgtcgtcttttttgggatcgatttggatgagccctttgaacggtcaagggaaaaaggctaccttcaggcgatggaaggcagtctgaaaaaagcagcgattttccggatggaaaacagttcaaaaaaaagtgaagcacgcgcgcgggaagtgcttgcatcctttgacgcacctgcagcggttgtttgcgcttcggaccgaatcgcgctcggggttatccgcgcggtgcaatcgcttggtaaaagaattccggaagatgtcgcggtcaccggctatgacggggtgtttctcgaccggatcgcttcgcctcgcctgacaaccgtcagacagcctgttgttgaaatgggagaggcttgcgcgagaatcctgctgaaaaaaatcaatgaagacggagcgccgcaaggcaatcaattttttgagccggagcttattgtccgcgaatcgactttgtag

SEQ ID NO: 609 - DNA, 1761 bp, Bacillus licheniformis
atggaatatgcagcgatacatcatcagcctttcagctctgatgcctattcttacaatggacggacattgcacatcaagatccgtacaaaaaaggatgatgccgaacacgtccgcttggtttggggcgatccttacgaatacaccggcggcacatggaaagcgaacgagcttgcgatggcgaaaattgccgcaacaagcacccatgattactggtttgccgaagtggcgcctccattcaggcgtctgcaatacggatttatcctgacaggcgctgatgatcgagacactttttacggaagcaatggtgcatgtccgtttgccgggaaagcggcggatataggcaaacactgttttaaatttccgtttgttcatgaggcagacacgtttgatgcacctgactgggtcaaatcaaccgtctggtatcaaatttttccggagcgctttgccagcgggcgggaagatttgtctccggaaaacgctttgccatggggaagcaaagatcctgaggcgcacgattttttcggaggggatttgcaggggatcatggacaagctggactatttggaagacttgggggtaggcggaatctatttgacgccgatctttgccgcgccttccaaccataaatacgacacattggactattgctccatcgatccgcattttggcgatgaggagctctttcgcacgctggtcagccggattcacgagcggggaatgaaaatcatgcttgatgctgtttttaaccacattggcagcgcttcgcaagagtggcaggatgttgtcaaaaacggtgaaacgtcccgctataaagactggttccatattcattctttccctgttaaagaaggcagctatgatacatttgcgtttactcccgagatgccgaagctcaatacggccaacccggaagttcaggcttatttgcttgatattgcgctgtactggatccgcgaatttgatatcgacggctggcgtttggatgtggcaaatgaagttgatcatgcgttttggaagaaattccggcaagccgtcacggcagaaaagcccgacatttttatattgggcgaaatctggcatcaggctgatccgtggcttagaggagacgaatttcattcggtcatgaactacccgttcacagaaccgatgattgactattttgcagacggatcgatttcagcttcgcaaatggccagccgcatcaattcgcatttaatgagcgggatgaagcaggtcaatgaggtgatgtttaatttgctggacagtcatgacacgaagcggattttgacaagatgcggaggagatgacaaaaaggtgcgctctcttttggcattcatgtttgctcagacaggctcgccgtgcatttattacggaacggaagtcgggcttgacggcggcgatgatccattgtgccggaagtgcatggtttgggaagaggaaaaacagaatcaagagatgctcgcatttatgaaacggctgatcgctttgcgaaaacaagagaatgatgtattgacttatggcgcgcttgagtggaagctggttgatgaccaaaacgattttgtcagtttttctcgaacgcatgaaggaaaagagctgatctacttcttccaccagggcagcgaggtgcgccgtgtcagattgcgggatttgaagattgcaagcgataaaagaatatacgatgcgtggacggaagaagcgcttcagcatgatgatgtggtcgacattcagccaggcggatttttcattttgggggcggtctaa

SEQ ID NO: 610 - DNA, 1254 bp, Bacillus licheniformis
atgcaacatttaaaaaaaggaattttagtgctgctggcgtcagttctgctgttcggtcttgccgcctgttcaagttcaaaggaaacgggaggcagcggcgggaaaaaagtgctgaccgtgtctgtagaagaggtctataaaccttacgtcgaaagcataaaggaaggttttgaaaaagagaatgatgtgacagtcaaaatcgttgaaaagccgatgttcgaccagcttgaagcgcttccgcttgacggtccggcaggcaatgcgcccgatgtcatgcttgcggcatacgaccgtatcggcggcttaggacagcaaggtcatttgctggaagtcaaaccgtctgacacaaaaagcttcggagacaaagaaatgcagcaggtgacggttggcggaaaagtctatggaatcccgcttgttattgaaactctcgtactctattacaacaaagacctgttaaaaacgccgccaaaaacttttaacgagctcgaggatttaacaaaagacaagaggttcgctttttcttcggaaaaaggaaaatcgaccgcctttcttgcaaaatggacggacttttacatgtcatacggtttaatggccggatacggcggatatgtattcggagctgacggcacggattccggagacatcggtctgaacaacaagggagccgtagaggcggtggaatacgccgaaaaatggtttagtgaatattggccgaaaggcatgcaggacaatacgagcgcagacgattttatccagcagacctttatggacggaaaagcagcggctgttatcggaggtccttggtcggcttccaattataaagaagccggtttgaactacggcgcagcgaaaatcccgacattgccgaacggaaaagagtatgccccgtttgcaggcggaaaaggctgggtcgcctcaaaatatacgaaagagccggagcttgctgagaaatggcttcaatatgccgcaaatgacgaaaacgcttaccgcttttatgaagatacgaacgaagttccggccaacctcgctgctcgaaagaaagcaggggagcaaaaaagcgagctgacgtcggcggtcatcacacaatacgaaacggcgactccaactccgaatattccggaaatggccgaagtgtggacaggtgcagaaagcttgatatttgacgcggcagcagggaaaaaatcggctcagcaatcagcggatgatgccgtgcgcgtgatcaaagaaaacattaaagaaaagtatgtgaaataa

SEQ ID NO: 611 - DNA, 1308 bp, Bacillus licheniformis
atgaacaaagaccaaacactagcaaaccggagccggaaggcagcgctgttatcgataattcccggtgctggccagattgcaaaccggcagttttcaaaggggatcctttttctagtcatcacaggcttgtttatttgtgagttagcgattttcggttatcaggcgctgatcggtctcgtgacgctggggactgtccccggagaagaccactcgctgtttctcttgatagagggcacgctgcaattgattttgacgctcgttttcttgatgttttacatctttaatctgtatgatgcccggaagaccgccgcgatgaaggcggcgggtttgaaaatcagcgagacggctggggacatgatcagaaatgcaggtgacaaagggtttccgtatttatttacgctgccggcatatctcatgatggtgtttgtgattatttttccggtgctggtgactctgtttatcgcgtttacaaactacgatttttatcatattccgccaaacagtctcatcgactgggtcggctttaaaaatttcatgaatatctttttccttggctcgtatcggcaaacattcgccgatgtgctgggctggacgatcatctggacgatctgtgcgacgacgctgcaaattgttctcggcatcgtgacggcgctgatcgtcaatcagaactttattaaaggcaagcggatgttccggatcatcttcctgcttccgtgggccgttccggcatttattacgattatgagcttcgccaacattttcaacgactcggcgggcgcgatgaacgtccaggtgatcccgcttttgaaccagcttccgttcgtcgacatcccggctgtcgcatggaagaccgatccgttctggacgaagacggctttgattatgatccagacgtggctcggttttccctacatttatgtcatggtgacgggggtgcttcaggcgattcccggagagctttatgaagcggcaaagattgacggcgcgacatttattcagcgctttaaacacattacgctgccgatgattttatttgcgaccgcaccggtgatgattacccagtatacatttaatttcaataacttctcgatcatctatttatttaatgaaggcggtccggggagtgcgggggccggagccgggtcaaccgacatcttaatatcctggatctataagctgacgacggggacgtcgccgcagtattccgtggcggctgctgtcacactgctcatttctttcattgtcatcggggtttccctgattgcttttaagaaatcgaatgcctttggcaatgaggaggtcatgtag

SEQ ID NO: 612 - DNA, 852 bp, Bacillus licheniformis
atgagagggctttttaaaaatacgcggttcaccgggatgctgaacaaggttttgacctatatatttttggcgtttttaagcatcgtgattatttatccgcttttgatcacagcatcatccgcattccgggtcgggaatgtagcggcttttacactcgatttttcgggcgcatggacattggaccactttaagcggctgtttgaagagacgctttacctcaattggtacgggaatacacttgtgatcgctctgtctgtcatggtgttccaggtgacgattgtgacgcttgccggctatacgtacagccgctaccggtttgcgggccgaaaaaagagcctcattttctttttgatcattcaaatggtgccgacgatggcggcgctgaccgctttttacgtcctggccatgctgatcggagctttggaccaatattggtttttaactgcaatctatatcggcggcggaattccgatgaacacatggctgatgaagggctactttgatacagtgccgagagaaatcgatgaagcggcgcgaattgatggagcggggcacctgcggatctttgcttcggtcgttctcccgcttgtgaaaccgatgcttgcagtccaggcgctgtgggcgtttatggggccgttcggcgactatctgctggcgaaatttctgcttcggtcgccggaaagcctgaccatcgccgtcggtttgcagacattcatctccaatccgcagcagcaaaaagtcgcgctgtttgcagctggggcgattcttgcagctctgccgatttgcatcttgttcttctttctccaaaagaactttgtgtccggtttgacatccggcggaacgaagggataa

SEQ ID NO: 613 - DNA, 882 bp, Bacillus licheniformis
atgaacgacatgcgaaacgaaaagctgatcgtccgatttcttaaagcagcggcatcaccggcgggcgtcatgcgctgcaaacatgcattcagctggctcgaaatttcttttctgtttatgtttttgactgcttgtttaatggcgcctatgacccttgcgtttatgaaaatggaccgcttcaatgccgggtatctgatcccgaacgtcgctcaagaggctgacgcggcattcatcaaacaattaaaaggctaccaattgacaaacggaagattgaagggcgaagacgagctgtaccgtgtggagaaagggagaaccctgctggccgtcgatttgaaggatgaattaaaaacaagcggtgagaacgggcggataaaagcggaaggctatcaaaatgcgctcatctttcagtcagatcatctgatcatcagtgatcaaagcggagcggggttttccgttcgctatccggcaaaggctgggctgaatgatctggatgccggtcatttgggggattttatcggtgcaatgtggtttgcccaatataagccgcttatcatcatgctggcctgttcggcggttttcatcatctcgctttttttaacggccgttctggcgggaggcatctggatctccaaaaaatccaacatgaccgggataaggtcgtttaaggaagcggccgcagcggcggtgtgcggatcggcgcttccggcaggagccgcaatggctttcggtatgatcagctttgacttcatcgcgatgctgctcatccattcgtgcggtagtgctttgatggtctctttcattttcaggcacatcttcaagaaccgccatcacaacgaaaatctacagtcaggaggaaatcatggcaaatcagcggctatttga

SEQ ID NO: 614 - DNA, 2283 bp, Bacillus licheniformis
atggcaaatcagcggctatttgagatcgaccagtggaaaatcaaaacaaacaaatttgaaaaggaacataaacggcttcaggaaagtctgacatccttggcgaacggatatatgggaatcagggggaattttgaagaaagctattcaggcgaaagtctcaaaggcacatatatcgcaggggtttggttccctgacaaaacgcgtgtcggctggtggaaaaacggctatcccgaatatttcgggaaagtgatcaatgcgatgaatttcatcggaattgatgtatatgtagacgacgaaaaagtcgacctcagccaaaacgacatcgaatcgtttgaattggagcttaatatgaaagaaggcatcttgcggagaagcgctgtcgtccgtgtgaatcaaaaggctgtcaaaatttcgtccgagcgctttcttagcctcgatgtcccgcaactgtgcgcgatccattatgaagcggaatgcctgagcgatgaagcggtcatcacgcttgttccttatcttgatggaaatgtcgcaaatgaggatgccaatttcgaagagcggttttggcaggaagaagcgaaaggcgccgaatctcatcgcggccatcttgtgacgaaaacgattgagaatccgtttggaaccccgcgttttacggtggctgcttctatgtgcaatgtgacggaaggatatgtcagcgagcattttcaaacggatgcaatgtacgcggaaaaccgctactgttacgaagtgggaccgggaacaaaggcttctttaaagaaattgatcattgtcacaacgtcccgggattttgaagaagcagagcttttagtacagggcagggcgcttttggcggatgttcttcggcagggatatgaagaagcgaagcggaggcataccgaacattggatggaaaggtgggcaaaagcggacattgaaattaaaggggatgatgagcttcagcagggcatccggtacaacctctttcagctcttctcgacatactacggagccgattcacgcttaaacatcgggccgaaaggatttaccggcgagaaatacggaggagccgcctattgggatactgaggcgtacgccgttccgatgtatttggcgacggcagagccggaggtgacgaagaatctgcttttgtaccgctatcatcatttggaggcagcaaaacggaatgccgccaaactggggctgaaaggagccctttatccgatggtcaccttcacaggcgatgaatgccacaatgaatgggagatcaccttcgaagaaattcaccgcaacggcgcgatctgttatgcgatctacaattatgtcaattatacaggcgaccgggactacatgaaagaatacgggatagacgttctcgtcgaaatcagcagattttgggcggaccgcgtccacttctcaaaacgaaacaataaatacatgatccacggcgtcacagggccgaatgaatatgaaaacaatgtcaacaacaactggtatacgaacttgattgcgtcatggacgcttgagtacacgctcgaaaacctcgctatcctcccggaggaaaaacgccgccggcttgatgtacgggaagccgaaatcgagaaatggaaggatatcatcgagcgaatgtactatccatacagtgaggaattaaatgtttttattcagcatgatactttcctggataaagagcttcaggcagcggatgagcttgaaccgggtgaccgtccgctctatcagaactggtcatgggataaaattctccgctccagttttattaagcaggctgatgttctgcaaggcatttatttctttaatcaccgatttacaatggaagaaaaacgtcgcaactttgaattttatgaaccgatgacagttcatgaatcgagcctttcgccatctgtccatgcggtgctggcggctgagctcaaaatggaaaagaaagcgctcgaactgtataagcgtacagcgaggcttgatctggataattacaatcatgacaccgaggaagggcttcatatcacttcgatgaccggaagctggctcgccatcgtgcaaggatttgccggcatgcgcactcaggatgagaagctgtcttttgctccgtttctgccgaaggaatgggacggttattcgttcaacatcaattatcgagaccggctaatcaatgtgcaggtagaggaaaacagcgtcgttttcagtcttttaaaaggagaaccgctttctatgacagtttatggagaacagatcgcactgaacggacggtatgaaaggaggatggcccgatga

SEQ ID NO: 615 - DNA, 1707 bp, Bacillus licheniformis
atgagccaatggtggaaagaggcagtcgtgtatcaaatttacccgcggagtttttatgattccaacggagacggcttcggtgatttgcagggggtgattcaaaagctcgattacatcaaaagccttggagccgatgtcatatggctgtgtcctgtgtttgattccccgcaggatgacaacggctacgacatcagcgactatagaagcatatacgaaaagttcgggacgaacgatgatatgtttcaattgattgatgaagtgcataaacgcggaatgaaaatcattatggatcttgtcgtgaatcacacgtctgatgaacatgcctggtttgccgaaagccgcaagtcaaaggacaatccttaccgtgattattatttttggaaggatccaaaggcggacggttcagagccgaacaattggggatcgatcttttcagggccggcatggacgctcgatgagcggacaggacagtattatcttcactacttttcgaaaaagcagcctgacttaaactgggagaatgaagcggttcgccgcgaagtatacgatttgatgacattttggatggacagaggcgtggacggctggcggatggacgtgatcggttccatctccaaattcgtcgactttcccgattatgaaacagatgacagccgtccatatgtcgtcggccgctatcattcgaacggcccccgtctgcacgaatttatacaagagatgaaccgggaagtgctgtcccgttacgactgtatgacggtcggcgaagcaaacggctcagatgttgaagaagcgaaaaaatacacggatccaagcagacatgagctgaacatgatttttacatttgaacatatggatattgataccaaacagcattctccgaatgggaaatggcagatgaagccgtttgacccgatcgctttaaaaaagacgatgacgaggtggcagaccgctttaatgaatgtcggctggaatacgctttatttcgaaaatcatgatcagccgagggtcatatcccgctggggcaatgaccgcgagctccgcaaacaatgcgccaaagcatttgcaacagttctgcacggcatgaagggaaccccgttcatttatcaaggtgaagaaatcggcatgacaaacagcgagatgccgctcgaaatgtatgatgatctcgaaatcaaaaacgcataccgcgaacttgtcattgaaaacaaaacgatgacagaggaagactttcgaaaagccgtggcgaaaaaagggcgggatcatgcgagaacgccgatgcaatgggatgacgggaaatacgcgggctttacggatggagagccttggctggcggtaaatccccgctatcaagaaatcaatgtgaaagagtcgcttgccgatgaagattcgattttctattattatcagaagctcatcgggctgcgcaaacaaaataaagtcatcgtgtacggagactatcggctgctgctcgaggaagatccgcgaatctttgcgtatatccgcgaatatcggggcgaaaagctgttagtcgccgtgaatttatcagaagaaaaggcgctgtttcatgcttcgccggaattgcttgaggacagatgggatgtgctgttgtcaaactacgcccgagagcggcttaatataagcggcagtatcgacatggagccttatgaagctttcatgatgatcagccgggcaaaggattacacatcatga

SEQ ID NO: 616 - DNA, 681 bp, Bacillus licheniformis
atgaaagcggtcatttttgacttggacggcgtgatcacggatacggccgagtatcattatctcgcatggaaacatactgcagaacaaatcggcattgagattgaccggagctttaatgaacggctgaaaggcatcaacagagagcagtcgcttgataagattttgattcacggcggcgcggccggaaagtttcaggaggcggagaaacaagagatcatgcgccggaaaaatcaatactaccaacagctgatccaaaacttgactccgcacgacctgctgccgggaatctccgtgctttttgccgaattgaaaagagaacatataagcattgcgttagcttcgtcaagccgaaacgcgcctgctattttgcagcggctcggtgtcatggacgaatttcagggtgtcgttgatccggccgcacttgctcacggaaagcccgaccccgaaatctttttgacggccgctgcactgctcggtgtgcctccgtctgaatgtgcagcaatcgaagatgctgaagccgggatcgccgcgatcaaatccgcagggatgttcgcggtgggagtcggtgatgagacatcgctgcgcggagccgatttgatcgtgcacaacacaaacgagctgacgtttgagctgctgaatgaaggatggcagcgctattgctgtataagagaaggaaaatga

SEQ ID NO: 617 - DNA, 1254 bp, Bacillus licheniformis
atgcagcaacaacaatttgatcaactgacaactgccgaaaagcgggaagtcgaaaggcagcttcacttatatatggacggagcggaggaggtcattcccccggaggaactgcgggcaaagctggccaaatcgattttgaccggcgaaccgctgaaaattaagctcggcctcgatccgtctgcgcctgacgtacatttgggccacaccgtcgtcttgaataagcttcgtcagtttcaggaaaacggacatatcgtccagctcctgatcggcgatttcacggggaaaatcggtgatccaacaggaaaatccgccgccaggaaacagctgacggacgaagaggtccgccgcaatgccgaaacatactttcaacagtttggaaaagtgcttgatcagaacaaggtcgagcttcactacaactcaaaatggcttaaacgattaaccttggaagacgtcattgagctcgcgggcaaaattaccgtcgcccgtttaatggaacgcgatgattttgaagaaagaatcgccatgcaaaagccgatttcgcttcatgagttcttttacccgttgatgcaggggtatgattcagtcgttctggacagcgacatcgaactgggcggaacggatcagcattttaacgtgctcatgggcagacactttcaggaaaagtacggaaaagaaaaacaggtcgtcattctcatgccgctgcttgaagggcttgacggcattgaaaaaatgtctaaatcaaagaacaattacatcggcatcgatgaagaccctcatgaaatgttcgggaaaacgatgtctctgccggacagtttgatgaaaaagtatatccatcttgcgaccgacttggaggcggaagaaaaaaaacgtcttgtcaaggatttggaaacgggggccgttcatccgagagacgcgaagatgcttctcgggaaaaccattgtcaacatgtatcatggaagcaaggcggcagaagcggccgaacagcagtttaagaaagtttttcagcaaaacagcgcgccggacaatataacagccgtacactggcaaggtggcggaacggtgccggtcaccgatttattggtgacgctcgaactccttccttccaaaagtgaagcccgccgcatgatccaaaacggcggcgttaaaatcaacggcgccaaagcggaatcgattcatgcggacattgcactcgaacacggcatgatcatccaagtcggcaaacgaaaatttgtcaaattgcaaatgcaccaataa

SEQ ID NO: 618 - DNA, 507 bp, Bacillus licheniformis
ttgaatagatccccccatcttcgacaggaagaacacgacaccctcagcaagctgaagcgcatgccgatcgaatccttgaatcttgaagccatttcggtcgccaccaacctttaccggtcggcgcaaaagctccgcgtcaaaatggagaccgaggtcctttcctcatatcaattgtcttggacggctttttcgattctttacgatctatgggtatggggcaggcttgaaacgagaaaactcgccgaactgtcaggaatttcaacagccactgcgagcaatgtcattaaaacgcttgagaaaaagaacttttgcgtcaaaagcgcggatccgagagaccgcagacacgtttacgccgagatcacaccggaaggaaaagccgcgattgaagagctttatccggcgttccacaaaggggaaacaatgctgatcaagggcatgacaaaagaggagcagaatacattgatcgagctccttcgaaaagtgaatgacaatcttcataaaccataa

SEQ ID NO: 619 - DNA, 567 bp, Bacillus licheniformis
atgaagaaaaaaagcgctcctcttattttgatcatggcgctgtccctcttgctgccttttgctcaagcagaggcagcaggcagcaaaggagcatccggggtgaaggcttcgagttcctcggctaataacagcgctctaaaaacacgtgcgggttcagtcaaccagagtatgcgcagttatatgaaacagtctgcgagccgacgatacttaaacaagaacagtcagttcaacaccattcagcggacactgcctcccgatgccctgtacaaaggaagcatcaagcggacactcaatcaaaatcctgctggatcagcctttttgaattactactttccatattggatgatcttccacgtaggcggatatacagcggaacaaaaaaacatcctccgtaccgcaggaatcaaagaaaaagcgctctctgaacgaaaagaaaaaagatattggctgttgattgaagatcaaaacggaaagaaacatgccgtcctcgtctcgaaaaaacaatatgacagcattcaaaaaggggaccgaattgaagtgcgccgcaaacagatcaccaaaaaatag

SEQ ID NO: 620 - DNA, 393 bp, Bacillus licheniformis
gtgaaaaaatcgaaactgatctctttatccgcggctgcgatgcttttagccgttcccttatcaggatgttcatcatccgcttcagaccgttcacaggaggtcgcagatgaccaatccattcaaaaatacgatctcgtatggtttgattacgtgaatgacagcgaatccgacaaagcaccattactgaaagcagcatacgtgaaagatggaaaagaaaagacggagactttcaaaaaatatgtggaaaatgtagaaaatgtcgaacagccttatattaaaatccgcgatcaggaagccttcatctttcgtcccccatacattaaatatgatcaggagccgcttgagggcgtcgtcaaagacaaagttgaacaaaaaagcagtgatgaacaatga

SEQ ID NO: 621 - DNA, 420 bp, Bacillus licheniformis
atgtcagaaaaaaatcccattcacggaggatatttttatatgaagaagatacttttttctgtttttgttttggcaggcagcttgctattggcttttaattttgccggtgaagcgagtgctaaaacgaaaaaagtcagcggctatatcacttggtacaacggagtgggcaaaatcggcgctgacggcaagaggctcggccattgggactgcgccacaaagatgggcttcgatgttccgagaaaaggcacaaaaataagagcctattcaaaagcaaaaccgcacaaagtcattacagtctataaatatgatgtcggcagaatgccgggcgctgttttggatgtaagcccgaaagcttttagagctttgggatttccgacaagcaaaggaaaggtagccggacattatacatataaaaaatag

SEQ ID NO: 622 - DNA, 1020 bp, Bacillus licheniformis
atgaaaaaagtttcagttgttttgttggcggcagtcattttagccgcaggcgcatttgcggccgtccgctatttcgtcccggaaaaagcggagccggcaaagagcggcggttcagacctgcttgtatcgataaccgatcagaagctgatgaccgcttactatgaaaatcaaaataagctgtatgaagaaaagatgacggattatccggctatggcattagaccggaaaaaacgaattctttactatacaaacaccgataacagcaatgtgaagcatttgatcaggctggatttacagtcgggcaaaaaaacaaccctatattcaggagatgaatatgtcgacgggctcagtttatcggcggacggttcgaagctgttcatgagatacaaccttgcggaggagaggaattttcaccttgcttcctttgatttaaaacaaaaggcgtttcatgtcatctatccatcgttgaaaaacaaggacgaaactgtcagctactatcagtacaacaaagctgacaatcaattcgttatgctgcattattcattgaaggaagactatcaaaaaacagatgatgcgaacaacaaaggcgtgccgcccgaaccgacgaatatgaacatttccatggcgggtgtgaaagatcggcaaaaggtgagaacgatagcaaaatttatcaatgacgtggcaatttcgccggatggaaaaacgattgtctttacagaatcggctgatgatcagaaggcgatttatgcgatggatgccgaaacgaaaaaatacaaagcgatcatttcagatcagcaggcattttcattggtcgattcagcacagccgcaattctcgaaagacgggaaaaagctttactttctcgctgaagcaaaagatgcgaagctgcttgaagatgaaacggggagcgaagcaagggtgagaacgatctattcgtatgatatggatacgaaaaaagtgagcaaagcctgggaaaaaacaaacgggatcatcaacacctttacggtcattgacgaataa

SEQ ID NO: 623 - DNA, 993 bp, Bacillus licheniformis
atggcatctgctaaactgcagcagcgattggatcaatataaagcaatttactctgagttaaaaagcgatttaaaatggaaagtcacagatcagcggacattaatgatgattgcttccatgtatgtcgtcaacaagcggccttttgataaagaacggtttttaaatctgagtgaggctgtcaaacaggccgccggtacattttcgccgttgaggtcagcccatcgctacacttttgccgctatgtttgacgtacgcttcgaagaacctgaaacgcatatcagaccttttttcactctttatgtaaaaatgaccggcaacggattcaaaaaaagtattttcacttatttgtccgctcttattcttttgacaaaataccgtgatgagcatgatcatgacagcaaaatcaatcgggctttgtctatttacaaaggaatgaaggacaagcacgtttttttaacatctgccggcgactacccgctctccgtgcttttggccggttcagatatggagacaggtgaactgattgactatatcgaagcgttttaccaaaagcttaaccaggcgggttttcgcaaagggaacgatttgcagtttctcagccacatcctctcgcttatgccggagcaggattcagatcagcttgtcgcccgctccctccggatatacgatgaattgacaaaaaagcataaaagaccaaagcctgtccattacccggaaatcggactgctcgcgctgcttgagaacggcgaaaaagacatagatgccatcactatcatggcaggcgcattgaacagcgataaactgttcaggtggcagaaagacatgaatctgaaaacggccgtcaacttgtacatgagcgaaaaaacggaagacccggcgcttttggatacagggctttatcaaacgcttgaagctgttattcaagcacagcagacggcagcaatcgccattatgacaagctctgctgcagcgtctcaggcaaacggctcataa

SEQ ID NO: 624 - DNA, 303 bp, Bacillus licheniformis
atgagtgttccgaaagatgccgcttgctcgatgccccatgatcatcaaaggtctttgcacgatttatgccgcaaatacatgcactatcacgtcgtgctgaaaatgaaggacggcagttctgttcacggcattcttgaaggggtgaaccgtcaggaagcatctgtcctcattcccgaagacgtgacagatgaaaggcagttttacggcggttacggatatccgcgccgacgattcaggcggttcaggagaaggatcttcccgtttgtttttattgctgcgctgtatccttttccatattattaa

SEQ ID NO: 625 - DNA, 549 bp, Bacillus licheniformis
atgaaaaatagtagaaaaaaagagatcttatcgtgggtgaaaacacttgtcatcgccgcagcgcttgtgatggtttgccgctattttctgtttacgccgtcaaccgttttgggagattcaatgtatccgactttagaggacggcaacatggtcatggttagtaagatcagcgatattcagcgctttgataaaattatttttcacgcgcctgattcggatgaaaactatgtgaaaagggtgatcgggctcccgggagatacgatcgaaatgaaggatgatgtcctttatataaacggaaaagcatacgatgaaccttatttaaagaaaaacaagcaaaagctgacgcttcatgaacatttaaccgataatttcacattggagaaattaacaggtgaacaaaaggtgccggaagatcacttgttcgtgatgggggataaccgtcaaaacagcaaagacagccgctttttcggatttatcacaatggactccgttgtcggcaaagttgagttccgttatttccctttcaatgagatcggcggaatagaatag

SEQ ID NO: 626 - DNA, 285 bp, Bacillus licheniformis
atgtttaatagacaacagatagatcatctgcttgaagaaaaaaaaggagagctgaagaaaaagttcggaagtggttttatcgcagttttctatatttctattcttctttccatatgtacgttttttatagaatacaaatattttctcattgtattattcgcacccactattattgtcatgttaatcaaccctcctttttccgaaaaaaaaggggtgtttcgtttcattgccggcctttatttgcttttattggcactggcaacatacttttggcttcgagcataa

SEQ ID NO: 627 - DNA, 645 bp, Bacillus licheniformis
atgaaagtgtttgtagtgggggcgaacggacaaatcgggcgccgtttgacgaaaagtttgaatgagagcagcgaacatcaggtcagggcaatggtgagaaatgaagagcaggcgcaagctttgaaacaatcgggaacagaaacagcgctcgctaatttagaaggcaccgttgaaagcatcgcagaagcggcggagggctgcgacgcgattgtctttaccgccggctcaggcggcaatacgggcgctgacaaaacgcttttggtcgacttggatggggcggttaaaacgatcgaagccgccgaaaaagcaggcattcgccgctttattatggtcagcacattgcaggcacaccgccgtgaaaattggaatgaagcgttaaagccgtattatgtcgccaaacattatgcggatcggatgcttgaaggcagcgaattaaactacacgattatccgtccgggaggcctgttaaacgaaccgggcacaggccgggtgaaagccgcggaaaatcttgagcgcggaacgattccgcgtgaagatgtggccgataccatcttggcggcgctcaccgaggagcacacattccgtcgttcgttcgatttggtttcgggtgatcaaacgcccgccgaggcgctgaaatctatataa

SEQ ID NO: 628 - DNA, 879 bp, Bacillus licheniformis
atgaatatgaatgattacgaaagaattcaaaacgcggttcagtttatcgaagaacaccttcaaaacgatttaaacatcacggatattgcggctaaatcgtgtttctccccatttcattttcaaaggctttttcaggcgatctccggtttttccgtttatcaatacattcgcaaccggcgtctgtctgaagctgcgcttctgcttgagaaaacagaccgttccattctcgacattgcaatcaatttcggctatggctcacaagaagctttcagcagggctttctcacagtacttcggcatcactccggccaagtatcgcaaagcgaaggtcaagcttgattttcaatctaaaattaatttcctcgaatataaagaaaggatgactggagatatgaacatcccaaagccgcacatcactcatttaaacgacatacatatgatcggatatgagtaccggacaaatttaaacgatgaaaagtatttcgaagatatcccgaaattctacaacgatttcggcagaaatggatactttatgcaaattcctcaaaaaacggatccgaatatgtgttacgggctgtcatgccgcttccaggatgacggaggtttctcatttattatcggggaagccgttcgcgaaacagcagccggggaagtgccggagccgcttatttatacgaaaattcccggcggcaaatacgccgtatttcatgtaaacggatcgactgaatcagtgcagaacacaagaagatacatctatggatcatggctgatgaataccaattacgagagaacagaaggaccggactttgaagtgactgatgtgtgccgttccgtaccgccgaacgagatgaagatgaccatctatatcccgcttctgtaa

SEQ ID NO: 629 - DNA, 1542 bp, Bacillus licheniformis
atgaaacttgaaaaattcgttgaccggctccccattccgcaagtgcttcaaccccaaagcaaaagcaaggaaatgacctattatgaagtcaccatgaaagaatttcagcagcagcttcaccgcgatctgccgccgactcggctgtttggatataacggagtttatcccggccctaccttcgaagtgcagaaacacgaaaaagtcgcagtcaagtggttaaataagcttccggatcgccattttctccccgtcgaccatacgcttcacgatgacggccatcacgaacatgaagtgaagacggtcgttcatttgcacggaggctgtacgcctgctgacagcgacggatatcctgaggcttggtacacaaaagacttccatgcaaaaggccctttctttgaaagggaggtgtatgaatatccgaatgagcaggatgctacagctctttggtatcatgaccatgcaatggccatcacaaggctgaatgtatatgcggggcttgtcggtttatattttattcgcgacagggaagagcgttcattgaacttgccgaagggagaatatgaaatcccgcttttgattcaggataaatcatttcatgaagatggttcattgttttatccgcggcagcctgacaacccttcgccggatcttccggacccgtcgattgttccggctttttgcggtgataccattttagtcaacggcaaggtatggcctttcgctgaactggaaccccgaaaataccgttttcggatactgaacgcctccaatacgagaatctttgagctgtatttcgatcatgacatcacatgtcatcaaatcggcacggacggcggtcttctgcagcatccggtcaaagtcaatgaactggtgatcgcgccggctgaaaggtgcgatatcatcgttgatttttcacgagcagaaggaaaaaccgtgacactgaaaaaacggatcggctgcggcggacaagacgcagatcccgatactgatgccgacatcatgcaattccgcatctcaaaacctttgaagcaaaaagatacaagttcattgccgagaatattgagaaagcgcccattttaccggagacacaagatcaatgccctcagaaatctgtcattgggcgcggccgttgaccaatatggaagacctgttctgcttttaaacaacacaaagtggcatgaaccggtaaccgaaacacccgcactcggcagcactgagatctggtcgatcatcaatgccggaagggcgatccatccgatccatttacatcttgttcaatttatgattctcgaccaccggccgtttgatatcgagcggtatcaggaaaacggagaacttgtttttaccggtccggcagttcctccggcaccgaatgaaaaggggctgaaagacaccgtcaaagtacccccgggttcagtgacgcgcattatcgccacctttgcgccgtacagcggcagatatgtttggcactgccacatccttgagcacgaagattacgatatgatgcgccctcttgaagtgacagatgttcgtcatcaataa

SEQ ID NO: 630 - DNA, 1008 bp, Bacillus licheniformis
ttgcagaaaagaatagagtggattgatgtttcgaaaggcgtgggaattatattggtcgtattgggccatacaccgacgccggattggctgaaaacgttcattttcgcatttcatatgccgctgtttttctttctgtccggcctcgtttaccatgatgggaatatgacttttacatcttttctcttaaaaaaaataaagacgctccttttgccgtacttcatcttctccgttcttgcctatttattctgggttctcgtcgagaggcattttacgttcaccggcagttcggatgtcgacccggttgtaccgtttaaagggattttttattcgatgcctgatgactacaagctgacacacaacccggcgctctggtttttaacatgcttattcatcgttgaaatactgtttttcatcgtgaagagatgggggaaaggcagactgtttatcgtcatagccgtattggtctcagccgctttaggctttttgaattatcaatatctcggcatcaagctgccgtggaatattgaagtggccctgaccgccatcgtcttttattcggccggttttctgttgaaaaataatctgaaagagatgagagaccgaagaatgctgctgctcacgcttcttttattcatcgcggtcggctgcttgcagaccctgaacgtcagagtggatatgagggccaatgagtacggaaacatggcgctcttttatatgacctcatttctggggacggcaggcgtcattttcagcagctttcaccttgaaaaagcaaggcttctccaattcctcggcaaaaactcgctgatcattctcgtactgcactatccggtcatcaggatgctgaaagccgtcgtctactacttcacacaggtttcccttgatgagacatacggctccctgttgtggagcgcgctttacaccggcatgacattgcttgtaatggtgccttgcatctttttgttgaaccggtatccgatcgtacttgggcggaagaaatgcaattaa

SEQ ID NO: 631 - DNA, 495 bp, Bacillus licheniformis
atgttcgcttcaagcggctcttctactcaagagagcaaatcgtccggaagcagcgcaaagacgacagccgcaaaaactagcgaagaaaaaagcaatgacgatgccaaagaaaaaactgaattcggtttaaatgaaacagctgatcttgacggcacacacatcacagttactaacgttaaaaaatcgatgggcaatgaatatttcaaaccaaacaacggtaatgaatatgtagttgcaacacttaacatagaaaataaaagcgataaagatatttcctataacccgctcgattttcaaattcaaaatgaagatggacaaattacgcacaatacgtttggaccatcagatgataacgacctatcttctggaaatctgacaccaaacggcaaggtatctggaacaatcactttcgagactaaaaagagcaaaacatataaagttatctacactcctgaattttggaatgacaaaaagattactttcaaccttaaataa

SEQ ID NO: 632 - DNA, 873 bp, Bacillus licheniformis
atggaacggtatgatgaattaaaaaaaggtgaaaccggggcatgggtcagcatcatcgcttaccttgtactgtcggctgttaaattggccgtcgggcttgcatttcactccgaagccctcagagccgacggactgaacaatacaaccgatattatcgcctcattagcggtgctgatcggcctcaggatttcgcagaagccgcctgatgaagaccatccgtacggacatttccgcgctgagacgatcgcctcgatgatcgcttcatttatcatgatggtggtcggtcttgaagtgctgtacagctcgggcgaaatgctgtttaatccgaaggaaacgacaccggacatgattgcggcctggacggctgcaggcagcgccgtcgtgatgtttttggttttcctctacaataaaaggctggcaaaaaaggtgaacagccatgccctctatgcagccgccgccgataataaatcagatgcctatgtcagcatcggaacattcgcaggcatctttgcttcgcaatttaaccttgcatgggtcgatacggcagccgcgtttatcattggattaatcatctgcaaaacggcttgggggatttttaaagaggcggcccattccttgacggacggattcgatattaaacatatttcaacctataaagaaacgatccggaaagttcccggcgtcggcaacatcaaagatgtaaaagcgcgttatttgggcagcgccatccacgtggaaattatcgtggaggtaaggtcagatctcaacattgcagaaagccatgacatcgccgatgaaatagagagaagaatgcaggaggagcactcgatcgttcattcccatgttcacatagagccttctaaagaaaaataa

SEQ ID NO: 633 - DNA, 963 bp, Bacillus licheniformis
atgtcatacgaagaaatgctgcatcccgttttgggaaaagtagctgataatattgacaaagtaatggtaggaaagaaacatattgccgttttaagcctgactgccattcttgcaaacggacacgttctgctggaagacgtacccggcgtcggaaagacgatgatggttcgcaccctggcaaaatcaacaggcgctgaatttaaaagaatccagtttacgcctgatttactgccttcagatgtaacaggggtttccatatataatccaaaaacgctggaatttgaataccgttcaggtccgattatgggggacatcatcctcgccgatgaaatcaacagaacatcgccgaaaacccagtcggcgcttctggaagcgatggaagaaggaagtgtgacagtagacggtgtgacaatgccgctctcaaagcctttttttgtgatggccacgcaaaaccctgtcgagtatgaggggacatacccgctgccggaagctcagcttgaccgctttttattcaagctgagaatgggatatccgacagtccgcgaagagcttcaagtgctcgatcttcaggaaaaccgcagccccattgaggaaattgagcctgtcatagagaaggaagagcttgccgcatttcaaaaagaagctgaaaaggtgtatgtagacgctgcgattaaagaatacattgttgggatcacccaaaaaacgaggagtcattccgccgtttatctcggggtgagtccgcgcggctcaatcgccttgatgaaggcggctcaggcgtttgcatttttatataaccgcgattatgtcattcctgatgatattcagtatttggcgccttttacccttgcgcacagaatgatcctgcggtcagaggcgaaatttgaaggaaagcggcctgaagctgtccttcaggacatcatgtcaaaaaccgaagttcccgtcggaaggccgatgagcagctga

SEQ ID NO: 634 - DNA, 1212 bp, Bacillus licheniformis
atgagagagcgcatcggtcttgtgatgtacggatggaagctgtttattctgtttcttctgtttgcttcaacgttttgctatgcgatgtttcaagggggatttgtcagctggtttctgttctactcatttctcccctttgcgctttatgctttcctgtttgctttttatccgctgaagaacttgacagcggagcggaggctgagccaagggcagtataaagccggtgatcaattggaggctttcgtcgtgctgaagagaaaatggccttttccgatcatgtttatgatcgtggaagactgcctgcctgattcgctggggaaaaacaggggttcggcagaggccaaacagcttctctttccttggtttaaaaaagaaattaaaatggcgtacacgatcgattcggttccgagaggagaccaccgtttagcaaaaatcagagtccgtacaggtgatccgctcggcctgctggaaagggaatgcgagattcaattggaagcttcctttctcgttttgccttcctatcaggagatcgcttaccgcgccagcggaggctcttatgacgagcatgcaggccgcgtttcagagcttcgccgcaaggacagtacactggcgtcaggtatcagagaatatcagccgggcgaccgttttgcatgggtcgactggaagacgtcagcccgccgcagccagctgatgacgaaggaatttgagcagacgaaaggggatgacctgctcgtctttatggatcagtccccgtctgaggcttttgaagagatcgtcacgtttaccgcttccatcattcgttcggcaatgcggagcgggacgaatgcagggcttgtttccattggtaaggagcggaatgtcttcccggttcggcagggggaagagcagctgagaaagctgttctactacttggcgattgccgactgcaatgcagtccagccgtttcacagtctgatagagggggaattgggacattccgatatgagaaaagccgtcaaatatattgtgacaagccgcatcacgatcgaactggtgcaggctttgaagaaaccgctctccggcgggcggcccgtcatttgtttggtgaagaaaaaaggcggagatctatcaagcgaggaaagcgcggctgtccagcatttaaaagcgcggggaatcgaagtaaacgtcatttacggggaacatttttcccggggtttggctgaagcgaggtga

SEQ ID NO: 635 - DNA, 2226 bp, Bacillus licheniformis
atgttgtccgggggaaaaagaaacaggttcggtttattgcttttttatgtgctgacttttttgctgctgtgggagtggctccgtcctttgcagtattttaccgatacggggcacaccgtcttttttattttatttatcgctcttgtatttttgcttacattttttaaggtcccttggtttatcagatttccggtcagccttggcttcgttctgtttgcactgcacacgattttttacgaaggatcggtgttttcaccttcatggattgccctgtttttccaggatttaaagcgaaatttctcctatattttctccggcatgtggcgggatatgtcgccgttgtttcggacgctgctcttttacgtccttctttggctgctcgtatacttgctgcactactgggtgatctatcagcgcagaattttattcttttttattatgaccgttgtttatgtcgcggtgatcgatacatttacgccgtttgacgcgtcatatgcgatcgtcaggatcgtgctgatcggctttttgcttctcggcctgctgtatttggaacggatcagggaatcagaagcgctcaaatcctcgaaatcgcggtttgccaaatggtttgcaccgctcttattgatgactgccgccgccgtgtgcatcggcgcggtctcgccaaaagccgatcccgtctggcctgatccggtgccgtttctgcagacggctgcgaccggcgattttgcttcctcaggcagaagcaaagtcggctatggaacgaatgatgaggcattgggcggtccattttcaaaagacgatacatgggtatttacatggcagggaaatgaacgaagctatttcagggtggaaacaaaaagccgctatacaggaaaaggctggattgaagacgaaaaatcaggcgcatccattcagcttgaagaggataaactggattaccagtggtacgacgaaagcgtgaagaccgaaacgcgcaaagcgatcgtcgatatcgatcccgcttaccggtacgatcatgtcctgtatccgatcgggacgaccgaaatcaagctcaataatttctttgtgccgctccgcatgaacttaaatacggagaaaataaaaccggccggcaagacaggcgcggacattcagaatctggaaagctattcggtcacctataaatcacccgtctttgatgtcgatcagctgaggaaagtcagcttggagtcggaggggaaatgggccaggagccatgagaagtacctgcagcttcccacttcccttcccgaccgcgtgaaaacattggcgcacgatttaacgaaagacgaagataatatatatgacaaagcgaaagcgattgagaagtatctcggttcttccgaattttcttatgagacggaagatgtcgctgttcctaaaggagaccaggattacgtcgatcagtttttatttgagacgaaaatcggctactgcgacaatttttccacggctatgatcgtactgctgcggtcggccggaataccggcccgctgggtgaaaggctacacatccggtgaatatgcaggaacgacggcagaccggaaacgcacgatgtacgaggtgacaaacaacaatgcccactcctgggttgaagtgtattttgaaggacaaggctgggttacgtttgaaccgacgaaaggctttttaaatcccgagcagctcgttgaagagtccagcggtcagcaagccggcgcggcttctgataaaaaagaagatgataagaaaaatgatgaaggccagcgtccgcaggatgcaaaagaacaagacaacaaagagaagcccgaatcccaggcaaagcgtgatgccaaagccgattcccatgccggaagcgatgatgcagaccgtactcttttgactggtgcggccgtactcggtctgttgctggcgtttgcagcggtgctttactatacaagggtgaaatggatgccgcacatcatcatcaacaggctgaaaaaacggcgtgatgaagcggttttctttaaagcctacgacgaactgctccgccagctgaagcgccaaggcatgcaaaaagaagaaggccagacgctgcgcgagtttgcgaagacggttgatgaacgctttcaaagcggggacatgacggctttgactcttcaatatgaacgggctttgtatcgaaaggaagacgccgctaagctttggaatgattcggcggagttatgggaaaatttaattaaaaagagatag

SEQ ID NO: 636 - DNA, 1542 bp, Bacillus licheniformis
atgacgaagttagtaaatgaaatgattcttgtgttggattttggaagtcagtacaaccagctgattacccgccgcattcgtgagtttggtgtatatagtgaattgcatcctcatacgttgacggcagaggaaatcaaaaaaatgaatccgaaaggaattattttgtccggcggtccgaacagcgtttacgacgaaggatctttccgctgcgacgaaaagattttcgaactggacatccctgttcttggaatttgctacggcatgcagctgatgacgcattaccttggcggaaaagtagaagcggcaagccagcgcgaatacggaaaagcaaacattcatatcgagggtgaaccggatctgtttaaagatcttccaaacgaacaagtcgtctggatgagtcatggtgatctagtagttgaagttccagaaggctttaccgttgatgcgacaagccatcattgcccgaactcagcaatgagcaagaaggataagaaatggtacggcgttcaatttcatccggaagtccgccattcagaatacggaaacgaccttttgaagaacttcgttttcggtgtttgtgaatgcgtcggcgaatggtcaatggaaaactttattgagattgaaatgcagaaaatccgcgaaacagtcggcgacaagcaagtactgtgcgcgttgagcggcggggttgactcctctgtcgttgcggtcttgatccataaagcgatcggcgaccagctgacttgtattttcgtagaccacgggctccttcgaaaaggtgaagcggaaggcgtgatgaaaacgttcagtgaaggcttcaacatgaacgtgatcaaagtggatgcgaaagatcgcttcctgaacaagcttaaaggcgtctcagaccctgaacaaaaacgcaaaatcatcggtaatgagtttatctacgtgtttgacgatgaagcggaaaaactgaaaggaattgacttccttgcacagggaacgctatacactgacattatcgagagcggaacagcgacggctcagacgatcaagtcgcatcacaatgtcggcggccttcctgaagacatgcagtttgaactgatcgaaccgctgaatacgctcttcaaagacgaagtgcgcgcgctcggaaccgagcttggcatccctgacgaaattgtttggcgccagccgttcccaggtccgggcctcggcatccgcgttcttggagaagtgacggaggaaaagcttgaaatcgtccgcgaatcagacgcgatcctccgcgaagaaatcgccaaagctgatcttgaaaaagatatttggcaatacttcaccgttcttcctgatatccgcagcgtcggcgtcatgggagacgcaagaacttatgactatacgatcggcattcgcgccgtgacatcgattgacggcatgacatcagactgggcgagaattccttgggatgtccttgagaaaatctcgacacggatcgtcaatgaagtgaagcacattaaccgcgtggtttacgatattacgagcaagccgcctgcaacaatcgagtgggaataa

SEQ ID NO: 637 - DNA, 1323 bp, Bacillus licheniformis
ttgaagcgttactttcagtttgaagaattgggcacaaattatcggagagaaatgatcggcggactcaccacatttttgtccatggcatatattttgatcgtcaacccgcttaccctttctctggcgtcggtggaaaatttcccggatgcattgagaatggatcaaagcgcggtctttacggcaaccgcggttgcagcagccgtcggttgttttatcatggggctgctcgcgaagtatccgatcgctctggcgcccggaatggggcttaacgcattctttgcattctcagtcatcctgaatatgcagattccttggcagacggctctttcaggcgttatggtttccggacttatttttatcgttctttcgctatccggtttaagggaaaaaattatcaattcgattccttatgagctgaaaatggctgtcggtgcggggattggcctgtttatcgctttcgtcggtttgcagggctccaaaatcgtcgtatccaacccggatacgattgtgtcgtttgggaatattcattcaggtcccgttcttttgactgttttcggactgatcatcactgtcattttaatggtattgcgcgtcaacggcggcattttcttcgggatgctgatcacggcgattgtcggcatgattttcggacagattgacgttcctgacaaaatcgtcggtgccgttcctagtcttgcgccaacatttggacaagcctttatccaccttcatgatatctttacggtgcaaatgcttgtcgtcattttaacgtttttattcgtcgacttttttgatacggccggtactttggtgggtgttgcatcacaagccggtttgatgaaggataacaaactgccgcgcgcgggaagagctttgcttgccgattcttccgcaactgtggccggagcgatccttggtacatcgacaacgaccgcttatgttgagtcaagcgccggggtagcggccggagcgagaagcggttttgcggcgattgtaaccggcgttttgttcttgctgtcgctgttcttctcgcccgtactcagcgttatcacttcacaagtgacggcgcctgctttaatcatcgtcggcgtgctgatggtggcgaatctcaacaaaatcgactggaccaaatttgagattgcggtgcccgcattcttcacgatgatcgcgatgccgctgacatatagcatcgccaccggaatcgcgatcggatttattttctacccgatcacgatgatttttaaaggcaaagcaaaagagatccatccgattatgtacggactggctgtcgtatttattctttatttcattttcttgaaatag

SEQ ID NO: 638 - DNA, 759 bp, Bacillus licheniformis
atgattgaagaacatcacaaacgaaacgaagatgatatagaacaagaacctgcttcgaggatgtcgaggaattcccggaaaaaagcgaagaagagcaaggagacgaatccgtctgcagcaaaagtcaaatcggtgatggagagtgtgattgccgctttgttccgttatttcagctttgtgctcgatattttaaagtccccggtgcgcactgcacttgattatgaccggtcttattttaagtattccgttatttcaatgacgcttttagctgttttcttttcgctcggcaacttttatcagctgcttgcgggccgggggagaattctcgggttcggcgtgtcggtgccgtttatggaagtgtttttgggtgtgtttatctactgcatggctttcatgttttggatggcggcagcgagctgggctgtatcgaattttatgctcaggtataaagcttcatttttcgatatcacggcaaagtacggctctttactggttccgtttatcgtccctgccgctctgtggatgattttcgcgattatcaacttcacggccgcgacggtgattctctcgatcgtcatctttatgggattgaccttcggcacttttacattgattcaatcaatttatgaaaaaagcgaaaaaccgcggtttgacctgatgtactgcgtgtttaccgtctttttgcttgaattggtattcgttggggcaacttggaagctggtgggcggatacttgctgtcctcgcttatccctgtataa

SEQ ID NO: 639 - DNA, 555 bp, Bacillus licheniformis
ttgcttcactcagcactattgaacggtgtgatcatggttggaattattctggttatcaatattatatatgtaacgtttttaacccttcgcatgatactgactctaaaaggccagcggtatctcgccgcttttatcgggacaatcgaaatgcttgtttacgtcgtcgggctgggtcttgttttagataatttaaatcaaatccaaaacgtgatcgcttatgcggttggatttggaatcggcatcatcgtcggcacgaagattgaagaaaagctcgctttgggctatattaccgttaacgccattacgaaagagcttgatttggatctgccgaaacagctcagggaaaaaggctacggggtcacccattgggtcgtcggcggacttgagggagacagaacggcgatgcagattttgacgccgagaaaatacgagctgcagctgtacgaaacaattaaatcaatcgattcaaaagcatttatcatttcctacgaaccgaagacgatacacggcggattctgggttaaagccgtaaagaaaaggagaattaaagaataa

SEQ ID NO: 640 - DNA, 198 bp, Bacillus licheniformis
atgacaaagccgaaaaaaaagcgctttgaagtaacggaaggcgaaacgatcgaaaccgtgttgacgaagatgcaggaagaaggctacacgccggtgcgccgaatggaggagccggtcttcaaagaaacaaaggaaaatggaacgattcaggttgttccgtgcggaagaaaaattatattcgaagggaaattactctaa

SEQ ID NO: 641 - DNA, 489 bp, Bacillus licheniformis
atgcagcctcttcttggtgttatcatgggaagcacatctgactgggaaacgatgaaacatgcctgcggcatactcgatgaactgggaattccgttcgaaaaaaaggtcgtttccgcacatcggacgcctgatttaatgtttgaatatgccgaaaaggctcgggaaagaggcttgaaagtcatcattgccggagcgggcggagccgctcacctgccgggaatggtcgcagccaaaacgacgctgcccgtcatcggtgtgccggttcagtcaaaagcgctgaacggtctcgattcgctgctttcaatcgttcaaatgccgggcggagtacccgttgcgaccgttgccatcggcaaagcgggagcggtcaacgcaggactgcttgcggcgcagattttgtcagcttttgacaaagagcttgccgaaagattggacgaacgaagggaaagcatcagacaaaccgtgttggaaagcagtgatcagcttgtataa

SEQ ID NO: 642 - DNA, 1143 bp, Bacillus licheniformis
ttgtataaacaaacgatttttccgggagcgacaatcggcattatcggaggcggacagctgggcaaaatgatggccgtcgcggccaaacaaatgggctataaaatcgcggtggttgatcctgttccttcatcaccgtgcggccaggtcgccgaccttgagattacggctagctataatgacggggaagcgatacggaagcttgccgaagcgagcgacgtgatcacttacgaattcgagaacatcgattatgacgcgctgaactggctgaaggagcacgcttaccttccgcaggggagcgagcttttgctccttacgcaaaacagggagaccgagaaaaaagcgattgcatcagcgggctgtaaagtcgcgccgtaccggatcattcacgaccgggcggaattggaagcgtccgtagcggagctcggtcttccggcggtgctgaaaacttgccgcggcgggtatgacggaaaagggcagcacgtcctgaaagaacaagcacaaatcggggaagccgcagctcttttacagcacggcacatgcattttggaaagctgggttcctttcaaaatggaattgtccgtgatcgtgacaagatcggttcacggagagacaaccgtctttccggcggcagaaaacatccataaacaaaatattttattccagagcatcgtcccggcccgggtcgatgaggcgattcaggaacaagcggcagcacttgccctcaggcttgccgaaaagcttcagcttgtcggaacactggccgttgagcttttcctgaaggaagacggcggccttctcgtcaatgaactggcgccgcggccgcataattccggccattacacccttgatctttgcgaaacgagccagtttgaacagcatattcgtgcggtctgcgggctgccgctcggtaaaacggatcttctgaaggaagggatgatggtgaaccttctcggggacgaagtgtacatggctgaagaagatcccgaacttttaaaagaagcgaagctttatatatacggaaagcatgaagtcaaaccaggccgcaaaatggggcacatcacatttttaagaacacccgacaatgaatggatcgggcagatgacagaaaagtggattgaaagagatggaggacgaaaacaatga

SEQ ID NO: 643 - DNA, 1296 bp, Bacillus licheniformis
atgatcgaacgttattcaagaccggaaatggctgcgatttggacagatgaaaacagattccaagcatggcttgaagttgaaatactggcttgtgaagcttgggctgagctcggcgtcattccgaaagaagatgtgaaggttttaagggaaaaagcgtcatttgacatcaaccgcatcttcgaaatcgagcaggacacgcgccatgatgtcgtcgcatttacccgcgccgtatcggaaacgcttggcgaagagaaaaaatgggtgcactacggactgacatcaacagatgtggtcgataccgctctttcttatctattaaaacaggcgaacgagattttgctcaaggacattgagaggtttattgacatcttgaaagaaaaagcaaaggaacataaatatacggtgatgatggggcgcacacacggcgtgcatgcagaaccgacgacattcggcttaaagctcgccctttggtatgaagagatgaagcgcaacctggaacgcttcaagcaagcgaaagaaggcatcgaagtcggtaaaatctcaggcgccgtcggaacgtacgcgaacatcgatccattcgtcgagcagtacgtatgtgagaagctcggcttaaaagctgcgccgatctcaacgcagacgctgcagcgcgaccgccacgccgattacatggctgcactggcgcttgttgcgacaagcatcgagaaattcgccgttgagatccgcggcctccaaaaaagcgaaacacgcgaggtcgaagaatttttcgcaaaaggccaaaaaggttcatctgccatgccgcataaacgcaacccgatcggttcggaaaacatgacgggaatggcgcgcgtcatccgcggctacatgctgaccgcttatgaaaatgtaccgctttggcatgaacgcgacatttcgcattcatcagcagagcgcatcattctgcctgatgcgacgatcgcgctgaattacatgctgaaccgcttcggcaacattgtgaaaaacttgaccgtgttccctgaaaacatgaagcgcaacatggaccgcacactcggattgatctactcccagcgcgtccttctcgctctcattgataccggcatggcgcgcgaagaagcgtatgacaccgttcagccgaaagcaatggaagcatgggagaaacaagtgccgttccgccagcttgtcgaggctgaggaaaaaattacgtcccgactgtctccggaacaaattaacgactgctttgattacaattaccacttgaaaaatgtcgactacatttttgaacgtttaggcttggcatag

SEQ ID NO: 644 - DNA, 717 bp, Bacillus licheniformis
gtgaatattgtgaaaaatgaacttttatacgaaggaaaagcgaaaaagatttaccggacggatgatgacaacactttgtttgtcgaatacaaaaactcagcgacggcttttaacggagaaaaaaaagccgagattgacggaaaaggccgtttaaataacgaaatttccagcctgattttcacaaggcttcacgagaagggaatcaacaaccactttgttgaacgaatttctgaaacggagcagctcattaaaaaagtgacgatcatcccgcttgaagtcgttgtccgcaatgtcgttgccggaagcatgtccaaaaggctcggcattccggaaggcacggagctggggcagccgattatcgagttttactacaaggatgacgcgctcggtgatccgttgatcacagaagaccatatccggattttaaaagcagctgagcctgaacaggtggagaaaatcaaatcgattacgagacaggtaaacgaagagctgcagacgattttcgcggcttgcgatgtcagattgatagatttcaagcttgagttcgggctcgataaagacggcgaggtcctgctggccgatgagatttccccggatacgtgccggctgtgggatcaagaaacgaatgaaaagcttgataaagatgtgttcagaagaaatctgggcggattgacggatgcatacgaagaaatattcaaaagacttggaggcatgtaa

SEQ ID NO: 645 - DNA, 255 bp, Bacillus licheniformis
atgtacaaagtgaaagtgtatgtcagcttaaaagagagtgttttagatcctcaggggagcgccgttcagcatgctttgcacagcatgtcctacaaagaagttcaggacgtccgcatcggcaaatacatggagctcacaatcgaaaaatcggaccgcgaccttgacgttctcgtcaaagaaatgtgcgaaaaacttttggccaacacggtgattgaagattacagatacgaagtcgaggaggttgtcgcacagtga

SEQ ID NO: 646 - DNA, 684 bp, Bacillus licheniformis
gtgaaatttgcggtgattgtgctgcctggctcaaactgcgatatcgatatgttccacgcgattaaggatgagcttggcgaagaagctgaatacgtctggcatacagaaacaagtcttgatgaatatgacggcgtcctcattccgggaggattctcatacggtgattatttaagatgcggcgcgatcgcccgcttcgcaaatattatgccggccgtcaaaaaagcggctgaagaagggaagccggtgctcggcgtctgcaacggatttcaaattttgcaggagctcggtcttttgccgggcgcaatgagacgcaacaaagatttgaaatttatctgccgtccggttgaactgatcgtccaaaacaatgaaacgctttttacatcttcctacggcaaaggcgaatccatcacgattccggtcgctcacggcgaaggaaacttctactgtgatgaagaaacgcttgccggattacaagaaaacaatcaaatcgctttcacatacggaacggatatcaacggaagcgtcgccgatattgcaggcgtcgtcaatgaaaaaggcaatgtattaggcatgatgcctcacccagaacgcgcagtcgattctctgctcggaagcgccgacggtcttaaactgtttcaatctatcgtgaaaaattggagggaaactcatgtcgctactgcttga

SEQ ID NO: 647 - DNA, 2229 bp, Bacillus licheniformis
atgtcgctactgcttgaaccaagtcaagaacaaattaaggaagagaaactttatcagcaaatgggtgtcagcgatgacgagtttgccatgattgaatcgattctcggaaggcttccaaactatacggaaatcgggattttttcagtcatgtggtcagagcactgcagctacaaaaattccaagccgatcctgaaaaagttcccgacaaaaggcgaacgcgtcctgcaaggaccgggggaaggcgcaggaatcgtcgatatcggcgacaatcaggcggttgtcttcaaaatcgaatcgcacaaccatccgtcagcgattgagccttatcagggagctgcaacgggtgtgggcggcatcatccgcgacgtcttttcaatgggcgcgcgtcccatcgctgttttgaactctctccggtttggcgaactcacttcaccgcgtgtgaagtacttgtttgaagaagtagtcgcgggcattgccggatacggaaactgcatcggcattccgaccgttggcggggaagttcagtttgacggctgctatgaaggcaatccgcttgtcaacgcgatgtgtgtcggtttaatcaaccatgaagatattaaaaaagggcaggcgaaaggcgtcggcaataccgtcatgtacgtcggcgcgaaaacggggcgcgacggcatccacggcgcaacgttcgcctcagaggaaatgtctgaccaatcagaagaaaagcgctcggccgttcaagtcggcgatccgttcatggagaagctgcttcttgaagcgtgtctggaagtcatcaaatctgacgctttggtcggtattcaggacatgggtgcggcaggcctgacaagttcaagcgcggaaatggcatccaaagccgggtctgggatcgagatgaaccttgacttgattccgcagcgcgaaacaggcatgacgccgtacgaaatgatgctttcggaatcccaggagcgcatgcttttggttatcgaacgcggccgcgaacaggaaatcatcgatatttttgacaagtacgatcttgaagccgttgctgtcggccatgtgactgatgacaagatgctgcgccttttccataacggagaaatggttgccgagcttccggtcgatgctcttgcagaggaagcgcctgtttaccataagccgtcaaaagtaccggattattacaaagagttccttgaaacagacgtccctgcaccaaaagtcgaagatgcgaaagaaacgcttctcgagctgctaaagcagccgaccattgcgagcaaagaatgggtttatgaccaatatgactacatggtcaggacgaacacggttgtcgcaccgggctctgatgcagccgtcctcaggattcgcggcacgaaaaaagcgctcgccatgacaacggactgcaatgcccgctacttgtaccttgatccggaaacaggcgggaaaatcgccgtcgcagaagcggcccgcaatatcgtctgctccggagcagaaccgcttgccgttacggataacctcaactttggaaatccggaaaagccggagatcttctggcagatcgaaaaagcggcagacgggatcagcgaggcgtgcaacgtgctcagcacaccggtcatcggcggaaacgtctctctctacaacgaatcaaacggaagcgcgatctacccgacgcctgtcatcggaatggtcggactgatcgaagatacggagcatattacgacacagcactttaaagcagcgggcgatttgatttatgtcatcggcgaaacattccctgagttcgccggaagcgagctgcaaaaactgaccgaaggaaagatttacggcaaagcgcctgcgattgacctggaagtcgaacaatcgcgtcaaaaagctcttctgaaagcgatccgctccggactcgttcaatcggcgcatgacgtctcagaaggcggcatcggcgtggcgctggcggaaagcgttatatcttctcaaaggctcggcgcccatgtgacgcttgcaggcgaacctgcattgttattcagcgaaacacaatcacggtttatcgtctctgtgaaaaaagaccatcaagaagcgttcgaaaagcttgtcaaagacgccgatctaatcggtgaagtaacgtcagacagcgtgctggctgttcaaagccaggaaggacaacaatggattcatgcgcagacagaagagctcgaaagcgcatggaaaggagctatcccatgcttgctgaaatcaaaggcttaa

SEQ ID NO: 648 - DNA, 1431 bp, Bacillus licheniformis
atgcttgctgaaatcaaaggcttaaatgaagaatgcggcgtatttgggatttgggggcatgaagaagcaccgcaaattacgtactacggccttcacagccttcagcacagaggccaggagggcgccggcatcgtcgcgacagacggcgaaaaaatgtccgcccacaaaggccaggggctgattaccgaagtttttcaaaacggtgagctcaaaaaggtgaaaggaaagggagcgatcggccacgtccgctatgcaacggcgggcggcggcggcttcgaaaacgtccagccgttccttttccattcgcaaaacaacggcagccttgcgcttgcgcacaatggaaacttagtgaacgccactcagctaaaacagcagcttgaaaaccagggcagcatttttcaaacgtcttcagatacggaagtgctcgcccatttaattaaaagaagcggccacttcgagctgaaagatcaaatcaaaaacgctctttctatgctgaaaggcgcttatgctttcctgatcatgacggaaaaggaaatgatcgtggcgcatgatccgaacggactcagaccgctatctgtcgcaatgcttggcgacgcgtacgtcgtcgcttctgaaacgtgcgcatttgatgtggtcggcgcgacatatctgcgcgatgtagaaccgggcgagatgctgatcatcaatgatgaaggcatgaagtcagagcggttctccatcaacatcaaccgttcgatctgcagcatggagtacatttatttctcaagacctgacagcaatattaacggcattaacgtccacagcgcgagaaagaatctcggcaaaaagctcgccgaggaatcaggcattgaagcagatgtggtgacaggcgttcctgactcaagcatttcagcggcgatcggctatgccgaagcgacgggaattccttacgaactcggattgatcaaaaaccgctatgtcggcagaacgttcattcagccgtcacagtcgctcagggagcagggcgtgagaatgaagctgtcagccgtccgcggggtcgttgaaggaaagcgcgtcgtcatggtggacgattcaatcgtgaggggcacgacgagccgcaggattgtgacgatgctgcgcgaagccggagcgacggaagtgcacgtcagaatcagttccccgcctattgcccatccgtgcttttacggaattgacacatcgacgcacgaagaactgatcgcgtcctctcattcagtggaagaaatccgtcaggaaatcggcgccgatacattgtcattcttgagcattgaaggactcctttccgggatcggaagacagtatgaaggtgaaaactgcggccagtgcatggcctgttttacaggaaaatatccgaccgaaatttatcaggatactgttcttcctcacgtgaaagaaatcgttttgacaaaataa

SEQ ID NO: 649 - DNA, 1041 bp, Bacillus licheniformis
ttgtctgaaagctataaaaacgccggggttgatattgaagccggatatgaagccgtaaaacgaatgaaaaaacatgtggaaagaacgaagcgaatcggcgcaatgggcggacttggcgggtttggcggcatgtttgacctgtcggaactgccgtacaaacagccggttctcatttcgggaacggacggtgtcggcacaaaactgaagctcgcttttgcgatggacaagcatgacacgatcggcatcgatgccgtcgcgatgtgtgtcaacgatgtgctcgctcaaggagcggagccgcttttcttcctcgattaccttgcggtcggaaaagccgatcccgtcaaaattgaagagatcgtaaaaggcgtcgcagaaggctgcgtacagtcgggatcagcgcttgtcggcggagaaacggcggaaatgccggggctttatacagaggatgaatacgatatcgccgggttctcggtcggagctgccgaaaaagatggcatcgtcacgggcgaaaatatcagcgaagggcaccttttaatcggactttcttcaagcggccttcacagcaacggcttctctctcgttcggaaagttcttcttgaagatgccggtctgaaccttgatgagacgtatgcaccttttgaacggcctcttggcgaagagcttttagagccgacgaaaatctatgtcaagcctgtccttgaagcggtgaaatcaggcaaaatcgccggcatggcgcacgtgaccggcggcggttttatcgaaaacctgccgcgcatgatgcccgatggcctcggcgttgaaatcgacatcggctcctggcccgttcctcctatcttcccgttcattcaggagaaaggcggcctgaaatccgaggaaatgtttaatgttttcaatatgggaatcggctttgttcttgcggtgaaagaagaggatatgacagacgtgatccaaacgctcgaaaacaacggtgaaaaagcctatctcatcggcagagtgaaagccggaagcggcgttgtgtttggcggtgccggtctttcatga

SEQ ID NO: 650 - DNA, 588 bp, Bacillus licheniformis
atgaaaaaattcgcggtatttgcatcaggaagcggaacgaattttgaagcaatcgaaagaagaatgagagaagagaactgggatgccgaaattgtcctcgtcgtctgtgacaagcccgatgcgaaagtgcttgaaagggcggaaaaagccggaatcccgtcgttcgccttccagccgaaatcgttcgacaataaagctgcatttgaacaagtgatcgttgaacagctccgccttcacggagcggaatggattgtgctggcggggtatatgaggctgatcggcgatacgcttctttcggcttaccggaataaaatcatcaacatccatccgtcgctcctgccggcgtttcccggcatcgacgcggtcggacaagcgtacagagcaggcgtgaaagtggcaggcatcacggttcactacgttgacgaaggcatggacaccggtccgattatcgcccagcgcgccgttgagcttgaaaaaagcgaaacactcgcgtctcttgaagaaaagatacacaaattggagcatgaactttatcccgaagtaatcaaagagcttcttgaactaaatggcagaggtgaaaaggaatga

SEQ ID NO: 651 - DNA, 1539 bp, Bacillus licheniformis
atgacgatcaaacgcgcattaatcagcgtatctgataaaacgaacattgtcccttttgtaaaagaattgacagagcttggcgttgaagtgatttcaacagggggcacaagcaaacttcttcaggaaaacggcgttgacgtcatcggcatttctgaagtgacgggctttcccgaaatcatggacggccgtctgaaaacccttcatccgaatattcacggcgggcttcttgccgtacgcggcaacgaaaagcacatggcgcagctgaatgagcagggtatccagccaatcgaccttgtcgttgtcaatttatatccttttaaagaaacggtttctaaagaagatgtcacattcgaagaagcgattgagaatatcgacatcggcggccccggcatgcttcgcgctgcagcgaaaaaccaccaggacgtggcggtcatcgtcgatccccgcgattacagccctgtgctgaacgacttgaaagaaaacggcagcgtctctcttgagaaaaaacgcgagcttgcggcgaaggtgttccgccacacggcagcatatgacgcgttgatcgctgactatttaacaaatgtaaccggtgaaaaagagcctgaacagttcaccgtcacttttgagaaaaaacaatcgctccgctacggcgaaaatccgcatcaggaagcagtcttttatcaaagcgcgctccctgtcaaagggtcgatcgcttcagctgaacagctgcacggaaaagagctttcctacaacaacatcaaagacgcggatgcggcacttcaaattgtccgcgagttcaccgagccggctgcggttgccgtcaagcatatgaacccttgcggcgtcgggacgggcaacacgatcgaagaggcgtttaacaaagcatacgccgctgacgaaacatcgattttcggcggcatcatcgccctgaaccgcgaagtggacaaagcgactgctgaaacgcttcacaaaatctttttggaaatcattatcgcgccggcattcagccaagaagcgcttgatattttaacatccaagaaaaaccttcgcctcttgaccctcgatgtcaatcagcctgtgaaaaacgaaaaacagctgacatctgttcaaggcgggctcttgattcaggatctggatatgcacggctttgacgacgctgacattacgattccgacgaaaagggagccgaccgaacaggaatgggctgacctgaagcttgcttggaaagtcgtgaagcacgtcaaatcgaatgcgattgtcctggcaaaggacgatatgacgatcggcgtcggcgccgggcaaatgaaccgcgtcggctcggcgaaaatcgcaattgagcaagccggggagaaagcaaaaggaagcgcgctcggatcagatgccttctttccgatgcctgatacggtcgaagaagcggctaaagccggtgtgacggcaatcattcagccgggcggctcggttcgtgatgaagattcaattaaaaaagcggatgaatacgggatcgcgatggtgttcaccggaatccgccatttcaaacattaa

SEQ ID NO: 652 - DNA, 1269 bp, Bacillus licheniformis
gtgaacgtattgattatcggcagaggcggcagggagcacacgctcgcctggaaagcggcgcaaagccctcttgtcggcactgtatatgcggcgcccggcaatgacggaatggccgggaccgccgtactcgttgatcttgacgaaggcaatcacgaagggcttctcgctttcgcaaaggaaaacaatatcggactgacgatcgtcggtcctgaggtccctttaatcgaagggcttgttgatgcatttgaagaagcgggccttccggtgtttggaccgtcgaaaaatgcagctgtgattgaaggaagcaagcagtttgccaaggatcttatgaaaaaataccagattccgacagcagaatacgaaacgtttacatcttttgaaaacgcaaaggcgtatgttgaggaaaaaggcgctccaatcgttattaaagccgacgggcttgccgccggaaaaggcgtcacagtcgcgatgacagccgaagaagcggttcagtgtctgcatgactttttagaagatgaaaagttcggcgaagcaagcgcatctgtcgtcatcgaggaatttttgagcggtgaagaattttcgctgatggcttttgtcaaaggtgagaaagtgtatccgatggtgattgcacaggatcacaagcgggcatttgacggagacaagggcccgaatacagggggaatgggcgcgtattctccggtgccgcagatttcggatgcggtcgtcgaagacgccgttaaaacgattttggagccggcggccgaagcgatggttaaagaaggccgttcgtttacgggagtcttgtatgccgggttaatgctgaccgaaaaaggaacaaaagtgatcgaattcaacgcgagattcggggatcccgaaacccaggtcgtcctgccgcgtcttgaatcagaccttgtccaggtcttggttgatctcctcgcagacagagaagtggagctgaagtggaaggatacggcggcagtcaccgttgttcttgcatctgacggctatccggaaagctatgaaaaaggcgcgccgatcggcacgcttgagcctgacatggagcagaccgtcgtctttcacgcaggcacgaaaaaaagcggcgatcagtttgtgacgaacggcggccgcgtcgccaatgtcaccgcgtttgcagagacgtttgatgcggcaagggaagcagcctatcaagcggtggatcgagtaagaaaaccggggctgttttaccggatggacatcggctcgcgtgcgctcaaggcagcacagaaataa

SEQ ID NO: 653 - DNA, 600 bp, Bacillus licheniformis
gtgattgaggaggcggctgaattggctgacagctaccgcggggacaagcggatcacaaaatcgaaaacaaacttaaaaaaagccttgtttgaactgcttgctgaaaaagaatggggaaaaatctctgtgcaggatattacgcaacgggcaaacttgaatcgaacgacattttatcagcattatcaagataaatacgatttgcttcatcaacatatgagggatatgtttgaggcgatgaaagaggatattttttcgccgcttgatatagatagcagcgggaaaaagccagaagcgtactggtatgtgctgcgcttttatcatcatttgcaacagaacagcggcgattttgcgattatcatcaacagaagatatgagctgaacattaaggagctgctcaatgatttttggaatgacagctttttgacgggaatcaaaaaaacggcagctgctgatactgaccgctcagtgcctctcgacattcagcggcggtttgtgatttccgcctttgcgggcacagccgcatggtggcttgaaaacggcatgccttatccgcccgaattgatggctgaatcgatgatcaagatcatccaaaaaaattga

SEQ ID NO: 654 - DNA, 1224 bp, Bacillus licheniformis
atgagtcaaacaaaacagcagaaccccattcagaaagcgctgattaacggaaagaacagacaagacccgtatgatccgtttccgtggtataaaaaaatgcgcaccgaatcaccgattcactatgatgaagacagcaaagtgtggagtgtgttccgctatgacgatgtcaaaagagtgatcagcgacaaagactttttttcaaatcaattccctcagcttggaactggcaatacgtttgcgaaaacgatgatcagcatggatccgccgaaacacacgagaatcagatcgatcgtcaacaaggcttttacaccgcgcgtcatgaaggagtgggagccgcgcattcgcgaactgacgaatcaattgctcgctgatgtccgcggcagggaagagatcgaccttgtacaggatttttcatatccgttgcccgtaatcgtcatttcggaattgctcggcgttcctttggtgtataagcatcatttcaaagaatggtccgacctgttggtcagcctgccgaagagcgatcggccggaagatgtgaacgagtggaaaaacatcagggaccaaggcgaagaagagctgaccgcattctttgaaaagatgattgaagagaaaagacaaaacctcggcaatgacctgatttcgcttttgatcaaagccgaacaagaaggggacaagctgtcccctgatgaattggttccattttgcaatctgctcttgatggcggggaatgaaacgacgacgaatttagtttcaaatgcggtctacagcattctcgaaacaccgggcgtgtatgacgagctcgccaggcatcctgaactgattccgcaggcagtcgaggaagccgtccgtttccgggcgccagcgccgatgattgtgcgcttcgttaaacaggataccgagatcagaggagtaagcttgaaaaaaggagaaggtgtgatcgctttccttgcttctgccaaccgtgatgaaacgaaatttgagagggcgcacgaatttgatattcaccgccatccgaacccgcatatcggatttgggcacggcatccacttttgtttgggcgccccgctcgcaaggctggaagcggcgatcgccattgaggcgctcttaaagcagtatgcctcgatggaaaagcttgcggtcgtgccgatggccgacagcagcatgtacggcttgaaacatttccgtctgcgggtgaagtcagcaggggaaacggcgcctaactaa

SEQ ID NO: 655 - DNA, 111 bp, Bacillus licheniformis
gtgtctaagctcgggaaatggctgaagcgtgaattggtgaagaaaggtctgcctttggcgaaagaaaaattaattccgattttgaaagaaaaaatgaaaaagaaacgataa

SEQ ID NO: 656 - DNA, 447 bp, Bacillus licheniformis
atgaaaagaattcttatagttcttgccggaattggccttttaggtgcgggcggatgcggaatgcttgatcaggtgaatgacggattgaactatacaaatgaagcggccggctatatccaaaaagtgaagacatttgcggaggaggcgccttccttggctgaacaggctgtaaacgacacgggtgcaaaagaaaagctggaaactcagcttgagtctatccagcaggctgcagccgattttaatgaattaacccctcctgatgccgcagccgaggttcataacaccatcgagaagcataatgaaacactgcaaaaaagcgctgaggatgttttgaaaagtgttgaggaaggaaaattaacagtcgagaagctggagcagtcagaattggtgcaaagcgctcagcagatcagcgatgtgatgggccagattgaaaaattgaccgaatag

SEQ ID NO: 657 - DNA, 417 bp, Bacillus licheniformis
atgttgcccaagcactcaaaagatcagcgtaaacagcttgaagtcgttgccttaagtgaacttgtccctgaagatcaactggtcaggaagatggaagaagccatggatttttcatttatttatgaaaaagttgcccctctttattcttcaaaagcacgtccaagcattgatcccgttgtattgatcaaaatggttctgattcaatacgtgtttgggcatcgctccatgcgcgaaaccatcgaacgggtttttgcggatttaaaacacaagcgtggcctgcgctggacaaccctgcggggaaagaaaaaattgtccatgcaggcgatgcttgttttcgctgccatgaatctaaaaaactggcgaattggacgtggaaaggccctaatcgccagccttttcatcgaaaaaacaaaataa

SEQ ID NO: 658 - DNA, 231 bp, Bacillus licheniformis
atgaagcaaaacatcggactgtttgacgccgtttttcgcattgcctgcggactgacgatcctgtcggcggcagcggcaaagtttacgagaaaaccgtggtgcagaatgacgcttttctgcatgtttatgggggcgatgaaggccgcttccggcattttacgattttgtcccatgacatatgtttgccaaacgtatatgaagcaacagggagagactggcgaacaatcataa

SEQ ID NO: 659 - DNA, 1740 bp, Bacillus licheniformis
atgtccgaacgcaccttaatttggaaaaacaagcacatcagatcgcaagttgatgttgtaagttcaaggctgcagccaacgctccttttacgaaatgcatctgtactgaacccgtatgtaaagcaatggattccagcaaacgtatggattcatcatgacagaatcgtttatgtcggccgtgacttgccgaagacggctgttaaaactacaatagattgtgaaggaaaatacattgtacccgggtatattgagccgcatgtacatccttttcaaatttataatccccaaactttggccgaatatgtgtcacagtttggaacgaccacattcgtaaatgacaacttgtttctgcttttacattgcggaaaaaagaaagcgttttctatactggaggaactgaaaaaacagcctgtccactactattggtggtcaaggtatgacttgcagaccgaagtgttgaatgaagatcaaatcttatcgatcgattaccgaaaacattggggagaacacccggatgtcatccagggaggagaaatgacaggctggccgcgccttttggacggcgatgatctgatccttcattgcatgcagtgcacgaaaagaaggagaaagcggatcgagggccattttccgggggcatcggaaaaaacgctgacgaagatgaagcttttcggcgctgacgccgatcatgaagccatgactggaaaggaagtgctgaagcggcttgaacttggttaccacgtcggcttgaggcagtcttccatccgccctgatttgcgaaaaattttgcgcgagctgcacgaagaaggctttcaccattatgaccatatgttttatacaacggacggcgcaacgccgaacttttataaagaaggcatgacaaacaagctgattgaaatcgccatcgaagagggcgtgccgctgatcgacgcctataatatggcttcgtttaatatcgcgaagtattaccatatggaggacatccttggggtggttgcaccgggcagatacgcgacgctcaacattttgaatagccctgatgaaccgaatccggagacggttttggcaaaaggtcggctgatcaaatcaggcggcataaatatgaatgcgttttcagttccggattggcaaaaagggggtcttgtccctctgaacctttcatatgatctaacgatggatgatttgcagttttccatgccgctcggcttgaaaatgaggaattccgtcattatggagccttatacgattgagattgacaactctgtgaaccagctttcttttgatcatgatgaaagctatctctcgctgttcgacaaatacggaaagtggcgtgtcaatacgatgctgaaaggctttgcaacccgcatccaaggtttcgtcagctcctattcgacaacgggagacattatcgcgatcggcaaaaacaaggaagacatgcttttggccttcaaacggatgaaagaaatcggaggaggtatcgtattagcggaaaacggaaaaattctgcacgaaattcctcttcatttaagcggcggcgcatcaattgagacgtatgaaaaggtgcttgaaagggaaaaagcgttaaaagagcttctgtttgaaagaggctatacgttcgacgacccgatctacaccctgctctttttgcaaagcacccatctgccttatatcagggtgacgccgaaagggatctttgatgtgatgaaaaaaactgtactctttccatcgataatgcgttaa

SEQ ID NO: 660 - DNA, 990 bp, Bacillus licheniformis
atggtgaatcgatatgtaagagtactgctttgttttgcttcgcttttactgcttgcatcgtgccagtcgcaggaacagcaggaaaaggaaaagaacattcatccgctgacagggttgaaggcggacggagatattcggcagcggcccattgccgttgtggtgaacaatcattcaaaagcaaggccgcagtcgggattaagcaaggctgacattgtcattgaagctctcagtgaaggaccgatcacacgattgttggcgatctatcaaagcgatatgcctgaagcggttggcccagtccgcagcgcccgggagtatttcattgatttggctctcggttttgacagcatccttgtgcatcacggctggagtccgggggcaaaagaccgcctgttgaacggcgacgccgatcatatcaatggaatggatcacgacgggaccctgttttggagagccgattttcgggaagcgccgcataattcgtacacatcatacaaaaacgtaaagcaagcagcagatgacaaaggatatgccatcgaaacccgcacagaaccgctcacttttaaagcaagccctgataaaccttcggatgcgctttattctatacggttagattatggaacaaaatccgttacaaaccgtgtcgaatatggttatgataaaaaggttgaaggctatgtgagaaagtcagacggcgttttgacaacagaccttgaaacagaagaaccggttgttcttcaaaacattctaatagcggaagccgaacatcatatgaaagatgcgtacgggagaagggatattgaccttcgttcaggcggaaaaggactccttctgcaaaacggggaagtccatcggatcagctggaagaacgaaaacggccggatcataccgacggcggacggcaaaaccgttccgttcgtgccgggaaaaacgtggatcaatatcgttcccgatctcagcaaggtttctattagcaaaggagaaggtgtgtaa

SEQ ID NO: 661 - DNA, 312 bp, Bacillus licheniformis
atgcagatcgataaattgcgcgggagagagctggaccagctttttcaatccatactatcactaaaagatctcgaagaatgctatcgttttttcgatgatttatgcacaataaatgaaattcaatcattggctcagcggctcgaagtagccagaatgctgcgcgacggcaacacgtatcataaaattgagacggaaaccggagcgagcaccgcgaccatttccagggtaaagcgctgcctgaactacggaaatgacgcttatatcatggcgctggaccgcgtcaaagcaaatcaatctgaatcatcttcatga

SEQ ID NO: 662 - DNA, 687 bp, Bacillus licheniformis
atgtacgatattaccgagtggaagcacgtctttaaactcgatccgaataaagatattacggatgatcagcttgaacagctgtgcgaatccggaacagacgcggttttgatcggcggaagcgaccatgtcacagaagatgacgtccttcggctgatgtcaaaggtgcgccgctttttagtgccgtgcgttcttgaagtatcgacgatcgatgcgatcgtcccggggtttgacctctattttattccgactgtgctcaacagcagggatacagactggattgccggcttacataaaaaggcgatgaaagaatacggcgagctgatgtcgccggaagagattgttgttgaagggtactgtattttgaatcaggactgcaaggctgccgctttgacgaacgcagataccgagcttgacattgaggatattaaagcgtacgcccgcgtagctgaacatcttttccgccttccggtcttttatcttgaatacagcggcatgctgggtgattcagagaccgttaaggaaacgaaagccgtgcttcaggaaacgacgctgttttacggcggcggcatcaaagatgcggagacggcggttaaaatggctgaacacgccgatgtgatcgtagtcggaaacgcgatttatgagaacttcgaagaagcgctgaaaacggtacaggccgtaaaaggatga

SEQ ID NO: 663 - DNA, 2220 bp, Bacillus licheniformis
ttgaattacattagcgaccaattattaagcggattgaacaagatgcagcaggaagcggtcaaaacgacggacggtccgcttttgatcatggcaggagcaggaagcggaaagacgcgggtattgacgcaccgcattgcgtatttaatggcggagaagcgcgttgccccgtggaacatactggcgattacatttacgaacaaagcggccagagaaatgaaagaacgtgtggaaagcattctcggaccgggagcggatgacatctggatttcgacgttccacagcatgtgcgtcagaattttgcggagagacatcgacagaatcggcatcaaccggaatttctcgattcttgatacgtctgaccagctttccgtcattaaaggaatcctgaaagaaagaaacatcgatccgaaaaaattcgatccgagaagcatactaggatcgatcagcagtgcgaaaaacgagttgatcgccccggaagaatacgagaaaacagccggcggtttttttgaacaagtcgtcagcgatgtctacaaagattatcagaagaaactgcggaaaaaccagtcgctcgattttgacgatttgattatgacgacgattgtcctgtttgaccgggtgccggaagtgcttgaatactaccagcggaaattccaatacattcatgtcgatgagtatcaggatacgaacagggcgcagtatttgctcgtcaaaaaaatggcgcagcgcttccaaaacatctgcgttgtcggggactccgaccagtcgatctacagatggcgcggagcggatatcgccaacatcctgtcgtttgaaaaagactatccgaatgcgagcgtcattctgctcgaacaaaactacagatcgacaaagcggatattgaacgcggccaatgaagtgattcagaacaactcaaacagaaagccgaaaaacctctggaccgaaaatgacgaaggggcgaaaatctcctacttcagaggcgacaacgaatttggcgaaggccaatttgtcgcgggcaaaatcagggagctcgtcggctctggaaaacgatccttctcagatatcgcgattttgtaccggacgaacgcccagtcgcgggtcattgaggaaacgctgatgaaggcgaacatcaactacaacatcgtcggcggcacgaagttctatgacagaaaagaaatcaaggacatcctcgcgtatttgcgcctcgtcgcaaaccctgacgacgatatcagctttgcgcggatcgtgaacgtcccgaagcgcggcgtcggtgcgacttcagtcgataaaatcgcggcctatgccgacatgaacggtatgtctttatttgaagcgctcggccaggttgactttatcggcctcagtgctagagcggccaacgcgcttgatgagttcagacagacgatcgaaaacctgacgaatatgcaggaatacttatccgtcacagagcttacggaagaaatccttgaaaaaaccgaataccgcgaaatgctgaaagcggaaaaatccttggaggcgcagagccgccttgagaatatcgacgaatttctctccgtaacgaaaaactttgagcagcaaagcgaagacaaatcgctcgtcgcttttttgaccgatttggcgctcatcgccgatatcgatcagcttgatcagaaggaagaagagaccggaaatcaagacgcggtcatcttaatgacgcttcatgctgcaaaaggactcgaattcccggtcgtgttcctgatggggcttgaagaaggagtgttcccgcacagccgctccctgatggaggaagcggagatggaagaagagcggagactcgcgtacgtcggcatcacgagggctgaggaagaactttatttaacgaacgcgcggatgcggacgttgttcggaagaacgaatatgaacccggaatcaaggttcattgcggaaataccggaggaattattggacaatctaaacgagaagaaaaaagatctgaaaacgccgtttggaagaaagcccgagcggagaggccccgttacccgtccggctgcatcgtacagcaaaaccggcggcgacggcgtcaattgggcagtcggcgacaaagcctcccataaaaaatggggcgtcggaaccgttgtcagcgtcaagggatccggcgaatcgacagagcttgacatcgcctttccgagcccgaccggagtgaagcgtcttctcgcggcctttgcgccaattgaaaagcaataa

SEQ ID NO: 664 - DNA, 2004 bp, Bacillus licheniformis
atggaaaaagaagcagctaaacgccgtgtggaacaactgcatgcattgattaacaaatacaactacgaatatcacacccttgacgatccaagcgtgcctgattccgaatatgacaagctgatgaaagagctgattgctcttgaagaagagcatcccgacctgaaaacgccggactctccttctcagcgcgtcggcggagccgttttggacgcctttcaaaaagtgcagcacaaaacgccgatgctgagcctcggcaacgcgtttaatgaagaagatctgcgcgactttgaccgccgcgtccgccaggcggtcggagacgttgaatacaacgtcgagtttaaaatagacggtcttgctgtttcactgcgctatgaaaacggcgtatttgtcagaggtgcgacgagaggcgacggtacgacgggcgaggatattacggaaaatttgaaaaccatcagaaacattcccctcagaatgaaacgcgatctttctattgaagtgcgcggcgaagcttttatgccgaagcgctcctttgaactgctgaacaaagcgcggatcgaacgtgatgaagagccgttcgccaacccgcggaacgccgctgccggttcattaaggcagctcgatccgaaaattgccgcgaaacgaaatctcgatatcttcgtctacagtatagcggagcttgatgaaatgggcgttgaaacgcaaagccagggactcgatttcctcgacgaactcggcttcaaaaccaatcatgaaagaaaaaaatgcagcacgatcgaagaagtcattgagattgtcgaagagctcaagacaaaacgcgccgacctcccgtatgaaatcgacgggatcgtcattaaagtcgattcccttgaccagcaggaagagctcggctttacggcgaaaagcccgcgctgggcgatcgcctacaagtttcctgccgaagaggttgttacgacgcttttggacattgaattaagcgtcggccggacgggcgcagtgaccccgactgcgattctcgaacctgtaaaagtggcgggaacgaccgtccaaagagcttctctccacaacgaagatttaattaaagagaaggatatcagactgctggacaaagtcgtcgtcaaaaaggcgggagacatcattccggaggtcgtcaacgtcctcgtcgaacagcggacgggcaaagaaaaagaattcaacatgccgaaggaatgcccggaatgcggaagcgagcttgtcagaatcgaaggagaagtcgcgcttcgctgcattaatccggaatgtccggctcagatcagggaaggcctgatccattttgtttcccggaatgcgatgaatatagatggtctcggcgagcgcgtcatcacccagctgttccgcgaagacctcgtccataatgtcgccgatctgtataagctgacgcgcgagcagctgatcaatctcgagcggatgggggaaaagtcgaccgacaacttattgaattcgattgaaaaatcgaagaagaactcattggaacggcttctcttcggactcggcatccgcttcatcggcgccaaagcggccaagacgctggcgatgcattttgaaacgctcgataagcttaaaaaagcgacaaaagaagaattgatcgaagtcgatgaaatcggcgacaagatggcggacgccctcgtcacctattttgaaaaagaagagattctgaagctgttggacgagcttgaagaactcggggtcaacaccgtgtataaaggcccgaaaaaagcggccgctgaagcgagcgattcgtattttgcggggaaaacgatcgtcctgaccgggaagctcagcgagatgtcgcggaatgacgcgaaagcggaaatcgaagcgctcggcggaaaaatcacaggcagtgtaagcaaaaaaaccgatctcgtcattgccggcgaagcggcaggcagcaaactggcgaaagctgaagacctaaacatcgaagtatgggatgaggcaagactgatcagtgagctaaagaaataa

SEQ ID NO: 665 - DNA, 1191 bp, Bacillus licheniformis
ttgaaaaagatattatgtttggcggctgctgcgggtatgctcatgctctcagcctgtgcgccgaattttgggggagaagaagagcaggagatggtgcagaaaacggataagtcgaaagaaaaagccatcattccgaaatacaacatctccgattcttattataaaatggttcttcctttcaaggcggggaaagcccgcggcttgacgaccgaacgcctgaatacgcggctggatatcgatgaatttgagacaggcatgatgcgccttgcgcaagattcattttctactgacgattacctttttcaagaaggacaatacctggatgaggatacggtatcgagctggctcgcccgcaaaaaaacgggggacgacttgaaaaaagcggagaaagacgataaaaacttcaaaaacctcggactgaacccggccctttccggaagcggatcaacagagaagcaaaacgaagaaagcccgatatacctcgcccatatgcttgagcacgactacctcgtccgcaaagacaaggatacgattgagctcggaggcgtcgtgatcggccttgcgctgaactctgtccactactaccgcgaaaatgtcggcgacccgcaaaaagaagtgaccatcagcgacaaaaagctgaggcaggaaggcgaaaaaatcgctgaagaagtggcgaaacggatcagaaacatggatgatctaaaaaatattccgctgacgatcatgctttacaagcaggcgcctaagtcatcgatcgtccctggaaactttatcgccaaaaccgatgtgaaagcagggacaagcgagatcggcggctgggataaaatcaatgaagagtacacgttcttcccttcaacagaaggttcggagaagcatccggatgacgcggagctcttcaaacgctttaaaaacaaagtcgatacgtattttccaaactacacaggggttgtcggcacggctctctataaagacgaccaaatgcaggacatgaaaatcaacatcccgatgcagttttacggcaaaagcgaagtcatcgcctttacccagttcttgaccggtgaagtgatggactactacggcaaaagcggactgaacgttgagatcaacattaattcgtcagccgggcaggaagccgtcattctgaaaaagccgggagacaaagaaccgaccgtccatatttatgattcataa

SEQ ID NO: 666 - DNA, 927 bp, Bacillus licheniformis
atgtgggaaaaattttactctaaaaatggtttggcagctaaaaatattgctaaagaattgatgaatatcaaagcaggtgaaaaaattccccgtatctcagactactgtcataagttatccatcggcagggggactgtgcaaagtgcgctgaatttattagttgatatgaaagcgattcaattggaggctagagggcatttaggaacgtttttggtaagtaaggataacaatttattacttgagattgcaggtattgcaccattaatcggctcaatgccacttccgtattcaagaaaatatgagggtctggcaacagggattgtggaagggtttgaatcaaccggaaaaacagttaacttgatctacatgcgtggcggagtgaatcgaatcgaagcagtccgaacaaaaagaagtgattttgcaattgtttctaagatgacggcagatcatatcatagcagaatatccaaatttgaaaattttcaaaaaattcggggaaagtagttatgtatcttcccataaaatcttcttagctcatccagatgaggaaataggcaaggatggcgtaagagtaggtgttgatttggaatctctagatcagaaacaattaacattggctgaatttgaaaacaaaaatgctgaatttgtcaatgtgaattatatgcagctctttgatatgcttctttcaaaacaaattgatgcagcagtttggaatgctgatgacaaaagaatgattcaaacgtttaaagcaatcgattttttttcaccgaaagcaaagaaaatttccaaggatacaacagaagccgttattgttattgaaggagacagagaaaaagaaatagcagaaaagtggaatttggttaatgagaaacagatattagacacccaaaaaagcgtagaaaagggagagaaaataccgcgctactaa

SEQ ID NO: 667 - DNA, 366 bp, Bacillus licheniformis
gtgaatcaaatacagctggaagaaaagttgtctattttactaacgagtcgagtgattacaaaaaatgctttcaacacaacattgaacacatttgttttcttatcagaaaagctgaaaaaggaggtgatcaaagactctgaaatgttttggacgcacatggcgatggctttaactagaattaaggagggagaaagcgaagaagttcctgcaaatgccatcatcaatgaaatgtatgaaacaccatataaaagtgcaatagaagaagtgatagactttatacattcactggcaggtctagaacttccagaaggtgagctcgtttatttttatcttcatcttcataaagtcatagaatctaataaatag

SEQ ID NO: 668 - DNA, 465 bp, Bacillus licheniformis
atggtgagaattgtaataggcggacagttgaaaaaacaagcgattgaaaaacttgttaaagaaattgggggaaataatgtagaagtattggtcaaaggtgatttggacgctgttatggctgtgaaaaacaataaggcagattattatattggcgcctgtgaaaccggatctggcggtgctcttgcaatggcaattgcattattaggtaaagataaatgcgtcaccttggcttctccaagtaccataaaaaacaaggaagagatcgagaaggaagtagaaagcggcaaaattgcttttggtttcaccgcttcaacatcacaaaatatattaaacattttaattcccttatttattaaaataagcgaacttttccaatatatattttgttatacaggcttaaatttttttcagttaaggaaagcgctttcttggatgctcgaaataaaagaagcgtggatgacatga

SEQ ID NO: 669 - DNA, 1302 bp, Bacillus licheniformis
atggacctttctttgattcaatgtcttgtcatagcggctgttggtgcattaggttctatactagtcaatcgcggggtagctgtatttaatgatggtttgcgtccgattatgcccgaatacctagaggggagaatgacaagaggggagcttgctgcaacaagctttgcattaagttttggattaatcatagggtttggtattccgctttccataggagcaacaatcattattggacacagtattttattggcttgtgacatcattggcatttggactccggaaaacaaaataggcatggcaactgcaggagttattggtgccgtttatagtattgggatcgttttaggattgcaatttgtagtagatttatttggcaagtttcccgtgaattttatagactctttaagtcttattggccagcctattattatcgcatttacagtatttccagctgtagcggtcggatatcagcacggtttaaaaaaagtcgccgtcactgcaattgtaactttagcttcttttctcttattcgaaaagtttggaacatttcaagcggcgggatatgaaatttcgctcagtcctgaagggatggctttattagcaggaatgttaatgatgatttattatgcagcgagaattagaggaggagatgaatctactaatgcaaatttagtgaatatatttaatgagcgtgtaaatcgaattaagaaaaaccgctggttattagctcttatgggagggcttgtttctttaacatcatctatgctgattttagcagtggatgcaatgcctcaagcattgattaataaagagctttacacagaggcggcaatcgctacatttgcacgtggaattggtttcatccctttagttttttcaactgcaatcgtaacgggggtttatggtttagctggtaccacactggtatttgcagtgggtcttattttcagggatataccgattttagcatttctgttgggctttttagtcatgtatttagaggtcatatcattatccgcagtatcaaaaagcatggacaaactgcctggtgtaagggagatgggagagcatatccgcacttcgctgtcagatgttctaggaatggctatattaattggcagtgcgatggcaggggaaaaaattgctcctggcattggcttcttctgggttattggattttatttaataaaccgaatagcatcaaaaccgcttgttgaattggctgtcggcccaattgcagttatattgttggggattgtcgctaatcttctctatgcagtcggtttatggcaggttggctaa

SEQ ID NO: 670 - DNA, 885 bp, Bacillus licheniformis
atgttgaaagacggaatgacctatatgcatgaacatacaacgatagacctttccaaagtaaaaaacaatgaggattgtaagttggatgtatttcctgaaaccgtcagagaatttaaaagtttatacgaaaagggcgtacggaatattgttgatgttacgaatattggaatggggagaaatattacatacgtccaaaaagttgcaaaagaaacaggcattaatattgtcttttcaactggtttctatcaagattctttttacccgatccatgtgtttcgtgaatcgaaagaaaagctggcagaaagaatgattatggagattgttgaaggaattagaggaacagatgccaatgccgaggtcatcggtgaaattggaacaagttacaataaatggacggaaaccgaacaaaaagtttttgaagcggttgttgtggcacataagcaaacaaaaaaaccaatatcaacccatacttccataggaacattaggacatgaacaagtagaattttttaaaaaacatgaagttgatttaaaccgagtggtgatagggcatgttgatttatctggggatgccgattatatattgaaaatgctgagagaaggtgtatatgtagaattcgatacaataggtaaagaaaattatatgcctgatcgtgttcgggccgaaatattgaaaaaaatacaggataaagggtatatagacaaggttctgttgtccatggatatcacaagaaaatcacatcttgtatataaaggcggggtgggctattcatatttgatagacacgtttatccctctcttgcaaacctatggaataactggtgaatcaattgataagatgttgattaaaaatcctcgcgcttttatgaaaggggagagtgaatga

SEQ ID NO: 671 - DNA, 1149 bp, Bacillus licheniformis
atgagcatggatacttatcctctagatagcctatcaattgaagaagccatgcatagacaatttaaattggttgatgtcatgacaagacattttcgaggagaagaattgctttcacttggcgatttaggcgttgtaaaaggaatcaataaaccgcggttcacaaaaaaaatagaagagacactagctgatttctttggcacagagaaagcaatgttagttcgtggtgcaggaacaggggcattgaggtttggttttatgagctttttaaagccgggtgacgagatccttgtccatgatgcaccgatatatccaacaagtaaaacaacgttagagtcgatggggatcttgccaatatacgcggattttcacgattctgaacaaataaaagaagccatcctcaaacacccgaagttaaaaggtgtattgattcagcatacgaggcaaaaaatagatgaccattatgatttggctgaaacgataaaaaaaatacgttccatttattctgatctagttattattacggatgacaactatgctgcgatgaaagcagaaaagattggagcgcaactcaaagccgatttgtccaccttttcattgttcaagctattaggtccggaaggtattggagtcattttaggaagaaaaaatttaatagaaaaaatagaaaaaataaactattcaggcggaagccaagttcaaggttatgaagctttagaagctttaaggggtctgatatatgctccggttatgctggcaatacaagcaagtgtcaatgatcagttagttcactcgcttaataatggagccattaagggtgttaaaaaggcttatttggcaaatgcacaatcaaaagtcttacttgtagagtttgttaaaccaattgcagaaaaagtgcttcatcatgctaatgaattgggagcagcaccccatccgataggtgctgaatcaaaatacgagtttgcaccaatgttttatagagtgtctggcacttttttatctgcggatccatcactggcaaaaaaaatgatccgcattaatccattaagaagcggtcctgagaccattttaagaattctaaacacatccgttcatcgagcaacagaagatctcagcgtaaattcttcaaaaggcgatgatataaatgaataa

SEQ ID NO: 672 - DNA, 1227 bp, Bacillus licheniformis
atgaataaaagagtcattatcataatattagacagcttaggtgtcggttatatggaagatgcaagcgattatcatccttcagatgttggcgccaatactttctatcacatacttgatacggtgccctctttaaacattccgaatctcgaaaaattgggtattaataaaatattgcaccatcctaaattgaaaaaaacagatcatattgccagctatggtgttttaaacctgatgcatcaaggagcggacagttttgaaggacataatgaaatcatgggaacaaagcctaaaaagacatatttagctccttttgcggaacatctcaatcatgttaaactcgctttggaagatcaaggttataaagttaacataccgaattcagatttgccgtatctattggtaaacgatttagtggtcgtggctgataatatcgaaacagattacgggcaaatttataatgtaagcgctccgctggattatattccgtttgatgaagtattgaaaataggaagatgcgtccgtcatcatgttaaagtaaatcgcgtgattgttcttggaggagaaaacgtaacacctgaacacttgcagagatcggttgaaagaagagaagacggattaataggggtgaattcgcctaaatctaacgtatacaagcaaggatatcaagttcgtcacttaggatttggtatctctcccgaaaatcagttgccgacattggcgagaaataggggaatggaagtctctcttatcggaaaaatgcaggacatcatttattgtgaaggtgcaaatagatttccaggtgtagatacagaacaagtcatgaaggatattattcaggagatggaccgcgtcaaaaaaggcttgattgctgccacagtacaagaaaccgatttggccggacatgcacagaatcccgtccgttatgcgaatcggattgaaatggtagatcgatatttgccggaaattctccggaaaatgacagatcaggatctgctgatgattagtgcagatcacgggaatgatcccacgatcggccacaaccaacacacacgggaaaaaacatatttgctggcttatcacaaaaaattatcgcctgttcacatcggggaaagaaaaacgctatccgacattgctgcaacttctgctgattatctagggcttcgcaatactgaaaacggcagttcattccttcatttaatgcaaaaaggaaaagaggagacatactga

SEQ ID NO: 673 - DNA, 1152 bp, Bacillus licheniformis
atgtttttggaatctacattaaaatataacaaaaaattaatagaggctgcattgagttttcatcagcagggaatcatttcacctaacacttatgtattagacttggacaccgtcaaaaaaaatgcaaaagtgttaagtgaaaaagccagaaaacaggatattgaactgttttttatgacaaagcaatttggtcgtaatccgttggtggcacaagctatagccgaaagcggaatcggcaaagcggttgctgtagacccgtgggaagcaatcacactcagccaaaatggaatcaaaattgggcatgtcggacatcttgttcaaatacctattcatatgatacccgcaatattggagcttcatcctgattatgttacggttttcagccttgaaaatgctcaaaacattaatagagtcgctaagaaaatgggaagaaaacaaaaagtttttttgcgtatcgcaaacaaagaggattatatatataaaggtcaagagggagggttcacttttgagcaaatcgttaaggatatcgaatcgattgaacaattagaaggacttgaaattgcaggtttaacaagctttccttgcatattgatccaagacggccttccagcagttactccgaatgtagcatccatgcaaaccgtaaaatcgtttttaatggaaagagggtataaaaagcttgagatgaatatgccaagtgcaacatcttgtgcaacaatgaaattgttaaaggaaaatggtgcaactcaaggcgaacccggccatgctttaattggaacgacacccatacatgcaacgaaacaacttgcagaaaggcctgcgatggtatatgtaaccgaagtgtcccacatatctaatcatcatgcttatgttttcggcggcggtttctatccgcgttcacatatgaaagcggcgctcgttggaacaaacaaagatcatcttaagaaggttcaagctattgaaatgacgcctgatcatattgattattacggttcattaaacacagttgaagcaaaagtcggcgatacggcaatatttgcttttcgtacacaagtctttgtcacgaatgcacatatagccatcttaaaaaacgttgctgaagatcctgaacttatcggtgtatatgattctaaaggaaatgtaatcgagtga

SEQ ID NO: 674 - DNA, 729 bp, Bacillus licheniformis
gtgaaaattattcatgtatcaggttatgaagaaatgagtggaaaatcggctgatctaatggctgagctcattcaaaattcaaataatcctgttatcggctttgcaacaggttcgacaccgattggtttatataaatgcctgataaaaaagtatcggcaaaaggaaatttcatttaggaatgttactgcttttaatttagacgagtacgttggattggctaaagaaaataaaaacagctaccattattatatgaatgaaaaattattcaaacatctggatattagtcgaaggaatatcaatatccccaatgggatggcggaagatttggaacaagaatgcctcagctacgacagacttgtttctgaaaaagcaattgacatacaaatattaggaatgggattgaatggtcatatcggttttaatgaaccggggacaagctttaaaagcagaacccatatcgttgatttggatcaatcaacccggcaggcaaattcccggttctttcgttccttggacgaagtaccgacaaaggcattaacaatgggcattgaaacaataatggaaagtaagcggatccttctgctcgtgtctggaaatgaaaaatctgaagccttggcacggctgctgaacagcacccgtgtctcccaagagttccctgcttcaattttaaggaaacataaagatgtgacggtgatggcagatgacgcagccttaaataaaattcattaa

SEQ ID NO: 675 - DNA, 693 bp, Bacillus licheniformis
atggattggcatattgaaactgaaacgctgttaaagcttggaatcgcaacattaatcggaatggtcatcggtctcgaaagggagctgaaaaacaagccgctcggcttaaaaacgtgcatcgtgattgcgatcagttcctgtgttctgacaatgatcagcattgatgcggcataccattttccaaggtcgaacagaatcatgatggaccctttgcggcttcccgcacaaatcatatcggggatcggcttcatcggagcgggcgtgattttacgcaaaagcaacgacgtcatttccggcctgaccacttcagcgatgatctggggagcggccggcctcggcgtcgccatcggagcgggcttttataaagaagcgtttgtcagtctgattttcattttaatcagcgtcgagtttttgccgtggatcgtcggcaaaatcgggcccaaccgcttgcaggaaaaagaaatccgcgtccgcatgtccctgaatgacaaggataaactgacggatatcttaaaggaaatgaaagcgaaaaaaatccggattcattccgtccggatcgatgatatgcgcgataatgaatttccgatcatggaaacgaaaatcatggttcataagaaaaggtatgtcaccgatgtctattacgatatcaaagcgatcgacggcgttgtcggagttaaatgtgatacgctgtaa

SEQ ID NO: 676 - DNA, 1482 bp, Bacillus licheniformis
gtgagtgttgaagtatttatttcgttggggatttattttgccgcgatgctcttaatcggctggtactcctatagaaagacatccaatttgaatgactacatgcttggcggcagaggtcttgggcctgctgttacggctttatcggccggcgcgtctgacatgagcggctggatgctgatgggactgcccggagccatgtatgtgacaggactttcaagcgcctggcttgccgtcggtttaacaatcggagcttatgtgaactatttggtggtcgctccccggctgcgcacatatacagaagtagcaaacgatgcgattacaattccggactttttcgaaaatcggtttaatgatacaacaagaatcttgcgcctggcatcagccatcgtcatcatggtgtttttcacattgtacacgtcggcgggtatggtgtccggaggaagactgtttgaaacggcgtttggcctcgattataaaatcggtcttttcttaacggccgcagtcgtaattgcctatacgctgttcggaggatttttggccgtcagtctgacagacttcgtgcaaggtttgattatgtttatcgctttagtgctcgtgccgatcgttgcctttactcaattaggcggaattacgccgactttcaatgtgatcgaagaaatcaatccaagcttgctcgatttcttcaaaggaacgaccgtcattagcattatttcatttctcgcctggggactgggctatttcggtcagccgcatattatcgtccgctttatggcgatttcatccgtaaaagaactgaagcctgcgcgccgcatcgcgatgggctggatgatcatctccgtaatcggcgctctgctcgtcggactgaccggtgtggcgtatgtccatgagacgggtacagcgcttaaagatccggaaacgatttttatcgggttttcaaaggtattattccatccgctcatcaccggatttttgctttccgctttgctcgcggcgattatgagtacggtgtcttcccagctgcttgttacatcaagcgccatgacggaagatttttaccggacgtttttccggcgcaaagcttcggataaggaactcgttcttgtcggacgtctgagcgttctgcttgtcgccgtcatcgcgatccttctgtctctgacaccgaataacacgatccttgatctggtcggctatgcgtgggccgggtttggttctgcattcggacccgccatccttctcagcttgtactggaagcggatgaaccagtggggcgcattggccgggatgattacaggggccgtgaccgtgctgatttggattctgaccggcctgcaggagaagacgggtatctatgaaatgatccctggtttcttcctgagcttgattgtcgtttacgctgtcagcatgatcacgaacaaaccggcaaaagaggcaagagatatgtttgaagaaatggaacagacgcatgaggaagaacattcttaa

SEQ ID NO: 677 - DNA, 291 bp, Bacillus licheniformis
atgtcgcgtatttctatagaagaagtaaagcatgtcgcccatcttgccagactggcgattacggacgaggaagcggcgatgtttaccgaacagcttgacagcattatttcatttgcagaagagctgaacgaagtcgatacagagaatgttaaaccaacaacgcacgtattgcaaatgaagaatatcatgagggaagatgtacctgataaagggcttccggttgaagacgtcgtcaaaaatgcgcctgatcataaagacggctacatccgcgtgccgtcaatcttggactaa

SEQ ID NO: 678 - DNA, 1458 bp, Bacillus licheniformis
atgtcactgtttgaccataaaatatctgaattaaaacgtctcatacataataaagagatcagcatatcagatttagtcgatgaatcttacaaacggattcacgaagttgacggaaaggtacaagcctttttgcagcttgatgaagaaaaagcccgcgcatatgccaaagaattggacgaagcgcttgatacccgggatgagcacggtcttcttttcgggatgccgatcggcattaaggacaatatcgtaacaaaagatctgcggacaacgtgcgcaagcaaaattctcgagaattttgatccgatctatgatgcaaccgttgttgagcgtcttcatgaagctgaagcggttaccatcggaaagctgaatatggatgaattcgcgatgggctcttccacagagaactcaggctttaaaaagacaaaaaacccgtggaacctcgaaactgttcctggcggatcaagcggaggctcagcggctgcggttgcggccggggaagtgccgttttcacttggatctgacacgggcggatcgattcgccagccggcatctttctgcggcgtcgtcggcttaaagcctacatacggacgcgtttccagatacggccttgtcgcatttgcatcttcattggatcaaatcggcccgatcacaagatctgtcgaagacaacgcctaccttctgcaggcgatttcaggcgttgacaaaatggattcaacgagcgccaatgtggacgtgcctgactacctgtctgcgctgacaggcgatattaaaggcttaaaaatcgccgttccgaaagaatatctcggcgaaggggtaagcgaagaagcgaagcagtccgtgcttgaagcgctgaaagtgctcgaaagccttggcgcgacatgggaagaggtatcgcttccgcacagcaaatacgcgctggcgacttactacctgctttcttcatctgaagcgtcggcaaacttggcgcgcttcgacggcatccgctacggctaccgcacggacaatgccgacaacctgatcgacctgtacaaacagacgcgttccgaaggattcggaaacgaagtcaaacgccgcatcatgctcggtacgtttgctctgagctccggctattacgacgcatactataaaaaagcgcagaaagtcagaacgctgatcaaaaaggactttgaagacgtatttgcaaactatgacgtcatcatcggaccgacaacgccgacgccggcatttaaaatcggcgaaaaaacgagcgatccgctgaccatgtacgccaacgacatcctgacgattcctgtcaaccttgcgggcgttccgggaatcagcgtaccgtgcggatttgcgaacggcttgccgctcggcctgcaaatcatcggcaaacactttgacgaaagcacagtataccgcgtcgcccacgcattcgaacaggcgacagaccaccataaagcaaaacctgaactgtaa

SEQ ID NO: 679 - DNA, 1431 bp, Bacillus licheniformis
atgaactttgaaacggtaatcggacttgaagtccacgtggagctcaaaacaaaatcgaaaattttctccagttctccaacgccattcggcgcggcggccaacacgcagacaagcgttatcgacttaggctatccaggtgtactgcctgtgttgaacaaagaagccgtcaatttcgcgatgaaagccgcaatggcgctcaactgcgaaattgcgacagatacgaaattcgaccggaaaaactatttctaccccgacaacccgaaagcttatcaaatttcacaatttgataaaccgatcggcgaaaacggctggatcgaaatcgaagtcggcggaaaaacgaagcgcatcggcattacccgccttcatttggaagaggatgcgggaaaactgacgcatacaggcgacggctactcccttgtcgactataaccgccagggaacaccgctcgttgaaatcgtctccgagcccgatatcagaacgcctgaagaagcttacgcctaccttgaaaaactgaaatcaatcattcagtatacaggcgtgtccgattgtaagatggaagaggggtcgctccgctgcgacgccaacatctcgctccgtccgatcggacaagaggagttcggtacaaagacagagctgaaaaacctgaactcattcgcctttgttcaaaaaggccttgagcacgaagaaaaacgccaggcgcaggttcttttgtcaggcggtgtcattcagcaggagacgcgccgctatgatgaagcgtccaaaacgacgattttgatgagggtcaaagagggatctgacgactaccgctacttccctgagcctgatcttgtcgagctttacatagacgacgagtggaagcaacgcgtgaaagacagcattcctgagcttccggacgagcgccgcaagcgctacatcgaagagcttggcctccctgcctatgacgcgaaagtgctgactttgacaaaagaaatgtccgacttcgtcgaagcggccgttgaaaaaggcgcagacgcgaagctggcgtcgaactggctgatgggtgaagtatcggcttacttgaacgcccagcaaaaagagcttgcggatgtcgaactcacacctgaaggccttgccggattggtcaagctgatcgaaaaaggaacgatttcatcgaaaatcgcgaaaaaggtcttcaaagaattgattgaaaaaggcggagacgcagaaaaaatcgtcaaagaaaaaggccttgtgcaaatctctgacgaagcgacgctcagaaagcttgtcacagaagcgctcgacaacaatccgcaatcaatcgaagactttaaaaacggaaaagaccgcgcgatcggcttccttgtcggccaaatcatgaaagcctcaaaaggacaagcgaacccgccgatggtcaacaagcttcttcttgaagaaatcaataaacgataa

SEQ ID NO: 680 - DNA, 303 bp, Bacillus licheniformis
atggaaagaaaggatgtacccgagtggatcttagctttagaagaagaagatgtagaatttattaaaaactttatgctgaaatctggatctttaaaagaaattgcaaagagttatcaagtatcttatccaacagtcagggttagattggatcgattaattcaaaaaattcaactaattgacgagttagaaaatgagacttttgttaactttataaaacagttagctatcgatgatcagattagtctggaaaatgcaaagctaatcattgagaaatacaaaaaagagcggggtgttcataaatga

SEQ ID NO: 681 - DNA, 282 bp, Bacillus licheniformis
atgaatcctatttatatactactcattggctttacaatactagggattcaatattttttatcgaccagaaatcataccttttggggagctatactgcctacagcttatatcgtttttctcgtggcattatccatttatgaaggaaaatctttcgcatcattctttcttcctcttatcggcggattggctttattgttgggagaatggattaaaggcagagaagctttgaaaaaaaagcgggaaagagaaatgagaataatgaaagccatggatattaaataa

SEQ ID NO: 682 - DNA, 744 bp, Bacillus licheniformis
ttgatcgcatactggaaaagcggaggcattccgcaaatcagcatgcacctcgcaaaccccgcgtttacttcgggtcattataaaactcagatttcaaacagccagtatgagagaattttagattcttccactcctgaaggaaagcggcttgaggcgatgctgagcaaaatcgcggacggcctccaggagcttgaaaatgaaggcgtgcccgttctattcagaccccttcacgaaatgaacggcgaatggttctggtgggggctgacgcaatataatcaaaaagacagcgaaagaatctccttgtacaaacagctctatgtgaaaatctatgactatatgacaaaaacaagaggcctggatcatctcttgtgggtgtatgcgccggacgccaacagagactttaaaacggacttttatccgggcgcatcatatgtggacattgtcgggcttgacgcttattttgatgacccgtacgccattgatggctacgaagagctcacatcgctgaacaagccgtttgcctttacagaagtcggaccgcagacgacaaacggcgggctggattacgcgcggtttatccatgccatcaaagaaaaatacccgaaaacgacgtacttcctggcgtggaacgatgagtggagcccggctgtgaataagggagcggacaccctctatcttcatccatggacgctgaataaaggagagatatgggacggcgattctttgacgcctgtcgtggaataa

SEQ ID NO: 683 - DNA, 342 bp, Bacillus licheniformis
gtgaaaaaaaacatcgtttgttcaatcttcgcgctgctccttgcttttgccgtttcgcagccgagctatgcacacaccgtttctccggtgaacccgaatgcccagccgacgacgaaagcggtgatgaactggctcgcccacctgcccaatcggacggaaagccgggtgatgtccggggcgttcggaggatacagcctcgacacattttcaacggctgaagcgaccggatcaaacaggcaacaggacagctgccggccatatacggctgcgattatgcaagaggatggctggagccggaaaagatcgccgatacgattgactacagctgcaaccgtgatttga

SEQ ID NO: 684 - DNA, 849 bp, Bacillus licheniformis
atgacagaaaaagaagaaaaaatcattaaagcaggcctgcacctgttcgcgaaaaacggttttgcttccacaacgattcaagacatcgccaatgaatgcaacatctcaaaaggggctttctacctgcatttcaagtcgaaagaagctcttttgctcgcaatcattaagtattatatcgatcgaatgatggaaaatatgaagatcattcagcagaagaatttccctcctaaggaaacgttcaaggagcagattgcttatcaattcagcgagagcaaggagcaccgcgattttattctcgtgatgatcagcgaacacagcataccggaaaacagcaagatcgaagaatattttaaaaatgtcagccaaaaattccacgagacgtatcaaaacgcgctgtcagccgcctacggtgacattgtgaagccttatctgtcagacttgtccgtgatcgttcaaggcatcgtgcagtcttatcaaaatttgtttatctttaatgaactggatatcgatttttacgaacttgcggattttattatgagaagaatcgatgacatgattgatggcatggttcaaaacggggagcagccgatcttggccggccggacgtacagctattaccggaacgccggcaatacggccgataaacatacgattttgcgggagcttgaagatgccaaacgtcagccggagctttcggaagacattctcattacactggatgtgatcgaggaagagctgagaaaggattcgccccgcgcacccgtgctccaaggcatgctgacaaacttgcagcatcaggacaatgttcagcatctatatggaatgatcacccgtttccttcattcataa

SEQ ID NO: 685 - DNA, 3159 bp, Bacillus licheniformis
atgaattctatcattaattttgtactaaagaacaagttcgctgtgtggctgatgacgattattgttacggttgccggcatttatgcgggtttaaatatgaagcaggaatcgattcctgatgtgaacatgccttatttgaccatcagcacgacatatcccggagccactccgagccaggtagctgatgaagtcacaaagccggttgaacaagccgtgcaaaatctggacggcgtcagcgttgtgacgtccacatcgtatgaaaacgcatcatcggtgatgattgaatacgattatgaaaaggatatggacaaagcgaagacggaagccgctgaagcattggcgaatctcgatctgccggacaatgcgaaagagccgagcatttcgcgctacagcatgaattccttcccgattctcgcgctcagcgtgtccagtgataaagacgatcttcaaagcttgacgaaaaaagtggaagacagcctcctgacgaagcttgaaggccttgaaggcgtagcttccgttcagctttccggtcagcaggttgaagaagtcgaattttcatttaaaaaagacaaattgaagcaatacgggcttgacgaggatacagtcaagcaagtgattcaaggatctgatgtgacgactccgcttgggttgtacacattcggcaaagaagaaaaatcggtcgtcgtcagcggcgatatcgacacaattaaagacttgaaaaatatgagaattccagcggcgtctgccggaggcgcaagcgcgcaagccggagcgcaaagtgcgcaggcggcccagggggcgcaggctcaagccggggcacagagcgccggacaagctcagcaaagcgcgggagtcccgacggttaagctgtctgacatcgcaacgattaaagatgtcaaaaaagccgaatccatttcacgaaccaatggcaaagacagcatcggcatcagcgtcattaaagcaaacgacgccaataccgtcgaggtagccgacaacgtaaaagctgaactcgaacaattcaaaaaagaccacaaaggcttcaaatacagctcgacatacgatcaggccgaaccgatcaccgagtcggtcgagacgatgctgagcaaagcgattttcggagcgatctttgcggttgtgatcattctcttattcctaagggatattaaatcaacattaatctcggtcatttcgattccattgtcattgttaatcgcactgctcgtcctgaaccagcttgatatcacgctgaatatcatgacgctcggcgccatgacagtcgccatcggacgggttgtcgacgactcgatcgtcgtcatcgaaaacatttaccgccgcatgaggctgaaagatgagccgctgcgcggaaaagcgctcgtgcgcgaagcgacgaaggaaatgttcatgccgatcatgtcatcaacgatcgtgacaatcgcggtattcctgccgctcgcacttgtcggcggtcaaatcggcgaattgttcatgccgtttgctttaacgattgtattcgcgctcgctgcatccctcttgatcgcgatcacgctcgtgccgatgcttgcgcacaccctcttcaaaaaatcattgacaggcgcgccggtaaaggcgaaagaacacaagcctggggtactggccaacttctacaaaaaagtgttgaattggtcgctcagccataaatggatcacatcgatcatcgcggttctgatgctggtcggaagcttgttcctcgtgccgctgatcggagcgagctacttgcctgccacaaaagaaaaaatggtgcagatcacgtacacccctgaaccgggagaaacgaaaaaagaagcggaaaaggaagcgcaaaaagctgaagaaatcctattggaccgcaaacacgtcgatacggttcagtatacgttaggagcgggaaatccgctgatgggcggaagttcaaacggcgcgttgttctatatcaaatatgaggaagacacgcctgattttgatcaagaaaaggacagcgtcttaaaagacattcagaagcaatccaaacgcggagaatggaaaactcaggatttcagctcctcaggcaacaacaatgagttaacgtattatgtgtacggggattctgaaaaagagattaaaggcactgtaaaagagatcgaaaagataatgaaagaccaaaaagacctgaaaaacgtaagctcaggcctgtccagcacatatgacgaatatacatttgtcgctgaccaggagaaattaagcaaactcgggttaacggcatcacagatttctcaggcgctcatgaaagaaacatcgcaggcgccgcttacaaccgtgaaaaaagacgggaaagatcttgatgttacgattaaaacagaagaagaaacatataaaagcgtcaaagatttagaagacaaaaaaatcacaactccgaccggccaggaagtgaaaatcggcgatgtcgcgaaagtgaaggaaggcacgacatccgacacaatttcgaaacgggacggcaaaatctatgccgatgtcacggcggaagtcacatcagacaacgtcacggccgtatcagtcgacgtacagaaaaacatcgacaagatcgacctgcctgacaacgtcacaatcgataccggcggcgtatccgctgatatcgaagattcctttacaaaactcggactcgcaatgcttgcggcggttgcgatcgtctacctcgtgcttgtgattacattcggcggagcactggcgccatttgcgatcctgttctcgctgccgtttaccgtcatcggcgccttggtgggactttacgtatcaggagaaacaatcagcttgaacgcaatgatcggaatgctgatgctgatcggtatcgtcgtcacaaacgcgattgtcctaatcgaccgcgtcatccataaggaagcggaagggctctcaacgagagaagcactcctggaagccggctctacaaggctccgtccgatcctgatgacggccatcgccacaatcggcgccctgattccattggcgctcggatttgaaggcggcagccaggtcatttcaaaagggctcggcgtcaccgttatcggcggtctgatcagttcaacgctcctcacccttctgatcgtaccgatcgtatacgaagtactggcgaaattccgccggaaaaaaccgggtatggaagaagagtaa

SEQ ID NO: 686 - DNA, 540 bp, Bacillus licheniformis
atgattaaaaaagggacaaacatttacatcaggccgctcacggctgaagacgccgaggcatgcctcgaattgcagaacgcaaaccgcccgttctttgaacagttttcaatggagcggaacgaggagttttatacaatcgaaggacaaaagaagaggcttcaaagattatatgaaaatatggagaacgatgaagattattattttggcatctttgatccggcaaacgatgcgctgatcggaacgatcaaccttttccaagtgctgcgcggttccttgcaaagcgccttcatcggctattttttggatcagaagcacaacggcaaaggctacacgaccgaagccgtcaagctgatggtcgagttcgcctttcacgatctcaagctccatcgcatcgaagccggcgtcatgccccgtaatattgcctcgatccgggtgctggagaaggcgggttttcacaaagaaggcatcgcccggaaaaacgtcaaagatcaacggaaaatgggaagatcatcagctgctggctgtgatcaatccgcatga

SEQ ID NO: 687 - DNA, 954 bp, Bacillus licheniformis
gtgaaaaagcccgtttattttaaccatgacggaggcgtcgatgatctcgtctctttatttctgctattgcagatggaaaatgtcaaattgatcggaacatccgtcataccggcggattgctatttggagcctgctctcagtgccagtcgaaaaatcattgaccgcttcggttcgtaccaggtcgagactgcggcatccgattcgagaggggtgcacccgttcccgaaggagtggcgcatgcacgccttttatgtcgacgctctgccgattttaaatgaaaaaggcgaagtccggactccggtgtcagaactgcccgcccaccttcatctgattgaatgcgtgaggcagagccccgaaccggtgacactgctgtttaccggcccgctgacagacttggcgagggcccttgaggaagagccggcgatcataaagcacattgcaaagcttgtctggatgggcggcaccttccttgagaaaggaaatgtggaagagcctgagcacgacgggacggcggaatggaacgctttttgggacccttacagcgtgaagacggtattcgagagcgacattcagatcgaaatggtcgcgcttgaaagcacgaaccaggtgcctttgacaaacgaaatccgctcccattgggcgagcctcagaaagcatatcgggatcgactttatcggccaatgctatgcgatgtgtccgccgcttgtccataacgaaacgaattcgacatactacctttgggatgtgctgacgacgctgacgctcggcacagtcgatatgacacgctcgcgcagcatcaaggcggttgtccatacacaaagcccgcgccaaggaacgacagaagagcatcctgacggcagaatggtcaaagtcgttgatcaagtcgacagggatcaattttttgcgtattttgaagagttgatgaaaagagccgaccgcattccatctttataa

SEQ ID NO: 688 - DNA, 915 bp, Bacillus licheniformis
atgaaacgtgcacgaatcatatacaatccgacttccggacgagaaatcttcaaaaaaaaccttgcccaagttctgcagaagttcgagcaggcaggctatgaaacgtcatgccatgcgacaacaggggaaggggatgccgtacaggccgccagacacgccgctgagcgggaatttgacttgattgttgcggccggaggagacggcacattaaatgaagtcatcaacggactggcgccgttggaacaccgccccaagctcggagtcattccggtcggaacgacgaatgactttgcgagagcgctcggcattccgcgcgaggatattttaaaggcggttgacacaatactagagggagaagcccgtccgattgacatcggccgcgtcaacggccaatatttcatcaatatcgccggcggcggacgccttacagaactgacatatgacgtaccaagcaaattgaagacgatgctcggccatcttgcctattatttgaaaggaatggaaatgctccttccttcactgcggccgaccgaggtcgaaatcgaatacgacggcaagctgtttgaaggagaagtgatgctgtttctcgtcatgctgacgaactccgtcggcggctttgagaagctcgcccccgactcaagcttgaatgacggcatgtttgacctcgtcattttaaagcgggcaaacctcgccgaattcatcagacttgtcggacttgccctccgcggcgaacatatcaatgacgagcatatcatctatacgaaagcgaaccgcgtcaaagtgacggtcaaagacaaaatgctcctaaaccttgacggcgaatacggcggcgaactgccgggcgaattcgaaaacctctaccgccatatcgacgtcgtcatgtcaaaagaaaaagcgagaaaattggatgattga

SEQ ID NO: 689 - DNA, 1389 bp, Bacillus licheniformis
atgaaacaaaaagcccccgttcaaaaaaatgaatattacaatgtcgtatttgaagatttaacacacgaaggagccggcgtcgccaaagtcgacggcttcccgattttcgtgccgaacgcgctgcctgacgaaaaggcgcagattaaagtgacccgggtcaaaaaaggcttcgccttcggccgcctcatcgacttgaaagaagaaagccgctttcgcacggacgcgccgtgcccgatctacaagcagtgcggcggctgccagctgcagcacatcaattacgaaggccagcttctctacaagcagaagcaagtcaaagacgtgctcgagcgaatcggcaagctcgatttaagccggatcaccgtccacccgaccctcggcatggaagacccgtggaactaccgaaacaaagcgcaggtccctgtcggcgaaagagaaggcggcctgatcgcaggcttctaccagcagcgcagccatgagatcatcgacatgaacgaatgcctgatccagcaatcggaaaacgaccgcgtcgttcaagcgattaaagagatctgcggcaaatacggcatcaaagcgtacaacgaagaacgccacaaaggctggctcagacacatcatggtcagatacggcgccgtcacaggcgaaatgatggtcgtcttcatcacaaggacaaacgacttcccgcacaaagcgaaaatcgtcgaagagatcaccgcggcattcccgcacgtcaaatcgatcgtccaaaacatcaacccgaaaaaaacaaacgtcatcttcggcgacgaaacaacggtcatctggggagaagaatacatttacgacacaatcggcggcatcaaattcgccatctccgctagatcgttctaccaagtcaaccctgagcaaacgaaagtgctctacgacaaagcgcttgaatacgccgaattgaacggcgaagagaccgtcatcgacgcctactgcggcatcggcacgatttcgctgtttttagcgaagcaggcgaagaaagtgtacggcgttgagattgtgccggaagcgattgaggatgcgaagcggaatgctgagttgaatggcattgagaacgctgagtttgaagttggcgaagctgaggtcgtgattccgaagtggtatgaggaaggcattgcggctgacacgctagtggttgacccgccgcgcaaaggctgcgatgaggctttgctgcggacgattattgagatgaagccgaagcgggttgtgtatgtgtcttgcaacccgggaaccctggcgcgcgatttgcgggtgctggaggatggcgggtatgtgacgcgtgaggtacagcctgttgatatgtttccgcatacgagccatgtggagtgtgtgacgaagttggttttaaaaggtgcagttgattaa

SEQ ID NO: 690 - DNA, 570 bp, Bacillus licheniformis
atgaaacttgaagatattgtaacggttaagataggaagaaacctttctagaggcaacgttaaaaatgatcatacattagttgcttatacatatgaggatttaatgaatgatttagatggctcatttctagactcacaagctagttttgatgctggacattcaaatcataaagaaagctatttgagcaatgccggagacgttgttttcagctttgttagttccaaagctggaatagtgagtaacttaaaccgagggaaaatcatcaatcaaaattttgcgaaactcatgatcgaacatgatgaattggatcgtagctatttatgttatgcgttgaatgaatcgtacgcaatgaaaaggcaaatggcaatttcgatgcaaggaagtgctgtgccaaaattaactccagcgattttgaaagagttggaaatcaagttgccaagtattgagaagcaaaggataattggaaaagcttatttctgtttaagaaagcgtcaagctttggcaaagaagcaagcagaacttgaagagaaactttttttagaagtattaaaacaattagaccaacaatag

SEQ ID NO: 691 - DNA, 1593 bp, Bacillus licheniformis
atggctgaattacactcaaaactctttagtgccgcagacaacttgcgaagtaaaatggatgcatcagaatataaaaactatttattaggtttaatcttttacaaatatttatctgataaattattagaaaaagtagtagaaatagcgggtgaatcgttagaagaatacaacacacaagacaaacaaactcaattgtatatggaatccttggcagatgaagagataaaaaatgacttgattgaaacgttagtcgacacattgggctatgatattgaaccaaagtatttattcagtgtattagccaaccaagcgaaacaaaacacgtttcatctgaatgacttgaataaggcatttatcgatttgtctacgaaatatgaccaatttaacggtctgtttgatgatgtggatttgaaatcgaaaaaactggggtcggatgatccacaacggaacattaccattactgaagtactgaagaaactaaatgatgtcaatgtgatagaacataatggtgatgttattggggatgcctatgagtacttaattagtcaatttgcctcagaggctggtaagaaagcgggggaattttacacccctcatcaagtatctgacatgatggctcgtattgccgcgattggtcaagaagacaaaaaattgtttagcgtatttgacccaacgatgggatctggttctttaatgttgaatattcgaaactatattaattatccagatagtgtgaaatatcatgggcaagaactaaacacaacaacttttaatctagcgaagatgaacttgatcttgcatggtgttaataaagaagatatgcggttacgcaatggggatacattgaataaagattggccgacagatgagccttatacttttgatgccgtccttatgaatccaccatactctgcaaaatggtctgcagatactacattcatagatgattcgcgtttcaatcgttacggaaagttagcgccgaaatcaaaagccgactttgcttttcttttacatgggttctatcatttgaaagattcgggaacaatggccatcgtcttaccgcatggggtcctgttccgtggagctgcagaaggtgtgattcgtaagaaattattagaagatgggagcattgatgctgtaatcggcatgccagcaaacttattctttgggacatcgatcccaacaacagtcatcatcttgaagaaaaaccgcagcactcgtgatgtgttatttattgatgcaagtaaggagtttattaaaggaaagaaccaaaataaactttctaaagaaaacattgataagattgtcgaaacgtataagaaacgagaagatgtcgagaaatatgcccacgttgcaactttcgaggaaatcaaggagaatgatttcaatttgaacatccctcgatacgtagatacctttgaagaagaagaacctattgatatggctgcaattggctcaaagattaaagatattcgaatagaaaaagcagaactagagtctagcctatatgacatgatttcttcgctacaatatgatgaagaaaatgctgactggatcaagggtgcgttagaggtgtttaatcgtggaaaataa

SEQ ID NO: 692 - DNA, 1194 bp, Bacillus licheniformis
gtggaaaataagcgagtaccagagcttcgatttgcgggatttgctggagattgggaagagcgtaagttaggagaattagtagaaattaaatctggttggacaccttctgattttgttgaaacccaaaaatgtaatggagagatctatataaaagtcgatgatctaaactactctacaagagaattattggattcaaaaatgaaagtcgctatccatgctaaatatcatactataaaaaaaggaagtaccatctttcccaaaagaggtgctgccattatgacaaataaggtgcggattttaggaactgatggatatatggataccaatatgatggcattagaaccaagaaatattaatggagaatttctttatacgttgattgatagaacagggctatttaaaatagcagatacttcaacaattccacaaatcaataataagcacgttgaaccatataaaatacttttacctaatttatatgagcaaaaaaatattggtaactttttcaaacaactagacgacacgatcgctcttcatcagcaagaactaaccaccctcaaacaaacaaaacagggattcttgcaaaaaatgtttccaaaagaaggggagtctgtgccggaggttcggttcccgggatttactggggaatgggaacagcgtaaggctgatgaaatattttactctgtgtctgataaaaatcattcgaatcttccggttctttctgctactcaagaaaaaggaatggtttatagggacgaaacaggacttgatattaattatgatgtaaagtctacaaaaaattacaagagggtacttcctggacaatttgttatccatcttcgttcttttcaaggaggttttgcattttctaatatcgaaggtataacttcacccgcgtatacagtattagattttaaaaataaagaaatgtactattcgttattttggagatgtgttttagctagtgatacttttattaaaaggttagaggcagttacctatggtatccgtgatgggaaaagcattagctttagtgacttttcaaccctaaagttccgagtgccctctcataatgaacagttaaaaataggtaactttttcaaacaactagacgacacaatcgcccttcatcaatgtgaactagataccttaaaagaaaccaaaaaagcattcctacaaaagatgtttgtctaa

SEQ ID NO: 693 - DNA, 3159 bp, Bacillus licheniformis
atgacaaagataccgcataaagatgaagctcaagtagaacgtcgcctgattgaagtgttgggggaagggcacaatcagtggaattatcgtcctgatttaaaatcggaagaagacctatggcagaatttacgtcaaaagattacgcaaaataacttatcagaaattggggaacatccaattactgataaggaatttgacacaataaagacagagttattatcgaaaacacagactccctttgatgctgctagatggctcaaaggggaaaatggaattgctcggattacgattgaacgtgaagatgtctctttaggttcgatgtctttagtgctgtattctaaccaagatataggtggcggaatctctacatatgaagttgttcatcagattgcaaaacaaaaagcaaaccttgatggtcgtgatcgcagatttgacgtgacacttttaattaatggattgccaattgttcaaattgaattgaaaaaggtcagtgccaaagacggtgtatttcaagcctttaatcaaatcaagaaatactcagaagaagggatgtttagaaataatatcttttctactcttcagttatttgtcatttccaatgaacaaacgactcgctattttgctaatgcgatgccaaaagacatgcacaagaaatttgtctttagctggcgcacaaaggacaatcgaaaagtagaaaatctttatgaatttgtaaaacaagtcttaaatattccagatgcacatcgattgattgccgattatacaattgtaagtgaggatcaagacaacaaagctgtaatagtattaaagccgtatcaaattcatgcgattcaagccttgtttacatctgccatgaaacatcaatccggatttgtttggcatgcgactggttcaggaaaaacgttgacaagttttgtttctacgaagttattagctcgcaaagcaggagtagatcgtaccattatgctgattgaccgaaaagacttagacaatcaaacaacgacagaattcaccaagtttgcttccgagtttaataccggtatttcttctggtgatgcaatatcgaatagcttgattgtcggaactggaagtgcgaaggagttaagtgatactctacagtctgatgccaattccaatacagtgattattaccactcgtcaaaaattagaagctgccttgcgctatgcccaaaggcaagaggagcaaaaaggtactcagcgctttaagaaactgctagggcaacatattgtctttgtcgtggatgaatgccatcgtgcgttaagtgcagaagggatgcaagtcattaagggattcttcccaaattcaacttggtttggatttacaggtacaccgatatttaacgagaataaaaaacaggctaaaggtcaattagctcgtaccactcgggatcaatatggagaagttttacacacctataccattaaaaatgcattggatgatggtgctgttttagggtttcaagtagagcacgaagatacaattgatccaacatcattaaataattatatttttaatcaactgcgtcaaaatgaaaaatacgccaatttgactgcagatgaaataaataacatcattgatcaaatggatggaacagaaaaggaagcatatcttgaaccttcttcgtttgaaagtgatgatcatattcaaaaagttattcataagattttcaggccggataatgcctatactaaatttgatttccaaaacggccgcccgcaaaagtctgccattttaacaactagttccattgatatggcgaagcgctactatcgggcaatcaaggaaatgatgaaagattcagattggttgacgaaagaatttgctggacatccgatccgaacgggacgaacgattgaagatccggattttccacgaattgcaatcacctattcgattcaagaaaacgaagacaattctaaacaaattcaagatgaaatgaaagagattattaaggaatataatgattattatcacactgcttggtcgatagaagatattgaacgatataatggtgatattaacaatcggttagctcgtaagaaagcagagttcaaagaatttggtaaacaaattgaccttgtcattgttgtcgatcggttgttgactggtttcgatgcaccaacgattcaaacgttatttgtggatcgaaatttaagttatgcgaatttgattcaagctttctctagaaccaatcgtacttatccaggaaagacaaaaggattagttgtgacatttaggaaaccttcaacaatggagcaaaatgtaaagaatgcgacgaagttatactcgcaagcacaagaggaatctagtcttgtttatccgacttatgatgaatcgaagaagcgctttaaaaaggctcacaaagcgctaactacattagttccaaatccaaccgatattgatgagaacacatctcttgaaacccgaattgagttcgtgaaagcatttcaagagctaaacaattcatatgaagctttagttacatataatgactacaacgatgatatgaagaaatcaccagcacttcaagaacaggtgaaaaccttagaagaatacattggtatatataacacggttaagggttcactcgaagatgaaggaaaccaagatggaccgggaccagatttctcagacattgaattttatggggaaaatgcagttaagatctatgatattgactcaacttatattgaccgactattagaaacatactcggccaataatcagaacatccgcgacgagatcgaaaatgcccttcaaaaactgaagaaatcagaaattgttaaaggcgtataccgcaagatgttaaatgctattgatgccaatgaaatagatgcagaggaagatattcttgcagtgaaacgaagctttttcactaaagcacgtgacaaagcgattcatgaatttgcgaatacgtggtttgtagaagaagatgagctgcatttatctgcaattcaatatgtgataggaataaattctattcctaatataagtaaaatcaacaatagtgggcaatttgataagtataaagccgtacatccagatgcaaaaccattgaaatatagaccagaaatcaaacgtcaatggaaaaagacattagatgaagtcattgtacctttggatgatgagttgagataa

SEQ ID NO: 694 - DNA, 621 bp, Bacillus licheniformis
ttgcaggaagacggccaatttttagaagaccgggttaacgaagaggagtatcagatagcggctcaaaccttcatcatatccgagaatacgaatgtgggatatgaagtcagtcaaaagagaaaacgtccgcaaccaatcattaatcaaggtggtcaaaggcactggacaagaaatgcaagtcttgcctcaaaagctatgatgctttctaactatacttgtgaaattgaccatacccacagaacttttatctctaaatctactaacatgccctatgttgagtgtcatcatcttgtccctatcgccaagcaagaggggttcaaatatgacttagatcaactggcaaacttggtaagcctatgtccacactgtcatcgtcttattcattatggccaagatgaggagaaagaaaaaatgttgaaaaaactgtatgatcagcggaaggatcacttgaaaaaggtaggaattgaaataaccttttcagaacttaaacgaatatataagtatcgaatatttagattcaaattacgggccttggacaagcgctaccaaggctttttgatgtttaacataatagacaaaaggttattgcaaaaatttacatatgtgatgagatcattttaa

SEQ ID NO: 695 - DNA, 1866 bp, Bacillus licheniformis
gtgaattacatacaaacagcaagagacgtattgcagcatgtcggcggtaaagagaatattgcccacttggagcattgttcgacacgactccgttttacattgattgatcaaaacaaggcggatgtaccggcgcttgagaaaacaccaggtgtcatcgctgtccgtatgtcgggccaatgccaggtcgtgattggaaacgatgtcatcgaagtctatgaggaattgaccggccttctcggcggagcactttctggacaaaatgggtcttcccatcagccgaaggaaaagcgaaaagtggggactgtactattagacttcattgtcggtgtttttcaaccgcttgttccagccattgcgggtggagggattttaaaatcgtttctcctcctcttctcgttattcggattcattgatgccaaagggcaaacgtatcagattttaaatatggttggcgatgcgccgctttacttcctgccattgctagtcgccgtgacgacagccaataaactaaaagtgaatccgcttgttgcattatcggcagtcggcgctcttattctgccaaacatgacggcgatgctgacagaaggcgctcaattattttcattcgatgtgaaaaatattgcgtatgcctatcaggtgtttccggtgatattatctgtcctgttgtatgcacagatggaaaaatggtttactcgtatttcgccaaaacccattcgtatcttcttcgtaccgatgatgtctttggttattacagttccgatcactctcctgctgttgggaccaatcggttttacagcagggcaaggcttcacagcactcatccttgctatgtttgataaagtaggctggattgcagttgcgatccttgcagcggttcttccatttatggttgcatcagggatgcacaaagcgatggtgccgtacgctgtaacaacaatgggcaatctcggaaaagaagcactttacttgcctgcatcacttgcacacaatatcgccgaaagcggagcgtgtttcgcaattgcccttcgtacaaaagataaagtgcttcgttcaactgccatttctgcaggaatttccgcattctttggcattaccgaacctgcattatacggggtgacactgcaaaataaacgtgtgctcagcagtgtcatgatcggttctttcatcggcggcatcttcattggacttgtcggacttcaagcgtttgttcttgttggacctggtcttgcaagtatgtcgatgtttatatctgacgagcttccacgcaacttcatgttcgcagtgattggttttgccatctcatttgctgttgcgtttgctgctgcctttattttaggaaaggatcgaaagacagaagaaacggaaaaagaagcagagccaggtgctttcgctgaaaaacttggcgcagatgagacgttcaaaagtccagtcatcggtcaaatgatttcactatctgatgtagaagatgacatattttcttcaaaggtaatgggagaaggaattgccattattccttcaaagggtgagctatatgcaccggtagacggcgagatttcccttctctttgaaacaaaccatgcgctcggcatgaaaacagcaaacggagttgaggttcttttccatattgggatcgacaccgttcagctagagggcaagttctttaaacctttggttcaagcaggagacaaagtcaaagcaggtgatctgctcattcaatttgacctggaaaaaattaaggaagcaggttatgatccagttacactagcagttattacgaatacggatcaatatgatataaaagtcacgcaattaaaagaggttaatcgtcaagatacattgatggttgttacacaattaggagggtaa

SEQ ID NO: 696 - DNA, 1470 bp, Bacillus licheniformis
atgatgacaaaaacaaaaggatttccaaaagattttttatggggcggtgcgattgccgcaaaccaagcagaaggagcctggaatgttgatggaaaaggaccgtctgttgctgatattgccatgtaccgttcgaatttgagtgttgaagattacgaaggacatcttgctgtttcttctgaaaacattgaacgcgcaatgaaagacccggacgtaaaaaaatatccgaagcgcagagggattgacttttatcatcactataaagaagatgtggctctctttgcagaaatgggttttaaaacattgcgtatatcgattgcatggagccgaattttcccgacaggagaagaagcagagcctagcgagaaaggccttcagttttatgatcgtctgtttcaagaaatgaaaaaacataacattgaaccgatcgtgactctgtcacattatgaaatgccattagcacttagtctgaaatacaacggatgggttgaaagaaaagtgatcgacctctttgtgaaatttgccaatgtgtgttttgaacgctataaagatgtcgtaaaatactggcttacctttaatgaaattgacagtatacatcgccattctttcattacagcgggaatcattcctgatcgctgtcctgaagggaaagtagaagaaacggtttatcaagcattgcaccatcaatttgtggcatccgctcttgtgactgcagattgtcatcgcatcattcccggcagtcaggtgggatgtatgctaacgaaactcacgacatacccgcacacttgccatccgagtgatgttgaacgcgcactgaagcaaaaccttgataactatttctatgcagatgttcaagtgtttggcgaatatccgccattgatcaaacgcatgctggaacgaaaaaatatcaatattaagatggaagcggacgatcttgccattataaaagaacatacggtagacttcgtttcgtttagctactatatgtccctgacagaatctgcacaggagggtctggaaaaaacagatggcaatacgattcgcggtgtgaaaaatccatatttgccgtcaacagattggggttggcaaatcgatccggtcggcttaaagatttcgctcattgaattgtatgatcgctatcaaaaacctctcattattgtggagaacggcatgggtgcgaaagatgttgtcgaaagcgatggatcgatccatgatgactatcgtattagctatttcagagagcatttccgtcagatgaaagaagccattgaagaaggtgttgatctctttggatataccagctggggacccattgacattattagtgcgggaacatctcaaatgtccaaacgatatggatttatccatgttgatcaagatgacgatggcaacgggacattgaagcgctcacgtaaagattcattctactggtataagaaagtgattgagacaaacggagaagtattagactaa

SEQ ID NO: 697 - DNA, 849 bp, Bacillus licheniformis
atgtttaaaataaaaaaagttttaaactcgagtgtggtactggctgtagatcagaaccgacaggagatggttttatgcggcaggggcatcggttacggacgaaaacctgggaatatgattgaagaaaaacaggctgatcaagtctttatgccagtagacaatatgaaggcaaaggaatttctccaactgttggattcaattccgcaagaatttattgaattgacccagcaaattgttcagcatgcagaagaaagattaaaaacaaagctaaattccggtgtatacttcacattaatggatcacttgaattttgcagtagagcgctataaaaagaacatcaatattacgaatcgcgtctactgggaaattaaaaactactatacggaagagtttgaggcagggaattatgcgcttcagctcatcaatgaaacatttgggatccaattgccgaaagaggaagcggcaaatattgcgttccacttaatcaatgcattaggtgaagagacagagtcaaaagatggaatgaaaaatgcaaaaatgatcgggagcattgtcaaccttgtccgttacacattaaacatgaaattagatcaagaaaatatccactacagccgatttatcacacacgttaaatttttcgttgaaagattttacgctgataaattgctggcaaatcaggagaatgaattatttgagcaaattgctaatttatatccgcaagcaatggatgtagctttcaaaatcaaggattatatcaagcaggtgcacggaaacgtcattccgaatgatgaactgacatacttggcagtccatattcatcgattgatttcttatcagcaattaaaataa

SEQ ID NO: 698 - DNA, 1113 bp, Bacillus licheniformis
atgagcaaggtcgcttcagaggtggttgcgggggtgttgaacgaattccatttggccattaaaaagcacgatactgagcaggcaaagcatctttttgatgaggcgaagtcgatgttttccgagatggaagaggatcagaatgtgctggcttatttttcgcttcttgaggagcggtaccggatgatgctttatgatgcgaggggagagcggctgccgcgggagtcttattttaatgattcgcagatcgagtgcatcgagcagacggatcatatgattgattactatttctacttttttgaggcgatgcatgaagcgtacaacaagaatgttgagcgggcgatcagtctgtacaaggttgccgagaaaaaactggcgaaggtgcccgatcagattgaagcggccgagttttattttaaagtgtcctggctgtatatgtctcttcggcaaaatgcggtttctctcaattatgcgagagacgcgatgaatatttacaaaatgcatgacgggtacgaaaaaaagctggcgatttcccaagttgtgatggggacaaattacatgcagatgcagcgctttaaagatgcggagaagtactttgaagaatcgattgaaatttccaaaaagattgacgattcatttttagaagcgatgcttcatcacaatatcagcattctgtattccaattccggccggtctcaggaatgcattctcgccgtccagcatgctttgagcaacgccgaatggtgcaagtcaagctactatatcaactcgctttacatgctgaccagagagtttttcaaaatcggcgaaacagaagcggccctgttctatcataaaaaaggacaggaggaattaaagaaaaacgggaataagcattatgaaaagaaaataaatattatttatgagctgtattgccatgaaaacgtaaaaagcatcaaagacgacatccattccttggacgagatgaatgatttagacggtgtctgcgatctttctttgctcatctcaagctattttgagaaaaaaggagatgacaagaaagcgctggaatttgttaaaatattcatgaaagccgaaaacaaaatgagatcattagggagtgaggtattgtcatga

SEQ ID NO: 699 - DNA, 123 bp, Bacillus licheniformis
atgaaaaaattaattctttgcttgtcgttaactgctatggtcttaggcggagctgctttatcccaaagccacaatcaggcgtcaggcggcgttcaaacagcggagctgccggttgggggttaa

SEQ ID NO: 700 - DNA, 759 bp, Bacillus licheniformis
atgaatgacaaaacatttttatcatttttaaaacacgcagataagcctttcagcggctgggatttttctttcattgaagacacaggacgaatgaaaagcgacctgctttcatggtcatacggaagcatggctctgtctcttatccaggattccgaatcaatgttggatatggggacaggcggcggcgagtttttatccaaattggggccgtttccttcgtcagcatacgctactgaatgttatttgcctaatgtgccagtcgccaaggaacgattgacgcctttaggggttcaggtcgttcaaattgatgatgatgaagatcttccatttgaatccggccaattcgacctgatcatcaataaacacgaatcatattcagtacaagaggtgaggagaatcctttcaaaaggaggacggtttctcactcagcaagtcggcgggcttgattgcgaagaaataaatgaaaaacttggcgtgccgctaaatgaagaatttaaggattgggacttggaaacagcgttaaaagagatggaaaagcatgattttaagattttaaaaagcagagaagagtgtccgactcaaaggttttatgatattggggctctggtctattatttgaaagccattccctggcaggcgctcggttttgaagtgaatcaatataaggatgaattgtacgagattcataaaatgatcgaagaaaagggctattttgacgtcacacagtaccggtttatgattttagcggaagcagtttag

SEQ ID NO: 701 - DNA, 720 bp, Bacillus licheniformis
atgggccgtaaatggaacaatataaaagagaagaaagcgtccaaggatgcgaatacgagccgaatctacgcgaagttcggccgcgaaatctatgtggcggcaaagcagggagagcccgatcccgaactgaaccagaacctgaaattcgtgcttgagcgcgccaaaacatacaatgtcccgaaagcgattattgagcgggcgatcgaaaaagcgaagggcggctctgaggaaaattacgacgagctgcgctatgaaggcttcggtccgaacggagcgatggtgatcgttgacgcgttgacaaacaacgtcaaccgcacggctgccgatgtgcgctccacatttggcaaaaacggcggaaacatgggagtgagcggatctgtcgcttacatgtttgatccgacggccgtcatcggctttgaaggcaaaacggctgatgaaacgctcgaattattgatggaagcggatatcgatgtccgtgatattttagaggaagacgatgcagtgatcgtctatgccgagcccgatcagttccacgccgtacaggaggcgctgcaaaacgccggcattactgagttcacggtggccgagctgacgatgctcgcgcaaaatgacgtcgcccttccagaggacgcgcgcgcacagtttgaaaagctgattgacgcgctggaagatctggaagacgttcagcaagtttaccataatgtcgatttaggggcgtaa

SEQ ID NO: 702 - DNA, 210 bp, Bacillus licheniformis
atgaaaacgttaataaaggaaaagcgcacttcgctgaacatgacacaagaagaactggctaaaaggcttaatgtgtcgaggcaaacggtgatttcccttgaaaagggaaaatataaaccttcactcgttctggcgcataaactggctcaaatttttgaatgtctgattgaagatttatttatttttgagggggatgaaaatattgactga

SEQ ID NO: 703 - DNA, 261 bp, Bacillus licheniformis
gtgctcgggatcgcaattgtttacaaagtaaacagacgaattggaaaaaaagagaggctgttcgatgagcgccagcagaagattagctatcaggctaaggcgctctcctggaacattacaatggcggccattttaattgcctgggcgttggtgatcattttccaaggaatatccttttcatttttcctaataacaggtttatatatcctgcaatatttatcaatgctgatcacaaccgtttatcttgctcagaaaaactga

SEQ ID NO: 704 - DNA, 1458 bp, Bacillus licheniformis
atgattcaaataactgacctcaaccgtcaatacataggaggggaatggagagacggccaaagtgaaagcgtgttggccgatctgaatccttttacccataaaacgattgcctcttttcggaaagcgacgcgggaggatgtcgatgcggcttacaaagctgcgcttgaggcgaaaaagaaatgggatggcgtcaatccctatgaaaaaagggcaattttagaaaaagccgcggcttatattgaagacaatagagaagcgattgtgtttctcattatggaggagcttggcggaacacggctgaaagcggcttttgaaatcgatcttgtcgtcaatatgatcaaagaagcggcgggcttcccgctcaaaatggaaggcaaaattctcccttcaccggttgatgggaaagaaaatcggatataccgcattccggcgggagtggtcggcgtcatcagtccgttcaattttccgttctttttatctgtaaaatcagttgcgcccgcgcttggcgccgggaacggcgttgttttaaagccgcatgaggaaacaccgatttgcggcggcacgctgattgcaaagatttttgaagaagccggtcttccgaagggactgctgaatgtcgtggtcacagatatcggggaaatcggcgacagcttcgttgagcatccgattccgcgaatcatctcgtttaccggttcaacgaaggtcggcagctatatcgggcagctggcgatcaaacatttcaaaaaaccgctgcttgaactcggcggaaacagcgccttgatcgttctcgaggatgccgatttggaatacgccgtcaatgccgcgactttcagccgcttcacacatcaagggcaaatctgcatgtcggccaaccggattcttgttcaaaaagaagtgtatccggaatttttaaagctgttcagccaaaaagtatccgggcttaaaacgggcgatccgctggaccctgaaaccgttatcggccctgttattaatgaacgccaagctgaacatttaagaaaatcgattgaaaaaggcatcgaagaaggcgccacaccgcttctgaaaggcgatattaaaggcaatctcgtcgagccgacgattcttgcggatgtcacgcctgatatgtctgtcgccaaggaagagctgttcggtccggttgtatgcgtcatgccgtttgagaccgaagcagacgcggttgagatcgcgaatgacacgcctttcggactgagcggagccgtacacacgggaaatgtggagagcggcgttgccatcgcaaagcaaatcgagacgggcatgatccatgtcaatgacacgacgatcaacgatgagccgcatgtcgctttcggcggtgaaaagcaatcggggatcggaaggctgaacggagagtggagccttgacgaatttacgacattaaaatggatttccgtccagcaccaaaaaaggagttttccatattaa

SEQ ID NO: 705 - DNA, 852 bp, Bacillus licheniformis
atgaatgaagcagtaaaaacggacatccacccgctgctggatgcttttgtgaaagtggcgccgttcctgaatcagctgattcaggacgatgtgacagtggggatttacgataccgaaaagctgatcgtcaacatcccgggaaagacattttccctgaatgtcaaagcgggtgaccctttgcaggaaggcgatattattacagacgccatccgccaaaacaaaaagaaagtaagcatggtgcctaaggagctgttcggcttccctcttgcggcgagagcgatcccgctccacgacgagaacggaagggttatcggcggagtcgggctcggcacgagccttgaaaaatcggatcagcttcaccgcgtcgcggaaagcctgtcggtcatcgtcgagcagacggcttcggccattcaggatatcgccgaatctgtcagcggcttctccggacaaatgtccgacatctccaagcaggcgaaggaagtcagtgaaagcgccggagaaatcgagaaaatttcagtcaccgtaaaaggcatttcagatcaaagcaacctgctcgggctgaacgcggcgattgaagcggcgagagccggagagtcaggaaaagggttctccgtcgtcgccgacgaaatccgcaagcttgcgacacactcaaaagaaaacgtcggccagattgaccaaatcacgaagaaaatccacgcgttattaaaagaccttgagcattcgatcgaagtcatcaatgaacatacgagcggccaggccgcaggtgttgaacaaatttccgccacgatgcaggagatcagcagcaacgcgcaaaaccttgccaagatggcggaacaccaatttgaagactag

SEQ ID NO: 706 - DNA, 1425 bp, Bacillus licheniformis
atgagagtatatacaacgactaaactgaccggattgttattggggccgatcagttttttgctgattctcggcttgataccggaagctgagctggcttacgcgccgcgaatcgttcttgcggttacagcctggacggccgtctggtggattacggaagccgtgccgattccggcggcatcgctcttgccagtcattttgctgccgacattgggtggtttagatatggaaacgacggccaaagcatacggcgatccgattgtgtttatgtatatggggggatttatcattgcgatcgccatcgaaaaatggaatcttcataaacggatggctttgcacattttaaagcggatcggggctgaaagccaccggatcgtgcttggcgtgatggcggcgactgcgtttttatcgatgtggatttcgaatgctgccaccgctttgatgatgcttcccgtagcgctagcagtcattaaagaagtgcaggaaaaagaaattttaaaaggcgaatcgctgcagaagttcagcaaaagcattttgctggctgtcgcgtatgcggcgtcgatcggcggacttgccacattggtcggttccgttccgaacgcggtgtttgccgcgatgtccaagcagatgctcaatcacgaaattatgttttttgaatggtttttattcgggttcccggtttccattctgtttcttgccattttatatgtttatttaacgaaaataaaatttaaagtgagcgcttttcaaggaaaaaagcctgattttatcgatcatgatttaaaggcgcttggcgcaatgacgagggaggaaaaatcggtttttaccgtttttttattaaccgcatgtttgtggatgttcaaatttatccttccgtttcaaatatcagatacgtcgatcgcgattttcggagcggttctgctgtttttaattccgagtacaaaggatgaacggattttggaatggaaggatatgcagtcgctgccatggggactgcttctattgtttggaggcggcttgtcgcttgcggccggtttttcggcgaccaatctgacagcatggatcggcggcaagctcaagctgttggaaggccacccttacttatttgtcctgattattttgacggctgcgattttatttatgactgaaatcatgtctaatacggctgtcgccaatatggtgattccgatgacgatcggccttggcgccgcgcttcaggtcgagccgtacgggctgatggcggcagctgcgcttgcttcatcgtgcgccttcatgcttccgatctccaccccgccgaatgcggccgtcttcagctccaatctgctgacgataaaggatatggtcagggcgggcttttggctcaatatcgcaggtgtcttcttgattgtgatcagcgcatatttttggcttccggccgtctttcaataa

SEQ ID NO: 707 - DNA, 1890 bp, Bacillus licheniformis
atgagcatttttaaagcggaaggtttatataaaacttacggagacaaaacattatttgaccatatatcgttccatattgaagaaaacgaacggatcggcttgatcggaccgaacggaacgggaaaaagcagcttgctgaaagtgatcgccggccatgaatcgaccgaaaaaggagacatcacaaagcccggcagcctccatatcgagtacttggatcaggatcctgatttggacggtccggaaaccgtgcttgagcacatttattcgggagattccgtgatgatgcggacgatgaggacgtatgagcaggcgcttcaggagctgaatgcggcgcctgatgatccgaagaagcaggaaaacctgctggcggcgcaggggaaaatggacgaacatggcgcctgggacgcgaatacggcggcaaaaacgatattgacgaagcttggcgtcgcggatgtggcaaaagaagtgagctccctttccggggggcaaaaaaagcgtgttgcgattgcgaaaacattaattcagcccgctgacctcctcattttggatgagccgacaaaccaccttgacaatgaaacgatcgaatggcttgaaggctatttgagcgggtatccgggctccgtcgtcctcgtcacccatgaccgctattttttaaaccgggtgaccaacaggatctatgaactggatcgagggcgcctatacacatacaaagggaactacgaagtgtttttggaaaagcgggccgaaagagaagcgctcgccgaacaaaacgaaacgaagcggcaaaaccttctcagaagggagcttgcttggctgagaaggggggccaaagcccgttcgacaaagcaaaaagcaagaattcagcgggtggaggaactaaaggagcaggacgcgcctgaaaccggttcttcccttgatttcgcgatcggctcccaccgtctcggcaagcaggtgattgaagcggaaggcgttgacatcagccgcggcgggaatcagcttgtccgttcattcaatgaactgattgtgccgggggaccggatcggcatcatcggaccgaacgggatcggcaaaacaacactcttaaacgcgcttgccgggcgcattaagcctgacggaggacagatcacgatcggccagaccgtaagaatcggctattatacacaggatcacagcgaaatgaacgatgcgctgcaggtcgtcgaatacatcaaggagacggctgaggtcgtcaaaacggccgacggacaagtggtcacagcggagcagatgctggaaaggttcctctttccgcggagcgtgcagcgcaacttgatccgcaagctgtcaggcggggaaaagaggcgcctttatctcttgaaagtgctgatggaggagccgaacgtcctgttcctcgatgagccgacaaacgaccttgataccgagacgctcggcgtgctcgaagattatttggagcagtttcccggcgttgtcgtgaccgtatcccatgaccgctatttccttgaccgcgtagtcgacaggctgcttgtatttgaaggcggcggaaacgtatcgcgttttcaaggttcctacagcgaatatatggagaagcaaaaggagaacagccgtcaaaagccggcgtctgaagccgcagaacctgtcaaacctgagaaaaagaaaaggaagaaactgtcttataaagatcagctggaatgggacggcatcgaagacagaatcgccgctctggaagaaaagcataaacggcttgaagaggaaatcgccgccgccggcagcgattttgccaaaatccagacattgatggaagagcaggcgcaaacagccgaagagctcgaagcggcaatggagcgctggacagagctgtcgctgttgatcgaagagcttgaacaatcgtaa

SEQ ID NO: 708 - DNA, 195 bp, Bacillus licheniformis
atgccttttgaagaattgctcagctgtctgctgatggccgcattatgtgttctcttgtttataaaagcaatgggctgccgcaaagaaaacagaagaggctcgctggcattctttatgatgttcagcatcgtctgcttgaccacgctcatcattaaaattgtaaagctcggccattttttcggccgagctttttaa

SEQ ID NO: 709 - DNA, 903 bp, Bacillus licheniformis
atggaacgcaaactgcatttgcccgcaaaacccgaacgccaccgccgcttcggatctgtcgaagccgtgaaaggaataaaaccgactgataaagaacagatgaaggatattcaaaatacaccgaacgactatttttttgacattgaccatgtcggtgtctcaaacgtttcgcatccgattttgattgcttcctcgctcaagccgtttacacaaacgacgatcggcgctttttcctttacgacgagccttgcgcgcgaccgcaaaggaatcaatatgagccgcctgacagaacagctgcagcgctatcacgaagcaaactggacggttgacttccatacactgaaagattttgcaaaggatttagccggcaatatggaacaggaaagcgcatccgtctccgtcagttttccatggtatttcgaacgcatcagcccggaaaccaaattgtccggactgatgcatgccgatatccatatgacagtctcttatcatgaaaacaaaggcttttcgcaaaccgccggcatcaccgcccatgcgacgacgctctgcccttgttcaaaagaaatcagcgaatacagcgcccataaccagcgcggcataatcaagatcaccgcgcatatcaatgaacaggcggagatgccggacgatttcaaagccgagcttcttgccgcagcggaaacgaacgcaagcgcaaagctccatcccgtcttaaaaagacccgatgaaaagagagtgactgaacaggcttatgagaatccaagatttgtagaagacgtcctccgcttaacagctgccgacttatacgaaatggactggatctccgcctttgagatcgaatgccggaacgaagaatcgattcacttgcacgatgccgtggcgcggctatcgttttccaaatgttaa

SEQ ID NO: 710 - DNA, 1113 bp, Bacillus licheniformis
ttgcagcatagcgaaatcgtcattgttggagcgggacccgcaggtattggaatggggatcgttctgaaaaaactcggttttaaatcgtttacgattttggaaaaagaccgtgcaggagcttcattccgaagctggtctgaagaaatgaaactgataacgccgtcctttaccgggcagggattcggggctttggatttaaacgctgttgctccgggaacatcccctgcctttacttttcaacgcgagcacttgagcggacgggagtatggagattatttggcgcttttggccgatcattttcagcttccaattcaagaaggcacatcggttcgcagcgttcataaagacgacggcggtttttcagttgaaacagataaaggcactatgaaggccaaagacgttatttggggagccggtgaattccaattcccgaaatattcgtttcatggtgcagagattggcatccacaacagcaaggttgccagatggagccaatttgaaaaagcccattattacgtggtaggcggctatgagagcgcaatggatgcggcggtacaactggcgtcctatggcagcgatgtgacggttgtgatgccgaattcgctccgcgaaaacgctgaagccgatccgagcaggtcgctttcaccttacacatgggagcgtctagaagatgcgtatgaaaaagggaaggttcagtttttggaaaaagccgttgtagagaaactggcgaaaaacggaccagcctatgatttatatttgtcagacgggaggaagatccgttcggaaacacggccgattatcgcgacaggctttcattccggcgcaaaacaaatcgagcatttgtttgaatggggagagaacggcaagccgcttttaacaaatgaagacatgtcgaccgtgacggacggtctttatttaatcgggccgagcgttcagcatcaaaacgcggtcttttgcttcatttataaattcaggcagcgattcgccgtcatcgccgagcatttgttgaaaaaacgaaggttttcgatcgatgaaaaggtgctgacagaatacagggaaaatcaaatgtttctcacagatttgagctgctgtgaggtgcagtgtgaatgctga

SEQ ID NO: 711 - DNA, 828 bp, Bacillus licheniformis
atgctgaaagaaccaacgcggcggcagcgcatgctcttcatcggactcgaatcggtcggaaaaacaacgcttttttcagcgatcactgatcagagggcaggcgaagcagcaaatgtgaaaggatcgacgatatttgcggctgaacgggagatcaaaagccttccgggctggcaagccattgatacaccgggcattcgggaggatggcagcgtgtcgaaacgagcgctgaaaaaagagattgaaaaggccgatgaggtggttgccgtcttgcgcggcacccatttttctgaagagctgaacgcggtcttggagctgattccgccggaagcccggcgcgtctgctttatcgttacgtttcaggataaaatgacggacgccatgcgccggaagctttctgagcaagtggccaagcacagtctcccggtcctgctggttgatacgagaaccgtgacagacgataaaaaagagcggatcatcgcttttttaagaaaagaggctgaatttcatccgctcaaacggaggcggatgaaacagattgaacttgaaagtgtggctgttcagcagtctgtgtttcatcgtcccgtagcggggcctgtagtgagcgctgcacttttatgtttgttgtttatggcgccgatcgtattggcttatcatacatcagagtgggtgcagcaatctgcggacaaatgggcggttgtccgctccaaaatgcggtcgggggcttgccgtcatggctgggcgcggcattggcggggaactatggcctgttatcccttggcatttactcgtttgtttgggcgtttcctgtcgttttgtttatgtctatag

SEQ ID NO: 712 - DNA, 1011 bp, Bacillus licheniformis
gtgggtgcagcaatctgcggacaaatgggcggttgtccgctccaaaatgcggtcgggggcttgccgtcatggctgggcgcggcattggcggggaactatggcctgttatcccttggcatttactcgtttgtttgggcgtttcctgtcgttttgtttatgtctatagcgaatgcggcagcggatgattcgggtttaaaggaccggatcgtcgattcattggacccgctgatgcggaagatcggtctgaacggccgtgatttagttccgcttttgaccggatttggctgcaatgtcgtggccgttcagcagacgcggtcatgcagcatgtgtacgagaaagcgctgtgtatcgtttatttctttcggatcagcgtgcagctaccaaatcggtgcgacgctgtcgatttttcatgctgcgggaagggagtggctgtttattccttacctcgctgttcttgttgccgcagcggccgttcataaccggatatggtatcgcatcgatcagaaatgggccgcttacttcgagcgacggcaaacgtttttgcagaagccgtcctggaaagggatcgtctttcgagtaaaagaagtgcttcagcaatttatctttcaggcgatgccgatctttctcatcatttgcctggcggcgaccgtattgaatgaactcggtgtcatccgtcttgtgacattgcttgtctcgcctgttttaagcctgttcggcgctccagaagatgcggcgcctggccttgttttttccctgatcaggaaagacggcattctcttgttcaatgaagggaatggagcgcttcttgacatgctgccgggagcaacgctctttctgctcatttacttggcatcaacctttactccatgcatggtgacggtttggacaattgccaaggaactggggatgaaaacggcggcagccattatgggaaaacagatggccacttcagtcgtttcggttttgagcatcatgatcatctggaagctgacgctttgcatttttaaataa

SEQ ID NO: 713 - DNA, 1200 bp, Bacillus licheniformis
atgagtaaaaagattcctgtgacagtattaagcggatacctgggggcgggtaaaacgacgctgctgaatcacatattgcaaaaccgccaagggctgaaagtcgccgttattgttaatgacatgagcgaagtcaacattgatgcagggcttgtcaagcaaggcggcctgtcgaggacggatgaaaagctggtcgaaatgtcaaacggctgcatttgctgcacactcagagaggatttgctggttgaagtcgaaaagctggcgaagcagggaaatattgattatatcgtgatcgaatcgaccggtatcagcgaaccgatcccggtcgctcagacgttctcttacatcgacgaagaattgggtattgatttgacccggttctgccgcttggacacaatggtgacggttgtcgacgccaatcgtttttggcacgattttcagtcgggggacagcctgctggaccggaaagaggctgtcggcgaagaggatgaacgcgacatcgccgatctgctcatcgatcaaatcgagttctgcgatgtgctgattttgaataaatgcgaccttgtctccgaggaagatctgcaaaagcttgagaaagtgctgaaaactttgcagcctaaagcaaacatcatcagagcggtcaaaggagaggtcgatccgaaggccgtcttaaacaccggtctcttcaattttgacgaagcgagcggttcagcaggctggatcagggaattaaaccaaggacaccaccagcatacgcctgagactgaagaatacggaatatcttcgtttgtatacgaagcgcgccgtccttttcatacagagcggttttataactggattcattcgctgccggaaaacgtcgtcagggcgaaaggaatagcctggtgtgcgacgcgcaacacccttgcccttttgatgtcgcaggcgggtccttccgtgtcgctggaaccgatctcttattgggtggccgcactgtccaaaccggaacaggaacaaattctcagacagaaccctgagcttttaaaagaatggaatgaagaattcggagaccgccatacaaagctcgtctttatcggattggatctgtcgccgtctgaaattaccgcagaagcggatcgatgccttttaacagattcggagatggcggccgactggtcgcttttatctgacccgttcgattggcagattgaaagagctagataa

SEQ ID NO: 714 - DNA, 693 bp, Bacillus licheniformis
atgaagggggaagcgtattacagtgtgagaatgagagcctccgagaacggtccccatgaagaggggggaaaacacatatccggaggagagcggcttgtgcctttcatcggtttaaatgatgccgtcagcgatttattggaaaaaggtatgtctcattcgcggggcaggccggactttatgcaaattcagttcgatcttgtaaacgaaccgataaagcttgttcaacctttgcgcattgaaacgaatgaaacggtatcagcggaagaaggacaagcgctcgcccgtgagctgatcagccgcgccggcgtgccggaaagcgcggttgaaaaagcgtttcaaggcattgccgaatactggggcgtgaggggcgccgttttgtttgatattcattccggccggcggattgacggaagaaaagaaaaaggagtgcgcgtctcgcggctcgattggccggaagccgattttcaaaggtgggccgctttgtgcggggtgccgccaaatccacggttgaaagaggcgcttgccatcgcctcaaaggtatgtgagcacccggccgtcatcgccgaattatgctggtcggatgaccctgattacataacgggctatgttgcggctaaaaagctgggttatcagcggatgacaaaagatgaaagagcatggggacgaaagcggctgccggattttttttgttga

SEQ ID NO: 715 - DNA, 1347 bp, Bacillus licheniformis
atgaatcaatcattcgttgagaaaagcaaacaatatctttggctgccttttacccaaatgaaagactatgacgaaaacccgctgatcatcgaaagcgggcagggaatcaagctgaaagatatcgacgggagggtgtactacgacggattttcttcagtatggctcaatgtccatggccatcgcaagaaggaactggatgaggccatcaaaaaacagctcggcaaaatcgctcattcgacattgctgggaatgacaaatgttccggcgacagaacttgccgaggtgttaatcaagatcacgccggaaaatctgacgcgtgttttttattcggacagcggcgccacagcaatggaaatcgcgctgaagatggcctttcaatattggaaaaacatcggcaagccggagaaacaaaaattcatttcgatgaaaaacggctatcacggcgatacgatcggcgctgtcagcgtcggtgcaatcgagctcttccaccatgtatacgggccgcttatgtttgaaagctttaaggtgaacgttccatacgtataccgctcgaaaagcggcaacccggacgagtgccgcgatgaatgtctcgcagaactcgaacggctcctgagcgagcggcacgatgagatcgccgcgctgtcggtcgaatcgatggttcaaggggcatcagggatgatcgtgatgcctgaaggatatttggcaggcgtccgggagctctgcacgaaatatgacgttttaatgattgtcgatgaagtggcgacagggttcggccgaaccgggaaaatgtttgcctgtgagcatgaacgtgttcaacctgacttgatggcggctggaaaggccattaccggaggctatttgccgatcgccgtaacgtttgcgacagaggaaatttatgaggcgttctatgatgactacaacaaactcaaaacgtttttccacggccactcatacacggggaaccagcttggttgtgccgttgcgctggaaaatttgcgcctgttcgaatcggaaaaaatcgtcgctcaagttgcggaaaagtcgaaaatactggaatcgctctttcatgatctggcagcgctccctcatgtcggcgacatccgccagctcggttttatgagcgggatcgagctcgttcagtcgaaggaaacgaggcagccttatccgcccgaagagcgaatcggataccgggtgtctttgaaaatgagagagcttggcatgctgacgaggccgctcggggatgttgtcgcatttcttcctccgctcgccagcaccgccgatgacctgcgcgccatggtgtcgattatgaaagaagcgattcaagaggttacaggccgtgcgtattga

SEQ ID NO: 716 - DNA, 1140 bp, Bacillus licheniformis
gtgcgtattgacgaatggctcagcagccggctcgcaaagacgaaagcagccgggctttaccgctcgcttaaactgcctcaagctgaacgtacgaattgggcgtcaaacgattatttgggcctggcgaacgacaaacggctgattcatgccgcagaaacagcgctccgccgctttggagccggaagcacaggatcaaggctgacgtcaggcaataccgcatggcatgaaaaacttgagcggaaaatcgccggttttaagcagacggaagcggctctcttgttttcaagcggatatttggccaatgtcggcgtgctttcgtctttgcctgaaaaaggagacgtcatattaagcgatcaattgaaccacgccagcatcatcgacggctgccgcctttcaaaagctgatacggttgtttaccgccacaaggatatgaatgatcttgaagaaaagctccgcgccgcacagagccgtgcacgccgctttattgtgacagacggcgtgttcagcatggacggcacgattgcgccgcttgacgaaatcatgctgctcgccaagcagtaccgggcctttgttatcgtagatgatgcccatgcaacaggggttttgggagaagccggcaggggaacgagcgagtatttcggcgtctctcccgatgttgtgatcggtacgttaagtaaagctgtaggcgcagaaggcggcttcgtcgcaggttctaaaacattgatcgattttttgctgaatcatgcgagaacgtttatctttcaaacagctgtcccgcccgcaagctgtgcggcggcatgcaaagctttagatatcatcgaagacagccgggctaaacgccggcttttgcaatcatcggtgaacacgatcaaacggagtctcgtggatatcgggtttacggtcaacggagaagatacgccgatcatacccgttatgatcggagatccccaaaaagctgttcaatttgcaaacggcctgaaggagaaggggattgaagccccggccatccgaccgccgactgttgcagaaggagagagccggatcaggctgaccgtcaccgcagaacgcaggttgaaagatattgaagatctattagaggggtttaaattaatgggaagagagttgaacttggtgaaatga

SEQ ID NO: 717 - DNA, 708 bp, Bacillus licheniformis
atgaagggtttttttgtaacgggaacagatacgggagtcgggaagacgtttatcgcttgcggtcttgccgctttactgaaagagcagcatgtagatgtcggcgtgtttaagccgtttttgagcggcgagctcgctagcgatccgcagagtgatacagctcttttaaagaacatgtctgaaacgcctcttactgatgaagaggttacgccttttatttttaaagagccgcttgcaccatacacagctgcgaagctcgaagggaggacagtcgggctggaagatgccgtgaaccattggaaaaagataaaggatcggcacgagtgcttcatcgttgaaggggcaggcggaattgctgtgccgctcggggaggattatttcgtcagcgacttgatcaaagcgctcgatttgccggccgtcattgtggcgcgtcccaatctcggaacgatcaaccatacgtatttaaccgcccaatacgcaaaacaaatggggatacgcgtgatcggcatcgtgatcaacggcatcagcagccggccgggacttgacgaacagacgaatccggacatgattgaaagattttgcggtgtgccgctcctcggcgttacaccgaagcttgaagacgcttcaccaacacaaattcaccacatgatcaaggatcatgtcgatgtttccttgattatgaatcaaatgcaaatgggggcagaaaaatga

SEQ ID NO: 718 - DNA, 1002 bp, Bacillus licheniformis
atgaatcagtggatggaacttgcagaacgtgtgctggatggcggggaagtaactgaaaaagaggcgctttccatcttggaatgcccggatgacgacgttcttctgcttatgcatgccgcttttcaaatcagaaaacgctactacggaaaaaaagtaaagctcaatatgattatgaatgcaaaatccggcctttgtccggaaaactgcggctactgctcgcagtcttcgatatcaaaagcgccgatcgacagctaccggatggtcgacaaaacgaccttgcttgaaggcgcaaagcgtgcgcacgatttaaatatcggaacatactgcatcgtggcgagcggcagaggaccgtccaacagagaagtcgatcaagtggtcgacgccgttaaagaaatcaaagaaacgtacggtttaaaaatctgcgcatgcctcggactgctaaagcccgggcaagccgagcggctgaaggaagccggagtagaccggtacaatcacaacatcaatacatcaaaaaccaaccattcaaatattacaacgtcccacacgtatgatgacagggtgaacactgtggaaacagccaaaaaatccgggatgtccccatgttcgggcgtcatcgtcgggatgaaagagacgaagcaggatgtcgttgatatggcgaaaagcttaaaggcgctggatgccgactcgattccagttaattttttgcatgcgatcgacgggactccgctggaaggggtcaatgaattgaatccgctttattgtttaaaggttttagctttgttccgctttatcaacccgacaaaggaaatccgcatttcaggggggcgcgaagtcaacctccgctccttgcagccgttggggctgtatgccgccaattcaatcttcgtcggagactatttaacgacggcaggacagaatgaaacagaggaccataagatgcttcatgatttagggttcgaagtcgaatcggtcgaagaaatgaaagccagtttacagcggtag

SEQ ID NO: 719 - DNA, 1197 bp, Bacillus licheniformis
atgacgacagaactgcacgaggcagggccgagcctgaaatcggattcggatttttggagagatccatatctgttttacgatcagctgcggtccattcatcctgtatataaaggaaccgttttaaagcatccgggctggtatgtcaccggatatgaagaagcggcagcgattttgaaggaaccggcatttataaaccgcgttcctctcccagaagcttctactaaatatgaacaacttcagcgattgcagcgaaatatgatgctgtttcaaaatgagtccggccataagcggatgcggacgattgccggcaaagaattcatgccgcagaagacggcaactttccgccctgctatagaagaaaccgtccatgaattgctcgatcagcttgaaaacaagaagacggcggacatggtatcggaattcgcctttcctttggcaagccttatcattgccggcatgctcggcgtcccggaagaggaatggtaccaattcaggcaatggacggcggatctcattcaaacgatcgatttgacccgtacacgaaaggtaatggcaaaaggcggtgataccgttgccaagctgacggcttattttaaaaatttaattgaaaagcgaaaagcgcatccttctgaagacctgatcagcacattcgccggtcatgagcagcttgctgatgaagaagtgcttgcgacgtgcatcctgcttgtgattgccggacatgagacgacagtcaaccttttgacgaacgggttgtttttgctcatgacacatcctgaccagctcagtgagctgaaagaaaatccgctgctgattgagtcggccgtcgaagaatgtcttcgctatgaaagcccgacacagctgacagcgcgcaccgcgtcggaggactgcgaaatcaacgggaaaatcatcaaaaaaggagagcacttatatatccttttaggcgccgccaaccgcgatccaaagatatttcaaaacccgcatctatttgacatcacaagaaagccgaatccgcaccttgcctttggagccggtgcgcacgtatgtttaggctcggcattggcgcggctcgaagcgcaaattgccattcccgcactgttggcgcggctgcctaacttgaagcttgcttcaacagacgttccatttcgcaggctaatcggctttagatcgctggccgagctgcctgtcatcctcaattaa

SEQ ID NO: 720 - DNA, 831 bp, Bacillus licheniformis
gtgaacactcatcaaaatcgatattcggttcaaagcaaggtttcggcattgattaattgccggctgtttcagtcattcatcacgacggtcattgtgttgaatgccatctcgatcggtttggaaacttacgctttctttaagccttatcaaaaagtattttttattgtggattgcttgtttttaacgatatttgtaatcgaactttctcttaaactgttcgttcaaaaacagcacttttttaaaaacaactggaacgtttttgacttcgtgatcgtcgccggcagtttgattctttacaatacgaatttcgtcagcgttctccgtattttccgggtgctgcgggtcctgcggacgatcacttcggtcccctcattaagacggatcgtcaacgcgctgtttatggcgattccgaccatcagcagcgtcattatcctgatgagcatcattttttacgtgtacgccgtcatcggtacgatgttcttctccgccatcgcgccggaatacttcggcaacctgcagctcagccttctgacactgtttcaaacctttacgctcgaatcgtgggcaagcggcatattcaggcccatttttgccgagagcggctggtcatggctctatttcgtttcatttatcgtcattgcgactttcattatgatcaacttgatcgtcggggaaatcgtgaataatgcgcaaaaaatttctcaggaaatagaggatgagacaggcgagctgaaagaggatacaaaagaaatcaaagaactgcgcgcagaagtcaaagaattaaaggcgcttctgcaaacctatattacccaaaatgaaaagaaagattaa

SEQ ID NO: 721 - DNA, 423 bp, Bacillus licheniformis
gtggagtggatgaagattgatcaaatggccaagcgaagcggcctgacgaaaagaacgatccgcttttacgaagaaatcggtctgctttcttcaccgaagcggacggaaggcggagtccgtctttactctgaagacgatcttgaggaacttgaaagagtgatcagcgcgaaggaagtgctgggattctcgctgcaggagctccagcagttcatggaaacgggcaagcacctggagatgaataaagaaggatacctattgtcgctggataaacgggaacgaaaagaaaagcttgaagacattcagaggatgctgaatgaacagatgagaatgattgatgaaaagattgaaaaatttcaatcattcaagaagcgcttggaaggtatgcaggcaaaagccgagaatgccctacaatcaattgattaa

SEQ ID NO: 722 - DNA, 1185 bp, Bacillus licheniformis
atgaatgaacaaccacctgagaactccagtatgtttaaacagccaaaagcggtctgggcggtagcctttgcctgcgtgatctcgtttatggggatcgggctcgtcgatccgattctgccggcgatcgcgcagcagctgcatgcttcccccagccaggtttcgcttttatttacaagctatctgttagtcacaggttttgccatgcttttatcaggcgctgtctcgagccggattggagcaaagctgacgttaatcagcggtttgatcctgatcatcgtctttgcgggcctgggcgggctctcgcattccatctctcagcttgtcggcttccgcggcggctggggactcggaaacgccatgtttatctccactgcgcttgccgtcattgtcagcgtggcttctggcggaagcgcaaaagccattattttgtatgaggctgctttgggattgggcatttcggttggaccgcttgccggcggagagcttggcacgatatcgtggagagcgccgtttttcggtgtatcggttttaatggccgctgctcttttggccatcttttttcttttgccgcctgtccaaaagccgcagaagaaaatttccgtcagtgcgccgatcaaagcgcttcgttataaagggctgttgacgctgtcaggagccgcattcttatataatttcggtttcttcaccctgcttgcatattcgccgtttgttcttgacttaaatgaacggggcctcggctatgtctttttcggctgggggctgtttcttgcgatcacttccgtttttatcgctccggccgtacagcggatcttcggaaccgtccgatctctgatccttctgtttatgctgtttgcagctgatttgctcgcgatcgggatttggacggagcacatggcgctcgtcatcggggcgatcatcatagccggaggtattcttggcatgatcaatacgattttgacaaccgcggtgatggaagccgcgcctgtcgaacggtctgttgcttcatctgcctacagctccatccggttcatcggcggggccattgcgccttggatcgccggtgtgttagccgatcattttactgcgcatactccatattttgcaggatgcatcgccgtgcttgccggcatcgccgtcttggctggaggccgccgttatttggcgggcatcaaagccggtcattaa

SEQ ID NO: 723 - DNA, 1557 bp, Bacillus licheniformis
atgagtttacttacagttacaaagctgagccacggttttggcgaccgggcgatctttcatgatatatcctttcgcttgctgaaaggcgaacatgtcggtctcatcggagcaaacggcgaaggaaaatcgaccttcatgaatatcattacgggcaaacttgagcctgacgaaggaaaagtagaatggtcaaaaaacgtccgggtcggctatcttgaccagcatacatcgcttgagcgcggacaaacgatccgcgatgtgctgagaaacgctttccattatttatttgcgatggaagaagaagtgaatgccatctacacaaaaatgggcgaggccgaccccgacgagcttgaaaagcttctcgaagaagtcggaacgattcaggacgccctgaccaacaacgacttttacgcgattgacgcaaaagttgaagaaatcgcccgcggcctcgggctcaacgatctcggacttgacagggatgtcgcggaattgagcggcggtcagcggacaaaggtgctgctcgccaaactgctcttggaaaagcccgacatcctgctgctcgatgagccgacaaactatctggacgaacagcatatcgaatggctgaaacgctatttgcaggagtacgagaacgcctttattttgatttctcacgacattccgtttttaaacagcgtcatcaatctgatctaccatgtggaaaaccaggagctgacccgctatgtcggcgactacaaccaattccgcgaagtatatgaagtgaaaaaacaacagcttgaagccgcctacaaaaaacagcagcaggagatttcagagctgaaagacttcgtcgcccgcaacaaagcgcgcgtcagcacaagaaatatggcaatgtcacggcaaaaaaagctcgataaaatggatatgatcgagctcccttcggaaaaaccgaagcctgaatttcactttaaacaagcaagaacatccggaaagctgatttttgaaacgaaggagctcgtcatcggctatgatgagccgttgtcccgcccgctgaacttgagaatggagcgcggccaaaaaatcgctctgtacggagccaacggcattggaaaaacgacattgctgaaaagcctcctgggggaaatttcaccgctgtcgggagaagtcgaacgcggcgaacaccttcatatcggctatttcgagcaggaagtcaaagagaccaacaacaacacatgcatagaagaagtgtggaacgacttcccgtcctttacacagtacgaaatccgcgcggccctggcgaagtgcgggctgacgacaaagcatatcgaaagcagggtttccgtattaagcggaggggaaaaagcaaaagtcagactatgcaagcttatcaattcagaaacgaatctgcttgtactcgatgaaccgacaaaccaccttgatgttgaagcaaaagaagaattaaaaagagctttgaaagaatacaaaggctctgtcctgctcatctctcacgaacctgaattctatatggacatagcgacagaaacatggaattgcgagtcatggacaacgaaagttttataa

SEQ ID NO: 724 - DNA, 1131 bp, Bacillus licheniformis
atgacagaaagatggccatttttaaataaagcaaaaccgtttattcaagaaaactggaaggcgtcgggctttcaagatccgacgaatgtccaaaaaaacgcggtcgatctgattttggacgggcgtgacgtgatcgccgagtcgccgactggaacgggcaaaacgctcgcatacgtcctgccgattctggaaaagctggaggcggatcaaaagaacgtgcaagctgtgattctggctccatcccgcgagcttgtcatgcagatttttgatgtgatcgttgaatggaaaaaaggctctgatatcagagccgcttccctgatcggcggcgccaatatcaaaaagcagcaggaaaagctgaaaaaacacccgcacatcattgcaggtacgcctggacgcgtatttgagctgattaaaatgaaaaagctgaaaatgcacgaagtgaaaacgatcgtccttgacgaaaccgatcatctgcttacgccggagcaccgcgggacgatacaaagcatcatcaaatcgacgctccgcgacaggcagctcctctgtttttcggcgactttaaaagacgatgccgaacgcgagcttcgtgaaatgaccaaggatgcggaagttctcaagatcaagaggtcgaaagaagaatcggcaaaagtcaaacatcaatttctcgtatgcgaccagcgggataaggtgaaaattctgcagaaattctctcggcttccaggcatgcaggcgctcgtctttgttaaagacatcggcaatttaaacgtatatgccgaaaagctcaaatttcatcatgtagaaatcggcgtccttcacagcgaggcgaaaaaaattgagcgcgccaaaatattgcaggcatttgaggcgggagagttcacactgcttctcgcgaccgatatcgcagcgcgcgggatcgacatcgaagatctcccttatgtcatccacgccgatttgccaaacgttgaaggctatatccaccggtcgggaaggacgggaagagcggggaatgaaggaaccgtgatcagccttgtcaaccgcattgaagaagaaaggctgaaaaagctggcgaagaagcttgaaattccgcttcagcggatcgtgtatgaaagaggacggattattgaaagataa

SEQ ID NO: 725 - DNA, 1023 bp, Bacillus licheniformis
atgccgcaaaagcaaattgaacttgcaagacgtccgcagggcatacctgttatggacgatttccgcataaaagaaacggaaattccggaagcaaaaaacggtgaagcgcttgtaaaaacgctttatgtctcagtggacccttatatgaggggaagaatgcaggatacgaaatcctatgtcgagccatttccgcttgatgaagtgatcaccgggggcgtgatcggcgaagtgatatctgcaaaaggagacaagctcaaaaaaggggatattgttttgggccgcttgggctggcaggagtattcagcggttcgcgaagacaatctccagaaaatcgatccgtccctcgcacctgttaccgcttttcttggaattctcggcatgaccggtttgacggcctatttcggacttctggacatcggacagccaaaagccggtgaaacggttgttgtctccggggccgccggagcagtcggctccgccgtcggacaaatcgccaaaatcaaaggggcaagagtcgtcggaattgcgggctctgatgaaaaaacggcatatttaaaagaaaagctcggttttgatgaagcaatcaattataaaacaacggaaaatatggcttcagcgcttgaacaagcttgcccggacggtgtcgatgtttactttgacaacgtcggtggcgcgatttcagatgccgtcttcaccctgatcaataagtttgcacgaattccggtctgcggggcgatttcttcttataacgtcaaaagcgcagaagaagatatgggaccgcgcgtacaaacggccttgattaaatcaagcgccctgatgaagggatttgtcgtaaacgattacagggaccgctttcctgaaggaatcaaacagctcgccgaatgggtgaaaagcggacagcttcaatatgaggaaacgataacagaaggtttcgagcggatacctgaggcatttttaggcttgtttgaaggaaaaaacctcggcaagcagctgatcaaagtcgccgattccgacaatgcctga

SEQ ID NO: 726 - DNA, 384 bp, Bacillus licheniformis
gtgtattatttttcaccggaacagcaatacaacgcatggatcattagcgatttggtcaagcagattttttcaagagagggtcatcaggaagctgatactcatcgatttgaatcatttgccgccagacgattcggcatcaatatcgattatgtcttttcgatcatcatgaacatcggcgatccggaagaaaggagaacggcaagcagcaccgaagacctcctctcttcttatctcctgtcattgctttcttttatcacaaaagacatgttccaatattcaagagaaaatgccaatcaatatcttttaaatgaaagaaatgccgatgtttttcacctttttctgcccgattctgtactgaagaaaacatttcgtgcaatccgctga

SEQ ID NO: 727 - DNA, 348 bp, Bacillus licheniformis
atgaaaccagtagtaagacaatatacaaacgatgaaaaactgatgaaggatgttgaggaactcagggaaatcggagttgcaagagaagatatttacgttttgtcacatgacgacgaccgtactgaaagacttgcagacaacgcggatgccaatacgattggagccgaagagacaggcatcaaaaatgccgtcggcaatatcttcaacaaaaaaggggacgagctccgcaataaaattcatgagatcggcttttcaaaacaagaagcagaacaattcgagaaacagcttgatgaaggaaaagtcctcctcttcgttacggatcatgaaaaagtgaaatcctgggtataa

SEQ ID NO: 728 - DNA, 417 bp, Bacillus licheniformis
gtggctaaagaaaaagatgcagaacaaaaatcggcactgaacatcattcctcttgcggtcacgattttagtcggagcggttatttggtttattccgtcgcccgccggattggacccgaaagcatggcacttatttgcaatctttgtggcaacgattatcggctttatatcaaaaccgctgccgatgggggcaatcgccgtattcgcattggcgatcacggcgctcactggaacgctgtcgattgaagaaacgctcagcgggtttggaaacaagacgatttggctgatcgtcattgccttttttatttcgcggggatttattaaaaccggtttaggtgcgcgaatcgcctatttatttgtacggatgttcggcaaaaaacactcggactctcgtattcactccttgtcagcgatttga

SEQ ID NO: 729 - DNA, 882 bp, Bacillus licheniformis
gtgggctttcaggggaacttgatcacttctgcgatgttcttaacggctatggcggcaaacccgctgattgccaaacttgcccatgatgtggcaggtgtgaatctgacctggacaagctgggctgtggcggccatcgtcccgggacttgtcagcttgatcatcaccccgcttgtcatttataaactgtatccgcctgaggtgaaaaaaacgcctgatgcggcgaaaatcgcaacagagaagctcaaagaaatgggcccgttcaaaaaatcggaactctctatggtcgcggtctttttgctcgtcctttttttatggattttcggaggcaacctgaatattgacgcgacaacaacggcattgatcggtttagccgtcctgcttttgacacaggttctgacgtgggacgatattaagaaagagcaaggcgcatgggatacgctgacatggtttgccgcgctcgtcatgctggcgagcttcttgaatgaactcggcatggtcggctggttcagcgatgcgatgaaatcgtatgtttcaggattctcctggatcagcgcatttctcattttaattgcggtttactattattcgcattatttctttgcgagtgcaaccgctcatatcagcgcgatgtattcggcctttctcgccgtgattatcgctgcaggcgctccgccgcttctcgcagcattaagccttgcgtttttcagcaacctttttgcttcgacaacgcattacggagcgggagcggctcccgtctttttcggggccggctatattccgcaaagcaaatggtggtcaatcggcttcatcttgtcgattgttcatattgtgacatggcttgttgtcggagggttatggtggaaattactgggcatatggtaa

SEQ ID NO: 730 - DNA, 579 bp, Bacillus licheniformis
atgttttggtcagttgatttcatgctgctcggtttcttgtatgcgatcgtctactttttgtacgacattgtgaaaaaccgaaaaaagacaagtttttttagaaaaatagtgtttgccagttttattgtttatttgagcgccgtttatcactatacgataggcggaatcaacattccgccgcagccggcatacgctcaaatgaacattcagctcattccgttttattttgtcactgaatgggtgcaaatgtatcagcagagcggctttgattggtttttttggaattccgtcaagcttacattttttaatgttttattgctcattcctttaggtgtgtatctttccgttctatggagaaaaacttcgcttaaaaaagcggcagtttttgtttttttgacgagctttttgattgagagtctccagcttgtgctgtctgtgacaggattaataatggcgagaacctttaatgtggatgatttaattttaaatacggccggcggtgtaatcggtttctgcctgacgtctttcatgttcggagctaaaggatcagattcccgcaggaaaggtctgcatttttga

SEQ ID NO: 731 - DNA, 783 bp, Bacillus licheniformis
atggcagatagtcagtggtttactgtgacagagcttgatgaatccacatatgcgatcagcgaatacgggcattgggaaaaagtacactcttatttgcttataggggcgaaggatgccgttttaattgatacgggtcttggcatcggcagcatgaagacggtgacggacggtctgaccgatctgccggtcagcgtcatcacaacccatgtccattgggatcacatcggaagccacgatgaatatcagcgcatttacgtccatgaagctgagagagaatggctgacggacggaatcaaaggacttccgatcgagcaaattcgccgcgatgtctcgagagatatcaccaagcctgttccggccggcttttccgctgaaacatacaccccgttcagaggcgaaccgtcgggaacgctgcaagacggagatacggtcggctgcgactcaaggccgcttgttatttatcatacgcctggacactccccggggcatatttgcatctttgatccagcgtcaggctacttgtttaccggcgatctgctgtataccggagctccaatctatgcattctatccgacgactgatccggctcaactggttcagtcgcttgaaaaagtttcggctatcgggcgcgtaaaaaaggttttcggcgggcatcatcagctcggtcttgctcctgacattttagaggaagccggacatgcggcacggcacttgaagaaacacggactggcacagcacggcacaggcatgcaccgatttaagagcctgagctttcaattttaa

SEQ ID NO: 732 - DNA, 798 bp, Bacillus licheniformis
atgatgagtgatccttacatgcctttgacatccgttaacagcggggtcctggaggagtatgccgaaggtgtatttggtttgacggtgcaaatcgtcaatgtgtattttattttcgatcccgattcgcgggaagccgttttaatcgatgccggtatgcccaagtccgctccattcattttaagagaggcgaaagagcggtttggcgattttcggcttaaaggaatcgttttgacacacggacatttcgaccatgtcggcgctttggaaagtcttctcgaaacatggccggttccagtttacgcccatgagaaagaaatgccttatttaatgggaaaagccgattatccgcctgcaaaaccgcaagtgaaaagcgggctggttgcaaagatgtctccgttatttccgaggcactccatcaacatttcgtcccatgtaaagcagcttaataaagatggttcgcttccgtttcttgaaggatggaaatggattgagacgccgggccatacaccggggcatgtttcgcttttccggcagtcggacagaaccttgatcgcaggggacgccgttacaactgttgagcaggagtctctatttgaagtggcaattcaaaagcaggagctgaacggaccgccggcttatttcacaatggattggacaaaagcagcagattcggttcggaagctggcaggattaaaaccggctgcattattgacgggacacggtgtaccgatgaaaggaagcgatttttccgaagcgctccttgatctatcagaccgcttgcccgcctctgattcgtaa

SEQ ID NO: 733 - DNA, 1644 bp, Bacillus licheniformis
atgaaaattcaaaaaagggtccaagctttgctggcaacttcggcaatgtttgcaggactgatgctgtccgatgcggtgtacgctgcggaaaccccttactatggaaagaactatactcagccagagcaagtgtcatcattatatccggagcctgaagaaacattctcaacccctgcttttgtaaaagaaggggaagcctttacgacacaagaagaaatgatgaagtttataaccagtctgacaaagaaaagcccgaatgtcaaaatcgggaatatcggtttttcaattgaaaaaagaaatattcctgtgctttacttcacaaaggacaagcaaatacgttccatatcaaaaaaaccaaccgtctggctgcaaggacagatacatggaaatgagccggcagcgggagaatctgctctggcgatagctgaaaaactggccggaccgtatggcgacaaagtgttggacaagatcaatgtcatcgttgttccgcgggtcaatcctgacggatcatatcagttcaacagacggctggcgaacggaatcgacggaaacagggatcatgtcaagctcgagtctccagaagtgcgcgccattcaccaagaattcaataagtattcgcctgaagtcgttatcgatgcccatgaatacggtgtcggccaaaacgaatttcagagcataggcgaaaaagggtcattaaaataccatgatattttaattttatcaggaaaaaatttaaacattcccaagtcgatcaggcatgcgtccgacagcctttatgtgaacggcgtcagagctaaacttgatgaaaaaggattttctaatgatgcttattatacgacaggaaaaagcaaggacggaaaaatcgaaatctatgaaggcggtacagaagcgagaatcgggcgtaatgcattcgccctccagcctgccctttccttcctggtggaaagcaggggaatagacatcggacgcgaaaattttgcaagaagagtcgcggctcaggttgctacacatgagacgatcatcgacacgacagtgaagcatgcagccgagatcaagcgccttgtctccaaagaaaaattaaagctgatacaaaacggcgctaaagtgagcgataaagaccaagtggtcatcaacagtgagtttgcaggcccgtttaaagacacgcttaaagtcgctgatattgcctcaggacaagcagttgacgttcctgtccaatattacagcgcctcagaggccgttcctgtgctgtcaagaactcggccgaccgcttaccttgtccttccgggccatcaagatatcgaacagaagctgaaggatcagggattaaagagcgtgacactggctttcaaacaaaaactcaccgctgaagcgtatgaggttttatcgaaagaaacagcgggagaatctgagggccggccagtgatcaaggtagaaacgaagctcaaaaaacagaaaaaagagtttcctaaaggaacaaaaatctattttacagctcagcagcaaagcaatctgctgtcaatcgcacttgagccggagtcggttgacagttatgtaagcacaggttacattccttctcaaaaaggcaaagagctgccggtttaccgcttcatgctgaacaccaaaacgcttaattttaaggaataa

SEQ ID NO: 734 - DNA, 1098 bp, Bacillus licheniformis
ttggaatcacatgaagaattatggagggaagccaaggccttcatcgagctctgctacggggaactgtcgaagtccgaagaagaaacaaggatgcgcttacataaaatagataaagaaatcagagaaaccggaagctatacacatacattagaagaaatcgaacatggagccagaatggcgtggagaaacagcagccgctgcatcggcaggctgttttggcactctcttactgtcatcgatcaaagaggcgttcaaaccgaggcagaggtgcgggatgcgcttttccaccatattcagcttgcaacaaacggagggaaaatcagaccgttcattacggttttccccccggaacaaaacggacaaaaaaaagtgtccatttggaaccaccagctgatcaggtatgcggggtatgaaactgagcaaggcgttatcggcgatccggcgtcattggaactgacaaaggcgtgtgaagcgctcggctggaaaggcgaaggtacgccttttgacgtattgccgcttgtttttcaaatagatgggcgtcctcctgtgtggtatgagctgcctcgtgaaatcgtcaaagaggttcggattgaacatccggagattgaaggcttcaaaagtttggggctgaagtggtacgctgtaccgattatagccgatatgaagctggaagtcggagggattcattataatgccgccccgtttaacggctggtatatgggaactgaaatcggagcgcgcaacctcgcggatgcagaccgctataatgcgctcgaaaaagtggcagccattatggggcttgatacggagcggaatacttcgctgtggaaagacaaggcgcttgttgaattaaatactgcggtgcttcactcctataaaaaagccggcgtcagcatcgtcgaccaccatactgcggcaagccaattcaagcggttcgaggagcaggaggctgaagccggaagggagcttgcagcaagctggacgtggctgattccgccgttatcgccggcagcgacccatatctttcacagctattatgaaaataaaacgctgaaaccgaattacttttatcaggaaaagccttaccttaacaaataa

SEQ ID NO: 735 - DNA, 639 bp, Bacillus licheniformis
atgagaaaacacattttttcgctcgctataatcgctatgaatctaatcatgtgggcaatcgcttatccgcacatttccggtcaagttccaatccattggtcatcttcgggggaaatcgacaggtatgcttccaaaatggaagcgatgcttgccatgattgggctgctcgtttttgtatatgtcttgatgttcttaacgccgaaaatcgatccgcgcagaaaaaactatcagcttttttcgaagacttattacattctcatcaatgccatgctgcttatattttctctgatcaacgtgcttgttatcatgaccgggctcgggtatgatctgccggcgggcagcatcgtaccggttcttgtaggcgctctattaatcgtcataggcaattacctaccgagagtccgctccaacttttttttcgggatcaagaacccttggacattgagcagtgattcaatctggaaaaaaacccacagatttgcggcgaaagtatttactttggcaggacttctaatagctgcggacgggttgttatcaatcagtccagaaatcatgcttccggttattttggcaacggttttggcgccctatatttattcttatgttttgtaccggaaggaaatcaatatgaaaagctga

SEQ ID NO: 736 - DNA, 294 bp, Bacillus licheniformis
atgctaaatatgaatcaaacctttaaagctctagctgatccgacgagaagaaagattttgaacctgctgaaggaccgggatatgaccgccggtgaaatttccgaccagtttcaaatgtctaaaccaagtatttctcagcatttaaaaattttaaaacaggctgaattaattcaggatgaaaaaaaaggccaatacatcatctactcgctaaacactacaatgtttcaagaaatcatcggctgggctttcagttttactgaacaagccggcaaagataaaggggatgcaaaatga

SEQ ID NO: 737 - DNA, 273 bp, Bacillus licheniformis
atgcttcaatacagaatcattgtagacggacgcgttcagggcgtgggatttcgctattttgttcaaatggaagcagataaacacaaattgacaggctgggttcgaaaccgcgacgacggcacagttgaaatccgcgccgagggacttgaggaaagcctgaagcaatttttaaaagcaattcaaaaaggaagtccattctcaaaagtaacggatgtaaaagtggaagaaaccaaagaattggacggattccaaaagtttaatatcagctattga

SEQ ID NO: 738 - DNA, 651 bp, Bacillus licheniformis
ttggaaaatcaggagtatgaaatcatatctattcatgtaggccgtccgcgtacatacgaattcgacggtaagcaggtggaaacggcaatcgtgaaggagcctgtcagcggacctgtctatttgagccgtacgaattttgaaggggacgggcaggcggatctgattcaccacgggggagaggataaagcggtttgcgtctatccggcggatcactacatgtattgggaaagcgtcttgaagcgaaagctgccagaggcggcatttggagaaaacgtgacagttaaagggctcaccgaaaaagaagtgtgcatcggcgatatctttaagctgggggaagctcttgttcaagtcagccagccgcgccagccttgtttcaagctggccaaacgtctgaatcaaaaagatatggtgttaaaagtgagggacaccgggtacagcggattctatttcagggttctcgaagaaggaattgttgcgcctgattcgcggctgcagctcgtttcaagagatgcgcatgaagccacggtctcgtatgccaatcatttgatgtaccatgacatgggcaatcacccagccattcggaagatccttgaggttgaagcgctgtcggaaagctggagaagctcatttttaaagcagctgagcgcataa

SEQ ID NO: 739 - DNA, 213 bp, Bacillus licheniformis
ttgccgcctatcccttttcagcgtttttctatagatgttagaatcccaattgcatcgaaatatagaagggagttttctgccatgcattacggaagcaaaggctggtatgtagaagaactgaaaaagctgggaatgacgaagtatgaaggaagaaagcttcaaagctataaaaaacactttttggccaacctgcttgaaagcgtcaaacaataa

SEQ ID NO: 740 - DNA, 156 bp, Bacillus licheniformis
atgctgtttgccatcatcgggctgatcttttttatcgagagcatcctgttaatcgtatatgctcataaaaaaaagaacggcttcttaaaatatattgggatcgtcctcagcatcgcgatcattgtgatgatcgtcaccagtttgacacacggctga

SEQ ID NO: 741 - DNA, 753 bp, Bacillus licheniformis
gtgattgtaacgaatgaccaagagctggaagggctcaagaaaatcggcagaatcgtcgctttagccagggaggaaatgaaggcaaaagcagctcccggcatgagcacaaaagagctggatctcatcggaaaagaagtgcttgaagcccatggcgccgcatcggctccggaaaaagaatacgacttcccgggaacgacgtgcatcagtgtgaacgatgaagtcgcccacggcatcccaagcgaatccagaattttaaaagaaggggatttgatcaacatcgacatctccgctgaatttggcggctactattctgatacgggcatttcttttgtactcggaaaaggcgatgaaatgctgcacaagctttgccaaagtgcggaaagcgcttttcaaaaggggcttttgcaggcgcgcgccggcaagaaacaaaaccaaatcggcagagccgtatacaatgaagcaaaagcaaacggatttaccgtcattaaaaacctgacgggacacgggattggaaggaacctccatgaagcgcccaaccatatcttaaattactatgacccgtttgataatgcgctctttaaaaacggaaccgtcatcgcccttgagccgtttgtttccacaaaagcagaacataccatcgaagccggagacggctggacattcaaaacgcctgacggcagctttgtggcgcagatcgagcatacgatcgtcatcacgaaaaacgaaccgatcattttaacacagcttgactga

SEQ ID NO: 742 - DNA, 1728 bp, Bacillus licheniformis
atgtcttttttgctatatgcgaacgttgtatactacagatttttcagcgactttatcacgctgcctgcaatcatgcaggcaaaaacaaacggaggacagctcggggacagcatcttctcgcttatgcacccgcttgatgttctgtatttcatcgacacctttattttaatcgggctggctgttttctataacagaccatctgaaacaacaacgaagcgtccgtttaaaattgtgatgggagcaagcatcctcgtcttcctcgccaacctggccgttgccgagatcgatcgtccggagcttctgacccgttcttttgaccgcaactaccttgtgaaatatttgggaacctacaacttcacaatctatgatgcggtgcaaaatatcaagtcaaacagccagcgcgcactggcaagttccagcgacgtaacggaagttgagaactatattaaagccaatcatgataagccgaatgccgaatacttcggaaaagcgaaaggcatgaacgtggtttacatttcactggaatcacttcagaccttcctgatcgattataagctcgacggcaaagaagtcacgccattcttaaattcactggcgcacgacaatgaaacgttttatttcgataactttttccaccaaaccggacaaggtaaaacgtccgacgccgaatttatgatggacaactcgctgtatcctttatcgcaagggtcagtgttcattaataaagcgcaaaacacgctgcagtcggctccggccattttgaagtctcaaggctatacatcagcggcgttccacggcaactacaaaacgttctggaaccgcaatgaaatgtataaagccatcggttatgacaaattctttgacgctacgtattacgatatgagcgaagataaaacgaaaaactacgggttgaaagataaaccgttctttgaagaatcaatgccgctgttgaaaagcctgaaacagccgttctatacgaagtttatcaccctttcgaaccattttccgttcgagatggatgaaggcgatacagacttccctgccggggataccggcgacagcgtcgttgaccattatttccagtcggccaactacatggaccaggcgcttgaacaattcttcaacgacctgaaaaaagccggactgtatgataatacgattgtcgtcatgtacggggaccactacggtatttctgaaaatcacaacaaagcgatggccaaagttttgggcaaagacatcacaccatatgaaaacgcccaattgcaaagggtgccgctgttcatccacgcgcctggggtcaagggaatcaaatcccataaatacggcggcgaagtcgatgtagcccctaccctgcttcatttgatgggcgtgaatacgaaagattacctgatgagcggttcagaccttctgtcaccggaacaccgtgaaattattccgttccgcaacggcgatttcgtctctccggaatatacgaaaacgaacggaaactactatgacacgaaaacaggagagctactgaacgaaaaagacatcgatccgaacatcgaagaggccgtgaaaaaagaactcgaaatgtcggataaaatcgtcgacggagatttgctgcgcttctataaaccgaagggctttaaagcgatcaatccgagcgactacgactataccaaccacaatccgaaaacatcagaatctgatgcggcgcaaacaacgaaatcggattccggacaataa

SEQ ID NO: 743 - DNA, 387 bp, Bacillus licheniformis
atggatttttcgagcatcgtttctgaagacaagattaagcaggccattaaggacggcgaattcgaagggcttccgggaatggggaaacctttgaaaaaagacgatgccgcccatgttccagagcatctccgcatggcttacagagtgatgaaaaacgccggaatggcgggggatgaaggcgctttaaagaaagaactgatgacgattgacgacttaatcgcaaagtgcgcggatgaagacgagcgcgagcgtttaattgagagaaaaacagaaacccggctcaggctcgacaggctcgccgacaaaaaaggcatgttttccaagcctgcctcagcgttttataaagaaaaagtgtaccgaaggctgagcggaaataaaaagcgctaa

SEQ ID NO: 744 - DNA, 1401 bp, Bacillus licheniformis
ttgaattgggttgaatacatatcagattggctgtgggggccaccgctgatcatactgctgacagggacaggagtctacttgacgatcctgctgaaattttttcaatttcgctatcctctctatatctttaagcagacgatcggaagtgtcggcaaaaagccgaaaggagaagggacggttacaccgctgcaggctttgacatcggctctcagctcaacagtcggcgccgccaatatcgtcggtgtgcctgcggccatcatgttcggcggtccgggagccgttttttggatgtggctggtcgcgctgtttgccatggcgatcaagttttcggaaagcgtcctcgccgtccactacagagaaaaaaatgaagaaggcgaatatgtcggtggaccgatgtattacattacaaaagggctctccatgaaatggctcggcgtctttttttcagtagcgctgatgatcgaacttgtaccgagcatcatggtgcagggaaattcggtttccgcatcgctggctgagacgttctcgttcaatcgtttatacaccggaatcgggattgcttttttgatcggtttagtggtgatcggagggattaaacggattggaaaagtgacggagctcgcagttccgcttatggcaggggcgtacatcggggccggtttcctgattgtcgtcacaaacctttcctctgtacccgcttttttctctctcatcttttcgaatgcgtttacatcttcttcggcattcggcggctttgcaggtgcggcagttgccgaaaccgttcgctgggggtttgcacgaggcctttattccaacgaagccgggatggggacggcgccgattgcccacgcagcggcgatgaccgaccaccctgtgagacaggggttctgggcggtgatcggcatcgtggtcgatacgctgctgatttgcacgaccaccgccttcgtcgtgctcgcatcaggcgtctggaccggcgaaaacgcatcaagcgatccgggggcgctggccgcagccgcatttcgcagctattttggccctgtgggcggatacttcgtctctgtctcgctcgttttctttgtcttatcaacgatcacagtggtcattttttacggtgtaaaacaagctgaatttctgttcggacggctcgcgggacatgtgattaaattcatctacctggccgccgtcgtcatcggtgctgccggaggagcaaaggcgatatggggattcctcgatctcgcgctcgttttcattcttcttccgaatattttggcggtgctgctcttgagcagaaaagtaaggtctttatatgatgagttttttacatcagaaaagtattatttgaaagacatcggtcagcaggacggcgtttatgaaggtgacgaaaaagtgaacaatttatga

SEQ ID NO: 745 - DNA, 1413 bp, Bacillus licheniformis
atgactgatttgaatcaatcagcgcgacggattgtcgatgctgtcggcggtgctgacaacattgcagcggtaacccattgtgtaacgcgtttgcgatttgcattgctcgatgaaagcaaagtcaatcaagaggtgctggagcaaatagatgttgtcaaaggatcgttttcgactaacggccaatttcaagtggtgatcggccaaggaacggtcaacaatgtgtacgcggagctggtgaaggcaacaggaatcggcgaatcgtcaaaggatgatgttaagaaagcctcagagaaaaatatgaatcctttacagcgtgccgtgaaaacgcttgcagatatatttattccaatattgccggcgattgtcactgccgggctgctgatggggatcaacaatatcctgacggctcaagacattttcttcagcggaaaatcaatcgttgaagtctatccgcaatgggcggatctcgctaatatgattaacttgatcgcggggactgctttcgcatttctccctgcgctaatcggctggtcggccgtcaagcggtttggcggaaatccgctgctcggcatcgtgctcggcgtcatgcttgtgcaccctgatttgttaaacgcctggggatacggggctgcggagcaaagcggagagattcctgtctggaatttattcggtttggaagtgcagaaggtcggctaccaggggcaggtgcttcccattttgctcgcttcttatttgctggcaaaaattgagcgctttttgacaaagcggacgcctgagagcattcagctccttgttgtggcaccgattacgctgcttgtcacaggttttgcttcatttattgtccttggaccgattacatttgccatcggaaatgttttaacatcaggccttattgctgtctttgaacaattcgccgtactgggcggactgttatacggagggctttacgccgctctcgtcattaccggaatgcatcatacattccttgccgttgaccttcagctgatcggctcaaagctcggcggaacatttttatggccgatgctcgcgctgtccaatattgcacaaggttcagccgcgcttgcgatgatgtttattgtcaaagatgagaagcagaaaggcctgtccctgacatccggaatttcagcttatctcggaattaccgaaccggcattgttcggagtgaatctcagatacagatttccgttcgtgatcgcgatgatcagttcggggattgccggtatgttcatttcctcgcaaggggttttggcaagctctgtcggcgtcggcggcgtacctggaattttctctattatgagccaatactggggagcgtttgcgatcggaatggcgatcgtgttgatcgcgccgtttgccggaacatatctctacgcaaaattaaaaatgaaataa

SEQ ID NO: 746 - DNA, 1689 bp, Bacillus licheniformis
atggaaacgaaagaaaatccatggtggaaaaaagcagtcgtctaccaaatttatccgaaaagctttaaagatacaacaggaaacggtgtcggcgacatacgcggcatcatcgaaaagctcgactacatcaaggagctcgcctgtgatgtcatttggctgacgccgatttatcaatcgccgcaaaacgacaacggctatgacatcagcgactattacagcatccatgaagaatatggaacaatggccgactttgaagagcttcttgaagaggcccacaagcgcggcataaaggtgatcatggatcttgtcgtcaaccatacatcaacagagcacagatggtttaaagaagcggcgtccggcaaagaaaatctgtaccgcgacttttatatttggaaagacatgaagccgaacggcgctccgccgacaaattgggaatcgaaattcggcggctcggcgtgggagtttcatgcagagagcggacagtattatctccatctctatgatgtgacacaggcggatttgaattgggagaatgaagcagtcagaaaaaaagtgtacgagatgatgcatttctggtttgaaaaaggaatcgacggcttcagacttgatgtcatcaatgtcatctcaaaagaccagcgtttccctgatgatgacgagggggacggacgcagattttatacggacgggccgagggttcacgagtttttgaatgaaatgaacagggaggttttttcaaaatatgacagcatgacggtcggagaaatgtcatcgactacaatcgcagattgcatccggtatacaaaccccgaaagccgtgagctcgatatggtgtttaactttcatcatttaaaggccgactatccaaacggggaaaaatgggcgcttgcggattttgattttctaaagctgaagaagattctttctgaatggcagacggaaatgaataaagggggcggatggaacgcattgttctggtgcaaccacgaccagccgcggatcgtctcacggtacggggacgacggaaaataccgcaaaaagtctgcgaaaatgctggcaaccgcgattcatatgcttcagggaacgccatacatttaccagggagaagagcttgggatgaccaacccgaaattcgatgacatctccctttacagggatgtcgaatctctcaatatgtaccgtatcctgaaagaagcagggaagccggaagccgaaatcatcgaaatcttgaaagcgaaatcccgtgataattcgcggacgccggtgcagtggaacggagaagaaaatgccgggtttacggcgggcacaccgtggattccggtgcctgacaactacaaagaaatcaacgcagaagaagcgctcaacgatcctgattcgattttctaccattataaaaagctgaatgagctccgcaaggaattcgatatcattacaaccggcgattatcagctcatactggaagacgatcaagagctttacgcgtatttgagaaacggagcggatgaaaaactgctggtgatcaataatttttacgggaaagagaccgagtttcagctgcctgacgatattgatattgaaggctatgatgccaaggttctcatttccaatgacaccgatcttcccgagtcatttaaacgcttcacagtgaaaccatatcaatcgattgtttatcatcttgccaaaccatgctaa

SEQ ID NO: 747 - DNA, 717 bp, Bacillus licheniformis
atgaagatcaacaagtatatgatgatttacaaacaaatcgcggaacaaatcgatcaaagcatactgaatgccggagatatcctgccgtctgaaaacgaccttgccgaacagcacgacacctcgagggaaaccgttcggaaagcgctgaacgtgcttgctcagaacggatatattcagaagattaaagggaaggggtcagtcgtgctgcacagggagaaaatgcagttcccggtttccggtttggtcagctttaaggagctttcagaaacgctcggaaaagagacaagcacgacggtccatgagttcggcttgacgcatccggacgcatatattcaaaagcagctccgcacttccggagatgaagaggtatggcgggttgtcaggtcgcggaacatcaacggagagcgtatcatcctggataaagactattttatccgcaaacacgtgccgcttttaacgaaagaaatatgcgaggactcgatctatcaataccttgaagatgaatgcgggctcgtcatcagctatgctcataaggaaattgtagtcgagccatgtacggcagaggatcaagagtatttggatctgaacggatacgagcacattgtggtcgtgaaaaatttcgtttttcttgatgatacgaccttgtttcaatatacggaaagcagacaccgccttgataaattccggtttgtcgattttgcaagaagagaaaagtag

SEQ ID NO: 748 - DNA, 693 bp, Bacillus licheniformis
atgattcatgaaactgcaaagatcggaaagaacgtggtattgggagagcatgccgttattgaagaaaatgtggtcatcggggacaacgtaacaatcggtcatcatgccattattaaaaaggacactcatatcggcagcggggtgaaaatcggcgatttggccgtccttggcaaagcggcttcttcaaataaaaaaatggctcgccagccgaagcaggcaggagcccctttgcggatagaagatgatgccatagttggagcaagcgctgtgatttaccgagacgtgctgttggaacaaggcgtcttcgtgggggatatggcgagcattcgcgaaaatgtcgcgatcggcagagaaagcattataggacgcaatgcgatggttgaaaacaataccagaattggaagtaaagcaacaattcaaacgggctgctatatcactgctgatatgacgattgaggatgaagtgtttatcggtccctgctgttccacgtcaaatgataaatatatgggaaagggaaactacccgtatcaaggtccaactattaaaagaggagcgaaaatcgggaataacgcaacattgctgccggcggttgtcgtcggggagggggcggtcattggagcgggtgccgtcattacaaaagatgttcccgcaggcaaaacggctgtgggcaatccaggccggttgatgaagtga

SEQ ID NO: 749 - DNA, 3285 bp, Bacillus licheniformis
atgtccattcaaaacgcggtgatgaacggtggttttgagacaggtgctttctcgccttgggtaggcgtaaacacatctgttacaagccagttttcgcattcaggatttttctctgcgagatttttgggcggaacagccacatcatatattgctcaatttgttccggccggtgcgggggaaggaagcgaatttcttgtttctcttgcgaaagcgggatttctcccggcaccttctgtaacgatacaggttacttattttgacagccagtttaattttctcggatatggtctatttgccactgtgacgtcaagcagaataccggcagccgaaaatgggacatggcttgaagtctatcaaacaacttcaccggctccccttggcaccacccaggcattcattttgattaacaatattccgcaggcgggaactgccagcgtgtttgtggatgatgttgctctattgagtgttgagggtggaggagccccaacgggagcgaccgggccaacaggagccaccggcccgacaggagcgacgggtccgacaggagtaacaggtccaacgggagtcaccggagcgacgggaccgacaggagtgacgggtccaacgggagcgatgggtccaacgggagccaccggagccacaggaccgacaggagtgacgggttcgaccggggtgacgggagccaccggagcgacgggtccgacaggagtgacgggtccaacgggagcgatgggtccaacgggagccaccggagccacaggtgcaacaggagcgacaggtgcaacaggagcgacaggtccgacaggagtgacgggagcaacaggagcgacgggtccgacaggagtgacgggagccaccggagcgacgggtccgacaggtgcaaccggagccaccggcccgacaggagcgacgggtccgaccggagcaacgggagccaccggcccgacgggagcaacaggagcgatgggtccaacgggagccaccggcccaacgggagcgaccggtccaacaggagtaacaggttcaacgggagcaacgggagccaccggcccgacgggagcaacaggagcgatgggtccaacgggagccaccggcccaacgggagcgacgggtccaacaggagtaacaggttcaacgggagcaacgggagccaccggcccgacgggagcaacaggagcgatgggtccaacgggagccaccggcccaacgggagcgaccggtccaacaggagtaacaggtccaacgggagaaacgggagccaccggcccaacgggagcgacgggtccaacaggagtaacaggagcgacgggtccgacaggagtgacgggtccaacaggagtaacaggtccaactggagcgacaggtgcaacaggagcgacaggtccgacaggagtgacgggagcaacaggagcgacgggtccgacaggagtgacgggagcgacaggtccgaccggagaaacgggagccaccggcccgacaggagcgacgggtccgaccggagcaacgggagccaccggcccgacgggagcaacaggagcgatgggtccaacgggagccaccggcccaacgggagcgacgggtccaacaggagtaacaggtccaacgggagaaacgggagccaccggcccgacgggaacaacaggagcgatgggtccaacgggagcaaccggcccgacaggagcgacgggtccaacaggagtaacaggttcaacgggagcaacaggagcaacaggagcgacaggagccacaggtccaacgggagccaccggcccaacgggagcgacgggtccaacaggagtaacaggagcgacgggtccgacaggagtgacgggtccaacgggagccaccggagccacaggtccgacaggagcgacgggtccaacaggagtaacaggtccaacaggagcgacaggtgcaacaggagcgacaggtccgaccggagcaacgggagcgaccggcccgacaggagcgacgggtccgaccggagcaacgggagccaccggcccgacgggagcaacaggagcgatgggtccaacgggagccaccggcccaacgggagcgaccggtccaacaggagtaacaggtccaacgggagaaacgggagccaccggcccgacgggaacaacaggagcgatgggtccaacgggagccaccggcccgacgggaacaacaggagcgatgggtccaacgggagccaccggcccgacgggaacaacaggagcgatgggtccaacgggagccaccggcccgacgggaacaacaggagcgatgggtccaacgggagccaccggcccgacgggaacaacaggagcgatgggtccaacgggagccaccggcccgacgggaacaacaggagcgatgggtccaacgggagccaccggcccgacgggaacaacaggagcgatgggtccaacgggagccaccggcccgacaggagcgacgggtccaacaggagtaacaggttcaacgggagccaccggagcaacgggagccactggcccgacgggagcaacaggagcgatgggtccaacgggagccaccggcccaacgggagcgacgggtccaacaggagtaacaggagcgacgggtccgacaggagtgacgggtccaacgggagccaccggagccacaggtccgacaggagcgacaggtgcaaccggagcgaccggcccgacgggtccgacaggagtgactggagccgccggagcgacaggtccgacaggagtgacgggagcaacaggagtaacaggttcaacgggagccaccggagcaacgggagccaccggagcgacgggtccgacaggagttacgggagcagcaggagcgacgggtccgaccggagccgccggagcgacaggtccagctagtccacaaactgctatattctttaacaatctatttgggtctacttcagtttacaatccaccgactattcctttaaataccgaggtaactgttgtaaacgtccctaatgtgccggtcactagcggtcagaatattaaggtggattatgcgttggcagtagaagcggtgaatactgctaacagtaatatagtttttgaaataagactttatagaggcggaactttagttcaatctagaatctttaatagaagtcttgcatccgcaggaactcaaagatttccattggccagtacaattgttgatactgttccagccaccgcaacaattgactattcagttagagttgcggtgacaactgcttcaaatgttacttctgcggcagcattcaatagagatttaaatctaattcgtttcccttaa

SEQ ID NO: 750 - DNA, 2163 bp, Bacillus licheniformis
atgtccattcaaaattcggtagtaaatggaagttttgaagcgggatcactctctccttgggcggggcaaaatgctgcggtcaccactcaattttcccattcgggcttttggtcggcaacattattgggtggagcaacggtatctttcattgcccaatttgttccagtagatgaaggggaagggcttgagtttcttgtttcgttggctaaatcaggaatcctaccatctccccaggtgcagattcaagtatcatattttgatagtatgtttaatttcttgggtcagggactttttattaatattccgtttaatagattacctgtcgtgcaaaataatgcatggcttgaagtttatcaaacgacatctccggctccttcaggttctacaatggcatttatcttaataaatacactgcctcaagcaggaacagcaaatgtcatagtagatgatgtagctttgttagatatagaagttgcagatgtaatcggcccaaccggcccgaccggagcgacgggtccaacgggagcgacgggtccgaccggagcgacaggcccgacaggagcaacgggagcgacaggcccgacaggagcaacgggagcgaccggcccgacaggagcaacaggagcgaccggcccgacaggagcgacaggcccgacaggagcaacgggagcgaccggcccgacaggagcaacaggagcgaccggcccgacaggagcgacaggcccgacaggagcgacaggcccgacaggagcaacaggagcgaccggagcaacgggagcaaccggcccgacaggcccgacaggagcaacaggggcgacaggcccgacaggagcaacgggagcgaccggcccgacaggagcaacaggagcgaccggcccgacaggagcgaccggagcaacaggagcgaccggagcaacaggagcgacaggagcgacaggagcaacaggagcgaccggagcaacgggagcaaccggcccgaccggcccgacaggagcaacaggagcgaccggcccgacaggagcgacaggcccgacaggagcaacgggagcgacaggcccgacaggtccaacgggagccaccggcccgacgggagcaacgggagcgaccggcccgacaggagcgaccggagcaacaggtccaacaggagcgacaggagcgaccggagcaacaggtccaacaggagcgaccggagcaacaggagcgacaggtccgacgggagcgaccggcccgacaggtccgaccggagcaacgggagcgacaggtccgaccggagcaacgggagcgacaggagcgaccggagcaacgggagcgaccggcccgacaggagcaacgggagcaacgggagcgacaggtccgacgggagcgacaggagcgaccggagcaacgggagcgaccggcccgacaggagcaacaggtccaacaggagcgacaggagcgacaggagcaacgggagcaacgggagcgacaggtccgacaggagcaacaggagccaccggcccgaccggagccaccggagcaacaggagcgacaggagcaacgggagcgacaggtccgacgggagcaacgggagcgacaggagcaacgggagcgaccggcccgacaggagcaacgggagcaacgggagcaacaggtccaacaggagcgacaggagcgacaggagcaacgggagcgaccggcccgaccggagccaccggagcaacaggagcgacaggagcaacgggagcaacgggagcgacaggtccgacaggagcaacaggagccaccggcccgaccggagccaccggagcaacaggagcgacaggagcaacgggagcgacaggtccgacgggagcaacgggagcgacaggagcaaagcaacgggagcgacaggagcaacaggagccaccggcccgaccggagccaccggagcaacaggagcgacaggagcaacgggagcgacaggtccgacgggagcaacgggagcgacaggtccgacgggagcaacgggagcaacaggtccaacaggagcgaccggagcaacgggagccaccggcccgaccggagccaccggagcaacaggtccaacaggagcgaccggagcaacgggagccaccggcccgacaggagcgaccggagccaccggagcaacgggagcgacaggtccgacaggagcaacaggagtga

SEQ ID NO: 751 - DNA, 1095 bp, Bacillus licheniformis
atgatcagattgatcgagccgtatattacatttgaagaagtgcaagcagaattaaaggagatattttcctctggcatgctgacaaaaggcccttatgtcagaacatttgctgatcatatgagacagtatgtcagtgcaaagcatgcttttttaacaacatcggcaacaacggctttatcgatgtgccttaaaagcctgaacgtgcaacccggagatgaagtaatcgtctcagacttctcgttccccgccactgtcaatgtaatagaagatttaggagccaagccggtttttgccgatgttgatcttgaaacatttaacatgcttccagaagaactggaaagtcaaatcacgtcccgtacaaaagccgttctttttgtagatgctcttggaaacccgacaggcatcaccaacattaagcaaatttgtaaggagtacggcttaccccttgtggatgatgccgcttgtgcgatcggcagcagcgaatacggctgtaaatccggaaaaattgccgatctcacctgtttcagctttcacccaagaaagctgcttacgacaggcgaaggcggggcaattacaaccgaccgggaagagttgaaagactggctttcggtcaaattaaaccatggcgctgccatctctgacggaaaattggattttatagatttcggctacaactacagattatccgatatccaagccgctcttggaattaaacagctccaaaaacttgatgacatcattcatcggagaaaccttcagcagaaagcatatagtgaacagcttgaacccctcggattccaaagtcaaaaaatcggtccagccgttgtacacaacatacaatccgccgttttcaaagttccaaaaaacatcgttcgcgacgaattgattcaatatttgagcgactgccatatagagtcgactttcggcacttattgtttaagcggcactccctattaccgccggaaataccaacagctaaaatcgaattctctctttcttgaacaacatacgattaccctcccttgccatgatgaagtcgatttagatcatgtggtttcagccatacaatcatttatcaaatttaaggttgattag

SEQ ID NO: 752 - DNA, 543 bp, Bacillus licheniformis
ttgaaacaatggaaaagcgaaggaaaaggtgaattcactctttcccagcttgggggctgtggcgaaaatgtcgttatcgaagacggggtccgcatttttcatccggaaaacatctatatcggagataacgtttatatcggccatgacacgattttaaaaggctattataagcatgacctgatcatcggttcaaacagctggatcgggcagcaatgttttatacacggtgccggcggggttacaatcggagaatttgcaggaattggtccgaacgtccggatacatgccgcttaccataccgatcctgataaacccgacagtaccattttgttttcgccgcttacattcgctcctattcatattgaagaaaactgcaacatcgggatcggtgcgtctatcctagcaggcgttacgataggcgcccactccaaaatcggagcaaatgccgtcgtcaatcgcaatattcccccgtacagcatagcagtaggcgtgccggcaaaggtgattaaaaaccgaagaatgaaagatgaggatctctcatga

SEQ ID NO: 753 - DNA, 975 bp, Bacillus licheniformis
atgagcgatatgacagagttatccggccagcatattttcataactggcggagcaggctttatcggatcctctttaataggaaagctgatagagcgcaacagcgtcaccgtatatgacaatttttcaagagactccctccggtataagccttaccgggaccatcctcacttgaaagtgctgcagggagacattttggatttgaacgcgcttaaaaaggcgatccagggggccagccacattgtccacgccgccggcatcgctgggattgacacggtcattcaaaacccggttaaaacgatgcaggtcaacatgatcggttcagccaatctgcttgaagcggctgccggtttaaccgaatgcaaaagggttgtctgtttcagtacaagcgaagtgttcggccaaatcgctttcagagcgcgcgagaccagtcatactgttttaggagcggtgggagaagcccgctggacatatgctgtcagcaaactcgccgaggagcatatggcatatgcctattttaaagaacttgggcttccgaccgtcaccgtccgcccttttaatgtttatggaccggaacaagtcggcgaaggcgccatcaaaacgatggttcacagagctctgttagatgagccgatctatattcacggcgatggaacgcaaatccgggcctggtgttacgtagatgacatgatcgacggaattttgcgttgtttgacgatgaaggaagccatcggagagtctttcaacatcggcaatgaacgcactgtgatcaccgtatacggattggcaagcacgattatcagagttctcggatcaaaatcacaaatcttctttggggagaaaaaagaagccgatattgaactgcgcatccctcaggtcaataaagcaaaagagatgctcggtttcagcgctaaagttgatctggaagaaggcatcagaagaacagctgaaagcattaaaaaaaatttggatcaataa

SEQ ID NO: 754 - DNA, 1374 bp, Bacillus licheniformis
atgaaagatttcaaatcagatatcattcattgtctggaacaaaaagagtggaacaaagccatgaagcgcctaaaggagtgggaagcccagggatcgcataacgagcctgacttttattttcttcaagcctctctttctgtctatctcggccatgactataacgcttggctgtggctctggagagggcttgatctttttcctgaaaacagatctttaaatctgctgatgggaaaagtgtgcctgcgcaccggaagggaaaaagaaagcgcggcctatcttcaaaaaggagatggagcagaaaccgcaagctggccgaagctggatcttcctgttgacgaaaaaaccgaacctccggctgggcaaatccgcattttgcaaggcacaatggaaatcgccaatcaaatgaataccttggctaaagggctctcacagcatggcgcgcttgcccacactttaaattactatccgtattatttaaattacgctgccgactacacctggtcattgctgaaagaacgcaatacgcccgccatgaatgcgaagctgagaaggcttgccaatgatctcctgccatcctatgatttgttccattttcatttcggcacaagcttcacgctggacatgtcggattatcccattttaaaacaggctgagaaaccaatggtcatgcatcattggggcagcgatgtgaggctttattcaacattggctaaaacaaatccatacgccgttgtcaaaacgaaaaacgaagctcgaattcgataccacctcaaacgaatttcccaatatgtccagcactgcatcgtcgccgatatggagctttacgagtatgtaaaagactattatgagcatgtccacatgattccgaccatgatccagcttgaccgctatactcccgactacaggtcaaatgaaaagccgctcatcgttcatgcccccacctctcccggaataaaaggaacccgccacatccttaaggcggttgaatctttaaaagaaaaatacgattttcattttcacctagtacaaggagtttctcatgaacaggcaaagaaaatctaccaaaaggctgatttgatcattgatcagcttcatatcggcagctacggattatttgccgtcgaatcgatggcaatggggaaacccgttatctgctggatcagtgattttatgaaggatcactatccttccgaactgcctcttataagagcaaatcccgccaacattacagaggtgattgaaaatgtgcttaaaaaccgggatatgctgccggaaatcggccagaaaggaagaaagtatgcagaagttcatcatgatatggtgaaaaacagcaaaaaaacattggctgtttatcagtcgctactttcggaatga

SEQ ID NO: 755 - DNA, 1986 bp, Bacillus licheniformis
atgaaggagaaagaagaccttttcaaaaaaatggtcaggcgtccaaaaatcatttttttcgtcaaaccggatttggaccggtttttgaattctgtcgttgagcacctttccggaacttaccggacaaaaaaaatcgtggttcatgacctgaatcaaatcgacgctggcatgcaatgggcggatatttgctggtttgaatggtgcgatgatttattgatccacgggagcaaagtcccttctgcagcggctaaaacattaatatgcagactccacagctatgaagcatttactttttatattaaaaaggtatattggcaagcggtggaccaagtgatttttgacggagagcatttgcgggaatacgtattggatcaagtcaaggcgttgaaaaaagagaaaacggccgtcgttccaaatggaatcaagctagatcaatacacttttaaacaaaggcaaaaaggctttcacatcgcttatgtcggctatatcaactataaaaaagggccgatgcttttgctgcaggctttcaaagcactgattgacaaagacccaagatacaaactgtttatcgccgggacgtttcaggacgcccgctatcagttgtacttcaagcaaatgattgatgaactgcggctgactgacagcgtccaatttgacggatggcaggatgatatgaatcaatacttggaagataagcattacctgatttgcacgagccttcttgaaagtcagcatatgtcggccatggaagcgatggctaaaggcataaaaccgctgattcacaatttttacggcgcaaagacgatatacgatgaatcagttgtttggaatacaatagatgaattcgtggccatgatcacaagcggtgattatacatctctccattatcggtcgtttattgaagagcattattcatatgacctgagcatgcgcaaaattgaagagatgatttcaggctttgcaaagcagtcagagttgacggttatgccaaatccgccgctgattacggtaggcatcatcaactataattacagtaattttattgatgaatgccttcaatccgttttaaatcaactctaccctaatatcgacattctgatcgttgacgaccattcaactgacgactccatgcaaaaaatcagcagctatcaaaaaacgcatccgcacattcgaacgatatgccacagcgaaaatacaaaacttcctgatctcgcttttaaggaaatcttccaagaggcaaagggagaatatgttttgcttttaagcgcagatgatttcctcccgcacaatttggtgatccatgactttatgcaatgcttttttgaagaagagggattggattatgtttacggcgaccttttgctcgttgatcaacacgggaaaaatgcgggtctgtggacatatcaagagtatggcgatgaggagctggtgaggactatttttcaaaggggcggctcaggcattgtcccgatggtgggcatgtttaaagcatcttattatcagcaaaaaggcttcacttggctggttgatccgcaaaagccgcttgcaggggatgtgctgaattgtttggccaacacgaagcgcggctggaagcggcgctatttaaaaaaacctgtattatgctaccgccgccaccaaaaaaacatttcctaccaattgcataaaagaattcaatcgcttgtgtacgtcatggattatattgtgaaagaatttgacgaaagcgtctattttcctcatatcaaatggaaggagcttgaggaaaatcaaagacagtccttgaaatatttcagcatcggaaaaaccttttggagaatggcccggagatacgcacaaaacggatatacccggcatttagatcaagacgccaaaaaagaatgcattcagccgctcctggataaaatggatgaatacttccaattaagcctcgcttcagacaatcagtatgaacgatatatgaaaaatattaaaaaaatccagctgatataa

SEQ ID NO: 756 - DNA, 1083 bp, Bacillus licheniformis
ttggttacaatcagtctatgtatgattgtcaaaaatgaagaagaagtattagcgagatgccttgatacagtgaaagacattgtagatgagattaatattgttgatacggggtcgacagataaaactgtagagattgcgaagcgatacacagaccgcgtctttttctttgaatggatcggcgattttgcggctgcccgcaatgaatcgttcaaacacgccactaaggattatattctctatctggatgcggatgatgttttgcttgaagaagatcagaaaaaactgaaagagttgaaggaaacgcttgatccttccgttgattccgtgtctatgtactatgatgctggaaccgacgaattcggaaatgtgacattaaggtaccgccgcaaccgtctggtgaaaagggagaagaactttaaatggaaaggcgactgccatcaatatttggaggtattcgggaacatcatcaatgccgatatttcagtgacgcataaaaaaatccgccactctgtcggacgaaacctcaatatttaccaaaagaagattgatcgcggcgacacgtttaccccgcgcgactatttttactacggtaatgaattaagagaaaacagacactacgaaaaagcgattgaaagctacaataaaaacattgaaatgaaagaaggatggattgaagacaaagtatacgcctgcatcaacaaagccgactgccaccgctttctcggcgacatggacaatgagctgagatctctgttccagtcatttgaattttctaaaacgcctcgtgccgaaacatgctcaagaatcggctataactttcagcggaggcgggaatacaaggccgctatctactggtatgagctggccacaacattggtgcctgattcaaataaatggagcttcacctatccggcatactatacttggtaccctcatttgcaaatgtgtgtgtgctattacaatttaggagactttgaaaagtcgtatcatcataatgaagaggcgaggaaataccgtcccgaagacaaatccgtccttcataacaaacagctgctggaagggaaattaggcattaacaattag

SEQ ID NO: 757 - DNA, 1110 bp, Bacillus licheniformis
atgatcccgttagtcaatttaaaacgtcaatttcaaacagtaaaacaggatattttaaaagagtttgaacatgtgctggacagcggccaatatatattggggccaaaggttgaagaattagagaaaagaatagctgaaaagcttggtgtaaaagaagcggtcgcggtcgccaacggaacggatgcattggtgctgacgcttgaagctttcggcatcggcaaaggggatgaagtgattacgaccccgttcacttttttcgccaccgccgaagccgtctcaagggtgggggctgaacctgtgtttgctgatgtcgatcctgaaacatacaatcttgatccgaaaaaaatagaagaaaagatcacccctgctactaaagcgatcattcccgtccatatcttcggacagccggctgatatggacgagatcatggagcttgccaaaaaacacggactgcttgtgattgaggatgcctgccaagcgttcggcgcatcgtataaagagcggcctgtcggcagcatcggggatgccgcctgtttttcatttttccctacaaaaaacttgggaacattgggagacgggggaatggtgacgatttcagacccggatgcagcccggcaattaagaacactcagaacccatggcactagcaaaaaatacttccatgacaaaatcggtttcaacagccgtcttgatgaattacacgccgcagctttactcattcttcttgagaaaatcgacggctggaatgaacaaagaagaagagtggccagccgctacagagaaggtttgaaaacggcggagcacctcacactgccggcagagaaagaggaccgcacacatatctatcatctctattgtatcggcgcgaaaaaccgcgactacatcatacaatcgctgaaagagcaggacattcattcaggtgtgtattatccttgctgccttcatctgcaatcggtctattcttcactgcagtacaaaaaaggcgattttcctatagccgagtccttgtccgaaacccttttcgccattccgatggatccttttctagccgccgaggaacaagatcagattatttctgcgctgctgaaaaaaggaggaggggaaaagtga

SEQ ID NO: 758 - DNA, 1065 bp, Bacillus licheniformis
gtgacggttcattttggtttaatcggctgcggctatatgtcaagaaaacatcttcaagcactggccgagtgcgatgatgcaaagttgtcggccgtcagtgatttgcaggaagaaagaatgaaggaagcggaagaatactatgcttccctcgccggtgaggaaagccgaatgacccgctatccgcagtatcaagcgctgctttcagatcctaaaattgaagcggtcattattgcggcggtttcgggactgcacgccgaaatggccaaacatgcgctgctggcaggcaagcacgtcatcgtcgaaaaaccgatgaccttgtcattacgggatgccgatgagcttatagaactggcggagcagaacgggctgaagctcatggtctgccaccagatgcgccaccggccgatcatgaaaaaactgaaggaaacgattgaggaaggaaagctgggaaagatctacttgggcacggtatcgctccgcttaaacaggtcccccgcttattatgaagcggcatcctggcggggaagctgggaaaaagacggcgggatgctggtcaatcaagggatacatctgatcgatctgctgcaatggtttttaggtgatgtaaaaggcgtttacggagatatgctgggcggctccggagctaaagaaacggaagatgttgctgtcggtattctgacgtttgccagtcaggcgaaaggtgtagtagaagcgaatatcgtcacacagccaaacaatatcggaagctctctctcgatttttggagaaaatggaacgatttcattggaaggtccggcattaaaccggatcagccgctggtacatccacggggagaaggcggatgctgaagaagcggcaaagctgattgacatcggcggcgaacaaaccgcaatgtatcaaaactttataagcgccctcaagcgccaagacacgctattggttgacggctatgaaggaaaaaaggcgattgaaaccatctttggaatctatcaatctgtgctgcagaagcaaccggtgcagctgcctctttcttcatttcaaacaactgatatgaaaaataaatag

SEQ ID NO: 759 - DNA, 1296 bp, Bacillus licheniformis
atgagcaaacaggaaattcataacgaaacgatagcggtcatcggcttggggtttgtcggtctgcccttggccatgttgttgatatcaaaaggaatgcgggttatcggtgttgatttggacaaaaagaaagtcgaggcattgcggaaaggaaccagctatatttcggatataaacgatcaagcggtgcaggacggaataggcaccggtttctttcgtcctgtttcggactacagtttaatcggtgaagcggatgccgtcatcatctgcgtgccgacgcctttgaatgatgatgcgggtcctgatttgaattatgtgaaaagagcggcgcaattgattggagcgcacttgaaaaaagggcagctcgtcgtgttggaaagctcgacatatccgggtacgacaagagacatcgtcaaaccgatcctggaaaaaagcggccttgtatgcgggaaggatttttacttggcttattctccagaacgcgttgatccgggcaatcagttcccgattgaggtcgtgccgaaggtagtgggaggagcgacggatgcatgccttgaaaaggtgcatcaattatacagcggcatttatgaagaggttgtgcctgttacatcgccagaaacagcggagctgacaaagctgctcgaaaatacgtaccggtttattaatatttcattcattaatgaattcgcgatgatatgcgacaggctcggggtgaatgtgtgggaagtcatcgaggcggcaagcacgaagccgtatgggtttgcggctttttatccaggccccggcatcggcggccattgcatccccgtcgacccgctgtatttgcagtttgtcatgaaacaaagcggattatcgagcgactttatcgagctgtcggaagcgacaaatgatagaatcgtccgctatatttcagagcgctccttgcagctggcagggaaagacaaggcgacagacgcccgcatcttaatctacggcgtcacctataaacgaaatatcgcggatgtccgcgaatcaaaatcgcttgatattatagagaagctgatcggcatgggagcagatgtttcctaccatgatccgcacgttccggacctcgacctcagcggcaaaaagctagcaagcgtgccgatagattcaaagatgctgaaagagtatgactgtgttgtcattttaactgatcatgacgcactcccgaaagagctgttattaaaccatgcaaacgtgatatttgatacgagaggagtgctgagggaagcagccggaaaagcaaaagtcatccagctcggaaacgggcgctcctga

SEQ ID NO: 760 - DNA, 912 bp, Bacillus licheniformis
gtgtggatcggaattctgttgatggtctctgggattgggatcagtattttcgccgtcagtctgattgtcagctatttgtttgttttgccgaaccggagcacatatgaagaaacttttttcagcggactcaaacacggcgagatcatcgatgacgtgtttgagtcccacgacaaagaagagctgtttttgacagcaggggatggatgccggctgcatgcgctgctatttcccgttcaaaagagcaggaaagccgtcatcatctcccacggcatcaagtggtcgctgtttggcgggtataaatacgtcgagctgtttcagtccatcggctacaatgtcctgctttgcgacagcaggtgccacgggttgagcggcggttcacacgtttcctacgggttttacgaaaaggatgatttggcgaggtgggctgacgagcttgagaacaggttcggcaaagatctttggatcggggtgcttggcgaatcgctcggagcggcggctgccatcgagctgatgaaacaggatcggagaatcaagttttgtattgccgattcctgcttcagcgatttaacagagctatgccgctttcagctgaaagccgccgtcaaattgtccgtgccgtttctcatcccgttggcaagcgggctgatcaagcggcgccacggctggagccttgctgatatatcgccggtcagcaaccttgagcagtcagacacgccgctgttgatcatccacggcacaaaggatcagcttgttccgccggaaatggccaaaagcctgtatgagaggaaaaagggattcaagaaactgtactggattgaaggcgccggacatgtcggcggatttcgccacaatcctgaggaatacttaaataaaatcaaagactttatcttgaaaatcgagccggccaattag

SEQ ID NO: 761 - DNA, 393 bp, Bacillus licheniformis
atgaaaaaacatccggcagcatgcgaagcaccggacggttattcatgtccggtggaagcaacgatcgatatcatcggcggcaaatggaaaagcgtcattctgtatcacttgatcgatgataaaaaacgctttaatgaactgcggcgcttaattcccggcgtgactcagcggatgctgaccctccagcttcgagagcttgagcgcgacggcatcgtctgccgtacaatttacaaacaggttcctccgaaagtcgagtacagtttaaccgagttcggcaagacgctgatcccgatcatccggcaaatgatgaattggggaacgtcctacgccggcaaaatcaaggaagcgcgccaaagatcggcagccgctgaaaaactggaatcgcaaggctaa

SEQ ID NO: 762 - DNA, 684 bp, Bacillus licheniformis
atgacagagcaatccaagaagcaagagattcttgacgcattccaatttagacatgcgacaaaagaatttgatccggacagaaagatatcagatgaggattttcagttcattttagaagcgggcagactgtcgccaagctcggtcggcctcgaaccgtggcaatttgtcgtcgtccaaaataaagagctgcgtgaaaaactgcgtcaagtctcatggggtgcacaggggcagcttccgacagccagccatttcgttttgctgctcggacgcacggctaaggaaatgcgacgtgattccggctatgttgcagatcaattaaagcatgtgaaaaaaatgccggaggacatcattgaaaatatgctgaaagaagacggcgttctggaaagtttccaagacggcgattttcatttgtacgaaagcgacagggcgatgtttgactgggtatcaaagcaaacgtacatcgcgctcgccaacatgatgacggctgccgctttgatcggcattgactcctgcccgattgaaggctttaactacgacaaagtccacgacatccttgaaaaagaaggggtgttggaggatggccgctttgacatctcggtcatggccgctttcggataccgtgtgaaagagccgcgtccgaagacgagacgggcgcttgatcaaatcgtgaaatgggtcgaataa

SEQ ID NO: 763 - DNA, 4272 bp, Bacillus licheniformis
atgatactcagtttactcatgccaaacacccagacatatgcagaagaacaaaacgaacacccgctgatcagcctcagcatcttgggtacgacagatatccacgcccatatgatggattatgactactatgccgacaaagaaacggctgaattcggactggcacgaacggctcagctgatcgaaaagtaccggagccggaatcctaacacgattcttgtcgacaacggcgacttaattcaaggaaaccctctaggggaatacatcttcaaacatgaacgtgaatcgattatctccggaacgaaaacacacccgatcattgatgtcatgaacaaactgcaatatgacgccggcacgctcggaaaccacgaattcaactacggccttgaattccttgacggcacgataaaaggggccgaatttcccatcgtcaatgccaatattaaaacaccggacggaaagaacaaatatacgccatatcatattgaagaccggacgctgacggatgaaagcggccgaaagcaccagcttaaagtcggctatatcggcttcgttccgcctcagattttaacatgggataaaaagcacctggacggcaaaatcacagtgcaggacatcaccgaatcagcaaaagaaacgattccaaaaatgaaacaggaaggcgccgacgtgatcatcgcgatcgcccactccggaattgaaaatggcgaacaggcggcgggagccgaaaacgccgtatacgacctggctctcaagacggaaggaatagatgcgatcatctccggacatcagcacggtctgttccccggcaccgactatcccggtaacggcgtgatcgacaaccaaaaaggaacgatcaacggcattcctgtcgtcatgccgaagaactggggcagccatttaggaattatcgatatgcagcttgaactggacggcggcaaatggaaagtgaaagatgccagcgcaaaaacggaagcgattgccggaaatgtgacgtcgcgaaacgaaaccgtcgtttccgcgattaaagatacgcacgaaaaaacgctcgaatacgtccgcgcgccggttggccaaacagaagctgatattaacagctttttcgcgcaggtaaaagacgatccttcaatccagattgtcacagatgcacaaaaatggtatgcggaagatgtcatgaagggaacggaatacgaaaacctgccgattttatcagcgggcgcgccgttcaaagcaggaggacgcaacggtgctgattattatacaaacattaaagcaggaaaccttgcgatcaaaaacatcggcgatttgtatttgtacgacaatacgctctatatcgtcaaactgacgggaagcgaagtgaaggactggatcgaaatgtcggccgggcagttcaatcagatcgatccttcaaaatcgggtgaacaggcgctcctcaaccccgatttcaggtcgtataatttcgatgtcattgacggtgtgacctaccagatcgatgtcacacagcctgcaaaatacaatgcctcaggcggggtgaaaaatccgcaggcgaaccgcgtcaaacagttgtcttacaacggaaaacccgtccgcgacgaccaggaattccttgtcgtcacaaataattaccgcgcctccgggggcggcggattcccgcatctgactcaggacaaagtcgtttatgcggcggctgatgaaaacaggcaggtgctcatgaactacattatggagaagaaaacggtcaatcccgccgccgacaacaactggtcgatcgctccgattaaaggagccgacgtgacattcgagtcttccctccttgccaaaccgtttgctgaaaaagcgaatgacatcgattttgtcagggaatccgaaaacaaaggatatggcgtctataagctgaactttgacggttcagagcctccagttgatgatgaaaactggacattaaccgtcatgcacacgaacgacacgcatgcccaccttgatggagcggcaaggcgcgctgccaaagtgaaagaaatccgcagtgaaacagaaaacaatgtgctgctcgatgccggcgacgtcttttccggcgatctgtattttacaaaatggaacggactcgccgatttgaaactgatgaacatgatgggctatgacgccatgaccttcggcaaccatgaatttgataaagggcctaaagtgctcgcagactttctcagcggaaactatacagccgtcgacccgttaaacagacaccagctggaaaagcccgattttccgatcgtcagctccaatgtggatgtatcaaaagagccgaagctgcgaagctttcagaaagagcctgcagtcttagcagcgggaaaaaagaaagaaagcggcatctatccttatattctgcttgatgtaaacggcgaacaagtcggcgtattcggcttgacgacggaagatacgtcatatacatcaagccccggtccgaacattgcgtttcatgacgcttatcagtcagcagagaaaacggtgaaggaactgaaagaaaaagaaaaggtcaacaaaatcatcgccctcacccacctcggctacaaccgggatctggagcttgccaagaaagtgaagggcatcgatttgattatcggcgggcatacgcatacacttgtcgatcacttgaaagtggtggagaacgaagaaccgacaatcgtcgctcaagtgaaagactacggacagtttttgggaagggtcgatgtggtgtttgatgagaacggcgtcgttcaaacggaccaatcaaggttcaatttgatcgcgatcgacgacaaagtggacgaagaccctcctgggaaagaagtgcttgacggctttaaagaagatattgacgaactgaaaaagaaaaaagtaggctatgccgatgtcccgctggacggaaaacgcgagcatgtccgctcaaaagaaaccaacctcggcaattttatcgcggacggcatgctgaagaaagcaaaacaagccggcggagctgacatcgccatcacaaacggcggcggaatcagaagcggtattgccaaaggcgaaatcacactcggcgatgtgctgacggtcatgccgttcggcaacaccctttatgccgctgatttgacgggggcgcaaatcaaagaagcgcttgagcacggggtgagccaagtcgaagaaggcggaggcgcgtttccgcatgtttcgggtctatccttcacctttacactgagcaagccaaaaggtgagcgaatccttgatgtgaacctagtcaatgacaaaggggacgctgttccgctcgatttggacaaaacctaccgtgtcgctacaaataacttcatgggcggcggcggagacggctattccgtttttaaagaagcgaaaaacggtgtcgatctcggctttaccgattacgacatttttacagagcagcttgccttatacgattctgtttcaccgaacatcgagaacagaatcacagaagtgttccttcccgaccgtcaggcagacggctcttggacgcttgcggaaaagccgttcgaaacatacgcgaaaaacgcaaatcaggcgattgcctatttccctgacacagaaaaggaacacatcatgctgaatatgacaaaagcacagactgaccttgtcaaagaaagaaccggtgatccaagcatcaccctgaaaaacgatcgcattgcgatgcagcttccagccgttaatctggcaagcgaaaagacaaaaatcagcattaaaatcgccaaggatatcaaacaggcggtcacaaaggtatatgatttcaacattcagcagaatggtaaaacggtcagcacatttaaagagcctgtcggactgttgttccaagtcgatgctcctgataaacatttgagcgtctattatgtcgaccgcaaaaacaacagcttcacaaaagtaacaaacggctatacgaaaggccgtaccgttgcaggctatgtcgaccatttcagcgagtataccgtgatgaatgacaatgatgccgggtcgccttcccttccgacgggttccggcgatgatgacactccggatggcggcagcggcggtgaaccccctgcttcgcccggcgccggcagcggcggagacggatcaggcggtcatgacagcggcggagcagatgacggaaatgaaccttccgatggttcaaacggcggttttttgcctgacaccgcttcaaacgcctatcattggctgatgctcggcctgctgttgcttatatccggaagcggcctgtacctttaccaaaggaagcggcgcaagctccagatctaa

SEQ ID NO: 764 - DNA, 516 bp, Bacillus licheniformis
atgagcaaaaaaattgcagttgttctgacagattactttgaggattcggagtataccgagcctgcgaaagcgttcaaagacgccggacaccagcttacggttattgaaaaagaaaaaggcaaaacgctgaaaggcaaacaaggcgaggcgcaagtggaaacagatgcgtccattgacgaagtcagcccggctgattttgacgcattgttgattccgggcggattttcgccggatattcttagagccgaccagcgtttcgtatcgtttgcaaaatcctttatggatgacaaaaaaccggtgtttgcgatctgccacggcccgcagcttttaatcaccgccaaggctctggacggtcgcggtgcgacaggctacacatcgattcaagtcgatttggaaaacgccggggtcaaatttaaggacgaggaagttgtcgtctgccagaaccagcttgtcacaagccggacgcctgacgacatccctgcgtttacacgagaatctttgaagctgctcggctga

SEQ ID NO: 765 - DNA, 216 bp, Bacillus licheniformis
ttgtcagatcaaaaaacagccgagctgaacaaaatgatcgaagagatctcacagaaattaaacatgctgaacatcggcgtcattaaagctgaagacttcagcaatgaaaagcttgaagaccttgaatacctgcaccaaatggtgatgaaaaagaaatctttcagtccgagcgaaatgcaggcaatcgcagaggaactggccgcactccgaaaataa

SEQ ID NO: 766 - DNA, 1359 bp, Bacillus licheniformis
atggaatttatttcacatattgtagatacaatgaacggttttttatgggggcctccgcttttgattctcattgttggaacagggatttatttgactttcaggctggcttttttgcaggtcagacttttgccttactctttaaagctcgccttttcaaggcatcaggataaatcctccgaaggcgatatttcccactttcaggcgctgatgaccgcccttgccgctacggtcggcacagggaatatcgtcggcgtcgcctcagctgttattgccggcgggccgggcgccgtattttggatgtggctcgccgccttcttcggaatggcgacgaaatatgctgaagcggtgcttgctgtcagattccgcgtgaaagataaaaacggcgaaatgtcaggcggtccgatgtattatttggaacacggcctcaagcaaaagtggcttggcgtgttatttgccatattcggggcgcttgccgcttttggaataggcaatatggttcagtcaaattctgtatccggagtcatgagctccactttttccgttcctgcctgggtaaccggcattattgtcacgacttttaccgcccttgtcattctcgggggaattaaaagcatcggcagagtcacctcgctgttcgtgccggtcatggctttattttatgtcatcgccggattgatcattcttgtcacaaactttgaacttgtccccggcgctgtcggtttaattttctctgacgcgtttaccgggcaagccgtggcaggaggcgcgatcggaaccgtgatccgctggggcgtagcgcggggcgtattttcaaatgaagcaggtctcggctcggcgccgatcgccgcagccgcggcaaaaaccgatatgccggcccgccaggcgcttgtctctatgacccaggttttcatcgacacattgattgtctgttcgattacggggatatcaattgtcatgggaaatatgtatctgacagaaaaaaccgatgccctgacatcgatgacattcgcacactttcttggtcctgcgggatcgacaatcgtcgcgatcggactgctgctgttcgcctactcgacgattttgggctggtcgtactacggagaaaaatgcttcacctacctgctgaatgaaaaatatgcgatcgtctatcgtatcatctttgtgatcgccgtctttttcggagcggtctttaaaaatgacttcgtctgggcgcttgccgatatgctgaacggcctgatggcaattccgaacctgatcggcctgctcggtttgacaggcattgtcgtctatgaatccaaacagatcctcgccaaaatcaaagccgaaaaagaagaaaagcaaaacagcgtatctgtttaa

SEQ ID NO: 767 - DNA, 474 bp, Bacillus licheniformis
gtgatgatcaaagtgttatttgtctgcctcggcaatatttgccgatctccgatggcagaagctgtatttaacgatatgctcaaaaaaagcggactggaggaccggatcgaagccgattcggctggcacaggaagctggcatgtcggcaaaccgcctcatgaaggcacaaggtcgctgctgtctgaaaaaaagataagctgcgaaggcctgtatgcaaggcagattactgacaaggacccggaagcgttcgattatatcatcgcaatggatgccgaaaatgcaggccatgtgagaagccttgccggctacgggagcaaagccgtcatccggaggctgctcgactatgtcgaagactgtgagacggcagatgttcctgatccatactacaccgggaactttgaagaggtgtacgaactcgtcgcgaaagggtgccgcgaattgctgaaggacattcgaaaagaacacaatctataa

SEQ ID NO: 768 - DNA, 351 bp, Bacillus licheniformis
atgaaaaacgaccgcgttttcatcagaaatatcctcctcggcgcttcggtcggggcggttatgtcactgctgcacaaaccgactagggaagcgtgcggtgcaaagcttaccgcgtgcaaaaacaaagtccgcctttaccgtgcaaatcccggcatgctcaccgaatgcgtgaaagaaaaaatggacgaagccaaaaagctgacggcttccatatcggatgatttgagcttcttaaatcaacagataaaagagctgaaggaaacgacgccaaaagtgatcggcctgattgaggaaacgagggatcacttcacagccaaatccaaaggacgtacggagccggaaaaagaatga

SEQ ID NO: 769 - DNA, 816 bp, Bacillus licheniformis
atgagttttttgaaagagctgggctggcgttttttccttcatgaaggaccgagcaaatcggcggaacttgcctacttttttctattgtctctgtttccgtttatgattttcctattgacattgatcggctacctgcctgtcaaaacgggcgatgtcatcgggctgatcgaacagtatgccccagaagacacgatgtccgtcattgaagagaccctgaataccggaaacaggggcctgctttctttcgggatcattgcggcgctctggtctgcatcaaacggattgaacgcgattgtcagggcctttaaccatgcttatgaagtagaggaaaaccgctcttttatcatggttcggctgacatcgctccttttgaccgccgcgatggttttcacaatattggtcgcgcttcttctgcctgtattcgggagggccatcggccattttatcgccaatctggacggtacgccggagatgtttctgacggcatggtcagcgcttcgctggggaatcagcccgcttgtgctgctgatcgtctttacggctttgtacttttttgctccgaataaacggctgtcatttaaattcgtgcttccgggagctgttgcagcgaccgccggctggatcctcgtcagcgtcctgttctcatactatgtcagcgaatttgcaaactacagtgcgacatacggaagcctcggcggcatcatcgtcctgatgatctggttttatttaagcggaatgatgattattcttggaggggaaatcaatgcccttttacataagcgtaaaatcattcctgaagaaaatccgcggaattga

SEQ ID NO: 770 - DNA, 1179 bp, Bacillus licheniformis
atgactagatttcactttttcattctcgttttgattgtcagtatatcaggtttttcgcaagggatgctccttccggtcatctctgttattttcgaacaggaaggccattcggctgcactgaacgggcttcatgcgacaggcctctacatcggcgtcctgatcgcttcgcctttcatggaagcaccgcttcgcaggctcggttttaaaccgctgattgtcatcggcggggtgatggtgtgcgcgagtttgttcgcctttgtttttattcagtcgtttatcgtttggttctttttgcggctcttgatcggaatcggggatcatatgctgcacttttcaacgcaaacttgggtgaccacattatcgtctgaaaaaaaacgcggccgcaatatctctttgtacggcctttcgtttggtttgggatttgcagccgggccttttttaacgccgcttgtcaacatcgccccatcattgccgtttatcgtctcaggtgcgttcagcctgctggcatggctgtttattttttgcctgcaaaacgatttccctgagaaaagcggctctgaaagccgcagcgataacagcttgaagcgtttcgctcaagccttcctgcttgggtgggtcgcgtttttgccgacattcggctacggctttttggaaaccgccctgaacggcaattttcccgtctatgcgctccggtcgggcatttccgtcgaaggcgtatcgatcattcttccggcttttgcgatcggaagcatcgtctttcagtatccgctcggcgtgttgagcgacaagtacggaaggcgaaatgtactccttgtcatattggctgtcggggcaggctgcttctttgctgcgggcttttccgaatccgttcttctgcttgcggcatgttttttcatagccggaatggctgtgggatcaactttttcactcggcatcagttttatggccgacctgcttccaaaacgccttctcccggccgggaacttgatgtgcggaattacattcagcttcggaagcattttcggtccggttgcaggcgggtggtatatgcagatattccataacagcaacctgttttatttgattacatgcgtgatggtgttgatctggatcggggtgctctttggcaaaacgaagaaaaacggcgctctcgaacaatctgaggcggcgccaatgtaa

SEQ ID NO: 771 - DNA, 381 bp, Bacillus licheniformis
atggaaatcgtgtggaatcagaacggctttgaggctgatctggaatatgggaagcttaaaatatcaagcaatgaagaagcgggattcaggccttatcaattgctggccgcttcgattgcggcatgcagcggaaccgttcttcgtaaaattttggaaaagaaaaggatacagctgaaagatatgatcatcgaaacaaaagaagaacgcatttccgaagaggctggccgcatcaaaagcatccatcttcacttcatattgaagggagaaaacctcggtgcagaacaaatcaaaaaggcgctgagaatagcgctgaaaaactgcgccatggtgaggtctgttgaaaacagtattgacatcatcgaaacatttgagattcgctga

SEQ ID NO: 772 - DNA, 1056 bp, Bacillus licheniformis
atgagccgttttttcttttggatgatggctgcgggtgttccactttctgtcgcagggagccttctgcattggccgcaggttttattgttcatcatatactgcctgacgatcatcgcgcttgcaagctatatgggaagagccaccgaaagccttgcgatcattgcgggaccgaggatcggaggccttttaaatgcgacgttcggaaacgccgttgagctgatcatttcgattttcgcgttgcgggaaggactgatcggaattgtgctcgcatcgctgacaggatctgtcttgggcaaccttctcctggtcgccgggctttcgtttttcatcgggggcctgaaatataagcgccaggaattcaacgtgtatgatgcgagacacaattcaggtctgctcatgttcgcggtgattgtcgctttcgttatccctgaagtgttttcagctgaaatgacagagccgaggaagctgtcgatgagcgtcggcatcagcatcatcatgattttgctttacctggctgcactttatttcaagcttgtcagccaccgcggggtttaccagacgaatcaaaatgagcaggaagaatcgcatgaagagccggaatggtcgggaaagcgcgcaacattgatcttatttttggcaactgttgccgtcgcctacatttccgagcacctcgtccatacgtttgatacggtggccgaacaattcggctggtcggagcttttcatcggggtcatcattgtcgcgatcgtcggaaacgcggcagagcatgcttccgccgtcattatggcctataaggacaaaatggatgtcgcggttgaaattgcgatcggatcaacgcttcagatcgcgatgtttgtcgcccctgttcttgtcatcagctctttgttttttccaacgagcatgccgctcgtctttaccttgccggagctggtcgccatggcttccgccgtccttttgatgatcatcatttccaacgacggggacacgaactggtttgaaggcgcgacattgctggccgcttatatcatcatgggaatcggttttttccttctttaa

SEQ ID NO: 773 - DNA, 792 bp, Bacillus licheniformis
atgaaaaagcttttgtgttttacgctgactgcgtttttatcctttagttttttcgctgtacaggaagctgacgcagccaagccgatcaagattccaagctctgtcacgaatatttccaaagagaacacataccctaacgcctctcaggatcagccgaggctgcagccgagcgaattagccgaagagctgctgaaaacaaccgatattgcgattgaaaatccgcatctgattaaaatgctgaatgagtcaagcatttccggcacaccgctggcaatcggctatcgggcgacgatttatttgggcagatgggcgctaggttacacctcgaatgaaaccgttgcgaactgggaataccgcaaaatcaacacaaaccgctttgacaaccggggcgggaaagcacctgcagaactcacgtattcccaggaacagacgagcaaaatcaaaggcggcttaacagcgaaagttccaaaggcggaagatgtcaaaaatatgatgatgctcaaagccatggaaaaaacaaagctgccgctcgcctttgaaacagtggtcggctccggtacaaaacgcgatcagatttataaagtgcagccgaaaaaactgggaaatttacacgcctatgcacctgccgtcaatgaaaaaggaaaagtcacctacggcgaagtgtacatcgtattaaaaggcaacaaaagaaagctagtcgtcaaaaatatcacctcgcaaggaatcggcgcttggattcctgtacaggatcacctgacattcggctttcagctcagccatcagccgaaataa

SEQ ID NO: 774 - DNA, 1122 bp, Bacillus licheniformis
atgacagaaaaaatgcaggctcgtccgatcaccccggaatatgatccgtgggaagcctacatggacgttgaccaatttggagatatacagctgacgaacgttgaatttacgacgacgactctttgcaatatgcgctgcgagcactgcgccgtcgggtatacgctccagacgaaggacccggacgcgctgccagtcagccttctgttgaaacggcttgatgagattccccgccttcgttctttaagcattacgggcggcgagccgatgctctcattaaaatctgtaaaggaatatgtcgttcctttattaaaatacgctcatgaacgcggcgtgcggacgcagatcaactcaaacttgacgctcgatatcggccgctacgagctgatcatcccctacctggatgtgcttcatatttcccacaactggggaacggtcgaagactttgcagaaatcggcttcgctatgatggataaaaagccgacgtttgcacagcgggcgcgctatttcgaaaaaatgatcgaaaacagccggacgcttgttgatgaaggggtcatggtctccgccgagacgatgctcaacaaacggacgcttcctcatatcgagcatattcaccggcaaattgtcgaagacatgaaatgccagcgccatgaggtccatccgatgtatccgagcgactttgcaagcgcacttgaatctttaagcttaaaagacatgagaaaagcgatccaccgccttcttgacattcgcgacgaaaatacgtggatgctgttcggcactctgccgttttacgcgtgcagccctgatcctgaagatcacgccctcttacagcggctgcgcgaagcgaaaaacgtcaccgtcagaaacgaccctgacggcagatcgcgcctgaacgtcaatatttttgacggcaatatcatcgtgaccgatttcggagatactccgccgctcggcaacattcagacagacagcctgccaagcgcctacgcgaagtggagaaaaacagagcttgccaaagaactcaactgccactgcccgcacgtccggtgcctcggaccgaatgtgctcgtcaaaaacagctattatcaagatgttgattttacttccagaacagcaagagtatga

SEQ ID NO: 775 - DNA, 186 bp, Bacillus licheniformis
atgggtaacgcagtacatgacaaagaacagcaagtcaattatttgaaaaacagattggatatgtttatgtcagtcatcgattctttagacccggaatcgaccgaccttgaagatattgacagactgatcagcatgctcgacgatttggaagccaaatacgagcgctttaaaaaagactggaaataa

SEQ ID NO: 776 - DNA, 783 bp, Bacillus licheniformis
atgaaacgaatctgtgccatatgctgcggattcctgctgacgctggcgttcagcggcaatgctgaagcgatttccaacaaggcgatccattggggtttttcaaaaagcaaaaaccatcagccggcagatgcgggtcaagagctgaccaaccttttacagcagtacgacgccttttatttgggcaacacaaaggaaaaaacgatctatctgacctttgataacggctatgaaaacggctacacccctcaggtgctcgatgttctgaaaaaacaaaacgtcaaagcggccttttttgtgacgggccattttgtcaaagatcagccggagctgatcaagcgaatggccgaggaggggcatatcatcgggaatcattcatatcaccatccggatctgacgacgaaaacaagccgcgtcattcaagaggaattggaatcggtcgatgaggaggtttacaaaatcacaggcgaaaaaaacaacctctacctgagaccgcctcggggcattttcagcgagcgggtgctcgaagaaacgaaaaagctcggctatcaaacggtattctggtctgttgcttttgtcgattggaaaatcaatgcccaaaaagggtggcgctatgcgtacgacaatatgatgaaacaggctcaccccggcgccatctatctgcttcacaccgtctcgagagacaatgccgaagcgcttgatcaggcgatcaccgacttgaaaaaagaaggttatacatttaaaagcctcgatgacctgatgtttgaaaaatctattgatgcttga

SEQ ID NO: 777 - DNA, 1104 bp, Bacillus licheniformis
atgtcaaaatcagtaaaatcagtcacatcacctaaaaaatttattacaggaaaacgactgctggagaacttgaacgactacattgaagattttggcgacaacgcatatatcatttgcgatgaattcattttggaacgcgctcaaaaagaagcggggaattcgattcagaaagccggcaatcaagccgtttttgaaaaattcaattacgaatgcacacaggaagaaatcgatcgcaaccgggagcttgcacgcaatgcaggcgctaatatcatcgttgggatcggaggcggtaaaacgcttgataccgcaaaagccaccgcttattacgagaagctgccggttgtgattttcccgacaattgcttctacggatgctccatgtacggcccttgccgtcatttataaacacgacggatcgtttgaccgctatctgtttttgccgacgaacccagatgtcgttcttgcggactctgagattttggcatccgcgccgccgcgctttttcgcagccggtatcggtgacgccttggcgacgtattttgaagcgcgtgcctgctttaaagcaaacggcgataacctcgtgctgatgaagccttcaacaactggattgggacttgcccgtctttgctatgatacgctgttggaaaacggtgtgaaagcgatgcaggcggttaagcacggcgtttccacacgagcggtcgaagatacaatcgaggcgaccatctatttaagcggcgtcggtgccgaatcaggcggtcttgccgccgcacacgcgatccacaacggaatgacagccgttccttctctgcacagggctcagcacggcgaaaaagtcacgttcggccttttggcgcagcttgttcttgaaaacgcgccggccgaagaattggagaccgttattgactttatcaaaggcgtcggtcttccgttgacattaaaagacctcggagtcgacgaatttgtcgaagaagaatggcgccaagtcgctcaaagcgcttgcgcggaaggcgacacaatgggcaacatgccgttcccagtcacccctgacgacgtctacaatgcgatcgtcgccgccaacgcgattgcagaatcttatcacgattaa

SEQ ID NO: 778 - DNA, 597 bp, Bacillus licheniformis
atgaaggtacatacagggcttgccggcatcatcatgattgttatcggcctgttgatcagcgccgagaatcatcaaggcgcgtctgtagcagacgcgctttcgggctttttaaaactgcccatccggaatttagtggttctgatctgcatgtttatgatcatcgccggcttcattatggcgtggcgccattattatggagtaccgtggatccgctttaagctgtttttgtttatcatcggtatttcagtattttacccgctggtcacagaacagctgatgttctttcaaaaatggaatgcacaaggcgatagcgccgtggaatatatgaaaaggggaagcgcttgcagctatcagggcgatatggaagcaggaagcatggactgtgaggtgaaagtcaacaactacgggaaaaagaccgcacgcgtccagctcacccctgatataataaatgaatttgactttcagccggaagagctggaactgtcgccgcattcacaggaaacgtacagcgtcacctttacggctccgggaaatgaggatgcatttgcatccggaattgaagaagagccgaggttgaagattaaagtggtgaaatga

SEQ ID NO: 779 - DNA, 960 bp, Bacillus licheniformis
atgattaaacattttgcgatgacaaaggacggacggcttttatccgacaacaaagcagaaaggctgacagatcaagatattgagtggttttggaccgatttcgatcagccttcggaagaagaagtctccttgctcaaaagccattttcactttcaccctttatcggtcgaagactgcgtacatcgcttgcagcgtcccaagctcgatcaatacgaagattatctttttttcgtcatacatgcgttgaatcaaaagactttggcgtctgaagaagttgatttattcgttggaaaggatttcatcgttacatttcattttcatcactcagacggcattgaaaaagtaagaagacagctttcggaaaacagcgagttgtggaaaaacggaccgggccacatcgcctatatggtcatggatacgcttgtggacgaatatttcccgattctttacaaaatagaagaccgcctcaatgaaattgccgaaagcgacagcaggaaaacgtatggaacgctgatgaacgaggtgtttgatatccgtggcgaccttttaaagctgaggaaaacaatcattccgatgcgggatttgctttaccggattttaaacattgaaatttcaaaagaaaaccgcgaacgaaaagcgtattacagcgacatttacgaccatctcttgaagctggccgaaatcgtcgaaaacaaccgtgacatgacagccgatttgagggacagctaccagacgctcaactccaaccggatgaacgccattatgatgacgctgacgatcgtctcaacgatttttattccgctcaccttcattgccggagtgtacggcatgaactttgacaacatgcctgaactgcattggcgctacggctattttttcatcctcggaataatggcagccgttgtcgccggcatgatcttctggttccggcataaaggatggtttgacattttcaagtaa

SEQ ID NO: 780 - DNA, 864 bp, Bacillus licheniformis
atgtggaaggaaactgtaagcgtaacaccgccttatcattttgaccgcgtgttggacaggctttcgcttgatccgctcaatgcggtcaacctcgacaaaagggaggtcaagctgccgctccgcaatcaaaacaaagagcctcgggttgtcgctgtgcaggcgacgggaactgctgaagccccggcgtttgccgtcagcggaatagacgatcgagatgacatgataaaagaagtgaaacggatcttcagatgggaagaaagtcttcagcctgtactggatcacttttcacaatcaagcctatcatcgatttttgaggagcatgccggaacgccgctggtgctcgattttcatttgtatcattgcctgatgaaatgcattatccaccagcagctgaacctgtcttttgcttatacgctcacggagcggttcgttcacacttttggagagcaaaaggacggggtctggttttatccgcttcccgaaacgattgcacagcttgactacaacgatctgcgcgaacttcaattcagcatgcgaaaggctgaatatgtcatcgatacatcaaggatgatcgcagacggccgtttagatcttgatgagcttgatcaattatcagatgaagatattatggaaaagctggtgaaaatcagaggaatcggcccgtggaccgtccaaaacgttctgctgttcggactcggccgtcccaatctgtttccggcagccgatatcggcatccaaaatgccatcaaacgccattttggcttaaacgataaaccgacaaaagaacaaatgcttgaaatgagcaaagaatggcacccttatttaagctatgcttccttgtatttatggaggagcatcgagtag

SEQ ID NO: 781 - DNA, 1392 bp, Bacillus licheniformis
gtgaaacgtgacaaaaaaggatcatcagcagaattaaaagtcggacagcaatttccgctgacgatcaagcgcctcggcatcaatggcgaaggcgtcggctacttcaagaaaaaagtcgtcttcgtccccggcgcgctgccgggagaagaagtcgtcgtcgaggcgacaaaggttcatccgaaattttccgaagggcgggtcaaaaaggtgcgcaaacgttcagagcaccgcgtcaagccgccctgcatcatctatgagcaatgcgggggctgccagctccagcatctggcttatgaagagcagctgaaaggaaaacgggacatcgtcattcaatcgctcgaacggcacacccgttttgacatcggcaaaatggacatcaggccgacgatcggcatggaaaacccgtggcactatcggaataaaagccagtttcagctcgggctttcgaaaaacggaaagatggtggccgggctgtacggccttgactcgcaccgtcttgtcccgattacggaatgcattgttcagcatccggcgacgaacaaaacgacgcaaaccgtcaagcaggttcttgaagacttcggcatttccgtctacaacgaacggaagcgcacgggcgatgtccgcacgatcgtgacgagggtcggcttcgagacgggggaagtgcaggttgtccttgtcacgtcaaaagaagacctgccgcgcaaggagctcattgcagaagaaatcaagaagcgtctgcctgaagtgacatctgtgattcaaaacgtcaacaaagccaaaacatcggttgtcttcggcgatgatacaaggctcttagccggcaatatggtcattcaggaatttctcggagaggtttcatttgagctgagcgcccgcgctttttttcagctcaatccgatccagacagtcaagctgtatgacgaagtgaaaaaagcggcaaaactgaccgggcgcgaaaaagtcgtcgacgcatattgcggcgtcggcacgatcggaatgtggatcgccgacggggcaaaagaaatccgcggcatggacgtcatcaaagaatcgattgatgacgccaaccaaaacgccaaaaagcacggaatcgaaaatgcgcgctatgtaacaggaacggccgagcactggctgccgaaatggacaaaagaaggcttcaggcccgacgtcgtcatcgtcgatccgccaagaacaggctgtgaccgcacgttccttgatacgatcaggcaggttaagccgaagcggttcgtttatgtctcatgcaatccgtcaacacttgcgaaagatttgcagtacttggcgaaggattaccatgtagaatacattcagcctgtcgatatgtttccgcagacggcgcacgtcgaatcggtcgtatcgctgaagctgaaataa

SEQ ID NO: 782 - DNA, 480 bp, Bacillus licheniformis
atgaaaagactttgcatcatcccgtgcggggcgaaaaaaatctgggatgttgatccggacatcggcccgtccgccgcaaaggatgtctatctaagcccatttcaccgggcgtgccgcgcatatgcgcagacattttttacggattgggtgattctttcagcaaaacacggttttttaaaacctgaagatatcgttcctgaaaactatgacgtcacatttgggatgcgccacccagagattatgccggatggcgggctgaaggctcaaggtgaacggaaaaacctgatggattgcgatgaaatcgtcatgctcggcggaaaaaaatacaggcctgtactgaggaacgtgtttggcagcggacagcagatcatatacccgctggcgggataccggggaatcggctatatgctgcaggcgctgaagcgggctgtcgatgaaggccgggaacttggtgaacatgaaaaaaatgagtttttttaa

SEQ ID NO: 783 - DNA, 564 bp, Bacillus licheniformis
atgaaggataaggaacgcagtatattcgaagatttgcttcctttataccatgaggggctgttaagcaaagagacggctgaatggattgaggaagcggccgaaaacgatgaggagcttcaaaagcttttgaagatgtcggaagacgagcttccgaaggaacatatcgagtcgtctgttcatgaagggcaaatgtttaaaagaatcaatcgaaagctctccttgtaccagctgatgtttatggcgatttcattttttctcgcgattcgcacatccctgttaaatgaaagcttcggctttattttgtggtacgccgtgcttgggtttgcggggtatctgtttttccgggatatgaaactcgtaatgctcctcacctatgcgccgattttcgtttgggggatgggggatattctggccgaatgggacgcatccggcggtacaggggttgtggagcacctgctgtatgccgtctttggcgctttcgtgctcgctgttattcactgttttttcgccgcggttgggatgatgatcggctggctgttcttaaagctgaaggaaagaagttga

SEQ ID NO: 784 - DNA, 723 bp, Bacillus licheniformis
atgaaaaagaaagtcttgtatagcgtgttgattgtgctgctcgtttcctttgtgcttgccgcttacaacgccttcaacggaaatcccgtaagcaagaagctgtctcaaacggcgcttgagcattatttgactgaccgctatcctgaaaaagacttgcggatcgacagcggcatctataatttcaagttcacggaatatgtatttgaagtcactgacaccggtgatccaaagcgcaaagatccctatctgcttactttgagagggtttgttcaacctgaagtatacacggacggaatctatgaagagaacctcaatgaaccgctgatggagcggcttggagaagaagcaggaaaagaaatcaaagcgcttttatcaaaaagcatagaccaactgaaagacgttgacgtgcatgtggaagtattaaaaggaaagctgaaaaatgacgcaaaatgggagaaaagcatccgcttagacaagccgatgcagattcatattttacttgatgccgaaaatgccggccgaaaagaagtatacaatacggcgcaaaagattcagcgcctgttgaatgaagaagggtacgactacgaaagcgtgacgattaatgccaacatttttgatggggaagatattaaagacgaggagatcggctgtcttaaatacagcacctcctttgaaaaaaatacggaaatcaagctgaaggatgttgaagagctaaatgattaa

SEQ ID NO: 785 - DNA, 576 bp, Bacillus licheniformis
ttgcaagagacgaacgaacggatcatatctgctgctttagacttaatgcaaaaatacggattcaagtcggtgacaataaaggatatcgcgcttcattcaggcgtcagcgagatgacggtctaccgccacttcaaaactaagcttggacttttggaagcggccgttcaacaattttcttatataccagcctttcagcgcgtatttgaaaacgatatcacttggaacctggagaaagacttaacattgattgcagaatcgtatttgcttcatatggaaaaaaacaagccgctctaccttatcgctgttcaagacggcggaaggatgactgatcttttcggttctctgttaaagcatatggaggagctcctttgttatttaacagactactttcggacgatgcaggacaaaaacctgatgaaaaagggagatgcagattcacaggccttcgcttttctgtcatctttatacggatacttctcgtctggcgcattggctggcggccgttttcaaaaagtcgctaaagacacttatattaaacagataaccgccgccttctgcggcggcttgcatgtatga

SEQ ID NO: 786 - DNA, 1215 bp, Bacillus licheniformis
atgaaaaatattctaatcgtcaattttccggcggaaggtcatgtcaatcctacattagggatcaccaaagcatttgctgacagaggcgacaatgtgcactatctttcaacagaaaagtataaagacaggctggagggcgtcggagctaccgttcatttatacaaagatctggtgagaaacgcgcatattgatccgaattcaccgtccggccttcttgaatttttaaaaattcatctcaaaacctcgctgtatattctagacattgtaaaagagctgtccaaaagcatttcgttcgatgtcgtgtattatgacacattcggtgcgggtgaattggtcagggattatttgaacattccgggaatcgcttcgtcggcttcatttctcttcggacaagaacataagaagattctgccgttgcatccggattcaggcgcggagctgcacttggacaaagaatgtgaggacctgcttgcggaactgaaagaaaagtacggcgtctcgcctaggcatacaggacagtttatgagcaatcaggcggagctgaccgttgtgtatacaagccggtattttcagcctgacagcggccgttttggggatgatgtgctgtttatcggcccgcgttttccaaagcgcctggacaagaccgattttccggtagaatcgttgaagaatgagaaagtcatttatatttcaatgggaaccgtacttggcaaaactgcggattttttcaatatgtgcattgatgcttttcgtgatttcgacggcaaggttgtcatcgccgctggcgaaaaatcggactacgcggaaattaaagaagtgccggagcattttatcatcgccccgtatgtgccgcaattagaggtgcttaaagaggccgatgtgttcatcacgcacggcggcatgaacagcgtcaatgaaggcatccattaccgtgtcccgatggttgtgcttccgcatgataaagatcagccgatgatcgcccagcgcttgaaagagctgaatgcgggatatcctctgtttgcagaagaagtgaatgctgaaagattgagagatgcagcagaacaagtgctcactgacggaaaatatcaggaaggtattcaaaaaattgatgaaagcttcagcaactgcatggacattaaagatgcattggcgcgtattgatgaatatacggcgcggaaaaaagtcgctgcagccataacagaaagccgctactaa

SEQ ID NO: 787 - DNA, 321 bp, Bacillus licheniformis
atgcgcaaactgtgcgtttgcctgcttctcgtcattccgctgtcatgtacggctgtcatgccctctgcctacggggaaacacgcgtttatcaagagttgacggacaagcagaaaaatgaactggcttctttgcaaaaggacattatggaaaagaaaaaacagctgatcaataagtatgtggagtacggaatacttgatcaggaaaggggaaaggaaatcaagtctcatattgaaaagcgctatgaaaaagagcgggaagacggatttttgccaaagtggaagcaccataaagaaaagtttcgcccgcatcacattcattaa

SEQ ID NO: 788 - DNA, 1203 bp, Bacillus licheniformis
atgaagaaccgtcctgtttcagagcgcagactgcttggcatcgcaggcctcggctggctttttgatgccatggacgttggtatattatcgtttattatcgccgctttgcacgcggaatggaagttgacgccgcaggaaatgagctggatcggcagcgtcaactcaatcggcatggctgtcggggcatttgtctttggccttttggctgaccgcgtcggaagaaaatatgtttttattattacgctgctgtttttctcgatcggcagcgggttgtccgctttaacgacgacattgtgggcatttttagtgctgcgctttttcgtcggaatggggctcgggggagagcttccagtcgcatctacgctcgtatctgaaaccgttgcgcctgatcggaggggaagagtcgtcgtcctgctcgaaagtttctgggcattcggctggctggctgcagcgctcatttcgtattttattattccggcctacggctggcagattgctttattgataactgcgataccggctttttacgccttatatttgcggattgccctgccggattctccgaaatatgagaagcttgcgcaggaaaggaagccgaccatcatggaaaatgtgaaaagcgtctggtcccgcaaatatgcccggcctacggccatgctgtggatcgtctggttttgcgtcgtcttttcctactatggcatgtttctttggctgccgagcgtcatggtgatgaaaggattcagcatgatcaagagctttgagtacgtcctgattatgacgctggctcagctgcccggctatttctccgcggcatggctgattgaaaaagccggtcggaaaatggtgcttaccgtctacttgctggggacggctgtcagcgcctacttcttcggatcggctgaatcgctggcgcttttgcttgtgtcaggcatgtttttatcatttttcaaccttggtgcgtggggtgcgctttacgcttataccccggaacaatacccgacgtcaatcagggggaccggcgcaggaatggcagccggctttggccgaatcggcggcatcctgggcccgcttcttgtcggctatctcgtcgcccggggaacagagatttcaatgatctttttcatcttctgcatcgccgttgttgcggccgtcgcagccatcatctttttggggaccgagacgaagcagaaagagcttgcctaa

SEQ ID NO: 789 - DNA, 1377 bp, Bacillus licheniformis
gtgcagcataaagagattgcaagagaactcttgcccctcattggaggcgcggagaatatcatcagcatcagccattgtacgacaaggctgcgcttcaatgtcagggatgaagaaaaaatcgatatagctgctattgaaaagatggagtctcagcaggggacttttttcagatacggtttgttccagatcattttcgctacaggtgtggtcaataaaatttataaggaaatgatccaatacagcgatccggctccttttgaagaagcccgtcgggaggcgcggccgaacatgaacgtattgacgcgatttgccaaaacgctgtcagacatctttgtgccgatcattcctgcaatcgttgcgagcggattgctcatgggtctcattagtgtgcttaaagaattcagcctcggcgcttatggcggcccgctgatgaaaatgctcgacattttttcaagctcagcgtttgtcattttgcctgtgctgatcgggttcagtgcggctaaacagtttggagccaatccatttttaggcgccgtcatcggcggtattttgacccatcctgatttgctcgatccttcaatgctcggcagccaaaagccggaatccatcgaagtattcggccttgaagtccctttgatcggataccaggggacagtcattccgattctcttatccgtctacatgatgagcaaaatcgaaaaattcttgaaaagaatcgtccccagttctttagatttgatcgttgccccgtttattacagtcatggcttccgggtttgccgcgctgtttatcatgggcccgctctcactgatgatcgcccatttcataagcgactgtctcgggtttgtttatcattttgcgggggcgtgcgccggatttttatttggcgggctttacgccttactcgttttgagcggcctgcaccacagtttttatgtgattgaagcgtcgctgctcgcagatcccgaatacggggtcaattttctgcttccaatatggtcgatggccaatgtcgcgcagggaggagcgggactcgccgtatttttgaaaacaaagaatgacggcatcagaaagattgcgattccggcttctctcacggcctttttgggaatcgtcgaaccggtcatgtttggcgtcaacctgaaactcgtcaggccgtttatcggcgcatcgatcggaggcgcactcggaggtgcatacgccgtcttcacacacgtggcggcaaattcttacggattgtccggcatcccgatgatttcaattattctccctcttggcaccgccaatctcattcattatttaatcgcttttgcgattgcggtgatttcagcatttattgcgactttgtgtcttggctttaaagatgaaaaagaataa

SEQ ID NO: 790 - DNA, 843 bp, Bacillus licheniformis
atgaaagtaaaaaaaatcttaaacaacaatgcgctcgtcgtaaaggatcgcggcgaggaaaagatcgtattagggtccggaatcgcatttcaaaaaaagaagaatgatattgtcgacagatctaaaattgaaaaaatattcgtgatgaaagattcatcagaataccgccaattcgaggagatcttaaaaacattgccggaagatcatattcaggtggcggaggatattatttcttatgcggaaaaagagctcgggatcaaaatcaatgagcgaatccatgtcgccttttcagatcatttatccttcgcgatagaacggttaagcaagggaatggtcattaaaaatccgctgcttcaagaagtcaaagtcctctacacgaaagaatttcaaatcggccgctgggcaaaggctctcattaaagaaaagctgaagatcgatatccccgaggatgaagtcgccaatattgcgctgcatatccacacagccaaaacaaacgcgggagatatgacaaaaacgctcgatctcacaacgatgatcaaggatattatcgagatcatcgaaaacaaactcaacattaaaataaaggatgagacgatttcgtatgagaggcttgtcaaccatctccgtttcgccattcagcatatcgagtcgggagagacattttacgaaatggatggtgagatgatcagcctcattaaaaagaagtttggacaagcgtttatgtgcgcagaagaaatcggggcatttgtgaagcgggagtatggctttgaatttccggaaaaagagctgtgctacattaccatgcatattcagagattttatcagcggtctgctgtcgtgtaa

SEQ ID NO: 791 - DNA, 507 bp, Bacillus licheniformis
atggaagaaaacaaaaaaatactcatgattatcggaatggagaaacagcttgaacagaccatctgccgggcagcaaatattcagccggaggacgccctcgttttaaaaagcgtcttccctgatatttcacagccctacggtgatttcatgagggatatcatcacccttgtccaccggaacaaagcggaagaaatctggattgtccgcgacaaatacgaaccatcggcagatgaagatatttctgaccttttaaatagagacaaagatttaaaagatagaatgcaaactttagagtaccttttccaaaactgcagtccggaatttacgcaaggcagcattgatgaatggctgtcaccgagcgaaaacgtggccgaaggtgtacaaaaaagcgtcgccgccatccgcaggcacccgttaatccctttgcacgtcaaagtgaaaggatttctaatcgataaatcggttttaacggaagttgaagctttaaacaaaaacggagcccgttaa

SEQ ID NO: 792 - DNA, 2622 bp, Bacillus licheniformis
atgaaagcagcacccacattgtctaaacaattgatattccaatatgaacatcagactgcggactttaatatggatgagttggttcaatcagcagcacgggtcatcgcgccgctttggccgattgaaacctttgccgctcgtcatccgtggatgggccttgaagaacaaacatttgaacagacggcccggcagcttaaacagcagcttcatgttgatatctacccaaagtcctccattttccgttccgcaaaacaacggggagaaatcgatgaaacgattcttgaaaaaaagctgatcaattggctcgattcacatcagcccggcatgcagagggaaacagcggaggcattttgcaaagccgccctcaagctggacgaaatacctggacagctcttgagatcccggcaagtgaaaaagcttgccaaacaagcggcccgcgggacaatcgatggccgaaaaacaagctttatcaaaccgctcagcgtttttgccggacagaaaagtgctcacctccttgaccatcatgtgattaaatggtgcaagctgttccttgatgaatcacaatcggcatggcggcttccgcatcgtgagaaagggttttacagcgcatggcggcagcttgttgaacatgatcccgctctgtcgcgcgcagaacgccaacgcctgaatggatggccggaagagccgcgggacgctatgaaaaaagcgctccgagcgtttgatatttccaatgcagacgttcaggcataccttgaagctcatctgctttctctgccgggatgggccgggatgatgctttggcgttctcagcaatcgcaggacgaagaagaactgctgctcgagtatttggctgtccggctttcaatggaatggatgcttgttgagccttatttaccgctgcctaagccgaatcctgaaaaagagatgcagctcgttcctttgattgcgtcctggctgcattggggcggccttacgcctgaagaatggctcgaactttccgcagcagagcaaaaagcgagattaacactcgcccgccgctttgatgatataacgcgcaggcgtctctggctggaagcttgggaacaaacatacgccgctgaggtaaggaagctcatcacggcaaacaaacctgccgctgctgacaaaagcgaaacggtgctggcccaattcgcattttgtattgacgtccgttcagagccgttccgcagggcattggaaaagtcaggcccttttgaaacatatggaacagcgggctttttcaatatggcaatcgaaacgtgcgaactaggcactaaacacagccacagctctctgccggtcatcctaaaaccgcagcatcgagtagaagaaacggccgaagaattaccctttaagtcgtatcaagaacataaaaaagcggcagcctcactgagctccgcctttaaaacgatgaaacagaatctattggcgggcatgctgcttcccgaagtgagcgggccttggctgagcctgcaaatggccgcgcgcagccttgtcccccgcgcagccggccaagcattcagaaatgcgcggaaaacatggctgaagaagcctcagacaaagctctcgcttgatcgcacggaaacatctgaagccggcattccggtcggatttacggaagaagaaaaagccgcctatgccagacaggcattaaagatgatggggatcacagaccggttcgctccgctggttgtcatttgcgggcacggcagcagaagcacgaataacccttatgcatcggcactggactgcggcgcctgcggaggcgcatctggcgctttcaacgcacgcgtcctagccgctttatgcaatcttccaagcgtcagagagaggcttcgctccgacggcatttttattccggatgatacggtattcgctgccgcagagcacattacaactttggatgaactgcactggctctatgtacctgagctgccggctaaagctcaacaagcgtttgaccgcatcaactctgtgcttcccgatgtgagccgtactgtcggagccgaacgcttagaagagctgccgcagctcggctatcaaaatccgcggaatgaagttgagcgcttcgccgaagattggagcgaaatccgtcccgaatgggggctggcccgaaatgcctcattcatcatcggcacacgccggcttacacggggggccgaccttgagggaagggcttttctgcacagctatgactggcggaatgacgaggacggctccatccttagcggcatcatttcagggcctggaacagtggcccaatggatcaatctgcagtattacgcgtcaaccgttgcaccgcattattatggaagcggaaataaagcaactcaaaccgtcactgccggtctcggcgttatgcaaggaaatgcaagcgatcttttggccggtctcccatggcagtccgtcatgcggtcagatgacgaaatctatcatgcgcctctcaggctgctgatcgtgattgaagcgccggatgatgatatcgaacggctccttgaccgcgatcacagcttccggcaaaaggcggagaacggatggattcatctggcatctattaatccggagggaaaatggaagaactggacaaacacgataaatgaatga

SEQ ID NO: 793 - DNA, 1533 bp, Bacillus licheniformis
atgtttgatatgctagattctttattttggctgaaaatatttttcgcgtcgcttgcgctttgtttgttcagcgcactgctcgtcctgaatcgaaaggttccattggcatatgtacggattcatgccaaaatcatcgccctgcctccgcttgccgcgctggcagcattgataacggcaaatcccgggcaggctgaagcttcttggcgcttggattcgcttgcttggctgatcgccttgtttgtcttgactatcggcttcatcgtccagcgctactctgtccggtatttattcggcgaccgctcctaccgtaaattttttgtgctgctgacgcttacgacaggaggagcttcatgcgcctggctgaacgatgatcttcgctggctccttttatgctgggggatcacgctgctcggcttgactgcgctaatcggcttaaacagcgcgtggcaggcggcgaaaaatgccgctttgtatgcgggccggatctttgcgctcagctggctggcgatagcagctgccgctctttggctgtctctttcgacgggacactggcgattatcatccgccatagcggaagaaagccttgtacagctcagctcatgggagaaaaccgggatcggcctcctcgtcattttaacggtgatgattcctgcggcacagtggccgtttcatcgttggctgctcgattcagcaatcgctccgactcccgtttccgcagtcatgcacgccggacttgtaaatgtaggcggcgtcatgctgactcgttttgcaccgatgttcagcggtgatgtactgcagcttattctgcttgtacccgccgtcctttccgtcttgctcggaacgggcatgatgatcgtccaaacggactacaagcggcagctcgcagcttcaacggtcgcgcagatgggttttatgctcgtccaatgcgcattaggggcctatattgcggctgttattcacctcattttgcacggcctgttcaaagccgcccttttcctgcaagccggatcagcggtgcgccgttatgaatcgttcgcatctaaaccgggcagaccggctcttttttggaacatgataggcggcgtctttgctcttgctctcgtcatcggaatctgggcctcagctacggacgatggctatcaattgatcagcgcccttgttttaggctgggcactgttcattgcttggaggcagcttgtcacagccaattacggacgcgtcacacgaattgccggacttttcattttaacaggggcttcactcgcgttcgccatcattcattccgttttacacgggctcctgaaggatgctgttgtacagggggctgagccgcctgcaatggcggccgttttgacggcagtcgttttgttagccggcagtgcggccggcgcgttgatcgttcggcagcgctttgcatggtccggcgcactttatttacgtcttgtgaaaacgggtgaaccccatttcgaatcggtcgaagaacggccgaattatcttgaccaatatcttactcagggaggtcgccaatcatga

SEQ ID NO: 794 - DNA, 375 bp, Bacillus licheniformis
ttggaaaaacagaaggtgacgaaggggtctttggaggcggagataagcaaagccttaacccaatgggaaaaagactatttgggacgcggatccgtatctgttaaaacagatattataagaaatatggtcatcgtttccctgaacggtattttgacgcccgccgaatacgaactttgcagtacaaaagaaggcctgctgtcaattaaaagaacccgctccggtttggtggaatcgggtatagagcagctgagccgcatgatgaagaagctgaccggtgaagagacgatcagctttcatacggatatcagcacgcgcacaggcgaacggattatggtgtttaaattggcaaacgacctgcaaaaaaaattgtcatag

SEQ ID NO: 795 - DNA, 636 bp, Bacillus licheniformis
atgtctcaatttgtctacttcgtcagttgcggaaatgtcgttgccgcggttagaatgaacggtagagacgaaggaggttttttcatgaagaaagcgtatgtttttttaatcgacggattcgaagaaattgaagcgatagcaacaattgatgttttacgaagggcagaagttgagaccgtcaccgtctcgcttgatccatcgcgcagcgtgaaaggcggacatgacattgtcgtcgaggcagacgtcatgtttgacgatgctgattggcaagaagcggatatgctgattcttccgggcggaaatgtaggcagcaaaaaaatgctggagcatcaagctctgcataagatgctgacagaagcggcaaatgcaggaaaatatgttgccgccatttgtgcggcaacgatgacgctcggaaaaacggggcttgtcagcggaaaaaaagcgacctgctatccgggagttgaagaacatttaacaggggcggatgtcaccgcacatgaaaacgtcgtcgttgatggaaatatcattacttccagagggccggcgaccacgatcccgtttgccctcaagcttgccgaactgctgaacggcaaggaaaaagccggtgcagtcgccaagggaatgctcgtctgctaa

SEQ ID NO: 796 - DNA, 975 bp, Bacillus licheniformis
atggaagaggcactgacaaaggaaaaagcagtgtggatgtatcaaaaaatgctggaaatccgctatttcgaagatcaggttcatcagctgtttgctaaaggaatactgccgggttttgtccatctttacgccggagaagaagcggtcgctgcgggcgtctgcgctcatctgaatgatgaagacaccatcacgagcacacatcgcggccatgggcactgcattgcaaaagggtgcgacttgaaaggcatgatggccgagatatacggaaaatctgcaggactttgtaaaggaaaaggcggatcgatgcatattgcagactttgacaaagggatgctaggcgcaaacggaatcgtcggcgggggatttcctttggcctgcggagcagctctcactgcaaagtataaaaagactaaaaatgtaagcgtttgcttttttggcgacggcgccaacaaccaggggacatttcacgaagggatcaaccttgccgccatctggaagctccctgtcatatttgtcgccgaaaacaacgggtatggcgaagcgactccgttttcctatgcgtcaagctgcgagtcgatcgcagatcgtgcggccgcttatgggattccgggcgttcgcgttgatggaaaagatgcggccgcggtcttccaggctgcgggccgggcgatagagcgtgccaaaaacggagaaggaccgacgctcattgagtgtatgacataccggaactacggccattttgaaggagatgcccagcgctacaaaacaaatgaagaaaaagcggtgcatcaggaagaaaaagatgccattgccgtgttcaaaagcgaactgctggcaaaagggctgatgagtgaagaagagcagtcgcggattgaaaaagaagttgaagaagcggtcgaggaagcggtcgcattcagcgaaaaaagcgcttatccggaagaaaccgaactgctgacggatgtatatgtatcctattaa

SEQ ID NO: 797 - DNA, 1035 bp, Bacillus licheniformis
atgacgagggaaatcagcatgtcagccgcattgaatgaagcgatcaaacttgcgatgagaagggacgatcacgtcattttaatgggggaagatgtcgcaggaggagcgaatgtcgatcatctgcaggatgatgaagcatggggcggtgtgctcggcgtcacgaaagggattgttcaggaatttggacgggagcgcgtccttgatacgccgatcagtgaagcggggtacatcggcgcagccatggctgctgcttcaaccggtttaaggccgatcgcggaattgatgtttaacgattttatcggaacatgtttggaccaggtgctgaaccagggagcgaaattccgctacatgtttggcggcaaagcggaagttccgattacgatccggacgacccacggcgccggctttagggcggccgcccagcattcgcaaagcttgtatgccctatttacaagcattcccggactgaaagtgattgtgccgtcgaccccgtacgacgcaaaaggattattgctcgctgcgattgaagatcaggacccggttatcttttttgaagacaaaacgctgtacaacatgacaggcgatgtgccggaagaatattacacgcttccaatcggaaaagcagatatcaagcggaaaggcgccgatgtaacgattgttgcaatcggcaaacaggttcatacggcgcttcaagcggcggaacagctctcagcgcggggaatcgaagccgaaatccttgatccgcgaagcctttcgccgcttgatgaagaggccgtccttgcatccgtagaaaaaacaaacaggcttgtgatcgtcgatgaggccaatccgagatgcagcatcgccgcggatatcgcatcattggcggcagataaaggatttgattcgcttgacgcaccggttaaaaaggtgacggctccgcatacgccggtgccattttcaccgcctcttgaagacctgtatttgccgacgccggaaaaagtcgtgaacaccgtgcttgagatgctcggagaaacatcaacacatacggtgtaa

SEQ ID NO: 798 - DNA, 1134 bp, Bacillus licheniformis
atggctgtcgaagtggtcatgccgaaattggggatgtcgatgaaagaaggtacggtttccgtctggaataaaaaagtcggggaagccgttgaaaaaggagaaagcattgccagcatcaattccgaaaaaatcgaaatggaaatcgaatctccggcaaacggaaccgtgttggacatccaagtatctgaaggagagggagtgccgccgggaaccgtcatctgccgcatcggaaatgaaaacgaacaaacgcaggagagccaaacaaaacagccggatcccacgaaagaacggattaaaatttctccggctgcgcgcaaaattgcgcaaagcgcaaatatagacatcaaaacgctgaagggcacaggccccggggggagaattacgaaagcggatgtgttgcaggcgcttcccggccggccgaacaagcaggcggctaaggctgaagctgaagagcggccgccggcaagcccgatgaggaaaacgatagccgcaagaatgacggaaagcctgcaaaacagcgcccagctgacgattacgatgaaggcggacatcacgaaattaacagtcctgcaaaaacagcttaatgaaaccgctcaatcaagatacgatacgaagctgacgatcactgattttgccgccagggcagctgttttttcgcttttggatcatccggccatgaacagtgtttatcaagacggaaggcttgcgacctttgagcatgttcatttaggagtggcggccgctttggacgaaggcctggccgttcccgtcatccgccatgccgagcggctcccgctgatcgaattggccaagaaaatcaaatggtacgccaaaaaagcgcgggaaggccggcttctacacgatgaaatagaaggatcgacatttacgattacaaacctcggcgcatatggtgtcgagcactttaccccgatcttgaatccgccggaaaccgggatactcggagtcggccaaatgtattcggcacccgtttatcaagacggagaactgacaaagggcgccattctgccgctcagtctgacttttgatcaccgcgcgcttgatggtgcgcctgctgcagcattcctttcagatgtgaaaaactatttggaagatccggcatcaattcttttatag

SEQ ID NO: 799 - DNA, 1377 bp, Bacillus licheniformis
gtgacacttgcaattataggagggggacctgcgggttacgtggcggcgattacagcggccaaaaatagcagagaagtcatcctgattgaagatggttccctcggaggaacgtgtttaaatgaaggatgcataccgaccaaagcgcttcttgaaagcgcagatatgttcgagaaaataaaatccgccggcgcattcggaatcgggctgtcaggcgaaagcccgacggttcagtgggaggccgtccaaagccgtaagagagagatcattcagcggctcgccgggggtattgaatatttgatgaataaaaataaaatcaaggttctgcaaggaaaagcatcgtttttgtccgaacacgacatacttgttgaaaaggacggaaaacaggaggtcatcaatgccgggcatgtgattatagcggcaggggcagcacctgccgcactgccttttgcgtcttttgacgggagctggatcatccacagcggagatgccatgtcattgccgtccatccctgaaacgatttttattatcggcggaggaatcatcggctgtgaatttgccagtatatacagcaggctgggagcgaacgtgatcatagccgagcaggcggaacagattctgcctgaggaagatccggatattgccgcctttcttcgcacaagtctcgaggagtccggcgtccgtgttttcacatctgtacaagtggagcgtcttgatcctgccaggcagcgcgtctttctgaaaaatggcgatgacagctttaatattcaagctgatcgatgtctcgtcgccgtcggccgaaagccgaggactgatgatctgaagcttgaccatatcggagtccaatatgacaggaaagggattcatgtcaaccagcatatgcagacaaacatcccgcatatttatgcgtgcggggatatcacaggcggggttcagctggcgcatgccgcttttcacgaaggaaccgtcgccgcatcccatgcctcaggcagagacatgaaggtcaacagtgacattattccgcgctgcatctatacttcgcctgaaatcgcaagcgtcggcttaaatgaaaaaaaggcgagggagcgctacagggatgttcgtatcggagagtttccgttttcttcaaacggaaaagcgcttattttgaatgaaactgccggcaaggtcaaaatcatcatagagccggagtatcaggaaattgtcggggtttcgatcgtgggtccgggagcaaccgaactgatcggccaggcagccgtaatgttgcatgcagagctgacggcagacgcaatggagcacttcatcgcggcccatccgactctttcggaaacgattcacgaagctttgctgcaagccgcaggtcgggccattcactgctga

SEQ ID NO: 800 - DNA, 1836 bp, Bacillus licheniformis
atgaatccgacgccctgctatttaaatacgtggaaacgctttgttcaggaagggcttcttgatcaggcccgcttgaacaaaagagtcatggaatcatggtaccgctgcaaaaatcgaaatgtcaatccgtatttagataaaggacagtcaattttaaaaaaggatttattcgacgctcaaaaaaagaaacactcgttattcctcgatatcgccctgccttatctacacaatatcagccgtgaattaaaagagtcggaaatgatggcgctcctgatcgatgccgacgggtacgtattaagcttggccggctgccggaggacgcttgaagaggcgaaaaaaatcaattttgtcgagggcgtgcgctggacggaaacagaagtcggcacgaacgccatcggaaccgcacttgaaatcggcgaagctgtcaccattcacgggaccgagcatttttcggtcgcttcccaccattggagctgttctgctgcaccgattcgcgatgaagacggcaccgttatgggtttaatcgatatttcctgcctcacggatagaaggcatccctttatgcttgggatggctgccactgccgcacacgccatcgaacgcgagatcagcgcacatacgaaaaaaaacgaagccgagctcatcagccattgtcttgaaaaaatcgattcggatcagccgtttatcgtctgcaatgaaaaagacaaaatcgtagccgcgagcagaccggtgcgggaacgtttttccgactggaggagaatggatgtcaatgatctgtatgagcgcgggtttgccggggggcacaagcagacaattttctccgccaaagacgggaggcccctcggtaagtcgattgcactggctgaagtgtcccgcaataaaacagctccatcactcgtatcccgtttcatctatccgggtgaaacaggaacaagccgggcgtttcagcaggcgcttcaccacatgaggcttgcggctaagacggatgcgaatgtatacatatggggggaaacaggctccggaaaggaacttgccgcgagggccattcatcaggcgagcgcacggagaaacggcccttttatcgccgtcaactgcggcgccattcctgaaagcttgatggagagcgaattgttcggctatgccgaaggcgcatttacaggagcaaagcgccgcggttcaaaagggaagtttgaacaggctcaccgcggtacgatttttctcgatgaaatcggtgagatcccttatcagatgcaagtggcgctcttaaggatcatcgaagagcggaaggtcactccgatcggcggaacccgtgaagttcccctcgacatcagaatcatcacagcaacacaccgtgatctgaaagaccttctccaaaaaggaaagatacgtgaagatctgtattaccgccttcatgtttaccccgtaaaaataccgccgctcagagagcgcaaagaggacatacctgatttgttccgccactatcaacaacaacacgagtggaaggccgagtttccgccgaattttttcaagcggcttcaggaatatcattggcctggtaacatccgtgagctctttaatacatttgaaaggctcagggttttatttccggaaggcggactgatcgatccgtcccaatacagcgcggtgctggacggactcgattggaacagcggcgcaccttctgaagaagaccggctcacattcagagaacgtgttcaaaaacaaacgatgatggaagctttgcaaaaaacgaaaggaaatgtgtccgaagcggccaagctggccggaattccaagaagcacattttacaagcggcttcgaaaatataacctttag

SEQ ID NO: 801 - DNA, 348 bp, Bacillus licheniformis
gtgaattggagtgtgttgttgatgatgatcgcaatcggtttatttttactggcgggtttggctgaaatcgcgggcggctatctcgtatggctgtggctgagggaatccaaaccattgtggtacgggttggccggagggctgactttaatcatttacggcgtcatcccggcttttcaggcatttccatcgttcgggcgcgtctatgccgcgtacgggggcgtatttattattctggctgtgctttgggggtggctggtcgacaaaaaaacccccgacctctatgattgggccggggctgtgatctgtttagccggcgtcagcgtcatgctttgggcgccgagaggctaa

SEQ ID NO: 802 - DNA, 1350 bp, Bacillus licheniformis
atggataaaacgtattcgattgtcattgcaggcggaggaagcacatttaccccggggattgtattgatgctcttggacaatctggatgatttcccgatccgacagctgaaattgtatgacaatgatggagagcggcaagacaaaatagccggcgcctgtgaagtgttggttaaagaaagagctccgcatattcaatttttagcgacgaccgatccggaagaggcgttttccgatgttgatttcgtcatggctcatatcagagtcggtaaatatgcaatgcgtgagctcgatgaaaagatccctctgaaatacggagtcgtcggccaggagacgtgcggacccggagggattgcgtacggaatgaggtcgattggcggcgtgcttgagctcattgattatatggaaacctattcgcctgacgcgtggatgctgaactattcaaacccggctgcaatcgtcgccgaagcgacaagaaggctgcggccgacatcaaaagtgctgaacatttgcgatatgccgatcggtatcgaagacaggatggctcagattctcggactgtcttcgcggaaggagatggttgtccgctattacggccttaatcattttggctggtggacgtcaatttgtgataaagacggcaacgatctgatgccggcgatcaaagagcatgtcaggaggttcggctatattccggaacaggagcatgaaaaggctgaggcgagctggaatgacacgttcaaaaaagcgcgggaagtatttgaactcgatcctgagacgcttccaaatacgtatttgcaatattatttttatcctgatgatatggtgaaaaaatcaaaccctgaatttacccgggcgaacgaagtaatggaagggcgggagaaattcattttcggcgagtgtgaaaaaatcgcaaaagcccaatccagcgccggcagcaaaatcgaaattgatgatcatgcttcatatattgtcgaccttgcgcgcgcccttgcattcaataccggtgaacggatgcttttaatcgttgaaaataacggagcgatccaaaacttcgattcatcggcgatggtagaggtgccttgcattgtcggcaagaacggtccggagccgatcacaatcggcaaaataccgcagttccaaaaagggctgatggaacagcaggtgtcggttgaaaagcttgtcgttgaagcctggattgaaaaatcgtatcaaaagctttggcaggctctgattttgtcgcggactgtgccgaatgcacgaacagccaaactgattctcgatgatctgattgaagcgaacaaaggctattggccggagctctccgcggaaaatcttcagccgtcgctttaa

SEQ ID NO: 803 - DNA, 771 bp, Bacillus licheniformis
atgcagttggaagaattaatgaacaagcattataaaaaattgaacgaaaacgattttcatgttttgaaatatattttgaaccatcaagacacttgctacaagctgggcatcaacgaattagcaaagaagtgcaatgtatcccgcacatcgattttaagactttctcaaaaactggatttcagcgggtacagcgagttcagggtgtttctgaagtgggaggccgagaagcgggaagaagagcgggaagattgccgttcctttgaaagcctcatgagggatatggaagcgagcatgaaatatttgaaaaatacggatttgcgaaagatgtgccagctcattgacgaagcggaccggatttttgtctatggttcaggcacggctcagacgacgtgcgcttatgagctgcagcgaatgtttgtttctcagcaccgttatttgacggtgatcaaagatcaaatcgatttcgacctcatgtttcctgattttagcacggccgatctgatcatcatcatttcgctgtcaggagaaaccccgtcgctgattccgcaggcacagtctttgtcggctaaaggcattccttttatctctttgacgaatttgaaaaataatctgctcgcccagctcactccttacaatctctatgcgccgagccagacggtgacggtttatccaaaaacagagctgaccgcttttgcacccttttttctcgttggggaagcgctgtttcgcagctatgtcgactatgctgaagaaaagaaaaatcaggagtaa

SEQ ID NO: 804 - DNA, 1593 bp, Bacillus licheniformis
ttgatgcaaaaagtacagcggttcggaagcgccatgtttgtgccggttttgctatttgcttttgccgggatcgtcgtgggcctcagcacattatttaagaatgagcagctgatgggatcgcttgccagtcaggataccttttggtatcaattctggtatatccttgaggaaggcggctggaccgttttcaggcaaatgccgctgttgtttgcggtcggaattccgatcgcactggcaaaaaaagcgcaagcgcgggcatgtttggaagcgcttactacttatttgaccttcaattattttgtcagcgctattttgactgtatggggcgactttttcggagttgatatgactcaggaagcaggaggaacaagcgggcttgcagaaattgccggcatcaaaacccttgatacgaacattatcggggcgattctgatttcatcgattgtcgtttatatccacaaccgctattttgataagaagctgcccgattttttagggatttttcaaggctcttcattcgtcgtcattatttcatttgcgattatgcttccggtagcactggcaaccgcgtggatttggccgatggtgcaggacggcattgcgtcgctgcaaagcttccttgtcgcctcaggtgctttcggtgtatgggtttacacatttttagaaagaattttgatccctacgggcctgcatcacttcatatacacgccatttgttttcggcccggccgtagttgaaggcgggattgtcacctattgggcgcagcatctcagcgagttttcagcaagctctgaaccgttgaaagagctctttcctcaaggcggattcgcgctccacggaaactccaaaatcttcggaattctggggatcgcactagccatctatgtaacagccaaaaaagaaaagaaaaaaatcgttgccggtctgctgattccgatcacgctgacagcggtaattgcggggatcacggagccgattgaatttacgtttttgttcatttcgccgctgctgtttttcgtacacagcctcttggccgcgacgatggcaaccttgatgtatgctgcaggggtggtcggaaatatgggcggcggtttaatcgagattttaacgctcaactggatccctctgtttcatcagcacggcagcacttatgtttttcaaattttgatcggcttgtctttcaccgccatttacttcttcgtattcaggttcttgattttaaaattggatattgccacgccggggcgtgaaaaagaccagcagcaggagacaaaattttattcgaaaaaagattacaaggcgaaaaaagaatccgaaaaagaggtttctgcggcgcaggaaattgctgagaccgatcaggcggttctttgcatcaaagcgctcggcggaaaagaaaacattgcggaggtgacaaactgcgcgacaagactgagagtcagcgtgtatgacgagtcaaaagtggagccggacagtacgtttaagtcctttggcgttcacggtgtcgtcagaaacggaaaagccttgcaaattattatcggtctttcggttccgcaagtccgtgaaagggtcgagaagctgctgaaccaatcataa

SEQ ID NO: 805 - DNA, 579 bp, Bacillus licheniformis
atgggaacggaaatgccagctgaattttatgatcaatttattgaccgacatctgattccgtttgaaaaaagcccgtggagaaaggtgtatgaagaagctgcacgtttattgccggagtccaaagatgaaacgattgtcgatatcggctgcggcactgggagattcgcaaagcttttatatgacaaaggatacagaaaatatttaggcatcgatttttccaaaggaatgcttgaagaagccaaaaggtataatccctcgtttactttcatcgaaggaaatgtatatgacgaggcgatcgtccggatgctgcaaaaatatcatgtttttgttttgctggaagtgttagagcatatagagaaagacaaagcgtttttatcgagtcttcctcaagggagcgacatggtgatttctgtgcctaactatgattcacgcgcccacgtccgccacttcaaacatattgacgaagtcatcgaaagatacgacggcattttggattttcagggcaccgaaaaagttgtcattaaaacatctgaacggctgaagaatgaaatttacgtgctgaattgtaaaaaaaggtaa

SEQ ID NO: 806 - DNA, 978 bp, Bacillus licheniformis
atgcggagatgcttgaaaatattagttctgattaaaacgttttggaagaccatgcccaaacatgaagtaaagtataaaatgatgaaatctcttgaggagtttgccgaagtcatgtactggcatacggacggctatcttccggatatattggacaaaatccaatttcgtcctgatttcattttccactacgacattgcctacggcttctcattgtccccaaacattagggggctcaaagatacaaacatccccaccggcgcgtttgtgatcgattctcattttaataaacagatcagaagcagctatttcgaagacaaccaaattgatttaattttttcagtgacaaaagagcattttttaaatgaatacccccagtacaaagacaaattcagatgggttccatgggcagttgatccagaaatattcaaggactggaagttgaagaaaacgatagactatttgctcatggggcttgtacatgaaggaaacaaaagatatcccccaaaaggaaaatacctttttagggaggctgtattgcagaccatgaagcatgaagaagggtttgttcaccacccccatcccggcaatgtcataactgacgaagaagaaatcaagcaggcttttttgaatgaaaaatatgcccaggaattgaacagagcaaagatatttttcacatgcggaagcgccctccgctacccgttgttaaaattttatgaagcccctgcctgcagaacgctgttgctggcggagccaaatcaagatattttcgatcttggctttaaagacggcacccatttcattgcttgtgaagttgaagacttttatgacaaagcaaaatactatcttcaaaataaaaaagaaaggcagcgtatcacagacaacggctaccgtctcgttcattcacagcatacctatcatgcgcgtgcacaagaaatagtagacacaataatagattttttagagcagcaggaacaatga

SEQ ID NO: 807 - DNA, 339 bp, Bacillus licheniformis
atgagcctatcatctttatgtccgaaatttgaaaaaggaatgaaaatgataagtcagcgctggaacggattcatcattcaccagcttcttaacggcccgcagcggttttgccatatagaatcttcccttcccatcagcggaaggctgttatccgaaagattaaaagaactcgaacacgagggcatcatccaccggcatgtgtatccagaaactccggtgcggatcgaatactccctgactgaaaaagggcaggcgctcgaaccggtccttaaaggaatggaaaaatggtcgcaggaatggatcgatctggacgaagccaatgaacgggaaaatcattaa

SEQ ID NO: 808 - DNA, 405 bp, Bacillus licheniformis
ttggttacaggtcttacatttttgcttcacgggctttcaaaatttcaaggcgggattgaaaatactgtaggattcttcagcagtgtcggaattccgggctttctcgcctatatcgtagcgattatcgaattggccggaggggctttgatgattctcgggctcggtacacgtgtgattggccttttatttgcgattgtcatgctgggggccattttcactgttaagctctccgccggtttcatgggaacggatggaggcgcaggctatgaatttgacgttacgcttcttgcaatgtctgtatacttggccttgagcggaagcagcatgctgtcccttggggaaatgatcctgaaatcaaggaaagaaggaaaaacagatgacgcagcaaatccacccgggcactga

SEQ ID NO: 809 - DNA, 861 bp, Bacillus licheniformis
atgacgcagcaaatccacccgggcactgagctcggatatgtcaagctgaaggtgagccgtcttgaaagatcggtttctttttacagggatgtgatcggttttcaagtattaaaacaggacggcaaaacggcggagttcacagttgacggaaaaaatccgcttttgatcattgaggagattccaaatgctgttgttcttcctgaacgatcggcagcaggcctttatcattttgccattttgcttccaaaccgaaagcagctcggcatggctgtgaagcatttgatccgcgccggcattgaactcggccagggagatcaccttgtcagcgaggcgttttacttgtcagatcctgatcaaaatggaatcgaaatctaccgcgaccgtccgcgagagggatggaagcgcgatgagcaggggaactacgtgatgggtacggagccggttgatgtccaaggacttctggaagaagccgatggccacgaatggcaaggtcttcccccggaaacaaaaatcggacacgtccattttcacgtccgggatttgaagcaggcgaaagaattttaccactctgtactgggatttgatatcacaggagattatcaacacatgtcagcgctttttgtctctgccggaggctaccatcatcatatcggcttaaacatctgggccggacagcatgcgccatttgccccgcttgatgcggcaggcatggcgtattacacggttcttttaccgaatcgagcggaacttgaccgaattgcaaaaaaactgaaaagctcgggttatgccgttgagcatgaagaaaacgcatggtttgttaaagacccggcatcaggtattgatatcagattgaccgtttga

SEQ ID NO: 810 - DNA, 1605 bp, Bacillus licheniformis
atggcaaaaagcctgactggcaaggcgaaacatcatccgcctgtctggaatccgaacattgacggcgggcggttttgcaatcccgttcttttcatggactactcagatccggatgtcattcggaaaggcagcgacttttttatggcggcttcaagtttttcctgttttcccggaattcccattttgcactcgacagatttggtgaactggtcattgatcagccatgtgtttgacgagctccccttcggcgaatatgaggcccctgctcatggcaaaggagcgtgggcgccgagcattcgataccataacggagaattctgggtgtatttcgcaacgcctgatgaaggaatcttcatgagcaaaacatcagatccgtttaaaggatgggagcctctcatacaggtcaaaaagacaaagggctggattgatccttgtccattttgggatgacgatggaaatgcctatctgatccatgcttacgcaaacagcagaatcgggatcaagagcaagctgaatctttgccgaatgaaaaaagacggaacggctttggaagacgatggagaaatcgtctttgacggcacgctgaaccaccctacgattgaaggaccgaaattgtataaaaaagacggctattattatatctttgctccggcgggaggggtgaagacaggctggcagacggttttgcggagcaagcagatttacggtccctatgaagacaaggttgtccttcaccaaggaaatacggtcattaacggtccgcaccagggaggctgggttgaacttgattccggagagtcatggtttatccactttcaagatcgcggagcattcggcagagttgtgcaacttcaacctgtccgctggttcgacggctggccgctgatgggtgaagacataaacggcgacgggatcggagaaccggttttgcattgggaaaagccgaagacgggcgccaaagaagtgaaactgccctttgatcatggcaatgatgatttttcttcttcagaccgccttgcgcttcattggcaatgggaagcgaatccgaagcaagaatggtactctctcagcgccagtcccggccggcttcgcttatacagccgcggcatcgctcatccgttcaaactgagccgcctgccgaaccttctgatgcagaaattttcggggccaagcttcacagcaacggtcaaattgtcgctaaacgccttgtcggaaactatgatggccggcttggctgtcatgggaagggaatacgcctatctcggcttctcgaaatcagaaaacggttatcggctttctgtatacgaaggccgtatagaaggtgatcaggaagatgtcaaaacagaagagcgcggcgtacatgcggaaatggtctatttgcgcgtgactgttgatgaacaggcggtctgccgtttcagctgcagcatggaccggcgtcatttcacacagattgggaattcgtttcaggctgttcccggactgtggacgggtgccaaagcaggtgtatattgcgccgataccggcggagaagacggacaggacggatggtgcgatatcgaatggttcagtgtcgaaccggcaggaggggaatgccatgagcggtga

SEQ ID NO: 811 - DNA, 1548 bp, Bacillus licheniformis
atgagcggtgaacacacatatacgaacccggtgttgaccggttttcatccggacccttcaattatcagagtcggggaagattattacatggtgaactcaacgttccagtatttcccggcaatcgttatttcccactctaaagatttagtccattggaagatcatcggccacggaatcacggaaaatgaaggattggacctgtcggatatcaatgattcgcacggcatttgggcgcctgatatttcgtatcataacggaaccttctacatcttcgcgacgcacaggctgaacggaccgactgtcatcaacggccgaaagctgatccgcagacagattatgatcaagtccagccgccccgaagggccttattcaaagcccgttttcattgatgaaggcagcggcatcgatccttctcacttcgttgacggcgacgggaaacactatatgctgctcagtcctgcctgcacgctctttcctctaaatgaagaatgcacagacatctccggcgagccggttcagatatgggaagggactgggagaagggcgcctgaagggccgcatttgctgaaaaaagacggttattactacgcgatattggcagaaggaggaaccggatattcccactcgattacgacagcccgctcaacgcatttgtacggtccttatgagccctgcccgtataatccgattttaacgcagacagacccggatgctccgattcaaagagcaggacacggcaagctcgttgaaacccagaatggagaatggtgggcggtgtatctatgcggacggcccaatcaaggtagctatacaacggttgggagggagaccgctttggatcccgtcgaatggacggatgacggctggtttgtcatcaacaacttgaagggcccgagtcttgttcagcgcgctccaaacctcccccaagtcaaatgggatgaaaagaatttcgacgattttgacgaggatacgctcggtcttgactggcagtttgtcaggaatcccgatcattccagctggtctttgatcgagagaccgggatatctcaggctgtggacaggtgattgggatttacatgacatccgtgcaaaaaatacggtcgtcagaagggaaaagcaccacctatacagcgccggcgtgaaactcgacttttcaccttcggcctccggagagcaagcggggatcgtctgctactacagcacgaataattatttgaaatgctgcttgatctatgaagaaggattgaagatcaaggtcgtggaaaatcgctccggttgccaaaaaacgctggggaaaaaacatgccgaggccggcccgctgtttctgaaagctgtcatcaataagcaaaagagggatttttactacagttatgaagggaagcattggcaccacgcgggcggtacagaggacgccagttttttaagcgatgagggttcgcgtgacgcaaagggacatacgggaacgatggtcgggatattcgccaataacggcggaagcggcagaaaggctgccgctgattttgactggttccgctatattgcatattaa

SEQ ID NO: 812 - DNA, 846 bp, Bacillus licheniformis
atgctccatcctaaatatttcatagccgagcattctttttcgattcaatatatgcagagaaaaggatttaccgagatgaacgcgccgcatgttcatgaaggctatgaactgtattatctgctgagcggagaacgcacgtattttattaaccaaagcgtctataccgcggaaaaaggcacgatgatcatcatcaatccccacgacctccaccgaacgtcaagcacggaagttcaagagttcgaacgcatcctgattaatttctcgcacgatttcatagaaccattgctgaagtgcagccattatcggcttcttccgtttccggaaaatcaaaacttcatcgcattttccctgcgtgaacaggccgcagtcgaacatatgctgatggagatgaaaaaggagtgcaagctgaaaaaagaaggacacgaggatgtcgtcagggcgctgctgtttcagctgcttttcaccatttaccggagccttgcgggcggcggccgcaatcaaacacggccgcttcacccgatggatgaaaaaatctcggaaatcgcttcatatatcaattgcagctttcaagaaacgatgacgttagacggattggccggacaattttatatcagcccatcctatttaagcagagtgtttaaaaaagtgaccggctttcatcttcaggagtatatccggcacatcaggatccgcgaagcgaaaaaacggcttcgtgatacagacgagaaaatattggacatcgctgcggataccggttttaagcatatcagccatttcaataaagtgtttaaagagatcgtcggcatcccgccgcttcaatacaggaaaaaaagcagagacatttaa

SEQ ID NO: 813 - DNA, 1404 bp, Bacillus licheniformis
atgaaaaagttatgttgcctgatcttggtcttggttttttccgcgggctgtactcagcaaaaggcatcaacggaagaggacggggcgcttgaaatcaattggctcgtaccgctccacacaccgcagcctccgaaagagaaggcgcttgacatcattgaagacaaaacgaatacaaagctgaagctcatctgggttccggattcaacaaaagaagagcggatcaatacaacccttgcaagcggaaacatgcctaaagtaatgacattgcctgatcttgaagattcagcggttgtcagcgcgctgcgctcgggaatgttctgggaaatcggaccgtatttcaaagactatccgaatttaagaaaacttgataaaactatattgaaaaatatttcggttgatggcaaagtttacgggatttatagagaaaggccgatggccaggcagggagtcgtgattcggaaagactggctcgacaatctcggattggaaatgccggaaaccgttgatgacctttataaaatagcgaaagcatttacagaacaggaccccgatcaaaacggaaaagacgacacgttcggtctcgccgaccgcaatgatctcaccttcggagcgtttaaaaccctggcttcgtactttggcgcgccgaacgaatggggaacggacgaagacggaaatctcttcccctattttaagcatgaggcctataaagacgcaatggcatacatgaaaaagctttatgaagaaggcctgatgaacagggactttgcggtgacaagcaaaacgcagcagcaggatttagtgattcaggggaaagcgggaatctatatcggcgcgatgagcgatgccatgaacttgcgtgatcagggactcgctttgaaccccggctttcagcttgatatcgcaaaccggatcaagggccccgacggcaaggagcgcacatgggcgctcggcgggcatggcgggatgttcgccatttcgaaatcaagcgtcaagactgaaaaagaggtcagaaaaatcctcgcattttttgacagaatcgctgaagaagacctcaacaatttgatgttgtatggaatagaaggcgtacactatgaaaagaaaggggggagcggctattttcgaaagcaggaaaactaccatctgtgggaagcggaaattcagccgttaaaccagctgattggcgtcaataaacaagctttaaaaagcgctgaagatccgctccgcgccaaaaatgaaaagcttgaggaggacaaccgggcaatcgcagtccagaatccggccgaaccgctgtattctgccgcacagatggacaggggaacagaattgaagaaaatcattgatgacgccacatttcaatttattctcggggaaatcaatgaaaaagctttgaccaggcagtcctga

SEQ ID NO: 814 - DNA, 594 bp, Bacillus licheniformis
atgcagactgccgttatatatgcacacccaaatccaaacagtttcaacggagccattttaaatcaagtcataaaggcgcttgaggacggtaagcatttttatgacgtcattgatttgtatagagaccggtttgatcccgttctattatttgatgaaaagaaaaggcgctcagatatgaatcgcgatccggaaactgccgaatatcgaagaattgtcaaaaacgccgaccatctgattttcatttatccgctttggtggggcggaatgccagcgatcatgaaaggctttattgaccgcgtttttgccgccggagaagcctatacatatcaaggaaagctgccaaaaggcctgctgaaggcgcgcacggcatcagtttactacacggctgacgctccgtcttggtatttgcggttttggcagcgggatgccgactgggtgacggttaaagatgtgatgttgaagttttgcggcgtacggcgggtaaagcgcctgctgtttgccggcgtgaaagacagctctgaagaaaaacgcacgcaatggcttgaccgtgtctaccggtctatagctcctgcagatcgggggatcagcaaatga

SEQ ID NO: 815 - DNA, 612 bp, Bacillus licheniformis
atgacaaaggagatgaagtggctggattgggcaaaggaaattcaagctatcgcccaggcggggcttgcctatacaaaagatgactttgatcgtgaacgttttgagcagcttcgcgagctgagctgcgaaatcatcgccgattatacggaaacggacttctctaaagtgaaagagctttttgccggggaatcgggctatcaaacgcctaaagtcgatgtgagagccgtaatttttaaagatcataagctcctccttgtccaggaaaaagcagacggcaaatgggcgctgccaggcggatgggcagacatcggctttacgccgaaagaaatcgcggttaaagaaacgcttgaagagacaggtttgaaagtcaaggcgcataaacttctggcggtcatggataaaaagcgccacaaccaccccccttccgccttccacatctataagctgtttatctcctgtcaaattgtcggaggcaaggcggaagcggggactgaaacacaaaaccttggttttttctcattggagaatctgcctgaattatcggcagcaaggaatacctatgaacagatcgaatatctttttgaaaagcatgatgaagtgtattgcgactaa

SEQ ID NO: 816 - DNA, 378 bp, Bacillus licheniformis
atggatcagttgaaatatccgatcggcaccttttccaaaccgcttgaagcggacgaaagggaactggaaaaatggatcggggatctgaagcaagcgccgcatctcctgagaagcgcggcggcggaactaaatgaagaacagcttgatacgccgtaccggaccggaggctgggctgtccgccaagtcgttcaccatcttgccgacagccatatgaacggctatattcgaagcaaattggcgctgacagaagagacgcctttgatccgcacgtttgacgaacagaattgggccgggcttaccgatgccagaacgctggatccggatttgtcgctggcgcttttagacacgctgcatctgcgctgggctgctcttttttga

SEQ ID NO: 817 - DNA, 2553 bp, Bacillus licheniformis
atgaaaaaaaatgcgctggcgattttaaggatcgtgattccggcggctgttcttttgtttgtcttttttcaagcgaaaaaagaactggccgggctgtcttttaaagaaacatttttgattatcgatcaaattaatcggattgacctattcatccttgtttttctcggacttgccgccattttggcgatgacattatacgattttgttctggtccgctccctcggaatgaaggtttcgaaatggaaaacgatcaaagtatcatggatcgccaactcacttaacaatgttctcgggttcggcggattgtccggtgcaggattgagaacgatcctttacaaagagcatgttgatgatgtgaagaagctgatcagggggatcgcttggcttgcgtcttcggttcttctcgggctgtctgtcctcagccttctcgtccttgccggaattctgcctgccggggatctgtttacagaaaaaacgtgggtgctgctggctgttgccggtacggcgatgatcgctcccggtgcggccgtcattttaatgatcaaaaagaagagaagcagaggagccgaaaagggcatgcggctttcggtcttcttttcttatctgggtgcatcggtgatcgagtgggttgccgcagcagcggtcatgtattattcccttgcaacgatgggcgtcgaattggacttaaaaaccgtcatcggcgtttttacgattgcttcggtggccggaatgatcagtctcgttcccggcggattcggttcgttcgacctgctttttttggtcggaatgagccagctgggggttgatcaggaaatcactctgacggcgattgtgctctaccggatcgcctattcgtttatcccttttgtgttcggtcttatttttgcagcagccgatttgactggaaatacgatgaagaggctcgaagaaaaaccgattattgccccggcaatagaaacgaccaatattctgttgattttacacagagcgctcctattcagactgctgaacggttcgctttcagtcatcgcattttgcagcggagcgattgtgatcgcatctgtggcgctgccgattgacaggattacattgataccgaatatttcgaagttcatgctggtgttttttaacggtttgtccctcagtttcggcttgattttgctgattctgccgcttgaactttatcggaggacaaagagatcttattatatgacgctgaccgctttggcgcttgcctttctgttcacgctttttaaaggctttaatattagcgccgtcttcatgattcctgtggtgtttgccctgtttgtattgctgagggggcagtttacaagggagcgggctgtctacacattcgggcaaatcgcatggggagcttttatcttcctctttactttattgaattacaatattatcgcttcacacatttgggaggcgctcggccatcttcttgtgaaagattatttcattcacagtgaacgccatgtcgacttcgcgacgttttttgcgttatttttcgttccgctgtatttcgctgttttcatctgggcgtttaacaggaaaacgaaagagatcggtgaagagcctgatccggagaaactggaggcattcttagaagaaaaaggcggcaacgctttgagccatttaggctttttaggggacaagcggtttttttattcaagcgacgggaatgcgctgattcaattcgccaaagtcggccagcgcctcgttgtgctcggcgacccgtccggccgggaagactcgtttccgctcgtgatcaaagaattccttcatgcggctgaccaaaaagggtatcttgtcattttctatcagatcgaacgcgaagacatggcgctctatcatgacttcggataccgctttttcaagcttggagaagaggcgattgtcgaccttgacacctttacaatcagcggaaaaaagcgggccggactaagggcgatctacaaccgttttgaacgggaagggtatacgttccatgtcgaacagccgccgttttcgagagaattcctcaacgagctgaggcaggtgtctgatgaatggctcggccgcaaaaaagaaaaaggcttttcgctcgggttttttcaagaagattatttgcaaaaggcgccaattgccgttttaaaaagcgaagaaggcgagatcgtcgcgtttatgaatatcatgccgatgtaccgcgaaggggaaatatccatcgatctgatgcgctattcgaaaaaggcgccgaaaggaatcatggatgcgctgttcatctatttatttcaatggggaaaagaacagggctacacggccttcaatatgggaatggcccctttatcgaatgtagggacaacgtttcagtcattctggacggagcggctggccgccgtgattttcaacaatgtcagctacatgtacagtttcagcggactgcggtcttttaaagaaaaatataagccggtttggcgggggaaatatttagcctatcggaaaaaccgatctctcccggtaacgatgatccttgtgacaaggctgatcggaaggagaacgaaatga

SEQ ID NO: 818 - DNA, 897 bp, Bacillus licheniformis
atgaagccaattgaagtattaagatatgacgcattttcaaagactgcgggtcaaggaaatccggcgggcatcgtgcttgaagcagacgggttgaccgattgggagatgcagaagatcgctgaacaggcaggctataatgaaacggctttcctgctgccgagcgagtcggccgacataaggatccgctactttacgccgggccatgaaatgaatttatgcggacatgcgactgttgcttctctttatgcgcttttggaaaaaggcgcgattgaagctggcgcggacgtgaaggtcgaaacaaaagcgggcgtcctttctggtggtataccgcctcagacggcaatcggcgttttttggtgacgctggagcaggcgcccccgtgttttcagtctttcacaggaagcagaagccaattggcggaacgctggggatcagcgaaggagctttcatgaagcattgcccgttgtttatggaagcacaggtatatggacattgcttgtgccggtgagagatttggccgcaatccgcagatgtaagcccgttcaagctgaatttccgaacgttttaaccgagatgccgcgagcatctgtccacccgttttgcctggagacgatgcagcgggattgccagcttcacggcaggcatttttcatcgccttattccggaacgagcgaatatcctgtcacaggaacggcatcaggagtgatgggcgcttatatgaaaacgttcggaaaggaattctgtgaagagggccagactgattttcagatcgaacagggccaggaaatggggaaagacggaaaagtgaaaatcgaagttgcggaacaaaacggcatcatgaaagtgcgcatgacaggaaccgctgtatttgctgaaaagcaaagctttgaagtgtaa

SEQ ID NO: 819 - DNA, 579 bp, Bacillus licheniformis
atgaacgacacgctagaaatccaaagtattcgcgattgcgtcagaaatagaagaacgattcgaaagtttaaacaggatccggtgccgaaggaagtggtgctggaactcttggaagatgcgatttatgctccgaaccacaagctgacagaaccgtggcgattcatttatatcgggacggaaaacgggaaaaagaagcatgccgacaatttaaaagcggcgtttaaagagctcaagccgaatatgcaggaagaacaaatcaataagttcagggagcatattctcagcgttccggcttttctcttcgttattatgaaagaagacgaaaacgaacgggtcagacgggatgattttgcagccgtcagctgtttaatccaaaatctgcagctgctcgcttgggaaaaaggcatcggcatggtatggaaaagcggggaagttctctctcatgaaacactgcacaggttaatgggactgaagcgcgatgagcaggtagcagctctcttgcagatcggatatcctgcggaaattcctgaagcgaagcacaggacgccggccgcacagctttttaccgaattaacttaa

SEQ ID NO: 820 - DNA, 195 bp, Bacillus licheniformis
atgggcagaaatgcaatccacaaaaaccgggataaaaacaagcaaaaactccctcaagttcctgatcagtataagcgagaagctgacggagtgtatgaggaatattcagcagaactcgccgatcaggatgaccgcgaagcacaagcccgcatgcaggcagctgataagcgcgcgaaaaagcggcagtcaaaataa

SEQ ID NO: 821 - DNA, 114 bp, Bacillus licheniformis
atggctgacaagaaaaaacgcgaacgttttaaatccactctgaacaagacgcaggaagtcagatattcgcgcgaatttaaaatggcagagcgcgccgcaagggaaaaatcgtaa

SEQ ID NO: 822 - DNA, 531 bp, Bacillus licheniformis
atgctgaagaaacgggaactgaccgactgctatgcactttttgaactgatgattcatccggatgtcttcccttttgtcagaaataaagcggagacgattgaagagtatatgtttcatgtcaaaaacatgattgaagaggaagaacagggaaagctgatatcgcgaacaatacttgatgaatgggaaaacccgatcggctgcatcagcttgtatgaaatcgaagagcaaaaaggcttcctcggcacatggctcggcaagccttaccatggaaaaggctataaccagcgggcgaaagacgcgtttttttgcgagcttttttatgaaaagcaaattgaagccgtttttatgaaaatcagaaaaacaaatatgcgctccctcaaagccgcggaaaagctcccatatgccgtcaagactgatcttgactgggccggcagcgatacatttcacctgtatgaaatcccgaaagatttgtacacgctgtacagcatgagaacattcgaggaggaaaacagccggttaaaagaagcttaa

SEQ ID NO: 823 - DNA, 900 bp, Bacillus licheniformis
atgaagattgcgattgccggggggacaggttttatcggcagacatttgacaaacgccttaaccgcccggggacatcacgtctatattttaacaagaaaaccggccgaaaccgaacaaaaaaacacttctttcgttctctggcaaaaaaacggcgcccgtcctgaaaaagatctgaccgatatcgatgtttggatcaatttagccggaaaatcgcttttcggccgttggaatgaaaaaacgaaggcggagatcgcgacaagccgcctccgctctgtggaggagtcggcccgcatcatacaaagtcttcagaagaagccgaacaccctcattcaggcgagcgcagtcggaatttacggaaccagtcttgaacagacattcacggaggaatctccagtttcggctgaggattttttaagcagaacgacagctttgtgggaacaggcagccgaaccaatcgaagcgcttggcatccgcaccgtctggatgcgttttggccttgtgcttggaaaagacggaggcgcgctcccgaaaatggcgctcccctatcaattgtttgcaggcggacgcatcggctcggggcggcaatgggtgccatggattcatatcgaagacgccgtcggcatgattttatctgcgattgaacagacgctgatgtccggccccgtcaatgtcacggcaccgaatcccgttcagatggatacattcgggcaaaccgtcgcgaaagtagaaaaacgcccacactggctcccggttcccgaatttgcgataaaaggcgtacttggagaaatgagcatgctcgtgctgaaaggacagcgcgtcctcccgaaaaaagcgcttcagaacggctatcatttcttatatcccgatctggaagatgccctgcacaaccttctggcataa

SEQ ID NO: 824 - DNA, 792 bp, Bacillus licheniformis
atgccatatattacaaagatttctgcccagaaaaacaatgaagagcgggtcaatatttttctggatgaaaaatatgcgttcagcgtcgacctggacgtgctcgtcaagtttgacctgcgaaaaggcaaagagcttgatgagcttgatatcattgagattcaatacggagacgacgttaaaaaagggttcaaaaaagcgctcgattatttgtcataccggatgcgctcgacaaaggaagttcaagaccatcttaagaaaaaaggcgtcgcagactccgcgatcacagaaattctgcatatgcttaaaggttataaatatttggacgaccgcgaatttgcggctgcatatgtcagcacccacagaaaaacgagcggcaaaggccctgatgtcttattcagagagcttaaattgaaagggatcgatgatgaactgattcatgaagcgctcagttcgttttcgttttccgatcaggtcgaggccgcggtcaagcatgcggaaaaagtactgaaaaaagaaaaaaagctgtcctccaaagagacgaagcaggccatcgaacagcaccttgtcagaaagggtttctccttcgatgtcatttcggccgcgcttcaggaaaccgattacgaaaacgacgatggcgctgagagagaagcgcttgagaagcaaggagaaaaagcaatgaagaggtacggttatgacggatcatacgaaacgaaaatgaaggtcaaacagtatctgtttagaaaaggattttcaattgacttgattgaccaatttttagatgaaaagggatga

SEQ ID NO: 825 - DNA, 315 bp, Bacillus licheniformis
atggagaaaagatacagtgaaatgactgcacacgaactgcaccaggaaattgcgggtctgaccgaaaaggcaagaaaagcagaacaaatggggattgtgaatgaactggccgttcacgaacggaaaatcgcgatggcgaaagcctaccttcttgatccggccgattttaaagccggcaacgtatacgaaatcgaagatgggggcgacgatttccatatccgctatttaaacggcgtattcgcctggggataccgtctttcgtcaccggatcatgaagaggctctgccaatttctttattaaaagaaaagggctaa

SEQ ID NO: 826 - DNA, 150 bp, Bacillus licheniformis
atgcgaaataaatcaagaggctttccgaacatgaacaacaataaatttgaaggcgagccccgggccaaagatgattttgcttcaaagcgccctgacggaagcacaaatactcatcctcaagaaagaatgagggcttccggcaaacgctaa

SEQ ID NO: 827 - DNA, 270 bp, Bacillus licheniformis
gtggaagagtactttgaaaaactgacaaatgcgcttcttgaaaaaaatcatatgctgagctacgcacaagccagaacatgggttgaactgctgtggggcgatttcgaggcgacatttgcaaaggccggccacccgtacagaggaaaagagctgacagagcgagtcgtcaaagagtggattgagcactacggcagccagttgcatttatttcaaaatgacaagccttcttaccaggatctgttctccggagcccgcgggctgcttcattaa

SEQ ID NO: 828 - DNA, 960 bp, Bacillus licheniformis
gtgaagaaaggattcgtttcaatcattattccttcatacaatgaagcaagcaatattaaattgatttatgaatcgttaaggaacgaatttcaatccattgattatgattatgaaatttattacataaatgatggaagcactgatcgaacattggaggaaattaaaaaactagccgaaaaaagcgagcatgtgaaatatatttcgttttcacggaatttcggcaaggaggcagccatccttgccggttttcagcatgcccgcggcgatgctgttgtggtgatggatgcggatttgcagcacccgacatacctcctgcacgattttattaaagggtatgaggaaggctatgatcaagtggtcgcccagcgcaacagaaagggagacaaccccgtgcgctcctatttgtcatccctttattaccgctttatcaacaatgcggtagaggttgatttaagggacggcgtcggcgattttcgtcttttaagcagaaaagccgttaatgcgatgctgaagctgagcgaaggcaacaggttctcaaaagggctgttttgctggatcggttttgaccaaaagattgtttattacgagaacgtcgaaaggaaaaacggaaaatccaagtggtcgttccgccacttgttgaactatggaatcgacgggattgtgtcgttcaacaacagaccgctgagaatgtgtttttacgccggtatttttatcctttttctatcgcttatttatatcgcggccacattcatcaggatcttaaaatacggtgtgattgttcccggctattttacgattatttccgccgtcctgtttctcggcggcgttcagcttctcagcctcggaattatcggcgaatacatcgggcgcatttattatgagacgaaaaagcggcctcattacttgatacaggaggcaaacatcgctcatggagaaactcatgaaaatcgtgaatcctga

SEQ ID NO: 829 - DNA, 390 bp, Bacillus licheniformis
atgaaaatcgtgaatcctgaatttattcgctttgccgttgtcggtgtagtgaatactttgaattactatgcggtttatttgctgctgcatgttttgcttcagttgaattatatggtttcgcatattgcagcttttttcgtcagccttgtgatttccttttttctgaactgctattttacttttaaaatcaagccgacgctggcaaagtttttgcaatttccgctgacacagctctttaatttgacggtatcttctttgttcgtctacacgtttgtgaattttttcaagatgaacagtgaggcagctccgcttgcctccatgtttttaaccgttcctctgacatttttagtgacagggaagattttgaaaaaagacaggggaagagtatga

SEQ ID NO: 830 - DNA, 2586 bp, Bacillus licheniformis
atgaagaaaacagtttttctatttgtgatcgcaagcattgcagtttccgtggccgcccattctttttttctgtatgaatgggcgcatgaccgttatatgacggggaacggcgacggacttgcacaaatgatcatttttaagtcgtttctttttgagcaatacaaacaagggaacttcttttattcgtattctttcggtctcgggggcggcatctacagccagctcggctattatttcacgacttcttttgtcttcatcgcttcattcgcggccgtttttctgatgcagcttttgcatttggccggggatgcggatcctttgttttgggcgcaggccgccgtattcatcagtgtcatcaagctcagcctgatcattttagcggcagcgtatgcgttaaacggtatggtgaaaaacaagcttgccgcctttacgggtgcggttttgtatggcacatcggtaatctatttcaggcacacggtgttctgggaatttttcagcgacgccatgctgtggctgccgctgcttgtcgccggagctgagaaagtcatcagagaaaagcggacagcactgtttattaccgcttgttctttgacgctgatcaataacttttactttgcctatatcaacttgattttcattgcgatctatatcatcttccgctggctgatcaggcttgacccggaaaaggaggcgccgaggtggaaacaattcagaatgttcgccgcttcaggcctgatttctttcggaatcagcgcgatttcctttgtgcctgcagtttacggctttttaaacaatttgcggccgccgtatgaccaggctgtcgctgtatacgatctgacggacaacattctgttttccagccgcattgtcttgctgccggctgtctttatgctgttcttgttcgcattttccttctataaaaataaaacgttcaggctgtttgcctcaatcagtgtgctgcttgtgcttctgcattacagcccgcttgcggcaagcgcattcaacggtttctccgctccgcagaaccgctttgaatacctgctcgcttttacgatcgggggagcggcggccgcaggaatgaccgaactgaaaaacatcaggcggaaagagatgatatggtctatcctgcttgtccttctggtttatatcgcggtcatttggcggaaagacttggatttatcacttatgcaaaattggagcattattgtgcttctgttcctgacaatcgccatatttacggcggcggggtttcaatataagaaatcgcagctttttttgcacgtctgcattttattatcgtccgtcctcgtggcgaacacgtatcaaaagtatgttctgtctgagtcaagcggcattaaaaacgtcacgaaaagctatttgaccagcaatgagtacaatggcgaagaacagcgccgcctcctgaacaacattcgaaaagacgataagggtgacccctatacaaggatcgactggatgaacggcgtccgcaacaatactccgctgatgcaggattttaacggcttcagcgcctactcaagcattctcaatcgcgatcttcttctgttttattgggaagaccttcaaatcgatatgggaagggaaagcgtcagccgctacgcatcgatgggcgaccgggccaacttgtacagtctgctgtacggcaagtattacatgacggaaaaagacaatgccgccaatgttccgtacgggtttattcaaacggatgaatcagagcactacacagtttataaaaacaaatacaccttgccgtttatccggacggcgcgaacgttgtttacggaaaaagctttagcagatgcgccagttttagcgcgggagcatgcgatgcttgaaggaatcgtgcttgagaatggcggtaacggaaaagagcagccgccgagcgttcctgatttgatgaagcagacgaagctgaaaaccgagggggcgagctatcataacggcttcctcgacgtcaccgctgaaaacggaggcatcgatctcattcccgaaggcggggttccaaaagaaggcgactattatgtcggattttatttaaaaagccttgcaaaagaccagttcttcaacttgcgggtcaatgattatgtaacatcaagaaagtcaaaccagtcgatttacaaaacaggtgtttacgatttaacgatcagggtgccgaaaacagataaaatttcaatcaggctgccaaaagggaaatatcaattggaccatttgaggctgcaccaggaagactatcaattgctgaaaaaagccgccgccaaaaaaacgccggccgccgacttgaactggcggaacaatcaagtgtccatcagctttgacaatcaaaacggagaccgctacatggtgctgccggttccgtacgaaaaaggctgggaagtcactgtaaacggaaaaacgcaaaccgttcaaaaggcaaattacgcgtttattggaatccccatcgaaaaagggaagaacaacatccgtctcgtttattacccgccgtacttcaaagctaccttggcggttacagtcatcagcctcatcatcggaatctggtacagcagaaggagaaaaaagcttggctcttaa

SEQ ID NO: 831 - DNA, 984 bp, Bacillus licheniformis
atggatactggcacacatgttgtcatgggcgttgcactcggaggcatcgcgacgcttgatccagttgtcggaatggacccatcaatggctcaagccgtgatgattgcgacaatcgccggatctcaggctccggatatcgataccgttttgaaattgaaaaacaacgctgtttatattaggcaccacaggggattcacccactccatccccgctgttctcgcctggtcgctgatgattccgggcattctcatgctgttttatcccgaagccaatctgcttcacctgtggctttggacccttgccgcggtcgcgcttcatgtgttcgtggatatttttaacgcatacgggacacaggcggtcagaccgttttcaaggaaatgggtagcgctcggcttgattaatacatttgatccgtttattttcgtcagccatctcatagccatcgccttttggctggcaggcgcgcatcaaggctatacatttttggctctttacatcgtcttggccggttattatctggtgaggtatttcatgcagaggaaaatcaagcatgagctccgtgaaaaaatcgatgatattgaagaaatcattatttcgcctacgatgaaattcaggcaatggcgaatcgccgtcaaagcaaaatcggctttttacgtcggacggagcatggatggaaacgtcgtgatcgtcgacacattcaacagggtgcctttaccggatacggatgtgatgaaagcggcgaaacaggataagaacatttcggcgtttctttcgttctcaccggtttacaaatgggagatcgatacgtataaggatcattacgaagtccgctttatcgatctgcgataccgcagcaaaggacactaccctttcgtggcgatcgcacacatcgacagggacacgctcgaattaatcacctcctataccggatggattttcagcgaggaaaaacttcaaaaaaaattaaagcttggctctgtttaa

SEQ ID NO: 832 - DNA, 1086 bp, Bacillus licheniformis
atgatggatctgcaaaagaaattagagcaaaaaaacatcaaacaatttcaagaagatttaatttcttggtatgagcaagaaaaacgggatctgccttggcgctcagacagcgacccttataaggtgtgggtgtcggaagtaatgcttcagcagacgagagtggacacggtgattccttacttcaacaactttatcgaaaagtttccgaccgtggaagcgctcgctgaagccgacgaagaaaaagtgcttaaagcctgggaaggactgggatactattcaagggttcggaacttgcagagcgctgtcagggaagttcacgaacgatacgggggtgtggtccctccttcaaaagaggaattcggcagcttaaaaggcgtcggcccttatacaagaggcgcggtgctgagcatcgcctacaatcagccggtccccgcggtagacggaaatgtcatgcgggtcatgtcacggattctttccgtatgggatgatattgcaaagcctaaaaccaaaaccctgtttgaaaaaattgtcgaagcgtttatttctgaggaaaaaccgtccgagtttaaccaggggctgatggagctgggcgctgtcatctgtacgccgaaatcgccatcatgccttctctgcccggtccgagagcactgttctgcttttgcagaaggctgtgaaaaagagcttccggttaaaagcaaaaagaaaaaaccttcggtaaaaacccttgcagctgtcgtcctgactgatgaagaaggatacatctatatccataaaagaccggcatcaggtcttttggcaaacctttgggaattcccaaacacagaaacgcagaaaggcctgaagtacgagcgcgagcagcttgcggcgtttttgaaagaagaggccggaatagaagctgaaatcggtccgctcgaaggagtcgtagagcatgtgtttacacaccttgtctggaacatttctgtctttttcgggaaaactctcgatcaaccggatgattcatactttaaaaaggtcacgaaagaagagcttgctgaatacgccttcccggtttcgcatcagaaaatatggaatatgtatatgaaatag

SEQ ID NO: 833 - DNA, 225 bp, Bacillus licheniformis
atgtacgtaggacgcgatatgagcgagctcgaccacacgccgaaaaacgagtggaaagatgcggagcttctctattttcaccgcgccttccagcaaatcatgccatttctcaatgaagaagggcatgccgagtacctggaggttgtgaaagaaattcaagcaagaggcggactgtgccgccaggaagccgattatacgcacggcaccaccatccagtacgactaa

SEQ ID NO: 834 - DNA, 753 bp, Bacillus licheniformis
atggaacaaagaaaatgtgcccttattacaggaagcagccgcggcgtcggcaaagcagcagcgctgaggtttgccgaaaacggctacaatatcgtcatcaactatgctagaagcaaaaaagcggcccttgagacggctgaagaaatcgaaaagctcggtgtcaaagcattggtcgtcaaggcgaatgtcggacagccggcgaaaataaaagatatgtttcagcaaatcgaggaggcgttcggcagactggacgtgttcgtcaacaatgctgcatccggcgtattgcgccctgtcatggagcttgaggaaagccattgggactggacgatgaacatcaatgcgaaagctctgctattctgcgcgcaggaagcggcaaagctgatggagaaaacgggaggcggccacattgtcagcatcagctcgctcggttcaatccgttatttggaaaactatacgacagtaggcgtttcaaaagctgcgcttgaatcattgacgagatatcttgccgtagagcttgcgcagaaaaacatcatcgttaatgcggtttcgggaggcgcgattgatacagacgccctgaagcattttccgaaccgcgaagagcttctggaagatgcccggcaaaatacgcctgccggccgcatggtagagatcagcgacatggtcgatgcggtggaatttttaacgtcagggaaagcggacatgatccgcggacagacgatcattattgacggcggccgttcactgctcgtataa

SEQ ID NO: 835 - DNA, 165 bp, Bacillus licheniformis
atggctaaccaacaatccaaaacaaacgcacaaaaagtaagacaacaaaaccaagcttctgcacaaggtggtcagttcggcactgaatttgccagcgaaactgacgcgcagcaagtaagacaaaataaccaacaagctgagcaaaaaaaacagcaaaacagctaa

SEQ ID NO: 836 - DNA, 246 bp, Bacillus licheniformis
atgccggaatttgaaaatttggttcaggggcagatggagattatggataagctgttgtatctgcaagcggagattgaaagatgccagaaaattgaaaaagaactggctgcccttgaaaagaaagcccagcttttatcgatccgggaagatatatcccagaagcggaaagatcttgctcagattcaggatttgttccaaaagcagacggagcaggtgattcaggcttatcaaagaatcgaggcatga

SEQ ID NO: 837 - DNA, 531 bp, Bacillus licheniformis
atgggctttcccaaggaaggagaaaccattcaaattcatagctataagcacaatgggcagattcatcggatttggaacgaaacaacgattttaaaagcaacggaattgtgcatcatcggcgccaatgaccggacaatggtcacggaatctgacggccggacatgggtgacgcgagagcccgccatttgttatttccatgcaaagcagtggtttaacgtcatcggcatgcttcgtgaagacgggatttattactattgcaacatcagctcgccgtttgctttggacgatgaagccatcaaatacatcgactatgatttagatgtaaaggtcttcccggatatgacgtatcatattcttgatgaagatgagtacgcggatcataaaaaggcgatgaattatccgaaggaaatcgacggcattttaaggtaccacttaaatacgctgctgcattggatacaccaaagaaaaggcccgtttgcatctgaatttattgatatttggtatgaacggtatttgcattatacaaaataa

SEQ ID NO: 838 - DNA, 1743 bp, Bacillus licheniformis
gtgggggtaatcagaaggtacatggaatttgtgaagccgtataaatggaaaatcgttttgacggttttaatcggtattattaaattttctattccgctggtcatcccgcttctgctgaaatacgtcgtggacgacatcatccaggggagcgggactgctgaggaaaaaacatccacattattcatggtaatggcggttatgttcgccatttttttggtgcttcggccgcctgtcgaatattaccgtcagtatttcgcgcagtggacggcaagcaaggtgctttatgatatcagggacaagctttttgcgcatatacaaaagctgagcctcaggtattatgcgaacacccgcgcaggagaaattatttcaagggtcatcaatgatgtcgagcagacgaaggaattcgtcatcatcggattgatgaatgtatggcttgacgtgatgacgatttttatcgccatcgccattatgatgacgatggacgtgaagctgacgcttatttcgatcgtgctgtttccgctttacggactgtctgttaaattcttctacggcaggctcagaaagctgacgagagaacgttcccaagcgctggccgaagtgcagggccatcttcatgaaagggttcagggaatgcctgtcatcaggagttttgcgatcgaggattatgaacaaaagcaatttgatcacgagaacgggaattttctcggtaaagcaatccgccatacggcctggaatgccaaaacctttgccgtcgtcaatacggttacagacctcgctccgctgatcatcattacggttgcaggttatcatgtgattcacgggaaccttactgtaggaacgatggtggcgtttttcggatatatcgaacgcctctacaacccgctgcgccgcctgatcaattcctcgacaacattgacgcagtcgatcgcatcaatggacaggctgtttgaatttattgatgaaccgtatgatttaaaagataagcccaatgctgtaaaagcagagcgattaaaagggattgttgaatttaaaaacgtttcctttcaatacgaaaaatcggaggaaatgattttgcaggatctttctttgaaagccgaacggggcgaaacggttgcgctcgtcgggatgagcggaggcggcaaatcgacgcttgtcagcctcattccgagattctacgatgtctcagccggaagcctggagatcgacggcatcgatgtgcgcgattatgaggcgcgaagccttagaaaccaaatcggcatggttctccaggatacgtttttattcagcgaatcggtacgcgaaaacatatcgatcgggaatcccgaagcttcgatggaagacatcattgaagcggcaaaagctgcgaatgcccatgattttattatggagctgccgcaaggctatgatacaaaggtcggagaaaggggagtcaagctgtccggaggccaaaaacagcggatatcaatcgccagggtgttcctgaagaacccgccgctcttaattttggatgaagcgacgtcagcgcttgaccttgaaagcgagcactatatccaggaagcgatggaaaagctcgcgaaagaccggacgacctttatcgttgctcacagactgtcgacgattacccacgctgacaaaatcgttgtcatcgaaaacggacgtgtcgcggaaatcggcacacatgacgaactaatgagccgcgacgggcactataagcatttattcaccattcaaaaattaaactaa

SEQ ID NO: 839 - DNA, 981 bp, Bacillus licheniformis
gtgacaaaagaaaaattgcttgaagtatcggatttatcgatttcgtttcaaaagaaaaagtccgaaaccccgattgtgcaaggcgtttctttcgatctccatcccggagaaatcatgggagtcgtcggagagtccggctgcggcaaaagcgtcacctctttggctttaatggggctgaacgcaaacacccggacgacgggccggatcaagtttcaaaacaaagaccttctcatgcagtctgaaaaagaatggagacagatgcgcggcaatgacatcgcgatggtttttcaagagccgatgacctccctcaatcccctttttacaattggcgatcaactaacagaagcactctccagccataccaatattcataaaaaagaagcaagaagaaaagccgttcaaatgctggataccgtcggcctgccgaggacggaccagctgatgaagcaatatccccacgaactgtcgggaggcatgaggcagcgggtcatgatcgcaatggcattaatttgcgaaccgaaactgctgattgccgatgaaccgacaacagctctcgacgtcaccatccaggctcagattctgtcccttttgaaaaaaatgaatgccgaatttaacacagccattctccttattacccatgaccttggcgtcgttcacaatacatgtgaacgcgtgatgatcatgtatgccgggcggatcgttgaagaaggcggtgtcaccgctgtttttgacagcccgaaacacccctatacaaaaggcttgttcgcctctattccggcattcacaggcaaatccgagcgtctgtcttcgattgaggggcaggtgccgaaaccggggtcgataaaaaaaggctgtatgtttgcgccgaggtgccctcataaacgcgaacgctgcgtagaggaggagcctggattgaacaggctggcggatgaccatgctgtaagctgctttctctacgaagaggaaggtgctttcacatga

SEQ ID NO: 840 - DNA, 957 bp, Bacillus licheniformis
atgaatcatgaactgctgaacgtccaagagctgaaaacgtattaccgcgtgtcccgcaagaaaatcgtcaaagcggtcgatgatgttacactgtcagtcaaaaaaggcgaaatcgtagggatcgtcggggaatccggctgcggaaaatcaaccttgggaaaatcgatactgcggctgaccgaaccgacttctggaaaggtgacgtttctcgggcgggagatgaccggccttgatgcaaaacagcttcgcaacatgagaaggcatatacaaatgatttttcaagatccgtacgcttcattgaatccgcgcatgaaaataaaagatattttggaggaaccgctgatcgttcataaactcggaacgaaggcggaaaggagagaagtcgttcgctcgatgcttgaaattgtcggtcttgatgcttcatacggcgaccgatatgcacaccaattcagcggcggccagaggcaaaggatcggtattgcaaaagcgctgatcacaaagccgaaattaatcattgccgatgagcctgtttccgcgcttgatgtatccgttcaggcgcagatcttaaatctgctgtctgatctgcaggaggcattcaatttaacgtttctgtttatttcgcatgatctcggggtcgtccgctatatcagcgacagggtagccgtgatgtatttcggaaagattgtcgagatggcggacgccgactctttatttagagaaccgaaacacccctatacagaaacactgttagcggcagtacccgtcatcggcaaaggagaggcggttcatacggcgccggatattgccgcgccccgcatgagtgaaaagggctgtcctttttacagccgatgcatgaagcgggcggacgtctgccttgaagcggagccgcttcttgaagagactgcggacgggcattatgctgcatgccattttaccaataaggaggctgtacgatga

SEQ ID NO: 841 - DNA, 1599 bp, Bacillus licheniformis
atgaaaaagaaaagctggctgatctgtttgggaatgattctgtctgtttccgcttttttaatgggatgctccggtaacgaaagcggaaagaacgacggagggacgaacggcggaaaagatacgctgatcatcggcagaggaggtgattcgacatcgcttgatccgatcacaacgacagaaggcgaagcgtttaaagtgacgatcaatatgtttgagaccttgctgaattacggggaacaagacacaacgctgaaggaaggcctcgcggtgaaatgggacgcttcagatgacggtttgacctacacattggagctgagaaaaggcgtgaaattccatgatggaacggattttaatgcagaagccgtcaaatacaattttgagcggtggatgaacggggatgaagaaaaatttccttactacggcatgttcggaggctataagaaagatgaggggcacgtcatcaaagacataaaagttctcgacgaccataagattcagttcattttaaaacgcccgcaagcgccgtttttaaagaaccttgccatgacttctttcgggattgcaagtcctgccgccattgaaaaatacggcgaaaaattcagggagcaccccgtcggcactggcccttacaaatttgtcgaatggaagccgaacgaccggatcgtccttgagaaaaatgaagactattgggatcaaggcaaaccgaaattgcagaagatcattttcagagccattcctgaaaactcagcccgcttaaatgcattgaagacgggcgaaatcgacctaatggatggcgtcaatccgtctgatatcgaaagcatcaaagcagacgccaatctgaaaatatttgaaaggccttcaatgaacgtcgggtatctcggaatgacaacgacgagaaagccatttgacaataagctggtccgccaggcgctgaaccatgctgtcgataaacaggcgattatcgactccttctacggaggtctcgctgaatctgcaaaaaacccgcttcctccgtcgctcgaagggtacaacgaccaggttaaggaatatccgtatgatttaaaaaaggcaaaagaactcttaaaagaagccggctacccggacgggtttaaaatgaagctttgggcaatgccggtaccgcggccgtatatgccggacggtatgaaaatagccgaagtgattcaatcaagctttgaaaaaatcggagtcaaagcggaaatcgtcacttacgactgggcgacgtacttggataaggtgagcaaaggggaagctgatgcgtttttaatgggctggaccggcgacaacggagatccggacaacttcatttatacgctgcttgataaagataatatcggcggtaacaactatacgtacttcagcaatgatgagcttcatgacatcttaatcgaggcgcagtcagaccctgatcaaaagaaaagaaataaactgtatcaagatgcgcaggagctcctccatgaagaatcgccttgggttccgcttgtccattccacgccgattttggccggttcaaaagatatcgacggatatgttccgcacccgacagggagtgaagtattgtccggcgtagagtttaaatag

SEQ ID NO: 842 - DNA, 1002 bp, Bacillus licheniformis
ttgcttgcgtactgtttaaaacggacggccatgctgatccccgttctcatcggcatgacattggtcgttttttcgatcatccgctttattcccggcaaccccgcccaggttattctcggccagagggcgacaaaggaagcggtgcagcagctgaccgtccagctcggccttgatcagccgtggtatatgcaatatgccagatatataggggatttgctgaaaggggatctcgggacatcaatccgcacgggagcggcgattacgcaagaaataaagccatatttgttcgccactctcgaacttgcctttttcgcgatgctgatcgcagtgtttgtcggcgtgaatgccggaatcatcagcgcgtggtttaagaactcggtattcgactatatcgcgatgctggtggctttaatcggcgtgtcgatgccgattttttggctcggtttgatgggccagtggtttttttcgatcgagctcggctggctgccgacaacaggaagggagaatgtcagaaatccggtcgaagccattacgtacattcatacattggacacccttttgcacggaagatttgatcagtttgcagaagccatccgccatttaattctgccgggaacggctcttgccaccattcccgcagcgatcattgcgagaattacgagagccagcatgatagaggtgctgcagtccgattatatccgcacggcaaaagcaaaaggcgtgcatatgtttttcgtcatctataagcacggtttaaaaaatgcattcattccggtattgaccgtcatcggcctgcaaaccggactgttactgggcggcgcaattttaacagagactatttttgcctggcccggcatcggccggtacatttatgatgcgatcagctaccgcgactacccggttatccaatcgggcatcctcgtgatcgccttcatcttcgtcatgattaacttcatcgttgatctgctgtacgccgtcatcgatccgagaattaaatattag

SEQ ID NO: 843 - DNA, 891 bp, Bacillus licheniformis
atggttgtgcttcaaaatgaacagcagagggaggacgtgaaggtgcgttcgcctttggcggaacatattcggcggttttttgagcataaattggctgccgccggcacgattctagtcgcgctgtttatcctgctagccatcttcgcgccgctcatcgcaccatacggaataaacgaccagtcactgtcagacaggctcgccgctccgtctgcggaacacctttttggcacggatgactttggcagggatattttctctagggtgctttacggcgcaaggctgtctttatgggtcggctttttctcctgtttggcatcggccttggcggggacgctgctagggctgatcgccggtttttacggcagatgggctgatgcattgatttcacggctgtttgatatcatgctcgcgtttccgagcattctgctggcgatcgccattgtagcgattctggggccttctcttgaaaatgccctgattgccatcgccatcatcaacgttccgacgtttggcaggctcgttcgttcaaaagtgctcagcatcaggcaggaggagtatatcttatcagcgcgtgctgtcgggatgtccaatataaggctgatgtttaaacacattctccccaacagcatggccccggttatcgttcaagcgacgctgaatattggaaccgcgattatagaagcggccgcgctcggatttttagggttgggggcgcaggcgccgaaccccgagtggggaaaaatgcttgcggatgccaggccttacttggcgcaggctccatggacattgttttttccgggatttgcgatcatgctgaccgttctcggctttaatctgatgggagacggcctgcgcgacacccttgatccgaaaatgaaggaaggaaaataa

SEQ ID NO: 844 - DNA, 1071 bp, Bacillus licheniformis
atgaaacttggtgcccgtattttcaaaacaggcattgccattacgcttgcgctttacctcgcgtcttggctcggccttccgactcctgtcttcgcgggaatcgcggctatcttcgcgatccagccttcgatctatcgttcatttttgacgattgtcgatcaagtgcaggcgaacattatcggagcagccacagccattatttttggacttatttttgaacccagtccgatcatcatcggattgacggcggtaatcgtcattacgatcaacttgaagctgaagatcgagaacacgatttcgatcgctcttgtcaccgttattgccatactggagagctccggcgacaactttttatggtttgctttggtgagaaccggaacggttattttgggcgtgttgtctgcgttcttggtcaacctgatttttctgccgcctaaatatgaaacgaagctcgtcagccatattgttgaaaatacagatgaagtcattaaatggatcagattgttgacgcggaagacaacggaacattccatgctgaaagaagacattgaaaaactgaaagaaaaaatgatgaaggttgaccacctttacttgctctacaaagaagaaagaagctatttaaaacgttccacatatgtaaaacagcgaaagctcgtgctgttcagacaggcgatcattgcatccaaccgtgcgcttgatgccctgaaaaagctgcaccggcttgaaaacgagttttatcacatgcctgaagaatttcaagaaacgctggtcgaagagctcgattatctcctccattggcacgaacgaattttaatgagattcgtcggcaggatcaaaacgcaggatcacgtcgacctgcacgaagaaggagacgtgtacaaacagcacttgaccgaatcattcctgaaaaaccaggacaaattaaaagaagaactgttggactacaatatgctgaccattatggcgagcactgtagaataccgagaacagcttgagcatttggaaaccttgctctcaagctttcagacgtaccacaaaaaagacagcgagcttgaagttgaggaagaataa

SEQ ID NO: 845 - DNA, 1299 bp, Bacillus licheniformis
atgcagcatactcaatctgaaaagcttcatgaagaagctcttcaacatatagtcggaggcgtcaacagcccctcaaggtcttacaaagcggtcggcggaggttctcccgtcgcgatggaaaggggaagcggcgcttatttttgggatgtggacggcaacaaatacatagactaccttgccgcgtacggaccgattattacgggccacgcccacccgcatatcacgaaagcgattcaaacagctgctgagaacggggtgctttacggtacgccgacaaagcatgaagtgacatttgccaagatgcttaaggaagcgattcctgccttggataaagtgagattcgtcaattcgggaacggaagctgtgatgacgacgattcgcgtcgcccgggcctatacaggcagaacgaaaatcatcaagttcgccggctgctaccacggccattccgatcttgtgctggtggcggccggttcaggaccgtcaacgctcggcacgcctgattccgccggggttccaaaaagcatcgccaacgaggtgattaccgttcctttcaatgatatcgacagctataaagaagcgctcgataaatgggggaacgatattgcggcagtcctcgttgaaccgattgtcggaaacttcgggatcgtcgaaccgaagagcggattcctcgagcaggtcaatgaacttacgcataacgcgggagccctggtcatctacgatgaagtcattaccgctttccgctttatgtacggcggcgcccaggatcttcttggcgtcaaacctgatttgacggcgctcggcaaaatcatcggcggcggcctgccgatcggcgcctacggaggcagaaaagagattatggaacaagtcgcaccgctcggacctgcttatcaagcgggcacgatggcggggaatccggcttccatcctctctggcatcgcctgccttgaagtgctgaaagaaaaaggcacatacgaaaaacttgaccgcctcggcgccatgcttgaagaaggcatcctggcacatgccgagacccacggcatcgacatcactgtcaaccgtctaaaaggcgcgctcaccgtatacttcacgaacgaaaaagtcgaaaactatgagcaagccgaaaatacggacggagacatgttcgcggcctttttcaaactgatgcttgagcgcggaatcaatcttgcgccttcaaaatatgaagcatggtttatcaccaccgcgcacacggaagaggacattaaagatacgctcaaagccgtggatgactcatttaaacaattgaaacagcgcatgtaa

SEQ ID NO: 846 - DNA, 474 bp, Bacillus licheniformis
atgactgttgaaattggacaaaaggtgcctgatattgaactgctgggcgatcacggagaaaaagtaaagctgtcggattttgaaggaaagtatgtcgtgctctatttttacccgaaagatatgacgccgggatgcacaacggaagcgtgcgatttcagagaccgtcatgaaagctttgcggaacttgatgccgtcattatcggagtcagccccgacgatcaggcaaggcatgaaaaattcaagcaaaaacacgatctgccgtttctgctgctcgtcgatgatgaacacaagctcgctgaaagctttgacgtatggaagctgaagaagaatttcggcaaggaatacatgggtgtcgaacggtcgacattcctgattgataaagaaggccgccttgtgaaagagtggcggaaagtaaaggtaaaagaccatgtcgcagaagcgcttcaagcagtaaaagaaatcgcggaagcataa

SEQ ID NO: 847 - DNA, 438 bp, Bacillus licheniformis
atggctgaacataacctgaaagaagcgttggaagcgttgaaggaaaccggggtgcgaattactcctcaacgtcatgccattctggaatttctcgtgaattctatgtctcatccaactgcagatgatatatataaagctctcgaagggaaatttccaaacatgagcgtagcaacggtctacaacaatttgcgggtttttaaggaatcagggctcgttaaggaattaacgtacggagattcctccagccggtttgacttcgtgacttccgagcattatcacgcaatttgcgaacgctgcgggaaaatcgtcgactttcattatcccggcctcgacgaagtggagcagcttgcttcacatgtgacaggatttaaagtcagtcaccatagactggagatatacggtttatgtcaggaatgcgacaaaaaagaaagccattaa

SEQ ID NO: 848 - DNA, 264 bp, Bacillus licheniformis
atggatatggccaaatactctagtaaaatcaacaaaatcagaacgtttgcgttgagccttgtatttataggcttcattattatgtatgtcggggtcttttttaggtcctcggtcctcttgatgtcggtgtttatgatcttgggggtattgtctatcttgttgagcacagcggtttatttttggatcggcatgctttcaacgaaagcggttcaagtcgtctgtccaaactgtgaaaaaccgacccaagattttaggccgggttga

SEQ ID NO: 849 - DNA, 885 bp, Bacillus licheniformis
atggaaaatcttctccgtccgatttaccaagaaagagcaagccgccctgacacactcgctgtcatgctgattgagaggagaaatcaaacttcatctgcaacagataattttgatgcggcattgttgattatcgttaataaggctgaagaccctgtattcgtgaagcattatgagttcgacggaaaaacggcttctcttcatattatttctgttgaacagcttcaggaatggattctgcttggaacaaacaggagaatcatagactgggttctcaatggaaaggtgcttttcgaccgaaacgaatttatcgccaagctgattgagcagctcaatacatttccgttttcagaaagaaaactaaaaatcggacttgaatacgggaaattaatcagaagatatatagaaggaaaatcgttttttgaggacggtcaatttttggatgcctacaattccatcgtacacgccctccaccatttggccagaatcgaagtgatcgataaggggtttcaccctgaagttacggtatggaaccaagtccgccacatggaacctcaggtttataaattgtataaggaattaattgaaagcaatgaaagcttgcaaaaacggctggagttattattcctcgcaagcgattttctcattcattcaaaagccgaaataggggctgcctatattctcaatgtcatggatgaaaaatcggtttggcaatttgccgaacttcttaaacatccggatctcaagtatttcacgacagacctgggagttatactggagttcttggctgaaaaggatttagtcggagtaaagccgatagagacaaagggccaaaagatttttcaccgaggatattttattaaaaaaagtgttgacactaatttataa

SEQ ID NO: 850 - DNA, 1041 bp, Bacillus licheniformis
atgaaagcagcagcctctgtgaacgtagccaatctcatcaatcagtggtatgttcacataaaaaagagagatgtttcaaatgccgtagaacttagggacagaataaaaggccttttaaacgtaatggaagaagatcaggatgttttgctttactttaatctacttgattacaggttcagagtattaatggaagacgtcgcgggggagccgcagcttccgcctattgctgaagataaggcgaagacagacggtttgttacgatactattactttctctttaaaggaatgtatgaaagtgcgaggagcaactactctaaagcgcttaattgttttagagttgccgagcggcagctcgataatgtcgaagatgaaatcgaaaaggccgagtttcattataagcttggaaatctctattattttacgaaaacaactctactttcttttcatcatctttcaatcgcgaagagcatttatagggcttatgaagaatataagacacagtcgataaactgtacggtgctgctcgcactcaattatatagacgacggacgtttaacaagagctgaaaatatgcttaagagttgcgcagaaagactgatcaagatgggcgataatcatctgctggcggctgtctactatgatctcggctttttaaaaattcaagaggataaacatgaagaagcactcgagtatttcgacctctcatttaaaacggatgatatcgaaaaaaatgcgcctattatgtacatgcagtgcatatacgagtcagctaggtcaacttataagataggtgaggttgataaggcgcttaagtgggttcatcttggttttgagtttgctcagaaaacggataatatcaacttttcgctcaaattctcgattctaaatatatgctatagcgctcccatcgagggtgtaccgcaagtaaaagagtttatcgaaatgctcgaggagagagaggcttacgtagacattgaggcgcttgctgaggatgtggccaacgtctacagctcattaaataattacaaatattccacataa

SEQ ID NO: 851 - DNA, 210 bp, Bacillus licheniformis
ttggaacagcaggcctttttactcacgtcagctgtattcgatcaacaccaacatcccctcaaattcattcaaaaagtgatcaatgttgagctaattctcgttgaaatcaacttcctccaccgtcttcccggacttatgaagaaaagcattatttttaaagtgcgggagccgcctgatgagtcaatctatttccaccgcgtcattccatga

SEQ ID NO: 852 - DNA, 177 bp, Bacillus licheniformis
ttgttttcttcagttgtttttgaacaaaagcttttttcaaaggaaagaatgttcattgtcagagcatgtatgtatgtggtttatacgtttgcttggatggtcatttttgtatctttaggtgagacattaaaaaaaagtttaatttggattataacgaaaatttgtctgtacggctga

SEQ ID NO: 853 - DNA, 126 bp, Bacillus licheniformis
atgatcttctgccgaaagtcacggcgggctttaaccatttcctcgcgctgcaagctcgtgattcctaaaaaggatgacgacaagccgaaatcaaaagaggaagagcggttcgggggccggatgtaa

SEQ ID NO: 854 - DNA, 216 bp, Bacillus licheniformis
atgcaagaggtcacctctgaaattctgattgagcgttatgggcttagcgaaaaaatactttccggtgagataaaggcttgtcaaaagcataaatgggctgtgcagcgattttttaaagatgtcgaggtgttagcggacccggattgcccctattattttgatgctgaagcggtgctggatttttacgaatgggcgcggcaggttcagacatgttga

SEQ ID NO: 855 - DNA, 276 bp, Bacillus licheniformis
ttgaacaggtattgcgaaatatctcggcctttgtggtggatcaagcaaccggcaacatcggccccgaaaaagaaagcacgaaaaagcaggagcaaaaaagtacccattccgcccggaatttacaaaagcctaattatgaagggaacggccgtccgacagattcaggaggctttagctgccctctatttctatccggacaaaggcgctaaaaataacggcattgatgtctattacggaacgaagacaaaggcgcagctcgagtcgctattggtttaa

SEQ ID NO: 856 - DNA, 339 bp, Bacillus licheniformis
atggaacctgattctttattcaaaacattattaaaatacaaagatagagaacttatattagaatgggaaaatggattaagagtaattggtaaaactgatacatttttcgaaacagacaacggtctggaggatgatgatatcaattataaagaatattacgcaacggcttttcaagtaaataaggttttatctcctcccgttaataatgaagaagatagtctatataattggctattggaagagaaaaactccctagttgaaatttctctttatgaagatacaccgaataagatcttagtagacggtaacacaatatgggaattagacagtgatgaataa

SEQ ID NO: 857 - DNA, 1725 bp, Bacillus licheniformis
atgaagactcttgatgttcaggcgctgcacaatgcaatagatcaaacgctggaacaattaaaacaacaatcagacgaaatcgccaaagtcaaaaaggctgttgagggcatcacatcacttgatgatgctttaaagggaaaaggcggcgacgcgatccgcgccttttacgaggaatgccacaccccttttctacagttctatgatacttttatagaggaatacagttccgcgctgaagaaaatgaaaagcgcgctgaattccctggaaccaaaccataacggatttatttcacagtcctttctcgggcatgagttggagaatggcttgaatgccgctgatcgcacaacgaaacatttggtttctaaaaccaacgccacgatcgcaaaagtcagccatattgtcgatttaccggatttgaatgacagcggttttcatgaacaaaatcagaaagcgttaaaggaaatcagcacgactcttgaaaagctccatgcgtttgaccgcgggcaaaccaacgccctgaagacggctgaaaacgaccttgagacgatgcagagatacatcgcaaggctcgaaaaaatgtataccggtcccaaaatagaaatcaccagttatcaaaaaggcgcgattttaaagtcggatgataactctacaataaacggactacctggcggacttcagggccaactggagaatgtcgaaccgtctccgatggagatgatgcttgaaaagctcaacaaaaataaacgatctaatgtggatacggtgattagggaagacaataaagaaaatatcaatcaagacgtttatgcgaacgattttgatttgaatgcgttgcaaaacgaagcagaaaaatatccgaaggtttatggagatattcgggtcattgatggtaaactatataatcataaaggatggaaaagggtcaaaacagttgatgtcgccgatgaagtggttcaaaatccggcagacattaaatatatcggtgggcgttaccatgtatatgaaaatggtcaaatcgtaagagagtacattgtaaacggtaaagtagagatggaagctgttaaacgtattccaaaaagtcgaagccaagggaatcttaagcgagattttgaaggaactcctttagaaccagtaaatgatataggggattttgttgcaaaagaaatagcgggcggtaatgatgcggttcgggtcataacaggcagagatccggacacaggtgaaaaagtctctaatgtcgagcgtgctgcgtccggaacttctttaacacctgttggtcggttgctaaagtacgggaaaaaaggatttaagttatttaaaggtgaagaggcgggaaagaaagttgcgaaggtagataaaacaccttcctatggcaaacaatccgtaccaaaaggtccgtaccgtgaagtaaatggtttccctgcaaaagttaaaccaggagctcaagaaaaacatattccaggaacaccaaattataaacaagaagttgcaaatggcagaaccaagagtatcttctacggggataataaaaaagcgcaagagttgcttgataaatatgctggcacaggagatatgttaaaaaaaggaaacaaagaaagagtggattttggtcaagtaataggaaaatactataatacagagacccgtaaatatgaagagactacaagaggcatgatacattatggaaaaaacggcgctcatatagtaccttcacaaccgtcttaa

SEQ ID NO: 858 - DNA, 240 bp, Bacillus licheniformis
atggtattaggagaaatgaaagttgatgctcgttttcttcctgatatctataatcgcattcgtcaaattaaagttaatcatggtttaagctcttggtttgaagtaaagtggacaaaagtttcaatgagtaaaatagacttttatttagatttaattgattatttttttgatactgcagctttaagttttagaagtgttgtagctacaggaaaaaaagaagttagaccacaatacatataa

SEQ ID NO: 859 - DNA, 441 bp, Bacillus licheniformis
atgtgggatcttaaagaacaaattttaactgccgctaagtcagttgacattaaggtaaatgaattatcaacaaatgatacagaaatcatatttcataatttggctaataaatacgcgaatgggaaaaagcattttccgttgtgggagtttgtagagaaagatttttctgtacaaaaccaagatgcttggcaatggatagccgattatattgcagattctgaagcaattctaatgtttaacccttcagatgaaaaatcttcctataaaattgatggggggaataatgtagtaaagatattatctgaaatgtttaatgtcgaattctatgtcactaataaaaacaatgattatttattaagttttaaccatcacgatatactaagtgcatgtggaaatgcaaaagaatggttaaaacagtataacccccagcaacaagattaa

SEQ ID NO: 860 - DNA, 1560 bp, Bacillus licheniformis
atgaagactcttgatgttcaggcgctgcacaatgcaatagatcaaacgctggaacaattaaaacaacaatcagacgaaatcgccaaagtcaaaaaggctgttgagggcatcacatcacttgatgatgctttaaagggaaaaggcggcgacgcgatccgcgccttttacgaggaatgccacaccccttttctacagttctatgatacttttatagaggaatacagttccgcgctgaagaaaatgaaaagcgcgctgaattccctggaaccaaaccataacggatttatttcacagtcctttctcgggcatgagttggagaatggcttgaatgccgctgatcgcacaacgaaacatttggtttctaaaaccaacgccacgatcgcaaaagtcagccatattgtcgatttaccggatttgaatgacagcggttttcatgaacaaaatcagaaagcgttaaaggaaatcagcacgactcttgaaaagctccatgcgtttgaccgcgggcaaaccaacgccctcaaaacggctgaaaacgatcttgagacgatgcagagatacatggcgcggctcgaaaagatgtataccggaccaaaaattgaaataaccggctatcaaaaaggttcgattttaaagccggatgagatggataccttgagtggaaatcaagaaacagcgatgggtgtcatgttgaaaaaagtcggagacaaagaagatgcggacattaacactctcgccgatccagatcgattaaaaaaattggcgacacaagtgtccaaaaaagtgtatactgacgaagaattagaaaacctgagtgaaaaagaattagaaaaactaaaaaaggtttataaatatgtgaatggtcataaatactgttattatttagatggtaaatatgtcgtcggcatacagttggttgacgatcctcctgcagaggataaagaagtaagtgatttagagaaatattcaagaattggcttggagctcttaggtgaaagtgactttgaacgagctgcattgggatatgatcctgatacatacaaaaagctttctctctttgaacggttcgaggccgctgttaatttaacgcctccattgaggattgtcaaatggattcgcaagggagataagctagcaaaagtttcgaaggtggataaaggggctaaaacagctggagatgttggtaagaagaccgctcccgttgcaaccaaagaaaaaaacactaagctgggaagtataacaggatacaagtttaaaaaaggtatagacttggattttagaggaacaggtaagacatataaagatgcattagatgaagcctttaaaagaactggagtacctaaaaaagaatttaaagttacaaaatggggaaaagacgaaaatggaaaatcattccctgttgaatggagatctaaaaatggggcggaagttaatatagatgttggccataccaaaaacggcccggatgttcctcacactggatatcaaaccgctgggaaaagaggtggcggaggagcaattagaggtcatattttagtagactcagtccctataaacagataa

SEQ ID NO: 861 - DNA, 1119 bp, Bacillus licheniformis
ttggagactatcccgtcttcagaagttggaatcaaaataaaccgctggtacaacgaaattcaaaaattaaacgtaatagaagcagaacgattaaaggcggaagttcacttagctatagaaagaatggaagaagatcaggacttgctttcctattatcagcttatgaattttagacatgagttaatgttggaatatcttttcccggcagaaaaaaagctgagcaaatctgattatcttagggaaattgagggacagggaagaaaattgtcaggcttgctcgaatactatttttcctttttcaccggaatgtatcatttttctcgcggaaaatacataaaggcaatcaaggcatatagagcagcagaaaaaaagttgacgaaagtttcagataaaatagaaaaggctgaattctattataagatggcggaagtgttttatcatatgaaacagactcatatgtcaatgtattatgtgtctctcgcttatgatatttataaatcctatgatgcatatgtgattcgaagaattaattgtctattcgttgttgctgggaattacattgatttatcaacccatgatcaagctttaccgcatcttttaagcgctaaggaatccgcggaagacattcaaaacaaggcgatcgttgcaaaggctcttttaaatgtagcatattgttataatgcaatggagagaccaacaaaagctattgaatactttcataaggcgattgatgtagcaaaggaaataaaggcaaaagaactgactcaggcttattatgatttggcattaattcactttcgaaataacgaaaatattgaaggacgaaaattttatgaaaaggcgcttgaaagtgcgcgggtatttgaagatgaattattcctgtgtctgttggatgttttagaggcactgtttataaaatcagctaataagtcagaggtactagaaacaatgaaaccattacgggatagtcgtggttacccctatcttgaggaactggcattagaagcagctctattctatactaggaatgagcggccaaatgattccatatttttttatgatcagatggtgcaggctcagaaacaaatcaaaaggggcgactttctgtatgaaatctaa

SEQ ID NO: 862 - DNA, 1326 bp, Bacillus licheniformis
ttgtcaattcgcattaaactgcctgacgggtccgtcagagaatttgaggaggaagcaagtattgaagatgttgctgcttccattagctgcggtctggaacatgcggttgcaggtaaattaaacggaaagcttgtagatttatcaactccgcttcaggacggtgcactcgttgaaattgtcacccgggactcagcagaaggacagaagatcgtgcgtgaaaaatcgcgggggaaagggcgtattgtggcacttgacgcagcacggggactggcggtcatcgggatgtatttgcagcacttcgccttgaacgaaacgaacggttcgatcgtttccgggaatacgacgcttctatttgtgctttgcggcggaatctcctattcgatcatggccgggcgcatgatggacagaggaatggagccggccgcatttcggacgcggatgcttgcccgcgcggtatttatcgatatgataggatatctgctcatcatgctgaatactccgttcggggtgattttgccggcttatgctgcactttttgtgctggcattggtgctgattcgccgttcgacgcgtgtgctcgttacaacagcagctgttttgcttgcggtgagcccgccgctgatgattctcggagggagcgtcctgtcgggagcaaacttgcttggcgatattgcaggcggcccgatgtcggcgctcgcacttgcacccgctttcgtcgccggtatggcaatcgggcgctttgatctgaccaggatgcgtacggcactttcgctagtaagcagcggcgcagtcatgcttatcgtctctaagttattgggcgttttcgttcttccttggctgagccgttccttcgaagaatggctcgtaagtgttcaaggcaccgccggcgccgagccggatcagtatgcaatctggccgcacaacgtggcaccgccgctttggcacaatcttctttcgatagctccgcacagtgcgtcaactttccagacgatgctggggcttggggctgcctttctggttctaggaatggtatgtctcgtgccgcagaagatttctgcagtgctaaagccgttcgcgggagtcggacgtgtagcgttgacgatgtatgcagctcagtttgttgtcatatgggctcttgaaatctcgggggccaagtatgatatcggggcaattccattcggtgatctgttcgtcgcggccgtggcgacggtgacagggtggctgattgcacggcttcctaccggtccgctcgagacagcgatgcgacgctttgaccgggcattcagcaatttgggacccgtcacgggaccggcgagactgagatag

SEQ ID NO: 863 - DNA, 765 bp, Bacillus licheniformis
ttgaagaaactggtgaaggtcagaggaattacattgggtgaaggccggccaaaaatctgtgtgccgcttgtcggaaaaaaccttgcccaattaaaagaagaagcggcttattttcaaacgcttgatgccgatattgcggagtggcgtgctgatttttatgaagatgtagatgacgttgatcaagtctgcgcggcattggcggaaatccgcggccttttaaaggacactccgctcattttcactttccgcagcgccgccgaaggcggagaaaaagagatcagcacagcgcgatatttttctttaaatgaagcggttgttaaaacagggcttgccgatgtgattgatatcgagctgttcaatgacgaagagcaagtgaaagcgctggtggaaacagcacatggtcatgaagtgtccgtgattatatctaatcatgattttgaaaagacaccagctgcagaagaaattgtttcccgtttgcgaaaagcacaggaattaggggctgatctgcctaaaatcgcggtgatgccggaaaccacggctgatgtcttgcgtctgcttgaagccacttgtacgatgaatgagaagtatgcagatcggccgattattacgatgtcaatggccggcaaaggtatcatcagccgcctggcgggcgaggtattcggttcagcaatgacgttcggtgccgcaaagaaagcttcagcaccggggcagattgcagctggtgagctcaaggaaatccttcatatattgcatcgcaatttataa

SEQ ID NO: 864 - DNA, 1797 bp, Bacillus licheniformis
atgaaacaggaatcagtacagcaaaaaaacatctcgataatgtcaagtttttcagggagccgcaaagtgtatgtcgaagggtcgcgtcctgacattcaagtgccgatgagagaaatttcgttaagtccgacgacgggttcgtttggcgacgaagaaaaccagcctgtccgcgtctacgacacgagcggcccctatacggacgccaatgcggacgttgatattcttaaggggctgaaacctttgcgggcgacctggatcagggagcgcggcgataccgaagaatatgaaggcagagaaataagaccggaggataacggctataaaggcaaagagaaagcgagccacagctatacagggttgaaacgaaaaccgctgcgcgcgaaaaaaggacaaaatgtcactcagctgcattacgcaagaaaggggatcattacgcccgagatggaatttattgcgatcagagagcacgtatctcccgaatttgttcgtgatgaagtggcaagcggacgggcgattattccgtcaaacatcaaccatccggaaagcgaaccgatgattatcggccgcaacttccacgtcaaaatcaatgccaacatcggcaattccgctgtcacctcttcgattgaagaagaagtggaaaaaatgacatgggccatccgctggggcgctgatacgatgatggacttgtccacaggtaaagatattcatacaacgagagaatggatcatccgcaactgtccggtgcctgtgggaacagtcccgatttatcaggcgcttgaaaaagtaaacggcgtcgcggaagatcttacttgggacatttaccgcgatacattgatcgaacaggctgagcaaggcgttgattatttcacgattcacgccggcgtccttctccggtatgtgccgttaacagcaaagcgcgtcaccggaatcgtatcccgcggcggggcgatcatggcgcaatggtgtttggctcatcatgaggaaagctttctgtacacccattttgaagagatatgcgagattatgaaaacatacgatatcgcattttcgctcggagacggtcttcgtcccggctcgattgccgatgcgaatgatgaggcccaatttgccgaattggagacgctcggcgagctgacggaaatcgcctggaagcatgatgttcaagtaatgatcgaaggcccgggacacgtgccgatgcataaaatcaaagagaatgtcgacaagcagatggagatttgcaaagaggcaccgttttacacgctcggtccgctgacgaccgatattgcaccgggctacgaccatattacatcggcgatcggagcggcgatgatcggctggtacggaacggccatgctttgctatgtgacgccgaaggagcatttgggactgccgaacaaagatgatgtccgcgaaggcgtcataacatacaaaatcgcggcccatgcggctgaccttgcaaaagggcaccccggcgcgcaaatccgcgatgacgcgctttcaaaggcgcgctttgaattccgctggcgggatcagttcaacttgtcgctcgatccggaaagagcgctcgaataccatgatgaaacccttccggcggaaggcgccaaaacggcacacttttgttcaatgtgcgggcctaaattttgcagcatgaggatttcccaggatattcgcgactacgccaaggaaaacaaccttgatgaagaaaaggctatccaaaaaggattgaagagaaggcgaaggaatttaaaaaagcaggcggcagcatttacagttaaaagcgggcaatacagcagatga

SEQ ID NO: 865 - DNA, 768 bp, Bacillus licheniformis
atgtctttatcaattcgtgtgaatgaaaaagcatttggaaaaggcagctttaaaacaagcgtgctccaagacgtgaatcttacggtcgaaaacggcgaatttttgactgtcatcggtccgagcgggtgcggaaaaagtacgctcttaaaaatcgctgccggtcttgacggggattatgaaggacgaatcagcatgaacggaagagaaatcaagggcccggggattcagcaaggcttcatctttcaggagcatcggctttttccatggatgacggttgagcaaaatatcgccgcagatttaagcctgaaagaaccagcagtgcgaaaaaaagtcgatgaattgattgaaacggtacggctgaaaggtgcggagaaacagtacccgcgcgagctgtccggcggaatgtcgcagcgggtcgcgattgccagggctttgctcagggagcctgagattttgctgcttgatgaacccttcggtgccttggacgcctttacgagaaagcatctgcaggatgtactgacagacatttggagagaaaagaagatgacgatgatcctcgtgacgcacgatattgacgaatcggtgtatttagccaaccggatcgcaattcttacggcaaagccggggagaatccacaagctgattccggtcgatctgccttttccgcgcagcagaacatcgcccgtttttcaaacaattagacaaaaggtgctgaaagagttcgagacaacggaaacattcagctttcaggaaggttcaggaatttga
